United States Patent 9,782,462 (MODIFIED POLYNUCLEOTIDES FOR THE PRODUCTION OF PROTEINS ASSOCIATED WITH HUMAN DISEASE) - sequence listing, part 49

SEQ ID NO: 92499 - DNA, 519 bp, Artificial Sequence
  Description of Artificial Sequence: Synthetic coding sequence
atgcagagaagactggtgcagcagtggagcgtggccgtgttcctgctgagctacgccgtgcccagctgcggcagaagcgtggagggcctgagcagaagactgaagagagccgtgagcgagcaccagctgctgcacgacaagggcaagagcatccaggacctgagaagaagattcttcctgcaccacctgatcgccgagatccacaccgccgagatcagagccaccagcgaggtgagccccaacagcaagcccagccccaacaccaagaaccaccccgtgagattcggcagcgacgacgagggcagatacctgacccaggagaccaacaaggtggagacctacaaggagcagcccctgaagacccccggcaagaagaagaagggcaagcccggcaagagaaaggagcaggagaagaagaagagaagaaccagaagcgcctggctggacagcggcgtgaccggcagcggcctggagggcgaccacctgagcgacaccagcaccaccagcctggagctgtag

SEQ ID NO: 92500 - DNA, 534 bp, Artificial Sequence; identical to SEQ ID NO: 92494
  Description of Artificial Sequence: Synthetic coding sequence

SEQ ID NO: 92501 - DNA, 891 bp, Artificial Sequence
  Description of Artificial Sequence: Synthetic coding sequence
atggtggccgagaaggagaccctgagcctgaacaagtgccccgacaagatgcccaagagaaccaagctgctggcccagcagcccctgcccgtgcaccagccccacagcctggtgagcgagggcttcaccgtgaaggccatgatgaagaacagcgtggtgagaggcccccccgccgccggcgccttcaaggagagacccaccaagcccaccgccttcagaaagttctacgagagaggcgacttccccatcgccctggagcacgacagcaagggcaacaagatcgcctggaaggtggagatcgagaagctggactaccaccactacctgcccctgttcttcgacggcctgtgcgagatgaccttcccctacgagttcttcgccagacagggcatccacgacatgctggagcacggcggcaacaagatcctgcccgtgctgccccagctgatcatccccatcaagaacgccctgaacctgagaaacagacaggtgatctgcgtgaccctgaaggtgctgcagcacctggtggtgagcgccgagatggtgggcaaggccctggtgccctactacagacagatcctgcccgtgctgaacatcttcaagaacatgaacggcagctacagcctgcccagactggagtgcagcggcgccatcatggccagatgcaacctggaccacctgggcagcagcgacccccccaccagcgccagccaggtggccgagatcatcgtgaacagcggcgacggcatcgactacagccagcagaagagagagaacatcggcgacctgatccaggagaccctggaggccttcgagagatacggcggcgagaacgccttcatcaacatcaagtacgtggtgcccacctacgagagctgcctgctgaactag

SEQ ID NO: 92502 - DNA, 774 bp, Artificial Sequence
  Description of Artificial Sequence: Synthetic coding sequence
atggtggccgagaaggagaccctgagcctgaacaagtgccccgacaagatgcccaagagaaccaagctgctggcccagcagcccctgcccgtgcaccagccccacagcctggtgagcgagggcttcaccgtgaaggccatgatgaagaacagcgtggtgagaggcccccccgccgccggcgccttcaaggagagacccaccaagcccaccgccttcagaaagttctacgagagaggcgacttccccatcgccctggagcacgacagcaagggcaacaagatcgcctggaaggtggagatcgagaagctggactaccaccactacctgcccctgttcttcgacggcctgtgcgagatgaccttcccctacgagttcttcgccagacagggcatccacgacatgctggagcacggcggcaacaagatcctgcccgtgctgccccagctgatcatccccatcaagaacgccctgaacctgagaaacagacaggtgatctgcgtgaccctgaaggtgctgcagcacctggtggtgagcgccgagatggtgggcaaggccctggtgccctactacagacagatcctgcccgtgctgaacatcttcaagaacatgaacgtgaacagcggcgacggcatcgactacagccagcagaagagagagaacatcggcgacctgatccaggagaccctggaggccttcgagagatacggcggcgagaacgccttcatcaacatcaagtacgtggtgcccacctacgagagctgcctgctgaactag

SEQ ID NO: 92503 - DNA, 774 bp, Artificial Sequence; identical to SEQ ID NO: 92502
  Description of Artificial Sequence: Synthetic coding sequence

SEQ ID NO: 92504 - DNA, 825 bp, Artificial Sequence
  Description of Artificial Sequence: Synthetic coding sequence
atgagcggcgagtgccagagcccccactgccccggcaccagcgccgagttcttcttcaagtgcggcgcccaccccaccagcgacaaggagaccagcgtggccctgcacctgatcgccaccaacagcagaaacatcacctgcatcacctgcaccgacgtgagaagccccgtgctggtgttccagtgcaacagcagacacgtgatctgcctggactgcttccacctgtactgcgtgaccagactgaacgacagacagttcgtgcacgacccccagctgggctacagcctgccctgcgtggccggctgccccaacagcctgatcaaggagctgcaccacttcagaatcctgggcgaggagcagtacaacagataccagcagtacggcgccgaggagtgcgtgctgcagatgggcggcgtgctgtgccccagacccggctgcggcgccggcctgctgcccgagcccgaccagagaaaggtgacctgcgagggcggcaacggcctgggctgcggcttcgccttctgcagagagtgcaaggaggcctaccacgagggcgagtgcagcgccgtgttcgaggccagcggcaccaccacccaggcctacagagtggacgagagagccgccgagcaggccagatgggaggccgccagcaaggagaccatcaagaagaccaccaagccctgccccagatgccacgtgcccgtggagaagaacggcggctgcatgcacatgaagtgcccccagccccagtgcagactggagtggtgctggaactgcggctgcgagtggaacagagtgtgcatgggcgaccactggttcgacgtgtag

SEQ ID NO: 92505 - DNA, 1107 bp, Artificial Sequence
  Description of Artificial Sequence: Synthetic coding sequence
atgatcgtgttcgtgagattcaacagcagccacggcttccccgtggaggtggacagcgacaccagcatcttccagctgaaggaggtggtggccaagagacagggcgtgcccgccgaccagctgagagtgatcttcgccggcaaggagctgagaaacgactggaccgtgcagaactgcgacctggaccagcagagcatcgtgcacatcgtgcagagaccctggagaaagggccaggagatgaacgccaccggcggcgacgaccccagaaacgccgccggcggctgcgagagagagccccagagcctgaccagagtggacctgagcagcagcgtgctgcccggcgacagcgtgggcctggccgtgatcctgcacaccgacagcagaaaggacagcccccccgccggcagccccgccggcagaagcatctacaacagcttctacgtgtactgcaagggcccctgccagagagtgcagcccggcaagctgagagtgcagtgcagcacctgcagacaggccaccctgaccctgacccagggccccagctgctgggacgacgtgctgatccccaacagaatgagcggcgagtgccagagcccccactgccccggcaccagcgccgagttcttcttcaagtgcggcgcccaccccaccagcgacaaggagaccagcgtggccctgcacctgatcgccaccaacagcagaaacatcacctgcatcacctgcaccgacgtgagaagccccgtgctggtgttccagtgcaacagcagacacgtgatctgcctggactgcttccacctgtactgcgtgaccagactgaacgacagacagttcgtgcacgacccccagctgggctacagcctgccctgcgtggccggctgccccaacagcctgatcaaggagctgcaccacttcagaatcctgggcgaggagcagtacaacagataccagcagtacggcgccgaggagtgcgtgctgcagatgggcggcgtgctgtgccccagacccggctgcggcgccggcctgctgcccgagcccgaccagagaaaggtgacctgcgagggcggcaacggcctgggctgcggctacggccagagaagaaccaagtag

SEQ ID NO: 92506 - DNA, 825 bp, Artificial Sequence; identical to SEQ ID NO: 92504
  Description of Artificial Sequence: Synthetic coding sequence

SEQ ID NO: 92507 - DNA, 657 bp, Artificial Sequence
  Description of Artificial Sequence: Synthetic coding sequence
atgaacgccaccggcggcgacgaccccagaaacgccgccggcggctgcgagagagagccccagagcctgaccagagtggacctgagcagcagcgtgctgcccggcgacagcgtgggcctggccgtgatcctgcacaccgacagcagaaaggacagcccccccgccggcagccccgccggcagaagcatctacaacagcttctacgtgtactgcaagggcccctgccagagagtgcagcccggcaagctgagagtgcagtgcagcacctgcagacaggccaccctgaccctgacccagggccccagctgctgggacgacgtgctgatccccaacagaatgagcggcgagtgccagagcccccactgccccggcaccagcgccgagttcttcttcaagtgcggcgcccaccccaccagcgacaaggagaccagcgtggccctgcacctgatcgccaccaacagcagaaacatcacctgcatcacctgcaccgacgtgagaagccccgtgctggtgttccagtgcaacagcagacacgtgatctgcctggactgcttccacctgtactgcgtgaccagactgaacgacagacagttcgtgcacgacccccagctgggctacagcctgccctgcgtggtgagcctgctgcccagccagtag

SEQ ID NO: 92508 - DNA, 951 bp, Artificial Sequence
  Description of Artificial Sequence: Synthetic coding sequence
atgatcgtgttcgtgagattcaacagcagccacggcttccccgtggaggtggacagcgacaccagcatcttccagctgaaggaggtggtggccaagagacagggcgtgcccgccgaccagctgagagtgatcttcgccggcaaggagctgagaaacgactggaccgtgcaggagttcttcttcaagtgcggcgcccaccccaccagcgacaaggagaccagcgtggccctgcacctgatcgccaccaacagcagaaacatcacctgcatcacctgcaccgacgtgagaagccccgtgctggtgttccagtgcaacagcagacacgtgatctgcctggactgcttccacctgtactgcgtgaccagactgaacgacagacagttcgtgcacgacccccagctgggctacagcctgccctgcgtggccggctgccccaacagcctgatcaaggagctgcaccacttcagaatcctgggcgaggagcagtacaacagataccagcagtacggcgccgaggagtgcgtgctgcagatgggcggcgtgctgtgccccagacccggctgcggcgccggcctgctgcccgagcccgaccagagaaaggtgacctgcgagggcggcaacggcctgggctgcggcttcgccttctgcagagagtgcaaggaggcctaccacgagggcgagtgcagcgccgtgttcgaggccagcggcaccaccacccaggcctacagagtggacgagagagccgccgagcaggccagatgggaggccgccagcaaggagaccatcaagaagaccaccaagccctgccccagatgccacgtgcccgtggagaagaacggcggctgcatgcacatgaagtgcccccagccccagtgcagactggagtggtgctggaactgcggctgcgagtggaacagagtgtgcatgggcgaccactggttcgacgtgtag

SEQ ID NO: 92509 - DNA, 1314 bp, Artificial Sequence
  Description of Artificial Sequence: Synthetic coding sequence
atgatcgtgttcgtgagattcaacagcagccacggcttccccgtggaggtggacagcgacaccagcatcttccagctgaaggaggtggtggccaagagacagggcgtgcccgccgaccagctgagagtgatcttcgccggcaaggagctgagaaacgactggaccgtgcagaactgcgacctggaccagcagagcatcgtgcacatcgtgcagagaccctggagaaagggccaggagatgaacgccaccggcggcgacgaccccagaaacgccgccggcggctgcgagagagagccccagagcctgaccagagtggacctgagcagcagcgtgctgcccggcgacagcgtgggcctggccgtgatcctgcacaccgacagcagaaaggacagcccccccgccggcagccccgccggcagaagcatctacaacagcttctacgtgtactgcaagggcccctgccagagagtgcagcccggcaagctgagagtgcagtgcagcacctgcagacaggccaccctgaccctgacccaggagttcttcttcaagtgcggcgcccaccccaccagcgacaaggagaccagcgtggccctgcacctgatcgccaccaacagcagaaacatcacctgcatcacctgcaccgacgtgagaagccccgtgctggtgttccagtgcaacagcagacacgtgatctgcctggactgcttccacctgtactgcgtgaccagactgaacgacagacagttcgtgcacgacccccagctgggctacagcctgccctgcgtggccggctgccccaacagcctgatcaaggagctgcaccacttcagaatcctgggcgaggagcagtacaacagataccagcagtacggcgccgaggagtgcgtgctgcagatgggcggcgtgctgtgccccagacccggctgcggcgccggcctgctgcccgagcccgaccagagaaaggtgacctgcgagggcggcaacggcctgggctgcggcttcgccttctgcagagagtgcaaggaggcctaccacgagggcgagtgcagcgccgtgttcgaggccagcggcaccaccacccaggcctacagagtggacgagagagccgccgagcaggccagatgggaggccgccagcaaggagaccatcaagaagaccaccaagccctgccccagatgccacgtgcccgtggagaagaacggcggctgcatgcacatgaagtgcccccagccccagtgcagactggagtggtgctggaactgcggctgcgagtggaacagagtgtgcatgggcgaccactggttcgacgtgtag

SEQ ID NO: 92510 - DNA, 1398 bp, Artificial Sequence
  Description of Artificial Sequence: Synthetic coding sequence
atgatcgtgttcgtgagattcaacagcagccacggcttccccgtggaggtggacagcgacaccagcatcttccagctgaaggaggtggtggccaagagacagggcgtgcccgccgaccagctgagagtgatcttcgccggcaaggagctgagaaacgactggaccgtgcagaactgcgacctggaccagcagagcatcgtgcacatcgtgcagagaccctggagaaagggccaggagatgaacgccaccggcggcgacgaccccagaaacgccgccggcggctgcgagagagagccccagagcctgaccagagtggacctgagcagcagcgtgctgcccggcgacagcgtgggcctggccgtgatcctgcacaccgacagcagaaaggacagcccccccgccggcagccccgccggcagaagcatctacaacagcttctacgtgtactgcaagggcccctgccagagagtgcagcccggcaagctgagagtgcagtgcagcacctgcagacaggccaccctgaccctgacccagggccccagctgctgggacgacgtgctgatccccaacagaatgagcggcgagtgccagagcccccactgccccggcaccagcgccgagttcttcttcaagtgcggcgcccaccccaccagcgacaaggagaccagcgtggccctgcacctgatcgccaccaacagcagaaacatcacctgcatcacctgcaccgacgtgagaagccccgtgctggtgttccagtgcaacagcagacacgtgatctgcctggactgcttccacctgtactgcgtgaccagactgaacgacagacagttcgtgcacgacccccagctgggctacagcctgccctgcgtggccggctgccccaacagcctgatcaaggagctgcaccacttcagaatcctgggcgaggagcagtacaacagataccagcagtacggcgccgaggagtgcgtgctgcagatgggcggcgtgctgtgccccagacccggctgcggcgccggcctgctgcccgagcccgaccagagaaaggtgacctgcgagggcggcaacggcctgggctgcggcttcgccttctgcagagagtgcaaggaggcctaccacgagggcgagtgcagcgccgtgttcgaggccagcggcaccaccacccaggcctacagagtggacgagagagccgccgagcaggccagatgggaggccgccagcaaggagaccatcaagaagaccaccaagccctgccccagatgccacgtgcccgtggagaagaacggcggctgcatgcacatgaagtgcccccagccccagtgcagactggagtggtgctggaactgcggctgcgagtggaacagagtgtgcatgggcgaccactggttcgacgtgtag

SEQ ID NO: 92511 - DNA, 612 bp, Artificial Sequence
  Description of Artificial Sequence: Synthetic coding sequence
atgagcggcgagtgccagagcccccactgccccggcaccagcgccgagttcttcttcaagtgcggcgcccaccccaccagcgacaaggagaccagcgtggccctgcacctgatcgccaccaacagcagaaacatcacctgcatcacctgcaccgacgtgagaagccccgtgctggtgttccagtgcaacagcagacacgtgatctgcctggactgcttccacctgtactgcgtgaccagactgaacgacagacagttcgtgcacgacccccagctgggctacagcctgccctgcgtggccggctgccccaacagcctgatcaaggagctgcaccacttcagaatcctgggcgaggagcagtacaacagataccagcagtacggcgccgaggagtgcgtgctgcagatgggcggcgtgctgtgccccagacccggctgcggcgccggcctgctgcccgagcccgaccagagaaaggtgacctgcgagggcggcaacggcctgggctgcggcttcgccttctgcagagagtgcaaggaggcctaccacgagggcgagtgcagcgccgtgttcgaggccagcggcaccaccacccagcacagcggctgcacctag

SEQ ID NO: 92512 - DNA, 429 bp, Artificial Sequence
  Description of Artificial Sequence: Synthetic coding sequence
agcgtgttcgtgagattcaacagcagccacggcttccccgtggaggtggacagcgacaccagcatcttccagctgaaggaggtggtggccaagagacagggcgtgcccgccgaccagctgagagtgatcttcgccggcaaggagctgagaaacgactggaccgtgcagaactgcgacctggaccagcagagcatcgtgcacatcgtgcagagaccctggagaaagggccaggagatgaacgccaccggcggcgacgaccccagaaacgccgccggcggctgcgagagagagccccagagcctgaccagagtggacctgagcagcagcgtgctgcccggcgacagcgtgggcctggccgtgatcctgcacaccgacagcagaaaggacagcccccccgccggcagccccggcaactgcctgcacggctag

SEQ ID NO: 92513 - DNA, 429 bp, Artificial Sequence
  Description of Artificial Sequence: Synthetic coding sequence
atggccgccgtggtggccgccaccgccctgaagggcagaggcgccagaaacgccagagtgctgagaggcatcctggccggcgccaccgccaacaaggccagccacaacagaaccagagccctgcagagccacagcagccccgagggcaaggaggagcccgagcccctgagccccgagctggagtacatccccagaaagagaggcaagaaccccatgaaggccgtgggcctggcctgggccatcggcttcccctgcggcatcctgctgttcatcctgaccaagagagaggtggacaaggacagagtgaagcagatgaaggccagacagaacatgagactgagcaacaccggcgagtacgagagccagagattcagagccagcagccagagcgcccccagccccgacgtgggcagcggcgtgcagacctag

SEQ ID NO: 92514 - DNA, 1086 bp, Artificial Sequence
  Description of Artificial Sequence: Synthetic coding sequence
atggcctggcagggctggcccgccgcctggcagtgggtggccggctgctggctgctgctggtgctggtgctggtgctgctggtgagccccagaggctgcagagccagaagaggcctgagaggcctgctgatggcccacagccagagactgctgttcagaatcggctacagcctgtacaccagaacctggctgggctacctgttctacagacagcagctgagaagagccagaaacagataccccaagggccacagcaagacccagcccagactgttcaacggcgtgaaggtgctgcccatccccgtgctgagcgacaactacagctacctgatcatcgacacccaggcccagctggccgtggccgtggaccccagcgaccccagagccgtgcaggccagcatcgagaaggagggcgtgaccctggtggccatcctgtgcacccacaagcactgggaccacagcggcggcaacagagacctgagcagaagacacagagactgcagagtgtacggcagcccccaggacggcatcccctacctgacccaccccctgtgccaccaggacgtggtgagcgtgggcagactgcagatcagagccctggccacccccggccacacccagggccacctggtgtacctgctggacggcgagccctacaagggccccagctgcctgttcagcggcgacctgctgttcctgagcggctgcggcagaaccttcgagggcaacgccgagaccatgctgagcagcctggacaccgtgctgggcctgggcgacgacaccctgctgtggcccggccacgagtacgccgaggagaacctgggcttcgccggcgtggtggagcccgagaacctggccagagagagaaagatgcagtgggtgcagagacagagactggagagaaagggcacctgccccagcaccctgggcgaggagagaagctacaaccccttcctgagaacccactgcctggccctgcaggaggccctgggccccggccccggccccaccggcgacgacgactacagcagagcccagctgctggaggagctgagaagactgaaggacatgcacaagagcaagtag

SEQ ID NO: 92515 - DNA, 1158 bp, Artificial Sequence
  Description of Artificial Sequence: Synthetic coding sequence
atggccgccgtggtggccgccaccgccctgaagggcagaggcgccagaaacgccagagtgctgagaggcatcctggccggcgccaccgccaacaaggccagccacaacagaaccagagccctgcagagccacagcagccccgagggcaaggaggagcccgagcccctgagccccgagctggagtacatccccagaaagagaggcaagaaccccatgaaggccgtgggcctggcctggtacagcctgtacaccagaacctggctgggctacctgttctacagacagcagctgagaagagccagaaacagataccccaagggccacagcaagacccagcccagactgttcaacggcgtgaaggtgctgcccatccccgtgctgagcgacaactacagctacctgatcatcgacacccaggcccagctggccgtggccgtggaccccagcgaccccagagccgtgcaggccagcatcgagaaggagggcgtgaccctggtggccatcctgtgcacccacaagcactgggaccacagcggcggcaacagagacctgagcagaagacacagagactgcagagtgtacggcagcccccaggacggcatcccctacctgacccaccccctgtgccaccaggacgtggtgagcgtgggcagactgcagatcagagccctggccacccccggccacacccagggccacctggtgtacctgctggacggcgagccctacaagggccccagctgcctgttcagcggcgacctgctgttcctgagcggctgcggcagaaccttcgagggcaacgccgagaccatgctgagcagcctggacaccgtgctgggcctgggcgacgacaccctgctgtggcccggccacgagtacgccgaggagaacctgggcttcgccggcgtggtggagcccgagaacctggccagagagagaaagatgcagtgggtgcagagacagagactggagagaaagggcacctgccccagcaccctgggcgaggagagaagctacaaccccttcctgagaacccactgcctggccctgcaggaggccctgggccccggccccggccccaccggcgacgacgactacagcagagcccagctgctggaggagctgagaagactgaaggacatgcacaagagcaagtag

SEQ ID NO: 92516 - DNA, 1455 bp, Artificial Sequence
  Description of Artificial Sequence: Synthetic coding sequence
atggccgccggcggcgaccacggcagccccgacagctacagaagccccctggccagcagatacgccagccccgagatgtgcttcgtgttcagcgacagatacaagttcagaacctggagacagctgtggctgtggctggccgaggccgagcagaccctgggcctgcccatcaccgacgagcagatccaggagatgaagagcaacctggagaacatcgacttcaagatggccgccgaggaggagaagagactgagacacgacgtgatggcccacgtgcacaccttcggccactgctgccccaaggccgccggcatcatccacctgggcgccaccagctgctacgtgggcgacaacaccgacctgatcatcctgagaaacgccctggacctgctgctgcccaagctggccagagtgatcagcagactggccgacttcgccaaggagagagccagcctgcccaccctgggcttcacccacttccagcccgcccagctgaccaccgtgggcaagagatgctgcctgtggatccaggacctgtgcatggacctgcagaacctgaagagagtgagagacgacctgagattcagaggcgtgaagggcaccaccggcacccaggccagcttcctgcagctgttcgagggcgacgaccacaaggtggagcagctggacaagatggtgaccgagaaggccggcttcaagagagccttcatcatcaccggccagacctacaccagaaaggtggacatcgaggtgctgagcgtgctggccagcctgggcgccagcgtgcacaagatctgcaccgacatcagactgctggccaacctgaaggagatggaggagcccttcgagaagcagcagatcggcagcagcgccatgccctacaagagaaaccccatgagaagcgagagatgctgcagcctggccagacacctgatgaccctggtgatggaccccctgcagaccgccagcgtgcagtggttcgagagaaccctggacgacagcgccaacagaagaatctgcctggccgaggccttcctgaccgccgacaccatcctgaacaccctgcagaacatcagcgagggcctggtggtgtaccccaaggtgatcgagagaagaatcagacaggagctgcccttcatggccaccgagaacatcatcatggccatggtgaaggccggcggcagcagacaggactgccacgagaagatcagagtgctgagccagcaggccgccagcgtggtgaagcaggagggcggcgacaacgacctgatcgagagaatccaggtggacgcctacttcagccccatccacagccagctggaccacctgctggaccccagcagcttcaccggcagagccagccagcaggtgcagagattcctggaggaggaggtgtaccccctgctgaagccctacgagagcgtgatgaaggtgaaggccgagctgtgcctgtag

SEQ ID NO: 92517 - DNA, 237 bp, Artificial Sequence
  Description of Artificial Sequence: Synthetic coding sequence
atggtgggcctgaagaagaagagcgccgacgacgtgaagaaggtgttccacatgctggacaaggacaagagcggcttcatcgaggaggacgagctgggcttcatcctgaagggcttcagccccgacgccagagacctgagcgccaaggagaccaagatgctgatggccgccggcgacaaggacggcgacggcaagatcggcgtggacgagttcagcaccctggtggccgagagctag

SEQ ID NO: 92518 - DNA, 333 bp, Artificial Sequence
  Description of Artificial Sequence: Synthetic coding sequence
atgagcatgaccgacctgctgaacgccgaggacatcaagaaggccgtgggcgccttcagcgccaccgacagcttcgaccacaagaagttcttccagatggtgggcctgaagaagaagagcgccgacgacgtgaagaaggtgttccacatgctggacaaggacaagagcggcttcatcgaggaggacgagctgggcttcatcctgaagggcttcagccccgacgccagagacctgagcgccaaggagaccaagatgctgatggccgccggcgacaaggacggcgacggcaagatcggcgtggacgagttcagcaccctggtggccgagagctag

SEQ ID NO: 92519 - DNA, 306 bp, Artificial Sequence
  Description of Artificial Sequence: Synthetic coding sequence
atgagcatgaccgacctgctgaacgccgaggacatcaagaaggccgtgggcgccttcagcgccaccgacagcttcgaccacaagaagttcttccagatggtgggcctgaagaagaagagcgccgacgacgtgaagaaggtgttccacatgctggacaaggacaagagcggcttcatcgaggaggacgagctgggcttcatcctgaagggcttcagccccgacgccagagacctgagcgccaaggagaccaagatgctgatggccgccggcgacaaggacggcgacggcaagatcggcgtggactag

SEQ ID NO: 92520 - DNA, 984 bp, Artificial Sequence
  Description of Artificial Sequence: Synthetic coding sequence
atgagcgacctgcaggaggagggcaagaacgccatcaacagccccatgagccccgccctggtggacgtgcaccccgaggacacccagctggaggagaacgaggagagaaccatgatcgaccccaccagcaaggaggaccccaagttcaaggagctggtgaaggtgctgctggactggatcaacgacgtgctggtggaggagagaatcatcgtgaagcagctggaggaggacctgtacgacggccaggtgctgcagaagctgctggagaagctggccggctgcaagctgaacgtggccgaggtgacccagagcgagatcggccagaagcagaagctgcagaccgtgctggaggccgtgcacgacctgctgagacccagaggctgggccctgagatggagcgtggacagcatccacggcaagaacctggtggccatcctgcacctgctggtgagcctggccatgcacttcagagcccccatcagactgcccgagcacgtgaccgtgcaggtggtggtggtgagaaagagagagggcctgctgcacagcagccacatcagcgaggagctgaccaccaccaccgagatgatgatgggcagattcgagagagacgccttcgacaccctgttcgaccacgcccccgacaagctgagcgtggtgaagaagagcctgatcaccttcgtgaacaagcacctgaacaagctgaacctggaggtgaccgagctggagacccagttcgccgacggcgtgtacctggtgctgctgatgggcctgctggaggactacttcgtgcccctgcaccacttctacctgacccccgagagcttcgaccagaaggtgcacaacgtgagcttcgccttcgagctgatgctggacggcggcctgaagaagcccaaggccagacccgaggacgtggtgaacctggacctgaagagcaccctgagagtgctgtacaacctgttcaccaagtacaagaacgtggagtag

SEQ ID NO: 92521 - DNA, 1239 bp, Artificial Sequence
  Description of Artificial Sequence: Synthetic coding sequence
atgctgggcatcatccccctgcccttcggcaagccccagccccagagcagaagaagacccctgagaccccccagcgccagcagcgccagcagacccgccagaggcagcctgagaagagccatggccaccagcccccagaagagccccagcgtgcccaagagccccacccccaagagcccccccagcagaaagaaggacgacagcttcctgggcaagctgggcggcaccctggccagaagaaagaaggccaaggaggtgagcgagctgcaggaggagggcatgaacgccatcaacctgcccctgagccccatccccttcgagctggaccccgaggacaccatgctggaggagaacgaggtgagaaccatggtggaccccaacagcagaagcgaccccaagctgcaggagctgatgaaggtgctgatcgactggatcaacgacgtgctggtgggcgagagaatcatcgtgaaggacctggccgaggacctgtacgacggccaggtgctgcagaagctgttcgagaagctggagagcgagaagctgaacgtggccgaggtgacccagagcgagatcgcccagaagcagaagctgcagaccgtgctggagaagatcaacgagaccctgaagctgccccccagaagcatcaagtggaacgtggacagcgtgcacgccaagagcctggtggccatcctgcacctgctggtggccctgagccagtacttcagagcccccatcagactgcccgaccacgtgagcatccaggtggtggtggtgcagaagagagagggcatcctgcagagcagacagatccaggaggagatcaccggcaacaccgaggccctgagcggcagacacgagagagacgccttcgacaccctgttcgaccacgcccccgacaagctgaacgtggtgaagaagaccctgatcaccttcgtgaacaagcacctgaacaagctgaacctggaggtgaccgagctggagacccagttcgccgacggcgtgtacctggtgctgctgatgggcctgctggagggctacttcgtgcccctgcacagcttcttcctgacccccgacagcttcgagcagaaggtgctgaacgtgagcttcgccttcgagctgatgcaggacggcggcctggagaagcccaagcccagacccgaggacatcgtgaactgcgacctgaagagcaccctgagagtgctgtacaacctgttcaccaagtacagaaacgtggagtag

SEQ ID NO: 92522 - DNA, 873 bp, Artificial Sequence
  Description of Artificial Sequence: Synthetic coding sequence
atgaacgccatcaacctgcccctgagccccatccccttcgagctggaccccgaggacaccatgctggaggagaacgaggtgagaaccatggtggaccccaacagcagaagcgaccccaagctgcaggagctgatgaaggtgctgatcgactggatcaacgacgtgctggtgggcgagagaatcatcgtgaaggacctggccgaggacctgtacgacggccaggtgctgcagaagctgttcgagaagctggagagcgagaagctgaacgtggccgaggtgacccagagcgagatcgcccagaagcagaagctgcagaccgtgctggagaagatcaacgagaccctgaagctgccccccagaagcatcaagtggaacgtggacagcgtgcacgccaagagcctggtggccatcctgcacctgctggtggccctgagccagtacttcagagcccccatcagactgcccgaccacgtgagcatccaggtggtggtggtgcagaagagagagggcatcctgcagagcagacagatccaggaggagatcaccggcaacaccgaggccctgagcggcagacacgagagagacgccttcgacaccctgttcgaccacgcccccgacaagctgaacgtggtgaagaaggtgggcaagggctgcctgggctggaccgagggcagcgagatgcagcagaacatcggcaagacccacccctgcagcctgagagccagctgccagaactggtggcaccacctgaccagcgcccacaccggcctgagccccctgcccagcatgtacctgagcgtgccccactggatgctgcacctgggcctgttccccagcatcagcatgaacagcctgagcagccaccccggctag

SEQ ID NO: 92523 - DNA, 1119 bp, Artificial Sequence
  Description of Artificial Sequence: Synthetic coding sequence
atggccaccagcccccagaagagccccagcgtgcccaagagccccacccccaagagcccccccagcagaaagaaggacgacagcttcctgggcaagctgggcggcaccctggccagaagaaagaaggccaaggaggtgagcgagctgcaggaggagggcatgaacgccatcaacctgcccctgagccccatccccttcgagctggaccccgaggacaccatgctggaggagaacgaggtgagaaccatggtggaccccaacagcagaagcgaccccaagctgcaggagctgatgaaggtgctgatcgactggatcaacgacgtgctggtgggcgagagaatcatcgtgaaggacctggccgaggacctgtacgacggccaggtgctgcagaagctgttcgagaagctggagagcgagaagctgaacgtggccgaggtgacccagagcgagatcgcccagaagcagaagctgcagaccgtgctggagaagatcaacgagaccctgaagctgccccccagaagcatcaagtggaacgtggacagcgtgcacgccaagagcctggtggccatcctgcacctgctggtggccctgagccagtacttcagagcccccatcagactgcccgaccacgtgagcatccaggtggtggtggtgcagaagagagagggcatcctgcagagcagacagatccaggaggagatcaccggcaacaccgagtacgtgagcagcagacacaagagagacgccttcgacaccctgttcgaccacgcccccgacaagctgaacgtggtgaagaagaccctgatcaccttcgtgaacaagcacctgaacaagctgaacctggaggtgaccgagctggagacccagttcgccgacggcgtgtacctggtgctgctgatgggcctgctggagggctacttcgtgcccctgcacagcttcttcctgacccccgacagcttcgagcagaaggtgctgaacgtgagcttcgccttcgagctgatgcaggacggcggcctggagaagcccaagcccagacccgaggacatcgtgaactgcgacctgaagagcaccctgagagtgctgtacaacctgttcaccaagtacagaaacgtggagtag

SEQ ID NO: 92524 - DNA, 1119 bp, Artificial Sequence
  Description of Artificial Sequence: Synthetic coding sequence
atggccaccagcccccagaagagccccagcgtgcccaagagccccacccccaagagcccccccagcagaaagaaggacgacagcttcctgggcaagctgggcggcaccctggccagaagaaagaaggccaaggaggtgagcgagctgcaggaggagggcatgaacgccatcaacctgcccctgagccccatccccttcgagctggaccccgaggacaccatgctggaggagaacgaggtgagaaccatggtggaccccaacagcagaagcgaccccaagctgcaggagctgatgaaggtgctgatcgactggatcaacgacgtgctggtgggcgagagaatcatcgtgaaggacctggccgaggacctgtacgacggccaggtgctgcagaagctgttcgagaagctggagagcgagaagctgaacgtggccgaggtgacccagagcgagatcgcccagaagcagaagctgcagaccgtgctggagaagatcaacgagaccctgaagctgccccccagaagcatcaagtggaacgtggacagcgtgcacgccaagagcctggtggccatcctgcacctgctggtggccctgagccagtacttcagagcccccatcagactgcccgaccacgtgagcatccaggtggtggtggtgcagaagagagagggcatcctgcagagcagacagatccaggaggagatcaccggcaacaccgaggccctgagcggcagacacgagagagacgccttcgacaccctgttcgaccacgcccccgacaagctgaacgtggtgaagaagaccctgatcaccttcgtgaacaagcacctgaacaagctgaacctggaggtgaccgagctggagacccagttcgccgacggcgtgtacctggtgctgctgatgggcctgctggagggctacttcgtgcccctgcacagcttcttcctgacccccgacagcttcgagcagaaggtgctgaacgtgagcttcgccttcgagctgatgcaggacggcggcctggagaagcccaagcccagacccgaggacatcgtgaactgcgacctgaagagcaccctgagagtgctgtacaacctgttcaccaagtacagaaacgtggagtag

SEQ ID NO: 92525 - DNA, 1095 bp, Artificial Sequence
  Description of Artificial Sequence: Synthetic coding sequence
atgagcagcgcccccagaagccccacccccagacccagaagaatgaagaaggacgagagcttcctgggcaagctgggcggcaccctggccagaaagagaagagccagagaggtgagcgacctgcaggaggagggcaagaacgccatcaacagccccatgagccccgccctggtggacgtgcaccccgaggacacccagctggaggagaacgaggagagaaccatgatcgaccccaccagcaaggaggaccccaagttcaaggagctggtgaaggtgctgctggactggatcaacgacgtgctggtggaggagagaatcatcgtgaagcagctggaggaggacctgtacgacggccaggtgctgcagaagctgctggagaagctggccggctgcaagctgaacgtggccgaggtgacccagagcgagatcggccagaagcagaagctgcagaccgtgctggaggccgtgcacgacctgctgagacccagaggctgggccctgagatggagcgtggacagcatccacggcaagaacctggtggccatcctgcacctgctggtgagcctggccatgcacttcagagcccccatcagactgcccgagcacgtgaccgtgcaggtggtggtggtgagaaagagagagggcctgctgcacagcagccacatcagcgaggagctgaccaccaccaccgagatgatgatgggcagattcgagagagacgccttcgacaccctgttcgaccacgcccccgacaagctgagcgtggtgaagaagagcctgatcaccttcgtgaacaagcacctgaacaagctgaacctggaggtgaccgagctggagacccagttcgccgacggcgtgtacctggtgctgctgatgggcctgctggaggactacttcgtgcccctgcaccacttctacctgacccccgagagcttcgaccagaaggtgcacaacgtgagcttcgccttcgagctgatgctggacggcggcctgaagaagcccaaggccagacccgaggacgtggtgaacctggacctgaagagcaccctgagagtgctgtacaacctgttcaccaagtacaagaacgtggagtag

SEQ ID NO: 92526 - DNA, 1194 bp, Artificial Sequence
  Description of Artificial Sequence: Synthetic coding sequence
atgcaccacgtgttcaaggaccaccagagaggcgagaagagaggcttcctgagccccgagaacaagaactgcagaagactggagctgagaagaggctgcagctgcagctggggcctgtgcagccaggccctgatggccagcctggccggcagcctgctgcccggcagcgacagaagcggcgtggagaccagcgagtacgcccagggcggcgtgagcgacctgcaggaggagggcaagaacgccatcaacagccccatgagccccgccctggtggacgtgcaccccgaggacacccagctggaggagaacgaggagagaaccatgatcgaccccaccagcaaggaggaccccaagttcaaggagctggtgaaggtgctgctggactggatcaacgacgtgctggtggaggagagaatcatcgtgaagcagctggaggaggacctgtacgacggccaggtgctgcagaagctgctggagaagctggccggctgcaagctgaacgtggccgaggtgacccagagcgagatcggccagaagcagaagctgcagaccgtgctggaggccgtgcacgacctgctgagacccagaggctgggccctgagatggagcgtggacagcatccacggcaagaacctggtggccatcctgcacctgctggtgagcctggccatgcacttcagagcccccatcagactgcccgagcacgtgaccgtgcaggtggtggtggtgagaaagagagagggcctgctgcacagcagccacatcagcgaggagctgaccaccaccaccgagatgatgatgggcagattcgagagagacgccttcgacaccctgttcgaccacgcccccgacaagctgagcgtggtgaagaagagcctgatcaccttcgtgaacaagcacctgaacaagctgaacctggaggtgaccgagctggagacccagttcgccgacggcgtgtacctggtgctgctgatgggcctgctggaggactacttcgtgcccctgcaccacttctacctgacccccgagagcttcgaccagaaggtgcacaacgtgagcttcgccttcgagctgatgctggacggcggcctgaagaagcccaaggccagacccgaggacgtggtgaacctggacctgaagagcaccctgagagtgctgtacaacctgttcaccaagtacaagaacgtggagtag

SEQ ID NO: 92527 - DNA, 996 bp, Artificial Sequence
  Description of Artificial Sequence: Synthetic coding sequence
atggagcccgagttcctgtacgacctgctgcagctgcccaagggcgtggagccccccgccgaggaggagctgagcaagggcggcaagaagaagtacctgccccccaccagcagaaaggaccccaagttcgaggagctgcagaaggtgctgatggagtggatcaacgccaccctgctgcccgagcacatcgtggtgagaagcctggaggaggacatgttcgacggcctgatcctgcaccacctgttccagagactggccgccctgaagctggaggccgaggacatcgccctgaccgccaccagccagaagcacaagctgaccgtggtgctggaggccgtgaacagaagcctgcagctggaggagtggcaggccaagtggagcgtggagagcatcttcaacaaggacctgctgagcaccctgcacctgctggtggccctggccaagagattccagcccgacctgagcctgcccaccaacgtgcaggtggaggtgatcaccatcgagagcaccaagagcggcctgaagagcgagaagctggtggagcagctgaccgagtacagcaccgacaaggacgagccccccaaggacgtgttcgacgagctgttcaagctggcccccgagaaggtgaacgccgtgaaggaggccatcgtgaacttcgtgaaccagaagctggacagactgggcctgagcgtgcagaacctggacacccagttcgccgacggcgtgatcctgctgctgctgatcggccagctggagggcttcttcctgcacctgaaggagttctacctgacccccaacagccccgccgagatgctgcacaacgtgaccctggccctggagctgctgaaggacgagggcctgctgagctgccccgtgagccccgaggacatcgtgaacaaggacgccaagagcaccctgagagtgctgtacggcctgttctgcaagcacacccagaaggcccacagagacagaaccccccacggcgcccccaactag

SEQ ID NO: 92528 - DNA, 81 bp, Artificial Sequence
  Description of Artificial Sequence: Synthetic coding sequence
atggagcccgagttcctgtacgacctgctgcagctgcccaagggcgtggagccccccgccgaggaggagctgagcaagtag

SEQ ID NO: 92529 - DNA, 93 bp, Artificial Sequence
  Description of Artificial Sequence: Synthetic coding sequence
atggagcccgagttcctgtacgacctgctgcagctgcccaagggcgtggagccccccgccgaggaggagctgagcaagggcgtgtgcccctag

SEQ ID NO: 92530 - DNA, 996 bp, Artificial Sequence; identical to SEQ ID NO: 92527
  Description of Artificial Sequence: Synthetic coding sequence

SEQ ID NO: 92531 - DNA, 996 bp, Artificial Sequence; identical to SEQ ID NO: 92527
  Description of Artificial Sequence: Synthetic coding sequence

SEQ ID NO: 92532 - DNA, 414 bp, Artificial Sequence
  Description of Artificial Sequence: Synthetic coding sequence
atggtgcccgccaaggagcaggtgcccggcagatgcgacagcacccagagatgcttccccggccccagcaactggaccggcgccggcggcagagccggcagccagcccttcgtgggcgacggcaccctgggcacccccaacttctgctgggaccacaaggagaagagagccgccgagagccagctgcaggcctgggaggccatggagcccgagttcctgtacgacctgctgcagctgcccaagggcgtggagccccccgccgaggaggagctgagcaagggcggcaagaagaagtacctgccccccaccagcagaaaggaccccaagttcgaggagctgcagaagcacacctggcccagccccgtgaccggcaccggcgacaccatctgcggcctggccagaaagacctggtag

SEQ ID NO: 92533 - DNA, 1083 bp, Artificial Sequence
  Description of Artificial Sequence: Synthetic coding sequence
atggccgccgagagaggcgccggccagcagcagagccaggagatgatggaggtggacagaagagtggagagcgaggagagcggcgacgaggagggcaagaagcacagcagcggcatcgtggccgacctgagcgagcagagcctgaaggacggcgaggagagaggcgaggaggaccccgaggaggagcacgagctgcccgtggacatggagaccatcaacctggacagagacgccgaggacgtggacctgaaccactacagaatcggcaagatcgagggcttcgaggtgctgaagaaggtgaagaccctgtgcctgagacagaacctgatcaagtgcatcgagaacctggaggagctgcagagcctgagagagctggacctgtacgacaaccagatcaagaagatcgagaacctggaggccctgaccgagctggagatcctggacatcagcttcaacctgctgagaaacatcgagggcgtggacaagctgaccagactgaagaagctgttcctggtgaacaacaagatcagcaagatcgagaacctgagcaacctgcaccagctgcagatgctggagctgggcagcaacagaatcagagccatcgagaacatcgacaccctgaccaacctggagagcctgttcctgggcaagaacaagatcaccaagctgcagaacctggacgccctgaccaacctgaccgtgctgagcatgcagagcaacagactgaccaagatcgagggcctgcagaacctggtgaacctgagagagctgtacctgagccacaacggcatcgaggtgatcgagggcctggagaacaacaacaagctgaccatgctggacatcgccagcaacagaatcaagaagatcgagaacatcagccacctgaccgagctgcaggagttctggatgaacgacaacctgctggagagctggagcgacctggacgagctgaagggcgccagaagcctggagaccgtgtacctggagagaaaccccctgcagaaggacccccagtacagaagaaaggtgatgctggccctgcccagcgtgagacagatcgacgccaccttcgtgagattctag

SEQ ID NO: 92534 - DNA, 3993 bp, Artificial Sequence
  Description of Artificial Sequence: Synthetic coding sequence
atggaggacggcggcctgaccgccttcgaggaggaccagagatgcctgagccagagcctgcccctgcccgtgagcgccgagggccccgccgcccagaccaccgccgagcccagcagaagcttcagcagcgcccacagacacctgagcagaagaaacggcctgagcagactgtgccagagcagaaccgccctgagcgaggacagatggagcagctactgcctgagcagcctggccgcccagaacatctgcaccagcaagctgcactgccccgccgcccccgagcacaccgaccccagcgagcccagaggcagcgtgagctgctgcagcctgctgagaggcctgagcagcggctggagcagccccctgctgcccgcccccgtgtgcaaccccaacaaggccatcttcaccgtggacgccaagaccaccgagatcctggtggccaacgacaaggcctgcggcctgctgggctacagcagccaggacctgatcggccagaagctgacccagttcttcctgagaagcgacagcgacgtggtggaggccctgagcgaggagcacatggaggccgacggccacgccgccgtggtgttcggcaccgtggtggacatcatcagcagaagcggcgagaagatccccgtgagcgtgtggatgaagagaatgagacaggagagaagactgtgctgcgtggtggtgctggagcccgtggagagagtgagcacctgggtggccttccagagcgacggcaccgtgaccagctgcgacagcctgttcgcccacctgcacggctacgtgagcggcgaggacgtggccggccagcacatcaccgacctgatccccagcgtgcagctgccccccagcggccagcacatccccaagaacctgaagatccagagaagcgtgggcagagccagagacggcaccaccttccccctgagcctgaagctgaagagccagcccagcagcgaggaggccaccaccggcgaggccgcccccgtgagcggctacagagccagcgtgtgggtgttctgcaccatcagcggcctgatcaccctgctgcccgacggcaccatccacggcatcaaccacagcttcgccctgaccctgttcggctacggcaagaccgagctgctgggcaagaacatcaccttcctgatccccggcttctacagctacatggacctggcctacaacagcagcctgcagctgcccgacctggccagctgcctggacgtgggcaacgagagcggctgcggcgagagaaccctggacccctggcagggccaggaccccgccgagggcggccaggaccccagaatcaacgtggtgctggccggcggccacgtggtgcccagagacgagatcagaaagctgatggagagccaggacatcttcaccggcacccagaccgagctgatcgccggcggccagctgctgagctgcctgagcccccagcccgcccccggcgtggacaacgtgcccgagggcagcctgcccgtgcacggcgagcaggccctgcccaaggaccagcagatcaccgccctgggcagagaggagcccgtggccatcgagagccccggccaggacctgctgggcgagagcagaagcgagcccgtggacgtgaagcccttcgccagctgcgaggacagcgaggcccccgtgcccgccgaggacggcggcagcgacgccggcatgtgcggcctgtgccagaaggcccagctggagagaatgggcgtgagcggccccagcggcagcgacctgtgggccggcgccgccgtggccaagccccaggccaagggccagctggccggcggcagcctgctgatgcactgcccctgctacggcagcgagtggggcctgtggtggagaagccaggacctggcccccagccccagcggcatggccggcctgagcttcggcacccccaccctggacgagccctggctgggcgtggagaacgacagagaggagctgcagacctgcctgatcaaggagcagctgagccagctgagcctggccggcgccctggacgtgccccacgccgagctggtgcccaccgagtgccaggccgtgaccgcccccgtgagcagctgcgacctgggcggcagagacctgtgcggcggctgcaccggcagcagcagcgcctgctacgccctggccaccgacctgcccggcggcctggaggccgtggaggcccaggaggtggacgtgaacagcttcagctggaacctgaaggagctgttcttcagcgaccagaccgaccagaccagcagcaactgcagctgcgccaccagcgagctgagagagacccccagcagcctggccgtgggcagcgaccccgacgtgggcagcctgcaggagcagggcagctgcgtgctggacgacagagagctgctgctgctgaccggcacctgcgtggacctgggccagggcagaagattcagagagagctgcgtgggccacgaccccaccgagcccctggaggtgtgcctggtgagcagcgagcactacgccgccagcgacagagagagccccggccacgtgcccagcaccctggacgccggccccgaggacacctgccccagcgccgaggagcccagactgaacgtgcaggtgaccagcacccccgtgatcgtgatgagaggcgccgccggcctgcagagagagatccaggagggcgcctacagcggcagctgctaccacagagacggcctgagactgagcatccagttcgaggtgagaagagtggagctgcagggccccacccccctgttctgctgctggctggtgaaggacctgctgcacagccagagagacagcgccgccagaaccagactgttcctggccagcctgcccggcagcacccacagcaccgccgccgagctgaccggccccagcctggtggaggtgctgagagccagaccctggttcgaggagccccccaaggccgtggagctggagggcctggccgcctgcgagggcgagtacagccagaagtacagcaccatgagccccctgggcagcggcgccttcggcttcgtgtggaccgccgtggacaaggagaagaacaaggaggtggtggtgaagttcatcaagaaggagaaggtgctggaggactgctggatcgaggaccccaagctgggcaaggtgaccctggagatcgccatcctgagcagagtggagcacgccaacatcatcaaggtgctggacatcttcgagaaccagggcttcttccagctggtgatggagaagcacggcagcggcctggacctgttcgccttcatcgacagacaccccagactggacgagcccctggccagctacatcttcagacaggtgagagccggccagagcagactggtgagcgccgtgggctacctgagactgaaggacatcatccacagagacatcaaggacgagaacatcgtgatcgccgaggacttcaccatcaagctgatcgacttcggcagcgccgcctacctggagagaggcaagctgttctacaccttctgcggcaccatcgagtactgcgcccccgaggtgctgatgggcaacccctacagaggccccgagctggagatgtggagcctgggcgtgaccctgtacaccctggtgttcgaggagaaccccttctgcgagctggaggagaccgtggaggccgccatccaccccccctacctggtgagcaaggagctgatgagcctggtgagcggcctgctgcagcccgtgcccgagagaagaaccaccctggagaagctggtgaccgacccctgggtgacccagcccgtgaacctggccgactacacctgggaggaggtgttcagagtgaacaagcccgagagcggcgtgctgagcgccgccagcctggagatgggcaacagaagcctgagcgacgtggcccaggcccaggagctgtgcggcggccccgtgcccggcgaggcccccaacggccagggctgcctgcaccccggcgaccccagactgctgaccagctag

SEQ ID NO: 92535 - DNA, 3972 bp, Artificial Sequence
  Description of Artificial Sequence: Synthetic coding sequence
atggaggacggcggcctgaccgccttcgaggaggaccagagatgcctgagccagagcctgcccctgcccgtgagcgccgagggccccgccgcccagaccaccgccgagcccagcagaagcttcagcagcgcccacagacacctgagcagaagaaacggcctgagcagactgtgccagagcagaaccgccctgagcgaggacagatggagcagctactgcctgagcagcctggccgcccagaacatctgcaccagcaagctgcactgccccgccgcccccgagcacaccgaccccagcgagcccagaggcagcgtgagctgctgcagcctgctgagaggcctgagcagcggctggagcagccccctgctgcccgcccccgtgtgcaaccccaacaaggccatcttcaccgtggacgccaagaccaccgagatcctggtggccaacgacaaggcctgcggcctgctgggctacagcagccaggacctgatcggccagaagctgacccagttcttcctgagaagcgacagcgacgtggtggaggccctgagcgaggagcacatggaggccgacggccacgccgccgtggtgttcggcaccgtggtggacatcatcagcagaagcggcgagaagatccccgtgagcgtgtggatgaagagaatgagacaggagagaagactgtgctgcgtggtggtgctggagcccgtggagagagtgagcacctgggtggccttccagagcgacggcaccgtgaccagctgcgacagcctgttcgcccacctgcacggctacgtgagcggcgaggacgtggccggccagcacatcaccgacctgatccccagcgtgcagctgccccccagcggccagcacatccccaagaacctgaagatccagagaagcgtgggcagagccagagacggcaccaccttccccctgagcctgaagctgaagagccagcccagcagcgaggaggccaccaccggcgaggccgcccccgtgagcggctacagagccagcgtgtgggtgttctgcaccatcagcggcctgatcaccctgctgcccgacggcaccatccacggcatcaaccacagcttcgccctgaccctgttcggctacggcaagaccgagctgctgggcaagaacatcaccttcctgatccccggcttctacagctacatggacctggcctacaacagcagcctgcagctgcccgacctggccagctgcctggacgtgggcaacgagagcggctgcggcgagagaaccctggacccctggcagggccaggaccccgccgagggcggccaggaccccagaatcaacgtggtgctggccggcggccacgtggtgcccagagacgagatcagaaagctgatggagagccaggacatcttcaccggcacccagaccgagctgatcgccggcggccagctgctgagctgcctgagcccccagcccgcccccggcgtggacaacgtgcccgagggcagcctgcccgtgcacggcgagcaggccctgcccaaggaccagcagatcaccgccctgggcagagaggagcccgtggccatcgagagccccggccaggacctgctgggcgagagcagaagcgagcccgtggacgtgaagcccttcgccagctgcgaggacagcgaggcccccgtgcccgccgaggacggcggcagcgacgccggcatgtgcggcctgtgccagaaggcccagctggagagaatgggcgtgagcggccccagcggcagcgacctgtgggccggcgccgccgtggccaagccccaggccaagggccagctggccggcggcagcctgctgatgcactgcccctgctacggcagcgagtggggcctgtggtggagaagccaggacctggcccccagccccagcggcatggccggcctgagcttcggcacccccaccctggacgagccctggctgggcgtggagaacgacagagaggagctgcagacctgcctgatcaaggagcagctgagccagctgagcctggccggcgccctggacgtgccccacgccgagctggtgcccaccgagtgccaggccgtgaccgcccccgtgagcagctgcgacctgggcggcagagacctgtgcggcggctgcaccggcagcagcagcgcctgctacgccctggccaccgacctgcccggcggcctggaggccgtggaggcccaggaggtggacgtgaacagcttcagctggaacctgaaggagctgttcttcagcgaccagaccgaccagaccagcagcaactgcagctgcgccaccagcgagctgagagagacccccagcagcctggccgtgggcagcgaccccgacgtgggcagcctgcaggagcagggcagctgcgtgctggacgacagagagctgctgctgctgaccggcacctgcgtggacctgggccagggcagaagattcagagagagctgcgtgggccacgaccccaccgagcccctggaggtgtgcctggtgagcagcgagcactacgccgccagcgacagagagagccccggccacgtgcccagcaccctggacgccggccccgaggacacctgccccagcgccgaggagcccagactgaacgtgcaggtgaccagcacccccgtgatcgtgatgagaggcgccgccggcctgcagagagagatccaggagggcgcctacagcggcagctgctaccacagagacggcctgagactgagcatccagttcgaggtgagaagagtggagctgcagggccccacccccctgttctgctgctggctggtgaaggacctgctgcacagccagagagacagcgccgccagaaccagactgttcctggccagcctgcccggcagcacccacagcaccgccgccgagctgaccggccccagcctggtggaggtgctgagagccagaccctggttcgaggagccccccaaggccgtggagctggagggcctggccgcctgcgagggcgagtacagccagaagtacagcaccatgagccccctgggcagcggcgccttcggcttcgtgtggaccgccgtggacaaggagaagaacaaggaggtggtggtgaagttcatcaagaaggagaaggtgctggaggactgctggatcgaggaccccaagctgggcaaggtgaccctggagatcgccatcctgagcagagtggagcacgccaacatcatcaaggtgctggacatcttcgagaaccagggcttcttccagctggtgatggagaagcacggcagcggcctggacctgttcgccttcatcgacagacaccccagactggacgagcccctggccagctacatcttcagacagctggtgagcgccgtgggctacctgagactgaaggacatcatccacagagacatcaaggacgagaacatcgtgatcgccgaggacttcaccatcaagctgatcgacttcggcagcgccgcctacctggagagaggcaagctgttctacaccttctgcggcaccatcgagtactgcgcccccgaggtgctgatgggcaacccctacagaggccccgagctggagatgtggagcctgggcgtgaccctgtacaccctggtgttcgaggagaaccccttctgcgagctggaggagaccgtggaggccgccatccaccccccctacctggtgagcaaggagctgatgagcctggtgagcggcctgctgcagcccgtgcccgagagaagaaccaccctggagaagctggtgaccgacccctgggtgacccagcccgtgaacctggccgactacacctgggaggaggtgttcagagtgaacaagcccgagagcggcgtgctgagcgccgccagcctggagatgggcaacagaagcctgagcgacgtggcccaggcccaggagctgtgcggcggccccgtgcccggcgaggcccccaacggccagggctgcctgcaccccggcgaccccagactgctgaccagctag

SEQ ID NO: 92536 - DNA, 378 bp, Artificial Sequence
  Description of Artificial Sequence: Synthetic coding sequence
atggaggacggcggcctgaccgccttcgaggaggaccagagatgcctgagccagagcctgcccctgcccgtgagcgccgagggccccgccgcccagaccaccgccgagcccagcagaagcttcagcagcgcccacagacacctgagcagaagaaacggcctgagcagactgtgccagagcagaaccgccctgagcgaggacagatggagcagctactgcctgagcagcctggccgcccagaacatctgcaccagcaagctgcactgccccgccgcccccgagcacaccgaccccagcgagcccagaggcagcgtgagctgctgcagcctgctgagaggcctgagcagcggctggagcagccccctgctgcccgcctag

SEQ ID NO: 92537 - DNA, 3324 bp, Artificial Sequence
  Description of Artificial Sequence: Synthetic coding sequence
atgaagagaatgagacaggagagaagactgtgctgcgtggtggtgctggagcccgtggagagagtgagcacctgggtggccttccagagcgacggcaccgtgaccagctgcgacagcctgttcgcccacctgcacggctacgtgagcggcgaggacgtggccggccagcacatcaccgacctgatccccagcgtgcagctgccccccagcggccagcacatccccaagaacctgaagatccagagaagcgtgggcagagccagagacggcaccaccttccccctgagcctgaagctgaagagccagcccagcagcgaggaggccaccaccggcgaggccgcccccgtgagcggctacagagccagcgtgtgggtgttctgcaccatcagcggcctgatcaccctgctgcccgacggcaccatccacggcatcaaccacagcttcgccctgaccctgttcggctacggcaagaccgagctgctgggcaagaacatcaccttcctgatccccggcttctacagctacatggacctggcctacaacagcagcctgcagctgcccgacctggccagctgcctggacgtgggcaacgagagcggctgcggcgagagaaccctggacccctggcagggccaggaccccgccgagggcggccaggaccccagaatcaacgtggtgctggccggcggccacgtggtgcccagagacgagatcagaaagctgatggagagccaggacatcttcaccggcacccagaccgagctgatcgccggcggccagctgctgagctgcctgagcccccagcccgcccccggcgtggacaacgtgcccgagggcagcctgcccgtgcacggcgagcaggccctgcccaaggaccagcagatcaccgccctgggcagagaggagcccgtggccatcgagagccccggccaggacctgctgggcgagagcagaagcgagcccgtggacgtgaagcccttcgccagctgcgaggacagcgaggcccccgtgcccgccgaggacggcggcagcgacgccggcatgtgcggcctgtgccagaaggcccagctggagagaatgggcgtgagcggccccagcggcagcgacctgtgggccggcgccgccgtggccaagccccaggccaagggccagctggccggcggcagcctgctgatgcactgcccctgctacggcagcgagtggggcctgtggtggagaagccaggacctggcccccagccccagcggcatggccggcctgagcttcggcacccccaccctggacgagccctggctgggcgtggagaacgacagagaggagctgcagacctgcctgatcaaggagcagctgagccagctgagcctggccggcgccctggacgtgccccacgccgagctggtgcccaccgagtgccaggccgtgaccgcccccgtgagcagctgcgacctgggcggcagagacctgtgcggcggctgcaccggcagcagcagcgcctgctacgccctggccaccgacctgcccggcggcctggaggccgtggaggcccaggaggtggacgtgaacagcttcagctggaacctgaaggagctgttcttcagcgaccagaccgaccagaccagcagcaactgcagctgcgccaccagcgagctgagagagacccccagcagcctggccgtgggcagcgaccccgacgtgggcagcctgcaggagcagggcagctgcgtgctggacgacagagagctgctgctgctgaccggcacctgcgtggacctgggccagggcagaagattcagagagagctgcgtgggccacgaccccaccgagcccctggaggtgtgcctggtgagcagcgagcactacgccgccagcgacagagagagccccggccacgtgcccagcaccctggacgccggccccgaggacacctgccccagcgccgaggagcccagactgaacgtgcaggtgaccagcacccccgtgatcgtgatgagaggcgccgccggcctgcagagagagatccaggagggcgcctacagcggcagctgctaccacagagacggcctgagactgagcatccagttcgaggtgagaagagtggagctgcagggccccacccccctgttctgctgctggctggtgaaggacctgctgcacagccagagagacagcgccgccagaaccagactgttcctggccagcctgcccggcagcacccacagcaccgccgccgagctgaccggccccagcctggtggaggtgctgagagccagaccctggttcgaggagccccccaaggccgtggagctggagggcctggccgcctgcgagggcgagtacagccagaagtacagcaccatgagccccctgggcagcggcgccttcggcttcgtgtggaccgccgtggacaaggagaagaacaaggaggtggtggtgaagttcatcaagaaggagaaggtgctggaggactgctggatcgaggaccccaagctgggcaaggtgaccctggagatcgccatcctgagcagagtggagcacgccaacatcatcaaggtgctggacatcttcgagaaccagggcttcttccagctggtgatggagaagcacggcagcggcctggacctgttcgccttcatcgacagacaccccagactggacgagcccctggccagctacatcttcagacagctggtgagcgccgtgggctacctgagactgaaggacatcatccacagagacatcaaggacgagaacatcgtgatcgccgaggacttcaccatcaagctgatcgacttcggcagcgccgcctacctggagagaggcaagctgttctacaccttctgcggcaccatcgagtactgcgcccccgaggtgctgatgggcaacccctacagaggccccgagctggagatgtggagcctgggcgtgaccctgtacaccctggtgttcgaggagaaccccttctgcgagctggaggagaccgtggaggccgccatccaccccccctacctggtgagcaaggagctgatgagcctggtgagcggcctgctgcagcccgtgcccgagagaagaaccaccctggagaagctggtgaccgacccctgggtgacccagcccgtgaacctggccgactacacctgggaggaggtgttcagagtgaacaagcccgagagcggcgtgctgagcgccgccagcctggagatgggcaacagaagcctgagcgacgtggcccaggcccaggagctgtgcggcggccccgtgcccggcgaggcccccaacggccagggctgcctgcaccccggcgaccccagactgctgaccagctag

SEQ ID NO: 92538 - DNA, 3414 bp, Artificial Sequence
  Description of Artificial Sequence: Synthetic coding sequence
atgggcttccccgacagcgccagagccggccagagaagcctggtggacatcatcagcagaagcggcgagaagatccccgtgagcgtgtggatgaagagaatgagacaggagagaagactgtgctgcgtggtggtgctggagcccgtggagagagtgagcacctgggtggccttccagagcgacggcaccgtgaccagctgcgacagcctgttcgcccacctgcacggctacgtgagcggcgaggacgtggccggccagcacatcaccgacctgatccccagcgtgcagctgccccccagcggccagcacatccccaagaacctgaagatccagagaagcgtgggcagagccagagacggcaccaccttccccctgagcctgaagctgaagagccagcccagcagcgaggaggccaccaccggcgaggccgcccccgtgagcggctacagagccagcgtgtgggtgttctgcaccatcagcggcctgatcaccctgctgcccgacggcaccatccacggcatcaaccacagcttcgccctgaccctgttcggctacggcaagaccgagctgctgggcaagaacatcaccttcctgatccccggcttctacagctacatggacctggcctacaacagcagcctgcagctgcccgacctggccagctgcctggacgtgggcaacgagagcggctgcggcgagagaaccctggacccctggcagggccaggaccccgccgagggcggccaggaccccagaatcaacgtggtgctggccggcggccacgtggtgcccagagacgagatcagaaagctgatggagagccaggacatcttcaccggcacccagaccgagctgatcgccggcggccagctgctgagctgcctgagcccccagcccgcccccggcgtggacaacgtgcccgagggcagcctgcccgtgcacggcgagcaggccctgcccaaggaccagcagatcaccgccctgggcagagaggagcccgtggccatcgagagccccggccaggacctgctgggcgagagcagaagcgagcccgtggacgtgaagcccttcgccagctgcgaggacagcgaggcccccgtgcccgccgaggacggcggcagcgacgccggcatgtgcggcctgtgccagaaggcccagctggagagaatgggcgtgagcggccccagcggcagcgacctgtgggccggcgccgccgtggccaagccccaggccaagggccagctggccggcggcagcctgctgatgcactgcccctgctacggcagcgagtggggcctgtggtggagaagccaggacctggcccccagccccagcggcatggccggcctgagcttcggcacccccaccctggacgagccctggctgggcgtggagaacgacagagaggagctgcagacctgcctgatcaaggagcagctgagccagctgagcctggccggcgccctggacgtgccccacgccgagctggtgcccaccgagtgccaggccgtgaccgcccccgtgagcagctgcgacctgggcggcagagacctgtgcggcggctgcaccggcagcagcagcgcctgctacgccctggccaccgacctgcccggcggcctggaggccgtggaggcccaggaggtggacgtgaacagcttcagctggaacctgaaggagctgttcttcagcgaccagaccgaccagaccagcagcaactgcagctgcgccaccagcgagctgagagagacccccagcagcctggccgtgggcagcgaccccgacgtgggcagcctgcaggagcagggcagctgcgtgctggacgacagagagctgctgctgctgaccggcacctgcgtggacctgggccagggcagaagattcagagagagctgcgtgggccacgaccccaccgagcccctggaggtgtgcctggtgagcagcgagcactacgccgccagcgacagagagagccccggccacgtgcccagcaccctggacgccggccccgaggacacctgccccagcgccgaggagcccagactgaacgtgcaggtgaccagcacccccgtgatcgtgatgagaggcgccgccggcctgcagagagagatccaggagggcgcctacagcggcagctgctaccacagagacggcctgagactgagcatccagttcgaggtgagaagagtggagctgcagggccccacccccctgttctgctgctggctggtgaaggacctgctgcacagccagagagacagcgccgccagaaccagactgttcctggccagcctgcccggcagcacccacagcaccgccgccgagctgaccggccccagcctggtggaggtgctgagagccagaccctggttcgaggagccccccaaggccgtggagctggagggcctggccgcctgcgagggcgagtacagccagaagtacagcaccatgagccccctgggcagcggcgccttcggcttcgtgtggaccgccgtggacaaggagaagaacaaggaggtggtggtgaagttcatcaagaaggagaaggtgctggaggactgctggatcgaggaccccaagctgggcaaggtgaccctggagatcgccatcctgagcagagtggagcacgccaacatcatcaaggtgctggacatcttcgagaaccagggcttcttccagctggtgatggagaagcacggcagcggcctggacctgttcgccttcatcgacagacaccccagactggacgagcccctggccagctacatcttcagacagctggtgagcgccgtgggctacctgagactgaaggacatcatccacagagacatcaaggacgagaacatcgtgatcgccgaggacttcaccatcaagctgatcgacttcggcagcgccgcctacctggagagaggcaagctgttctacaccttctgcggcaccatcgagtactgcgcccccgaggtgctgatgggcaacccctacagaggccccgagctggagatgtggagcctgggcgtgaccctgtacaccctggtgttcgaggagaaccccttctgcgagctggaggagaccgtggaggccgccatccaccccccctacctggtgagcaaggagctgatgagcctggtgagcggcctgctgcagcccgtgcccgagagaagaaccaccctggagaagctggtgaccgacccctgggtgacccagcccgtgaacctggccgactacacctgggaggaggtgttcagagtgaacaagcccgagagcggcgtgctgagcgccgccagcctggagatgggcaacagaagcctgagcgacgtggcccaggcccaggagctgtgcggcggccccgtgcccggcgaggcccccaacggccagggctgcctgcaccccggcgaccccagactgctgaccagctag

SEQ ID NO: 92539 - DNA, 3432 bp, Artificial Sequence
  Description of Artificial Sequence: Synthetic coding sequence
atggaggacggcggcctgaccgccttcgaggaggaccagagatgcctgagccagagcctgcccctgcccgtgagcgccgagggccccgccgcccagaccaccgccgagcccagcagaagcttcagcagcgcccacagacacctgagcagaagaaacggcctgagcagactgtgccagagcagaaccgccctgagcgaggacagatggagcagctactgcctgagcagcctggccgcccagaacatctgcaccagcaagctgcactgccccgccgcccccgagcacaccgaccccagcgagcccagaggcagcgtgagctgctgcagcctgctgagaggcctgagcagcggctggagcagccccctgctgcccgcccccgtgtgcaaccccaacaaggccatcttcaccgtggacgccaagaccaccgagatcctggtggccaacgacaaggcctgcggcctgctgggctacagcagccaggacctgatcggccagaagctgacccagttcttcctgagaagcgacagcgacgtggtggaggccctgagcgaggagcacatggaggccgacggccacgccgccgtggtgttcggcaccgtggtggacatcatcagcagaagcggcgagaagatccccgtgagcgtgtggatgaagagaatgagacaggagagaagactgtgctgcgtggtggtgctggagcccgtggagagagtgagcacctgggtggccttccagagcgacggcaccgtgaccagctgcgacagcctgttcgcccacctgcacggctacgtgagcggcgaggacgtggccggccagcacatcaccgacctgatccccagcgtgcagctgccccccagcggccagcacatccccaagaacctgaagatccagagaagcgtgggcagagccagagacggcaccaccttccccctgagcctgaagctgaagagccagcccagcagcgaggaggccaccaccggcgaggccgcccccgtgagcggctacagagccagcgtgtgggtgttctgcaccatcagcggcctgatcaccctgctgcccgacggcaccatccacggcatcaaccacagcttcgccctgaccctgttcggctacggcaagaccgagctgctgggcaagaacatcaccttcctgatccccggcttctacagctacatggacctggcctacaacagcagcctgcagctgcccgacctggccagctgcctggacgtgggcaacgagagcggctgcggcgagagaaccctggacccctggcagggccaggaccccgccgagggcggccaggaccccagaatcaacgtggtgctggccggcggccacgtggtgcccagagacgagatcagaaagctgatggagagccaggacatcttcaccggcacccagaccgagctgatcgccggcggccagctgctgagctgcctgagcccccagcccgcccccggcgtggacaacgtgcccgagggcagcctgcccgtgcacggcgagcaggccctgcccaaggaccagcagatcaccgccctgggcagagaggagcccgtggccatcgagagccccggccaggacctgctgggcgagagcagaagcgagcccgtggacgtgaagcccttcgccagctgcgaggacagcgaggcccccgtgcccgccgaggacggcggcagcgacgccggcatgtgcggcctgtgccagaaggcccagctggagagaatgggcgtgagcggccccagcggcagcgacctgtgggccggcgccgccgtggccaagccccaggccaagggccagctggccggcggcagcctgctgatgcactgcccctgctacggcagcgagtggggcctgtggtggagaagccaggacctggcccccagccccagcggcatggccggcctgagcttcggcacccccaccctggacgagccctggctgggcgtggagaacgacagagaggagctgcagacctgcctgatcaaggagcagctgagccagctgagcctggccggcgccctggacgtgccccacgccgagctggtgcccaccgagtgccaggccgtgaccgcccccgtgagcagctgcgacctgggcggcagagacctgtgcggcggctgcaccggcagcagcagcgcctgctacgccctggccaccgacctgcccggcggcctggaggccgtggaggcccaggaggtggacgtgaacagcttcagctggaacctgaaggagctgttcttcagcgaccagaccgaccagaccagcagcaactgcagctgcgccaccagcgagctgagagagacccccagcagcctggccgtgggcagcgaccccgacgtgggcagcctgcaggagcagggcagctgcgtgctggacgacagagagctgctgctgctgaccggcacctgcgtggacctgggccagggcagaagattcagagagagctgcgtgggccacgaccccaccgagcccctggaggtgtgcctggtgagcagcgagcactacgccgccagcgacagagagagccccggccacgtgcccagcaccctggacgccggccccgaggacacctgccccagcgccgaggagcccagactgaacgtgcaggtgaccagcacccccgtgatcgtgatgagaggcgccgccggcctgcagagagagatccaggagggcgcctacagcggcagctgctaccacagagacggcctgagactgagcatccagttcgaggtgagaagagtggagctgcagggccccacccccctgttctgctgctggctggtgaaggacctgctgcacagccagagagacagcgccgccagaaccagactgttcctggccagcctgcccggcagcacccacagcaccgccgccgagctgaccggccccagcctggtggaggtgctgagagccagaccctggttcgaggagccccccaaggccgtggagctggagggcctggccgcctgcgagggcgagtacagccagaagtacagcaccatgagccccctgggcagcggcgccttcggcttcgtgtggaccgccgtggacaaggagaagaacaaggaggtggtggtgaagttcatcaagaaggagaaggtgctggaggactgctggatcgaggaccccaagctgggcaaggtgaccctggagatcgccatcctgagcagagtggagcacgccaacatcatcaaggtgctggacatcttcgagaaccagggcttcttccagctggtgatggagaagcacggcagcggcctggacctgttcgccttcatcgacagacaccccagactggacgagcccctggccagctacatcttcagacaggtgagagccggccagagcagagtgagcgtgaacgccggcctgggcgcctgggtgagatggctgcagagaagcgtgatccacaccagattcagcctgtag

SEQ ID NO: 92540 - DNA, 1314 bp, Artificial Sequence
  Description of Artificial Sequence: Synthetic coding sequence
atggtgcagatgatgagacagttcctgtacagagtgctgcccgaggacagctacaaggtgaccaccggcaagctgcacgtgagcctgaccagactgaccgacggcgagaacgtggtggtgagcgagttcaccagcaaggaggagctgatcgaggccctgtactgcagctgcttcgtgcccgtgtactgcggcctgatcccccccacctacagaggcgtgagatacatcgacggcggcttcaccggcatgcagccctgcgccttctggaccgacgccatcaccatcagcaccttcagcggccagcaggacatctgccccagagactgccccgccatcttccacgacttcagaatgttcaactgcagcttccagttcagcctggagaacatcgccagaatgacccacgccctgttcccccccgacctggtgatcctgcacgactactactacagaggctacgaggacgccgtgctgtacctgagaagactgaacgccgtgtacctgaacagcagcagcaagagagtgatcttccccagagtggaggtgtactgccagatcgagctggccctgggcaacgagtgccccgagagaagccagcccagcctgagagccagacaggccagcctggagggcgccacccagccccacaaggagtgggtgcccaagggcgacggcagaggcagccacggcccccccgtgagccagcccgtgcagaccctggagttcacctgcgagagccccgtgagcgcccccgtgagccccctggagcagccccccgcccagcccctggccagcagcacccccctgagcctgagcggcatgccccccgtgagcttccccgccgtgcacaagccccccagcagcacccccggcagcagcctgcccacccccccccccggcctgagccccctgagcccccagcagcaggtgcagcccagcggcagccccgccagaagcctgcacagccaggcccccaccagccccagacccagcctgggccccagcaccgtgggcgccccccagaccctgcccagaagcagcctgagcgccttccccgcccagccccccgtggaggagctgggccaggagcagccccaggccgtggccctgctggtgagcagcaagcccaagagcgccgtgcccctggtgcacgtgaaggagaccgtgagcaagccctacgtgaccgagagccccgccgaggacagcaactgggtgaacaaggtgttcaagaagaacaagcagaagaccagcggcaccagaaagggcttccccagacacagcggcagcaagaagcccagcagcaaggtgcagtag

SEQ ID NO: 92541 - DNA, 1599 bp, Artificial Sequence
  Description of Artificial Sequence: Synthetic coding sequence
atggaggagcaggtgttcaagggcgaccccgacaccccccacagcatcagcttcagcggcagcggcttcctgagcttctaccaggccggcgccgtggacgccctgagagacctggcccccagaatgctggagaccgcccacagattcgccggcaccagcgccggcgccgtgatcgccgccctggccatctgcggcatcgagatggacgagtacctgagagtgctgaacgtgggcgtggccgaggtgaagaagagcttcctgggccccctgagccccagctgcaagatggtgcagatgatgagacagttcctgtacagagtgctgcccgaggacagctacaaggtgaccaccggcaagctgcacgtgagcctgaccagactgaccgacggcgagaacgtggtggtgagcgagttcaccagcaaggaggagctgatcgaggccctgtactgcagctgcttcgtgcccgtgtactgcggcctgatcccccccacctacagaggcgtgagatacatcgacggcggcttcaccggcatgcagccctgcgccttctggaccgacgccatcaccatcagcaccttcagcggccagcaggacatctgccccagagactgccccgccatcttccacgacttcagaatgttcaactgcagcttccagttcagcctggagaacatcgccagaatgacccacgccctgttcccccccgacctggtgatcctgcacgactactactacagaggctacgaggacgccgtgctgtacctgagaagactgaacgccgtgtacctgaacagcagcagcaagagagtgatcttccccagagtggaggtgtactgccagatcgagctggccctgggcaacgagtgccccgagagaagccagcccagcctgagagccagacaggccagcctggagggcgccacccagccccacaaggagtgggtgcccaagggcgacggcagaggcagccacggcccccccgtgagccagcccgtgcagaccctggagttcacctgcgagagccccgtgagcgcccccgtgagccccctggagcagccccccgcccagcccctggccagcagcacccccctgagcctgagcggcatgccccccgtgagcttccccgccgtgcacaagccccccagcagcacccccggcagcagcctgcccacccccccccccggcctgagccccctgagcccccagcagcaggtgcagcccagcggcagccccgccagaagcctgcacagccaggcccccaccagccccagacccagcctgggccccagcaccgtgggcgccccccagaccctgcccagaagcagcctgagcgccttccccgcccagccccccgtggaggagctgggccaggagcagccccaggccgtggccctgctggtgagcagcaagcccaagagcgccgtgcccctggtgcacgtgaaggagaccgtgagcaagccctacgtgaccgagagccccgccgaggacagcaactgggtgaacaaggtgttcaagaagaacaagcagaagaccagcggcaccagaaagggcttccccagacacagcggcagcaagaagcccagcagcaaggtgcagtag

SEQ ID NO: 92542 - DNA, 1602 bp, Artificial Sequence
  Description of Artificial Sequence: Synthetic coding sequence
atggaggagcaggtgttcaagggcgaccccgacaccccccacagcatcagcttcagcggcagcggcttcctgagcttctaccaggccggcgccgtggacgccctgagagacctggcccccagaatgctggagaccgcccacagattcgccggcaccagcgccggcgccgtgatcgccgccctggccatctgcggcatcgagatggacgagtacctgagagtgctgaacgtgggcgtggccgaggtgaagaagagcttcctgggccccctgagccccagctgcaagatggtgcagatgatgagacagttcctgtacagagtgctgcccgaggacagctacaaggtgaccaccggcaagctgcacgtgagcctgaccagactgaccgacggcgagaacgtggtggtgagcgagttcaccagcaaggaggagctgatcgaggccgccctgtactgcagctgcttcgtgcccgtgtactgcggcctgatcccccccacctacagaggcgtgagatacatcgacggcggcttcaccggcatgcagccctgcgccttctggaccgacgccatcaccatcagcaccttcagcggccagcaggacatctgccccagagactgccccgccatcttccacgacttcagaatgttcaactgcagcttccagttcagcctggagaacatcgccagaatgacccacgccctgttcccccccgacctggtgatcctgcacgactactactacagaggctacgaggacgccgtgctgtacctgagaagactgaacgccgtgtacctgaacagcagcagcaagagagtgatcttccccagagtggaggtgtactgccagatcgagctggccctgggcaacgagtgccccgagagaagccagcccagcctgagagccagacaggccagcctggagggcgccacccagccccacaaggagtgggtgcccaagggcgacggcagaggcagccacggcccccccgtgagccagcccgtgcagaccctggagttcacctgcgagagccccgtgagcgcccccgtgagccccctggagcagccccccgcccagcccctggccagcagcacccccctgagcctgagcggcatgccccccgtgagcttccccgccgtgcacaagccccccagcagcacccccggcagcagcctgcccacccccccccccggcctgagccccctgagcccccagcagcaggtgcagcccagcggcagccccgccagaagcctgcacagccaggcccccaccagccccagacccagcctgggccccagcaccgtgggcgccccccagaccctgcccagaagcagcctgagcgccttccccgcccagccccccgtggaggagctgggccaggagcagccccaggccgtggccctgctggtgagcagcaagcccaagagcgccgtgcccctggtgcacgtgaaggagaccgtgagcaagccctacgtgaccgagagccccgccgaggacagcaactgggtgaacaaggtgttcaagaagaacaagcagaagaccagcggcaccagaaagggcttccccagacacagcggcagcaagaagcccagcagcaaggtgcagtag

SEQ ID NO: 92543 - DNA, 1341 bp, Artificial Sequence
  Description of Artificial Sequence: Synthetic coding sequence
atggtgcagatgatgagacagttcctgtacagagtgctgcccgaggacagctacaaggtgaccaccggcaagctgcacgtgagcctgaccagactgaccgacggcgagaacgtggtggtgagcgagttcaccagcaaggaggagctgatcgaggccctgtactgcagctgcttcgtgcccgtgtactgcggcctgatcccccccacctacagaggcgtgtgggccttcctgaccctgcccccccagagatacatcgacggcggcttcaccggcatgcagccctgcgccttctggaccgacgccatcaccatcagcaccttcagcggccagcaggacatctgccccagagactgccccgccatcttccacgacttcagaatgttcaactgcagcttccagttcagcctggagaacatcgccagaatgacccacgccctgttcccccccgacctggtgatcctgcacgactactactacagaggctacgaggacgccgtgctgtacctgagaagactgaacgccgtgtacctgaacagcagcagcaagagagtgatcttccccagagtggaggtgtactgccagatcgagctggccctgggcaacgagtgccccgagagaagccagcccagcctgagagccagacaggccagcctggagggcgccacccagccccacaaggagtgggtgcccaagggcgacggcagaggcagccacggcccccccgtgagccagcccgtgcagaccctggagttcacctgcgagagccccgtgagcgcccccgtgagccccctggagcagccccccgcccagcccctggccagcagcacccccctgagcctgagcggcatgccccccgtgagcttccccgccgtgcacaagccccccagcagcacccccggcagcagcctgcccacccccccccccggcctgagccccctgagcccccagcagcaggtgcagcccagcggcagccccgccagaagcctgcacagccaggcccccaccagccccagacccagcctgggccccagcaccgtgggcgccccccagaccctgcccagaagcagcctgagcgccttccccgcccagccccccgtggaggagctgggccaggagcagccccaggccgtggccctgctggtgagcagcaagcccaagagcgccgtgcccctggtgcacgtgaaggagaccgtgagcaagccctacgtgaccgagagccccgccgaggacagcaactgggtgaacaaggtgttcaagaagaacaagcagaagaccagcggcaccagaaagggcttccccagacacagcggcagcaagaagcccagcagcaaggtgcagtag

SEQ ID NO: 92544 - DNA, 1515 bp, Artificial Sequence
  Description of Artificial Sequence: Synthetic coding sequence
atgttccccagagagaagacctggaacatcagcttcgccggctgcggcttcctgggcgtgtactacgtgggcgtggccagctgcctgagagagcacgcccccttcctggtggccaacgccacccacatctacggcgccagcgccggcgccctgaccgccaccgccctggtgaccggcgtgtgcctgggcgaggccggcgccaagttcatcgaggtgagcaaggaggccagaaagagattcctgggccccctgcaccccagcttcaacctggtgaagatcatcagaagcttcctgctgaaggtgctgcccgccgacagccacgagcacgccagcggcagactgggcatcagcctgaccagagtgagcgacggcgagaacgtgatcatcagccacttcaacagcaaggacgagctgatccaggccaacgtgtgcagcggcttcatccccgtgtactgcggcctgatcccccccagcctgcagggcgtgagatacgtggacggcggcatcagcgacaacctgcccctgtacgagctgaagaacaccatcaccgtgagccccttcagcggcgagagcgacatctgcccccaggacagcagcaccaacatccacgagctgagagtgaccaacaccagcatccagttcaacctgagaaacctgtacagactgagcaaggccctgttcccccccgagcccctggtgctgagagagatgtgcaagcagggctacagagacggcctgagattcctgcagagaaacggcctgctgaacagacccaaccccctgctggccctgccccccgccagaccccacggccccgaggacaaggaccaggccgtggagagcgcccaggccgaggactacagccagctgcccggcgaggaccacatcctggagcacctgcccgccagactgaacgaggccctgctggaggcctgcgtggagcccaccgacctgctgaccaccctgagcaacatgctgcccgtgagactggccaccgccatgatggtgccctacaccctgcccctggagagcgccctgagcttcaccatcagactgctggagtggctgcccgacgtgcccgaggacatcagatggatgaaggagcagaccggcagcatctgccagtacctggtgatgagagccaagagaaagctgggcagacacctgcccagcagactgcccgagcaggtggagctgagaagagtgcagagcctgcccagcgtgcccctgagctgcgccgcctacagagaggccctgcccggctggatgagaaacaacctgagcctgggcgacgccctggccaagtgggaggagtgccagagacagctgctgctgggcctgttctgcaccaacgtggccttcccccccgaggccctgagaatgagagcccccgccgaccccgcccccgcccccgccgaccccgccagcccccagcaccagctggccggccccgcccccctgctgagcacccccgcccccgaggccagacccgtgatcggcgccctgggcctgtag

SEQ ID NO: 92545 - DNA, 1290 bp, Artificial Sequence
  Description of Artificial Sequence: Synthetic coding sequence
atgggcttcctggaggaggagggcagatggaacctgagcttcagcggcgccggctacctgggcgcccaccacgtgggcgccaccgagtgcctgagacagagagcccccagactgctgcagggcgccagaagaatctacggcagcagcagcggcgccctgaacgccgtgagcatcgtgtgcggcaagagcgtggacttctgctgcagccacctgctgggcatggtgggccagctggagagactgagcctgagcatcctgcaccccgcctacgcccccatcgagcacgtgaagcagcagctgcaggacgccctgccccccgacgcccacgtgctggccagccagagactgggcatcagcctgaccagatggcccgacggcagaaacttcctggtgaccgacttcgccacctgcgacgagctgatccaggccctggtgtgcaccctgtacttccccttctactgcggcctgatcccccccgagttcagaggcgagagatacatcgacggcgccctgagcaacaacctgcccttcgccgactgccccagcaccatcaccgtgagccccttccacggcaccgtggacatctgcccccagagcaccagccccaacctgcacgagctgaacgtgttcaacttcagcttccagatcagcaccgagaacttcttcctgggcctgatctgcctgatcccccccagcctggaggtggtggccgacaactgcagacagggctacctggacgccctgagattcctggagagaagaggcctgaccaaggagcccgtgctgtggaccctggtgagcaaggagccccccgcccccgccgacggcaactgggacgccggctgcgaccagagatggaagggcggcctgagcctgaactggaaggtgccccacgtgcaggtgaaggacgtgcccaacttcgagcagctgagccccgagctggaggccgccctgaagaaggcctgcaccagagaccccagcagatgggccagattctggcacagcggccccggccaggtgctgacctacctgctgctgccctgcaccctgcccttcgagtacatctacttcagaagcagaagactggtggtgtggctgcccgacgtgcccgccgacctgtggtggatgcagggcctgctgagaaacatggccctggaggtgttcagcagaaccaaggcccagctgctgggccccatcagcccccccgccaccagagtgctggagaccagccccctgcagccccagatcgccccccacagagaggagctgggccccacccaccaggcctag

SEQ ID NO: 92546 - DNA, 1515 bp, Artificial Sequence
  Description of Artificial Sequence: Synthetic coding sequence
atggccgcccagagaagaagcctgctgcagagcgagcagcagcccagctggaccgacgacctgcccctgtgccacctgagcggcgtgggcagcgccagcaacagaagctacagcgccgacggcaagggcaccgagagccacccccccgaggacagctggctgaagttcagaagcgagaacaactgcttcctgtacggcgtgttcaacggctacgacggcaacagagtgaccaacttcgtggcccagagactgagcgccgagctgctgctgggccagctgaacgccgagcacgccgaggccgacgtgagaagagtgctgctgcaggccttcgacgtggtggagagaagcttcctggagagcatcgacgacgccctggccgagaaggccagcctgcagagccagctgcccgagggcgtgccccagcaccagctgcccccccagtaccagaagatcctggagagactgaagaccctggagagagagatcagcggcggcgccatggccgtggtggccgtgctgctgaacaacaagctgtacgtggccaacgtgggcaccaacagagccctgctgtgcaagagcaccgtggacggcctgcaggtgacccagctgaacgtggaccacaccaccgagaacgaggacgagctgttcagactgagccagctgggcctggacgccggcaagatcaagcaggtgggcatcatctgcggccaggagagcaccagaagaatcggcgactacaaggtgaagtacggctacaccgacatcgacctgctgagcgccgccaagagcaagcccatcatcgccgagcccgagatccacggcgcccagcccctggacggcgtgaccggcttcctggtgctgatgagcgagggcctgtacaaggccctggaggccgcccacggccccggccaggccaaccaggagatcgccgccatgatcgacaccgagttcgccaagcagaccagcctggacgccgtggcccaggccgtggtggacagagtgaagagaatccacagcgacaccttcgccagcggcggcgagagagccagattctgccccagacacgaggacatgaccctgctggtgagaaacttcggctaccccctgggcgagatgagccagcccacccccagccccgcccccgccgccggcggcagagtgtaccccgtgagcgtgccctacagcagcgcccagagcaccagcaagaccagcgtgaccctgagcctggtgatgcccagccagggccagatggtgaacggcgcccacagcgccagcaccctggacgaggccacccccaccctgaccaaccagagccccaccctgaccctgcagagcaccaacacccacacccagagcagcagcagcagcagcgacggcggcctgttcagaagcagacccgcccacagcctgccccccggcgaggacggcagagtggagccctacgtggacttcgccgagttctacagactgtggagcgtggaccacggcgagcagagcgtggtgaccgccccctag

SEQ ID NO: 92547 - DNA, 948 bp, Artificial Sequence
  Description of Artificial Sequence: Synthetic coding sequence
atgggcttcctggaggaggagggcagatggaacctgagcttcagcggcgccggctacctgggcgcccaccacgtgggcgccaccgagtgcctgagacagagagcccccagactgctgcagggcgccagaagaatctacggcagcagcagcggcgccctgaacgccgtgagcatcgtgtgcggcaagagcgtggactgccccagcaccatcaccgtgagccccttccacggcaccgtggacatctgcccccagagcaccagccccaacctgcacgagctgaacgtgttcaacttcagcttccagatcagcaccgagaacttcttcctgggcctgatctgcctgatcccccccagcctggaggtggtggccgacaactgcagacagggctacctggacgccctgagattcctggagagaagaggcctgaccaaggagcccgtgctgtggaccctggtgagcaaggagccccccgcccccgccgacggcaactgggacgccggctgcgaccagagatggaagggcggcctgagcctgaactggaaggtgccccacgtgcaggtgaaggacgtgcccaacttcgagcagctgagccccgagctggaggccgccctgaagaaggcctgcaccagagaccccagcagatgggccagattctggcacagcggccccggccaggtgctgacctacctgctgctgccctgcaccctgcccttcgagtacatctacttcagaagcagaagactggtggtgtggctgcccgacgtgcccgccgacctgtggtggatgcagggcctgctgagaaacatggccctggaggtgttcagcagaaccaaggcccagctgctgggccccatcagcccccccgccaccagagtgctggagaccagccccctgcagccccagatcgccccccacagagaggagctgggccccacccaccaggcctag

SEQ ID NO: 92548 - DNA, 807 bp, Artificial Sequence
  Description of Artificial Sequence: Synthetic coding sequence
atgggcttcctggaggaggagggcagatggaacctgagcttcagcggcgccggctacctgggcgcccaccacgtgggcgccaccgagtgcctgagacagagagcccccagactgctgcagggcgccagaagaatctacggcagcagcagcggcgccctgaacgccgtgagcatcgtgtgcggcaagagcgtggacttctgctgcagccacctgctgggcatggtgggccagctggagagactgagcctgagcatcctgcaccccgcctacgcccccatcgagcacgtgaagcagcagctgcaggacgccctgccccccgacgcccacgtgctggccagccagagactgggcatcagcctgaccagatggcccgacggcagaaacttcctggtgaccgacttcgccacctgcgacgagctgatccaggtggtggccgacaactgcagacagggctacctggacgccctgagattcctggagagaagaggcctgaccaaggagcccgtgctgtggaccctggtgagcaaggagccccccgcccccgccgacggcaactgggacgccggctgcgaccagagatggaagggcggcctgagcctgaactggaaggtgccccacgtgcaggtgaaggacgtgcccaacttcgagcagctgagccccgagctggaggccgccctgaagaaggcctgcaccagagaccccagcagatgggccagattctggcacagcggccccggccaggtgctgacctacctgctgctgccctgcaccctgcccttcgagtacatctacttcagaagcagatag

SEQ ID NO: 92549 - DNA, 948 bp, Artificial Sequence; identical to SEQ ID NO: 92547
  Description of Artificial Sequence: Synthetic coding sequence

SEQ ID NO: 92550 - DNA, 708 bp, Artificial Sequence
  Description of Artificial Sequence: Synthetic coding sequence
atggaggaggagacccacaccgacgccaagatcagagccgagaacggcaccggcagcagccccagaggccccggctgcagcctgagacacttcgcctgcgagcagaacctgctgagcagacccgacggcagcgccagcttcctgcagggcgacaccagcgtgctggccggcgtgtacggccccgccgaggtgaaggtgagcaaggagatcttcaacaaggccaccctggaggtgatcctgagacccaagatcggcctgcccggcgtggccgagaagagcagagagagactgatcagaaacacctgcgaggccgtggtgctgggcaccctgcaccccagaaccagcatcaccgtggtgctgcaggtggtgagcgacgccggcagcctgctggcctgctgcctgaacgccgcctgcatggccctggtggacgccggcgtgcccatgagagccctgttctgcggcgtggcctgcgccctggacagcgacggcaccctggtgctggaccccaccagcaagcaggagaaggaggccagagccgtgctgaccttcgccctggacagcgtggagagaaagctgctgatgagcagcaccaagggcctgtacagcgacaccgagctgcagcagtgcctggccgccgcccaggccgccagccagcacgtgttcagattctacagagagagcctgcagagaagatacagcaagagctag

SEQ ID NO: 92551 - DNA, 4128 bp, Artificial Sequence
  Description of Artificial Sequence: Synthetic coding sequence
atggaggcccccctgcagaccggcatgatgggcaccagcagccacggcctggccaccaacagcagcggcgccaaggtggccgagagagacggcttccaggacgtgctggcccccggcgagggcagcgccggcagaatctgcggcgcccagcccgtgcccttcgtgccccaggtgctgggcgtgatgatcggcgccggcgtggccgtggtggtgaccgccgtgctgatcctgctggtggtgagaagactgagagtgcccaagacccccgcccccgacggccccagatacagattcagaaagagagacaaggtgctgttctacggcagaaagatcatgagaaaggtgagccagagcaccagcagcctggtggacaccagcgtgagcgccaccagcagacccagaatgagaaagaagctgaagatgctgaacatcgccaagaagatcctgagaatccagaaggagacccccaccctgcagagaaaggagcccccccccgccgtgctggaggccgacctgaccgagggcgacctggccaacagccacctgcccagcgaggtgctgtacatgctgaagaacgtgagagtgctgggccacttcgagaagcccctgttcctggagctgtgcagacacatggtgttccagagactgggccagggcgactacgtgttcagacccggccagcccgacgccagcatctacgtggtgcaggacggcctgctggagctgtgcctgcccggccccgacggcaaggagtgcgtggtgaaggaggtggtgcccggcgacagcgtgaacagcctgctgagcatcctggacgtgatcaccggccaccagcacccccagagaaccgtgagcgccagagccgccagagacagcaccgtgctgagactgcccgtggaggccttcagcgccgtgttcaccaagtaccccgagagcctggtgagagtggtgcagatcatcatggtgagactgcagagagtgaccttcctggccctgcacaactacctgggcctgaccaacgagctgttcagccacgagatccagcccctgagactgttccccagccccggcctgcccaccagaaccagccccgtgagaggcagcaagagaatggtgagcaccagcgccaccgacgagcccagagagacccccggcagaccccccgaccccaccggcgcccccctgcccggccccaccggcgaccccgtgaagcccaccagcctggagacccccagcgcccccctgctgagcagatgcgtgagcatgcccggcgacatcagcggcctgcagggcggccccagaagcgacttcgacatggcctacgagagaggcagaatcagcgtgagcctgcaggaggaggccagcggcggcagcctggccgcccccgccagaacccccacccaggagcccagagagcagcccgccggcgcctgcgagtacagctactgcgaggacgagagcgccaccggcggctgccccttcggcccctaccagggcagacagaccagcagcatcttcgaggccgccaagcaggagctggccaagctgatgagaatcgaggaccccagcctgctgaacagcagagtgctgctgcaccacgccaaggccggcaccatcatcgccagacagggcgaccaggacgtgagcctgcacttcgtgctgtggggctgcctgcacgtgtaccagagaatgatcgacaaggccgaggacgtgtgcctgttcgtggcccagcccggcgagctggtgggccagctggccgtgctgaccggcgagcccctgatcttcaccctgagagcccagagagactgcaccttcctgagaatcagcaagagcgacttctacgagatcatgagagcccagcccagcgtggtgctgagcgccgcccacaccgtggccgccagaatgagccccttcgtgagacagatggacttcgccatcgactggaccgccgtggaggccggcagagccctgtacagacagggcgacagaagcgactgcacctacatcgtgctgaacggcagactgagaagcgtgatccagagaggcagcggcaagaaggagctggtgggcgagtacggcagaggcgacctgatcggcgtggtggaggccctgaccagacagcccagagccaccaccgtgcacgccgtgagagacaccgagctggccaagctgcccgagggcaccctgggccacatcaagagaagatacccccaggtggtgaccagactgatccacctgctgagccagaagatcctgggcaacctgcagcagctgcagggccccttccccgccggcagcggcctgggcgtgcccccccacagcgagctgaccaaccccgccagcaacctggccaccgtggccatcctgcccgtgtgcgccgaggtgcccatggtggccttcaccctggagctgcagcacgccctgcaggccatcggccccaccctgctgctgaacagcgacatcatcagagccagactgggcgccagcgccctggacagcatccaggagttcagactgagcggctggctggcccagcaggaggacgcccacagaatcgtgctgtaccagaccgacgccagcctgaccccctggaccgtgagatgcctgagacaggccgactgcatcctgatcgtgggcctgggcgaccaggagcccaccctgggccagctggagcagatgctggagaacaccgccgtgagagccctgaagcagctggtgctgctgcacagagaggagggcgccggccccaccagaaccgtggagtggctgaacatgagaagctggtgcagcggccacctgcacctgagatgccccagaagactgttcagcagaagaagccccgccaagctgcacgagctgtacgagaaggtgttcagcagaagagccgacagacacagcgacttcagcagactggccagagtgctgaccggcaacaccatcgccctggtgctgggcggcggcggcgccagaggctgcagccacatcggcgtgctgaaggccctggaggaggccggcgtgcccgtggacctggtgggcggcaccagcatcggcagcttcatcggcgccctgtacgccgaggagagaagcgccagcagaaccaagcagagagccagagagtgggccaagagcatgaccagcgtgctggagcccgtgctggacctgacctaccccgtgaccagcatgttcaccggcagcgccttcaacagaagcatccacagagtgttccaggacaagcagatcgaggacctgtggctgccctacttcaacgtgaccaccgacatcaccgccagcgccatgagagtgcacaaggacggcagcctgtggagatacgtgagagccagcatgaccctgagcggctacctgccccccctgtgcgaccccaaggacggccacctgctgatggacggcggctacatcaacaacctgcccgccgacatcgccagaagcatgggcgccaagaccgtgatcgccatcgacgtgggcagccaggacgagaccgacctgagcacctacggcgacagcctgagcggctggtggctgctgtggaagagactgaacccctgggccgacaaggtgaaggtgcccgacatggccgagatccagagcagactggcctacgtgagctgcgtgagacagctggaggtggtgaagagcagcagctactgcgagtacctgagaccccccatcgactgcttcaagaccatggacttcggcaagttcgaccagatctacgacgtgggctaccagtacggcaaggccgtgttcggcggctggagcagaggcaacgtgatcgagaagatgctgaccgacagaagaagcaccgacctgaacgagagcagaagagccgacgtgctggccttccccagcagcggcttcaccgacctggccgagatcgtgagcagaatcgagccccccaccagctacgtgagcgacggctgcgccgacggcgaggagagcgactgcctgaccgagtacgaggaggacgccggccccgactgcagcagagacgagggcggcagccccgagggcgccagccccagcaccgccagcgagatggaggaggagaagagcatcctgagacagagaagatgcctgccccaggagccccccggcagcgccaccgacgcctag

SEQ ID NO: 92552 - DNA, 3984 bp, Artificial Sequence
  Description of Artificial Sequence: Synthetic coding sequence
atggaggcccccctgcagaccggcatggtgctgggcgtgatgatcggcgccggcgtggccgtggtggtgaccgccgtgctgatcctgctggtggtgagaagactgagagtgcccaagacccccgcccccgacggccccagatacagattcagaaagagagacaaggtgctgttctacggcagaaagatcatgagaaaggtgagccagagcaccagcagcctggtggacaccagcgtgagcgccaccagcagacccagaatgagaaagaagctgaagatgctgaacatcgccaagaagatcctgagaatccagaaggagacccccaccctgcagagaaaggagcccccccccgccgtgctggaggccgacctgaccgagggcgacctggccaacagccacctgcccagcgaggtgctgtacatgctgaagaacgtgagagtgctgggccacttcgagaagcccctgttcctggagctgtgcagacacatggtgttccagagactgggccagggcgactacgtgttcagacccggccagcccgacgccagcatctacgtggtgcaggacggcctgctggagctgtgcctgcccggccccgacggcaaggagtgcgtggtgaaggaggtggtgcccggcgacagcgtgaacagcctgctgagcatcctggacgtgatcaccggccaccagcacccccagagaaccgtgagcgccagagccgccagagacagcaccgtgctgagactgcccgtggaggccttcagcgccgtgttcaccaagtaccccgagagcctggtgagagtggtgcagatcatcatggtgagactgcagagagtgaccttcctggccctgcacaactacctgggcctgaccaacgagctgttcagccacgagatccagcccctgagactgttccccagccccggcctgcccaccagaaccagccccgtgagaggcagcaagagaatggtgagcaccagcgccaccgacgagcccagagagacccccggcagaccccccgaccccaccggcgcccccctgcccggccccaccggcgaccccgtgaagcccaccagcctggagacccccagcgcccccctgctgagcagatgcgtgagcatgcccggcgacatcagcggcctgcagggcggccccagaagcgacttcgacatggcctacgagagaggcagaatcagcgtgagcctgcaggaggaggccagcggcggcagcctggccgcccccgccagaacccccacccaggagcccagagagcagcccgccggcgcctgcgagtacagctactgcgaggacgagagcgccaccggcggctgccccttcggcccctaccagggcagacagaccagcagcatcttcgaggccgccaagcaggagctggccaagctgatgagaatcgaggaccccagcctgctgaacagcagagtgctgctgcaccacgccaaggccggcaccatcatcgccagacagggcgaccaggacgtgagcctgcacttcgtgctgtggggctgcctgcacgtgtaccagagaatgatcgacaaggccgaggacgtgtgcctgttcgtggcccagcccggcgagctggtgggccagctggccgtgctgaccggcgagcccctgatcttcaccctgagagcccagagagactgcaccttcctgagaatcagcaagagcgacttctacgagatcatgagagcccagcccagcgtggtgctgagcgccgcccacaccgtggccgccagaatgagccccttcgtgagacagatggacttcgccatcgactggaccgccgtggaggccggcagagccctgtacagacagggcgacagaagcgactgcacctacatcgtgctgaacggcagactgagaagcgtgatccagagaggcagcggcaagaaggagctggtgggcgagtacggcagaggcgacctgatcggcgtggtggaggccctgaccagacagcccagagccaccaccgtgcacgccgtgagagacaccgagctggccaagctgcccgagggcaccctgggccacatcaagagaagatacccccaggtggtgaccagactgatccacctgctgagccagaagatcctgggcaacctgcagcagctgcagggccccttccccgccggcagcggcctgggcgtgcccccccacagcgagctgaccaaccccgccagcaacctggccaccgtggccatcctgcccgtgtgcgccgaggtgcccatggtggccttcaccctggagctgcagcacgccctgcaggccatcggccccaccctgctgctgaacagcgacatcatcagagccagactgggcgccagcgccctggacagcatccaggagttcagactgagcggctggctggcccagcaggaggacgcccacagaatcgtgctgtaccagaccgacgccagcctgaccccctggaccgtgagatgcctgagacaggccgactgcatcctgatcgtgggcctgggcgaccaggagcccaccctgggccagctggagcagatgctggagaacaccgccgtgagagccctgaagcagctggtgctgctgcacagagaggagggcgccggccccaccagaaccgtggagtggctgaacatgagaagctggtgcagcggccacctgcacctgagatgccccagaagactgttcagcagaagaagccccgccaagctgcacgagctgtacgagaaggtgttcagcagaagagccgacagacacagcgacttcagcagactggccagagtgctgaccggcaacaccatcgccctggtgctgggcggcggcggcgccagaggctgcagccacatcggcgtgctgaaggccctggaggaggccggcgtgcccgtggacctggtgggcggcaccagcatcggcagcttcatcggcgccctgtacgccgaggagagaagcgccagcagaaccaagcagagagccagagagtgggccaagagcatgaccagcgtgctggagcccgtgctggacctgacctaccccgtgaccagcatgttcaccggcagcgccttcaacagaagcatccacagagtgttccaggacaagcagatcgaggacctgtggctgccctacttcaacgtgaccaccgacatcaccgccagcgccatgagagtgcacaaggacggcagcctgtggagatacgtgagagccagcatgaccctgagcggctacctgccccccctgtgcgaccccaaggacggccacctgctgatggacggcggctacatcaacaacctgcccgccgacatcgccagaagcatgggcgccaagaccgtgatcgccatcgacgtgggcagccaggacgagaccgacctgagcacctacggcgacagcctgagcggctggtggctgctgtggaagagactgaacccctgggccgacaaggtgaaggtgcccgacatggccgagatccagagcagactggcctacgtgagctgcgtgagacagctggaggtggtgaagagcagcagctactgcgagtacctgagaccccccatcgactgcttcaagaccatggacttcggcaagttcgaccagatctacgacgtgggctaccagtacggcaaggccgtgttcggcggctggagcagaggcaacgtgatcgagaagatgctgaccgacagaagaagcaccgacctgaacgagagcagaagagccgacgtgctggccttccccagcagcggcttcaccgacctggccgagatcgtgagcagaatcgagccccccaccagctacgtgagcgacggctgcgccgacggcgaggagagcgactgcctgaccgagtacgaggaggacgccggccccgactgcagcagagacgagggcggcagccccgagggcgccagccccagcaccgccagcgagatggaggaggagaagagcatcctgagacagagaagatgcctgccccaggagccccccggcagcgccaccgacgcctag

SEQ ID NO: 92553 - DNA, 1371 bp, Artificial Sequence
  Description of Artificial Sequence: Synthetic coding sequence
atgagaaaggtgagccagagcaccagcagcctggtggacaccagcgtgagcgccaccagcagacccagaatgagaaagaagctgaagatgctgaacatcgccaagaagatcctgagaatccagaaggagacccccaccctgcagagaaaggagcccccccccgccgtgctggaggccgacctgaccgagggcgacctggccaacagccacctgcccagcgaggtgctgtacatgctgaagaacgtgagagtgctgggccacttcgagaagcccctgttcctggagctgtgcagacacatggtgttccagagactgggccagggcgactacgtgttcagacccggccagcccgacgccagcatctacgtggtgcaggacggcctgctggagctgtgcctgcccggccccgacggcaaggagtgcgtggtgaaggaggtggtgcccggcgacagcgtgaacagcctgctgagcatcctggacgtgatcaccggccaccagcacccccagagaaccgtgagcgccagagccgccagagacagcaccgtgctgagactgcccgtggaggccttcagcgccgtgttcaccaagtaccccgagagcctggtgagagtggtgcagatcatcatggtgagactgcagagagtgaccttcctggccctgcacaactacctgggcctgaccaacgagctgttcagccacgagatccagcccctgagactgttccccagccccggcctgcccaccagaaccagccccgtgagaggcagcaagagaatggtgagcaccagcgccaccgacgagcccagagagacccccggcagaccccccgaccccaccggcgcccccctgcccggccccaccggcgaccccgtgaagcccaccagcctggagacccccagcgcccccctgctgagcagatgcgtgagcatgcccggcgacatcagcggcctgcagggcggccccagaagcgacttcgacatggcctacgagagaggcagaatcagcgtgagcctgcaggaggaggccagcggcggcagcctggccgcccccgccagaacccccacccaggagcccagagagcagcccgccggcgcctgcgagtacagctactgcgaggacgagagcgccaccggcggctgccccttcggcccctaccagggcagacagaccagcagcatcttcgaggccgccaagcaggagctggccaagctgatgagaatcgaggaccccagcctgctgaacagcagagtgctgctgcaccacgccaaggccggcaccatcatcgccagacagggcgaccaggacgtgagcggcccccacaccggcctgacctgccccgagagaggctgcagcgtggccctgatgacctag

SEQ ID NO: 92554 - DNA, 3903 bp, Artificial Sequence
  Description of Artificial Sequence: Synthetic coding sequence
atggaggcccccctgcagaccggcatggtgctgggcgtgatgatcggcgccggcgtggccgtggtggtgaccgccgtgctgatcctgctggtggtgagaagactgagagtgcccaagacccccgcccccgacggccccagatacagattcagaaagagagacaaggtgctgttctacggcagaaagatcatgagaaaggtgagccagagcaccagcagcctggtggacaccagcgtgagcgccaccagcagacccagaatgagaaagaagctgaagatgctgaacatcgccaagaagatcctgagaatccagaaggagacccccaccctgcagagaaaggagcccccccccgccgtgctggaggccgacctgaccgagggcgacctggccaacagccacctgcccagcgaggtgctgtacatgctgaagaacgtgagagtgctgggccacttcgagaagcccctgttcctggagctgtgcagacacatggtgttccagagactgggccagggcgactacgtgttcagacccggccagcccgacgccagcatctacgtggtgcaggacggcctgctggagctgtgcctgcccggccccgacggcaaggagtgcgtggtgaaggaggtggtgcccggcgacagcgtgaacagcctgctgagcatcctggacgtgatcaccggccaccagcacccccagagaaccgtgagcgccagagccgccagagacagcaccgtgctgagactgcccgtggaggccttcagcgccgtgttcaccaagtaccccgagagcctggtgagagtggtgcagatcatcatggtgagactgcagagagtgaccttcctggccctgcacaactacctgggcctgaccaacgagctgttcagccacgagatccagcccctgagactgttccccagccccggcctgcccaccagaaccagccccgtgagaggcagcaagagaatggtgagcaccagcgccaccgacgagcccagagagacccccggcagaccccccgaccccaccggcgcccccctgcccggccccaccggcgaccccgtgaagcccaccagcctggagacccccagcgcccccctgctgagcagatgcgtgagcatgcccggcgacatcagcggcctgcagggcggccccagaagcgacttcgacatggcctacgagagaggcagaatcagcgtgagcctgcaggaggaggccagcggcggcagcctggccgcccccgccagaacccccacccaggagcccagagagcagcccgccggcgcctgcgagtacagctactgcgaggacgagagcgccaccggcggctgccccttcggcccctaccagggcagacagaccagcagcatcttcgaggccgccaagcaggagctggccaagctgatgagaatcgaggacgtgagcctgcacttcgtgctgtggggctgcctgcacgtgtaccagagaatgatcgacaaggccgaggacgtgtgcctgttcgtggcccagcccggcgagctggtgggccagctggccgtgctgaccggcgagcccctgatcttcaccctgagagcccagagagactgcaccttcctgagaatcagcaagagcgacttctacgagatcatgagagcccagcccagcgtggtgctgagcgccgcccacaccgtggccgccagaatgagccccttcgtgagacagatggacttcgccatcgactggaccgccgtggaggccggcagagccctgtacagacagggcgacagaagcgactgcacctacatcgtgctgaacggcagactgagaagcgtgatccagagaggcagcggcaagaaggagctggtgggcgagtacggcagaggcgacctgatcggcgtggtggaggccctgaccagacagcccagagccaccaccgtgcacgccgtgagagacaccgagctggccaagctgcccgagggcaccctgggccacatcaagagaagatacccccaggtggtgaccagactgatccacctgctgagccagaagatcctgggcaacctgcagcagctgcagggccccttccccggcagcggcctgggcgtgcccccccacagcgagctgaccaaccccgccagcaacctggccaccgtggccatcctgcccgtgtgcgccgaggtgcccatggtggccttcaccctggagctgcagcacgccctgcaggccatcggccccaccctgctgctgaacagcgacatcatcagagccagactgggcgccagcgccctggacagcatccaggagttcagactgagcggctggctggcccagcaggaggacgcccacagaatcgtgctgtaccagaccgacgccagcctgaccccctggaccgtgagatgcctgagacaggccgactgcatcctgatcgtgggcctgggcgaccaggagcccaccctgggccagctggagcagatgctggagaacaccgccgtgagagccctgaagcagctggtgctgctgcacagagaggagggcgccggccccaccagaaccgtggagtggctgaacatgagaagctggtgcagcggccacctgcacctgagatgccccagaagactgttcagcagaagaagccccgccaagctgcacgagctgtacgagaaggtgttcagcagaagagccgacagacacagcgacttcagcagactggccagagtgctgaccggcaacaccatcgccctggtgctgggcggcggcggcgccagaggctgcagccacatcggcgtgctgaaggccctggaggaggccggcgtgcccgtggacctggtgggcggcaccagcatcggcagcttcatcggcgccctgtacgccgaggagagaagcgccagcagaaccaagcagagagccagagagtgggccaagagcatgaccagcgtgctggagcccgtgctggacctgacctaccccgtgaccagcatgttcaccggcagcgccttcaacagaagcatccacagagtgttccaggacaagcagatcgaggacctgtggctgccctacttcaacgtgaccaccgacatcaccgccagcgccatgagagtgcacaaggacggcagcctgtggagatacgtgagagccagcatgaccctgagcggctacctgccccccctgtgcgaccccaaggacggccacctgctgatggacggcggctacatcaacaacctgcccgccgacatcgccagaagcatgggcgccaagaccgtgatcgccatcgacgtgggcagccaggacgagaccgacctgagcacctacggcgacagcctgagcggctggtggctgctgtggaagagactgaacccctgggccgacaaggtgaaggtgcccgacatggccgagatccagagcagactggcctacgtgagctgcgtgagacagctggaggtggtgaagagcagcagctactgcgagtacctgagaccccccatcgactgcttcaagaccatggacttcggcaagttcgaccagatctacgacgtgggctaccagtacggcaaggccgtgttcggcggctggagcagaggcaacgtgatcgagaagatgctgaccgacagaagaagcaccgacctgaacgagagcagaagagccgacgtgctggccttccccagcagcggcttcaccgacctggccgagatcgtgagcagaatcgagccccccaccagctacgtgagcgacggctgcgccgacggcgaggagagcgactgcctgaccgagtacgaggaggacgccggccccgactgcagcagagacgagggcggcagccccgagggcgccagccccagcaccgccagcgagatggaggaggagaagagcatcctgagacagagaagatgcctgccccaggagccccccggcagcgccaccgacgcctag

SEQ ID NO: 92555 - DNA, 3954 bp, Artificial Sequence
  Description of Artificial Sequence: Synthetic coding sequence
atggaggaggagaaggacgacagcccccagctgaccggcatcgccgtgggcgccctgctggccctggccctggtgggcgtgctgatcctgttcatgttcagaagactgagacagttcagacaggcccagcccaccccccagtacagattcagaaagagagacaaggtgatgttctacggcagaaagatcatgagaaaggtgaccaccctgcccaacaccctggtggagaacaccgccctgcccagacagagagccagaaagagaaccaaggtgctgagcctggccaagagaatcctgagattcaagaaggagtaccccgccctgcagcccaaggagcccccccccagcctgctggaggccgacctgaccgagttcgacgtgaagaacagccacctgcccagcgaggtgctgtacatgctgaagaacgtgagagtgctgggccacttcgagaagcccctgttcctggagctgtgcaagcacatcgtgttcgtgcagctgcaggagggcgagcacgtgttccagcccagagagcccgaccccagcatctgcgtggtgcaggacggcagactggaggtgtgcatccaggacaccgacggcaccgaggtggtggtgaaggaggtgctggccggcgacagcgtgcacagcctgctgagcatcctggacatcatcaccggccacgccgccccctacaagaccgtgagcgtgagagccgccatccccagcaccatcctgagactgcccgccgccgccttccacggcgtgttcgagaagtaccccgagaccctggtgagagtggtgcagatcatcatggtgagactgcagagagtgaccttcctggccctgcacaactacctgggcctgaccaccgagctgttcaacgccgagagccaggccatccccctggtgagcgtggccagcgtggccgccggcaaggccaagaagcaggtgttctacggcgaggaggagagactgaagaagccccccagactgcaggagagctgcgacagcgaccacggcggcggcagacccgccgccgccggccccctgctgaagagaagccacagcgtgcccgcccccagcatcagaaagcagatcctggaggagctggagaagcccggcgccggcgaccccgaccccagcgccccccagggcggccccggcagcgccaccagcgacctgggcatggcctgcgacagagccagagtgttcctgcacagcgacgagcaccccggcagcagcgtggccagcaagagcagaaagagcgtgatggtggccgagatccccagcaccgtgagccagcacagcgagagccacaccgacgagaccctggccagcagaaagagcgacgccatcttcagagccgccaagaaggacctgctgaccctgatgaagctggaggacagcagcctgctggacggcagagtggccctgctgcacgtgcccgccggcaccgtggtgagcagacagggcgaccaggacgccagcatcctgttcgtggtgagcggcctgctgcacgtgtaccagagaaagatcggcagccaggaggacacctgcctgttcctgaccagacccggcgagatggtgggccagctggccgtgctgaccggcgagcccctgatcttcaccgtgaaggccaacagagactgcagcttcctgagcatcagcaaggcccacttctacgagatcatgagaaagcagcccaccgtggtgctgggcgtggcccacaccgtggtgaagagaatgagcagcttcgtgagacagatcgacttcgccctggactgggtggaggtggaggccggcagagccatctacagacagggcgacaagagcgactgcacctacatcatgctgagcggcagactgagaagcgtgatcagaaaggacgacggcaagaagagactggccggcgagtacggcagaggcgacctggtgggcgtggtggagaccctgacccaccaggccagagccaccaccgtgcacgccgtgagagacagcgagctggccaagctgcccgccggcgccctgaccagcatcaagagaagatacccccaggtggtgaccagactgatccacctgctgggcgagaagatcctgggcagcctgcagcagggccccgtgaccggccaccagctgggcctgcccaccgagggcagcaagtgggacctgggcaaccccgccgtgaacctgagcaccgtggccgtgatgcccgtgagcgaggaggtgcccctgaccgccttcgccctggagctggagcacgccctgagcgccatcggccccaccctgctgctgaccagcgacaacatcaagagaagactgggcagcgccgccctggacagcgtgcacgagtacagactgagcagctggctgggccagcaggaggacacccacagaatcgtgctgtaccaggtggacggcaccctgaccccctggacccagagatgcgtgagacaggccgactgcatcctgatcgtgggcctgggcgaccaggagcccaccgtgggcgagctggagagaatgctggagagcaccgccgtgagagcccagaagcagctgatcctgctgcacagagaggagggccccgcccccgccagaaccgtggagtggctgaacatgagaagctggtgcagcggccacctgcacctgtgctgccccagaagagtgttcagcagaagaagcctgcccaagctggtggagatgtacaagcacgtgttccagagaccccccgacagacacagcgacttcagcagactggccagagtgctgaccggcaacgccatcgccctggtgctgggcggcggcggcgccagaggctgcgcccaggtgggcgtgctgaaggccctggccgagtgcggcatccccgtggacatggtgggcggcaccagcatcggcgccttcgtgggcgccctgtacagcgaggagagaaactacagccagatgagaatcagagccaagcagtgggccgagggcatgaccagcctgatgaaggccgccctggacctgacctaccccatcaccagcatgttcagcggcgccggcttcaacagcagcatcttcagcgtgttcaaggaccagcagatcgaggacctgtggatcccctacttcgccatcaccaccgacatcaccgccagcgccatgagagtgcacaccgacggcagcctgtggtggtacgtgagagccagcatgagcctgagcggctacatgccccccctgtgcgaccccaaggacggccacctgctgatggacggcggctacatcaacaacctgcccgccgacgtggccagaagcatgggcgccaaggtggtgatcgccatcgacgtgggcagcagagacgagaccgacctgaccaactacggcgacgccctgagcggctggtggctgctgtggaagagatggaaccccctggccaccaaggtgaaggtgctgaacatggccgagatccagaccagactggcctacgtgtgctgcgtgagacagctggaggtggtgaagagcagcgactactgcgagtacctgagaccccccatcgacagctacagcaccctggacttcggcaagttcaacgagatctgcgaggtgggctaccagcacggcagaaccgtgttcgacatctggggcagaagcggcgtgctggagaagatgctgagagaccagcagggccccagcaagaagcccgccagcgccgtgctgacctgccccaacgccagcttcaccgacctggccgagatcgtgagcagaatcgagcccgccaagcccgccatggtggacgacgagagcgactaccagaccgagtacgaggaggagctgctggacgtgcccagagacgcctacgccgacttccagagcaccagcgcccagcagggcagcgacctggaggacgagagcagcctgagacacagacaccccagcctggccttccccaagctgagcgagggcagcagcgaccaggacggctag

SEQ ID NO: 92556 - DNA, 2178 bp, Artificial Sequence
  Description of Artificial Sequence: Synthetic coding sequence
atggtgagactgcagagagtgaccttcctggccctgcacaactacctgggcctgaccaccgagctgttcaacgccgagagccaggccatccccctggtgagcgtggccagcgtggccgccggcaaggccaagaagcaggtgttctacggcgaggaggagagactgaagaagccccccagactgcaggagagctgcgacagcgccgaccacggcggcggcagacccgccgccgccggccccctgctgaagagaagccacagcgtgcccgcccccagcatcagaaagcagatcctggaggagctggagaagcccggcgccggcgaccccgaccccagcgccccccagggccaccagctgggcctgcccaccgagggcagcaagtgggacctgggcaaccccgccgtgaacctgagcaccgtggccgtgatgcccgtgagcgaggaggtgcccctgaccgccttcgccctggagctggagcacgccctgagcgccatcggccccaccctgctgctgaccagcgacaacatcaagagaagactgggcagcgccgccctggacagcgtgcacgagtacagactgagcagctggctgggccagcaggaggacacccacagaatcgtgctgtaccaggtggacggcaccctgaccccctggacccagagatgcgtgagacaggccgactgcatcctgatcgtgggcctgggcgaccaggagcccaccgtgggcgagctggagagaatgctggagagcaccgccgtgagagcccagaagcagctgatcctgctgcacagagaggagggccccgcccccgccagaaccgtggagtggctgaacatgagaagctggtgcagcggccacctgcacctgtgctgccccagaagagtgttcagcagaagaagcctgcccaagctggtggagatgtacaagcacgtgttccagagaccccccgacagacacagcgacttcagcagactggccagagtgctgaccggcaacgccatcgccctggtgctgggcggcggcggcgccagaggctgcgcccaggtgggcgtgctgaaggccctggccgagtgcggcatccccgtggacatggtgggcggcaccagcatcggcgccttcgtgggcgccctgtacagcgaggagagaaactacagccagatgagaatcagagccaagcagtgggccgagggcatgaccagcctgatgaaggccgccctggacctgacctaccccatcaccagcatgttcagcggcgccggcttcaacagcagcatcttcagcgtgttcaaggaccagcagatcgaggacctgtggatcccctacttcgccatcaccaccgacatcaccgccagcgccatgagagtgcacaccgacggcagcctgtggtggtacgtgagagccagcatgagcctgagcggctacatgccccccctgtgcgaccccaaggacggccacctgctgatggacggcggctacatcaacaacctgcccgccgacgtggccagaagcatgggcgccaaggtggtgatcgccatcgacgtgggcagcagagacgagaccgacctgaccaactacggcgacgccctgagcggctggtggctgctgtggaagagatggaaccccctggccaccaaggtgaaggtgctgaacatggccgagatccagaccagactggcctacgtgtgctgcgtgagacagctggaggtggtgaagagcagcgactactgcgagtacctgagaccccccatcgacagctacagcaccctggacttcggcaagttcaacgagatctgcgaggtgggctaccagcacggcagaaccgtgttcgacatctggggcagaagcggcgtgctggagaagatgctgagagaccagcagggccccagcaagaagcccgccagcgccgtgctgacctgccccaacgccagcttcaccgacctggccgagatcgtgagcagaatcgagcccgccaagcccgccatggtggacgacgagagcgactaccagaccgagtacgaggaggagctgctggacgtgcccagagacgcctacgccgacttccagagcaccagcgcccagcagggcagcgacctggaggacgagagcagcctgagacacagacaccccagcctggccttccccaagctgagcgagggcagcagcgaccaggacggctag

SEQ ID NO: 92557 - DNA, 1377 bp, Artificial Sequence
  Description of Artificial Sequence: Synthetic coding sequence
atggaggaggagaaggacgacagcccccaggccgacttctgcctgggcaccgccctgcacagctggggcctgtggttcaccgaggagggcagccccagcaccatgctgaccggcatcgccgtgggcgccctgctggccctggccctggtgggcgtgctgatcctgttcatgttcagaagactgagacagttcagacaggcccagcccaccccccagtacagattcagaaagagagacaaggtgatgttctacggcagaaagatcatgagaaaggtgaccaccctgcccaacaccctggtggagaacaccgccctgcccagacagagagccagaaagagaaccaaggtgctgagcctggccaagagaatcctgagattcaagaaggagtaccccgccctgcagcccaaggagcccccccccagcctgctggaggccgacctgaccgagttcgacgtgaagaacagccacctgcccagcgaggtgctgtacatgctgaagaacgtgagagtgctgggccacttcgagaagcccctgttcctggagctgtgcaagcacatcgtgttcgtgcagctgcaggagggcgagcacgtgttccagcccagagagcccgaccccagcatctgcgtggtgcaggacggcagactggaggtgtgcatccaggacaccgacggcaccgaggtggtggtgaaggaggtgctggccggcgacagcgtgcacagcctgctgagcatcctggacatcatcaccggccacgccgccccctacaagaccgtgagcgtgagagccgccatccccagcaccatcctgagactgcccgccgccgccttccacggcgtgttcgagaagtaccccgagaccctggtgagagtggtgcagatcatcatggtgagactgcagagagtgaccttcctggccctgcacaactacctgggcctgaccaccgagctgttcaacgccgagagccaggccatccccctggtgagcgtggccagcgtggccgccggcaaggccaagaagcaggtgttctacggcgaggaggagagactgaagaagccccccagactgcaggagagctgcgacagcgaccacggcggcggcagacccgccgccgccggccccctgctgaagagaagccacagcgtgcccgcccccagcatcagaaagcagatcctggaggagctggagaagcccggcgccggcgaccccgaccccagcgccccccaggccagagtgctgtgcctgctgccccagtgcctgggcggcctgccccccaccgacaccagcgtgtacagcagcgccagcagcgactgctgcggctgcagcatgcccgtgctgtgcatcatgggccacaagccccacgtgaccgtggacacctag

SEQ ID NO: 92558 - DNA, 3765 bp, Artificial Sequence
  Description of Artificial Sequence: Synthetic coding sequence
atggaggaggagaaggacgacagcccccagctgaccggcatcgccgtgggcgccctgctggccctggccctggtgggcgtgctgatcctgttcatgttcagaagactgagacagttcagacaggcccagcccaccccccagtacagattcagaaagagagacaaggtgatgttctacggcagaaagatcatgagaaaggtgaccaccctgcccaacaccctggtggagaacaccgccctgcccagacagagagccagaaagagaaccaaggtgctgagcctggccaagagaatcctgagattcaagaaggagtaccccgccctgcagcccaaggagcccccccccagcctgctggaggccgacctgaccgagttcgacgtgaagaacagccacctgcccagcgaggtgctgtacatgctgaagaacgtgagagtgctgggccacttcgagaagcccctgttcctggagctgtgcaagcacatcgtgttcgtgcagctgcaggagggcgagcacgtgttccagcccagagagcccgaccccagcatctgcgtggtgcaggacggcagactggaggtgtgcatccaggacaccgacggcaccgaggtggtggtgaaggaggtgctggccggcgacagcgtgcacagcctgctgagcatcctggacatcatcaccggccacgccgccccctacaagaccgtgagcgtgagagccgccatccccagcaccatcctgagactgcccgccgccgccttccacggcgtgttcgagaagtaccccgagaccctggtgagagtggtgcagatcatcatggtgagactgcagagagtgaccttcctggccctgcacaactacctgggcctgaccaccgagctgttcaacgccgagagccaggccatccccctggtgagcgtggccagcgtggccgccggcaaggccaagaagcaggtgttctacggcgaggaggagagactgaagaagccccccagactgcaggagagctgcgacagcgaccacggcggcggcagacccgccgccgccggccccctgctgaagagaagccacagcgtgcccgcccccagcatcagaaagcagatcctggaggagctggagaagcccggcgccggcgaccccgaccccagcgccccccagggcggccccggcagcgccaccagcgacctgggcatggcctgcgacagagccagagtgttcctgcacagcgacgagcaccccggcagcagcgtggccagcaagagcagaaagagcgtgatggtggccgagatccccagcaccgtgagccagcacagcgagagccacaccgacgagaccctggccagcagaaagagcgacgccatcttcagagccgccaagaaggacctgctgaccctgatgaagctggaggacagcagcctgctggacggcagagtggccctgctgcacgtgcccgccggcaccgtggtgagcagacagggcgaccaggacgccagcatcctgttcgtggtgagcggcctgctgcacgtgtaccagagaaagatcggcagccaggaggacacctgcctgttcctgaccagacccggcgagatggtgggccagctggccgtgctgaccggcgagcccctgatcttcaccgtgaaggccaacagagactgcagcttcctgagcatcagcaaggcccacttctacgagatcatgagaaagcagcccaccgtggtgctgggcgtggcccacaccgtggtgaagagaatgagcagcttcgtgagacagatcgacttcgccctggactgggtggaggtggaggccggcagagccatctacagacagggcgacaagagcgactgcacctacatcatgctgagcggcagactgagaagcgtgatcagaaaggacgacggcaagaagagactggccggcgagtacggcagaggcgacctggtgggcgtggtggagaccctgacccaccaggccagagccaccaccgtgcacgccgtgagagacagcgagctggccaagctgcccgccggcgccctgaccagcatcaagagaagatacccccaggtggtgaccagactgatccacctgctgggcgagaagatcctgggcagcctgcagcagggccccgtgaccggccaccagctgggcctgcccaccgagggcagcaagtgggacctgggcaaccccgccgtgaacctgagcaccgtggccgtgatgcccgtgagcgaggaggtgcccctgaccgccttcgccctggagctggagcacgccctgagcgccatcggccccaccctgctgctgaccagcgacaacatcaagagaagactgggcagcgccgccctggacagcgtgcacgagtacagactgagcagctggctgggccagcaggaggacacccacagaatcgtgctgtaccaggtggacggcaccctgaccccctggacccagagatgcgtgagacaggccgactgcatcctgatcgtgggcctgggcgaccaggagcccaccgtgggcgagctggagagaatgctggagagcaccgccgtgagagcccagaagcagctgatcctgctgcacagagaggagggccccgcccccgccagaaccgtggagtggctgaacatgagaagctggtgcagcggccacctgcacctgtgctgccccagaagagtgttcagcagaagaagcctgcccaagctggtggagatgtacaagcacgtgttccagagaccccccgacagacacagcgacttcagcagactggccagagtgctgaccggcaacgccatcgccctggtgctgggcggcggcggcgccagaggctgcgcccaggtgggcgtgctgaaggccctggccgagtgcggcatccccgtggacatggtgggcggcaccagcatcggcgccttcgtgggcgccctgtacagcgaggagagaaactacagccagatgagaatcagagccaagcagtgggccgagggcatgaccagcctgatgaaggccgccctggacctgacctaccccatcaccagcatgttcagcggcgccggcttcaacagcagcatcttcagcgtgttcaaggaccagcagatcgaggacctgtggatcccctacttcgccatcaccaccgacatcaccgccagcgccatgagagtgcacaccgacggcagcctgtggtggtacgtgagagccagcatgagcctgagcggctacatgccccccctgtgcgaccccaaggacggccacctgctgatggacggcggctacatcaacaacctgcccgccgacgtggccagaagcatgggcgccaaggtggtgatcgccatcgacgtgggcagcagagacgagaccgacctgaccaactacggcgacgccctgagcggctggtggctgctgtggaagagatggaaccccctggccaccaaggtgaaggtgctgaacatggccgagatccagaccagactggcctacgtgtgctgcgtgagacagctggaggtggtgaagagcagcgactactgcgagtacctgagaccccccatcgacagctacagcaccctggacttcggcaagttcaacgagatctgcgtgcccgacgagagcgactaccagaccgagtacgaggaggagctgctggacgtgcccagagacgcctacgccgacttccagagcaccagcgcccagcagggcagcgacctggaggacgagagcagcctgagacacagacaccccagcctggccttccccaagctgagcgagggcagcagcgaccaggacggctag

SEQ ID NO: 92559 - DNA, 2772 bp, Artificial Sequence
  Description of Artificial Sequence: Synthetic coding sequence
atggcctgcgacagagccagagtgttcctgcacagcgacgagcaccccggcagcagcgtggccagcaagagcagaaagagcgtgatggtggccgagatccccagcaccgtgagccagcacagcgagagccacaccgacgagaccctggccagcagaaagagcgacgccatcttcagagccgccaagaaggacctgctgaccctgatgaagctggaggacagcagcctgctggacggcagagtggccctgctgcacgtgcccgccggcaccgtggtgagcagacagggcgaccaggacgccagcatcctgttcgtggtgagcggcctgctgcacgtgtaccagagaaagatcggcagccaggaggacacctgcctgttcctgaccagacccggcgagatggtgggccagctggccgtgctgaccggcgagcccctgatcttcaccgtgaaggccaacagagactgcagcttcctgagcatcagcaaggcccacttctacgagatcatgagaaagcagcccaccgtggtgctgggcgtggcccacaccgtggtgaagagaatgagcagcttcgtgagacagatcgacttcgccctggactgggtggaggtggaggccggcagagccatctacagacagggcgacaagagcgactgcacctacatcatgctgagcggcagactgagaagcgtgatcagaaaggacgacggcaagaagagactggccggcgagtacggcagaggcgacctggtgggcgtggtggagaccctgacccaccaggccagagccaccaccgtgcacgccgtgagagacagcgagctggccaagctgcccgccggcgccctgaccagcatcaagagaagatacccccaggtggtgaccagactgatccacctgctgggcgagaagatcctgggcagcctgcagcagggccccgtgaccggccaccagctgggcctgcccaccgagggcagcaagtgggacctgggcaaccccgccgtgaacctgagcaccgtggccgtgatgcccgtgagcgaggaggtgcccctgaccgccttcgccctggagctggagcacgccctgagcgccatcggccccaccctgctgctgaccagcgacaacatcaagagaagactgggcagcgccgccctggacagcgtgcacgagtacagactgagcagctggctgggccagcaggaggacacccacagaatcgtgctgtaccaggtggacggcaccctgaccccctggacccagagatgcgtgagacaggccgactgcatcctgatcgtgggcctgggcgaccaggagcccaccgtgggcgagctggagagaatgctggagagcaccgccgtgagagcccagaagcagctgatcctgctgcacagagaggagggccccgcccccgccagaaccgtggagtggctgaacatgagaagctggtgcagcggccacctgcacctgtgctgccccagaagagtgttcagcagaagaagcctgcccaagctggtggagatgtacaagcacgtgttccagagaccccccgacagacacagcgacttcagcagactggccagagtgctgaccggcaacgccatcgccctggtgctgggcggcggcggcgccagaggctgcgcccaggtgggcgtgctgaaggccctggccgagtgcggcatccccgtggacatggtgggcggcaccagcatcggcgccttcgtgggcgccctgtacagcgaggagagaaactacagccagatgagaatcagagccaagcagtgggccgagggcatgaccagcctgatgaaggccgccctggacctgacctaccccatcaccagcatgttcagcggcgccggcttcaacagcagcatcttcagcgtgttcaaggaccagcagatcgaggacctgtggatcccctacttcgccatcaccaccgacatcaccgccagcgccatgagagtgcacaccgacggcagcctgtggtggtacgtgagagccagcatgagcctgagcggctacatgccccccctgtgcgaccccaaggacggccacctgctgatggacggcggctacatcaacaacctgcccgccgacgtggccagaagcatgggcgccaaggtggtgatcgccatcgacgtgggcagcagagacgagaccgacctgaccaactacggcgacgccctgagcggctggtggctgctgtggaagagatggaaccccctggccaccaaggtgaaggtgctgaacatggccgagatccagaccagactggcctacgtgtgctgcgtgagacagctggaggtggtgaagagcagcgactactgcgagtacctgagaccccccatcgacagctacagcaccctggacttcggcaagttcaacgagatctgcgaggtgggctaccagcacggcagaaccgtgttcgacatctggggcagaagcggcgtgctggagaagatgctgagagaccagcagggccccagcaagaagcccgccagcgccgtgctgacctgccccaacgccagcttcaccgacctggccgagatcgtgagcagaatcgagcccgccaagcccgccatggtggacgacgagagcgactaccagaccgagtacgaggaggagctgctggacgtgcccagagacgcctacgccgacttccagagcaccagcgcccagcagggcagcgacctggaggacgagagcagcctgagacacagacaccccagcctggccttccccaagctgagcgagggcagcagcgaccaggacggctag

SEQ ID NO: 92560 - DNA, 4029 bp, Artificial Sequence
  Description of Artificial Sequence: Synthetic coding sequence
atggaggaggagaaggacgacagcccccaggccgacttctgcctgggcaccgccctgcacagctggggcctgtggttcaccgaggagggcagccccagcaccatgctgaccggcatcgccgtgggcgccctgctggccctggccctggtgggcgtgctgatcctgttcatgttcagaagactgagacagttcagacaggcccagcccaccccccagtacagattcagaaagagagacaaggtgatgttctacggcagaaagatcatgagaaaggtgaccaccctgcccaacaccctggtggagaacaccgccctgcccagacagagagccagaaagagaaccaaggtgctgagcctggccaagagaatcctgagattcaagaaggagtaccccgccctgcagcccaaggagcccccccccagcctgctggaggccgacctgaccgagttcgacgtgaagaacagccacctgcccagcgaggtgctgtacatgctgaagaacgtgagagtgctgggccacttcgagaagcccctgttcctggagctgtgcaagcacatcgtgttcgtgcagctgcaggagggcgagcacgtgttccagcccagagagcccgaccccagcatctgcgtggtgcaggacggcagactggaggtgtgcatccaggacaccgacggcaccgaggtggtggtgaaggaggtgctggccggcgacagcgtgcacagcctgctgagcatcctggacatcatcaccggccacgccgccccctacaagaccgtgagcgtgagagccgccatccccagcaccatcctgagactgcccgccgccgccttccacggcgtgttcgagaagtaccccgagaccctggtgagagtggtgcagatcatcatggtgagactgcagagagtgaccttcctggccctgcacaactacctgggcctgaccaccgagctgttcaacgccgagagccaggccatccccctggtgagcgtggccagcgtggccgccggcaaggccaagaagcaggtgttctacggcgaggaggagagactgaagaagccccccagactgcaggagagctgcgacagcgaccacggcggcggcagacccgccgccgccggccccctgctgaagagaagccacagcgtgcccgcccccagcatcagaaagcagatcctggaggagctggagaagcccggcgccggcgaccccgaccccagcgccccccagggcggccccggcagcgccaccagcgacctgggcatggcctgcgacagagccagagtgttcctgcacagcgacgagcaccccggcagcagcgtggccagcaagagcagaaagagcgtgatggtggccgagatccccagcaccgtgagccagcacagcgagagccacaccgacgagaccctggccagcagaaagagcgacgccatcttcagagccgccaagaaggacctgctgaccctgatgaagctggaggacagcagcctgctggacggcagagtggccctgctgcacgtgcccgccggcaccgtggtgagcagacagggcgaccaggacgccagcatcctgttcgtggtgagcggcctgctgcacgtgtaccagagaaagatcggcagccaggaggacacctgcctgttcctgaccagacccggcgagatggtgggccagctggccgtgctgaccggcgagcccctgatcttcaccgtgaaggccaacagagactgcagcttcctgagcatcagcaaggcccacttctacgagatcatgagaaagcagcccaccgtggtgctgggcgtggcccacaccgtggtgaagagaatgagcagcttcgtgagacagatcgacttcgccctggactgggtggaggtggaggccggcagagccatctacagacagggcgacaagagcgactgcacctacatcatgctgagcggcagactgagaagcgtgatcagaaaggacgacggcaagaagagactggccggcgagtacggcagaggcgacctggtgggcgtggtggagaccctgacccaccaggccagagccaccaccgtgcacgccgtgagagacagcgagctggccaagctgcccgccggcgccctgaccagcatcaagagaagatacccccaggtggtgaccagactgatccacctgctgggcgagaagatcctgggcagcctgcagcagggccccgtgaccggccaccagctgggcctgcccaccgagggcagcaagtgggacctgggcaaccccgccgtgaacctgagcaccgtggccgtgatgcccgtgagcgaggaggtgcccctgaccgccttcgccctggagctggagcacgccctgagcgccatcggccccaccctgctgctgaccagcgacaacatcaagagaagactgggcagcgccgccctggacagcgtgcacgagtacagactgagcagctggctgggccagcaggaggacacccacagaatcgtgctgtaccaggtggacggcaccctgaccccctggacccagagatgcgtgagacaggccgactgcatcctgatcgtgggcctgggcgaccaggagcccaccgtgggcgagctggagagaatgctggagagcaccgccgtgagagcccagaagcagctgatcctgctgcacagagaggagggccccgcccccgccagaaccgtggagtggctgaacatgagaagctggtgcagcggccacctgcacctgtgctgccccagaagagtgttcagcagaagaagcctgcccaagctggtggagatgtacaagcacgtgttccagagaccccccgacagacacagcgacttcagcagactggccagagtgctgaccggcaacgccatcgccctggtgctgggcggcggcggcgccagaggctgcgcccaggtgggcgtgctgaaggccctggccgagtgcggcatccccgtggacatggtgggcggcaccagcatcggcgccttcgtgggcgccctgtacagcgaggagagaaactacagccagatgagaatcagagccaagcagtgggccgagggcatgaccagcctgatgaaggccgccctggacctgacctaccccatcaccagcatgttcagcggcgccggcttcaacagcagcatcttcagcgtgttcaaggaccagcagatcgaggacctgtggatcccctacttcgccatcaccaccgacatcaccgccagcgccatgagagtgcacaccgacggcagcctgtggtggtacgtgagagccagcatgagcctgagcggctacatgccccccctgtgcgaccccaaggacggccacctgctgatggacggcggctacatcaacaacctgcccgccgacgtggccagaagcatgggcgccaaggtggtgatcgccatcgacgtgggcagcagagacgagaccgacctgaccaactacggcgacgccctgagcggctggtggctgctgtggaagagatggaaccccctggccaccaaggtgaaggtgctgaacatggccgagatccagaccagactggcctacgtgtgctgcgtgagacagctggaggtggtgaagagcagcgactactgcgagtacctgagaccccccatcgacagctacagcaccctggacttcggcaagttcaacgagatctgcgaggtgggctaccagcacggcagaaccgtgttcgacatctggggcagaagcggcgtgctggagaagatgctgagagaccagcagggccccagcaagaagcccgccagcgccgtgctgacctgccccaacgccagcttcaccgacctggccgagatcgtgagcagaatcgagcccgccaagcccgccatggtggacgacgagagcgactaccagaccgagtacgaggaggagctgctggacgtgcccagagacgcctacgccgacttccagagcaccagcgcccagcagggcagcgacctggaggacgagagcagcctgagacacagacaccccagcctggccttccccaagctgagcgagggcagcagcgaccaggacggctag

SEQ ID NO: 92561 - DNA, 3846 bp, Artificial Sequence
  Description of Artificial Sequence: Synthetic coding sequence
atgctgaccggcatcgccgtgggcgccctgctggccctggccctggtgggcgtgctgatcctgttcatgttcagaagactgagacagttcagacaggcccagcccaccccccagtacagattcagaaagagagacaaggtgatgttctacggcagaaagatcatgagaaaggtgaccaccctgcccaacaccctggtggagaacaccgccctgcccagacagagagccagaaagagaaccaaggtgctgagcctggccaagagaatcctgagattcaagaaggagtaccccgccctgcagcccaaggagcccccccccagcctgctggaggccgacctgaccgagttcgacgtgaagaacagccacctgcccagcgaggtgctgtacatgctgaagaacgtgagagtgctgggccacttcgagaagcccctgttcctggagctgtgcaagcacatcgtgttcgtgcagctgcaggagggcgagcacgtgttccagcccagagagcccgaccccagcatctgcgtggtgcaggacggcagactggaggtgtgcatccaggacaccgacggcaccgaggtggtggtgaaggaggtgctggccggcgacagcgtgcacagcctgctgagcatcctggacatcatcaccggccacgccgccccctacaagaccgtgagcgtgagagccgccatccccagcaccatcctgagactgcccgccgccgccttccacggcgtgttcgagaagtaccccgagaccctggtgagagtggtgcagatcatcatggtgagactgcagagagtgaccttcctggccctgcacaactacctgggcctgaccaccgagctgttcaacgccgagagccaggccatccccctggtgagcgtggccagcgtggccgccggcaaggccaagaagcaggtgttctacggcgaggaggagagactgaagaagccccccagactgcaggagagctgcgacagcgaccacggcggcggcagacccgccgccgccggccccctgctgaagagaagccacagcgtgcccgcccccagcatcagaaagcagatcctggaggagctggagaagcccggcgccggcgaccccgaccccagcgccccccagggcggccccggcagcgccaccagcgacctgggcatggcctgcgacagagccagagtgttcctgcacagcgacgagcaccccggcagcagcgtggccagcaagagcagaaagagcgtgatggtggccgagatccccagcaccgtgagccagcacagcgagagccacaccgacgagaccctggccagcagaaagagcgacgccatcttcagagccgccaagaaggacctgctgaccctgatgaagctggaggacagcagcctgctggacggcagagtggccctgctgcacgtgcccgccggcaccgtggtgagcagacagggcgaccaggacgccagcatcctgttcgtggtgagcggcctgctgcacgtgtaccagagaaagatcggcagccaggaggacacctgcctgttcctgaccagacccggcgagatggtgggccagctggccgtgctgaccggcgagcccctgatcttcaccgtgaaggccaacagagactgcagcttcctgagcatcagcaaggcccacttctacgagatcatgagaaagcagcccaccgtggtgctgggcgtggcccacaccgtggtgaagagaatgagcagcttcgtgagacagatcgacttcgccctggactgggtggaggtggaggccggcagagccatctacagacagggcgacaagagcgactgcacctacatcatgctgagcggcagactgagaagcgtgatcagaaaggacgacggcaagaagagactggccggcgagtacggcagaggcgacctggtgggcgtggtggagaccctgacccaccaggccagagccaccaccgtgcacgccgtgagagacagcgagctggccaagctgcccgccggcgccctgaccagcatcaagagaagatacccccaggtggtgaccagactgatccacctgctgggcgagaagatcctgggcagcctgcagcagggccccgtgaccggccaccagctgggcctgcccaccgagggcagcaagtgggacctgggcaaccccgccgtgaacctgagcaccgtggccgtgatgcccgtgagcgaggaggtgcccctgaccgccttcgccctggagctggagcacgccctgagcgccatcggccccaccctgctgctgaccagcgacaacatcaagagaagactgggcagcgccgccctggacagcgtgcacgagtacagactgagcagctggctgggccagcaggaggacacccacagaatcgtgctgtaccaggtggacggcaccctgaccccctggacccagagatgcgtgagacaggccgactgcatcctgatcgtgggcctgggcgaccaggagcccaccgtgggcgagctggagagaatgctggagagcaccgccgtgagagcccagaagcagctgatcctgctgcacagagaggagggccccgcccccgccagaaccgtggagtggctgaacatgagaagctggtgcagcggccacctgcacctgtgctgccccagaagagtgttcagcagaagaagcctgcccaagctggtggagatgtacaagcacgtgttccagagaccccccgacagacacagcgacttcagcagactggccagagtgctgaccggcaacgccatcgccctggtgctgggcggcggcggcgccagaggctgcgcccaggtgggcgtgctgaaggccctggccgagtgcggcatccccgtggacatggtgggcggcaccagcatcggcgccttcgtgggcgccctgtacagcgaggagagaaactacagccagatgagaatcagagccaagcagtgggccgagggcatgaccagcctgatgaaggccgccctggacctgacctaccccatcaccagcatgttcagcggcgccggcttcaacagcagcatcttcagcgtgttcaaggaccagcagatcgaggacctgtggatcccctacttcgccatcaccaccgacatcaccgccagcgccatgagagtgcacaccgacggcagcctgtggtggtacgtgagagccagcatgagcctgagcggctacatgccccccctgtgcgaccccaaggacggccacctgctgatggacggcggctacatcaacaacctgcccgccgacgtggccagaagcatgggcgccaaggtggtgatcgccatcgacgtgggcagcagagacgagaccgacctgaccaactacggcgacgccctgagcggctggtggctgctgtggaagagatggaaccccctggccaccaaggtgaaggtgctgaacatggccgagatccagaccagactggcctacgtgtgctgcgtgagacagctggaggtggtgaagagcagcgactactgcgagtacctgagaccccccatcgacagctacagcaccctggacttcggcaagttcaacgagatctgcgaggtgggctaccagcacggcagaaccgtgttcgacatctggggcagaagcggcgtgctggagaagatgctgagagaccagcagggccccagcaagaagcccgccagcgccgtgctgacctgccccaacgccagcttcaccgacctggccgagatcgtgagcagaatcgagcccgccaagcccgccatggtggacgacgagagcgactaccagaccgagtacgaggaggagctgctggacgtgcccagagacgcctacgccgacttccagagcaccagcgcccagcagggcagcgacctgtag

SEQ ID NO: 92562 - DNA, 2349 bp, Artificial Sequence
  Description of Artificial Sequence: Synthetic coding sequence
atgagcatcaacctgaccgtggacatctacatctacctgctgagcaacgccagaagcgtgtgcggcaagcagagaagcaagcagctgtacttcctgttcagccccaagcactactggagaatcagccacatcagcctgcagagaggcttccacaccaacatcatcagatgcaagtggaccaagagcgaggcccacagctgcagcaagcactgctacagccccagcaaccacggcctgcacatcggcatcctgaagctgagcaccagcgcccccaagggcctgaccaaggtgaacatctgcatgagcagaatcaagagcaccctgaacagcgtgagcaaggccgtgttcggcaaccagaacgagatgatcagcagactggcccagttcaagcccagcagccagatcctgagaaaggtgagcgacagcggctggctgaagcagaagaacatcaagcaggccatcaagagcctgaagaagtacagcgacaagagcgccgagaagagccccttccccgaggagaagagccacatcatcgacaaggaggaggacatcggcaagagaagcctgttccactacaccagcagcatcaccaccaagttcggcgacagcttctacttcctgagcaaccacatcaacagctacttcaagagaaaggagaagatgagccagcagaaggagaacgagcacttcagagacaagagcgagctggaggacaagaaggtggaggagggcaagctgagaagccccgaccccggcatcctggcctacaagcccggcagcgagagcgtgcacaccgtggacaagcccaccagccccagcgccatccccgacgtgctgcaggtgagcaccaagcagagcatcgccaacttcctgagcagacccaccgagggcgtgcaggccctggtgggcggctacatcggcggcctggtgcccaagctgaagtacgacagcaagagccagagcgaggagcaggaggagcccgccaagaccgaccaggccgtgagcaaggacagaaacgccgaggagaagaagagactgagcctgcagagagagaagatcatcgccagagtgagcatcgacaacagaaccagagccctggtgcaggccctgagaagaaccaccgaccccaagctgtgcatcaccagagtggaggagctgaccttccacctgctggagttccccgagggcaagggcgtggccgtgaaggagagaatcatcccctacctgctgagactgagacagatcaaggacgagaccctgcaggccgccgtgagagagatcctggccctgatcggctacgtggaccccgtgaagggcagaggcatcagaatcctgagcatcgacggcggcggcaccagaggcgtggtggccctgcagaccctgagaaagctggtggagctgacccagaagcccgtgcaccagctgttcgactacatctgcggcgtgagcaccggcgccatcctggccttcatgctgggcctgttccacatgcccctggacgagtgcgaggagctgtacagaaagctgggcagcgacgtgttcagccagaacgtgatcgtgggcaccgtgaagatgagctggagccacgccttctacgacagccagacctgggagaacatcctgaaggacagaatgggcagcgccctgatgatcgagaccgccagaaaccccacctgccccaaggtggccgccgtgagcaccatcgtgaacagaggcatcacccccaaggccttcgtgttcagaaactacggccacttccccggcatcaacagccactacctgggcggctgccagtacaagatgtggcaggccatcagagccagcagcgccgcccccggctacttcgccgagtacgccctgggcaacgacctgcaccaggacggcggcctgctgctgaacaaccccagcgccctggccatgcacgagtgcaagtgcctgtggcccgacgtgcccctggagtgcatcgtgagcctgggcaccggcagatacgagagcgacgtgagaaacaccgtgacctacaccagcctgaagaccaagctgagcaacgtgatcaacagcgccaccgacaccgaggaggtgcacatcatgctggacggcctgctgccccccgacacctacttcagattcaaccccgtgatgtgcgagaacatccccctggacgagagcagaaacgagaagctggaccagctgcagctggagggcctgaagtacatcgagagaaacgagcagaagatgaagaaggtggccaagatcctgagccaggagaagaccaccctgcagaagatcaacgactggatcaagctgaagaccgacatgtacgagggcctgcccttcttcagcaagctgtag

SEQ ID NO: 92563 - DNA, 2163 bp, Artificial Sequence
  Description of Artificial Sequence: Synthetic coding sequence
atgagcatcaacctgaccgtggacatctacatctacctgctgagcaacgccagaagcgtgtgcggcaagcagagaagcaagcagctgtacttcctgttcagccccaagcactactggagaatcagccacatcagcctgcagagaggcttccacaccaacatcatcagatgcaagtggaccaagagcgaggcccacagctgcagcaagcactgctacagccccagcaaccacggcctgcacatcggcatcctgaagctgagcaccagcgcccccaagggcctgaccaaggtgaacatctgcatgagcagaatcaagagcaccctgaacagcgtgagcaaggccgtgttcggcaaccagaacgagatgatcagcagactggcccagttcaagcccagcagccagatcctgagaaaggtgagcgacagcggctggctgaagcagaagaacatcaagcaggccatcaagagcctgaagaagtacagcgacaagagcgccgagaagagccccttccccgaggagaagagccacatcatcgacaaggaggaggacatcggcaagagaagcctgttccactacaccagcagcatcaccaccaagttcggcgacagcttctacttcctgagcaaccacatcaacagctacttcaagagaaaggagaagatgagccagcagaaggagaacgagcacttcagagacaagagcgagctggaggacaagaaggtggaggagggcaagctgagaagccccgaccccggcatcctggcctacaagcccggcagcgagagcgtgcacaccgtggacaagcccaccagccccagcgccatccccgacgtgctgcaggtgagcaccaagcagagcatcgccaacttcctgagcagacccaccgagggcgtgcaggccctggtgggcggctacatcggcggcctggtgcccaagctgaagtacgacagcaagagccagagcgaggagcaggaggagcccgccaagaccgaccaggccgtgagcaaggacagaaacgccgaggagaagaagagactgagcctgcagagagagaagatcatcgccagagtgagcatcgacaacagaaccagagccctggtgcaggccctgagaagaaccaccgaccccaagctgtgcatcaccagagtggaggagctgaccttccacctgctggagttccccgagggcaagggcgtggccgtgaaggagagaatcatcccctacctgctgagactgagacagatcaaggacgagaccctgcaggccgccgtgagagagatcctggccctgatcggctacgtggaccccgtgaagggcagaggcatcagaatcctgagcatcgacggcggcggcaccagaggcgtggtggccctgcagaccctgagaaagctggtggagctgacccagaagcccgtgcaccagctgttcgactacatctgcggcgtgagcaccggcgccatcctggccttcatgctgggcctgttccacatgcccctggacgagtgcgaggagctgtacagaaagctgggcagcgacgtgttcagccagaacgtgatcgtgggcaccgtgaagatgagctggagccacgccttctacgacagccagacctgggagaacatcctgaaggacagaatgggcagcgccctgatgatcgagaccgccagaaaccccacctgccccaaggtgagaaaggacggcggcctgctgctgaacaaccccagcgccctggccatgcacgagtgcaagtgcctgtggcccgacgtgcccctggagtgcatcgtgagcctgggcaccggcagatacgagagcgacgtgagaaacaccgtgacctacaccagcctgaagaccaagctgagcaacgtgatcaacagcgccaccgacaccgaggaggtgcacatcatgctggacggcctgctgccccccgacacctacttcagattcaaccccgtgatgtgcgagaacatccccctggacgagagcagaaacgagaagctggaccagctgcagctggagggcctgaagtacatcgagagaaacgagcagaagatgaagaaggtggccaagatcctgagccaggagaagaccaccctgcagaagatcaacgactggatcaagctgaagaccgacatgtacgagggcctgcccttcttcagcaagctgtag

SEQ ID NO: 92564 - DNA, 168 bp, Artificial Sequence
  Description of Artificial Sequence: Synthetic coding sequence
atgagcatcaacctgaccgtggacatctacatctacctgctgagcaacgccagaagcgtgtgcggcaagcagagaagcaagcagctgtacttcctgttcagccccaagcactactggagaatcagccacatcagcctgcagagaggcttccacaccaacatcatctag

SEQ ID NO: 92565 - DNA, 2349 bp, Artificial Sequence; identical to SEQ ID NO: 92562
  Description of Artificial Sequence: Synthetic coding sequence

SEQ ID NO: 92566 - DNA, 582 bp, Artificial Sequence
  Description of Artificial Sequence: Synthetic coding sequence
atgagcatcaacctgaccgtggacatctacatctacctgctgagcaacgccagaagcgtgtgcggcaagcagagaagcaagcagctgtacttcctgttcagccccaagcactactggagaatcagccacatcagcctgcagagaggcttccacaccaacatcatcagatgcaagtggaccaagagcgaggcccacagctgcagcaagcactgctacagccccagcaaccacggcctgcacatcggcatcctgaagctgagcaccagcgcccccaagggcctgaccaaggtgaacatctgcatgagcagaatcaagagcaccctgaacagcgtgagcaaggccgtgttcggcaaccagaacgagatgatcagcagactggcccagttcaagcccagcagccagatcctgagaaaggtgagcgacagcggctggctgaagcagaagaacatcaagcaggccatcaagagcctgaagaagtacagcgacaagagcgccgagaagagccccttccccgaggagaagagccacatcatcgacaaggaggaggacatcggcaagagaagcctgttccactacacctag

SEQ ID NO: 92567 - DNA, 2349 bp, Artificial Sequence; identical to SEQ ID NO: 92562
  Description of Artificial Sequence: Synthetic coding sequence

SEQ ID NO: 92568 - DNA, 2154 bp, Artificial Sequence
  Description of Artificial Sequence: Synthetic coding sequence
atgagcatcaacctgaccgtggacatctacatctacctgctgagcaacgccagaagcgtgtgcggcaagcagagaagcaagcagctgtacttcctgttcagccccaagcactactggagaatcagccacatcagcctgcagagaggcttccacaccaacatcatcagatgcaagtggaccaagagcgaggcccacagctgcagcaagcactgctacagccccagcaaccacggcctgcacatcggcatcctgaagctgagcaccagcgcccccaagggcctgaccaaggtgaacatctgcatgagcagaatcaagagcaccctgaacagcgtgagcaaggccgtgttcggcaaccagaacgagatgatcagcagactggcccagttcaagcccagcagccagatcctgagaaaggtgagcgacagcggctggctgaagcagaagaacatcaagcaggccatcaagagcctgaagaagtacagcgacaagagcgccgagaagagccccttccccgaggagaagagccacatcatcgacaaggaggaggacatcggcaagagaagcctgttccactacaccagcagcatcaccaccaagttcggcgacagcttctacttcctgagcaaccacatcaacagctacttcaagagaaaggagaagatgagccagcagaaggagaacgagcacttcagagacaagagcgagctggaggacaagaaggtggaggagggcaagctgagaagccccgaccccggcatcctggcctacaagcccggcagcgagagcgtgcacaccgtggacaagcccaccagccccagcgccatccccgacgtgctgcaggtgagcaccaagcagagcatcgccaacttcctgagcagacccaccgagggcgtgcaggccctggtgggcggctacatcggcggcctggtgcccaagctgaagtacgacagcaagagccagagcgaggagcaggaggagcccgccaagaccgaccaggccgtgagcaaggacagaaacgccgaggagaagaagagactgagcctgcagagagagaagatcatcgccagagtgagcatcgacaacagaaccagagccctggtgcaggccctgagaagaaccaccgaccccaagctgtgcatcaccagagtggaggagctgaccttccacctgctggagttccccgagggcaagggcgtggccgtgaaggagagaatcatcccctacctgctgagactgagacagatcaaggacgagaccctgcaggccgccgtgagagagatcctggccctgatcggctacgtggaccccgtgaagggcagaggcatcagaatcctgagcatcgacggcggcggcaccagaggcgtggtggccctgcagaccctgagaaagctggtggagctgacccagaagcccgtgcaccagctgttcgactacatctgcggcgtgagcaccggcgccatcctggccttcatgctgggcctgttccacatgcccctggacgagtgcgaggagctgtacagaaagctgggcagcgacgtgttcagccagaacgtgatcgtgggcaccgtgaagatgagctggagccacgccttctacgacagccagacctgggagaacatcctgaaggacagaatgggcagcgccctgatgatcgagaccgccagaaaccccacctgccccaaggacggcggcctgctgctgaacaaccccagcgccctggccatgcacgagtgcaagtgcctgtggcccgacgtgcccctggagtgcatcgtgagcctgggcaccggcagatacgagagcgacgtgagaaacaccgtgacctacaccagcctgaagaccaagctgagcaacgtgatcaacagcgccaccgacaccgaggaggtgcacatcatgctggacggcctgctgccccccgacacctacttcagattcaaccccgtgatgtgcgagaacatccccctggacgagagcagaaacgagaagctggaccagctgcagctggagggcctgaagtacatcgagagaaacgagcagaagatgaagaaggtggccaagatcctgagccaggagaagaccaccctgcagaagatcaacgactggatcaagctgaagaccgacatgtacgagggcctgcccttcttcagcaagctgtag

SEQ ID NO: 92569 - DNA, 2049 bp, Artificial Sequence
  Description of Artificial Sequence: Synthetic coding sequence
atgagcagaatcaagagcaccctgaacagcgtgagcaaggccgtgttcggcaaccagaacgagatgatcagcagactggcccagttcaagcccagcagccagatcctgagaaaggtgagcgacagcggctggctgaagcagaagaacatcaagcaggccatcaagagcctgaagaagtacagcgacaagagcgccgagaagagccccttccccgaggagaagagccacatcatcgacaaggaggaggacatcggcaagagaagcctgttccactacaccagcagcatcaccaccaagttcggcgacagcttctacttcctgagcaaccacatcaacagctacttcaagagaaaggagaagatgagccagcagaaggagaacgagcacttcagagacaagagcgagctggaggacaagaaggtggaggagggcaagctgagaagccccgaccccggcatcctggcctacaagcccggcagcgagagcgtgcacaccgtggacaagcccaccagccccagcgccatccccgacgtgctgcaggtgagcaccaagcagagcatcgccaacttcctgagcagacccaccgagggcgtgcaggccctggtgggcggctacatcggcggcctggtgcccaagctgaagtacgacagcaagagccagagcgaggagcaggaggagcccgccaagaccgaccaggccgtgagcaaggacagaaacgccgaggagaagaagagactgagcctgcagagagagaagatcatcgccagagtgagcatcgacaacagaaccagagccctggtgcaggccctgagaagaaccaccgaccccaagctgtgcatcaccagagtggaggagctgaccttccacctgctggagttccccgagggcaagggcgtggccgtgaaggagagaatcatcccctacctgctgagactgagacagatcaaggacgagaccctgcaggccgccgtgagagagatcctggccctgatcggctacgtggaccccgtgaagggcagaggcatcagaatcctgagcatcgacggcggcggcaccagaggcgtggtggccctgcagaccctgagaaagctggtggagctgacccagaagcccgtgcaccagctgttcgactacatctgcggcgtgagcaccggcgccatcctggccttcatgctgggcctgttccacatgcccctggacgagtgcgaggagctgtacagaaagctgggcagcgacgtgttcagccagaacgtgatcgtgggcaccgtgaagatgagctggagccacgccttctacgacagccagacctgggagaacatcctgaaggacagaatgggcagcgccctgatgatcgagaccgccagaaaccccacctgccccaaggtggccgccgtgagcaccatcgtgaacagaggcatcacccccaaggccttcgtgttcagaaactacggccacttccccggcatcaacagccactacctgggcggctgccagtacaagatgtggcaggccatcagagccagcagcgccgcccccggctacttcgccgagtacgccctgggcaacgacctgcaccaggacggcggcctgctgctgaacaaccccagcgccctggccatgcacgagtgcaagtgcctgtggcccgacgtgcccctggagtgcatcgtgagcctgggcaccggcagatacgagagcgacgtgagaaacaccgtgacctacaccagcctgaagaccaagctgagcaacgtgatcaacagcgccaccgacaccgaggaggtgcacatcatgctggacggcctgctgccccccgacacctacttcagattcaaccccgtgatgtgcgagaacatccccctggacgagagcagaaacgagaagctggaccagctgcagctggagggcctgaagtacatcgagagaaacgagcagaagatgaagaaggtggccaagatcctgagccaggagaagaccaccctgcagaagatcaacgactggatcaagctgaagaccgacatgtacgagggcctgcccttcttcagcaagctgtag

SEQ ID NO: 92570 - DNA, 3612 bp, Artificial Sequence
  Description of Artificial Sequence: Synthetic coding sequence
atgaccagaagcccccccctgagagagctgccccccagctacaccccccccgccagaaccgccgccccccagatcctggccggcagcctgaaggcccccctgtggctgagagcctacttccagggcctgctgttcagcctgggctgcggcatccagagacactgcggcaaggtgctgttcctgggcctgctggccttcggcgccctggccctgggcctgagaatggccatcatcgagaccaacctggagcagctgtgggtggaggtgggcagcagagtgagccaggagctgcactacaccaaggagaagctgggcgaggaggccgcctacaccagccagatgctgatccagaccgccagacaggagggcgagaacatcctgacccccgaggccctgggcctgcacctgcaggccgccctgaccgccagcaaggtgcaggtgagcctgtacggcaagagctgggacctgaacaagatctgctacaagagcggcgtgcccctgatcgagaacggcatgatcgagagaatgatcgagaagctgttcccctgcgtgatcctgacccccctggactgcttctgggagggcgccaagctgcagggcggcagcgcctacctgcccggcagacccgacatccagtggaccaacctggaccccgagcagctgctggaggagctgggccccttcgccagcctggagggcttcagagagctgctggacaaggcccaggtgggccaggcctacgtgggcagaccctgcctgcaccccgacgacctgcactgcccccccagcgcccccaaccaccacagcagacaggcccccaacgtggcccacgagctgagcggcggctgccacggcttcagccacaagttcatgcactggcaggaggagctgctgctgggcggcatggccagagacccccagggcgagctgctgagagccgaggccctgcagagcaccttcctgctgatgagccccagacagctgtacgagcacttcagaggcgactaccagacccacgacatcggctggagcgaggagcaggccagcaccgtgctgcaggcctggcagagaagattcgtgcagctggcccaggaggccctgcccgagaacgccagccagcagatccacgccttcagcagcaccaccctggacgacatcctgcacgccttcagcgaggtgagcgccgccagagtggtgggcggctacctgctgatgctggcctacgcctgcgtgaccatgctgagatgggactgcgcccagagccagggcagcgtgggcctggccggcgtgctgctggtggccctggccgtggccagcggcctgggcctgtgcgccctgctgggcatcaccttcaacgccgccaccacccaggtgctgcccttcctggccctgggcatcggcgtggacgacgtgttcctgctggcccacgccttcaccgaggccctgcccggcacccccctgcaggagagaatgggcgagtgcctgcagagaaccggcaccagcgtggtgctgaccagcatcaacaacatggccgccttcctgatggccgccctggtgcccatccccgccctgagagccttcagcctgcaggccgccatcgtggtgggctgcaccttcgtggccgtgatgctggtgttccccgccatcctgagcctggacctgagaagaagacactgccagagactggacgtgctgtgctgcttcagcagcccctgcagcgcccaggtgatccagatcctgccccaggagctgggcgacggcaccgtgcccgtgggcatcgcccacctgaccgccaccgtgcaggccttcacccactgcgaggccagcagccagcacgtggtgaccatcctgcccccccaggcccacctggtgcccccccccagcgaccccctgggcagcgagctgttcagccccggcggcagcaccagagacctgctgggccaggaggaggagaccagacagaaggccgcctgcaagagcctgccctgcgccagatggaacctggcccacttcgccagataccagttcgcccccctgctgctgcagagccacgccaaggccatcgtgctggtgctgttcggcgccctgctgggcctgagcctgtacggcgccaccctggtgcaggacggcctggccctgaccgacgtggtgcccagaggcaccaaggagcacgccttcctgagcgcccagctgagatacttcagcctgtacgaggtggccctggtgacccagggcggcttcgactacgcccacagccagagagccctgttcgacctgcaccagagattcagcagcctgaaggccgtgctgcccccccccgccacccaggcccccagaacctggctgcactactacagaaactggctgcagggcatccaggccgccttcgaccaggactgggccagcggcagaatcaccagacacagctacagaaacggcagcgaggacggcgccctggcctacaagctgctgatccagaccggcgacgcccaggagcccctggacttcagccagctgaccaccagaaagctggtggacagagagggcctgatcccccccgagctgttctacatgggcctgaccgtgtgggtgagcagcgaccccctgggcctggccgccagccaggccaacttctacccccccccccccgagtggctgcacgacaagtacgacaccaccggcgagaacctgagaatcccccccgcccagcccctggagttcgcccagttccccttcctgctgagaggcctgcagaagaccgccgacttcgtggaggccatcgagggcgccagagccgcctgcgccgaggccggccaggccggcgtgcacgcctaccccagcggcagccccttcctgttctgggagcagtacctgggcctgagaagatgcttcctgctggccgtgtgcatcctgctggtgtgcaccttcctggtgtgcgccctgctgctgctgaacccctggaccgccggcctgatcgtgctggtgctggccatgatgaccgtggagctgttcggcatcatgggcttcctgggcatcaagctgagcgccatccccgtggtgatcctggtggccagcgtgggcatcggcgtggagttcaccgtgcacgtggccctgggcttcctgaccacccagggcagcagaaacctgagagccgcccacgccctggagcacaccttcgcccccgtgaccgacggcgccatcagcaccctgctgggcctgctgatgctggccggcagccacttcgacttcatcgtgagatacttcttcgccgccctgaccgtgctgaccctgctgggcctgctgcacggcctggtgctgctgcccgtgctgctgagcatcctgggccccccccccgaggtgatccagatgtacaaggagagccccgagatcctgagcccccccgccccccagggcggcggcctgagatggggcgccagcagcagcctgccccagagcttcgccagagtgaccaccagcatgaccgtggccatccaccccccccccctgcccggcgcctacatccaccccgcccccgacgagcccccctggagccccgccgccaccagcagcggcaacctgagcagcagaggccccggccccgccaccggctag

SEQ ID NO: 92571 - DNA, 267 bp, Artificial Sequence
  Description of Artificial Sequence: Synthetic coding sequence
tgattcgacttcatcgtgagatacttcttcgccgccctgaccgtgctgaccctgctgggcctgctgcacggcctggtgctgctgcccgtgctgctgagcatcctgggccccccccccgaggtgatccagatgtacaaggagagccccgagatcctgagcccccccgccccccagggcggcggcctgagagtgggcagcctgcaggtgaacatcagctactggaaggagctgctgtggtgccaggacctgagacccgaggagatctag

SEQ ID NO: 92572 - DNA, 3441 bp, Artificial Sequence
  Description of Artificial Sequence: Synthetic coding sequence
atgaccagaagcccccccctgagagagctgccccccagctacaccccccccgccagaaccgccgccccccagatcctggccggcagcctgaaggcccccctgtggctgagagcctacttccagggcctgctgttcagcctgggctgcggcatccagagacactgcggcaaggtgctgttcctgggcctgctggccttcggcgccctggccctgggcctgagaatggccatcatcgagaccaacctggagcagctgtgggtggaggtgggcagcagagtgagccaggagctgcactacaccaaggagaagctgggcgaggaggccgcctacaccagccagatgctgatccagaccgccagacaggagggcgagaacatcctgacccccgaggccctgggcctgcacctgcaggccgccctgaccgccagcaaggtgcaggtgagcctgtacggcaagagctgggacctgaacaagatctgctacaagagcggcgtgcccctgatcgagaacggcatgatcgagagaatgatcgagaagctgttcccctgcgtgatcctgacccccctggactgcttctgggagggcgccaagctgcagggcggcagcgcctacctgcccggcagacccgacatccagtggaccaacctggaccccgagcagctgctggaggagctgggccccttcgccagcctggagggcttcagagagctgctggacaaggcccaggtgggccaggcctacgtgggcagaccctgcctgcaccccgacgacctgcactgcccccccagcgcccccaaccaccacagcagacaggcccccaacgtggcccacgagctgagcggcggctgccacggcttcagccacaagttcatgcactggcaggaggagctgctgctgggcggcatggccagagacccccagggcgagctgctgagagccgaggccctgcagagcaccttcctgctgatgagccccagacagctgtacgagcacttcagaggcgactaccagacccacgacatcggctggagcgaggagcaggccagcaccgtgctgcaggcctggcagagaagattcgtgcagctggcccaggaggccctgcccgagaacgccagccagcagatccacgccttcagcagcaccaccctggacgacatcctgcacgccttcagcgaggtgagcgccgccagagtggtgggcggctacctgctgatgctggcctacgcctgcgtgaccatgctgagatgggactgcgcccagagccagggcagcgtgggcctggccggcgtgctgctggtggccctggccgtggccagcggcctgggcctgtgcgccctgctgggcatcaccttcaacgccgccaccacccaggtgctgcccttcctggccctgggcatcggcgtggacgacgtgttcctgctggcccacgccttcaccgaggccctgcccggcacccccctgcaggagagaatgggcgagtgcctgcagagaaccggcaccagcgtggtgctgaccagcatcaacaacatggccgccttcctgatggccgccctggtgcccatccccgccctgagagccttcagcctgcaggccgccatcgtggtgggctgcaccttcgtggccgtgatgctggtgttccccgccatcctgagcctggacctgagaagaagacactgccagagactggacgtgctgtgctgcttcagcagcccctgcagcgcccaggtgatccagatcctgccccaggagctgggcgacggcaccgtgcccgtgggcatcgcccacctgaccgccaccgtgcaggccttcacccactgcgaggccagcagccagcacgtggtgaccatcctgcccccccaggcccacctggtgcccccccccagcgaccccctgggcagcgagctgttcagccccggcggcagcaccagagacctgctgggccaggaggaggagaccagacagaaggccgcctgcaagagcctgccctgcgccagatggaacctggcccacttcgccagataccagttcgcccccctgctgctgcagagccacgccaaggccatcgtgctggtgctgttcggcgccctgctgggcctgagcctgtacggcgccaccctggtgcaggacggcctggccctgaccgacgtggtgcccagaggcaccaaggagcacgccttcctgagcgcccagctgagatacttcagcctgtacgaggtggccctggtgacccagggcggcttcgactacgcccacagccagagagccctgttcgacctgcaccagagattcagcagcctgaaggccgtgctgcccccccccgccacccaggcccccagaacctggctgcactactacagaaactggctgcagggcatccaggccgccttcgaccaggactgggccagcggcagaatcaccagacacagctacagaaacggcagcgaggacggcgccctggcctacaagctgctgatccagaccggcgacgcccaggagcccctggacttcagccagctgaccaccagaaagctggtggacagagagggcctgatcccccccgagctgttctacatgggcctgaccgtgtgggtgagcagcgaccccctgggcctggccgccagccaggccaacttctacccccccccccccgagtggctgcacgacaagtacgacaccaccggcgagaacctgagaatcccccccgcccagcccctggagttcgcccagttccccttcctgctgagaggcctgcagaagaccgccgacttcgtggaggccatcgagggcgccagagccgcctgcgccgaggccggccaggccggcgtgcacgcctaccccagcggcagccccttcctgttctgggagcagtacctgggcctgagaagatgcttcctgctggccgtgtgcatcctgctggtgtgcaccttcctggtgtgcgccctgctgctgctgaacccctggaccgccggcctgatcgtgctggtgctggccatgatgaccgtggagctgttcggcatcatgggcttcctgggcatcaagctgagcgccatccccgtggtgatcctggtggccagcgtgggcatcggcgtggagttcaccgtgcacgtggccctgggcttcctgaccacccagggcagcagaaacctgagagccgcccacgccctggagcacaccttcgcccccgtgaccgacggcgccatcagcaccctgctgggcctgctgatgctggccggcagccacttcgacttcatcgtgagatacttcttcgccgccctgaccgtgctgaccctgctgggcctgctgcacggcctggtgctgctgcccgtgctgctgagcatcctgggccccccccccgaggtgatccagatgtacaaggagagccccgagatcctgagcccccccgccccccagggcggcggcctgagacccgaggagatctag

SEQ ID NO: 92573 - DNA, 2667 bp, Artificial Sequence
  Description of Artificial Sequence: Synthetic coding sequence
atgctgagacaggtgctgcacagaggcctgagaacctgcttcagcagactgggccacttcatcgccagccaccccgtgttcttcgccagcgcccccgtgctgatcagcatcctgctgggcgccagcttcagcagataccaggtggaggagagcgtggagcacctgctggccccccagcacagcctggccaagatcgagagaaacctggtgaacagcctgttccccgtgaacagaagcaagcacagactgtacagcgacctgcagacccccggcagatacggcagagtgatcgtgaccagcttccagaaggccaacatgctggaccagcaccacaccgacctgatcctgaagctgcacgccgccgtgaccaagatccaggtgcccagacccggcttcaactacaccttcgcccacatctgcatcctgaacaacgacaagacctgcatcgtggacgacatcgtgcacgtgctggaggagctgaagaacgccagagccaccaacagaaccaacttcgccatcacctaccccatcacccacctgaaggacggcagagccgtgtacaacggccaccagctgggcggcgtgaccgtgcacagcaaggacagagtgaagagcgccgaggccatccagctgacctactacctgcagagcatcaacagcctgaacgacatggtggccgagagatgggagagcagcttctgcgacaccgtgagactgttccagaagagcaacagcaaggtgaagatgtacccctacaccagcagcagcctgagagaggacttccagaagaccagcagagtgagcgagagatacctggtgaccagcctgatcctggtggtgaccatggccatcctgtgctgcagcatgcaggactgcgtgagaagcaagccctggctgggcctgctgggcctggtgaccatcagcctggccaccctgaccgccgccggcatcatcaacctgaccggcggcaagtacaacagcaccttcctgggcgtgcccttcgtgatgctgggccacggcctgtacggcaccttcgagatgctgagcagctggagaaagaccagagaggaccagcacgtgaaggagagaaccgccgccgtgtacgccgacagcatgctgagcttcagcctgaccaccgccatgtacctggtgaccttcggcatcggcgccagccccttcaccaacatcgaggccgccagaatcttctgctgcaacagctgcatcgccatcttcttcaactacctgtacgtgctgagcttctacggcagcagcctggtgttcaccggctacatcgagaacaactaccagcacagcatcttctgcagaaaggtgcccaagcccgaggccctgcaggagaagcccgcctggtacagattcctgctgaccgccagattcagcgaggacaccgccgagggcgaggaggccaacacctacgagagccacctgctggtgtgcttcctgaagagatactactgcgactggatcaccaacacctacgtgaagcccttcgtggtgctgttctacctgatctacatcagcttcgccctgatgggctacctgcaggtgagcgagggcagcgacctgagcaacatcgtggccaccgccacccagaccatcgagtacaccaccgcccagcagaagtacttcagcaactacagccccgtgatcggcttctacatctacgagagcatcgagtactggaacaccagcgtgcaggaggacgtgctggagtacaccaagggcttcgtgagaatcagctggttcgagagctacctgaactacctgagaaagctgaacgtgagcaccggcctgcccaagaagaacttcaccgacatgctgagaaacagcttcctgaaggccccccagttcagccacttccaggaggacatcatcttcagcaagaagtacaacgacgaggtggacgtggtggccagcagaatgttcctggtggccaagaccatggagaccaacagagaggagctgtacgacctgctggagaccctgagaagactgagcgtgaccagcaaggtgaagttcatcgtgttcaaccccagcttcgtgtacatggacagatacgccagcagcctgggcgcccccctgcacaacagctgcatcagcgccctgttcctgctgttcttcagcgccttcctggtggccgacagcctgatcaacgtgtggatcaccctgaccgtggtgagcgtggagttcggcgtgatcggcttcatgaccctgtggaaggtggagctggactgcatcagcgtgctgtgcctgatctacggcatcaactacaccatcgacaactgcgcccccatgctgagcaccttcgtgctgggcaaggacttcaccagaaccaagtgggtgaagaacgccctggaggtgcacggcgtggccatcctgcagagctacctgtgctacatcgtgggcctgatccccctggccgccgtgcccagcaacctgacctgcaccctgttcagatgcctgttcctgatcgccttcgtgaccttcttccactgcttcgccatcctgcccgtgatcctgaccttcctgccccccagcaagaagaagagaaaggagaagaagaaccccgagaacagagaggagatcgagtgcgtggagatggtggacatcgacagcaccagagtggtggaccagatcaccaccgtgtag

SEQ ID NO: 92574 - DNA, 4179 bp, Artificial Sequence
  Description of Artificial Sequence: Synthetic coding sequence
atggacaccgaggacgaccccctgctgcaggacgtgtggctggaggaggagcaggaggaggaggaggccaccggcgagaccttcctgggcgcccagaagcccggcccccagcccggcgccggcggccagtgctgctggagacactggcccctggccagcagaccccccgccagcggcttctggagcaccctgggctgggccttcaccaacccctgctgcgccggcctggtgctgttcctgggctgcagcatccccatggccctgagcgccttcatgttcctgtactacccccccctggacatcgacatcagctacaacgccttcgagatcagaaaccacgaggccagccagagattcgacgccctgaccctggccctgaagagccagttcggcagctggggcagaaacagaagagacctggccgacttcaccagcgagaccctgcagagactgatcagcgagcagctgcagcagctgcacctgggcaacagaagcagacaggccagcagagcccccagagtgatccccgccgccagcctgggcggccccggcccctacagagacaccagcgccgcccagaagcccaccgccaacagaagcggcagactgagaagagagaccccccccctggaggacctggccgccaaccagagcgaggaccccagaaaccagagactgagcaagaacggcagataccagcccagcatccccccccacgccgccgtggccgccaaccagagcagagccagaagaggcgccagcagatgggactacagcagagcctacgtgagcgccaacacccagacccacgcccactggagaatcgagctgatcttcctggccagaggcgacgccgagagaaacatcttcaccagcgagagactggtgaccatccacgagatcgagagaaagatcatggaccaccccggcttcagagagttctgctggaagccccacgaggtgctgaaggacctgcccctgggcagctacagctactgcagcccccccagcagcctgatgacctacttcttccccaccgagagaggcggcaagatctactacgacggcatgggccaggacctggccgacatcagaggcagcctggagctggccatgacccaccccgagttctactggtacgtggacgagggcctgagcgccgacaacctgaagagcagcctgctgagaagcgagatcctgttcggcgcccccctgcccaactactacagcgtggacgacagatgggaggagcagagagccaagttccagagcttcgtggtgacctacgtggccatgctggccaagcagagcaccagcaaggtgcaggtgctgtacggcggcaccgacctgttcgactacgaggtgagaagaaccttcaacaacgacatgctgctggccttcatcagcagcagctgcatcgccgccctggtgtacatcctgaccagctgcagcgtgttcctgagcttcttcggcatcgccagcatcggcctgagctgcctggtggccctgttcctgtaccacgtggtgttcggcatccagtacctgggcatcctgaacggcgtggccgccttcgtgatcgtgggcatcggcgtggacgacgtgttcgtgttcatcaacacctacagacaggccacccacctggaggacccccagctgagaatgatccacaccgtgcagaccgccggcaaggccaccttcttcaccagcctgaccaccgccgccgcctacgccgccaacgtgttcagccagatccccgccgtgcacgacttcggcctgttcatgagcctgatcgtgagctgctgctggctggccgtgctggtgaccatgcccgccgccctgggcctgtggagcctgtacctggcccccctggagagcagctgccagaccagctgccaccagaactgcagcagaaagaccagcctgcacttccccggcgacgtgttcgccgcccccgagcaggtgggcggcagccccgcccagggccccatcccctacctggacgacgacatccccctgctggaggtggaggaggagcccgtgagcctggagctgggcgacgtgagcctggtgagcgtgagccccgagggcctgcagcccgccagcaacaccggcagcagaggccacctgatcgtgcagctgcaggagctgctgcaccactgggtgctgtggagcgccgtgaagagcagatgggtgatcgtgggcctgttcgtgagcatcctgatcctgagcctggtgttcgccagcagactgagacccgccagcagagcccccctgctgttcagacccgacaccaacatccaggtgctgctggacctgaagtacaacctgagcgccgagggcatcagctgcatcacctgcagcggcctgttccaggagaagccccacagcctgcagaacaacatcagaaccagcctggagaagaagagaagaggcagcggcgtgccctgggccagcagacccgaggccaccctgcaggacttccccggcaccgtgtacatcagcaaggtgaagagccagggccaccccgccgtgtacagactgagcctgaacgccagcctgcccgccccctggcaggccgtgagccccggcgacggcgaggtgcccagcttccaggtgtacagagcccccttcggcaacttcaccaagaagctgaccgcctgcatgagcaccgtgggcctgctgcaggccgccagccccagcagaaagtggatgctgaccaccctggcctgcgacgccaagagaggctggaagttcgacttcagcttctacgtggccaccaaggagcagcagcacaccagaaagctgtacttcgcccagagccacaagccccccttccacggcagagtgtgcatggccccccccggctgcctgctgagcagcagccccgacggccccaccaagggcttcttcttcgtgcccagcgagaaggtgcccaaggccagactgagcgccaccttcggcttcaacccctgcgtgaacaccggctgcggcaagcccgccgtgagacccctggtggacaccggcgccatggtgttcgtggtgttcggcatcatcggcgtgaacagaaccagacaggtggacaaccacgtgatcggcgaccccggcagcgtggtgtacgacagcagcttcgacctgttcaaggagatcggccacctgtgccacctgtgcaaggccatcgccgccaacagcgagctggtgaagcccggcggcgcccagtgcctgcccagcggctacagcatcagcagcttcctgcagatgctgcaccccgagtgcaaggagctgcccgagcccaacctgctgcccggccagctgagccacggcgccgtgggcgtgagagagggcagagtgcagtggatcagcatggccttcgagagcaccacctacaagggcaagagcagcttccagacctacagcgactacctgagatgggagagcttcctgcagcagcagctgcaggccctgcccgagggcagcgtgctgagaagaggcttccagacctgcgagcactggaagcagatcttcatggagatcgtgggcgtgcagagcgccctgtgcggcctggtgctgagcctgctgatctgcgtggccgccgtggccgtgttcaccacccacatcctgctgctgctgcccgtgctgctgagcatcctgggcatcgtgtgcctggtggtgaccatcatgtactggagcggctgggagatgggcgccgtggaggccatcagcctgagcatcctggtgggcagcagcgtggactactgcgtgcacctggtggagggctacctgctggccggcgagaacctgcccccccaccaggccgaggacgccagaacccagagacagtggagaaccctggaggccgtgagacacgtgggcgtggccatcgtgagcagcgccctgaccaccgtgatcgccaccgtgcccctgttcttctgcatcatcgcccccttcgccaagttcggcaagatcgtggccctgaacaccggcgtgagcatcctgtacaccctgaccgtgagcaccgccctgctgggcatcatggcccccagcagcttcaccagaaccagaaccagcttcctgaaggccctgggcgccgtgctgctggccggcgccctgggcctgggcgcctgcctggtgctgctgcagagcggctacaagatccccctgcccgccggcgccagcctgtag

SEQ ID NO: 92575 - DNA, 4179 bp, Artificial Sequence
  Description of Artificial Sequence: Synthetic coding sequence
atggacaccgaggacgaccccctgctgcaggacgtgtggctggaggaggagcaggaggaggaggaggccaccggcgagaccttcctgggcgcccagaagcccggcccccagcccggcgccggcggccagtgctgctggagacactggcccctggccagcagaccccccgccagcggcttctggagcaccctgggctgggccttcaccaacccctgctgcgccggcctggtgctgttcctgggctgcagcatccccatggccctgagcgccttcatgttcctgtactacccccccctggacatcgacatcagctacaacgccttcgagatcagaaaccacgaggccagccagagattcgacgccctgaccctggccctgaagagccagttcggcagctggggcagaaacagaagagacctggccgacttcaccagcgagaccctgcagagactgatcagcgagcagctgcagcagctgcacctgggcaacagaagcagacaggccagcagagcccccagagtgatccccgccgccagcctgggcggccccggcccctacagagacaccagcgccgcccagaagcccaccgccaacagaagcggcagactgagaagagagaccccccccctggaggacctggccgccaaccagagcgaggaccccagaaaccagagactgagcaagaacggcagataccagcccagcatccccccccacgccgccgtggccgccaaccagagcagagccagaagaggcgccagcagatgggactacagcagagcctacgtgagcgccaacacccagacccacgcccactggagaatcgagctgatcttcctggccagaggcgacgccgagagaaacatcttcaccagcgagagactggtgaccatccacgagatcgagagaaagatcatggaccaccccggcttcagagagttctgctggaagccccacgaggtgctgaaggacctgcccctgggcagctacagctactgcagcccccccagcagcctgatgacctacttcttccccaccgagagaggcggcaagatctactacgacggcatgggccaggacctggccgacatcagaggcagcctggagctggccatgacccaccccgagttctactggtacgtggacgagggcctgagcgccgacaacctgaagagcagcctgctgagaagcgagatcctgttcggcgcccccctgcccaactactacagcgtggacgacagatgggaggagcagagagccaagttccagagcttcgtggtgacctacgtggccatgctggccaagcagagcaccagcaaggtgcaggtgctgtacggcggcaccgacctgttcgactacgaggtgagaagaaccttcaacaacgacatgctgctggccttcatcagcagcagctgcatcgccgccctggtgtacatcctgaccagctgcagcgtgttcctgagcttcttcggcatcgccagcatcggcctgagctgcctggtggccctgttcctgtaccacgtggtgttcggcatccagtacctgggcatcctgaacggcgtggccgccttcgtgatcgtgggcatcggcgtggacgacgtgttcgtgttcatcaacacctacagacaggccacccacctggaggacccccagctgagaatgatccacaccgtgcagaccgccggcaaggccaccttcttcaccagcctgaccaccgccgccgcctacgccgccaacgtgttcagccagatccccgccgtgcacgacttcggcctgttcatgagcctgatcgtgagctgctgctggctggccgtgctggtgaccatgcccgccgccctgggcctgtggagcctgtacctggcccccctggagagcagctgccagaccagctgccaccagaactgcagcagaaagaccagcctgcacttccccggcgacgtgttcgccgcccccgagcaggtgggcggcagccccgcccagggccccatcccctacctggacgacgacatccccctgctggaggtggaggaggagcccgtgagcctggagctgggcgacgtgagcctggtgagcgtgagccccgagggcctgcagcccgccagcaacaccggcagcagaggccacctgatcgtgcagctgcaggagctgctgcaccactgggtgctgtggagcgccgtgaagagcagatgggtgatcgtgggcctgttcgtgagcatcctgatcctgagcctggtgttcgccagcagactgagacccgccagcagagcccccctgctgttcagacccgacaccaacatccaggtgctgctggacctgaagtacaacctgagcgccgagggcatcagctgcatcacctgcagcggcctgttccaggagaagccccacagcctgcagaacaacatcagaaccagcctggagaagaagagaagaggcagcggcgtgccctgggccagcagacccgaggccaccctgcaggacttccccggcaccgtgtacatcagcaaggtgaagagccagggccaccccgccgtgtacagactgagcctgaacgccagcctgcccgccccctggcaggccgtgagccccggcgacggcgaggtgcccagcttccaggtgtacagagcccccttcggcaacttcaccaagaagctgaccgcctgcatgagcaccgtgggcctgctgcaggccgccagccccagcagaaagtggatgctgaccaccctggcctgcgacgccaagagaggctggaagttcgacttcagcttctacgtggccaccaaggagcagcagcacaccagaaagctgtacttcgcccagagccacaagccccccttccacggcagagtgtgcatggccccccccggctgcctgctgagcagcagccccgacggccccaccaagggcttcttcttcgtgcccagcgagaaggtgcccaaggccagactgagcgccaccttcggcttcaacccctgcgtgaacaccggctgcggcaagcccgccgtgagacccctggtggacaccggcgccatggtgttcgtggtgttcggcatcatcggcgtgaacagaaccagacaggtggacaaccacgtgatcggcgaccccggcagcgtggtgtacgacagcagcttcgacctgttcaaggagatcggccacctgtgccacctgtgcaaggccatcgccgccaacagcgagctggtgaagcccggcggcgcccagtgcctgcccagcggctacagcatcagcagcttcctgcagatgctgcaccccgagtgcaaggagctgcccgagcccaacctgctgcccggccagctgagccacggcgccgtgggcgtgagagagggcagagtgcagtggatcagcatggccttcgagagcaccacctacaagggcaagagcagcttccagacctacagcgactacctgagatgggagagcttcctgcagcagcagctgcaggccctgcccgagggcagcgtgctgagaagaggcttccagacctgcgagcactggaagcagatcttcatggagatcgccggcgtgcagagcgccctgtgcggcctggtgctgagcctgctgatctgcgtggccgccgtggccgtgttcaccacccacatcctgctgctgctgcccgtgctgctgagcatcctgggcatcgtgtgcctggtggtgaccatcatgtactggagcggctgggagatgggcgccgtggaggccatcagcctgagcatcctggtgggcagcagcgtggactactgcgtgcacctggtggagggctacctgctggccggcgagaacctgcccccccaccaggccgaggacgccagaacccagagacagtggagaaccctggaggccgtgagacacgtgggcgtggccatcgtgagcagcgccctgaccaccgtgatcgccaccgtgcccctgttcttctgcatcatcgcccccttcgccaagttcggcaagatcgtggccctgaacaccggcgtgagcatcctgtacaccctgaccgtgagcaccgccctgctgggcatcatggcccccagcagcttcaccagaaccagaaccagcttcctgaaggccctgggcgccgtgctgctggccggcgccctgggcctgggcgcctgcctggtgctgctgcagagcggctacaagatccccctgcccgccggcgccagcctgtag

SEQ ID NO: 92576 - DNA, 2304 bp, Artificial Sequence
  Description of Artificial Sequence: Synthetic coding sequence
atgccctgggtggagcccaagcccagacccggccccgagcagaagcccaagctgaccaagcccgacagcgccaccggcccccagtggtaccaggagagccaggagagcgagagcgagggcaagcagcccccccccggccccctggccccccccaagagccccgagcccagcggccccctggccagcgagcaggacgcccccctgcccgagggcgacgacgccccccccagacccagcatgctggacgacgcccccagactgcccctggagctggacgacgcccccctgcccgaggaggagacccccgagcccaccgccatctgcagacacagacacagatgccacaccgactgcctggagggcctgctgagcagaaccttccagtggctgggctggcaggtgggcgcccacccctggatcttcctgctggcccccctgatgctgaccgccgccctgggcaccggcttcctgtacctgcccaaggacgaggaggaggacctggaggagcactacacccccgtgggcagccccgccaaggccgagagaagattcgtgcagggccacttcaccaccaacgacagctacagattcagcgccagcagaagaagcaccgaggccaacttcgtgagcctgctggtggtgagctacagcgacagcctgctggaccccgccaccttcgccgaggtgagcaagctggacggcgccgtgcaggacctgagagtggccagagagaagggcagccagatccagtaccagcaggtgtgcgccagatacagagccctgtgcgtgccccccaaccccatcctgtacgcctggcaggtgaacaagaccctgaacctgagcagcatcagcttccccgcctacaaccacggcagacaccccctgtacctgaccggcttcttcggcggctacatcctgggcggcagcctgggcatgggccagctgctgctgagagccaaggccatgagactgctgtactacctgaagaccgaggaccccgagtacgacgtgcagagcaagcagtggctgacccacctgctggaccagttcaccaacatcaagaacatcctggccctgaagaagatcgaggtggtgcacttcaccagcctgagcagacagctggagttcgaggccaccagcgtgaccgtgatccccgtgttccacctggcctacatcctgatcatcctgttcgccgtgaccagctgcttcagattcgactgcatcagaaacaagatgtgcgtggccgccttcggcgtgatcagcgccttcctggccgtggtgagcggcttcggcctgctgctgcacatcggcgtgcccttcgtgatcatcgtggccaacagccccttcctgatcctgggcgtgggcgtggacgacatgttcatcatgatcagcgcctggcacaagaccaacctggccgacgacatcagagagagaatgagcaacgtgtacagcaaggccgccgtgagcatcaccatcaccaccatcaccaacatcctggccctgtacaccggcatcatgagcagcttcagaagcgtgcagtgcttctgcatctacaccggcatgaccctgctgttctgctacttctacaacatcacctgcttcggcgccttcatggccctggacggcaagagagaggtggtgtgcctgtgctggctgaagaaggccgaccccaagtggcccagcttcaagaagttctgctgcttccccttcggcagcgtgcccgacgagcacggcaccgacatccaccccatcagcctgttcttcagagactacttcggccccttcctgaccagaagcgagagcaagtacttcgtggtgttcatctacgtgctgtacatcatcagcagcatctacggctgcttccacgtgcaggagggcctggacctgagaaacctggccagcgacgacagctacatcaccccctacttcaacgtggaggagaactacttcagcgactacggccccagagtgatggtgatcgtgaccaagaaggtggactactgggacaaggacgtgagacagaagctggagaactgcaccaagatcttcgagaagaacgtgtacgtggacaagaacctgaccgagttctggctggacgcctacgtgcagtacctgaagggcaacagccaggaccccaacgagaagaacaccttcatgaacaacatccccgacttcctgagcaacttccccaacttccagcacgacatcaacatcagcagcagcaacgagatcatcagcagcagaggcttcatccagaccaccgacgtgagcagcagcgccaagaagaagatcctgctgttctag

SEQ ID NO: 92577 - DNA, 978 bp, Artificial Sequence
  Description of Artificial Sequence: Synthetic coding sequence
atgaccgagagaagaagagacgagctgagcgaggagatcaacaacctgagagagaaggtgatgaagcagagcgaggagaacaacaacctgcagagccaggtgcagaagctgaccgaggagaacaccaccctgagagagcaggtggagcccacccccgaggacgaggacgacgacatcgagctgagaggcgccgccgccgccgccgccccccccccccccatcgaggaggagtgccccgaggacctgcccgagaagttcgacggcaaccccgacatgctggcccccttcatggcccagtgccagatcttcatggagaagagcaccagagacttcagcgtggacagagtgagagtgtgcttcgtgaccagcatgatgaccggcagagccgccagatgggccagcgccaagctggagagaagccactacctgatgcacaactaccccgccttcatgatggagatgaagcacgtgttcgaggacccccagagaagagaggtggccaagagaaagatcagaagactgagacagggcatgggcagcgtgatcgactacagcaacgccttccagatgatcgcccaggacctggactggaacgagcccgccctgatcgaccagtaccacgagggcctgagcgaccacatccaggaggagctgagccacctggaggtggccaagagcctgagcgccctgatcggccagtgcatccacatcgagagaagactggccagagccgccgccgccagaaagcccagaagcccccccagagccctggtgctgccccacatcgccagccaccaccaggtggaccccaccgagcccgtgggcggcgccagaatgagactgacccaggaggagaaggagagaagaagaaagctgaacctgtgcctgtactgcggcaccggcggccactacgccgacaactgccccgccaaggccagcaagagcagccccgccggcaacagccccgcccccctgtag

SEQ ID NO: 92578 - DNA, 978 bp, Artificial Sequence; identical to SEQ ID NO: 92577
  Description of Artificial Sequence: Synthetic coding sequence

SEQ ID NO: 92579 - DNA, 1311 bp, Artificial Sequence
  Description of Artificial Sequence: Synthetic coding sequence
atgatggccacccagaccctgagcatcgacagctaccaggacggccagcagatgcaggtggtgaccgagctgaagaccgagcaggaccccaactgcagcgagcccgacgccgagggcgtgagccccccccccgtggagagccagacccccatggacgtggacaagcaggccatctacagacaccccctgttccccctgctggccctgctgttcgagaagtgcgagcagagcacccagggcagcgagggcaccaccagcgccagcttcgacgtggacatcgagaacttcgtgagaaagcaggagaaggagggcaagcccttcttctgcgaggaccccgagaccgacaacctgatggtgaaggccatccaggtgctgagaatccacctgctggagctggagaaggtgaacgagctgtgcaaggacttctgcagcagatacatcgcctgcctgaagaccaagatgaacagcgagaccctgctgagcggcgagcccggcagcccctacagccccgtgcagagccagcagatccagagcgccatcaccggcaccatcagcccccagggcatcgtggtgcccgccagcgccctgcagcagggcaacgtggccatggccaccgtggccggcggcaccgtgtaccagcccgtgaccgtggtgaccccccagggccaggtggtgacccagaccctgagccccggcaccatcagaatccagaacagccagctgcagctgcagctgaaccaggacctgagcatcctgcaccaggacgacggcagcagcaagaacaagagaggcgtgctgcccaagcacgccaccaacgtgatgagaagctggctgttccagcacatcggccacccctaccccaccgaggacgagaagaagcagatcgccgcccagaccaacctgaccctgctgcaggtgaacaactggttcatcaacgccagaagaagaatcctgcagcccatgctggacagcagctgcagcgagacccccaagaccaagaagaagaccgcccagaacagacccgtgcagagattctggcccgacagcatcgccagcggcgtggcccagcccccccccagcgagctgaccatgagcgagggcgccgtggtgaccatcaccacccccgtgaacatgaacgtggacagcctgcagagcctgagcagcgacggcgccaccctggccgtgcagcaggtgatgatggccggccagagcgaggacgagagcgtggacagcaccgaggaggacgccggcgccctggcccccgcccacatcagcggcctggtgctggagaacagcgacagcctgcagtag

SEQ ID NO: 92580 - DNA, 960 bp, Artificial Sequence
  Description of Artificial Sequence: Synthetic coding sequence
atggtgaaggccatccaggtgctgagaatccacctgctggagctggagaaggtgaacgagctgtgcaaggacttctgcagcagatacatcgcctgcctgaagaccaagatgaacagcgagaccctgctgagcggcgagcccggcagcccctacagccccgtgcagagccagcagatccagagcgccatcaccggcaccatcagcccccagggcatcgtggtgcccgccagcgccctgcagcagggcaacgtggccatggccaccgtggccggcggcaccgtgtaccagcccgtgaccgtggtgaccccccagggccaggtggtgacccagaccctgagccccggcaccatcagaatccagaacagccagctgcagctgcagctgaaccaggacctgagcatcctgcaccaggacgacggcagcagcaagaacaagagaggcgtgctgcccaagcacgccaccaacgtgatgagaagctggctgttccagcacatcggccacccctaccccaccgaggacgagaagaagcagatcgccgcccagaccaacctgaccctgctgcaggtgaacaactggttcatcaacgccagaagaagaatcctgcagcccatgctggacagcagctgcagcgagacccccaagaccaagaagaagaccgcccagaacagacccgtgcagagattctggcccgacagcatcgccagcggcgtggcccagcccccccccagcgagctgaccatgagcgagggcgccgtggtgaccatcaccacccccgtgaacatgaacgtggacagcctgcagagcctgagcagcgacggcgccaccctggccgtgcagcaggtgatgatggccggccagagcgaggacgagagcgtggacagcaccgaggaggacgccggcgccctggcccccgcccacatcagcggcctggtgctggagaacagcgacagcctgcagtag

SEQ ID NO: 92581 - DNA, 1260 bp, Artificial Sequence
  Description of Artificial Sequence: Synthetic coding sequence
atgatggccacccagaccctgagcatcgacagctaccaggacggccagcagatgcaggtggtgaccgagctgaagaccgagcaggaccccaactgcagcgagcccgacgccgagggcgtgagccccccccccgtggagagccagacccccatggacgtggacaagcaggccatctacagacaccccctgttccccctgctggccctgctgttcgagaagtgcgagcagagcacccagggcagcgagggcaccaccagcgccagcttcgacgtggacatcgagaacttcgtgagaaagcaggagaaggagggcaagcccttcttctgcgaggaccccgagaccgacaacctgatggtgaaggccatccaggtgctgagaatccacctgctggagctggagaaggtgaacgagctgtgcaaggacttctgcagcagatacatcgcctgcctgaagaccaagatgaacagcgagaccctgctgagcggcgagcccggcagcccctacagccccgtgcagagccagcagatccagagcgccatcaccggcaccatcagcccccagggcatcgtggtgcccgccagcgccctgcagcagggcaacgtggccatggccaccgtggccggcggcaccgtgtaccagcccgtgaccgtggtgaccccccagggccaggtggtgacccagaccctgagccccggcaccatcagaatccagaacagccagctgcagctgcagctgaaccaggacctgagcatcctgcaccaggacgacggcagcagcaagaacaagagaggcgtgctgcccaagcacgccaccaacgtgatgagaagctggctgttccagcacatcggccacccctaccccaccgaggacgagaagaagcagatcgccgcccagaccaacctgaccctgctgcaggtgaacaactggttcatcaacgccagaagaagaatcctgcagcccatgctggacagcagctgcagcgagacccccaagaccaagaagaagaccgcccagaacagacccgtgcagagattctggcccgacagcatcgccagcggcgtggcccagcccccccccagcgagctgaccatgagcgagggcaccggcggcagacccagacccgacatggtggaccacggcgtgggcatcatgaacaagagacccggcagcggcctgctggccccccccagacccgccgagaacgacatcctgaagccccccctgagaagcagcttcgtgaactgcctgctgatcttctag

SEQ ID NO: 92582 - DNA, 1419 bp, Artificial Sequence
  Description of Artificial Sequence: Synthetic coding sequence
atgatgcagcacgccagccccgcccccgccctgaccatgatggccacccagaacgtgcccccccccccctaccaggacagcccccagatgaccgccaccgcccagccccccagcaaggcccaggccgtgcacatcagcgcccccagcgccgccgccagcacccccgtgcccagcgcccccatcgacccccaggcccagctggaggccgacaagagagccgtgtacagacaccccctgttccccctgctgaccctgctgttcgagaagtgcgagcaggccacccagggcagcgagtgcatcaccagcgccagcttcgacgtggacatcgagaacttcgtgcaccagcaggagcaggagcacaagcccttcttcagcgacgaccccgagctggacaacctgatggtgaaggccatccaggtgctgagaatccacctgctggagctggagaaggtgaacgagctgtgcaaggacttctgcaacagatacatcacctgcctgaagaccaagatgcacagcgacaacctgctgagaaacgacctgggcggcccctacagccccaaccagcccagcatcaacctgcacagccaggacctgctgcagaacagccccaacagcatgagcggcgtgagcaacaacccccagggcatcgtggtgcccgccagcgccctgcagcagggcaacatcgccatgaccaccgtgaacagccaggtggtgagcggcggcgccctgtaccagcccgtgaccatggtgaccagccagggccaggtggtgacccaggccatcccccagggcgccatccagatccagaacacccaggtgaacctggacctgaccagcctgctggacaacgaggacaagaagagcaagaacaagagaggcgtgctgcccaagcacgccaccaacatcatgagaagctggctgttccagcacctgatgcacccctaccccaccgaggacgagaagagacagatcgccgcccagaccaacctgaccctgctgcaggtgaacaactggttcatcaacgccagaagaagaatcctgcagcccatgctggacgccagcaaccccgaccccgcccccaaggccaagaagatcaagagccagcacagacccacccagagattctggcccaacagcatcgccgccggcgtgctgcagcagcagggcggcgcccccggcaccaaccccgacggcagcatcaacctggacaacctgcagagcctgagcagcgacagcgccaccatggccatgcagcaggccatgatggccgcccacgacgacagcctggacggcaccgaggaggaggacgaggacgagatggaggaggaggaggaggaggagctggaggaggaggtggacgagctgcagaccaccaacgtgagcgacctgggcctggagcacagcgacagcctggagtag

SEQ ID NO: 92583 - DNA, 120 bp, Artificial Sequence
  Description of Artificial Sequence: Synthetic coding sequence
atgatgcagcacgccagccccgcccccgccctgaccatgatggccacccagaacgtgcccccccccccctaccaggacagcccccagatgaccgccaccgcccagccccccagcaagtag

SEQ ID NO: 92584 - DNA, 1332 bp, Artificial Sequence
  Description of Artificial Sequence: Synthetic coding sequence
atgaccgccaccgcccagccccccagcaaggcccaggccgtgcacatcagcgcccccagcgccgccgccagcacccccgtgcccagcgcccccatcgacccccaggcccagctggaggccgacaagagagccgtgtacagacaccccctgttccccctgctgaccctgctgttcgagaagtgcgagcaggccacccagggcagcgagtgcatcaccagcgccagcttcgacgtggacatcgagaacttcgtgcaccagcaggagcaggagcacaagcccttcttcagcgacgaccccgagctggacaacctgatggtgaaggccatccaggtgctgagaatccacctgctggagctggagaaggtgaacgagctgtgcaaggacttctgcaacagatacatcacctgcctgaagaccaagatgcacagcgacaacctgctgagaaacgacctgggcggcccctacagccccaaccagcccagcatcaacctgcacagccaggacctgctgcagaacagccccaacagcatgagcggcgtgagcaacaacccccagggcatcgtggtgcccgccagcgccctgcagcagggcaacatcgccatgaccaccgtgaacagccaggtggtgagcggcggcgccctgtaccagcccgtgaccatggtgaccagccagggccaggtggtgacccaggccatcccccagggcgccatccagatccagaacacccaggtgaacctggacctgaccagcctgctggacaacgaggacaagaagagcaagaacaagagaggcgtgctgcccaagcacgccaccaacatcatgagaagctggctgttccagcacctgatgcacccctaccccaccgaggacgagaagagacagatcgccgcccagaccaacctgaccctgctgcaggtgaacaactggttcatcaacgccagaagaagaatcctgcagcccatgctggacgccagcaaccccgaccccgcccccaaggccaagaagatcaagagccagcacagacccacccagagattctggcccaacagcatcgccgccggcgtgctgcagcagcagggcggcgcccccggcaccaaccccgacggcagcatcaacctggacaacctgcagagcctgagcagcgacagcgccaccatggccatgcagcaggccatgatggccgcccacgacgacagcctggacggcaccgaggaggaggacgaggacgagatggaggaggaggaggaggaggagctggaggaggaggtggacgagctgcagaccaccaacgtgagcgacctgggcctggagcacagcgacagcctggagtag

SEQ ID NO: 92585 - DNA, 1332 bp, Artificial Sequence; identical to SEQ ID NO: 92584
  Description of Artificial Sequence: Synthetic coding sequence

SEQ ID NO: 92586 - DNA, 123 bp, Artificial Sequence
  Description of Artificial Sequence: Synthetic coding sequence
atgatgcagcacgccagccccgcccccgccctgaccatgatggccacccagaacgtgcccccccccccctaccaggacagcccccagatgaccgccaccgcccagccccccagcaaggcctag

SEQ ID NO: 92587 - DNA, 921 bp, Artificial Sequence
  Description of Artificial Sequence: Synthetic coding sequence
atgatggccacccagaacgtgcccccccccccctaccaggacagcccccagatgaccgccaccgcccagccccccagcaaggcccaggccgtgcacatcagcgcccccagcgccgccgccagcacccccgtgcccagcgcccccatcgacccccaggcccagctggaggccgacaagagagccgtgtacagacaccccctgttccccctgctgaccctgctgttcgagaagtgcgagcaggccacccagggcagcgagtgcatcaccagcgccagcttcgacgtggacatcgagaacttcgtgcaccagcaggagcaggagcacaagcccttcttcagcgacgaccccgagctggacaacctgatggtgaaggccatccaggtgctgagaatccacctgctggagctggagaaggtgaacgagctgtgcaaggacttctgcaacagatacatcacctgcctgaagaccaagatgcacagcgacaacctgctgagaaacgacctgggcggcccctacagccccaaccagcccagcatcaacctgcacagccaggacctgctgcagaacagccccaacagcatgagcggcgtgagcaacaacccccagggcatcgtggtgcccgccagcgccctgcagcagggcaacatcgccatgaccaccgtgaacagccaggtggtgagcggcggcgccctgtaccagcccgtgaccatggtgaccagccagggccaggtggtgacccaggccatcccccagggcgccatccagatccagaacacccaggtgaacctggacctgaccagcctgctggacaacgaggacaagaagagcaagaacaagagaggcgtgctgcccaagcacgccaccaacatcatgagaagctggctgttccagcaccacgcccccctgccccacggcggctag

SEQ ID NO: 92588 - DNA, 1227 bp, Artificial Sequence
  Description of Artificial Sequence: Synthetic coding sequence
atgagcagaccccaccccaccagaaccgcccacagacaccccctgttccccctgctgaccctgctgttcgagaagtgcgagcaggccacccagggcagcgagtgcatcaccagcgccagcttcgacgtggacatcgagaacttcgtgcaccagcaggagcaggagcacaagcccttcttcagcgacgaccccgagctggacaacctgatggtgaaggccatccaggtgctgagaatccacctgctggagctggagaaggtgaacgagctgtgcaaggacttctgcaacagatacatcacctgcctgaagaccaagatgcacagcgacaacctgctgagaaacgacctgggcggcccctacagccccaaccagcccagcatcaacctgcacagccaggacctgctgcagaacagccccaacagcatgagcggcgtgagcaacaacccccagggcatcgtggtgcccgccagcgccctgcagcagggcaacatcgccatgaccaccgtgaacagccaggtggtgagcggcggcgccctgtaccagcccgtgaccatggtgaccagccagggccaggtggtgacccaggccatcccccagggcgccatccagatccagaacacccaggtgaacctggacctgaccagcctgctggacaacgaggacaagaagagcaagaacaagagaggcgtgctgcccaagcacgccaccaacatcatgagaagctggctgttccagcacctgatgcacccctaccccaccgaggacgagaagagacagatcgccgcccagaccaacctgaccctgctgcaggtgaacaactggttcatcaacgccagaagaagaatcctgcagcccatgctggacgccagcaaccccgaccccgcccccaaggccaagaagatcaagagccagcacagacccacccagagattctggcccaacagcatcgccgccggcgtgctgcagcagcagggcggcgcccccggcaccaaccccgacggcagcatcaacctggacaacctgcagagcctgagcagcgacagcgccaccatggccatgcagcaggccatgatggccgcccacgacgacagcctggacggcaccgaggaggaggacgaggacgagatggaggaggaggaggaggaggagctggaggaggaggtggacgagctgcagaccaccaacgtgagcgacctgggcctggagcacagcgacagcctggagtag

SEQ ID NO: 92589 - DNA, 297 bp, Artificial Sequence
  Description of Artificial Sequence: Synthetic coding sequence
atgatgcagcacgccagccccgcccccgccctgaccatgatggccacccagaacgtgcccccccccccctaccaggacagcccccagatgaccgccaccgcccagccccccagcaaggcccaggccgtgcacatcagcgcccccagcgccgccgccagcacccccgtgcccagcgcccccatcgacccccaggcccagctggaggccgacaagagagccgtgtacagacaccccctgttccccctgctgaccctgctgttcgagaagtgcgagcaggccacccagggcagcgagtag

SEQ ID NO: 92590 - DNA, 234 bp, Artificial Sequence
  Description of Artificial Sequence: Synthetic coding sequence
atgatgcagcacgccagccccgcccccgccctgaccatgatggccacccagaacgtgcccccccccccctaccaggacagcccccagatgaccgccaccgcccagccccccagcaaggcccaggccgtgcacatcagcgcccccagcgccgccgccagcacccccgtgcccagcgcccccatcgacccccaggcccagctggaggccgacaagagagccgtgtacagatggtag

SEQ ID NO: 92591 - DNA, 990 bp, Artificial Sequence
  Description of Artificial Sequence: Synthetic coding sequence
atgaccagagacttcaagcccggcgacctgatcttcgccaagatgaagggctacccccactggcccgccagagtggacgaggtgcccgacggcgccgtgaagccccccaccaacaagctgcccatcttcttcttcggcacccacgagaccgccttcctgggccccaaggacatcttcccctacagcgagaacaaggagaagtacggcaagcccaacaagagaaagggcttcaacgagggcctgtgggagatcgacaacaaccccaaggtgaagttcagcagccagcaggccgccaccaagcagagcaacgccagcagcgacgtggaggtggaggagaaggagaccagcgtgagcaaggaggacaccgaccacgaggagaaggccagcaacgaggacgtgaccaaggccgtggacatcaccacccccaaggccgccagaagaggcagaaagagaaaggccgagaagcaggtggagaccgaggaggccggcgtggtgaccaccgccaccgccagcgtgaacctgaaggtgagccccaagagaggcagacccgccgccaccgaggtgaagatccccaagcccagaggcagacccaagatggtgaagcagccctgccccagcgagagcgacatcatcaccgaggaggacaagagcaagaagaagggccaggaggagaagcagcccaagaagcagcccaagaaggacgaggagggccagaaggaggaggacaagcccagaaaggagcccgacaagaaggagggcaagaaggaggtggagagcaagagaaagaacctggccaagaccggcgtgaccagcaccagcgacagcgaggaggagggcgacgaccaggagggcgagaagaagagaaagggcggcagaaacttccagaccgcccacagaagaaacatgctgaagggccagcacgagaaggaggccgccgacagaaagagaaagcaggaggagcagatggagaccgagcacttcgccctgtag

SEQ ID NO: 92592 - DNA, 1002 bp, Artificial Sequence
  Description of Artificial Sequence: Synthetic coding sequence
atgaccagagacttcaagcccggcgacctgatcttcgccaagatgaagggctacccccactggcccgccagagtggacgaggtgcccgacggcgccgtgaagccccccaccaacaagctgcccatcttcttcttcggcacccacgagaccgccttcctgggccccaaggacatcttcccctacagcgagaacaaggagaagtacggcaagcccaacaagagaaagggcttcaacgagggcctgtgggagatcgacaacaaccccaaggtgaagttcagcagccagcaggccgccaccaagcagagcaacgccagcagcgacgtggaggtggaggagaaggagaccagcgtgagcaaggaggacaccgaccacgaggagaaggccagcaacgaggacgtgaccaaggccgtggacatcaccacccccaaggccgccagaagaggcagaaagagaaaggccgagaagcaggtggagaccgaggaggccggcgtggtgaccaccgccaccgccagcgtgaacctgaaggtgagccccaagagaggcagacccgccgccaccgaggtgaagatccccaagcccagaggcagacccaagatggtgaagcagccctgccccagcgagagcgacatcatcaccgaggaggacaagagcaagaagaagggccaggaggagaagcagcccaagaagcagcccaagaaggacgaggagggccagaaggaggaggacaagcccagaaaggagcccgacaagaaggagggcaagaaggaggtggagagcaagagaaagaacctggccaagaccggcgtgaccagcaccagcgacagcgaggaggagggcgacgaccaggagggcgagaagaagagaaagggcggcagaaacttccagaccgcccacagaagaaacatgctgaagggccagcacgagaaggaggccgccgacagaaagagaaagcaggaggagcagatggagaccgagcaccagaccacctgcaacctgcagtag

SEQ ID NO: 92593 - DNA, 1593 bp, Artificial Sequence
  Description of Artificial Sequence: Synthetic coding sequence
atgaccagagacttcaagcccggcgacctgatcttcgccaagatgaagggctacccccactggcccgccagagtggacgaggtgcccgacggcgccgtgaagccccccaccaacaagctgcccatcttcttcttcggcacccacgagaccgccttcctgggccccaaggacatcttcccctacagcgagaacaaggagaagtacggcaagcccaacaagagaaagggcttcaacgagggcctgtgggagatcgacaacaaccccaaggtgaagttcagcagccagcaggccgccaccaagcagagcaacgccagcagcgacgtggaggtggaggagaaggagaccagcgtgagcaaggaggacaccgaccacgaggagaaggccagcaacgaggacgtgaccaaggccgtggacatcaccacccccaaggccgccagaagaggcagaaagagaaaggccgagaagcaggtggagaccgaggaggccggcgtggtgaccaccgccaccgccagcgtgaacctgaaggtgagccccaagagaggcagacccgccgccaccgaggtgaagatccccaagcccagaggcagacccaagatggtgaagcagccctgccccagcgagagcgacatcatcaccgaggaggacaagagcaagaagaagggccaggaggagaagcagcccaagaagcagcccaagaaggacgaggagggccagaaggaggaggacaagcccagaaaggagcccgacaagaaggagggcaagaaggaggtggagagcaagagaaagaacctggccaagaccggcgtgaccagcaccagcgacagcgaggaggagggcgacgaccaggagggcgagaagaagagaaagggcggcagaaacttccagaccgcccacagaagaaacatgctgaagggccagcacgagaaggaggccgccgacagaaagagaaagcaggaggagcagatggagaccgagcagcagaacaaggacgagggcaagaagcccgaggtgaagaaggtggagaagaagagagagaccagcatggacagcagactgcagagaatccacgccgagatcaagaacagcctgaagatcgacaacctggacgtgaacagatgcatcgaggccctggacgagctggccagcctgcaggtgaccatgcagcaggcccagaagcacaccgagatgatcaccaccctgaagaagatcagaagattcaaggtgagccaggtgatcatggagaagagcaccatgctgtacaacaagttcaagaacatgttcctggtgggcgagggcgacagcgtgatcacccaggtgctgaacaagagcctggccgagcagagacagcacgaggaggccaacaagaccaaggaccagggcaagaagggccccaacaagaagctggagaaggagcagaccggcagcaagaccctgaacggcggcagcgacgcccaggacggcaaccagccccagcacaacggcgagagcaacgaggacagcaaggacaaccacgaggccagcaccaagaagaagcccagcagcgaggagagagagaccgagatcagcctgaaggacagcaccctggacaactag

SEQ ID NO: 92594 - DNA, 1593 bp, Artificial Sequence; identical to SEQ ID NO: 92593
  Description of Artificial Sequence: Synthetic coding sequence

SEQ ID NO: 92595 - DNA, 1002 bp, Artificial Sequence; identical to SEQ ID NO: 92592
  Description of Artificial Sequence: Synthetic coding sequence

SEQ ID NO: 92596 - DNA, 1362 bp, Artificial Sequence
  Description of Artificial Sequence: Synthetic coding sequence
atggcccacatcaccatcaaccagtacctgcagcaggtgtacgaggccatcgacagcagagacggcgccagctgcgccgagctggtgagcttcaagcacccccacgtggccaaccccagactgcagatggccagccccgaggagaagtgccagcaggtgctggagcccccctacgacgagatgttcgccgcccacctgagatgcacctacgccgtgggcaaccacgacttcatcgaggcctacaagtgccagaccgtgatcgtgcagtaccccctgagcttcatggccgccgtgccccacagaacccacgccgtggactacctgggcctggagaccagaaagcactgggccagctgcagcttcctgcagctggagagaaacgacagcgtgctggagcagaagctggtgagcgccctgagcctgggcaccagcttcctgagagccttccaggcccacaaggaggagaactgggccctgcccgtgatgtacgccgtggccctggacctgagagtgttcgccaacaacgccgaccagcagctggtgaagaagggcaagagcaaggtgggcgacatgctggagaaggccgccgagctgctgatgagctgcttcagagtgtgcgccagcgacaccagagccggcatcgaggacagcaagaagtggggcatgctgttcctggtgaaccagctgttcaagatctacttcaagatcaacaagctgcacctgtgcaagcccctgatcagagccatcgacagcagcaacctgaaggacgactacagcaccgcccagagagtgacctacaagtactacgtgggcagaaaggccatgttcgacagcgacttcaagcaggccgaggagtacctgagcttcgccttcgagcactgccacagaagcagccagaagaacaagagaatgatcctgatctacctgctgcccgtgaagatgctgctgggccacatgcccaccgtggagctgctgaagaagtaccacctgatgcagttcgccgaggtgaccagagccgtgagcgagggcaacctgctgctgctgcacgaggccctggccaagcacgaggccttcttcatcagatgcggcatcttcctgatcctggagaagctgaagatcatcacctacagaaacctgttcaagaaggtgtacctgctgctgaagacccaccagctgagcctggacgccttcctggtggccctgaagttcatgcaggtggaggacgtggacatcgacgaggtgcagtgcatcctggccaacctgatctacatgggccacgtgaagggctacatcagccaccagcaccagaagctggtggtgagcaagcagaaccccttcccccccctgagcaccgtgtgctag

SEQ ID NO: 92597 - DNA, 1200 bp, Artificial Sequence
  Description of Artificial Sequence: Synthetic coding sequence
atgagactgaccgacgtggtgcagcagctggtgtacgaggccatcgacagcagagacggcgccagctgcgccgagctggtgagcttcaagcacccccacgtggccaaccccagactgcagatggccagccccgaggagaagtgccagcaggtgctggagcccccctacgacgagatgttcgccgcccacctgagatgcacctacgccgtgggcaaccacgacttcatcgaggcctacaagtgccagaccgtgatcgtgcagtacaccagcttcctgagagccttccaggcccacaaggaggagaactgggccctgcccgtgatgtacgccgtggccctggacctgagagtgttcgccaacaacgccgaccagcagctggtgaagaagggcaagagcaaggtgggcgacatgctggagaaggccgccgagctgctgatgagctgcttcagagtgtgcgccagcgacaccagagccggcatcgaggacagcaagaagtggggcatgctgttcctggtgaaccagctgttcaagatctacttcaagatcaacaagctgcacctgtgcaagcccctgatcagagccatcgacagcagcaacctgaaggacgactacagcaccgcccagagagtgacctacaagtactacgtgggcagaaaggccatgttcgacagcgacttcaagcaggccgaggagtacctgagcttcgccttcgagcactgccacagaagcagccagaagaacaagagaatgatcctgatctacctgctgcccgtgaagatgctgctgggccacatgcccaccgtggagctgctgaagaagtaccacctgatgcagttcgccgaggtgaccagagccgtgagcgagggcaacctgctgctgctgcacgaggccctggccaagcacgaggccttcttcatcagatgcggcatcttcctgatcctggagaagctgaagatcatcacctacagaaacctgttcaagaaggtgtacctgctgctgaagacccaccagctgagcctggacgccttcctggtggccctgaagttcatgcaggtggaggacgtggacatcgacgaggtgcagtgcatcctggccaacctgatctacatgggccacgtgaagggctacatcagccaccagcaccagaagctggtggtgagcaagcagaaccccttcccccccctgagcaccgtgtgctag

SEQ ID NO: 92598 - DNA, 1200 bp, Artificial Sequence
  Description of Artificial Sequence: Synthetic coding sequence
atggcccacatcaccatcaaccagtacctgcagcaggtgtacgaggccatcgacagcagagacggcgccagctgcgccgagctggtgagcttcaagcacccccacgtggccaaccccagactgcagatggccagccccgaggagaagtgccagcaggtgctggagcccccctacgacgagatgttcgccgcccacctgagatgcacctacgccgtgggcaaccacgacttcatcgaggcctacaagtgccagaccgtgatcgtgcagagcttcctgagagccttccaggcccacaaggaggagaactgggccctgcccgtgatgtacgccgtggccctggacctgagagtgttcgccaacaacgccgaccagcagctggtgaagaagggcaagagcaaggtgggcgacatgctggagaaggccgccgagctgctgatgagctgcttcagagtgtgcgccagcgacaccagagccggcatcgaggacagcaagaagtggggcatgctgttcctggtgaaccagctgttcaagatctacttcaagatcaacaagctgcacctgtgcaagcccctgatcagagccatcgacagcagcaacctgaaggacgactacagcaccgcccagagagtgacctacaagtactacgtgggcagaaaggccatgttcgacagcgacttcaagcaggccgaggagtacctgagcttcgccttcgagcactgccacagaagcagccagaagaacaagagaatgatcctgatctacctgctgcccgtgaagatgctgctgggccacatgcccaccgtggagctgctgaagaagtaccacctgatgcagttcgccgaggtgaccagagccgtgagcgagggcaacctgctgctgctgcacgaggccctggccaagcacgaggccttcttcatcagatgcggcatcttcctgatcctggagaagctgaagatcatcacctacagaaacctgttcaagaaggtgtacctgctgctgaagacccaccagctgagcctggacgccttcctggtggccctgaagttcatgcaggtggaggacgtggacatcgacgaggtgcagtgcatcctggccaacctgatctacatgggccacgtgaagggctacatcagccaccagcaccagaagctggtggtgagcaagcagaaccccttcccccccctgagcaccgtgtgctag

SEQ ID NO: 92599 - DNA, 1131 bp, Artificial Sequence
  Description of Artificial Sequence: Synthetic coding sequence
atggcccacatcaccatcaaccagtacctgcagcaggtgtacgaggccatcgacagcagagacggcgccagctgcgccgagctggtgagcttcaagcacccccacgtggccaaccccagactgcagatggccagccccgaggagaagtgccagcaggtgctggagcccccctacgacgagatgttcgccgcccacctgagatgcacctacgccgtgggcaaccacgacttcatcgaggcctacaagtgccagaccgtgatcgtgcagtaccccctgagcttcatggccgccgtggccgaccagcagctggtgaagaagggcaagagcaaggtgggcgacatgctggagaaggccgccgagctgctgatgagctgcttcagagtgtgcgccagcgacaccagagccggcatcgaggacagcaagaagtggggcatgctgttcctggtgaaccagctgttcaagatctacttcaagatcaacaagctgcacctgtgcaagcccctgatcagagccatcgacagcagcaacctgaaggacgactacagcaccgcccagagagtgacctacaagtactacgtgggcagaaaggccatgttcgacagcgacttcaagcaggccgaggagtacctgagcttcgccttcgagcactgccacagaagcagccagaagaacaagagaatgatcctgatctacctgctgcccgtgaagatgctgctgggccacatgcccaccgtggagctgctgaagaagtaccacctgatgcagttcgccgaggtgaccagagccgtgagcgagggcaacctgctgctgctgcacgaggccctggccaagcacgaggccttcttcatcagatgcggcatcttcctgatcctggagaagctgaagatcatcacctacagaaacctgttcaagaaggtgtacctgctgctgaagacccaccagctgagcctggacgccttcctggtggccctgaagttcatgcaggtggaggacgtggacatcgacgaggtgcagtgcatcctggccaacctgatctacatgggccacgtgaagggctacatcagccaccagcaccagaagctggtggtgagcaagcagaaccccttcccccccctgagcaccgtgtgctag

SEQ ID NO: 92600 - DNA, 1200 bp, Artificial Sequence; identical to SEQ ID NO: 92598
  Description of Artificial Sequence: Synthetic coding sequence

SEQ ID NO: 92601 - DNA, 1200 bp, Artificial Sequence; identical to SEQ ID NO: 92598
  Description of Artificial Sequence: Synthetic coding sequence

SEQ ID NO: 92602 - DNA, 1194 bp, Artificial Sequence
  Description of Artificial Sequence: Synthetic coding sequence
atgagactgaccgacgtggtgcagcagctggtgtacgaggccatcgacagcagagacggcgccagctgcgccgagctggtgagcttcaagcacccccacgtggccaaccccagactgcagatggccagccccgaggagaagtgccagcaggtgctggagcccccctacgacgagatgttcgccgcccacctgagatgcacctacgccgtgggcaaccacgacttcatcgaggcctacaagtgccagaccgtgatcgtgcagagcttcctgagagccttccaggcccacaaggaggagaactgggccctgcccgtgatgtacgccgtggccctggacctgagagtgttcgccaacaacgccgaccagcagctggtgaagaagggcaagagcaaggtgggcgacatgctggagaaggccgccgagctgctgatgagctgcttcagagtgtgcgccagcgacaccagagccggcatcgaggacagcaagaagtggggcatgctgttcctggtgaaccagctgttcaagatctacttcaagatcaacaagctgcacctgtgcaagcccctgatcagagccatcgacagcagcaacctgaaggacgactacagcaccgcccagagagtgacctacaagtactacgtgggcagaaaggccatgttcgacagcgacttcaagcaggccgaggagtacctgagcttcgccttcgagcactgccacagaagcagccagaagaacaagagaatgatcctgatctacctgctgcccgtgaagatgctgctgggccacatgcccaccgtggagctgctgaagaagtaccacctgatgcagttcgccgaggtgaccagagccgtgagcgagggcaacctgctgctgctgcacgaggccctggccaagcacgaggccttcttcatcagatgcggcatcttcctgatcctggagaagctgaagatcatcacctacagaaacctgttcaagaaggtgtacctgctgctgaagacccaccagctgagcctggacgccttcctggtggccctgaagttcatgcaggtggaggacgtggacatcgacgaggtgcagtgcatcctggccaacctgatctacatgggccacgtgaagggctacatcagccaccagcaccagaagctggtggtgagcaagcagaaccccttcccccccctgagcaccgtgtgctag

SEQ ID NO: 92603 - DNA, 546 bp, Artificial Sequence
  Description of Artificial Sequence: Synthetic coding sequence
atgcccaagggcggcagaaagggcggccacaagggcagagccagacagtacaccagccccgaggagatcgacgcccagctgcaggccgagaagcagaaggccagagaggaggaggagcagaaggagggcggcgacggcgccgccggcgaccccaagaaggagaagaagagcctggacagcgacgagagcgaggacgaggaggacgactaccagcagaagagaaagggcgtggagggcctgatcgacatcgagaaccccaacagagtggcccagaccaccaagaaggtgacccagctggacctggacggccccaaggagctgagcagaagagagagagaggagatcgagaagcagaaggccaaggagagatacatgaagatgcacctggccggcaagaccgagcaggccaaggccgacctggccagactggccatcatcagaaagcagagagaggaggccgccagaaagaaggaggaggagagaaaggccaaggacgacgccaccctgagcggcaagagaatgcagagcctgagcctgaacaagtag

SEQ ID NO: 92604 - DNA, 1026 bp, Artificial Sequence
  Description of Artificial Sequence: Synthetic coding sequence
atggtgagcagccagcccaagtacgacctgatcagagaggtgggcagaggcagctacggcgtggtgtacgaggccgtgatcagaaagaccagcgccagagtggccgtgaagaagatcagatgccacgcccccgagaacgtggagctggccctgagagagttctgggccctgagcagcatcaagagccagcaccccaacgtgatccacctggaggagtgcatcctgcagaaggacggcatggtgcagaagatgagccacggcagcaacagcagcctgtacctgcagctggtggagaccagcctgaagggcgagatcgccttcgaccccagaagcgcctactacctgtggttcgtgatggacttctgcgacggcggcgacatgaacgagtacctgctgagcagaaagcccaacagaaagaccaacaccagcttcatgctgcagctgagcagcgccctggccttcctgcacaagaaccagatcatccacagagacctgaagcccgacaacatcctgatcagccagaccagactggacaccagcgacctggagcccaccctgaaggtggccgacttcggcctgagcaaggtgtgcagcgccagcggccagaaccccgaggagcccgtgagcgtgaacaagtgcttcctgagcaccgcctgcggcaccgacttctacatggcccccgaggtgtgggagggccactacaccgccaaggccgacatcttcgccctgggcatcatcatctgggccatgctggagagaatcaccttcatcgacaccgagaccaagaaggagctgctgggcagctacgtgaagcagggcaccgagatcgtgcccgtgggcgaggccctgctggagaaccccaagatggagctgctgatccccgtgaagaagaagagcatgaacggcagaatgaagcagctgatcaaggagatgctggccgccaacccccaggacagacccgacgccttcgagctggagctgagactggtgcagatcgccttcaaggacagcagctgggagacctag

SEQ ID NO: 92605 - DNA, 1026 bp, Artificial Sequence; identical to SEQ ID NO: 92604
  Description of Artificial Sequence: Synthetic coding sequence

SEQ ID NO: 92606 - DNA, 576 bp, Artificial Sequence
  Description of Artificial Sequence: Synthetic coding sequence
atggtgagcagccagcccaagtacgacctgatcagagaggtgggcagaggcagctacggcgtggtgtacgaggccgtgatcagaaagaccagcgccagagtggccgtgaagaagatcagatgccacgcccccgagaacgtggagctggccctgagagagttctgggccctgagcagcatcaagagccagcaccccaacgtgatccacctggaggagtgcatcctgcagaaggacggcatggtgcagaagatgagccacggcagcaacagcagcctgtacctgcagctggtggagaccagcctgaagggcgagatcgccttcgaccccagaagcgcctactacctgtggttcgtgatggacttctgcgacggcggcgacatgaacgagtacctgctgagcagaaagcccaacagaaagaccaacaccagcttcatgctgcagctgagcagcgccctggccttcctgcacaagaaccagatcatccacagagacctgaagcccgacaacatcctgatcagccagaccagactggacaccagcgacctggagcccaccctgaaggtggccgacttctag

SEQ ID NO: 92607 - DNA, 4014 bp, Artificial Sequence
  Description of Artificial Sequence: Synthetic coding sequence
atggacttcaccgcccagcccaagcccgccaccgccctgtgcggcgtggtgagcgccgacggcaagatcgcctacccccccggcgtgaaggagatcaccgacaagatcaccaccgacgagatgatcaagagactgaagatggtggtgaagaccttcatggacatggaccaggacagcgaggacgagaagcagcagtacctgcccctggccctgcacctggccagcgagttcttcctgagaaaccccaacaaggacgtgagactgctggtggcctgctgcctggccgacatcttcagaatctacgcccccgaggccccctacaccagccacgacaagctgaaggacatcttcctgttcatcaccagacagctgaagggcctggaggacaccaagagcccccagttcaacagatacttctacctgctggagaacctggcctgggtgaagagctacaacatctgcttcgagctggaggactgcaacgagatcttcatccagctgttcagaaccctgttcagcgtgatcaacaacagccacaacaagaaggtgcagatgcacatgctggacctgatgagcagcatcatcatggagggcgacggcgtgacccaggagctgctggacagcatcctgatcaacctgatccccgcccacaagaacctgaacaagcagagcttcgacctggccaaggtgctgctgaagagaaccgtgcagaccatcgaggcctgcatcgccaacttcttcaaccaggtgctggtgctgggcagaagcagcgtgagcgacctgagcgagcacgtgttcgacctgatccaggagctgttcgccatcgacccccacctgctgctgagcgtgatgccccagctggagttcaagctgaagagcaacgacggcgaggagagactggccgtggtgagactgctggccaagctgttcggcagcaaggacagcgacctggccacccagaacagacccctgtggcagtgcttcctgggcagattcaacgacatccacgtgcccgtgagactggagagcgtgaagttcgccagccactgcctgatgaaccaccccgacctggccaaggacctgaccgagtacctgaaggtgagaagccacgaccccgaggaggccatcagacacgacgtgatcgtgaccatcatcaccgccgccaagagagacctggccctggtgaacgaccagctgctgggcttcgtgagagagagaaccctggacaagagatggagagtgagaaaggaggccatgatgggcctggcccagctgtacaagaagtactgcctgcacggcgaggccggcaaggaggccgccgagaaggtgagctggatcaaggacaagctgctgcacatctactaccagaacagcatcgacgacaagctgctggtggagaagatcttcgcccagtacctggtgccccacaacctggagaccgaggagagaatgaagtgcctgtactacctgtacgccagcctggaccccaacgccgtgaaggccctgaacgagatgtggaagtgccagaacatgctgagaagccacgtgagagagctgctggacctgcacaagcagcccaccagcgaggccaactgcagcgccatgttcggcaagctgatgaccatcgccaagaacctgcccgaccccggcaaggcccaggacttcgtgaagaagttcaaccaggtgctgggcgacgacgagaagctgagaagccagctggagctgctgatcagccccacctgcagctgcaagcaggccgacatctgcgtgagagagatcgccagaaagctggccaaccccaagcagcccaccaaccccttcctggagatggtgaagttcctgctggagagaatcgcccccgtgcacatcgacagcgaggccatcagcgccctggtgaagctgatgaacaagagcatcgagggcaccgccgacgacgaggaggagggcgtgagccccgacaccgccatcagaagcggcctggagctgctgaaggtgctgagcttcacccaccccaccagcttccacagcgccgagacctacgagagcctgctgcagtgcctgagaatggaggacgacaaggtggccgaggccgccatccagatcttcagaaacaccggccacaagatcgagaccgacctgccccagatcagaagcaccctgatccccatcctgcaccagaaggccaagagaggcaccccccaccaggccaagcaggccgtgcactgcatccacgccatcttcaccaacaaggaggtgcagctggcccagatcttcgagcccctgagcagaagcctgaacgccgacgtgcccgagcagctgatcacccccctggtgagcctgggccacatcagcatgctggcccccgaccagttcgccagccccatgaagagcgtggtggccaacttcatcgtgaaggacctgctgatgaacgacagaagcaccggcgagaagaacggcaagctgtggagccccgacgaggaggtgagccccgaggtgctggccaaggtgcaggccatcaagctgctggtgagatggctgctgggcatgaagaacaaccagagcaagagcgccaacagcaccctgagactgctgagcgccatgctggtgagcgagggcgacctgaccgagcagaagagaatcagcaagagcgacatgagcagactgagactggccgccggcagcgccatcatgaagctggcccaggagccctgctaccacgagatcatcacccccgagcagttccagctgtgcgccctggtgatcaacgacgagtgctaccaggtgagacagatcttcgcccagaagctgcacaaggccctggtgaagctgctgctgcccctggagtacatggccatcttcgccctgtgcgccaaggaccccgtgaaggagagaagagcccacgccagacagtgcctgctgaagaacatcagcatcagaagagagtacatcaagcagaaccccatggccaccgagaagctgctgagcctgctgcccgagtacgtggtgccctacatgatccacctgctggcccacgaccccgacttcaccagaagccaggacgtggaccagctgagagacatcaaggagtgcctgtggttcatgctggaggtgctgatgaccaagaacgagaacaacagccacgccttcatgaagaagatggccgagaacatcaagctgaccagagacgcccagagccccgacgagagcaagaccaacgagaagctgtacaccgtgtgcgacgtggccctgtgcgtgatcaacagcaagagcgccctgtgcaacgccgacagccccaaggaccccgtgctgcccatgaagttcttcacccagcccgagaaggacttctgcaacgacaagagctacatcagcgaggagaccagagtgctgctgctgaccggcaagcccaagcccgccggcgtgctgggcgccgtgaacaagcccctgagcgccaccggcagaaagccctacgtgagaagcaccggcaccgagaccggcagcaacatcaacgtgaacagcgagctgaaccccagcaccggcaacagaagcagagagcagagcagcgaggccgccgagaccggcgtgagcgagaacgaggagaaccccgtgagaatcatcagcgtgacccccgtgaagaacatcgaccccgtgaagaacaaggagatcaacagcgaccaggccacccagggcaacatcagcagcgacagaggcaagaagagaaccgtgaccgccgccggcgccgagaacatccagcagaagaccgacgagaaggtggacgagagcggcccccccgcccccagcaagcccagaagaggcagaagacccaagagcgagagccagggcaacgccaccaagaacgacgacctgaacaagcccatcaacaagggcagaaagagagccgccgtgggccaggagagccccggcggcctggaggccggcaacgccaaggcccccaagctgcaggacctggccaagaaggccgcccccgccgagagacagatcgacctgcagagatag

SEQ ID NO: 92608 - DNA, 1803 bp, Artificial Sequence
  Description of Artificial Sequence: Synthetic coding sequence
atggacttcaccgcccagcccaagcccgccaccgccctgtgcggcgtggtgagcgccgacggcaagatcgcctacccccccggcgtgaaggagatcaccgacaagatcaccaccgacgagatgatcaagagactgaagatggtggtgaagaccttcatggacatggaccaggacagcgaggacgagaagcagcagtacctgcccctggccctgcacctggccagcgagttcttcctgagaaaccccaacaaggacgtgagactgctggtggcctgctgcctggccgacatcttcagaatctacgcccccgaggccccctacaccagccacgacaagctgaaggacatcttcctgttcatcaccagacagctgaagggcctggaggacaccaagagcccccagttcaacagatacttctacctgctggagaacctggcctgggtgaagagctacaacatctgcttcgagctggaggactgcaacgagatcttcatccagctgttcagaaccctgttcagcgtgatcaacaacagccacaacaagaaggtgcagatgcacatgctggacctgatgagcagcatcatcatggagggcgacggcgtgacccaggagctgctggacagcatcctgatcaacctgatccccgcccacaagaacctgaacaagcagagcttcgacctggccaaggtgctgctgaagagaaccgtgcagaccatcgaggcctgcatcgccaacttcttcaaccaggtgctggtgctgggcagaagcagcgtgagcgacctgagcgagcacgtgttcgacctgatccaggagctgttcgccatcgacccccacctgctgctgagcgtgatgccccagctggagttcaagctgaagagcaacgacggcgaggagagactggccgtggtgagactgctggccaagctgttcggcagcaaggacagcgacctggccacccagaacagacccctgtggcagtgcttcctgggcagattcaacgacatccacgtgcccgtgagactggagagcgtgaagttcgccagccactgcctgatgaaccaccccgacctggccaaggacctgaccgagtacctgaaggtgagaagccacgaccccgaggaggccatcagacacgacgtgatcgtgaccatcatcaccgccgccaagagagacctggccctggtgaacgaccagctgctgggcttcgtgagagagagaaccctggacaagagatggagagtgagaaaggaggccatgatgggcctggcccagctgtacaagaagtactgcctgcacggcgaggccggcaaggaggccgccgagaaggtgagctggatcaaggacaagctgctgcacatctactaccagaacagcatcgacgacaagctgctggtggagaagatcttcgcccagtacctggtgccccacaacctggagaccgaggagagaatgaagtgcctgtactacctgtacgccagcctggaccccaacgccgtgaaggccctgaacgagatgtggaagtgccagaacatgctgagaagccacgtgagagagctgctggacctgcacaagcagcccaccagcgaggccaactgcagcgccatgttcggcaagctgatgaccatcgccaagaacctgcccgaccccggcaaggcccaggacttcgtgaagaagttcaaccaggtgctgggcgacgacgagaagctgagaagccagctggagctgctgatcagccccacctgcagctgcaagcaggccgacatctgcgtggtgagcaagagctacttcaccctgttcctgtag

SEQ ID NO: 92609 - DNA, 990 bp, Artificial Sequence
  Description of Artificial Sequence: Synthetic coding sequence
atgaccacccagcagatcgacctgcagggccccggcccctggggcttcagactggtgggcggcaaggacttcgagcagcccctggccatcagcagagtgacccccggcagcaaggccgccctggccaacctgtgcatcggcgacgtgatcaccgccatcgacggcgagaacaccagcaacatgacccacctggaggcccagaacagaatcaagggctgcaccgacaacctgaccctgaccgtggccagaagcgagcacaaggtgtggagccccctggtgaccgaggagggcaagagacacccctacaagatgaacctggccagcgagccccaggaggtgctgcacatcggcagcgcccacaacagaagcgccatgcccttcaccgccagccccgccagcagcaccaccgccagagtgatcaccaaccagtacaacaaccccgccggcctgtacagcagcgagaacatcagcaacttcaacaacgccctggagagcaagaccgccgccagcggcgtggaggccaacagcagacccctggaccacgcccagccccccagcagcctggtgatcgacaaggagagcgaggtgtacaagatgctgcaggagaagcaggagctgaacgagccccccaagcagagcaccagcttcctggtgctgcaggagatcctggagagcgaggagaagggcgaccccaacaagcccagcggcttcagaagcgtgaaggcccccgtgaccaaggtggccgccagcatcggcaacgcccagaagctgcccatgtgcgacaagtgcggcaccggcatcgtgggcgtgttcgtgaagctgagagacagacacagacaccccgagtgctacgtgtgcaccgactgcggcaccaacctgaagcagaagggccacttcttcgtggaggaccagatctactgcgagaagcacgccagagagagagtgaccccccccgagggctacgaggtggtgaccgtgttccccaagtag

SEQ ID NO: 92610 - DNA, 1101 bp, Artificial Sequence
  Description of Artificial Sequence: Synthetic coding sequence
atggccctgaccgtggacgtggccggccccgccccctggggcttcagaatcaccggcggcagagacttccacacccccatcatggtgaccaaggtggccgagagaggcaaggccaaggacgccgacctgagacccggcgacatcatcgtggccatcaacggcgagagcgccgagggcatgctgcacgccgaggcccagagcaagatcagacagagccccagccccctgagactgcagctggacagaagccaggccaccagccccggccagaccaacggcgacagcagcctggaggtgctggccaccagattccagggcagcgtgagaacctacaccgagagccagagcagcctgagaagcagctacagcagccccaccagcctgagccccagagccggcagccccttcagccccccccccagcagcagcagcctgaccggcgaggccgccatcagcagaagcttccagagcctggcctgcagccccggcctgcccgccgccgacagactgagctacagcggcagacccggcagcagacaggccggcctgggcagagccggcgacagcgccgtgctggtgctgccccccagccccggccccagaagcagcagacccagcatggacagcgagggcggcagcctgctgctggacgaggacagcgaggtgttcaagatgctgcaggagaacagagagggcagagccgcccccagacagagcagcagcttcagactgctgcaggaggccctggaggccgaggagagaggcggcacccccgccttcctgcccagcagcctgagcccccagagcagcctgcccgccagcagagccctggccaccccccccaagctgcacacctgcgagaagtgcagcaccagcatcgccaaccaggccgtgagaatccaggagggcagatacagacaccccggctgctacacctgcgccgactgcggcctgaacctgaagatgagaggccacttctgggaggacgcctgcgccatggagggcatgagactgagcctggaggccctggagggcatggtggagggcgccaagagaagagacagaagaaagaccagaagacccatccagcccagctggtag

SEQ ID NO: 92611 - DNA, 1809 bp, Artificial Sequence
  Description of Artificial Sequence: Synthetic coding sequence
atgagaggcggcagagccagacccgcctgggagagcttcatgggcctgccccccagaagcagcgccaagtggggcgccggccagagcctggacagactgtgctgcgcccccggcagcagaggcctggccggcgcccccggcagaatgagagccccccccgccggcagaagccagcccgccggcggccccggcgacagcctgccccacccccccggcggcctgggccccggcggcagcgcctgggccagaagagccgaggccgccgccagcagagccagaggcggcggcagaggcggccccggcatcacctgggccgaggccggccccggcgcccccggcggcctgagccccgagagcggcagaagacagagagagagatggagactgcccgccttcccccccagcagagcctgggcccccagcagaaccggcgagagacagcccggcgagagagcccacctgagactgagcgccagacccgccctgcccggcgccggcctgctgagcgcccccctgagcgccagaaaccccggcctggtgagaggccccgccccctggagcctggccagcgccggcgccccccccagagccgccctgagccccgccggcgccctgctgctgcagccccccgccagaagagtgctgtgccccagaagcgagggcggcagcagaaccggcagagccggccccagcggctgggccccccccagaggcgccagaagcgccgagagcaccgacagactgaagggcatggccctgaccgtggacgtggccggccccgccccctggggcttcagaatcaccggcggcagagacttccacacccccatcatggtgaccaaggtggccgagagaggcaaggccaaggacgccgacctgagacccggcgacatcatcgtggccatcaacggcgagagcgccgagggcatgctgcacgccgaggcccagagcaagatcagacagagccccagccccctgagactgcagctggacagaagccaggccaccagccccggccagaccaacggcgacagcagcctggaggtgctggccaccagattccagggcagcgtgagaacctacaccgagagccagagcagcctgagaagcagctacagcagccccaccagcctgagccccagagccggcagccccttcagccccccccccagcagcagcagcctgaccggcgaggccgccatcagcagaagcttccagagcctggcctgcagccccggcctgcccgccgccgacagactgagctacagcggcagacccggcagcagacaggccggcctgggcagagccggcgacagcgccgtgctggtgctgccccccagccccggccccagaagcagcagacccagcatggacagcgagggcggcagcctgctgctggacgaggacagcgaggtgttcaagatgctgcaggagaacagagagggcagagccgcccccagacagagcagcagcttcagactgctgcaggaggccctggaggccgaggagagaggcggcacccccgccttcctgcccagcagcctgagcccccagagcagcctgcccgccagcagagccctggccaccccccccaagctgcacacctgcgagaagtgcagcaccagcatcgccaaccaggccgtgagaatccaggagggcagatacagacaccccggctgctacacctgcgccgactgcggcctgaacctgaagatgagaggccacttctgggtgggcgacgagctgtactgcgagaagcacgccagacagagatacagcgcccccgccaccctgagcagcagagcctag

SEQ ID NO: 92612 - DNA, 837 bp, Artificial Sequence
  Description of Artificial Sequence: Synthetic coding sequence
atggccctgaccgtggacgtggccggccccgccccctggggcttcagaatcaccggcggcagagacttccacacccccatcatggtgaccaaggtggccgagagaggcaaggccaaggacgccgacctgagacccggcgacatcatcgtggccatcaacggcgagagcgccgagggcatgctgcacgccgaggcccagagcaagatcagacagagccccagccccctgagactgcagctggacagaagccaggccaccagccccggccagaccaacggcgacagcagcctggaggtgctggccaccagattccagggcagcgtgagaacctacaccgagagccagagcagcctgagaagcagctacagcagccccaccagcctgagccccagagccggcagccccttcagccccccccccagcagcagcagcctgaccggcgaggccgccatcagcagaagcttccagagcctggcctgcagccccggcctgcccgccgccgacagactgagctacagcggcagacccggcagcagacaggccggcctgggcagagccggcgacagcgccgtgctggtgctgccccccagccccggccccagaagcagcagacccagcatggacagcgagggcggcagcctgctgctggacgaggacagcgaggtgttcaagatgctgcaggagaacagagagggcagagccgcccccagacagagcagcagcttcagactgctgcaggaggccctggaggccgaggagagaggcaccagactgtgcgccagcagaagagccggcaccgccacccccgccgccacccccgtgcccaccgtgggctag

SEQ ID NO: 92613 - DNA, 675 bp, Artificial Sequence
  Description of Artificial Sequence: Synthetic coding sequence
atggccctgaccgtggacgtggccggccccgccccctggggcttcagaatcaccggcggcagagacttccacacccccatcatggtgaccaaggtggccgagagaggcaaggccaaggacgccgacctgagacccggcgacatcatcgtggccatcaacggcgagagcgccgagggcatgctgcacgccgaggcccagagcaagatcagacagagccccagccccctgagactgcagctggacagaagccaggccaccagccccggccagaccaacggcgacagcagcctggaggtgctggccaccagattccagggcagcgtgagaacctacaccgagagccagagcagcctgagaagcagctacagcagccccaccagcctgagccccagagccggcagccccttcagccccccccccagcagcagcagcctgaccggcgaggccgccatcagcagaagcagacccagacccagatggagactgggcggcgccggcgccgccgccttccccggccccagcttcctgcaggcccagcacggcctgggcagaggcaagcccccccccggcagaggcctgggcagcctgcaggacgccgccggcaagagcagaggcaccggcggcccccccaccgtgcagctgctgagcgccctggccggcagccccggcggctag

SEQ ID NO: 92614 - DNA, 1059 bp, Artificial Sequence
  Description of Artificial Sequence: Synthetic coding sequence
atggccctgaccgtggacgtggccggccccgccccctggggcttcagaatcaccggcggcagagacttccacacccccatcatggtgaccaaggtggccgagagaggcaaggccaaggacgccgacctgagacccggcgacatcatcgtggccatcaacggcgagagcgccgagggcatgctgcacgccgaggcccagagcaagatcagacagagccccagccccctgagactgcagctggacagaagccaggccaccagccccggccagaccaacggcgacagcagcctggaggtgctggccaccagattccagggcagcgtgagaacctacaccgagagccagagcagcctgagaagcagctacagcagccccaccagcctgagccccagagccggcagccccttcagccccccccccagcagcagcagcctgaccggcgaggccgccatcagcagaagcttccagagcctggcctgcagccccggcctgcccgccgccgacagactgagctacagcggcagacccggcagcagacaggccggcctgggcagagccggcgacagcgccgtgctggtgctgccccccagccccggccccagaagcagcagacccagcatggacagcgagggcggcagcctgctgctggacgaggacagcgaggtgttcaagatgctgcaggagaacagagagggcagagccgcccccagacagagcagcagcttcagactgctgcaggaggccctggaggccgaggagagaggcggcacccccgccttcctgcccagcagcctgagcccccagagcagcctgcccgccagcagagccctggccaccccccccaagctgcacacctgcgagaagtgcagcaccagcatcgccaaccaggccgtgagaatccaggagggcagatacagacaccccggctgctacacctgcgccgactgcggcctgaacctgaagatgagaggccacttctgggtgggcgacgagctgtactgcgagaagcacgccagacagagatacagcgcccccgccaccctgagcagcagagcctag

SEQ ID NO: 92615 - DNA, 1059 bp, Artificial Sequence; identical to SEQ ID NO: 92614
  Description of Artificial Sequence: Synthetic coding sequence

SEQ ID NO: 92616 - DNA, 837 bp, Artificial Sequence; identical to SEQ ID NO: 92612
  Description of Artificial Sequence: Synthetic coding sequence

SEQ ID NO: 92617 - DNA, 1059 bp, Artificial Sequence; identical to SEQ ID NO: 92614
  Description of Artificial Sequence: Synthetic coding sequence

SEQ ID NO: 92618 - DNA, 1560 bp, Artificial Sequence
  Description of Artificial Sequence: Synthetic coding sequence
atgaccagcaccttcaaccccagagagtgcaagctgagcaagcaggagggccagaactacggcttcttcctgagaatcgagaaggacaccgagggccacctggtgagagtggtggagaagtgcagccccgccgagaaggccggcctgcaggacggcgacagagtgctgagaatcaacggcgtgttcgtggacaaggaggagcacatgcaggtggtggacctggtgagaaagagcggcaacagcgtgaccctgctggtgctggacggcgacagctacgagaaggccgtgaagaccagagtggacctgaaggagctgggccagagccagaaggagcagggcctgagcgacaacatcctgagccccgtgatgaacggcggcgtgcagacctggacccagcccagactgtgctacctggtgaaggagggcggcagctacggcttcagcctgaagaccgtgcagggcaagaagggcgtgtacatgaccgacatcaccccccagggcgtggccatgagagccggcgtgctggccgacgaccacctgatcgaggtgaacggcgagaacgtggaggacgccagccacgaggaggtggtggagaaggtgaagaagagcggcagcagagtgatgttcctgctggtggacaaggagaccgacaagagacacgtggagcagaagatccagttcaagagagagaccgccagcctgaagctgctgccccaccagcccagaatcgtggagatgaagaagggcagcaacggctacggcttctacctgagagccggcagcgagcagaagggccagatcatcaaggacatcgacagcggcagccccgccgaggaggccggcctgaagaacaacgacctggtggtggccgtgaacggcgagagcgtggagaccctggaccacgacagcgtggtggagatgatcagaaagggcggcgaccagaccagcctgctggtggtggacaaggagaccgacaacatgtacagactggcccacttcagccccttcctgtactaccagagccaggagctgcccaacggcagcgtgaaggaggcccccgcccccacccccaccagcctggaggtgagcagcccccccgacaccaccgaggaggtggaccacaagcccaagctgtgcagactggccaagggcgagaacggctacggcttccacctgaacgccatcagaggcctgcccggcagcttcatcaaggaggtgcagaagggcggccccgccgacctggccggcctggaggacgaggacgtgatcatcgaggtgaacggcgtgaacgtgctggacgagccctacgagaaggtggtggacagaatccagagcagcggcaagaacgtgaccctgctggtgtgcggcaagaaggcctacgactacttccaggccaagaagatccccatcgtgagcagcctggccgaccccctggacaccccccccgacagcaaggagggcatcgtggtggagagcaaccacgacagccacatggccaaggagagagcccacagcaccgccagccacagcagcagcaacagcgaggacaccgagatgtag

SEQ ID NO: 92619 - DNA, 1560 bp, Artificial Sequence; identical to SEQ ID NO: 92618
  Description of Artificial Sequence: Synthetic coding sequence

SEQ ID NO: 92620 - DNA, 795 bp, Artificial Sequence
  Description of Artificial Sequence: Synthetic coding sequence
atgaccagcaccttcaaccccagagagtgcaagctgagcaagcaggagggccagaactacggcttcttcctgagaatcgagaaggacaccgagggccacctggtgagagtggtggagaagtgcagccccgccgagaaggccggcctgcaggacggcgacagagtgctgagaatcaacggcgtgttcgtggacaaggaggagcacatgcaggtggtggacctggtgagaaagagcggcaacagcgtgaccctgctggtgctggacggcgacagctacgagaaggccgtgaagaccagagtggacctgaaggagctgggccagagccagaaggagcagggcctgagcgacaacatcctgagccccgtgatgaacggcggcgtgcagacctggacccagcccagactgtgctacctggtgaaggagggcggcagctacggcttcagcctgaagaccgtgcagggcaagaagggcgtgtacatgaccgacatcaccccccagggcgtggccatgagagccggcgtgctggccgacgaccacctgatcgaggtgaacggcgagaacgtggaggacgccagccacgaggaggtggtggagaaggtgaagaagagcggcagcagagtgatgttcctgctggtggacaaggagaccgacaagagacacgtggagcagaagatccagttcaagagagagaccgccagcctgaagctgctgccccaccagcccagaatcgtggagatgaagaagggcagcaacggctacggcttctacctgagagccggcagcgagcagaagtag

SEQ ID NO: 92621 - DNA, 1227 bp, Artificial Sequence
  Description of Artificial Sequence: Synthetic coding sequence
atgaccagcaccttcaaccccagagagtgcaagctgagcaagcaggagggccagaactacggcttcttcctgagaatcgagaaggacaccgagggccacctggtgagagtggtggagaagtgcagccccgccgagaaggccggcctgcaggacggcgacagagtgctgagaatcaacggcgtgttcgtggacaaggaggagcacatgcaggtggtggacctggtgagaaagagcggcaacagcgtgaccctgctggtgctggacggcgacagctacgagaaggccgtgaagaccagagtggacctgaaggagctgggccagagccagaaggagcagggcctgagcgacaacatcctgagccccgtgatgaacggcggcgtgcagacctggacccagcccagactgtgctacctggtgaaggagggcggcagctacggcttcagcctgaagaccgtgcagggccagatcatcaaggacatcgacagcggcagccccgccgaggaggccggcctgaagaacaacgacctggtggtggccgtgaacggcgagagcgtggagaccctggaccacgacagcgtggtggagatgatcagaaagggcggcgaccagaccagcctgctggtggtggacaaggagaccgacaacatgtacagactggcccacttcagccccttcctgtactaccagagccaggagctgcccaacggcagcgtgaaggaggcccccgcccccacccccaccagcctggaggtgagcagcccccccgacaccaccgaggaggtggaccacaagcccaagctgtgcagactggccaagggcgagaacggctacggcttccacctgaacgccatcagaggcctgcccggcagcttcatcaaggaggtgcagaagggcggccccgccgacctggccggcctggaggacgaggacgtgatcatcgaggtgaacggcgtgaacgtgctggacgagccctacgagaaggtggtggacagaatccagagcagcggcaagaacgtgaccctgctggtgtgcggcaagaaggcctacgactacttccaggccaagaagatccccatcgtgagcagcctggccgaccccctggacaccccccccgacagcaaggagggcatcgtggtggagagcaaccacgacagccacatggccaaggagagagcccacagcaccgccagccacagcagcagcaacagcgaggacaccgagatgtag

SEQ ID NO: 92622 - DNA, 423 bp, Artificial Sequence
  Description of Artificial Sequence: Synthetic coding sequence
atggacagcagaatcccctacgacgactaccccgtggtgttcctgcccgcctacgagaacccccccgcctggatccccccccacgagagagtgcaccaccccgactacaacaacgagctgacccagttcctgcccagaaccatcaccctgaagaagccccccggcgcccagctgggcttcaacatcagaggcggcaaggccagccagctgggcatcttcatcagcaaggtgatccccgacagcgacgcccacagagccggcctgcaggagggcgaccaggtgctggccgtgaacgacgtggacttccaggacatcgagcacagcaaggccgtggagatcctgaagaccgccagagagatcagcatgagagtgagattcttcccctacaactaccacagacagaaggagagaaccgtgcactag

SEQ ID NO: 92623 - DNA, 423 bp, Artificial Sequence; identical to SEQ ID NO: 92622
  Description of Artificial Sequence: Synthetic coding sequence

SEQ ID NO: 92624 - DNA, 8520 bp, Artificial Sequence
  Description of Artificial Sequence: Synthetic coding sequence
atgcccatcacccaggacaacgccgtgctgcacctgcccctgctgtaccagtggctgcagaacagcctgcaggagggcggcgacggccccgagcagagactgtgccaggccgccatccagaagctgcaggagtacatccagctgaacttcgccgtggacgagagcaccgtgccccccgaccacagcccccccgagatggagatctgcaccgtgtacctgaccaaggagctgggcgacaccgagaccgtgggcctgagcttcggcaacatccccgtgttcggcgactacggcgagaagagaagaggcggcaagaagagaaagacccaccagggccccgtgctggacgtgggctgcatctgggtgaccgagctgagaaagaacagccccgccggcaagagcggcaaggtgagactgagagacgagatcctgagcctgaacggccagctgatggtgggcgtggacgtgagcggcgccagctacctggccgagcagtgctggaacggcggcttcatctacctgatcatgctgagaagattcaagcacaaggcccacagcacctacaacggcaacagcagcaacagcagcgagcccggcgagacccccaccctggagctgggcgacagaaccgccaagaagggcaagagaaccagaaagttcggcgtgatcagcagaccccccgccaacaaggcccccgaggagagcaagggcagcgccggctgcgaggtgagcagcgaccccagcaccgagctggagaacggccccgaccccgagctgggcaacggccacgtgttccagctggagaacggccccgacagcctgaaggaggtggccggcccccacctggagagaagcgaggtggacagaggcaccgagcacagaatccccaagaccgacgcccccctgaccaccagcaacgacaagagaagattcagcaagggcggcaagaccgacttccagagcagcgactgcctggccagagaggaggtgggcagaatctggaagatggagctgctgaaggagagcgacggcctgggcatccaggtgagcggcggcagaggcagcaagagaagcccccacgccatcgtggtgacccaggtgaaggagggcggcgccgcccacagagacggcagactgagcctgggcgacgagctgctggtgatcaacggccacctgctggtgggcctgagccacgaggaggccgtggccatcctgagaagcgccaccggcatggtgcagctggtggtggccagcaaggagaacagcgccgaggacctgctgagactgaccagcaagagcctgcccgacctgaccagcagcgtggaggacgtgagcagctggaccgacaacgaggaccaggaggccgacggcgaggaggacgagggcaccagcagcagcgtgcagagagccatgcccggcaccgacgagccccaggacgtgtgcggcgccgaggagagcaagggcaacctggagagccccaagcagggcagcaacaagatcaagctgaagagcagactgagcggcggcgtgcacagactggagagcgtggaggagtacaacgagctgatggtgagaaacggcgaccccagaatcagaatgctggaggtgagcagagacggcagaaagcacagcctgccccagctgctggacagcagcagcgccagccaggagtaccacatcgtgaagaagagcaccagaagcctgagcaccacccaggtggagagcccctggagactgatcagacccagcgtgatcagcatcatcggcctgtacaaggagaagggcaagggcctgggcttcagcatcgccggcggcagagactgcatcagaggccagatgggcatcttcgtgaagaccatcttccccaacggcagcgccgccgaggacggcagactgaaggagggcgacgagatcctggacgtgaacggcatccccatcaagggcctgaccttccaggaggccatccacaccttcaagcagatcagaagcggcctgttcgtgctgaccgtgagaaccaagctggtgagccccagcctgaccccctgcagcacccccacccacatgagcagaagcgccagccccaacttcaacaccagcggcggcgccagcgccggcggcagcgacgagggcagcagcagcagcctgggcagaaagacccccggccccaaggacagaatcgtgatggaggtgaccctgaacaaggagcccagagtgggcctgggcatcggcgcctgctgcctggccctggagaacagcccccccggcatctacatccacagcctggcccccggcagcgtggccaagatggagagcaacctgagcagaggcgaccagatcctggaggtgaacagcgtgaacgtgagacacgccgccctgagcaaggtgcacgccatcctgagcaagtgcccccccggccccgtgagactggtgatcggcagacaccccaaccccaaggtgagcgagcaggagatggacgaggtgatcgccagaagcacctaccaggagagcaaggaggccaacagcagccccggcctgggcacccccctgaagagccccagcctggccaagaaggacagcctgatcagcgagagcgagctgagccagtacttcgcccacgacgtgcccggccccctgagcgacttcatggtggccggcagcgaggacgaggaccaccccggcagcggctgcagcaccagcgaggagggcagcctgccccccagcaccagcacccacaaggagcccggcaagcccagagccaacagcctggtgaccctgggcagccacagagccagcggcctgttccacaagcaggtgaccgtggccagacaggccagcctgcccggcagcccccaggccctgagaaaccccctgctgagacagagaaaggtgggctgctacgacgccaacgacgccagcgacgaggaggagttcgacagagagggcgactgcatcagcctgcccggcgccctgcccggccccatcagacccctgagcgaggacgaccccagaagagtgagcatcagcagcagcaagggcatggacgtgcacaaccaggaggagagacccagaaagaccctggtgagcaaggccatcagcgcccccctgctgggcagcagcgtggacctggaggagagcatccccgagggcatggtggacgccgccagctacgccgccaacctgaccgacagcgccgaggcccccaagggcagccccggcagctggtggaagaaggagctgagcggcagcagcagcgcccccaagctggagtacaccgtgagaaccgacacccagagccccaccaacaccggcagccccagcagcccccagcagaagagcgagggcctgggcagcagacacagacccgtggccagagtgagcccccactgcaagagaagcgaggccgaggccaagcccagcggcagccagaccgtgaacctgaccggcagagccaacgacccctgcgacctggacagcagagtgcaggccaccagcgtgaaggtgaccgtggccggcttccagcccggcggcgccgtggagaaggagagcctgggcaagctgaccaccggcgacgcctgcgtgagcaccagctgcgagctggccagcgccctgagccacctggacgccagccacctgaccgagaacctgcccaaggccgccagcgagctgggccagcagcccatgaccgagctggacagcagcagcgacctgatcagcagccccggcaagaagggcgccgcccaccccgaccccagcaagaccagcgtggacaccggccaggtgagcagacccgagaaccccagccagcccgccagccccagagtgaccaagtgcaaggccagaagccccgtgagactgccccacgagggcagccccagccccggcgagaaggccgccgccccccccgactacagcaagaccagaagcgccagcgagaccagcaccccccacaacaccagaagagtggccgccctgagaggcgccggccccggcgccgagggcatgacccccgccggcgccgtgctgcccggcgaccccctgaccagccaggagcagagacagggcgcccccggcaaccacagcaaggccctggagatgaccggcatccacgcccccgagagcagccaggagcccagcctgctggagggcgccgacagcgtgagcagcagagccccccaggccagcctgagcatgctgcccagcaccgacaacaccaaggaggcctgcggccacgtgagcggccactgctgccccggcggcagcagagagagccccgtgaccgacatcgacagcttcatcaaggagctggacgccagcgccgccagaagccccagcagccagaccggcgacagcggcagccaggagggcagcgcccagggccacccccccgccggcgccggcggcggcagcagctgcagagccgagcccgtgcccggcggccagaccagcagccccagaagagcctgggccgccggcgcccccgcctacccccagtgggccagccagcccagcgtgctggacagcatcaaccccgacaagcacttcaccgtgaacaagaacttcctgagcaactacagcagaaacttcagcagcttccacgaggacagcaccagcctgagcggcctgggcgacagcaccgagcccagcctgagcagcatgtacggcgacgccgaggacagcagcagcgaccccgagagcctgaccgaggcccccagagccagcgccagagacggctggagcccccccagaagcagagtgagcctgcacaaggaggaccccagcgagagcgaggaggagcagatcgagatctgcagcaccagaggctgccccaacccccccagcagccccgcccacctgcccacccaggccgccatctgccccgccagcgccaaggtgctgagcctgaagtacagcacccccagagagagcgtggccagccccagagagaaggccgcctgcctgcccggcagctacaccagcggccccgacagcagccagcccagcagcctgctggagatgagcagccaggagcacgagacccacgccgacatcagcaccagccagaaccacagacccagctgcgccgaggagaccaccgaggtgaccagcgccagcagcgccatggagaacagccccctgagcaaggtggccagacacttccacagcccccccatcatcctgagcagccccaacatggtgaacggcctggagcacgacctgctggacgacgagaccctgaaccagtacgagaccagcatcaacgccgccgccagcctgagcagcttcagcgtggacgtgcccaagaacggcgagagcgtgctggagaacctgcacatcagcgagagccaggacctggacgacctgctgcagaagcccaagatgatcgccagaagacccatcatggcctggttcaaggagatcaacaagcacaaccagggcacccacctgagaagcaagaccgagaaggagcagcccctgatgcccgccagaagccccgacagcaagatccagatggtgagcagcagccagaagaagggcgtgaccgtgccccacagccccccccagcccaagaccaacctggagaacaaggacctgagcaagaagagccccgccgagatgctgctgaccaacggccagaaggccaagtgcggccccaagctgaagagactgagcctgaagggcaaggccaaggtgaacagcgaggcccccgccgccaacgccgtgaaggccggcggcaccgaccacagaaagcccctgatcagcccccagaccagccacaagaccctgagcaaggccgtgagccagagactgcacgtggccgaccacgaggaccccgacagaaacaccaccgccgcccccagaagcccccagtgcgtgctggagagcaagccccccctggccaccagcggccccctgaagcccagcgtgagcgacaccagcatcagaaccttcgtgagccccctgaccagccccaagcccgtgcccgagcagggcatgtggagcagattccacatggccgtgctgagcgagcccgacagaggctgccccaccacccccaagagccccaagtgcagagccgagggcagagcccccagagccgacagcggccccgtgagccccgccgccagcagaaacggcatgagcgtggccggcaacagacagagcgagcccagactggccagccacgtggccgccgacaccgcccagcccagacccaccggcgagaagggcggcaacatcatggccagcgacagactggagagaaccaaccagctgaagatcgtggagatcagcgccgaggccgtgagcgagaccgtgtgcggcaacaagcccgccgagagcgacagaagaggcggctgcctggcccagggcaactgccaggagaagagcgagatcagactgtacagacaggtggccgagagcagcaccagccaccccagcagcctgcccagccacgccagccaggccgagcaggagatgagcagaagcttcagcatggccaagctggccagcagcagcagcagcctgcagaccgccatcagaaaggccgagtacagccagggcaagagcagcctgatgagcgacagcagaggcgtgcccagaaacagcatccccggcggccccagcggcgaggaccacctgtacttcacccccagacccgccaccagaacctacagcatgcccgcccagttcagcagccacttcggcagagagggccaccccccccacagcctgggcagaagcagagacagccaggtgcccgtgaccagcagcgtggtgcccgaggccaaggccagcagaggcggcctgcccagcctggccaacggccagggcatctacagcgtgaagcccctgctggacaccagcagaaacctgcccgccaccgacgagggcgacatcatcagcgtgcaggagaccagctgcctggtgaccgacaagatcaaggtgaccagaagacactactgctacgagcagaactggccccacgagagcaccagcttcttcagcgtgaagcagagaatcaagagcttcgagaacctggccaacgccgacagacccgtggccaagagcggcgccagccccttcctgagcgtgagcagcaagccccccatcggcagaagaagcagcggcagcatcgtgagcggcagcctgggccaccccggcgacgccgccgccagactgctgagaagaagcctgagcagctgcagcgagaaccagagcgaggccggcaccctgctgccccagatggccaagagccccagcatcatgaccctgaccatcagcagacagaacccccccgagaccagcagcaagggcagcgacagcgagctgaagaagagcctgggccccctgggcatccccacccccaccatgaccctggccagccccgtgaagagaaacaagagcagcgtgagacacacccagcccagccccgtgagcagaagcaagctgcaggagctgagagccctgagcatgcccgacctggacaagctgtgcagcgaggactacagcgccggccccagcgccgtgctgttcaagaccgagctggagatcacccccagaagaagccccggcccccccgccggcggcgtgagctgccccgagaagggcggcaacagagcctgccccggcggcagcggccccaagaccagcgccgccgagacccccagcagcgccagcgacaccggcgaggccgcccaggacctgcccttcagaagaagctggagcgtgaacctggaccagctgctggtgagcgccggcgaccagcagagactgcagagcgtgctgagcagcgtgggcagcaagagcaccatcctgaccctgatccaggaggccaaggcccagagcgagaacgaggaggacgtgtgcttcatcgtgctgaacagaaaggagggcagcggcctgggcttcagcgtggccggcggcaccgacgtggagcccaagagcatcaccgtgcacagagtgttcagccagggcgccgccagccaggagggcaccatgaacagaggcgacttcctgctgagcgtgaacggcgccagcctggccggcctggcccacggcaacgtgctgaaggtgctgcaccaggcccagctgcacaaggacgccctggtggtgatcaagaagggcatggaccagcccagacccagcgccagacaggagccccccaccgccaacggcaagggcctgctgagcagaaagaccatccccctggagcccggcatcggcagaagcgtggccgtgcacgacgccctgtgcgtggaggtgctgaagaccagcgccggcctgggcctgagcctggacggcggcaagagcagcgtgaccggcgacggccccctggtgatcaagagagtgtacaagggcggcgccgccgagcaggccggcatcatcgaggccggcgacgagatcctggccatcaacggcaagcccctggtgggcctgatgcacttcgacgcctggaacatcatgaagagcgtgcccgagggccccgtgcagctgctgatcagaaagcacagaaacagcagctag

SEQ ID NO: 92625 - DNA, 7923 bp, Artificial Sequence
  Description of Artificial Sequence: Synthetic coding sequence
atgcccatcacccaggacaacgccgtgctgcacctgcccctgctgtaccagtggctgcagaacagcctgcaggagggcggcgacggccccgagcagagactgtgccaggccgccatccagaagctgcaggagtacatccagctgaacttcgccgtggacgagagcaccgtgccccccgaccacagcccccccgagatggagatctgcaccgtgtacctgaccaaggagctgggcgacaccgagaccgtgggcctgagcttcggcaacatccccgtgttcggcgactacggcgagaagagaagaggcggcaagaagagaaagacccaccagggccccgtgctggacgtgggctgcatctgggtgaccgagctgagaaagaacagccccgccggcaagagcggcaaggtgagactgagagacgagatcctgagcctgaacggccagctgatggtgggcgtggacgtgagcggcgccagctacctggccgagcagtgctggaacggcggcttcatctacctgatcatgctgagaagattcaagcacaaggcccacagcacctacaacggcaacagcagcaacagcagcgagcccggcgagacccccaccctggagctgggcgacagaaccgccaagaagggcaagagaaccagaaagttcggcgtgatcagcagaccccccgccaacaaggcccccgaggagagcaagggcagcgccggctgcgaggtgagcagcgaccccagcaccgagctggagaacggccccgaccccgagctgggcaacggccacgtgttccagctggagaacggccccgacagcctgaaggaggtggccggcccccacctggagagaagcgaggtggacagaggcaccgagcacagaatccccaagaccgacgcccccctgaccaccagcaacgacaagagaagattcagcaagggcggcaagaccgacttccagagcagcgactgcctggccagagaggaggtgggcagaatctggaagatggagctgctgaaggagagcgacggcctgggcatccaggtgagcggcggcagaggcagcaagagaagcccccacgccatcgtggtgacccaggtgaaggagggcggcgccgcccacagagagtaccacatcgtgaagaagagcaccagaagcctgagcaccacccaggtggagagcccctggagactgatcagacccagcgtgatcagcatcatcggcctgtacaaggagaagggcaagggcctgggcttcagcatcgccggcggcagagactgcatcagaggccagatgggcatcttcgtgaagaccatcttccccaacggcagcgccgccgaggacggcagactgaaggagggcgacgagatcctggacgtgaacggcatccccatcaagggcctgaccttccaggaggccatccacaccttcaagcagatcagaagcggcctgttcgtgctgaccgtgagaaccaagctggtgagccccagcctgaccccctgcagcacccccacccacatgagcagaagcgccagccccaacttcaacaccagcggcggcgccagcgccggcggcagcgacgagggcagcagcagcagcctgggcagaaagacccccggccccaaggacagaatcgtgatggaggtgaccctgaacaaggagcccagagtgggcctgggcatcggcgcctgctgcctggccctggagaacagcccccccggcatctacatccacagcctggcccccggcagcgtggccaagatggagagcaacctgagcagaggcgaccagatcctggaggtgaacagcgtgaacgtgagacacgccgccctgagcaaggtgcacgccatcctgagcaagtgccccgtgagcgagcaggagatggacgaggtgatcgccagaagcacctaccaggagagcaaggaggccaacagcagccccggcctgggcacccccctgaagagccccagcctggccaagaaggacagcctgatcagcgagagcgagctgagccagtacttcgcccacgacgtgcccggccccctgagcgacttcatggtggccggcagcgaggacgaggaccaccccggcagcggctgcagcaccagcgaggagggcagcctgccccccagcaccagcaaggagcccggcaagcccagagccaacagcctggtgaccctgggcagccacagagccagcggcctgttccacaagcaggtgaccgtggccagacaggccagcctgcccggcagcccccaggccctgagaaaccccctgctgagacagagaaaggtgggctgctacgacgccaacgacgccagcgacgaggaggagttcgacagagagggcgactgcatcagcctgcccggcgccctgcccggccccatcagacccctgagcgaggacgaccccagaagagtgagcatcagcagcagcaagggcatggacgtgcacaaccaggaggagagacccagaaagaccctggtgagcaaggccatcagcgcccccctgctgggcagcagcgtggacctggaggagagcatccccgagggcatggtggacgccgccagctacgccgccaacctgaccgacagcgccgaggcccccaagggcagccccggcagctggtggaagaaggagctgagcggcagcagcagcgcccccaagctggagtacaccgtgagaaccgacacccagagccccaccaacaccggcagccccagcagcccccagcagaagagcgagggcctgggcagcagacacagacccgtggccagagtgagcccccactgcaagagaagcgaggccgaggccaagcccagcggcagccagaccgtgaacctgaccggcagagccaacgacccctgcgacctggacagcagagtgcaggccaccagcgtgaaggtgaccgtggccggcttccagcccggcggcgccgtggagaagctgtgccaggagagcctgggcaagctgaccaccggcgacgcctgcgtgagcaccagctgcgagctggccagcgccctgagccacctggacgccagccacctgaccgagaacctgcccaaggccgccagcgagctgggccagcagcccatgaccgccagcgacctgatcagcagccccggcaagaagggcgccgcccaccccgaccccagcaagaccagcgtggacaccggccaggtgagcagacccgagaaccccagccagcccgccagccccagagtgaccaagtgcaaggccagaagccccgtgagactgccccacgagggcagccccagccccggcgagaaggccgccgccccccccgactacagcaagaccagaagcgccagcgagaccagcaccccccacaacaccagaagagtggccgccctgagaggcgccggccccggcgccgagggcatgacccccgccggcgccgtgctgcccggcgaccccctgaccagccaggagcagagacagggcgcccccggcaaccacagcaaggccctggagatgaccggcatccacgcccccgagagcagccaggagcccagcctgctggagggcgccgacagcgtgagcagcagagccccccaggccagcctgagcatgctgcccagcaccgacaacaccaaggaggcctgcggccacgtgagcggccactgctgccccggcggcagcagagagagccccgtgaccgacatcgacagcttcatcaaggagctggacgccagcgccgccagaagccccagcagccagaccggcgacagcggcagccaggagggcagcgcccagggccacccccccgccggcgccggcggcggcagcagctgcagagccgagcccgtgcccggcggccagaccagcagccccagaagagcctgggccgccggcgcccccgcctacccccagtgggccagccagcccagcgtgctggacagcatcaaccccgacaagcacttcaccgtgaacaagaacttcctgagcaactacagcagaaacttcagcagcttccacgaggacagcaccagcctgagcggcctgggcgacagcaccgagcccagcctgagcagcatgtacggcgacgccgaggacagcagcagcgaccccgagagcctgaccgaggcccccagagccagcgccagagacggctggagcccccccagaagcagagtgagcctgcacaaggaggaccccagcgagagcgaggaggagcagatcgagatctgcagcaccagaggctgccccaacccccccagcagccccgcccacctgcccacccaggccgccatctgccccgccagcgccaaggtgctgagcctgaagtacagcacccccagagagagcgtggccagccccagagagaaggccgcctgcctgcccggcagctacaccagcggccccgacagcagccagcccagcagcctgctggagatgagcagccaggagcacgagacccacgccgacatcagcaccagccagaaccacagacccagctgcgccgaggagaccaccgaggtgaccagcgccagcagcgccatggagaacagccccctgagcaaggtggccagacacttccacagcccccccatcatcctgagcagccccaacatggtgaacggcctggagcacgacctgctggacgacgagaccctgaaccagtacgagaccagcatcaacgccgccgccagcctgagcagcttcagcgtggacgtgcccaagaacggcgagagcgtgctggagaacctgcacatcagcgagagccaggacctggacgacctgctgcagaagcccaagatgatcgccagaagacccatcatggcctggttcaaggagatcaacaagcacaaccagggcacccacctgagaagcaagaccgagaaggagcagcccctgatgcccgccagaagccccgacagcaagatccagatggtgagcagcagccagaagaagggcgtgaccgtgccccacagccccccccagcccaagaccaacctggagaacaaggacctgagcaagaagagccccgccgagatgctgctgaccaacggccagaaggccaagtgcggccccaagctgaagagactgagcctgaagggcaaggccaaggtgaacagcgaggcccccgccgccaacgccgtgaaggccggcggcaccgaccacagaaagcccctgatcagcccccagaccagccacaagaccctgagcaaggccgtgagccagagactgcacgtggccgaccacgaggaccccgacagaaacaccaccgccgcccccagaagcccccagtgcgtgctggagagcaagccccccctggccaccagcggccccctgaagcccagcgtgagcgacaccagcatcagaaccttcgtgagccccctgaccagccccaagcccgtgcccgagcagggcatgtggagcagattccacatggccgtgctgagcgagcccgacagaggctgccccaccacccccaagagccccaagtgcagagccgagggcagagcccccagagccgacagcggccccgtgagccccgccgccagcagaaacggcatgagcgtggccggcaacagacagagcgagcccagactggccagccacgtggccgccgacaccgcccagcccagacccaccggcgagaagggcggcaacatcatggccagcgacagactggagagaaccaaccagctgaagatcgtggagatcagcgccgaggccgtgagcgagaccgtgtgcggcaacaagcccgccgagagcgacagaagaggcggctgcctggcccagggcaactgccaggagaagagcgagatcagactgtacagacaggtggccgagagcagcaccagccaccccagcagcctgcccagccacgccagccaggccgagcaggagatgagcagaagcttcagcatggccaagctggccagcagcagcagcagcctgcagaccgccatcagaaaggccgagtacagccagggcaagagcagcctgatgagcgacagcagaggcgtgcccagaaacagcatccccggcggccccagcggcgaggaccacctgtacttcacccccagacccgccaccagaacctacagcatgcccgcccagttcagcagccacttcggcagagagggccaccccccccacagcctgggcagaagcagagacagccaggtgcccgtgaccagcagcgtggtgcccgaggccaaggccagcagaggcggcctgcccagcctggccaacggccagggcatctacagcgtgaagcccctgctggacaccagcagaaacctgcccgccaccgacgagggcgacatcatcagcgtgcaggagaccagctgcctggtgaccgacaagatcaaggtgaccagaagacactactgctacgagcagaactggccccacgagagcaccagcttcttcagcgtgaagcagagaatcaagagcttcgagaacctggccaacgccgacagacccgtggccaagagcggcgccagccccttcctgagcgtgagcagcaagccccccatcggcagaagaagcagcggcagcatcgtgagcggcagcctgggccaccccggcgacgccgccgccagactgctgagaagaagcctgagcagctgcagcgagaaccagagcgaggccggcaccctgctgccccagatggccaagagccccagcatcatgaccctgaccatcagcagacagaacccccccgagaccagcagcaagggcagcgacagcgagctgaagaagagcctgggccccctgggcatccccacccccaccatgaccctggccagccccgtgaagagaaacaagagcagcgtgagacacacccagcccagccccgtgagcagaagcaagctgcaggagctgagagccctgagcatgcccgacctggacaagctgtgcagcgaggactacagcgccggccccagcgccgtgctgttcaagaccgagctggagatcacccccagaagaagccccggcccccccgccggcggcgtgagctgccccgagaagggcggcaacagagcctgccccggcggcagcggccccaagaccagcgccgccgagacccccagcagcgccagcgacaccggcgaggccgcccaggacctgcccttcagaagaagctggagcgtgaacctggaccagctgctggtgagcgccggcgaccagcagagactgcagagcgtgctgagcagcgtgggcagcaagagcaccatcctgaccctgatccaggaggccaaggcccagagcgagaacgaggaggacgtgtgcttcatcgtgctgaacagaaaggagggcagcggcctgggcttcagcgtggccggcggcaccgacgtggagcccaagagcatcaccgtgcacagagtgttcagccagggcgccgccagccaggagggcaccatgaacagaggcgacttcctgctgagcgtgaacggcgccagcctggccggcctggcccacggcaacgtgctgaaggtgctgcaccaggcccagctgcacaaggacgccctggtggtgatcaagaagggcatggaccagcccagacccagcgccagacaggagccccccaccgccaacggcaagggcctgctgagcagaaagaccatccccctggagcccggcatcggcagaagcgtggccgtgcacgacgccctgtgcgtggaggtgctgaagaccagcgccggcctgggcctgagcctggacggcggcaagagcagcgtgaccggcgacggccccctggtgatcaagagagtgtacaagggcggcgccgccgagcaggccggcatcatcgaggccggcgacgagatcctggccatcaacggcaagcccctggtgggcctgatgcacttcgacgcctggaacatcatgaagagcgtgcccgagggccccgtgcagctgctgatcagaaagcacagaaacagcagctag

SEQ ID NO: 92626 - DNA, 8520 bp, Artificial Sequence; identical to SEQ ID NO: 92624
  Description of Artificial Sequence: Synthetic coding sequence

SEQ ID NO: 92627 - DNA, 45 bp, Artificial Sequence
  Description of Artificial Sequence: Synthetic coding sequence
atgcccatcacccaggacaacgccgtgctgcacctgcccctgtag

SEQ ID NO: 92628 - DNA, 1476 bp, Artificial Sequence
  Description of Artificial Sequence: Synthetic coding sequence
atggagaaggccgccgacctgcaggacaccgccagcctgaccctgaagttcaagttcaaccccaagctgggcatcgacaaccccgtgctgagcctggccgaggaccacgacccctacgacccctggagcctggagagacccagattctgcctgctgagcaaggaggagggcaagagcttcggcttccacctgcagcaggagctgggcagagccggccacgtggtgtgcagagtggaccccggcaccagcgcccagagacagggcctgcaggagggcgacagaatcctggccgtgaacaacgacgtggtggagcacgaggactacgccgtggtggtgagaagaatcagagccagcagccccagagtgctgctgaccgtgctggccagacacgcccacgacgtggccagagcccagctgggcgaggacgcccacctgtgccccaccctgggccccggcgtgagacccagactgtgccacatcgtgaaggacgagggcggcttcggcttcagcgtgacccacggcaaccagggccccttctggctggtgctgagcaccggcggcgccgccgagagagccggcgtgccccccggcgccagactgctggaggtgaacggcctgtggcagagcggccagcaggtgaccctgctggtggccggccccgaggtggaggagcagtgcagacagctgggcctgcccctggccgcccccctggccgagggctgggccctgcccaccaagcccagatgcctgcacctggagaagggcccccagggcttcggcttcctgctgagagaggagaagggcctggacggcagacccggccagttcctgtgggaggtggaccccggcctgcccgccaagaaggccggcatgcaggccggcgacagactggtggccgtggccggcgagagcgtggagggcctgggccacgaggagaccgtgagcagaatccagggccagggcagctgcgtgagcctgaccgtggtggaccccgaggccgacagattcttcagcatggtgagactgagccccctgctgttcctggagaacaccgaggcccccgccagccccagaggcagcagcagcgccagcctggtggagaccgaggaccccagcctggaggacaccagcgtgcccagcgtgcccctgggcagcagacagtgcttcctgtaccccggccccggcggcagctacggcttcagactgagctgcgtggccagcggccccagactgttcatcagccaggtgacccccggcggcagcgccgccagagccggcctgcaggtgggcgacgtgatcctggaggtgaacggctaccccgtgggcggccagaacgacctggagagactgcagcagctgcccgaggccgagccccccctgtgcctgaagctggccgccagaagcctgagaggcctggaggcctggatcccccccggcgccgccgaggactgggccctggccagcgacctgctgtag

SEQ ID NO: 92629 - DNA, 1518 bp, Artificial Sequence
  Description of Artificial Sequence: Synthetic coding sequence
atggagaaggccgccgacctgcaggacaccgccagcctgaccctgaagttcaagttcaaccccaagctgggcatcgacaaccccgtgctgagcctggccgaggaccacgacccctacgacccctggagcctggagagacccagattctgcctgctgagcaaggaggagggcaagagcttcggcttccacctgcagcaggagctgggcagagccggccacgtggtgtgcagagtggaccccggcaccagcgcccagagacagggcctgcaggagggcgacagaatcctggccgtgaacaacgacgtggtggagcacgaggactacgccgtggtggtgagaagaatcagagccagcagccccagagtgctgctgaccgtgctggccagacacgcccacgacgtggccagagcccagctgggcgaggacgcccacctgtgccccaccctgggccccggcgtgagacccagactgtgccacatcgtgaaggacgagggcggcttcggcttcagcgtgacccacggcaaccagggccccttctggctggtgctgagcaccggcggcgccgccgagagagccggcgtgccccccggcgccagactgctggaggtgaacggcgtgagcgtggagaagttcacccacaaccagctgaccagaaagctgtggcagagcggccagcaggtgaccctgctggtggccggccccgaggtggaggagcagtgcagacagctgggcctgcccctggccgcccccctggccgagggctgggccctgcccaccaagcccagatgcctgcacctggagaagggcccccagggcttcggcttcctgctgagagaggagaagggcctggacggcagacccggccagttcctgtgggaggtggaccccggcctgcccgccaagaaggccggcatgcaggccggcgacagactggtggccgtggccggcgagagcgtggagggcctgggccacgaggagaccgtgagcagaatccagggccagggcagctgcgtgagcctgaccgtggtggaccccgaggccgacagattcttcagcatggtgagactgagccccctgctgttcctggagaacaccgaggcccccgccagccccagaggcagcagcagcgccagcctggtggagaccgaggaccccagcctggaggacaccagcgtgcccagcgtgcccctgggcagcagacagtgcttcctgtaccccggccccggcggcagctacggcttcagactgagctgcgtggccagcggccccagactgttcatcagccaggtgacccccggcggcagcgccgccagagccggcctgcaggtgggcgacgtgatcctggaggtgaacggctaccccgtgggcggccagaacgacctggagagactgcagcagctgcccgaggccgagccccccctgtgcctgaagctggccgccagaagcctgagaggcctggaggcctggatcccccccggcgccgccgaggactgggccctggccagcgacctgctgtag

SEQ ID NO: 92630 - DNA, 1716 bp, Artificial Sequence
  Description of Artificial Sequence: Synthetic coding sequence
atggtgacccccagcccccccggcaaccacagcctgagcctggaggcccccagactgcacaccgccagcgacctgctgggcaaccacagcctgggcctgcccctgatcaccgccctggtgggcagcagagacagaagaggcagagtgttcagccccgtgcccgtgcccctgcccaccaaccccaccacccagcaccccaccagacagaagctgcccagcaccctgagcggccacagagtgtgccaggcccacggcgagcccgtgctgggcctgtgccccctgctgcccctgttctgctgccccccccacccccccgacccctggagcctggagagacccagattctgcctgctgagcaaggaggagggcaagagcttcggcttccacctgcagcaggagctgggcagagccggccacgtggtgtgcagagtggaccccggcaccagcgcccagagacagggcctgcaggagggcgacagaatcctggccgtgaacaacgacgtggtggagcacgaggactacgccgtggtggtgagaagaatcagagccagcagccccagagtgctgctgaccgtgctggccagacacgcccacgacgtggccagagcccagctgggcgaggacgcccacctgtgccccaccctgggccccggcgtgagacccagactgtgccacatcgtgaaggacgagggcggcttcggcttcagcgtgacccacggcaaccagggccccttctggctggtgctgagcaccggcggcgccgccgagagagccggcgtgccccccggcgccagactgctggaggtgaacggcgtgagcgtggagaagttcacccacaaccagctgaccagaaagctgtggcagagcggccagcaggtgaccctgctggtggccggccccgaggtggaggagcagtgcagacagctgggcctgcccctggccgcccccctggccgagggctgggccctgcccaccaagcccagatgcctgcacctggagaagggcccccagggcttcggcttcctgctgagagaggagaagggcctggacggcagacccggccagttcctgtgggaggtggaccccggcctgcccgccaagaaggccggcatgcaggccggcgacagactggtggccgtggccggcgagagcgtggagggcctgggccacgaggagaccgtgagcagaatccagggccagggcagctgcgtgagcctgaccgtggtggaccccgaggccgacagattcttcagcatggtgagactgagccccctgctgttcctggagaacaccgaggcccccgccagccccagaggcagcagcagcgccagcctggtggagaccgaggaccccagcctggaggacaccagcgtgcccagcgtgcccctgggcagcagacagtgcttcctgtaccccggccccggcggcagctacggcttcagactgagctgcgtggccagcggccccagactgttcatcagccaggtgacccccggcggcagcgccgccagagccggcctgcaggtgggcgacgtgatcctggaggtgaacggctaccccgtgggcggccagaacgacctggagagactgcagcagctgcccgaggccgagccccccctgtgcctgaagctggccgccagaagcctgagaggcctggaggcctggatcccccccggcgccgccgaggactgggccctggccagcgacctgctgtag

SEQ ID NO: 92631 - DNA, 1518 bp, Artificial Sequence
  Description of Artificial Sequence: Synthetic coding sequence
atggaggaggccctggacctgcaggacaccgccagcctgaccctgaagttcaagttcaaccccaagctgggcatcgacaaccccgtgctgagcctggccgaggaccacgacccctacgacccctggagcctggagagacccagattctgcctgctgagcaaggaggagggcaagagcttcggcttccacctgcagcaggagctgggcagagccggccacgtggtgtgcagagtggaccccggcaccagcgcccagagacagggcctgcaggagggcgacagaatcctggccgtgaacaacgacgtggtggagcacgaggactacgccgtggtggtgagaagaatcagagccagcagccccagagtgctgctgaccgtgctggccagacacgcccacgacgtggccagagcccagctgggcgaggacgcccacctgtgccccaccctgggccccggcgtgagacccagactgtgccacatcgtgaaggacgagggcggcttcggcttcagcgtgacccacggcaaccagggccccttctggctggtgctgagcaccggcggcgccgccgagagagccggcgtgccccccggcgccagactgctggaggtgaacggcgtgagcgtggagaagttcacccacaaccagctgaccagaaagctgtggcagagcggccagcaggtgaccctgctggtggccggccccgaggtggaggagcagtgcagacagctgggcctgcccctggccgcccccctggccgagggctgggccctgcccaccaagcccagatgcctgcacctggagaagggcccccagggcttcggcttcctgctgagagaggagaagggcctggacggcagacccggccagttcctgtgggaggtggaccccggcctgcccgccaagaaggccggcatgcaggccggcgacagactggtggccgtggccggcgagagcgtggagggcctgggccacgaggagaccgtgagcagaatccagggccagggcagctgcgtgagcctgaccgtggtggaccccgaggccgacagattcttcagcatggtgagactgagccccctgctgttcctggagaacaccgaggcccccgccagccccagaggcagcagcagcgccagcctggtggagaccgaggaccccagcctggaggacaccagcgtgcccagcgtgcccctgggcagcagacagtgcttcctgtaccccggccccggcggcagctacggcttcagactgagctgcgtggccagcggccccagactgttcatcagccaggtgacccccggcggcagcgccgccagagccggcctgcaggtgggcgacgtgatcctggaggtgaacggctaccccgtgggcggccagaacgacctggagagactgcagcagctgcccgaggccgagccccccctgtgcctgaagctggccgccagaagcctgagaggcctggaggcctggatcccccccggcgccgccgaggactgggccctggccagcgacctgctgtag

SEQ ID NO: 92632 - DNA, 1716 bp, Artificial Sequence; identical to SEQ ID NO: 92630
  Description of Artificial Sequence: Synthetic coding sequence

SEQ ID NO: 92633 - DNA, 2310 bp, Artificial Sequence
  Description of Artificial Sequence: Synthetic coding sequence
atgggctgcaacatgtgcgtggtgcagaagcccgaggagcagtacaaggtgatgctgcaggtgaacggcaaggagctgagcaagctgagccaggagcagaccctgcaggccctgagaagcagcaaggagcccctggtgatccaggtgctgagaagaagccccagactgagaggcgacagcagctgccacgacctgcagctggtggacagcggcacccagaccgacatcaccttcgagcacatcatggccctgggcaagctgagaccccccaccccccccatggtgatcctggagcccccccccatcagccacgagtactacgaccccgccgagttcatggagggcggcccccaggaggccgacagactggacgagctggagtacgaggaggtggagctgtacaagagcagccacagagacaagctgggcctgatggtgtgctacagaaccgacgacgaggaggacctgggcatctacgtgggcgaggtgaaccccaacagcatcgccgccaaggacggcagaatcagagagggcgacagaatcatccagatcaacggcgtggacgtgcagaacagagaggaggccgtggccatcctgagccaggaggagaacaccaacatcagcctgctggtggccagacccgagagccagctggccaagagatggaaggacagcgacagagacgacttcctggacgacttcggcagcgagaacgagggcgagctgagagccagaaagctgaagagcccccccgcccagcagcccggcaacgaggaggagaagggcgcccccgacgccggccccggcctgagcaacagccaggagctggacagcggcgtgggcagaaccgacgagagcaccagaaacgaggagagcagcgagcacgacctgctgggcgacgagccccccagcagcaccaacacccccggcagcctgagaaagttcggcctgcagggcgacgccctgcagagcagagacttccacttcagcatggacagcctgctggccgagggcgccggcctgggcggcggcgacgtgcccggcctgaccgacgaggagtacgagagatacagagagctgctggagatcaagtgccacctggagaacggcaaccagctgggcctgctgttccccagagccagcggcggcaacagcgccctggacgtgaacagaaacgagagcctgggccacgagatggccatgctggaggaggagctgagacacctggagttcaagtgcagaaacatcctgagagcccagaagatgcagcagctgagagagagatgcatgaaggcctggctgctggaggaggagagcctgtacgacctggccgccagcgagcccaagaagcacgagctgagcgacatcagcgagctgcccgagaagagcgacaaggacagcaccagcgcctacaacaccggcgagagctgcagaagcacccccctgctggtggagcccctgcccgagagccccctgagaagagccatggccggcaacagcaacctgaacagaaccccccccggccccgccgtggccacccccgccaaggccgcccccccccccggcagccccgccaagttcagaagcctgagcagagaccccgaggccggcagaagacagcacgccgaggagagaggcagaagaaaccccaagaccggcctgaccctggagagagtgggccccgagagcagcccctacctgagcagaagacacagaggccagggccaggagggcgagcactaccacagctgcgtgcagctggcccccaccagaggcctggaggagctgggccacggccccctgagcctggccggcggccccagagtgggcggcgtggccgccgccgccaccgaggcccccagaatggagtggaaggtgaaggtgagaagcgacggcaccagatacgtggccaagagacccgtgagagacagactgctgaaggccagagccctgaagatcagagaggagagaagcggcatgaccaccgacgacgacgccgtgagcgagatgaagatgggcagatactggagcaaggaggagagaaagcagcacctgatcagagccagagagcagagaaagagaagagagttcatgatgcagagcagactggagtgcctgagagagcagcagaacggcgacagcaagcccgagctgaacatcatcgccctgagccacagaaagaccatgaagaagagaaacaagaagatcctggacaactggatcaccatccaggagatgctggcccacggcgccagaagcgccgacggcaagagagtgtacaaccccctgctgagcgtgaccaccgtgtag

SEQ ID NO: 92634 - DNA, 2085 bp, Artificial Sequence
  Description of Artificial Sequence: Synthetic coding sequence
atggccctgggcaagctgagaccccccaccccccccatggtgatcctggagccctacgtgctgagcgagctgccccccatcagccacgagtactacgaccccgccgagttcatggagggcggcccccaggaggccgacagactggacgagctggagtacgaggaggtggagctgtacaagagcagccacagagacaagctgggcctgatggtgtgctacagaaccgacgacgaggaggacctgggcatctacgtgggcgaggtgaaccccaacagcatcgccgccaaggacggcagaatcagagagggcgacagaatcatccagatcaacggcgtggacgtgcagaacagagaggaggccgtggccatcctgagccaggaggagaacaccaacatcagcctgctggtggccagacccgagagccagctggccaagagatggaaggacagcgacagagacgacttcctggacgacttcggcagcgagaacgagggcgagctgagagccagaaagctgaagagcccccccgcccagcagcccggcaacgaggaggagaagggcgcccccgacgccggccccggcctgagcaacagccaggagctggacagcggcgtgggcagaaccgacgagagcaccagaaacgaggagagcagcgagcacgacctgctgggcgacgagccccccagcagcaccaacacccccggcagcctgagaaagttcggcctgcagggcgacgccctgcagagcagagacttccacttcagcatggacagcctgctggccgagggcgccggcctgggcggcggcgacgtgcccggcctgaccgacgaggagtacgagagatacagagagctgctggagatcaagtgccacctggagaacggcaaccagctgggcctgctgttccccagagccagcggcggcaacagcgccctggacgtgaacagaaacgagagcctgggccacgagatggccatgctggaggaggagctgagacacctggagttcaagtgcagaaacatcctgagagcccagaagatgcagcagctgagagagagatgcatgaaggcctggctgctggaggaggagagcctgtacgacctggccgccagcgagcccaagaagcacgagctgagcgacatcagcgagctgcccgagaagagcgacaaggacagcaccagcgcctacaacaccggcgagagctgcagaagcacccccctgctggtggagcccctgcccgagagccccctgagaagagccatggccggcaacagcaacctgaacagaaccccccccggccccgccgtggccacccccgccaaggccgcccccccccccggcagccccgccaagttcagaagcctgagcagagaccccgaggccggcagaagacagcacgccgaggagagaggcagaagaaaccccaagaccggcctgaccctggagagagtgggccccgagagcagcccctacctgagcagaagacacagaggccagggccaggagggcgagcactaccacagctgcgtgcagctggcccccaccagaggcctggaggagctgggccacggccccctgagcctggccggcggccccagagtgggcggcgtggccgccgccgccaccgaggcccccagaatggagtggaaggtgaaggtgagaagcgacggcaccagatacgtggccaagagacccgtgagagacagactgctgaaggccagagccctgaagatcagagaggagagaagcggcatgaccaccgacgacgacgccgtgagcgagatgaagatgggcagatactggagcaaggaggagagaaagcagcacctgatcagagccagagagcagagaaagagaagagagttcatgatgcagagcagactggagtgcctgagagagcagcagaacggcgacagcaagcccgagctgaacatcatcgccctgagccacagaaagaccatgaagaagagaaacaagaagatcctggacaactggatcaccatccaggagatgctggcccacggcgccagaagcgccgacggcaagagagtgtacaaccccctgctgagcgtgaccaccgtgtag

SEQ ID NO: 92635 - DNA, 2022 bp, Artificial Sequence
  Description of Artificial Sequence: Synthetic coding sequence
atgaccgccccccccatcagccacgagtactacgaccccgccgagttcatggagggcggcccccaggaggccgacagactggacgagctggagtacgaggaggtggagctgtacaagagcagccacagagacaagctgggcctgatggtgtgctacagaaccgacgacgaggaggacctgggcatctacgtgggcgaggtgaaccccaacagcatcgccgccaaggacggcagaatcagagagggcgacagaatcatccagatcaacggcgtggacgtgcagaacagagaggaggccgtggccatcctgagccaggaggagaacaccaacatcagcctgctggtggccagacccgagagccagctggccaagagatggaaggacagcgacagagacgacttcctggacgacttcggcagcgagaacgagggcgagctgagagccagaaagctgaagagcccccccgcccagcagcccggcaacgaggaggagaagggcgcccccgacgccggccccggcctgagcaacagccaggagctggacagcggcgtgggcagaaccgacgagagcaccagaaacgaggagagcagcgagcacgacctgctgggcgacgagccccccagcagcaccaacacccccggcagcctgagaaagttcggcctgcagggcgacgccctgcagagcagagacttccacttcagcatggacagcctgctggccgagggcgccggcctgggcggcggcgacgtgcccggcctgaccgacgaggagtacgagagatacagagagctgctggagatcaagtgccacctggagaacggcaaccagctgggcctgctgttccccagagccagcggcggcaacagcgccctggacgtgaacagaaacgagagcctgggccacgagatggccatgctggaggaggagctgagacacctggagttcaagtgcagaaacatcctgagagcccagaagatgcagcagctgagagagagatgcatgaaggcctggctgctggaggaggagagcctgtacgacctggccgccagcgagcccaagaagcacgagctgagcgacatcagcgagctgcccgagaagagcgacaaggacagcaccagcgcctacaacaccggcgagagctgcagaagcacccccctgctggtggagcccctgcccgagagccccctgagaagagccatggccggcaacagcaacctgaacagaaccccccccggccccgccgtggccacccccgccaaggccgcccccccccccggcagccccgccaagttcagaagcctgagcagagaccccgaggccggcagaagacagcacgccgaggagagaggcagaagaaaccccaagaccggcctgaccctggagagagtgggccccgagagcagcccctacctgagcagaagacacagaggccagggccaggagggcgagcactaccacagctgcgtgcagctggcccccaccagaggcctggaggagctgggccacggccccctgagcctggccggcggccccagagtgggcggcgtggccgccgccgccaccgaggcccccagaatggagtggaaggtgaaggtgagaagcgacggcaccagatacgtggccaagagacccgtgagagacagactgctgaaggccagagccctgaagatcagagaggagagaagcggcatgaccaccgacgacgacgccgtgagcgagatgaagatgggcagatactggagcaaggaggagagaaagcagcacctgatcagagccagagagcagagaaagagaagagagttcatgatgcagagcagactggagtgcctgagagagcagcagaacggcgacagcaagcccgagctgaacatcatcgccctgagccacagaaagaccatgaagaagagaaacaagaagatcctggacaactggatcaccatccaggagatgctggcccacggcgccagaagcgccgacggcaagagagtgtacaaccccctgctgagcgtgaccaccgtgtag

SEQ ID NO: 92636 - DNA, 1983 bp, Artificial Sequence
  Description of Artificial Sequence: Synthetic coding sequence
atgggctgcaacatgtgcgtggtgcagaagcccgaggagcagtacaaggtgatgctgcaggaggtggagctgtacaagagcagccacagagacaagctgggcctgatggtgtgctacagaaccgacgacgaggaggacctgggcatctacgtgggcgaggtgaaccccaacagcatcgccgccaaggacggcagaatcagagagggcgacagaatcatccagatcaacggcgtggacgtgcagaacagagaggaggccgtggccatcctgagccaggaggagaacaccaacatcagcctgctggtggccagacccgagagccagctggccaagagatggaaggacagcgacagagacgacttcctggacgacttcggcagcgagaacgagggcgagctgagagccagaaagctgaagagcccccccgcccagcagcccggcaacgaggaggagaagggcgcccccgacgccggccccggcctgagcaacagccaggagctggacagcggcgtgggcagaaccgacgagagcaccagaaacgaggagagcagcgagcacgacctgctgggcgacgagccccccagcagcaccaacacccccggcagcctgagaaagttcggcctgcagggcgacgccctgcagagcagagacttccacttcagcatggacagcctgctggccgagggcgccggcctgggcggcggcgacgtgcccggcctgaccgacgaggagtacgagagatacagagagctgctggagatcaagtgccacctggagaacggcaaccagctgggcctgctgttccccagagccagcggcggcaacagcgccctggacgtgaacagaaacgagagcctgggccacgagatggccatgctggaggaggagctgagacacctggagttcaagtgcagaaacatcctgagagcccagaagatgcagcagctgagagagagatgcatgaaggcctggctgctggaggaggagagcctgtacgacctggccgccagcgagcccaagaagcacgagctgagcgacatcagcgagctgcccgagaagagcgacaaggacagcaccagcgcctacaacaccggcgagagctgcagaagcacccccctgctggtggagcccctgcccgagagccccctgagaagagccatggccggcaacagcaacctgaacagaaccccccccggccccgccgtggccacccccgccaaggccgcccccccccccggcagccccgccaagttcagaagcctgagcagagaccccgaggccggcagaagacagcacgccgaggagagaggcagaagaaaccccaagaccggcctgaccctggagagagtgggccccgagagcagcccctacctgagcagaagacacagaggccagggccaggagggcgagcactaccacagctgcgtgcagctggcccccaccagaggcctggaggagctgggccacggccccctgagcctggccggcggccccagagtgggcggcgtggccgccgccgccaccgaggcccccagaatggagtggaaggtgaaggtgagaagcgacggcaccagatacgtggccaagagacccgtgagagacagactgctgaaggccagagccctgaagatcagagaggagagaagcggcatgaccaccgacgacgacgccgtgagcgagatgaagatgggcagatactggagcaaggaggagagaaagcagcacctgatcagagccagagagcagagaaagagaagagagttcatgatgcagagcagactggagtgcctgagagagcagcagaacggcgacagcaagcccgagctgaacatcatcgccctgagccacagaaagaccatgaagaagagaaacaagaagatcctggacaactggatcaccatccaggagatgctggcccacggcgccagaagcgccgacggcaagagagtgtacaaccccctgctgagcgtgaccaccgtgtag

SEQ ID NO: 92637 - DNA, 1554 bp, Artificial Sequence
  Description of Artificial Sequence: Synthetic coding sequence
atggcccagggcttcgccgtgggcttcgaccccctgggcctgggcgacctgagcagcggcagcctgagcagcctgagcagcagaggccacctgggcagcgacagcggcagcaccgccaccagatacctgctgagaaagcagcagagactgctgaacggcccccccagaggcatcagagccagcagccccatgggcagagtgatcctgatcaacagccccatcgaggccaacagcgacgagagcgacatcatccacagcgtgagagtggagaagagccccgccggcagactgggcttcagcgtgagaggcggcagcgagcacggcctgggcatcttcgtgagcaaggtggaggagggcagcagcgccgagagagccggcctgtgcgtgggcgacaagatcaccgaggtgaacggcctgagcctggagagcaccaccatgggcagcgccgtgaaggtgctgaccagcagcagcagactgcacatgatggtgagaagaatgggcagagtgcccggcatcaagttcagcaaggagaagaccacctgggtggacgtggtgaacagaagactggtggtggagaagtgcggcagcacccccagcgacaccagcagcgaggacggcgtgagaagaatcgtgcacctgtacaccaccagcgacgacttctgcctgggcttcaacatcagaggcggcaaggagttcggcctgggcatctacgtgagcaaggtggaccacggcggcctggccgaggagaacggcatcaaggtgggcgaccaggtgctggccgccaacggcgtgagattcgacgacatcagccacagccaggccgtggaggtgctgaagggccagacccacatcatgctgaccatcaaggagaccggcagataccccgcctacaaggagatggtgagcgagtactgctggctggacagactgagcaacggcgtgctgcagcagctgagccccgccagcgagagcagcagcagcgtgagcagctgcgccagcagcgccccctacagcagcggcagcctgcccagcgacagaatggacatctgcctgggccaggaggagcccggcagcagaggccccggctggggcagagccgacaccgccatgcagaccgagcccgacgccggcggcagagtggagacctggtgcagcgtgagacccaccgtgatcctgagagacaccgccatcagaagcgacggcccccaccccggcagaagactggacagcgccctgagcgagagccccaagaccgccctgctgctggccctgagcagacccagaccccccatcaccagaagccagagctacctgaccctgtgggaggagaagcagcagagaaagaaggagaagagcggcagccccggcgagaagggcgccctgcagagaagcaagaccctgatgaacctgttcttcaagggcggcagacagggcagactggccagagacggcagaagagaggcctggaccctggacagcggcagcctggccaagacctaccccagactggacatcgagaaggagatgggcgtgagcccctgctgccccggctag

SEQ ID NO: 92638 - DNA, 3102 bp, Artificial Sequence
  Description of Artificial Sequence: Synthetic coding sequence
atggcccagggcttcgccgtgggcttcgaccccctgggcctgggcgacctgagcagcggcagcctgagcagcctgagcagcagaggccacctgggcagcgacagcggcagcaccgccaccagatacctgctgagaaagcagcagagactgctgaacggcccccccagaggcatcagagccagcagccccatgggcagagtgatcctgatcaacagccccatcgaggccaacagcgacgagagcgacatcatccacagcgtgagagtggagaagagccccgccggcagactgggcttcagcgtgagaggcggcagcgagcacggcctgggcatcttcgtgagcaaggtggaggagggcagcagcgccgagagagccggcctgtgcgtgggcgacaagatcaccgaggtgaacggcctgagcctggagagcaccaccatgggcagcgccgtgaaggtgctgaccagcagcagcagactgcacatgatggtgagaagaatgggcagagtgcccggcatcaagttcagcaaggagaagaccacctgggtggacgtggtgaacagaagactggtggtggagaagtgcggcagcacccccagcgacaccagcagcgaggacggcgtgagaagaatcgtgcacctgtacaccaccagcgacgacttctgcctgggcttcaacatcagaggcggcaaggagttcggcctgggcatctacgtgagcaaggtggaccacggcggcctggccgaggagaacggcatcaaggtgggcgaccaggtgctggccgccaacggcgtgagattcgacgacatcagccacagccaggccgtggaggtgctgaagggccagacccacatcatgctgaccatcaaggagaccggcagataccccgcctacaaggagatggtgagcgagtactgctggctggacagactgagcaacggcgtgctgcagcagctgagccccgccagcgagagcagcagcagcgtgagcagctgcgccagcagcgccccctacagcagcggcagcctgcccagcgacagaatggacatctgcctgggccaggaggagcccggcagcagaggccccggctggggcagagccgacaccgccatgcagaccgagcccgacgccggcggcagagtggagacctggtgcagcgtgagacccaccgtgatcctgagagacaccgccatcagaagcgacggcccccaccccggcagaagactggacagcgccctgagcgagagccccaagaccgccctgctgctggccctgagcagacccagaccccccatcaccagaagccagagctacctgaccctgtgggaggagaagcagcagagaaagaaggagaagagcggcagccccggcgagaagggcgccctgcagagaagcaagaccctgatgaacctgttcttcaagggcggcagacagggcagactggccagagacggcagaagagaggcctggaccctggacagcggcagcctggccaagacctaccccagactggacatcgagaaggccggcggcgtgggccccgtgcagaagttcgtgacctggagactgagaagagaccaggagagaggcagagccctgctgagcgccagaagcggcagccccagcagccagctgcccaacgtggacgagcaggtgcaggcctgggagagcagaagacccctgatccaggacctggcccagagactgctgaccgacgacgaggtgctggccgtgaccagacactgcagcagatacgtgcacgagggcggcatcgaggacctggtgagacccctgctggccatcctggacagacccgagaagctgctgctgctgcaggacatcagaagcgtggtggcccccaccgacctgggcagattcgacagcatggtgatgctggtggagctggaggccttcgaggccctgaagagcagagccgtgagaccccccgccctgagacccgccagacaggacaccccccccaagagacacctgatcacccccgtgcccgacagcagaggcggcttctacctgctgcccgtgaacggcttccccgaggaggaggacaacggcgagctgagagagagactgggcgccctgaaggtgagccccagcgccagcgcccccagacacccccacaagggcatcccccccctgcaggacgtgcccgtggacgccttcacccccctgagaatcgcctgcaccccccccccccagctgccccccgtggcccccagacccctgagacccaactggctgctgaccgagcccctgagcagagagcaccccccccagagccagatcagaggcagagcccagagcagaagcagaagcagaagcagaagcagaagcagaagcagcagaggccagggcaagagccccggcagaagaagccccagccccgtgcccacccccgcccccagcatgaccaacggcagataccacaagcccagaaaggccagaccccccctgcccagacccctggacggcgaggccgccaaggtgggcgccaagcagggccccagcgagagcggcaccgagggcaccgccaaggaggccgccatgaagaaccccagcggcgagctgaagaccgtgaccctgagcaagatgaagcagagcctgggcatcagcatcagcggcggcatcgagagcaaggtgcagcccatggtgaagatcgagaagatcttccccggcggcgccgccttcctgagcggcgccctgcaggccggcttcgagctggtggccgtggacggcgagaacctggagcaggtgacccaccagagagccgtggacaccatcagaagagcctacagaaacaaggccagagagcccatggagctggtggtgagagtgcccggccccagccccagacccagccccagcgacagcagcgccctgaccgacggcggcctgcccgccgaccacctgcccgcccaccagcccctggacgccgcccccgtgcccgcccactggctgcccgagccccccaccaacccccagaccccccccaccgacgccagactgctgcagcccacccccagccccgcccccagccccgccctgcagacccccgacagcaagcccgcccccagccccagaatcccctag

SEQ ID NO: 92639 - DNA, 627 bp, Artificial Sequence
  Description of Artificial Sequence: Synthetic coding sequence
tgacccagaccccccatcaccagaagccagagctacctgaccctgtgggaggagaagcagcagagaaagaaggagaagagcggcagccccggcgagaagggcgccctgcagagaagcaagaccctgatgaacctgttcttcaagggcggcagacagggcagactggccagagacggcagaagagaggcctggaccctggacagcggcagcctggccaagacctaccccagactggacatcgagaaggccggcggcgtgggccccgtgcagaagttcgtgacctggagactgagaagagaccaggagagaggcagagccctgctgagcgccagaagcggcagccccagcagccagctgcccaacgtggacgagcaggtgcaggcctgggagagcagaagacccctgatccaggacctggcccagagactgctgaccgacgacgaggtgctggccgtgaccagacactgcagcagatacgtgcacgagggcggcatcgaggacctggtgagacccctgctggccatcctggacagacccgagaagctgctgctgctgcaggacatcagaagcgtggtggcccccaccgacctgggcagattcgacagcatggtgatgctggtggagtag

SEQ ID NO: 92640 - DNA, 3465 bp, Artificial Sequence
  Description of Artificial Sequence: Synthetic coding sequence
atgggcctgctgctgatgatcctggccagcgccgtgctgggcagcttcctgaccctgctggcccagttcttcctgctgtacagaagacagcccgagccccccgccgacgaggccgccagagccggcgagggcttcagatacatcaagcccgtgcccggcctgctgctgagagagtacctgtacggcggcggcagagacgaggagcccagcggcgccgcccccgagggcggcgccacccccaccgccgcccccgagacccccgccccccccaccagagagacctgctacttcctgaacgccaccatcctgttcctgttcagagagctgagagacaccgccctgaccagaagatgggtgaccaagaagatcaaggtggagttcgaggagctgctgcagaccaagaccgccggcagactgctggagggcctgagcctgagagacgtgttcctgggcgagaccgtgcccttcatcaagaccatcagactggtgagacccgtggtgcccagcgccaccggcgagcccgacggccccgagggcgaggccctgcccgccgcctgccccgaggagctggccttcgaggccgaggtggagtacaacggcggcttccacctggccatcgacgtggacctggtgttcggcaagagcgcctacctgttcgtgaagctgagcagagtggtgggcagactgagactggtgttcaccagagtgcccttcacccactggttcttcagcttcgtggaggaccccctgatcgacttcgaggtgagaagccagttcgagggcagacccatgccccagctgaccagcatcatcgtgaaccagctgaagaagatcatcaagagaaagcacaccctgcccaactacaagatcagattcaagcccttcttcccctaccagaccctgcagggcttcgaggaggacgaggagcacatccacatccagcagtgggccctgaccgagggcagactgaaggtgaccctgctggagtgcagcagactgctgatcttcggcagctacgacagagaggccaacgtgcactgcaccctggagctgagcagcagcgtgtgggaggagaagcagagaagcagcatcaagaccgtggagctgatcaagggcaacctgcagagcgtgggcctgaccctgagactggtgcagagcaccgacggctacgccggccacgtgatcatcgagaccgtggcccccaacagccccgccgccatcgccgacctgcagagaggcgacagactgatcgccatcggcggcgtgaagatcaccagcaccctgcaggtgctgaagctgatcaagcaggccggcgacagagtgctggtgtactacgagagacccgtgggccagagcaaccagggcgccgtgctgcaggacaacttcggccagctggaggagaacttcctgagcagcagctgccagagcggctacgaggaggaggccgccggcctgaccgtggacaccgagagcagagagctggacagcgagttcgaggacctggccagcgacgtgagagcccagaacgagttcaaggacgaggcccagagcctgagccacagccccaagagagtgcccaccaccctgagcatcaagcccctgggcgccatcagccccgtgctgaacagaaagctggccgtgggcagccaccccctgccccccaagatccagagcaaggacggcaacaagcccccccccctgaagaccagcgagatcaccgaccccgcccaggtgagcaagcccacccagggcagcgccttcaagccccccgtgccccccagaccccaggccaaggtgcccctgcccagcgccgacgcccccaaccaggccgagcccgacgtgctggtggagaagcccgagaaggtggtgcccccccccctggtggacaagagcgccgagaagcaggccaagaacgtggacgccatcgacgacgccgccgcccccaagcagttcctggccaagcaggaggtggccaaggacgtgaccagcgagaccagctgccccaccaaggacagcagcgacgacagacagacctgggagagcagcgagatcctgtacagaaacaagctgggcaagtggaccagaaccagagccagctgcctgttcgacatcgaggcctgccacagatacctgaacatcgccctgtggtgcagagaccccttcaagctgggcggcctgatctgcctgggccacgtgagcctgaagctggaggacgtggccctgggctgcctggccaccagcaacaccgagtacctgagcaagctgagactggaggcccccagccccaaggccatcgtgaccagaaccgccctgagaaacctgagcatgcagaagggcttcaacgacaagttctgctacggcgacatcaccatccacttcaagtacctgaaggagggcgagagcgaccaccacgtggtgaccaacgtggagaaggagaaggagccccacctggtggaggaggtgagcgtgctgcccaaggaggagcagttcgtgggccagatgggcctgaccgagaacaagcacagcttccaggacacccagttccagaaccccacctggtgcgactactgcaagaagaaggtgtggaccaaggccgccagccagtgcatgttctgcgcctacgtgtgccacaagaagtgccaggagaagtgcctggccgagaccagcgtgtgcggcgccaccgacagaagaatcgacagaaccctgaagaacctgagactggagggccaggagaccctgctgggcctgccccccagagtggacgccgaggccagcaagagcgtgaacaagaccaccggcctgaccagacacatcatcaacaccagcagcagactgctgaacctgagacaggtgagcaagaccagactgagcgagcccggcaccgacctggtggagcccagccccaagcacacccccaacaccagcgacaacgagggcagcgacaccgaggtgtgcggccccaacagccccagcaagagaggcaacagcaccggcatcaagctggtgagaaaggagggcggcctggacgacagcgtgttcatcgccgtgaaggagatcggcagagacctgtacagaggcctgcccaccgaggagagaatccagaagctggagttcatgctggacaagctgcagaacgagatcgaccaggagctggagcacaacaacagcctggtgagagaggagaaggagaccaccgacaccagaaagaagagcctgctgagcgccgccctggccaagagcggcgagagactgcaggccctgaccctgctgatgatccactacagagccggcatcgaggacatcgagaccctggagagcctgagcctggaccagcacagcaagaagatcagcaagtacaccgacgacaccgaggaggacctggacaacgagatcagccagctgatcgacagccagcccttcagcagcatcagcgacgacctgttcggccccagcgagagcgtgtag

SEQ ID NO: 92641 - DNA, 3201 bp, Artificial Sequence
  Description of Artificial Sequence: Synthetic coding sequence
atgggcttcgagctggacagattcgacggcgacgtggaccccgacctgaagtgcgccctgtgccacaaggtgctggaggaccccctgaccaccccctgcggccacgtgttctgcgccggctgcgtgctgccctgggtggtgcaggagggcagctgccccgccagatgcagaggcagactgagcgccaaggagctgaaccacgtgctgcccctgaagagactgatcctgaagctggacatcaagtgcgcctacgccaccagaggctgcggcagagtggtgaagctgcagcagctgcccgagcacctggagagatgcgacttcgcccccgccagatgcagacacgccggctgcggccaggtgctgctgagaagagacgtggaggcccacatgagagacgcctgcgacgccagacccgtgggcagatgccaggagggctgcggcctgcccctgacccacggcgagcagagagccggcggccactgctgcgccagagccctgagagcccacaacggcgccctgcaggccagactgggcgccctgcacaaggccctgaagaaggaggccctgagagccggcaagagagagaagagcctggtggcccagctggccgccgcccagctggagctgcagatgaccgccctgagataccagaagaagttcaccgagtacagcgccagactggacagcctgagcagatgcgtggccgccccccccggcggcaagggcgaggagaccaagagcctgaccctggtgctgcacagagacagcggcagcctgggcttcaacatcatcggcggcagacccagcgtggacaaccacgacggcagcagcagcgagggcatcttcgtgagcaagatcgtggacagcggccccgccgccaaggagggcggcctgcagatccacgacagaatcatcgaggtgaacggcagagacctgagcagagccacccacgaccaggccgtggaggccttcaagaccgccaaggagcccatcgtggtgcaggtgctgagaagaacccccagaaccaagatgttcaccccccccagcgagagccagctggtggacaccggcacccagaccgacatcaccttcgagcacatcatggccctgaccaagatgagcagccccagcccccccgtgctggacccctacctgctgcccgaggagcaccccagcgcccacgagtactacgaccccaacgactacatcggcgacatccaccaggagatggacagagaggagctggagctggaggaggtggacctgtacagaatgaacagccaggacaagctgggcctgaccgtgtgctacagaaccgacgacgaggacgacatcggcatctacatcagcgagatcgaccccaacagcatcgccgccaaggacggcagaatcagagagggcgacagaatcatccagatcaacggcatcgaggtgcagaacagagaggaggccgtggccctgctgaccagcgaggagaacaagaacttcagcctgctgatcgccagacccgagctgcagctggacgagggctggatggacgacgacagaaacgacttcctggacgacctgcacatggacatgctggaggagcagcaccaccaggccatgcagttcaccgccagcgtgctgcagcagaagaagcacgacgaggacggcggcaccaccgacaccgccaccatcctgagcaaccagcacgagaaggacagcggcgtgggcagaaccgacgagagcaccagaaacgacgagagcagcgagcaggagaacaacggcgacgacgccaccgccagcagcaaccccctggccggccagagaaagctgacctgcagccaggacaccctgggcagcggcgacctgcccttcagcaacgagagcttcatcagcgccgactgcaccgacgccgactacctgggcatccccgtggacgagtgcgagagattcagagagctgctggagctgaagtgccaggtgaagagcgccaccccctacggcctgtactaccccagcggccccctggacgccggcaagagcgaccccgagagcgtggacaaggagctggagctgctgaacgaggagctgagaagcatcgagctggagtgcctgagcatcgtgagagcccacaagatgcagcagctgaaggagcagtacagagagagctggatgctgcacaacagcggcttcagaaactacaacaccagcatcgacgtgagaagacacgagctgagcgacatcaccgagctgcccgagaagagcgacaaggacagcagcagcgcctacaacaccggcgagagctgcagaagcacccccctgaccctggagatcagccccgacaacagcctgagaagagccgccgagggcatcagctgccccagcagcgagggcgccgtgggcaccaccgaggcctacggccccgccagcaagaacctgctgagcatcaccgaggaccccgaggtgggcacccccacctacagccccagcctgaaggagctggaccccaaccagcccctggagagcaaggagagaagagccagcgacggcagcagaagccccacccccagccagaagctgggcagcgcctacctgcccagctaccaccacagcccctacaagcacgcccacatccccgcccacgcccagcactaccagagctacatgcagctgatccagcagaagagcgccgtggagtacgcccagagccagatgagcctggtgagcatgtgcaaggacctgagcagccccacccccagcgagcccagaatggagtggaaggtgaagatcagaagcgacggcaccagatacatcaccaagagacccgtgagagacagactgctgagagagagagccctgaagatcagagaggagagaagcggcatgaccaccgacgacgacgccgtgagcgagatgaagatgggcagatactggagcaaggaggagagaaagcagcacctggtgaaggccaaggagcagagaagaagaagagagttcatgatgcagagcagactggactgcctgaaggagcagcaggccgccgacgacagaaaggagatgaacatcctggagctgagccacaagaagatgatgaagaagagaaacaagaagatcttcgacaactggatgaccatccaggagctgctgacccacggcaccaagagccccgacggcaccagagtgtacaacagcttcctgagcgtgaccaccgtgtag

SEQ ID NO: 92642 - DNA, 2190 bp, Artificial Sequence
  Description of Artificial Sequence: Synthetic coding sequence
atgggcttcgagctggacagattcgacggcgacgtggaccccgacctgaagtgcgccctgtgccacaaggtgctggaggaccccctgaccaccccctgcggccacgtgttctgcgccggctgcgtgctgccctgggtggtgcaggagggcagctgccccgccagatgcagaggcagactgagcgccaaggagctgaaccacgtgctgcccctgaagagactgatcctgaagctggacatcaagtgcgcctacgccaccagaggctgcggcagagtggtgaagctgcagcagctgcccgagcacctggagagatgcgacttcgcccccgccagatgcagacacgccggctgcggccaggtgctgctgagaagagacgtggaggcccacatgagagacgcctgcgacgccagacccgtgggcagatgccaggagggctgcggcctgcccctgacccacggcgagcagagagccggcggccactgctgcgccagagccctgagagcccacaacggcgccctgcaggccagactgggcgccctgcacaaggccctgaagaaggaggccctgagagccggcaagagagagaagagcctggtggcccagctggccgccgcccagctggagctgcagatgaccgccctgagataccagaagaagttcaccgagtacagcgccagactggacagcctgagcagatgcgtggccgccccccccggcggcaagggcgaggagaccaagagcctgaccctggtgctgcacagagacagcggcagcctgggcttcaacatcatcggcggcagacccagcgtggacaaccacgacggcagcagcagcgagggcatcttcgtgagcaagatcgtggacagcggccccgccgccaaggagggcggcctgcagatccacgacagaatcatcgaggtgaacggcagagacctgagcagagccacccacgaccaggccgtggaggccttcaagaccgccaaggagcccatcgtggtgcaggtgctgagaagaacccccagaaccaagatgttcaccccccccagcgagagccagctggtggacaccggcacccagaccgacatcaccttcgagcacatcatggccctgaccaagatgagcagccccagcccccccgtgctggacccctacctgctgcccgaggagcaccccagcgcccacgagtactacgaccccaacgactacatcggcgacatccaccaggagatggacagagaggagctggagctggaggaggtggacctgtacagaatgaacagccaggacaagctgggcctgaccgtgtgctacagaaccgacgacgaggacgacatcggcatctacatcagcgagatcgaccccaacagcatcgccgccaaggacggcagaatcagagagggcgacagaatcatccagatcaacggcatcgaggtgcagaacagagaggaggccgtggccctgctgaccagcgaggagaacaagaacttcagcctgctgatcgccagacccgagctgcagctggacgagggctggatggacgacgacagaaacgacttcctggacgacctgcacatggacatgctggaggagcagcaccaccaggccatgcagttcaccgccagcgtgctgcagcagaagaagcacgacgaggacggcggcaccaccgacaccgccaccatcctgagcaaccagcacgagaaggacagcggcgtgggcagaaccgacgagagcaccagaaacgacgagagcagcgagcaggagaacaacggcgacgacgccaccgccagcagcaaccccctggccggccagagaaagctgacctgcagccaggacaccctgggcagcggcgacctgcccttcagcaacgagagcttcatcagcgccgactgcaccgacgccgactacctgggcatccccgtggagggcgaggacccccagagaagagacgccctgcaccaccaggaggccagagccggcccccccgccgccggcgccagacccgaggaccccggcagagcccagagacacgaccacagaagaagaagaggcgagagagacgaggacggcgccctgctggagcagggcggcgaggaggccgcccccggcgagggccagggcgccgccgccgccgccagagtgcacgacgccgagcaggtgggcctgagccagggcgccgccagcagcagatag

SEQ ID NO: 92643 - DNA, 2352 bp, Artificial Sequence
  Description of Artificial Sequence: Synthetic coding sequence
atgggctgcagcctgtgcagcctgcagaagcaggaggagcagtacaagctgctgtacgaggtgtgccaggtgaacggcagagacctgagcagagccacccacgaccaggccgtggaggccttcaagaccgccaaggagcccatcgtggtgcaggtgctgagaagaacccccagaaccaagatgttcaccccccccagcgagagccagctggtggacaccggcacccagaccgacatcaccttcgagcacatcatggccctgaccaagatgagcagccccagcccccccgtgctggacccctacctgctgcccgaggagcaccccagcgcccacgagtactacgaccccaacgactacatcggcgacatccaccaggagatggacagagaggagctggagctggaggaggtggacctgtacagaatgaacagccaggacaagctgggcctgaccgtgtgctacagaaccgacgacgaggacgacatcggcatctacatcagcgagatcgaccccaacagcatcgccgccaaggacggcagaatcagagagggcgacagaatcatccagatcaacggcatcgaggtgcagaacagagaggaggccgtggccctgctgaccagcgaggagaacaagaacttcagcctgctgatcgccagacccgagctgcagctggacgagggctggatggacgacgacagaaacgacttcctggacgacctgcacatggacatgctggaggagcagcaccaccaggccatgcagttcaccgccagcgtgctgcagcagaagaagcacgacgaggacggcggcaccaccgacaccgccaccatcctgagcaaccagcacgagaaggacagcggcgtgggcagaaccgacgagagcaccagaaacgacgagagcagcgagcaggagaacaacggcgacgacgccaccgccagcagcaaccccctggccggccagagaaagctgacctgcagccaggacaccctgggcagcggcgacctgcccttcagcaacgagagcttcatcagcgccgactgcaccgacgccgactacctgggcatccccgtggacgagtgcgagagattcagagagctgctggagctgaagtgccaggtgaagagcgccaccccctacggcctgtactaccccagcggccccctggacgccggcaagagcgaccccgagagcgtggacaaggagctggagctgctgaacgaggagctgagaagcatcgagctggagtgcctgagcatcgtgagagcccacaagatgcagcagctgaaggagcagtacagagagagctggatgctgcacaacagcggcttcagaaactacaacaccagcatcgacgtgagaagacacgagctgagcgacatcaccgagctgcccgagaagagcgacaaggacagcagcagcgcctacaacaccggcgagagctgcagaagcacccccctgaccctggagatcagccccgacaacagcctgagaagagccgccgagggcatcagctgccccagcagcgagggcgccgtgggcaccaccgaggcctacggccccgccagcaagaacctgctgagcatcaccgaggaccccgaggtgggcacccccacctacagccccagcctgaaggagctggaccccaaccagcccctggagagcaaggagagaagagccagcgacggcagcagaagccccacccccagccagaagctgggcagcgcctacctgcccagctaccaccacagcccctacaagcacgcccacatccccgcccacgcccagcactaccagagctacatgcagctgatccagcagaagagcgccgtggagtacgcccagagccagatgagcctggtgagcatgtgcaaggacctgagcagccccacccccagcgagcccagaatggagtggaaggtgaagatcagaagcgacggcaccagatacatcaccaagagacccgtgagagacagactgctgagagagagagccctgaagatcagagaggagagaagcggcatgaccaccgacgacgacgccgtgagcgagatgaagatgggcagatactggagcaaggaggagagaaagcagcacctggtgaaggccaaggagcagagaagaagaagagagttcatgatgcagagcagactggactgcctgaaggagcagcaggccgccgacgacagaaaggagatgaacatcctggagctgagccacaagaagatgatgaagaagagaaacaagaagatcttcgacaactggatgaccatccaggagctgctgacccacggcaccaagagccccgacggcaccagagtgtacaacagcttcctgagcgtgaccaccgtgtag

SEQ ID NO: 92644 - DNA, 2367 bp, Artificial Sequence
  Description of Artificial Sequence: Synthetic coding sequence
atgaagatggagcacaagagaatgatcctgctgttcagcaagttcaccctgatccacaagccccacggcggcagatggtacctggtgaacggcagagacctgagcagagccacccacgaccaggccgtggaggccttcaagaccgccaaggagcccatcgtggtgcaggtgctgagaagaacccccagaaccaagatgttcaccccccccagcgagagccagctggtggacaccggcacccagaccgacatcaccttcgagcacatcatggccctgaccaagatgagcagccccagcccccccgtgctggacccctacctgctgcccgaggagcaccccagcgcccacgagtactacgaccccaacgactacatcggcgacatccaccaggagatggacagagaggagctggagctggaggaggtggacctgtacagaatgaacagccaggacaagctgggcctgaccgtgtgctacagaaccgacgacgaggacgacatcggcatctacatcagcgagatcgaccccaacagcatcgccgccaaggacggcagaatcagagagggcgacagaatcatccagatcaacggcatcgaggtgcagaacagagaggaggccgtggccctgctgaccagcgaggagaacaagaacttcagcctgctgatcgccagacccgagctgcagctggacgagggctggatggacgacgacagaaacgacttcctggacgacctgcacatggacatgctggaggagcagcaccaccaggccatgcagttcaccgccagcgtgctgcagcagaagaagcacgacgaggacggcggcaccaccgacaccgccaccatcctgagcaaccagcacgagaaggacagcggcgtgggcagaaccgacgagagcaccagaaacgacgagagcagcgagcaggagaacaacggcgacgacgccaccgccagcagcaaccccctggccggccagagaaagctgacctgcagccaggacaccctgggcagcggcgacctgcccttcagcaacgagagcttcatcagcgccgactgcaccgacgccgactacctgggcatccccgtggacgagtgcgagagattcagagagctgctggagctgaagtgccaggtgaagagcgccaccccctacggcctgtactaccccagcggccccctggacgccggcaagagcgaccccgagagcgtggacaaggagctggagctgctgaacgaggagctgagaagcatcgagctggagtgcctgagcatcgtgagagcccacaagatgcagcagctgaaggagcagtacagagagagctggatgctgcacaacagcggcttcagaaactacaacaccagcatcgacgtgagaagacacgagctgagcgacatcaccgagctgcccgagaagagcgacaaggacagcagcagcgcctacaacaccggcgagagctgcagaagcacccccctgaccctggagatcagccccgacaacagcctgagaagagccgccgagggcatcagctgccccagcagcgagggcgccgtgggcaccaccgaggcctacggccccgccagcaagaacctgctgagcatcaccgaggaccccgaggtgggcacccccacctacagccccagcctgaaggagctggaccccaaccagcccctggagagcaaggagagaagagccagcgacggcagcagaagccccacccccagccagaagctgggcagcgcctacctgcccagctaccaccacagcccctacaagcacgcccacatccccgcccacgcccagcactaccagagctacatgcagctgatccagcagaagagcgccgtggagtacgcccagagccagatgagcctggtgagcatgtgcaaggacctgagcagccccacccccagcgagcccagaatggagtggaaggtgaagatcagaagcgacggcaccagatacatcaccaagagacccgtgagagacagactgctgagagagagagccctgaagatcagagaggagagaagcggcatgaccaccgacgacgacgccgtgagcgagatgaagatgggcagatactggagcaaggaggagagaaagcagcacctggtgaaggccaaggagcagagaagaagaagagagttcatgatgcagagcagactggactgcctgaaggagcagcaggccgccgacgacagaaaggagatgaacatcctggagctgagccacaagaagatgatgaagaagagaaacaagaagatcttcgacaactggatgaccatccaggagctgctgacccacggcaccaagagccccgacggcaccagagtgtacaacagcttcctgagcgtgaccaccgtgtag

SEQ ID NO: 92645 - DNA, 2331 bp, Artificial Sequence
  Description of Artificial Sequence: Synthetic coding sequence
atgagcggcaagagacagttcttcctgaagcccctggccctgctgacctgctggcccagcaccgtgaacggcaaggacctgagcaaggccacccacgaggaggccgtggaggccttcagaaacgccaaggagcccatcgtggtgcaggtgctgagaagaacccccctgagcagacccgcctacggcatggccagcgaggtgcagctgatgaacgccagcacccagaccgacatcaccttcgagcacatcatggccctggccaagctgagaccccccaccccccccgtgcccgacatctgccccttcctgctgagcgacagctgccacagcctgcaccccatggagcacgagttctacgaggacaacgagtacatcagcagcctgcccgccgacgccgacagaaccgaggacttcgagtacgaggaggtggagctgtgcagagtgagcagccaggagaagctgggcctgaccgtgtgctacagaaccgacgacgaggaggacaccggcatctacgtgagcgaggtggaccccaacagcatcgccgccaaggacggcagaatcagagagggcgacagaatcctgcagatcaacggcgaggacgtgcagaacagagaggaggccgtggccctgctgagcaacgacgagtgcaagagaatcgtgctgctggtggccagacccgagatccagctggacgagggctggctggaggacgagagaaacgagttcctggaggagctgaacctggagatgctggaggaggagcacaacgaggccatgcagcccaccgccaacgaggtggagcagcccaagaagcaggaggaggaggagggcaccaccgacaccgccaccagcagcagcaacaaccacgagaaggacagcggcgtgggcagaaccgacgagagcctgagaaacgacgagagcagcgagcaggagaacgccgccgaggaccccaacagcaccagcctgaagagcaagagagacctgggccagagccaggacaccctgggcagcgtggagctgcagtacaacgagagcctggtgagcggcgagtacatcgacagcgactgcatcggcaaccccgacgaggactgcgagagattcagacagctgctggagctgaagtgcaagatcagaaaccacggcgagtacgacctgtactacagcagcagcaccatcgagtgcaaccagggcgagcaggagggcgtggagcacgagctgcagctgctgaacgaggagctgagaaacatcgagctggagtgccagaacatcatgcaggcccacagactgcagaaggtgaccgaccagtacggcgacatctggaccctgcacgacggcggcttcagaaactacaacaccagcatcgacatgcagagaggcaagctggacgacatcatggagcaccccgagaagagcgacaaggacagcagcagcgcctacaacaccgccgagagctgcagaagcacccccctgaccgtggacagaagccccgacagcagcctgcccagagtgatcaacctgaccaacaagaagaacctgagaagcaccatggccgccacccagagcagcagcggccagagcagcaaggagagcaccagcaccaaggccaagaccaccgagcagggctgcagcgccgagagcaaggagaaggtgctggagggcagcaagctgcccgaccaggagaaggccgtgagcgagcacatcccctacctgagcccctaccacagcagcagctacagatacgccaacatccccgcccacgccagacactaccagagctacatgcagctgatccagcagaagagcgccgtggagtacgcccagagccagctgagcctggtgagcatgtgcaaggagagccagaagtgcagcgagcccaagatggagtggaaggtgaagatcagaagcgacggcaccagatacatcaccaagagacccgtgagagacagaatcctgaaggagagagccctgaagatcaaggaggagagaagcggcatgaccaccgacgacgacaccatgagcgagatgaagatgggcagatactggagcaaggaggagagaaagcagcacctggtgagagccaaggagcagagaagaagaagagagttcatgatgagaagcagactggagtgcctgaaggagagcccccagagcggcagcgagggcaagaaggagatcaacatcatcgagctgagccacaagaagatgatgaagaagagaaacaagaagatcctggacaactggatgaccatccaggagctgatgacccacggcgccaagagccccgacggcaccagagtgcacaacgccttcctgagcgtgaccaccgtgtag

SEQ ID NO: 92646 - DNA, 3111 bp, Artificial Sequence
  Description of Artificial Sequence: Synthetic coding sequence
atgggcttcgccctggagagattcgccgaggccgtggaccccgccctggagtgcaagctgtgcggccaggtgctggaggagcccctgtgcaccccctgcggccacgtgttctgcgccagctgcctgctgccctgggccgtgagaagaagaagatgccccctgcagtgccagcccctggcccccggcgagctgtacagagtgctgcccctgagaagcctgatccagaagctgagagtgcagtgcgactacagagccagaggctgcggccacagcgtgagactgcacgagctggaggcccacgtggagcactgcgacttcggccccgccagaagactgagaagcagaggcggctgcgccagcggcctgggcggcggcgaggtgcccgccagaggcggctgcggccccacccccagagccggcagaggcggcggcgccagaggcggcccccccggcggcagatggggcagaggcagaggccccggccccagagtgctggcctggagaagaagagagaaggccctgctggcccagctgtgggccctgcagggcgaggtgcagctgaccgccagaagataccaggagaagttcacccagtacatggcccacgtgagaaacttcgtgggcgacctgggcggcggccacagaagagacggcgagcacaagcccttcaccatcgtgctggagagagagaacgacaccctgggcttcaacatcatcggcggcagacccaaccagaacaaccaggagggcaccagcaccgagggcatctacgtgagcaagatcctggagaacggccccgccgacagagccgacggcctggagatccacgacaagatcatggaggtgaacggcaaggacctgagcaaggccacccacgaggaggccgtggaggccttcagaaacgccaaggagcccatcgtggtgcaggtgctgagaagaacccccctgagcagacccgcctacggcatggccagcgaggtgcagctgatgaacgccagcacccagaccgacatcaccttcgagcacatcatggccctggccaagctgagaccccccaccccccccgtgcccgacatctgccccttcctgctgagcgacagctgccacagcctgcaccccatggagcacgagttctacgaggacaacgagtacatcagcagcctgcccgccgacgccgacagaaccgaggacttcgagtacgaggaggtggagctgtgcagagtgagcagccaggagaagctgggcctgaccgtgtgctacagaaccgacgacgaggaggacaccggcatctacgtgagcgaggtggaccccaacagcatcgccgccaaggacggcagaatcagagagggcgacagaatcctgcagatcaacggcgaggacgtgcagaacagagaggaggccgtggccctgctgagcaacgacgagtgcaagagaatcgtgctgctggtggccagacccgagatccagctggacgagggctggctggaggacgagagaaacgagttcctggaggagctgaacctggagatgctggaggaggagcacaacgaggccatgcagcccaccgccaacgaggtggagcagcccaagaagcaggaggaggaggagggcaccaccgacaccgccaccagcagcagcaacaaccacgagaaggacagcggcgtgggcagaaccgacgagagcctgagaaacgacgagagcagcgagcaggagaacgccgccgaggaccccaacagcaccagcctgaagagcaagagagacctgggccagagccaggacaccctgggcagcgtggagctgcagtacaacgagagcctggtgagcggcgagtacatcgacagcgactgcatcggcaaccccgacgaggactgcgagagattcagacagctgctggagctgaagtgcaagatcagaaaccacggcgagtacgacctgtactacagcagcagcaccatcgagtgcaaccagggcgagcaggagggcgtggagcacgagctgcagctgctgaacgaggagctgagaaacatcgagctggagtgccagaacatcatgcaggcccacagactgcagaaggtgaccgaccagtacggcgacatctggaccctgcacgacggcggcttcagaaactacaacaccagcatcgacatgcagagaggcaagctggacgacatcatggagcaccccgagaagagcgacaaggacagcagcagcgcctacaacaccgccgagagctgcagaagcacccccctgaccgtggacagaagccccgacagcagcctgcccagagtgatcaacctgaccaacaagaagaacctgagaagcaccatggccgccacccagagcagcagcggccagagcagcaaggagagcaccagcaccaaggccaagaccaccgagcagggctgcagcgccgagagcaaggagaaggtgctggagggcagcaagctgcccgaccaggagaaggccgtgagcgagcacatcccctacctgagcccctaccacagcagcagctacagatacgccaacatccccgcccacgccagacactaccagagctacatgcagctgatccagcagaagagcgccgtggagtacgcccagagccagctgagcctggtgagcatgtgcaaggagagccagaagtgcagcgagcccaagatggagtggaaggtgaagatcagaagcgacggcaccagatacatcaccaagagacccgtgagagacagaatcctgaaggagagagccctgaagatcaaggaggagagaagcggcatgaccaccgacgacgacaccatgagcgagatgaagatgggcagatactggagcaaggaggagagaaagcagcacctggtgagagccaaggagcagagaagaagaagagagttcatgatgagaagcagactggagtgcctgaaggagagcccccagagcggcagcgagggcaagaaggagatcaacatcatcgagctgagccacaagaagatgatgaagaagagaaacaagaagatcctggacaactggatgaccatccaggagctgatgacccacggcgccaagagccccgacggcaccagagtgcacaacgccttcctgagcgtgaccaccgtgtag

SEQ ID NO: 92647 - DNA, 2337 bp, Artificial Sequence
  Description of Artificial Sequence: Synthetic coding sequence
atgggctgcaacctgtgcaccttccagaagagagaggagcactacaagctgctgtacgaggtgagccaggtgaacggcaaggacctgagcaaggccacccacgaggaggccgtggaggccttcagaaacgccaaggagcccatcgtggtgcaggtgctgagaagaacccccctgagcagacccgcctacggcatggccagcgaggtgcagctgatgaacgccagcacccagaccgacatcaccttcgagcacatcatggccctggccaagctgagaccccccaccccccccgtgcccgacatctgccccttcctgctgagcgacagctgccacagcctgcaccccatggagcacgagttctacgaggacaacgagtacatcagcagcctgcccgccgacgccgacagaaccgaggacttcgagtacgaggaggtggagctgtgcagagtgagcagccaggagaagctgggcctgaccgtgtgctacagaaccgacgacgaggaggacaccggcatctacgtgagcgaggtggaccccaacagcatcgccgccaaggacggcagaatcagagagggcgacagaatcctgcagatcaacggcgaggacgtgcagaacagagaggaggccgtggccctgctgagcaacgacgagtgcaagagaatcgtgctgctggtggccagacccgagatccagctggacgagggctggctggaggacgagagaaacgagttcctggaggagctgaacctggagatgctggaggaggagcacaacgaggccatgcagcccaccgccaacgaggtggagcagcccaagaagcaggaggaggaggagggcaccaccgacaccgccaccagcagcagcaacaaccacgagaaggacagcggcgtgggcagaaccgacgagagcctgagaaacgacgagagcagcgagcaggagaacgccgccgaggaccccaacagcaccagcctgaagagcaagagagacctgggccagagccaggacaccctgggcagcgtggagctgcagtacaacgagagcctggtgagcggcgagtacatcgacagcgactgcatcggcaaccccgacgaggactgcgagagattcagacagctgctggagctgaagtgcaagatcagaaaccacggcgagtacgacctgtactacagcagcagcaccatcgagtgcaaccagggcgagcaggagggcgtggagcacgagctgcagctgctgaacgaggagctgagaaacatcgagctggagtgccagaacatcatgcaggcccacagactgcagaaggtgaccgaccagtacggcgacatctggaccctgcacgacggcggcttcagaaactacaacaccagcatcgacatgcagagaggcaagctggacgacatcatggagcaccccgagaagagcgacaaggacagcagcagcgcctacaacaccgccgagagctgcagaagcacccccctgaccgtggacagaagccccgacagcagcctgcccagagtgatcaacctgaccaacaagaagaacctgagaagcaccatggccgccacccagagcagcagcggccagagcagcaaggagagcaccagcaccaaggccaagaccaccgagcagggctgcagcgccgagagcaaggagaaggtgctggagggcagcaagctgcccgaccaggagaaggccgtgagcgagcacatcccctacctgagcccctaccacagcagcagctacagatacgccaacatccccgcccacgccagacactaccagagctacatgcagctgatccagcagaagagcgccgtggagtacgcccagagccagctgagcctggtgagcatgtgcaaggagagccagaagtgcagcgagcccaagatggagtggaaggtgaagatcagaagcgacggcaccagatacatcaccaagagacccgtgagagacagaatcctgaaggagagagccctgaagatcaaggaggagagaagcggcatgaccaccgacgacgacaccatgagcgagatgaagatgggcagatactggagcaaggaggagagaaagcagcacctggtgagagccaaggagcagagaagaagaagagagttcatgatgagaagcagactggagtgcctgaaggagagcccccagagcggcagcgagggcaagaaggagatcaacatcatcgagctgagccacaagaagatgatgaagaagagaaacaagaagatcctggacaactggatgaccatccaggagctgatgacccacggcgccaagagccccgacggcaccagagtgcacaacgccttcctgagcgtgaccaccgtgtag

SEQ ID NO: 92648 - DNA, 1158 bp, Artificial Sequence
  Description of Artificial Sequence: Synthetic coding sequence
atgaagctggtgagaaagaacatcgagaaggacaacgccggccaggtgaccctggtgcccgaggagcccgaggacatgtggcacacctacaacctggtgcaggtgggcgacagcctgagagccagcaccatcagaaaggtgcagaccgagagcagcaccggcagcgtgggcagcaacagagtgagaaccaccctgaccctgtgcgtggaggccatcgacttcgacagccaggcctgccagctgagagtgaagggcaccaacatccaggagaacgagtacgtgaagatgggcgcctaccacaccatcgagctggagcccaacagacagttcaccctggccaagaagcagtgggacagcgtggtgctggagagaatcgagcaggcctgcgaccccgcctggagcgccgacgtggccgccgtggtgatgcaggagggcctggcccacatctgcctggtgacccccagcatgaccctgaccagagccaaggtggaggtgaacatccccagaaagagaaagggcaactgcagccagcacgacagagccctggagagattctacgagcaggtggtgcaggccatccagagacacatccacttcgacgtggtgaagtgcatcctggtggccagccccggcttcgtgagagagcagttctgcgactacctgttccagcaggccgtgaagaccgacaacaagctgctgctggagaacagaagcaagttcctgcaggtgcacgccagcagcggccacaagtacagcctgaaggaggccctgtgcgaccccaccgtggccagcagactgagcgacaccaaggccgccggcgaggtgaaggccctggacgacttctacaagatgctgcagcacgagcccgacagagccttctacggcctgaagcaggtggagaaggccaacgaggccatggccatcgacaccctgctgatcagcgacgagctgttcagacaccaggacgtggccaccagaagcagatacgtgagactggtggacagcgtgaaggagaacgccggcaccgtgagaatcttcagcagcctgcacgtgagcggcgagcagctgagccagctgaccggcgtggccgccatcctgagattccccgtgcccgagctgagcgaccaggagggcgacagcagcagcgaggaggactag

SEQ ID NO: 92649 - DNA, 855 bp, Artificial Sequence
  Description of Artificial Sequence: Synthetic coding sequence
atggccagctacccctacagacagggctgccccggcgccgccggccaggcccccggcgccccccccggcagctactaccccggcccccccaacagcggcggccagtacggcagcggcctgccccccggcggcggctacggcggccccgcccccggcggcccctacggcccccccgccggcggcggcccctacggccaccccaaccccggcatgttccccagcggcacccccggcggcccctacggcggcgccgcccccggcggcccctacggccagcccccccccagcagctacggcgcccagcagcccggcctgtacggccagggcggcgccccccccaacgtggaccccgaggcctacagctggttccagagcgtggacagcgaccacagcggctacatcagcatgaaggagctgaagcaggccctggtgaactgcaactggagcagcttcaacgacgagacctgcctgatgatgatcaacatgttcgacaagaccaagagcggcagaatcgacgtgtacggcttcagcgccctgtggaagttcatccagcagtggaagaacctgttccagcagtacgacagagacagaagcggcagcatcagctacaccgagctgcagcaggccctgagccagatgggctacaacctgagcccccagttcacccagctgctggtgagcagatactgccccagaagcgccaaccccgccatgcagctggacagattcatccaggtgtgcacccagctgcaggtgctgaccgaggccttcagagagaaggacaccgccgtgcagggcaacatcagactgagcttcgaggacttcgtgaccatgaccgccagcagaatgctgtag

SEQ ID NO: 92650 - DNA, 423 bp, Artificial Sequence
  Description of Artificial Sequence: Synthetic coding sequence
atggccagctacccctacagacagggctgccccggcgccgccggccaggcccccggcgccccccccggcagctactaccccggcccccccaacagcggcggccagtacggcagcggcctgccccccggcggcggctacggcggccccgcccccggcggcccctacggcccccccgccggcggcggcccctacggccaccccaaccccggcatgttccccagcggcacccccggcggcccctacggcggcgccgcccccggcggcccctacggccagcccccccccagcagctacggcgcccagcagcccggcctgtacggccagggcatccacgccgagggcgccgcccccgtgtgggacatgctgagcctgtggcagagagagggcgccggcgagctggccagaatgcacaacgccagctag

SEQ ID NO: 92651 - DNA, 1146 bp, Artificial Sequence
  Description of Artificial Sequence: Synthetic coding sequence
atgcacctgctggccatcctgttctgcgccctgtggagcgccgtgctggccgagaacagcgacgactacgacctgatgtacgtgaacctggacaacgagatcgacaacggcctgcaccccaccgaggaccccaccccctgcgcctgcggccaggagcacagcgagtgggacaagctgttcatcatgctggagaacagccagatgagagagagaatgctgctgcaggccaccgacgacgtgctgagaggcgagctgcagagactgagagaggagctgggcagactggccgagagcctggccagaccctgcgcccccggcgcccccgccgaggccagactgaccagcgccctggacgagctgctgcaggccaccagagacgccggcagaagactggccagaatggagggcgccgaggcccagagacccgaggaggccggcagagccctggccgccgtgctggaggagctgagacagaccagagccgacctgcacgccgtgcagggctgggccgccagaagctggctgcccgccggctgcgagaccgccatcctgttccccatgagaagcaagaagatcttcggcagcgtgcaccccgtgagacccatgagactggagagcttcagcgcctgcatctgggtgaaggccaccgacgtgctgaacaagaccatcctgttcagctacggcaccaagagaaacccctacgagatccagctgtacctgagctaccagagcatcgtgttcgtggtgggcggcgaggagaacaagctggtggccgaggccatggtgagcctgggcagatggacccacctgtgcggcacctggaacagcgaggagggcctgaccagcctgtgggtgaacggcgagctggccgccaccaccgtggagatggccaccggccacatcgtgcccgagggcggcatcctgcagatcggccaggagaagaacggctgctgcgtgggcggcggcttcgacgagaccctggccttcagcggcagactgaccggcttcaacatctgggacagcgtgctgagcaacgaggagatcagagagaccggcggcgccgagagctgccacatcagaggcaacatcgtgggctggggcgtgaccgagatccagccccacggcggcgcccagtacgtgagctag

SEQ ID NO: 92652 - DNA, 1422 bp, Artificial Sequence
  Description of Artificial Sequence: Synthetic coding sequence
atgggcagcggcaactgggaggtgaccggccccccctgcggcagcagatgcgagagaccccccggcctgcccagaggcgtgcacggccagttcagaagcgccgtgggcctgagcggcctgagatggttcagaagattccaggaggtgacctggacccacctgcagaacatcgccagcaactacaacgtgagctacaacgtggacgtgagattcagaagcctggccgaggagagccaggccgtggcccaggccgtgaacagaagccaggccagcgtgcagggcgagctggcccagctgaaggcctgggtgagaaagctgcagagaagaggcagaaaggtggacaccagactgagagccctggacctgaccctgggcgagagaagccagcagagagccagagagagaaaggcccacaaggcccagagagacgccctgcaggacagcctggccagactggagggcctggtgcacagccagggcgccagactggccgccctggagggcagactgcccgtggcccaccccggcaccgccgccctgggccccgccctggtgcccacccccacccagcccgaggagctgggccccaccagcctgaagctgcagagagacagacaggagctgagagccgccagcgagcacagaggccccccccaggacagcagcgcccccctgcagggcagaagagagccccccgccagcggcagccacagagtgctgagcggcaccgcccccaaggaccccagacagcaggcctggagcccccaggtgcccggcgagatctgcggcgtgggccccaccctggtgttccccaacgccagcaccagaaacgtggtgttcctgagccccggcttcgtgaccgccctgagagccctgagcttctgcagctgggtgagaaccgccagcggcagactgggcaccctgctgagctacgccaccgaggacaacgacaacaagctggtgctgcacggcagagacagcctgctgcccggcagcatccacttcgtgatcggcgaccccgccttcagagagctgcccctgcagctgctgctggacggccagtggcaccacatctgcgtgatctggaccagcacccagggcagatactggctgcacgtggacagaagactggtggccaccggcagcagattcagagagggctacgagatcccccccggcggcagcctggtgctgggccaggagcaggacagcgtgggcggcggcttcgacagcagcgaggccttcgtgggcagcatgagcggcctggccatctgggacagagccctggtgcccggcgaggtggccaacctggccatcggcaaggagttccccaccggcgccatcctgaccctggccaacgccgccctggccggcggcttcgtgcagggcgccaactgcacctgcctggagagatgcccctag

SEQ ID NO: 92653 - DNA, 1437 bp, Artificial Sequence
  Description of Artificial Sequence: Synthetic coding sequence
atgggctgcagctggagaaagaccctgagcttcttcctggtgttcgtgcccatctacctgcacggcgccagcagccaggaggccgcccccgtgggccccagaaagcccttcttcgagagactgagaagactggaggagcagttcagaagattccaggaggtgacctggacccacctgcagaacatcgccagcaactacaacgtgagctacaacgtggacgtgagattcagaagcctggccgaggagagccaggccgtggcccaggccgtgaacagaagccaggccagcgtgcagggcgagctggcccagctgaaggcctgggtgagaaagctgcagagaagaggcagaaaggtggacaccagactgagagccctggacctgaccctgggcgagagaagccagcagagagccagagagagaaaggcccacaaggcccagagagacgccctgcaggacagcctggccagactggagggcctggtgcacagccagggcgccagactggccgccctggagggcagactgcccgtggcccaccccggcaccgccgccctgggccccgccctggtgcccacccccacccagcccgaggagctgggccccaccagcctgaagctgcagagagacagacaggagctgagagccgccagcgagcacagaggccccccccaggacagcagcgcccccctgcagggcagaagagagccccccgccagcggcagccacagagtgctgagcggcaccgcccccaaggaccccagacagcaggcctggagcccccaggtgcccggcgagatctgcggcgtgggccccaccctggtgttccccaacgccagcaccagaaacgtggtgttcctgagccccggcttcgtgaccgccctgagagccctgagcttctgcagctgggtgagaaccgccagcggcagactgggcaccctgctgagctacgccaccgaggacaacgacaacaagctggtgctgcacggcagagacagcctgctgcccggcagcatccacttcgtgatcggcgaccccgccttcagagagctgcccctgcagctgctgctggacggccagtggcaccacatctgcgtgatctggaccagcacccagggcagatactggctgcacgtggacagaagactggtggccaccggcagcagattcagagagggctacgagatcccccccggcggcagcctggtgctgggccaggagcaggacagcgtgggcggcggcttcgacagcagcgaggccttcgtgggcagcatgagcggcctggccatctgggacagagccctggtgcccggcgaggtggccaacctggccatcggcaaggagttccccaccggcgccatcctgaccctggccaacgccgccctggccggcggcttcgtgcagggcgccaactgcacctgcctggagagatgcccctag

SEQ ID NO: 92654 - DNA, 1167 bp, Artificial Sequence
  Description of Artificial Sequence: Synthetic coding sequence
atgaagtggctgctgctgctgggcctggtggccctgagcgagtgcatcatgtacaaggtgcccctgatcagaaagaagagcctgagaagaaccctgagcgagagaggcctgctgaaggacttcctgaagaagcacaacctgaaccccgccagaaagtacttcccccagtggaaggcccccaccctggtggacgagcagcccctggagaactacctggacatggagtacttcggcaccatcggcatcggcacccccgcccaggacttcaccgtggtgttcgacaccggcagcagcaacctgtgggtgcccagcgtgtactgcagcagcctggcctgcaccaaccacaacagattcaaccccgaggacagcagcacctaccagagcaccagcgagaccgtgagcatcacctacggcaccggcagcatgaccggcatcctgggctacgacaccgtgcaggtgggcggcatcagcgacaccaaccagatcttcggcctgagcgagaccgagcccggcagcttcctgtactacgcccccttcgacggcatcctgggcctggcctaccccagcatcagcagcagcggcgccacccccgtgttcgacaacatctggaaccagggcctggtgagccaggacctgttcagcgtgtacctgagcgccgacgaccagagcggcagcgtggtgatcttcggcggcatcgacagcagctactacaccggcagcctgaactgggtgcccgtgaccgtggagggctactggcagatcaccgtggacagcatcaccatgaacggcgaggccatcgcctgcgccgagggctgccaggccatcgtggacaccggcaccagcctgctgaccggccccaccagccccatcgccaacatccagagcgacatcggcgccagcgagaacagcgacggcgacatggtggtgagctgcagcgccatcagcagcctgcccgacatcgtgttcaccatcaacggcgtgcagtaccccgtgccccccagcgcctacatcctgcagagcgagggcagctgcatcagcggcttccagggcatgaacctgcccaccgagagcggcgagctgtggatcctgggcgacgtgttcatcagacagtacttcaccgtgttcgacagagccaacaaccaggtgggcctggcccccgtggcctag

SEQ ID NO: 92655 - DNA, 849 bp, Artificial Sequence
  Description of Artificial Sequence: Synthetic coding sequence
atgaagtggctgctgctgctgggcctggtggccctgagcgagtgcatcatgtacaaggtgcccctgatcagaaagaagagcctgagaagaaccctgagcgagagaggcctgctgaaggacttcctgaagaagcacaacctgaaccccgccagaaagtacttcccccagtggaaggcccccaccctggtggacgagcagcccctggagaactacctggacatggagtacttcggcaccatcggcatcggcacccccgcccaggacttcaccgtggtgttcgacaccggcagcagcaacctgtgggtgcccagcgtgtactgcagcagcctggcctgcaccaaccacaacagattcaaccccgaggacagcagcacctaccagagcaccagcgagaccgtgagcatcacctacggcaccggcagcatgaccggcatcctgggctacgacaccgtgcagaccgtggccatctggagaagcgccgccatgggcctggtgagccaggacctgttcagcgtgtacctgagcgccgacgaccagagcggcagcgtggtgatcttcggcggcatcgacagcagctactacaccggcagcctgaactgggtgcccgtgaccgtggagggctactggcagatcaccgtggacagcatcaccatgaacggcgaggccatcgcctgcgccgagggctgccaggccatcgtggacaccggcaccagcctgctgaccggccccaccagccccatcgccaacatccagagcgacatcggcgccagcgagaacagcgacggcgacatggtggtgagctgcagcgccatcagcagcctgcccgacatcgtgttcaccatcaactag

SEQ ID NO: 92656 - DNA, 750 bp, Artificial Sequence
  Description of Artificial Sequence: Synthetic coding sequence
atgaccggcatcctgggctacgacaccgtgcaggtgggcggcatcagcgacaccaaccagatcttcggcctgagcgagaccgagcccggcagcttcctgtactacgcccccttcgacggcatcctgggcctggcctaccccagcatcagcagcagcggcgccacccccgtgttcgacaacatctggaaccagggcctggtgagccaggacctgttcagcgtgtacctgagcgccgacgaccagagcggcagcgtggtgatcttcggcggcatcgacagcagctactacaccggcagcctgaactgggtgcccgtgaccgtggagggctactggcagatcaccgtggacagcatcaccatgaacggcgaggccatcgcctgcgccgagggctgccaggccatcgtggacaccggcaccagcctgctgaccggccccaccagccccatcgccaacatccagagcgacatcggcgccagcgagaacagcgacggcgacatggtggtgagctgcagcgccatcagcagcctgcccgacatcgtgttcaccatcaacggcgtgcagtaccccgtgccccccagcgcctacatcctgcagctgcccagcgagggcagctgcatcagcggcttccagggcatgaacctgcccaccgagagcggcgagctgtggatcctgggcgacgtgttcatcagacagtacttcaccgtgttcgacagagccaacaaccaggtgggcctggcccccgtggcctag

SEQ ID NO: 92657 - DNA, 1167 bp, Artificial Sequence
  Description of Artificial Sequence: Synthetic coding sequence
atgaagtggctgctgctgctgggcctggtggccctgagcgagtgcatcatgtacaaggtgcccctgatcagaaagaagagcctgagaagaaccctgagcgagagaggcctgctgaaggacttcctgaagaagcacaacctgaaccccgccagaaagtacttcccccagtgggaggcccccaccctggtggacgagcagcccctggagaactacctggacatggagtacttcggcaccatcggcatcggcacccccgcccaggacttcaccgtggtgttcgacaccggcagcagcaacctgtgggtgcccagcgtgtactgcagcagcctggcctgcaccaaccacaacagattcaaccccgaggacagcagcacctaccagagcaccagcgagaccgtgagcatcacctacggcaccggcagcatgaccggcatcctgggctacgacaccgtgcaggtgggcggcatcagcgacaccaaccagatcttcggcctgagcgagaccgagcccggcagcttcctgtactacgcccccttcgacggcatcctgggcctggcctaccccagcatcagcagcagcggcgccacccccgtgttcgacaacatctggaaccagggcctggtgagccaggacctgttcagcgtgtacctgagcgccgacgaccagagcggcagcgtggtgatcttcggcggcatcgacagcagctactacaccggcagcctgaactgggtgcccgtgaccgtggagggctactggcagatcaccgtggacagcatcaccatgaacggcgaggccatcgcctgcgccgagggctgccaggccatcgtggacaccggcaccagcctgctgaccggccccaccagccccatcgccaacatccagagcgacatcggcgccagcgagaacagcgacggcgacatggtggtgagctgcagcgccatcagcagcctgcccgacatcgtgttcaccatcaacggcgtgcagtaccccgtgccccccagcgcctacatcctgcagagcgagggcagctgcatcagcggcttccagggcatgaacctgcccaccgagagcggcgagctgtggatcctgggcgacgtgttcatcagacagtacttcaccgtgttcgacagagccaacaaccaggtgggcctggcccccgtggcctag

SEQ ID NO: 92658 - DNA, 1167 bp, Artificial Sequence
  Description of Artificial Sequence: Synthetic coding sequence
atgaagtggctgctgctgctgggcctggtggccctgagcgagtgcatcatgtacaaggtgcccctgatcagaaagaagagcctgagaagaaccctgagcgagagaggcctgctgaaggacttcctgaagaagcacaacctgaaccccgccagaaagtacttcccccagtgggaggcccccaccctggtggacgagcagcccctggagaactacctggacatggagtacttcggcaccatcggcatcggcacccccgcccaggacttcaccgtggtgttcgacaccggcagcagcaacctgtgggtgcccagcgtgtactgcagcagcctggcctgcaccaaccacaacagattcaaccccgaggacagcagcacctaccagagcaccagcgagaccgtgagcatcacctacggcaccggcagcatgaccggcatcctgggctacgacaccgtgcaggtgggcggcatcagcgacaccaaccagatcttcggcctgagcgagaccgagcccggcagcttcctgtactacgcccccttcgacggcatcctgggcctggcctaccccagcatcagcagcagcggcgccacccccgtgttcgacaacatctggaaccagggcctggtgagccaggacctgttcagcgtgtacctgagcgccgacgacaagagcggcagcgtggtgatcttcggcggcatcgacagcagctactacaccggcagcctgaactgggtgcccgtgaccgtggagggctactggcagatcaccgtggacagcatcaccatgaacggcgagaccatcgcctgcgccgagggctgccaggccatcgtggacaccggcaccagcctgctgaccggccccaccagccccatcgccaacatccagagcgacatcggcgccagcgagaacagcgacggcgacatggtggtgagctgcagcgccatcagcagcctgcccgacatcgtgttcaccatcaacggcgtgcagtaccccgtgccccccagcgcctacatcctgcagagcgagggcagctgcatcagcggcttccagggcatgaacgtgcccaccgagagcggcgagctgtggatcctgggcgacgtgttcatcagacagtacttcaccgtgttcgacagagccaacaaccaggtgggcctggcccccgtggcctag

SEQ ID NO: 92659 - DNA, 849 bp, Artificial Sequence
  Description of Artificial Sequence: Synthetic coding sequence
atgaagtggctgctgctgctgggcctggtggccctgagcgagtgcatcatgtacaaggtgcccctgatcagaaagaagagcctgagaagaaccctgagcgagagaggcctgctgaaggacttcctgaagaagcacaacctgaaccccgccagaaagtacttcccccagtgggaggcccccaccctggtggacgagcagcccctggagaactacctggacatggagtacttcggcaccatcggcatcggcacccccgcccaggacttcaccgtggtgttcgacaccggcagcagcaacctgtgggtgcccagcgtgtactgcagcagcctggcctgcaccaaccacaacagattcaaccccgaggacagcagcacctaccagagcaccagcgagaccgtgagcatcacctacggcaccggcagcatgaccggcatcctgggctacgacaccgtgcagaccgtggccatctggagaagcgccgccatgggcctggtgagccaggacctgttcagcgtgtacctgagcgccgacgaccagagcggcagcgtggtgatcttcggcggcatcgacagcagctactacaccggcagcctgaactgggtgcccgtgaccgtggagggctactggcagatcaccgtggacagcatcaccatgaacggcgaggccatcgcctgcgccgagggctgccaggccatcgtggacaccggcaccagcctgctgaccggccccaccagccccatcgccaacatccagagcgacatcggcgccagcgagaacagcgacggcgacatggtggtgagctgcagcgccatcagcagcctgcccgacatcgtgttcaccatcaactag

SEQ ID NO: 92660 - DNA, 750 bp, Artificial Sequence; identical to SEQ ID NO: 92656
  Description of Artificial Sequence: Synthetic coding sequence

SEQ ID NO: 92661 - DNA, 1167 bp, Artificial Sequence; identical to SEQ ID NO: 92658
  Description of Artificial Sequence: Synthetic coding sequence

SEQ ID NO: 92662 - DNA, 849 bp, Artificial Sequence
  Description of Artificial Sequence: Synthetic coding sequence
atgaagtggctgctgctgctgggcctggtggccctgagcgagtgcatcatgtacaaggtgcccctgatcagaaagaagagcctgagaagaaccctgagcgagagaggcctgctgaaggacttcctgaagaagcacaacctgaaccccgccagaaagtacttcccccagtgggaggcccccaccctggtggacgagcagcccctggagaactacctggacatggagtacttcggcaccatcggcatcggcacccccgcccaggacttcaccgtggtgttcgacaccggcagcagcaacctgtgggtgcccagcgtgtactgcagcagcctggcctgcaccaaccacaacagattcaaccccgaggacagcagcacctaccagagcaccagcgagaccgtgagcatcacctacggcaccggcagcatgaccggcatcctgggctacgacaccgtgcagaccgtggccatctggagaagcgccgccatgggcctggtgagccaggacctgttcagcgtgtacctgagcgccgacgacaagagcggcagcgtggtgatcttcggcggcatcgacagcagctactacaccggcagcctgaactgggtgcccgtgaccgtggagggctactggcagatcaccgtggacagcatcaccatgaacggcgagaccatcgcctgcgccgagggctgccaggccatcgtggacaccggcaccagcctgctgaccggccccaccagccccatcgccaacatccagagcgacatcggcgccagcgagaacagcgacggcgacatggtggtgagctgcagcgccatcagcagcctgcccgacatcgtgttcaccatcaactag

SEQ ID NO: 92663 - DNA, 750 bp, Artificial Sequence
  Description of Artificial Sequence: Synthetic coding sequence
atgaccggcatcctgggctacgacaccgtgcaggtgggcggcatcagcgacaccaaccagatcttcggcctgagcgagaccgagcccggcagcttcctgtactacgcccccttcgacggcatcctgggcctggcctaccccagcatcagcagcagcggcgccacccccgtgttcgacaacatctggaaccagggcctggtgagccaggacctgttcagcgtgtacctgagcgccgacgacaagagcggcagcgtggtgatcttcggcggcatcgacagcagctactacaccggcagcctgaactgggtgcccgtgaccgtggagggctactggcagatcaccgtggacagcatcaccatgaacggcgagaccatcgcctgcgccgagggctgccaggccatcgtggacaccggcaccagcctgctgaccggccccaccagccccatcgccaacatccagagcgacatcggcgccagcgagaacagcgacggcgacatggtggtgagctgcagcgccatcagcagcctgcccgacatcgtgttcaccatcaacggcgtgcagtaccccgtgccccccagcgcctacatcctgcagctgcccagcgagggcagctgcatcagcggcttccagggcatgaacgtgcccaccgagagcggcgagctgtggatcctgggcgacgtgttcatcagacagtacttcaccgtgttcgacagagccaacaaccaggtgggcctggcccccgtggcctag

SEQ ID NO: 92664 - DNA, 1578 bp, Artificial Sequence
  Description of Artificial Sequence: Synthetic coding sequence
atggccgccgtggtgctggccgccaccagactgctgagaggcagcggcagctggggctgcagcagactgagattcggcccccccgcctacagaagattcagcagcggcggcgcctaccccaacatccccctgagcagccccctgcccggcgtgcccaagcccgtgttcgccaccgtggacggccaggagaagttcgagaccaaggtgaccaccctggacaacggcctgagagtggccagccagaacaagttcggccagttctgcaccgtgggcatcctgatcaacagcggcagcagatacgaggccaagtacctgagcggcatcgcccacttcctggagaagctggccttcagcagcaccgccagattcgacagcaaggacgagatcctgctgaccctggagaagcacggcggcatctgcgactgccagaccagcagagacaccaccatgtacgccgtgagcgccgacagcaagggcctggacaccgtggtggccctgctggccgacgtggtgctgcagcccagactgaccgacgaggaggtggagatgaccagaatggccgtgcagttcgagctggaggacctgaacctgagacccgaccccgagcccctgctgaccgagatgatccacgaggccgcctacagagagaacaccgtgggcctgcacagattctgccccaccgagaacgtggccaagatcaacagagaggtgctgcacagctacctgagaaactactacacccccgacagaatggtgctggccggcgtgggcgtggagcacgagcacctggtggactgcgccagaaagtacctgctgggcgtgcagcccgcctggggcagcgccgaggccgtggacatcgacagaagcgtggcccagtacaccggcggcatcgccaagctggagagagacatgagcaacgtgagcctgggccccacccccatccccgagctgacccacatcatggtgggcctggagagctgcagcttcctggaggaggacttcatccccttcgccgtgctgaacatgatgatgggcggcggcggcagcttcagcgccggcggccccggcaagggcatgttcagcagactgtacctgaacgtgctgaacagacaccactggatgtacaacgccaccagctaccaccacagctacgaggacaccggcctgctgtgcatccacgccagcgccgaccccagacaggtgagagagatggtggagatcatcaccaaggagttcatcctgatgggcggcaccgtggacaccgtggagctggagagagccaagacccagctgaccagcatgctgatgatgaacctggagagcagacccgtgatcttcgaggacgtgggcagacaggtgctggccaccagaagcagaaagctgccccacgagctgtgcaccctgatcagaaacgtgaagcccgaggacgtgaagagagtggccagcaagatgctgagaggcaagcccgccgtggccgccctgggcgacctgaccgacctgcccacctacgagcacatccagaccgccctgagcagcaaggacggcagactgcccagaacctacagactgttcagatag

SEQ ID NO: 92665 - DNA, 441 bp, Artificial Sequence
  Description of Artificial Sequence: Synthetic coding sequence
atggccgccgtggtgctggccgccaccagactgctgagaggcagcggcagctggggctgcagcagactgagattcggcccccccgcctacagaagattcagcagcggcggcgcctaccccaacatccccctgagcagccccctgcccggcgtgcccaagcccgtgttcgccaccgtggacggccaggagaagttcgagaccaaggtgaccaccctggacaacggcctgagagtggccagccagaacaagttcggccagttctgcaccgtgggcatcctgatcaacagcggcagcagatacgaggccaagtacctgagcggcatcgcccacttcctggagaagctggccttcagcagcaccgccagattcgacagcaaggacgagatcctgctgaccctggagaagcacggcggcatctgcgactgccagaccagcagatag

SEQ ID NO: 92666 - DNA, 1185 bp, Artificial Sequence
  Description of Artificial Sequence: Synthetic coding sequence
atgaagagaaacaccctggtggagctgctgaccttctggaagaactggcacttcagactgctgctggacctgaccgccaagatgaagttctgcctgagatggaagagcatgggcgtgagcgtgaccgccagacaccaggacgaggaggtggagatgaccagaatggccgtgcagttcgagctggaggacctgaacctgagacccgaccccgagcccctgctgaccgagatgatccacgaggccgcctacagagagaacaccgtgggcctgcacagattctgccccaccgagaacgtggccaagatcaacagagaggtgctgcacagctacctgagaaactactacacccccgacagaatggtgctggccggcgtgggcgtggagcacgagcacctggtggactgcgccagaaagtacctgctgggcgtgcagcccgcctggggcagcgccgaggccgtggacatcgacagaagcgtggcccagtacaccggcggcatcgccaagctggagagagacatgagcaacgtgagcctgggccccacccccatccccgagctgacccacatcatggtgggcctggagagctgcagcttcctggaggaggacttcatccccttcgccgtgctgaacatgatgatgggcggcggcggcagcttcagcgccggcggccccggcaagggcatgttcagcagactgtacctgaacgtgctgaacagacaccactggatgtacaacgccaccagctaccaccacagctacgaggacaccggcctgctgtgcatccacgccagcgccgaccccagacaggtgagagagatggtggagatcatcaccaaggagttcatcctgatgggcggcaccgtggacaccgtggagctggagagagccaagacccagctgaccagcatgctgatgatgaacctggagagcagacccgtgatcttcgaggacgtgggcagacaggtgctggccaccagaagcagaaagctgccccacgagctgtgcaccctgatcagaaacgtgaagcccgaggacgtgaagagagtggccagcaagatgctgagaggcaagcccgccgtggccgccctgggcgacctgaccgacctgcccacctacgagcacatccagaccgccctgagcagcaaggacggcagactgcccagaacctacagactgttcagatag

SEQ ID NO: 92667 - DNA, 816 bp, Artificial Sequence
  Description of Artificial Sequence: Synthetic coding sequence
tacaccggcggcatcgccaagctggagagagacatgagcaacgtgagcctgggccccacccccatccccgagctgacccacatcatggtgggcctggagagctgcagcttcctggaggaggacttcatccccttcgccgtgctgaacatgatgatgggcggcggcggcagcttcagcgccggcggccccggcaagggcatgttcagcagactgtacctgaacgtgctgaacagacaccactggatgtacaacgccaccagctaccaccacagctacgaggacaccggcctgctgtgcatccacgccagcgccgaccccagacaggtgagagagatggtggagatcatcaccaaggagttcatcctgatgggcggcaccgtggacaccgtggagctggagagagccaagacccagctgaccagcatgctgatgatgaacctggagagcagacccgtgatcttcgaggacgtgggcagacaggtgctggccaccagaagcagaaagctgccccacgagctgtgcaccctgatcagagagtacagaagaggcagcgagggcctgccccaggccagcgccagactgagaggcggcagactggccctgccccaggccgtggtgggcctgtggtacgtgcaccacacccagaacctgggccccagccccgtggtgctgagcagaggcggccagggccagggcagaggcgtggccgacctggtgagcctgcccggccccaccatgcacctgctgcccccctggcaggtgaccccccccagcgcccccctgggcggcgccgtgaccaccgcccagagctgctag

SEQ ID NO: 92668 - DNA, 1482 bp, Artificial Sequence
  Description of Artificial Sequence: Synthetic coding sequence
atggccgccgccaccggccccagcttctggctgggcaacgagaccctgaaggtgcccctggccctgttcgccctgaacagacagagactgtgcgagagactgagaaagaaccccgccgtgcaggccggcagcatcgtggtgctgcagggcggcgaggagacccagagatactgcaccgacaccggcgtgctgttcagacaggagagcttcttccactgggccttcggcgtgaccgagcccggctgctacggcgtgatcgacgtggacaccggcaagagcaccctgttcgtgcccagactgcccgccagccacgccacctggatgggcaagatccacagcaaggagcacttcaaggagaagtacgccgtggacgacgtgcagtacgtggacgagatcgccagcgtgctgaccagccagaagcccagcgtgctgctgaccctgagaggcgtgaacaccgacagcggcagcgtgtgcagagaggccagcttcgacggcatcagcaagttcgaggtgaacaacaccatcctgcaccccgagatcgtggagtgcagagtgttcaagaccgacatggagctggaggtgctgagatacaccaacaagatcagcagcgaggcccacagagaggtgatgaaggccgtgaaggtgggcatgaaggagtacgagctggagagcctgttcgagcactactgctacagcagaggcggcatgagacacagcagctacacctgcatctgcggcagcggcgagaacagcgccgtgctgcactacggccacgccggcgcccccaacgacagaaccatccagaacggcgacatgtgcctgttcgacatgggcggcgagtactactgcttcgccagcgacatcacctgcagcttccccgccaacggcaagttcaccgccgaccagaaggccgtgtacgaggccgtgctgagaagcagcagagccgtgatgggcgccatgaagcccggcgtgtggtggcccgacatgcacagactggccgacagaatccacctggaggagctggcccacatgggcatcctgagcggcagcgtggacgccatggtgcaggcccacctgggcgccgtgttcatgccccacggcctgggccacttcctgggcatcgacgtgcacgacgtgggcggctaccccgagggcgtggagagaatcgacgagcccggcctgagaagcctgagaaccgccagacacctgcagcccggcatggtgctgaccgtggagcccggcatctacttcatcgaccacctgctggacgaggccctggccgaccccgccagagccagcttcctgaacagagaggtgctgcagagattcagaggcttcggcggcgtgagaatcgaggaggacgtggtggtgaccgacagcggcatcgagctgctgacctgcgtgcccagaaccgtggaggagatcgaggcctgcatggccggctgcgacaaggccttcacccccttcagcggccccaagtag

SEQ ID NO: 92669 - DNA, 1359 bp, Artificial Sequence
  Description of Artificial Sequence: Synthetic coding sequence
atggccgccgccaccggccccagcttctggctgggcaacgagaccctgaaggtgcccctggccctgttcgccctgaacagacagagactgtgcgagagactgagaaagaaccccgccgtgcaggccggcagcatcgtggtgctgcagggcggcgaggagacccagagatactgcaccgacaccggcgtgctgttcagacaggagagcttcttccactgggccttcggcgtgaccgagcccggctgctacggcgtgatcgacgtggacaccggcaagagcaccctgttcgtgcccagactgcccgccagccacgccacctggatgggcaagatccacagcaaggagcacttcaaggagaagtacgccgtggacgacgtgcagtacgtggacgagatcgccagcgtgctgaccagccagaagcccagcgtgctgctgaccctgagaggcgtgaacaccgacagcggcagcgtgtgcagagaggccagcttcgacggcatcagcaagttcgaggtgaacaacaccatcctgcaccccgagatcgtggagtgcctgttcgagcactactgctacagcagaggcggcatgagacacagcagctacacctgcatctgcggcagcggcgagaacagcgccgtgctgcactacggccacgccggcgcccccaacgacagaaccatccagaacggcgacatgtgcctgttcgacatgggcggcgagtactactgcttcgccagcgacatcacctgcagcttccccgccaacggcaagttcaccgccgaccagaaggccgtgtacgaggccgtgctgagaagcagcagagccgtgatgggcgccatgaagcccggcgtgtggtggcccgacatgcacagactggccgacagaatccacctggaggagctggcccacatgggcatcctgagcggcagcgtggacgccatggtgcaggcccacctgggcgccgtgttcatgccccacggcctgggccacttcctgggcatcgacgtgcacgacgtgggcggctaccccgagggcgtggagagaatcgacgagcccggcctgagaagcctgagaaccgccagacacctgcagcccggcatggtgctgaccgtggagcccggcatctacttcatcgaccacctgctggacgaggccctggccgaccccgccagagccagcttcctgaacagagaggtgctgcagagattcagaggcttcggcggcgtgagaatcgaggaggacgtggtggtgaccgacagcggcatcgagctgctgacctgcgtgcccagaaccgtggaggagatcgaggcctgcatggccggctgcgacaaggccttcacccccttcagcggccccaagtag

SEQ ID NO: 92670 - DNA, 1290 bp, Artificial Sequence
  Description of Artificial Sequence: Synthetic coding sequence
atggccgccgccaccggccccagcttctggctgggcaacgagaccctgaaggtgcccctggccctgttcgccctgaacagacagagactgtgcgagagactgagaaagaaccccgccgtgcaggccggcagcatcgtggtgctgcagggcggcgaggagacccagagatactgcaccgacaccggcgtgctgttcagacagatcgccagcgtgctgaccagccagaagcccagcgtgctgctgaccctgagaggcgtgaacaccgacagcggcagcgtgtgcagagaggccagcttcgacggcatcagcaagttcgaggtgaacaacaccatcctgcaccccgagatcgtggagtgcagagtgttcaagaccgacatggagctggaggtgctgagatacaccaacaagatcagcagcgaggcccacagagaggtgatgaaggccgtgaaggtgggcatgaaggagtacgagctggagagcctgttcgagcactactgctacagcagaggcggcatgagacacagcagctacacctgcatctgcggcagcggcgagaacagcgccgtgctgcactacggccacgccggcgcccccaacgacagaaccatccagaacggcgacatgtgcctgttcgacatgggcggcgagtactactgcttcgccagcgacatcacctgcagcttccccgccaacggcaagttcaccgccgaccagaaggccgtgtacgaggccgtgctgagaagcagcagagccgtgatgggcgccatgaagcccggcgtgtggtggcccgacatgcacagactggccgacagaatccacctggaggagctggcccacatgggcatcctgagcggcagcgtggacgccatggtgcaggcccacctgggcgccgtgttcatgccccacggcctgggccacttcctgggcatcgacgtgcacgacgtgggcggctaccccgagggcgtggagagaatcgacgagcccggcctgagaagcctgagaaccgccagacacctgcagcccggcatggtgctgaccgtggagcccggcatctacttcatcgaccacctgctggacgaggccctggccgaccccgccagagccagcttcctgaacagagaggtgctgcagagattcagaggcttcggcggcgtgagaatcgaggaggacgtggtggtgaccgacagcggcatcgagctgctgacctgcgtgcccagaaccgtggaggagatcgaggcctgcatggccggctgcgacaaggccttcacccccttcagcggccccaagtag

SEQ ID NO: 92671 - DNA, 354 bp, Artificial Sequence
  Description of Artificial Sequence: Synthetic coding sequence
atgagagccagcagcttcctgatcgtggtggtgttcctgatcgccggcaccctggtgctggaggccgccgtgaccggcgtgcccgtgaagggccaggacaccgtgaagggcagagtgcccttcaacggccaggaccccgtgaagggccaggtgagcgtgaagggccaggacaaggtgaaggcccaggagcccgtgaagggccccgtgagcaccaagcccggcagctgccccatcatcctgatcagatgcgccatgctgaacccccccaacagatgcctgaaggacaccgactgccccggcatcaagaagtgctgcgagggcagctgcggcatggcctgcttcgtgccccagtag

SEQ ID NO: 92672 - DNA, 732 bp, Artificial Sequence
  Description of Artificial Sequence: Synthetic coding sequence
atggccagactgtggggcgccctgagcctgtggcccctgtgggccgccgtgccctggggcggcgccgccgccgtgggcgtgagagcctgcagcagcaccgccgcccccgacggcgtggagggccccgccctgagaagaagctactggagacacctgagaagactggtgctgggcccccccgagccccccttcagccacgtgtgccaggtgggcgaccccgtgctgagaggcgtggccgcccccgtggagagagcccagctgggcggccccgagctgcagagactgacccagagactggtgcaggtgatgagaagaagaagatgcgtgggcctgagcgccccccagctgggcgtgcccagacaggtgctggccctggagctgcccgaggccctgtgcagagagtgcccccccagacagagagccctgagacagatggagcccttccccctgagagtgttcgtgaaccccagcctgagagtgctggacagcagactggtgaccttccccgagggctgcgagagcgtggccggcttcctggcctgcgtgcccagattccaggccgtgcagatcagcggcctggaccccaacggcgagcaggtggtgtggcaggccagcggctgggccgccagaatcatccagcacgagatggaccacctgcagggctgcctgttcatcgacaagatggacagcagaaccttcaccaacgtgtactggatgaaggtgaacgactag

SEQ ID NO: 92673 - DNA, 294 bp, Artificial Sequence
  Description of Artificial Sequence: Synthetic coding sequence
atggtgttcgtgagaagaccctggcccgccctgaccaccgtgctgctggccctgctggtgtgcctgggcgccctggtggacgcctaccccatcaagcccgaggcccccagagaggacgccagccccgaggagctgaacagatactacgccagcctgagacactacctgaacctggtgaccagacagagatacggcaagagagacggccccgacaccctgctgagcaagaccttcttccccgacggcgaggacagacccgtgagaagcagaagcgagggccccgacctgtggtag

SEQ ID NO: 92674 - DNA, 1992 bp, Artificial Sequence
  Description of Artificial Sequence: Synthetic coding sequence
atggcccccaagagagtggtgcagctgagcctgaagatgcccacccacgccgtgtgcgtggtgggcgtggaggcccacgtggacatccacagcgacgtgcccaagggcgccaacagcttcagagtgagcggcagcagcggcgtggaggtgttcatggtgtacaacagaaccagagtgaaggagcccatcggcaaggccagatggcccctggacaccgacgccgacatggtggtgagcgtgggcaccgccagcaaggagctgaaggacttcaaggtgagagtgagctacttcggcgagcaggaggaccaggccctgggcagaagcgtgctgtacctgaccggcgtggacatcagcctggaggtggacaccggcagaaccggcaaggtgaagagaagccagggcgacaagaagacctggagatggggccccgagggctacggcgccatcctgctggtgaactgcgacagagacaaccacagaagcgccgagcccgacctgacccacagctggctgatgagcctggccgacctgcaggacatgagccccatgctgctgagctgcaacggccccgacaagctgttcgacagccacaagctggtgctgaacgtgcccttcagcgacagcaagagagtgagagtgttctgcgccagaggcggcaacagcctgagcgactacaagcaggtgctgggcccccagtgcctgagctacgaggtggagagacagcccggcgagcaggagatcaagttctacgtggagggcctgaccttccccgacgccgacttcctgggcctggtgagcctgagcgtgagcctggtggaccccggcaccctgcccgaggtgaccctgttcaccgacaccgtgggcttcagaatggccccctggatcatgacccccaacacccagccccccgaggagctgtacgtgtgcagagtgatggacacccacggcagcaacgagaagttcctggaggacatgagctacctgaccctgaaggccaactgcaagctgaccatctgcccccaggtggagaacagaaacgacagatggatccaggacgagatggagttcggctacatcgaggccccccacaagagcttccccgtggtgttcgacagccccagaaacagaggcctgaaggacttcccctacaagagaatcctgggccccgacttcggctacgtgaccagagagatccccctgcccggccccagcagcctggacagcttcggcaacctggacgtgagcccccccgtgaccgtgggcggcaccgagtaccccctgggcagaatcctgatcggcagcagcttccccaagagcggcggcagacagatggccagagccgtgagaaacttcctgaaggcccagcaggtgcaggcccccgtggagctgtacagcgactggctgagcgtgggccacgtggacgagttcctgaccttcgtgcccaccagcgaccagaagggcttcagactgctgctggccagccccagcgcctgcctgaagctgttccaggagaagaaggaggagggctacggcgaggccgcccagttcgacggcctgaagcaccaggccaagagaagcatcaacgagatgctggccgacagacacctgcagagagacaacctgcacgcccagaagtgcatcgactggaacagaaacgtgctgaagagagagctgggcctggccgagagcgacatcgtggacatcccccagctgttcttcctgaagaacttctacgccgaggccttcttccccgacatggtgaacatggtggtgctgggcaagtacctgggcatccccaagccctacggccccatcatcaacggcagatgctgcctggaggagaaggtgcagagcctgctggagcccctgggcctgcactgcatcttcatcgacgactacctgagctaccacgagctgcagggcgagatccactgcggcaccaacgtgagaagaaagcccttccccttcaagtggtggaacatggtgccctag

SEQ ID NO: 92675 - DNA, 537 bp, Artificial Sequence
  Description of Artificial Sequence: Synthetic coding sequence
atggccagagccgtgagaaacttcctgaaggcccagcaggtgcaggcccccgtggagctgtacagcgactggctgagcgtgggccacgtggacgagttcctgaccttcgtgcccaccagcgaccagaagggcttcagactgctgctggccagccccagcgcctgcctgaagctgttccaggagaagaaggaggagggctacggcgaggccgcccagttcgacggcctgaagcaccaggccaagagaagcatcaacgagatgctggccgacagacacctgcagagagacaacctgcacgcccaggtgaacatggtggtgctgggcaagtacctgggcatccccaagccctacggccccatcatcaacggcagatgctgcctggaggagaaggtgcagagcctgctggagcccctgggcctgcactgcatcttcatcgacgactacctgagctaccacgagctgcagggcgagatccactgcggcaccaacgtgagaagaaagcccttccccttcaagtggtggaacatggtgccctag

SEQ ID NO: 92676 - DNA, 405 bp, Artificial Sequence
  Description of Artificial Sequence: Synthetic coding sequence
atgctggccgacagacacctgcagagagacaacctgcacgcccagaagtgcatcgactggaacagaaacgtgctgaagagagagctgggcctggccgagagcgacatcgtggacatcccccagctgttcttcctgaagaacttctacgccgaggccttcttccccgacatggtgaacatggtggtgctgggcaagtacctgggcatccccaagccctacggccccatcatcaacggcagatgctgcctggaggagaaggtgcagagcctgctggagcccctgggcctgcactgcatcttcatcgacgactacctgagctaccacgagctgcagggcgagatccactgcggcaccaacgtgagaagaaagcccttccccttcaagtggtggaacatggtgccctag

SEQ ID NO: 92677 - DNA, 663 bp, Artificial Sequence
  Description of Artificial Sequence: Synthetic coding sequence
atggccagagccgtgagaaacttcctgaaggcccagcaggtgcaggcccccgtggagctgtacagcgactggctgagcgtgggccacgtggacgagttcctgaccttcgtgcccaccagcgaccagaagggcttcagactgctgctggccagccccagcgcctgcctgaagctgttccaggagaagaaggaggagggctacggcgaggccgcccagttcgacggcctgaagcaccaggccaagagaagcatcaacgagatgctggccgacagacacctgcagagagacaacctgcacgcccagaagtgcatcgactggaacagaaacgtgctgaagagagagctgggcctggccgagagcgacatcgtggacatcccccagctgttcttcctgaagaacttctacgccgaggccttcttccccgacatggtgaacatggtggtgctgggcaagtacctgggcatccccaagccctacggccccatcatcaacggcagatgctgcctggaggagaaggtgcagagcctgctggagcccctgggcctgcactgcatcttcatcgacgactacctgagctaccacgagctgcagggcgagatccactgcggcaccaacgtgagaagaaagcccttccccttcaagtggtggaacatggtgccctag

SEQ ID NO: 92678 - DNA, 1314 bp, Artificial Sequence
  Description of Artificial Sequence: Synthetic coding sequence
atgctgagagagagaaccgtgagactgcagtacggcagcagagtggaggccgtgtacgtgctgggcacctacctgtggaccgacgtgtacagcgccgcccccgccggcgcccagaccttcagcctgaagcacagcgagcacgtgtgggtggaggtggtgagagacggcgaggccgaggaggtggccaccaacggcaagcagagatggctgctgagccccagcaccaccctgagagtgaccatgagccaggccagcaccgaggccagcagcgacaaggtgaccgtgaactactacgacgaggagggcagcatccccatcgaccaggccggcctgttcctgaccgccatcgagatcagcctggacgtggacgccgacagagacggcgtggtggagaagaacaaccccaagaaggccagctggacctggggccccgagggccagggcgccatcctgctggtgaactgcgacagagagaccccctggctgcccaaggaggactgcagagacgagaaggtgtacagcaaggaggacctgaaggacatgagccagatgatcctgagaaccaagggccccgacagactgcccgccggctacgagatcgtgctgtacatcagcatgagcgacagcgacaaggtgggcgtgttctacgtggagaaccccttcttcggccagagatacatccacatcctgggcagaagaaagctgtaccacgtggtgaagtacaccggcggcagcgccgagctgctgttcttcgtggagggcctgtgcttccccgacgagggcttcagcggcctggtgagcatccacgtgagcctgctggagtacatggcccaggacatccccctgacccccatcttcaccgacaccgtgatcttcagaatcgccccctggatcatgacccccaacatcctgccccccgtgagcgtgttcgtgtgctgcatgaaggacaactacctgttcctgaaggaggtgaagaacctggtggagaagaccaactgcgagctgaaggtgtgcttccagtacctgaacagaggcgacagatggatccaggacgagatcgagttcggctacatcgaggccccccacaagggcttccccgtggtgctggacagccccagagacggcaacctgaaggacttccccgtgaaggagctgctgggccccgacttcggctacgtgaccagagagcccctgttcgagagcgtgaccagcctggacagcttcggcaacctggaggtgagcccccccgtgaccgtgaacggcaagacctaccccctgggcagaatcctgatcggcagcagcttccccctgtag

SEQ ID NO: 92679 - DNA, 1998 bp, Artificial Sequence
  Description of Artificial Sequence: Synthetic coding sequence
atgctgagagagagaaccgtgagactgcagtacggcagcagagtggaggccgtgtacgtgctgggcacctacctgtggaccgacgtgtacagcgccgcccccgccggcgcccagaccttcagcctgaagcacagcgagcacgtgtgggtggaggtggtgagagacggcgaggccgaggaggtggccaccaacggcaagcagagatggctgctgagccccagcaccaccctgagagtgaccatgagccaggccagcaccgaggccagcagcgacaaggtgaccgtgaactactacgacgaggagggcagcatccccatcgaccaggccggcctgttcctgaccgccatcgagatcagcctggacgtggacgccgacagagacggcgtggtggagaagaacaaccccaagaaggccagctggacctggggccccgagggccagggcgccatcctgctggtgaactgcgacagagagaccccctggctgcccaaggaggactgcagagacgagaaggtgtacagcaaggaggacctgaaggacatgagccagatgatcctgagaaccaagggccccgacagactgcccgccggctacgagatcgtgctgtacatcagcatgagcgacagcgacaaggtgggcgtgttctacgtggagaaccccttcttcggccagagatacatccacatcctgggcagaagaaagctgtaccacgtggtgaagtacaccggcggcagcgccgagctgctgttcttcgtggagggcctgtgcttccccgacgagggcttcagcggcctggtgagcatccacgtgagcctgctggagtacatggcccaggacatccccctgacccccatcttcaccgacaccgtgatcttcagaatcgccccctggatcatgacccccaacatcctgccccccgtgagcgtgttcgtgtgctgcatgaaggacaactacctgttcctgaaggaggtgaagaacctggtggagaagaccaactgcgagctgaaggtgtgcttccagtacctgaacagaggcgacagatggatccaggacgagatcgagttcggctacatcgaggccccccacaagggcttccccgtggtgctggacagccccagagacggcaacctgaaggacttccccgtgaaggagctgctgggccccgacttcggctacgtgaccagagagcccctgttcgagagcgtgaccagcctggacagcttcggcaacctggaggtgagcccccccgtgaccgtgaacggcaagacctaccccctgggcagaatcctgatcggcagcagcttccccctgagcggcggcagaagaatgaccaaggtggtgagagacttcctgaaggcccagcaggtgcaggcccccgtggagctgtacagcgactggctgaccgtgggccacgtggacgagttcatgagcttcgtgcccatccccggcaccaagaagttcctgctgctgatggccagcaccagcgcctgctacaagctgttcagagagaagcagaaggacggccacggcgaggccatcatgttcaagggcctgggcggcatgagcagcaagagaatcaccatcaacaagatcctgagcaacgagagcctggtgcaggagaacctgtacttccagagatgcctggactggaacagagacatcctgaagaaggagctgggcctgaccgagcaggacatcatcgacctgcccgccctgttcaagatggacgaggaccacagagccagagccttcttccccaacatggtgaacatgatcgtgctggacaaggacctgggcatccccaagcccttcggcccccaggtggaggaggagtgctgcctggagatgcacgtgagaggcctgctggagcccctgggcctggagtgcaccttcatcgacgacatcagcgcctaccacaagttcctgggcgaggtgcactgcggcaccaacgtgagaagaaagcccttcaccttcaagtggtggcacatggtgccctag

SEQ ID NO: 92680 - DNA, 1650 bp, Artificial Sequence
  Description of Artificial Sequence: Synthetic coding sequence
atgctgagagagagaaccgtgagactgcagtacggcagcagagtggaggccgtgtacgtgctgggcacctacctgtggaccgacgtgtacagcgccgcccccgccggcgcccagaccttcagcctgaagcacagcgagcacgtgtgggtggaggtggtgagagacggcgaggccgaggaggtggccaccaacggcaagcagagatggctgctgagccccagcaccaccctgagagtgaccatgagccaggccagcaccgaggccagcagcgacaaggtgaccgtgaactactacgacgaggagggcagcatccccatcgaccaggccggcctgttcctgaccgccatcgagatcagcctggacgtggacgccgacagagacggcgtggtggagaagaacaaccccaagaagaccagaagcagcgccaacgccatcagcaccagctgggccggcggcagcagcaccatgtggagcagcaccagagtggcccccagaagctgctgcagcagctggaaggccagcgtgagccccaccagagccagccaggcctggagccccagcatgagcgcctgctggagcacctggcccagcatgaaggacaactacctgttcctgaaggaggtgaagaacctggtggagaagaccaactgcgagctgaaggtgtgcttccagtacctgaacagaggcgacagatggatccaggacgagatcgagttcggctacatcgaggccccccacaagggcttccccgtggtgctggacagccccagagacggcaacctgaaggacttccccgtgaaggagctgctgggccccgacttcggctacgtgaccagagagcccctgttcgagagcgtgaccagcctggacagcttcggcaacctggaggtgagcccccccgtgaccgtgaacggcaagacctaccccctgggcagaatcctgatcggcagcagcttccccctgagcggcggcagaagaatgaccaaggtggtgagagacttcctgaaggcccagcaggtgcaggcccccgtggagctgtacagcgactggctgaccgtgggccacgtggacgagttcatgagcttcgtgcccatccccggcaccaagaagttcctgctgctgatggccagcaccagcgcctgctacaagctgttcagagagaagcagaaggacggccacggcgaggccatcatgttcaagggcctgggcggcatgagcagcaagagaatcaccatcaacaagatcctgagcaacgagagcctggtgcaggagaacctgtacttccagagatgcctggactggaacagagacatcctgaagaaggagctgggcctgaccgagcaggacatcatcgacctgcccgccctgttcaagatggacgaggaccacagagccagagccttcttccccaacatggtgaacatgatcgtgctggacaaggacctgggcatccccaagcccttcggcccccaggtggaggaggagtgctgcctggagatgcacgtgagaggcctgctggagcccctgggcctggagtgcaccttcatcgacgacatcagcgcctaccacaagttcctgggcgaggtgcactgcggcaccaacgtgagaagaaagcccttcaccttcaagtggtggcacatggtgccctag

SEQ ID NO: 92681 - DNA, 1995 bp, Artificial Sequence
  Description of Artificial Sequence: Synthetic coding sequence
atgagcctgcagagaatcgtgagagtgagcctggagcaccccaccagcgccgtgtgcgtggccggcgtggagaccctggtggacatctacggcagcgtgcccgagggcaccgagatgttcgaggtgtacggcacccccggcgtggacatctacatcagccccaacatggagagaggcagagagagagccgacaccagaagatggagattcgacgccaccctggagatcatcgtggtgatgaacagccccagcaacgacctgaacgacagccacgtgcagatcagctaccacagcagccacgagcccctgcccctggcctacgccgtgctgtacctgacctgcgtggacatcagcctggactgcgacctgaactgcgagggcagacaggacagaaacttcgtggacaagagacagtgggtgtggggccccagcggctacggcggcatcctgctggtgaactgcgacagagacgaccccagctgcgacgtgcaggacaactgcgaccagcacgtgcactgcctgcaggacctggaggacatgagcgtgatggtgctgagaacccagggccccgccgccctgttcgacgaccacaagctggtgctgcacaccagcagctacgacgccaagagagcccaggtgttccacatctgcggccccgaggacgtgtgcgaggcctacagacacgtgctgggccaggacaaggtgagctacgaggtgcccagactgcacggcgacgaggagagattcttcgtggagggcctgagcttccccgacgccggcttcaccggcctgatcagcttccacgtgaccctgctggacgacagcaacgaggacttcagcgccagccccatcttcaccgacaccgtggtgttcagagtggccccctggatcatgacccccagcaccctgccccccctggaggtgtacgtgtgcagagtgagaaacaacacctgcttcgtggacgccgtggccgagctggccagaaaggccggctgcaagctgaccatctgcccccaggccgagaacagaaacgacagatggatccaggacgagatggagctgggctacgtgcaggccccccacaagaccctgcccgtggtgttcgacagccccagaaacggcgagctgcaggacttcccctacaagagaatcctgggccccgacttcggctacgtgaccagagagcccagagacagaagcgtgagcggcctggacagcttcggcaacctggaggtgagcccccccgtggtggccaacggcaaggagtaccccctgggcagaatcctgatcggcggcaacctgcccggcagcagcggcagaagagtgacccaggtggtgagagacttcctgcacgcccagaaggtgcagccccccgtggagctgttcgtggactggctggccgtgggccacgtggacgagttcctgagcttcgtgcccgcccccgacggcaagggcttcagaatgctgctggccagccccggcgcctgcttcaagctgttccaggagaagcagaagtgcggccacggcagagccctgctgttccagggcgtggtggacgacgagcaggtgaagaccatcagcatcaaccaggtgctgagcaacaaggacctgatcaactacaacaagttcgtgcagagctgcatcgactggaacagagaggtgctgaagagagagctgggcctggccgagtgcgacatcatcgacatcccccagctgttcaagaccgagagaaagaaggccaccgccttcttccccgacctggtgaacatgctggtgctgggcaagcacctgggcatccccaagcccttcggccccatcatcaacggctgctgctgcctggaggagaaggtgagaagcctgctggagcccctgggcctgcactgcaccttcatcgacgacttcaccccctaccacatgctgcacggcgaggtgcactgcggcaccaacgtgtgcagaaagcccttcagcttcaagtggtggaacatggtgccctag

SEQ ID NO: 92682 - DNA, 645 bp, Artificial Sequence
  Description of Artificial Sequence: Synthetic coding sequence
atggcccagggcaccctgatcagagtgacccccgagcagcccacccacgccgtgtgcgtgctgggcaccctgacccagctggacatctgcagcagcgcccccgaggactgcaccagcttcagcatcaacgccagccccggcgtggtggtggacatcgcccacggcccccccgccaagaagaagagcaccggcagcagcacctggcccctggaccccggcgtggaggtgaccctgaccatgaaggtggccagcggcagcaccggcgaccagaaggtgcagatcagctactacggccccaagaccccccccgtgaaggccctgctgtacctgaccggcgtggacggcgtgagcccctgccaccccggctggagcgccatgcacgacctggcccactgcaacctgagactgcaggtgcaggccatcctgtgcttcagcgtgcccagcagctggaccaccggcgcctgccaccacgcctggctgatcttcgtgttcctggtggagatggagttccaccacgtgggccaggccggcctggagctgctgaccagcggcgacctgcccgccagcggcagccagagcgccagaatcaccggcatgaaccactgcgccagacccagcatcttcctgatcctgaagtacctgtag

SEQ ID NO: 92683 - DNA, 1992 bp, Artificial Sequence
  Description of Artificial Sequence: Synthetic coding sequence
atggcccagggcaccctgatcagagtgacccccgagcagcccacccacgccgtgtgcgtgctgggcaccctgacccagctggacatctgcagcagcgcccccgaggactgcaccagcttcagcatcaacgccagccccggcgtggtggtggacatcgcccacggcccccccgccaagaagaagagcaccggcagcagcacctggcccctggaccccggcgtggaggtgaccctgaccatgaaggtggccagcggcagcaccggcgaccagaaggtgcagatcagctactacggccccaagaccccccccgtgaaggccctgctgtacctgaccggcgtggagatcagcctgtgcgccgacatcaccagaaccggcaaggtgaagcccaccagagccgtgaaggaccagagaacctggacctggggcccctgcggccagggcgccatcctgctggtgaactgcgacagagacaacctggagagcagcgccatggactgcgaggacgacgaggtgctggacagcgaggacctgcaggacatgagcctgatgaccctgagcaccaagacccccaaggacttcttcaccaaccacaccctggtgctgcacgtggccagaagcgagatggacaaggtgagagtgttccaggccaccagaggcaagctgagcagcaagtgcagcgtggtgctgggccccaagtggcccagccactacctgatggtgcccggcggcaagcacaacatggacttctacgtggaggccctggccttccccgacaccgacttccccggcctgatcaccctgaccatcagcctgctggacaccagcaacctggagctgcccgaggccgtggtgttccaggacagcgtggtgttcagagtggccccctggatcatgacccccaacacccagcccccccaggaggtgtacgcctgcagcatcttcgagaacgaggacttcctgaagagcgtgaccaccctggccatgaaggccaagtgcaagctgaccatctgccccgaggaggagaacatggacgaccagtggatgcaggacgagatggagatcggctacatccaggccccccacaagaccctgcccgtggtgttcgacagccccagaaacagaggcctgaaggagttccccatcaagagagtgatgggccccgacttcggctacgtgaccagaggcccccagaccggcggcatcagcggcctggacagcttcggcaacctggaggtgagcccccccgtgaccgtgagaggcaaggagtaccccctgggcagaatcctgttcggcgacagctgctaccccagcaacgacagcagacagatgcaccaggccctgcaggacttcctgagcgcccagcaggtgcaggcccccgtgaagctgtacagcgactggctgagcgtgggccacgtggacgagttcctgagcttcgtgcccgcccccgacagaaagggcttcagactgctgctggccagccccagaagctgctacaagctgttccaggagcagcagaacgagggccacggcgaggccctgctgttcgagggcatcaagaagaagaagcagcagaagatcaagaacatcctgagcaacaagaccctgagagagcacaacagcttcgtggagagatgcatcgactggaacagagagctgctgaagagagagctgggcctggccgagagcgacatcatcgacatcccccagctgttcaagctgaaggagttcagcaaggccgaggccttcttccccaacatggtgaacatgctggtgctgggcaagcacctgggcatccccaagcccttcggccccgtgatcaacggcagatgctgcctggaggagaaggtgtgcagcctgctggagcccctgggcctgcagtgcaccttcatcaacgacttcttcacctaccacatcagacacggcgaggtgcactgcggcaccaacgtgagaagaaagcccttcagcttcaagtggtggaacatggtgccctag

SEQ ID NO: 92684 - DNA, 384 bp, Artificial Sequence
  Description of Artificial Sequence: Synthetic coding sequence
atggcccagggcaccctgatcagagtgacccccgagcagcccacccacgccgtgtgcgtgctgggcaccctgacccagctggacatctgcagcagcgcccccgaggactgcaccagcttcagcatcaacgccagccccggcgtggtggtggacatcgcccacggcccccccgccaagaagaagagcaccggcagcagcacctggcccctggaccccggcgtggaggtgaccctgaccatgaaggtggccagcggcagcaccggcgaccagaaggtgcagatcagctactacggccccaagaccccccccgtgaaggccctgctgtacctgaccggcgtggacggcgtgagcccctgccaccccggctggagcgccatggcctag

SEQ ID NO: 92685 - DNA, 2628 bp, Artificial Sequence
  Description of Artificial Sequence: Synthetic coding sequence
atggacaccgtgcaccacatgctgctgttcggctgcaacatgcccagcagcaccggcagctactggttctgcgacgagggcacctgcaccgacaaggccaacatcctgtacgcctgggccagaaacgccccccccaccagactgcccaagggcgtgggcttcagagtgggcggcgagaccggcagcaagtacttcgtgctgcaggtgcactacggcgacatcagcgccttcagagacaacaacaaggactgcagcggcgtgagcctgcacctgaccagactgccccagcccctgatcgccggcatgtacctgatgatgagcgtggacaccgtgatccccgccggcgagaaggtggtgaacagcgacatcagctgccactacaagaactaccccatgcacgtgttcgcctacagagtgcacacccaccacctgggcaaggtggtgagcggctacagagtgagaaacggccagtggaccctgatcggcagacagagcccccagctgccccaggccttctaccccgtgggccaccccgtggacgtgagcttcggcgacctgctggccgccagatgcgtgttcaccggcgagggcagaaccgaggccacccacatcggcggcaccagcagcgacgagatgtgcaacctgtacatcatgtactacatggaggccaagcacgccgtgagcttcatgacctgcacccagaacgtggcccccgacatgttcagaaccatcccccccgaggccaacatccccatccccgtgaagagcgacatggtgatgatgcacgagcaccacaaggagaccgagtacaaggacaagatccccctgctgcagcagcccaagagagaggaggaggaggtgctggaccagggcgacttctacagcctgctgagcaagctgctgggcgagagagaggacgtggtgcacgtgcacaagtacaaccccaccgagaaggccgagagcgagagcgacctggtggccgagatcgccaacgtggtgcagaagaaggacctgggcagaagcgacgccagagagggcgccgagcacgagagaggcaacgccatcctggtgagagacagaatccacaagttccacagactggtgagcaccctgagaccccccgagagcagagtgttcagcctgcagcagcccccccccggcgagggcacctgggagcccgagcacaccggcgacttccacatggaggaggccctggactggcccggcgtgtacctgctgcccggccaggtgagcggcgtggccctggaccccaagaacaacctggtgatcttccacagaggcgaccacgtgtgggacggcaacagcttcgacagcaagttcgtgtaccagcagatcggcctgggccccatcgaggaggacaccatcctggtgatcgaccccaacaacgccgccgtgctgcagagcagcggcaagaacctgttctacctgccccacggcctgagcatcgacaaggacggcaactactgggtgaccgacgtggccctgcaccaggtgttcaagctggaccccaacaacaaggagggccccgtgctgatcctgggcagaagcatgcagcccggcagcgaccagaaccacttctgccagcccaccgacgtggccgtggaccccggcaccggcgccatctacgtgagcgacggctactgcaacagcagaatcgtgcagttcagccccagcggcaagttcatcacccagtggggcgaggagagcagcggcagcagccccctgcccggccagttcaccgtgccccacagcctggccctggtgcccctgctgggccagctgtgcgtggccgacagagagaacggcagaatccagtgcttcaagaccgacaccaaggagttcgtgagagagatcaagcacagcagcttcggcagaaacgtgttcgccatcagctacatccccggcctgctgttcgccgtgaacggcaagccccacttcggcgaccaggagcccgtgcagggcttcgtgatgaacttcagcaacggcgagatcatcgacatcttcaagcccgtgagaaagcacttcgacatgccccacgacatcgtggccagcgaggacggcaccgtgtacatcggcgacgcccacaccaacaccgtgtggaagttcaccctgaccgagaagctggagcacagaagcgtgaagaaggccggcatcgaggtgcaggagatcaaggccgaggccgtggtggagaccaagatggagaacaagcccaccagcagcgagctgcagaagatgcaggagaagcagaagctgatcaaggagcccggcagcggcgtgcccgtggtgctgatcaccaccctgctggtgatccccgtggtggtgctgctggccatcgccatcttcatcagatggaagaagagcagagccttcggcgacagcgagcacaagctggagaccagcagcggcagagtgctgggcagattcagaggcaagggcagcggcggcctgaacctgggcaacttcttcgccagcagaaagggctacagcagaaagggcttcgacagactgagcaccgagggcagcgaccaggagaaggaggacgacggcagcgagagcgaggaggagtacagcgcccccctgcccgccctggcccccagcagcagctag

SEQ ID NO: 92686 - DNA, 2925 bp, Artificial Sequence
  Description of Artificial Sequence: Synthetic coding sequence
atggccggcagagtgcccagcctgctggtgctgctggtgttccccagcagctgcctggccttcagaagccccctgagcgtgttcaagagattcaaggagaccaccagacccttcagcaacgagtgcctgggcaccaccagacccgtggtgcccatcgacagcagcgacttcgccctggacatcagaatgcccggcgtgacccccaagcagagcgacacctacttctgcatgagcatgagaatccccgtggacgaggaggccttcgtgatcgacttcaagcccagagccagcatggacaccgtgcaccacatgctgctgttcggctgcaacatgcccagcagcaccggcagctactggttctgcgacgagggcacctgcaccgacaaggccaacatcctgtacgcctgggccagaaacgccccccccaccagactgcccaagggcgtgggcttcagagtgggcggcgagaccggcagcaagtacttcgtgctgcaggtgcactacggcgacatcagcgccttcagagacaacaacaaggactgcagcggcgtgagcctgcacctgaccagactgccccagcccctgatcgccggcatgtacctgatgatgagcgtggacaccgtgatccccgccggcgagaaggtggtgaacagcgacatcagctgccactacaagaactaccccatgcacgtgttcgcctacagagtgcacacccaccacctgggcaaggtggtgagcggctacagagtgagaaacggccagtggaccctgatcggcagacagagcccccagctgccccaggccttctaccccgtgggccaccccgtggacgtgagcttcggcgacctgctggccgccagatgcgtgttcaccggcgagggcagaaccgaggccacccacatcggcggcaccagcagcgacgagatgtgcaacctgtacatcatgtactacatggaggccaagcacgccgtgagcttcatgacctgcacccagaacgtggcccccgacatgttcagaaccatcccccccgaggccaacatccccatccccgtgaagagcgacatggtgatgatgcacgagcaccacaaggagaccgagtacaaggacaagatccccctgctgcagcagcccaagagagaggaggaggaggtgctggaccagggcgacttctacagcctgctgagcaagctgctgggcgagagagaggacgtggtgcacgtgcacaagtacaaccccaccgagaaggccgagagcgagagcgacctggtggccgagatcgccaacgtggtgcagaagaaggacctgggcagaagcgacgccagagagggcgccgagcacgagagaggcaacgccatcctggtgagagacagaatccacaagttccacagactggtgagcaccctgagaccccccgagagcagagtgttcagcctgcagcagcccccccccggcgagggcacctgggagcccgagcacaccggcgacttccacatggaggaggccctggactggcccggcgtgtacctgctgcccggccaggtgagcggcgtggccctggaccccaagaacaacctggtgatcttccacagaggcgaccacgtgtgggacggcaacagcttcgacagcaagttcgtgtaccagcagatcggcctgggccccatcgaggaggacaccatcctggtgatcgaccccaacaacgccgccgtgctgcagagcagcggcaagaacctgttctacctgccccacggcctgagcatcgacaaggacggcaactactgggtgaccgacgtggccctgcaccaggtgttcaagctggaccccaacaacaaggagggccccgtgctgatcctgggcagaagcatgcagcccggcagcgaccagaaccacttctgccagcccaccgacgtggccgtggaccccggcaccggcgccatctacgtgagcgacggctactgcaacagcagaatcgtgcagttcagccccagcggcaagttcatcacccagtggggcgaggagagcagcggcagcagccccctgcccggccagttcaccgtgccccacagcctggccctggtgcccctgctgggccagctgtgcgtggccgacagagagaacggcagaatccagtgcttcaagaccgacaccaaggagttcgtgagagagatcaagcacagcagcttcggcagaaacgtgttcgccatcagctacatccccggcctgctgttcgccgtgaacggcaagccccacttcggcgaccaggagcccgtgcagggcttcgtgatgaacttcagcaacggcgagatcatcgacatcttcaagcccgtgagaaagcacttcgacatgccccacgacatcgtggccagcgaggacggcaccgtgtacatcggcgacgcccacaccaacaccgtgtggaagttcaccctgaccgagaagctggagcacagaagcgtgaagaaggccggcatcgaggtgcaggagatcaaggaggccgaggccgtggtggagaccaagatggagaacaagcccaccagcagcgagctgcagaagatgcaggagaagcagaagctgatcaaggagcccggcagcggcgtgcccgtggtgctgatcaccaccctgctggtgatccccgtggtggtgctgctggccatcgccatcttcatcagatggaagaagagcagagccttcggcgccgacagcgagcacaagctggagaccagcagcggcagagtgctgggcagattcagaggcaagggcagcggcggcctgaacctgggcaacttcttcgccagcagaaagggctacagcagaaagggcttcgacagactgagcaccgagggcagcgaccaggagaaggaggacgacggcagcgagagcgaggaggagtacagcgcccccctgcccgccctggcccccagcagcagctag

SEQ ID NO: 92687 - DNA, 2664 bp, Artificial Sequence
  Description of Artificial Sequence: Synthetic coding sequence
atggccggcagagtgcccagcctgctggtgctgctggtgttccccagcagctgcctggccttcagaagccccctgagcgtgttcaagagattcaaggagaccaccagacccttcagcaacgagtgcctgggcaccaccagacccgtggtgcccatcgacagcagcgacttcgccctggacatcagaatgcccggcgtgacccccaagcagagcgacacctacttctgcatgagcatgagaatccccgtggacgaggaggccttcgtgatcgacttcaagcccagagccagcatggacaccgtgcaccacatgctgctgttcggctgcaacatgcccagcagcaccggcagctactggttctgcgacgagggcacctgcaccgacaaggccaacatcctgtacgcctgggccagaaacgccccccccaccagactgcccaagggcgtgggcttcagagtgggcggcgagaccggcagcaagtacttcgtgctgcaggtgcactacggcgacatcagcgccttcagagacaacaacaaggactgcagcggcgtgagcctgcacctgaccagactgccccagcccctgatcgccggcatgtacctgatgatgagcgtggacaccgtgatccccgccggcgagaaggtggtgaacagcgacatcagctgccactacaagaactaccccatgcacgtgttcgcctacagagtgcacacccaccacctgggcaaggtggtgagcggctacagagtgagaaacggccagtggaccctgatcggcagacagagcccccagctgccccaggccttctaccccgtgggccaccccgtggacgtgagcttcggcgacctgctggccgccagatgcgtgttcaccggcgagggcagaaccgaggccacccacatcggcggcaccagcagcgacgagatgtgcaacctgtacatcatgtactacatggaggccaagcacgccgtgagcttcatgacctgcacccagaacgtggcccccgacatgttcagaaccatcccccccgaggccaacatccccatccccgtgaagagcgacatggtgatgatgcacgagcaccacaaggagaccgagtacaaggacaagatccccctgctgcagcagcccaagagagaggaggaggaggtgctggaccagggcgacttctacagcctgctgagcaagctgctgggcgagagagaggacgtggtgcacgtgcacaagtacaaccccaccgagaaggccgagagcgagagcgacctggtggccgagatcgccaacgtggtgcagaagaaggacctgggcagaagcgacgccagagagggcgccgagcacgagagaggcaacgccatcctggtgagagacagaatccacaagttccacagactggtgagcaccctgagaccccccgagagcagagtgttcagcctgcagcagcccccccccggcgagggcacctgggagcccgagcacaccggcgacttccacatggaggaggccctggactggcccggcgtgtacctgctgcccggccaggtgagcggcgtggccctggaccccaagaacaacctggtgatcttccacagaggcgaccacgtgtgggacggcaacagcttcgacagcaagttcgtgtaccagcagatcggcctgggccccatcgaggaggacaccatcctggtgatcgaccccaacaacgccgccgtgctgcagagcagcggcaagaacctgttctacctgccccacggcctgagcatcgacaaggacggcaactactgggtgaccgacgtggccctgcaccaggtgttcaagctggaccccaacaacaaggagggccccgtgctgatcctgggcagaagcatgcagcccggcagcgaccagaaccacttctgccagcccaccgacgtggccgtggaccccggcaccggcgccatctacgtgagcgacggctactgcaacagcagaatcgtgcagttcagccccagcggcaagttcatcacccagtggggcgaggagagcagcggcagcagccccctgcccggccagttcaccgtgccccacagcctggccctggtgcccctgctgggccagctgtgcgtggccgacagagagaacggcagaatccagtgcttcaagaccgacaccaaggagttcgtgagagagatcaagcacagcagcttcggcagaaacgtgttcgccatcagctacatccccggcctgctgttcgccgtgaacggcaagccccacttcggcgaccaggagcccgtgcagggcttcgtgatgaacttcagcaacggcgagatcatcgacatcttcaagcccgtgagaaagcacttcgacatgccccacgacatcgtggccagcgaggacggcaccgtgtacatcggcgacgcccacaccaacaccgtgtggaagttcaccctgaccgagaagctggagcacagaagcgtgaagaaggccggcatcgaggtgcaggagatcaagggcaagggcagcggcggcctgaacctgggcaacttcttcgccagcagaaagggctacagcagaaagggcttcgacagactgagcaccgagggcagcgaccaggagaaggaggacgacggcagcgagagcgaggaggagtacagcgcccccctgcccgccctggcccccagcagcagctag

SEQ ID NO: 92688 - DNA, 2601 bp, Artificial Sequence
  Description of Artificial Sequence: Synthetic coding sequence
atggccggcagagtgcccagcctgctggtgctgctggtgttccccagcagctgcctggccttcagaagccccctgagcgtgttcaagagattcaaggagaccaccagacccttcagcaacgagtgcctgggcaccaccagacccgtggtgcccatcgacagcagcgacttcgccctggacatcagaatgcccggcgtgacccccaagcagagcgacacctacttctgcatgagcatgagaatccccgtggacgaggaggccttcgtgatcgacttcaagcccagagccagcatggacaccgtgcaccacatgctgctgttcggctgcaacatgcccagcagcaccggcagctactggttctgcgacgagggcacctgcaccgacaaggccaacatcctgtacgcctgggccagaaacgccccccccaccagactgcccaagggcgtgggcttcagagtgggcggcgagaccggcagcaagtacttcgtgctgcaggtgcactacggcgacatcagcgccttcagagacaacaacaaggactgcagcggcgtgagcctgcacctgaccagactgccccagcccctgatcgccggcatgtacctgatgatgagcgtggacaccgtgatccccgccggcgagaaggtggtgaacagcgacatcagctgccactacaagaactaccccatgcacgtgttcgcctacagagtgcacacccaccacctgggcaaggtggtgagcggctacagagtgagaaacggccagtggaccctgatcggcagacagagcccccagctgccccaggccttctaccccgtgggccaccccgtggacgtgagcttcggcgacctgctggccgccagatgcgtgttcaccggcgagggcagaaccgaggccacccacatcggcggcaccagcagcgacgagatgtgcaacctgtacatcatgtactacatggaggccaagcacgccgtgagcttcatgacctgcacccagaacgtggcccccgacatgttcagaaccatcccccccgaggccaacatccccatccccgtgaagagcgacatggtgatgatgcacgagcaccacaaggagaccgagtacaaggacaagatccccctgctgcagcagcccaagagagaggaggaggaggtgctggaccaggacttccacatggaggaggccctggactggcccggcgtgtacctgctgcccggccaggtgagcggcgtggccctggaccccaagaacaacctggtgatcttccacagaggcgaccacgtgtgggacggcaacagcttcgacagcaagttcgtgtaccagcagatcggcctgggccccatcgaggaggacaccatcctggtgatcgaccccaacaacgccgccgtgctgcagagcagcggcaagaacctgttctacctgccccacggcctgagcatcgacaaggacggcaactactgggtgaccgacgtggccctgcaccaggtgttcaagctggaccccaacaacaaggagggccccgtgctgatcctgggcagaagcatgcagcccggcagcgaccagaaccacttctgccagcccaccgacgtggccgtggaccccggcaccggcgccatctacgtgagcgacggctactgcaacagcagaatcgtgcagttcagccccagcggcaagttcatcacccagtggggcgaggagagcagcggcagcagccccctgcccggccagttcaccgtgccccacagcctggccctggtgcccctgctgggccagctgtgcgtggccgacagagagaacggcagaatccagtgcttcaagaccgacaccaaggagttcgtgagagagatcaagcacagcagcttcggcagaaacgtgttcgccatcagctacatccccggcctgctgttcgccgtgaacggcaagccccacttcggcgaccaggagcccgtgcagggcttcgtgatgaacttcagcaacggcgagatcatcgacatcttcaagcccgtgagaaagcacttcgacatgccccacgacatcgtggccagcgaggacggcaccgtgtacatcggcgacgcccacaccaacaccgtgtggaagttcaccctgaccgagaagctggagcacagaagcgtgaagaaggccggcatcgaggtgcaggagatcaaggaggccgaggccgtggtggagaccaagatggagaacaagcccaccagcagcgagctgcagaagatgcaggagaagcagaagctgatcaaggagcccggcagcggcgtgcccgtggtgctgatcaccaccctgctggtgatccccgtggtggtgctgctggccatcgccatcttcatcagatggaagaagagcagagccttcggcgacagcgagcacaagctggagaccagcagcggcagagtgctgggcagattcagaggcaagggcagcggcggcctgaacctgggcaacttcttcgccagcagaaagggctacagcagaaagggcttcgacagactgagcaccgagggcagcgaccaggagaaggaggacgacggcagcgagagcgaggaggagtacagcgcccccctgcccgccctggcccccagcagcagctag

SEQ ID NO: 92689 - DNA, 1008 bp, Artificial Sequence
  Description of Artificial Sequence: Synthetic coding sequence
atgcagcccggcagcgaccagaaccacttctgccagcccaccgacgtggccgtggaccccggcaccggcgccatctacgtgagcgacggctactgcaacagcagaatcgtgcagttcagccccagcggcaagttcatcacccagtggggcgaggagagcagcggcagcagccccctgcccggccagttcaccgtgccccacagcctggccctggtgcccctgctgggccagctgtgcgtggccgacagagagaacggcagaatccagtgcttcaagaccgacaccaaggagttcgtgagagagatcaagcacagcagcttcggcagaaacgtgttcgccatcagctacatccccggcctgctgttcgccgtgaacggcaagccccacttcggcgaccaggagcccgtgcagggcttcgtgatgaacttcagcaacggcgagatcatcgacatcttcaagcccgtgagaaagcacttcgacatgccccacgacatcgtggccagcgaggacggcaccgtgtacatcggcgacgcccacaccaacaccgtgtggaagttcaccctgaccgagaagctggagcacagaagcgtgaagaaggccggcatcgaggtgcaggagatcaaggaggccgaggccgtggtggagaccaagatggagaacaagcccaccagcagcgagctgcagaagatgcaggagaagcagaagctgatcaaggagcccggcagcggcgtgcccgtggtgctgatcaccaccctgctggtgatccccgtggtggtgctgctggccatcgccatcttcatcagatggaagaagagcagagccttcggcggcaagggcagcggcggcctgaacctgggcaacttcttcgccagcagaaagggctacagcagaaagggcttcgacagactgagcaccgagggcagcgaccaggagaaggaggacgacggcagcgagagcgaggaggagtacagcgcccccctgcccgccctggcccccagcagcagctag

SEQ ID NO: 92690 - DNA, 468 bp, Artificial Sequence
  Description of Artificial Sequence: Synthetic coding sequence
atgcacgagcaccacaaggagaccgagtacaaggacaagatccccctgctgcagcagcccaagagagaggaggaggaggtgctggaccagggcgacttctacagcctgctgagcaagctgctgggcgagagagaggacgtggtgcacgtgcacaagtacaaccccaccgagaaggccgagagcgagagcgacctggtggccgagatcgccaacgtggtgcagaagaaggacctgggcagaagcgacgccagagagggcgccgagcacgagagaggcaacgccatcctggtgagagacagaatccacaagttccacagactggtgagcaccctgagaccccccgagagcagagtgttcagcctgcagcagcccccccccggcgagggcacctgggagcccgagcacaccggcgccagaagagaggacatgaagtgcttccagtgcaaggagatgatcagcgtgcagtag

SEQ ID NO: 92691 - DNA, 2922 bp, Artificial Sequence
  Description of Artificial Sequence: Synthetic coding sequence
atggccggcagagtgcccagcctgctggtgctgctggtgttccccagcagctgcctggccttcagaagccccctgagcgtgttcaagagattcaaggagaccaccagacccttcagcaacgagtgcctgggcaccaccagacccgtggtgcccatcgacagcagcgacttcgccctggacatcagaatgcccggcgtgacccccaagcagagcgacacctacttctgcatgagcatgagaatccccgtggacgaggaggccttcgtgatcgacttcaagcccagagccagcatggacaccgtgcaccacatgctgctgttcggctgcaacatgcccagcagcaccggcagctactggttctgcgacgagggcacctgcaccgacaaggccaacatcctgtacgcctgggccagaaacgccccccccaccagactgcccaagggcgtgggcttcagagtgggcggcgagaccggcagcaagtacttcgtgctgcaggtgcactacggcgacatcagcgccttcagagacaacaacaaggactgcagcggcgtgagcctgcacctgaccagactgccccagcccctgatcgccggcatgtacctgatgatgagcgtggacaccgtgatccccgccggcgagaaggtggtgaacagcgacatcagctgccactacaagaactaccccatgcacgtgttcgcctacagagtgcacacccaccacctgggcaaggtggtgagcggctacagagtgagaaacggccagtggaccctgatcggcagacagagcccccagctgccccaggccttctaccccgtgggccaccccgtggacgtgagcttcggcgacctgctggccgccagatgcgtgttcaccggcgagggcagaaccgaggccacccacatcggcggcaccagcagcgacgagatgtgcaacctgtacatcatgtactacatggaggccaagcacgccgtgagcttcatgacctgcacccagaacgtggcccccgacatgttcagaaccatcccccccgaggccaacatccccatccccgtgaagagcgacatggtgatgatgcacgagcaccacaaggagaccgagtacaaggacaagatccccctgctgcagcagcccaagagagaggaggaggaggtgctggaccagggcgacttctacagcctgctgagcaagctgctgggcgagagagaggacgtggtgcacgtgcacaagtacaaccccaccgagaaggccgagagcgagagcgacctggtggccgagatcgccaacgtggtgcagaagaaggacctgggcagaagcgacgccagagagggcgccgagcacgagagaggcaacgccatcctggtgagagacagaatccacaagttccacagactggtgagcaccctgagaccccccgagagcagagtgttcagcctgcagcagcccccccccggcgagggcacctgggagcccgagcacaccggcgacttccacatggaggaggccctggactggcccggcgtgtacctgctgcccggccaggtgagcggcgtggccctggaccccaagaacaacctggtgatcttccacagaggcgaccacgtgtgggacggcaacagcttcgacagcaagttcgtgtaccagcagatcggcctgggccccatcgaggaggacaccatcctggtgatcgaccccaacaacgccgccgtgctgcagagcagcggcaagaacctgttctacctgccccacggcctgagcatcgacaaggacggcaactactgggtgaccgacgtggccctgcaccaggtgttcaagctggaccccaacaacaaggagggccccgtgctgatcctgggcagaagcatgcagcccggcagcgaccagaaccacttctgccagcccaccgacgtggccgtggaccccggcaccggcgccatctacgtgagcgacggctactgcaacagcagaatcgtgcagttcagccccagcggcaagttcatcacccagtggggcgaggagagcagcggcagcagccccctgcccggccagttcaccgtgccccacagcctggccctggtgcccctgctgggccagctgtgcgtggccgacagagagaacggcagaatccagtgcttcaagaccgacaccaaggagttcgtgagagagatcaagcacagcagcttcggcagaaacgtgttcgccatcagctacatccccggcctgctgttcgccgtgaacggcaagccccacttcggcgaccaggagcccgtgcagggcttcgtgatgaacttcagcaacggcgagatcatcgacatcttcaagcccgtgagaaagcacttcgacatgccccacgacatcgtggccagcgaggacggcaccgtgtacatcggcgacgcccacaccaacaccgtgtggaagttcaccctgaccgagaagctggagcacagaagcgtgaagaaggccggcatcgaggtgcaggagatcaaggaggccgaggccgtggtggagaccaagatggagaacaagcccaccagcagcgagctgcagaagatgcaggagaagcagaagctgatcaaggagcccggcagcggcgtgcccgtggtgctgatcaccaccctgctggtgatccccgtggtggtgctgctggccatcgccatcttcatcagatggaagaagagcagagccttcggcgacagcgagcacaagctggagaccagcagcggcagagtgctgggcagattcagaggcaagggcagcggcggcctgaacctgggcaacttcttcgccagcagaaagggctacagcagaaagggcttcgacagactgagcaccgagggcagcgaccaggagaaggaggacgacggcagcgagagcgaggaggagtacagcgcccccctgcccgccctggcccccagcagcagctag

SEQ ID NO: 92692 - DNA, 2718 bp, Artificial Sequence
  Description of Artificial Sequence: Synthetic coding sequence
atggccggcagagtgcccagcctgctggtgctgctggtgttccccagcagctgcctggccttcagaagccccctgagcgtgttcaagagattcaaggagaccaccagacccttcagcaacgagtgcctgggcaccaccagacccgtggtgcccatcgacagcagcgacttcgccctggacatcagaatgcccggcgtgacccccaagcagagcgacacctacttctgcatgagcatgagaatccccgtggacgaggaggccttcgtgatcgacttcaagcccagagccagcatggacaccgtgcaccacatgctgctgttcggctgcaacatgcccagcagcaccggcagctactggttctgcgacgagggcacctgcaccgacaaggccaacatcctgtacgcctgggccagaaacgccccccccaccagactgcccaagggcgtgggcttcagagtgggcggcgagaccggcagcaagtacttcgtgctgcaggtgcactacggcgacatcagcgccttcagagacaacaacaaggactgcagcggcgtgagcctgcacctgaccagactgccccagcccctgatcgccggcatgtacctgatgatgagcgtggacaccgtgatccccgccggcgagaaggtggtgaacagcgacatcagctgccactacaagaactaccccatgcacgtgttcgcctacagagtgcacacccaccacctgggcaaggtggtgagcggctacagagtgagaaacggccagtggaccctgatcggcagacagagcccccagctgccccaggccttctaccccgtgggccaccccgtggacgtgagcttcggcgacctgctggccgccagatgcgtgttcaccggcgagggcagaaccgaggccacccacatcggcggcaccagcagcgacgagatgtgcaacctgtacatcatgtactacatggaggccaagcacgccgtgagcttcatgacctgcacccagaacgtggcccccgacatgttcagaaccatcccccccgaggccaacatccccatccccgtgaagagcgacatggtgatgatgcacgagcaccacaaggagaccgagtacaaggacaagatccccctgctgcagcagcccaagagagaggaggaggaggtgctggaccagggcgacttctacagcctgctgagcaagctgctgggcgagagagaggacgtggtgcacgtgcacaagtacaaccccaccgagaaggccgagagcgagagcgacctggtggccgagatcgccaacgtggtgcagaagaaggacctgggcagaagcgacgccagagagggcgccgagcacgagagaggcaacgccatcctggtgagagacagaatccacaagttccacagactggtgagcaccctgagaccccccgagagcagagtgttcagcctgcagcagcccccccccggcgagggcacctgggagcccgagcacaccggcgacttccacatggaggaggccctggactggcccggcgtgtacctgctgcccggccaggtgagcggcgtggccctggaccccaagaacaacctggtgatcttccacagaggcgaccacgtgtgggacggcaacagcttcgacagcaagttcgtgtaccagcagatcggcctgggccccatcgaggaggacaccatcctggtgatcgaccccaacaacgccgccgtgctgcagagcagcggcaagaacctgttctacctgccccacggcctgagcatcgacaaggacggcaactactgggtgaccgacgtggccctgcaccaggtgttcaagctggaccccaacaacaaggagggccccgtgctgatcctgggcagaagcatgcagcccggcagcgaccagaaccacttctgccagcccaccgacgtggccgtggaccccggcaccggcgccatctacgtgagcgacggctactgcaacagcagaatcgtgcagttcagccccagcggcaagttcatcacccagtggggcgaggagagcagcggcagcagccccctgcccggccagttcaccgtgccccacagcctggccctggtgcccctgctgggccagctgtgcgtggccgacagagagaacggcagaatccagtgcttcaagaccgacaccaaggagttcgtgagagagatcaagcacagcagcttcggcagaaacgtgttcgccatcagctacatccccggcctgctgttcgccgtgaacggcaagccccacttcggcgaccaggagcccgtgcagggcttcgtgatgaacttcagcaacggcgagatcatcgacatcttcaagcccgtgagaaagcacttcgacatgccccacgacatcgtggccagcgaggacggcaccgtgtacatcggcgacgcccacaccaacaccgtgtggaagttcaccctgaccgagaagctggagcacagaagcgtgaagaaggccggcatcgaggtgcaggagatcaaggacagcgagcacaagctggagaccagcagcggcagagtgctgggcagattcagaggcaagggcagcggcggcctgaacctgggcaacttcttcgccagcagaaagggctacagcagaaagggcttcgacagactgagcaccgagggcagcgaccaggagaaggaggacgacggcagcgagagcgaggaggagtacagcgcccccctgcccgccctggcccccagcagcagctag

SEQ ID NO: 92693 - DNA, 90 bp, Artificial Sequence
  Description of Artificial Sequence: Synthetic coding sequence
atggccggcagagtgcccagcctgctggtgctgctggtgttccccagcagctgcctggccttcagaagccccctgagcgtgttcaagtag

SEQ ID NO: 92694 - DNA, 87 bp, Artificial Sequence
  Description of Artificial Sequence: Synthetic coding sequence
atggccggcagagtgcccagcctgctggtgctgctggtgttccccagcagctgcctggccttcagaagccccctgagcgtgttctag

SEQ ID NO: 92695 - DNA, 162 bp, Artificial Sequence
  Description of Artificial Sequence: Synthetic coding sequence
atggccggcagagtgcccagcctgctggtgctgctggtgttccccagcagctgcctggccttcagaagccccctgagcgtgttcaagagattcaaggagaccaccagacccttcagcaacgagtgcctgggcaccaccagacccgtggtgcccatcgactag

SEQ ID NO: 92696 - DNA, 129 bp, Artificial Sequence
  Description of Artificial Sequence: Synthetic coding sequence
atggccggcagagtgcccagcctgctggtgctgctggtgttccccagcagctgcctggccttcagaagccccctgagcgtgttcaagagattcaaggagaccaccagacccttcagcaacgagtgctag

SEQ ID NO: 92697 - DNA, 207 bp, Artificial Sequence
  Description of Artificial Sequence: Synthetic coding sequence
atggccggcagagtgcccagcctgctggtgctgctggtgttccccagcagctgcctggccttcagaagccccctgagcgtgttcaagagattcaaggagaccaccagacccttcagcaacgagtgcctgggcaccaccagacccgtggtgcccatcgacagcagcgacttcgccctggacatcagaatgcccggcgtgaccccctag

SEQ ID NO: 92698 - DNA, 78 bp, Artificial Sequence
  Description of Artificial Sequence: Synthetic coding sequence
atggccggcagagtgcccagcctgctggtgctgctggtgttccccagcagctgcctggccttcagaagccccctgtag

SEQ ID NO: 92699 - DNA, 501 bp, Artificial Sequence
  Description of Artificial Sequence: Synthetic coding sequence
atggccgccatcccccccgacagctggcagccccccaacgtgtacctggagaccagcatgggcatcatcgtgctggagctgtactggaagcacgcccccaagacctgcaagaacttcgccgagctggccagaagaggctactacaacggcaccaagttccacagaatcatcaaggacttcatgatccagggcggcgaccccaccggcaccggcagaggcggcgccagcatctacggcaagcagttcgaggacgagctgcaccccgacctgaagttcaccggcgccggcatcctggccatggccaacgccggccccgacaccaacggcagccagttcttcgtgaccctggcccccacccagtggctggacggcaagcacaccatcttcggcagagtgtgccagggcatcggcatggtgaacagagtgggcatggtggagaccaacagccaggacagacccgtggacgacgtgaagatcatcaaggcctaccccagcggctag

SEQ ID NO: 92700 - DNA, 1563 bp, Artificial Sequence
  Description of Artificial Sequence: Synthetic coding sequence
atgggcaagagacagcaccagaaggacaagatgtacatcacctgcgccgagtacacccacttctacggcggcaagaagcccgacctgccccagaccaacttcagaagactgcccttcgaccactgcagcctgagcctgcagcccttcgtgtaccccgtgtgcacccccgacggcatcgtgttcgacctgctgaacatcgtgccctggctgaagaagtacggcaccaaccccagcaacggcgagaagctggacggcagaagcctgatcaagctgaacttcagcaagaacagcgagggcaagtaccactgccccgtgctgttcaccgtgttcaccaacaacacccacatcgtggccgtgagaaccaccggcaacgtgtacgcctacgaggccgtggagcagctgaacatcaaggccaagaacttcagagacctgctgaccgacgagcccttcagcagacaggacatcatcaccctgcaggaccccaccaacctggacaagttcaacgtgagcaacttctaccacgtgaagaacaacatgaagatcatcgaccccgacgaggagaaggccaagcaggaccccagctactacctgaagaacaccaacgccgagaccagagagaccctgcaggagctgtacaaggagttcaagggcgacgagatcctggccgccaccatgaaggcccccgagaagaagaaggtggacaagctgaacgccgcccactacagcaccggcaaggtgagcgccagcttcaccagcaccgccatggtgcccgagaccacccacgaggccgccgccatcgacgaggacgtgctgagataccagttcgtgaagaagaagggctacgtgagactgcacaccaacaagggcgacctgaacctggagctgcactgcgacctgacccccaagacctgcgagaacttcatcagactgtgcaagaagcactactacgacggcaccatcttccacagaagcatcagaaacttcgtgatccagggcggcgaccccaccggcaccggcaccggcggcgagagctactggggcaagcccttcaaggacgagttcagacccaacctgagccacaccggcagaggcatcctgagcatggccaacagcggccccaacagcaacagaagccagttcttcatcaccttcagaagctgcgcctacctggacaagaagcacaccatcttcggcagagtggtgggcggcttcgacgtgctgaccgccatggagaacgtggagagcgaccccaagaccgacagacccaaggaggagatcagaatcgacgccaccaccgtgttcgtggacccctacgaggaggccgacgcccagatcgcccaggagagaaagacccagctgaaggtggcccccgagaccaaggtgaagagcagccagccccaggccggcagccagggcccccagaccttcagacagggcgtgggcaagtacatcaaccccgccgccaccaagagagccgccgaggaggagcccagcaccagcgccaccgtgcccatgagcaagaagaagcccagcagaggcttcggcgacttcagcagctggtag

SEQ ID NO: 92701 - DNA, 1563 bp, Artificial Sequence; identical to SEQ ID NO: 92700
  Description of Artificial Sequence: Synthetic coding sequence

SEQ ID NO: 92702 - DNA, 1563 bp, Artificial Sequence; identical to SEQ ID NO: 92700
  Description of Artificial Sequence: Synthetic coding sequence

SEQ ID NO: 92703 - DNA, 1584 bp, Artificial Sequence
  Description of Artificial Sequence: Synthetic coding sequence
atgggcaagagacagcaccagaaggacaagatgtacatcacctgcgccgagtacacccacttctacggcggcaagaagcccgacctgccccagaccaacttcagaagactgcccttcgaccactgcagcctgagcctgcagcccttcgtgtaccccgtgtgcacccccgacggcatcgtgttcgacctgctgaacatcgtgccctggctgaagaagtacggcaccaaccccagcaacggcgagaagctggacggcagaagcctgatcaagctgaacttcagcaagaacagcgagggcaagtaccactgccccgtgctgttcaccgtgttcaccaacaacacccacatcgtggccgtgagaaccaccggcaacgtgtacgcctacgaggccgtggagcagctgaacatcaaggccaagaacttcagagacctgctgaccgacgagcccttcagcagacaggacatcatcaccctgcaggaccccaccaacctggacaagttcaacgtgagcaacttctaccacgtgaagaacaacatgaagatcatcgaccccgacgaggagaaggccaagcaggaccccagctactacctgaagaacaccaacgccgagaccagagagaccctgcaggagctgtacaaggagttcaagggcgacgagatcctggccgccaccatgaaggcccccgagaagaagaaggtggacaagctgaacgccgcccactacagcaccggcaaggtgagcgccagcttcaccagcaccgccatggtgcccgagaccacccacgaggccgccgccatcgacgaggacgtgctgagataccagttcgtgaagaagaagggctacgtgagactgcacaccaacaagggcgacctgaacctggagctgcactgcgacctgacccccaagacctgcgagaacttcatcagactgtgcaagaagcactactacgacggcaccatcttccacagaagcatcagaaacttcgtgatccagggcggcgaccccaccggcaccggcaccggcggcgagagctactggggcaagcccttcaaggacgagttcagacccaacctgagccacaccggcagaggcatcctgagcatggccaacagcggccccaacagcaacagaagccagttcttcatcaccttcagaagctgcgcctacctggacaagaagcacaccatcttcggcagagtggtgggcggcttcgacgtgctgaccgccatggagaacgtggagagcgaccccaagaccgacagacccaaggaggagatcagaatcgacgccaccaccgtgttcgtggacccctacgaggaggccgacgcccagatcgcccaggagagaaagacccagctgaaggtggcccccgagaccaaggtgaagagcagccagccccaggccggcagccagggcccccagaccttcagacagggcgtgggcaagtacatcaaccccgccgccaccgagcagcagagaaagagcccccagcccgtgcccctgagcccctgccccagaagaagccccgtgggcgtgctgggcaccagcgcccccggcagcagcagactgcccgacgaccactag

SEQ ID NO: 92704 - DNA, 1470 bp, Artificial Sequence
  Description of Artificial Sequence: Synthetic coding sequence
atgggcaagagacagcaccagaaggacaagatgtacatcacctgcgccgagtacacccacttctacggcggcaagaagcccgacctgccccagaccaacttcagaagactgcccttcgaccactgcagaaacatcgtgccctggctgaagaagtacggcaccaaccccagcaacggcgagaagctggacggcagaagcctgatcaagctgaacttcagcaagaacagcgagggcaagtaccactgccccgtgctgttcaccgtgttcaccaacaacacccacatcgtggccgtgagaaccaccggcaacgtgtacgcctacgaggccgtggagcagctgaacatcaaggccaagaacttcagagacctgctgaccgacgagcccttcagcagacaggacatcatcaccctgcaggaccccaccaacctggacaagttcaacgtgagcaacttctaccacgtgaagaacaacatgaagatcatcgaccccgacgaggagaaggccaagcaggaccccagctactacctgaagaacaccaacgccgagaccagagagaccctgcaggagctgtacaaggagttcaagggcgacgagatcctggccgccaccatgaaggcccccgagaagaagaaggtggacaagctgaacgccgcccactacagcaccggcaaggtgagcgccagcttcaccagcaccgccatggtgcccgagaccacccacgaggccgccgccatcgacgaggacgtgctgagataccagttcgtgaagaagaagggctacgtgagactgcacaccaacaagggcgacctgaacctggagctgcactgcgacctgacccccaagacctgcgagaacttcatcagactgtgcaagaagcactactacgacggcaccatcttccacagaagcatcagaaacttcgtgatccagggcggcgaccccaccggcaccggcaccggcggcgagagctactggggcaagcccttcaaggacgagttcagacccaacctgagccacaccggcagaggcatcctgagcatggccaacagcggccccaacagcaacagaagccagttcttcatcaccttcagaagctgcgcctacctggacaagaagcacaccatcttcggcagagtggtgggcggcttcgacgtgctgaccgccatggagaacgtggagagcgaccccaagaccgacagacccaaggaggagatcagaatcgacgccaccaccgtgttcgtggacccctacgaggaggccgacgcccagatcgcccaggagagaaagacccagctgaaggaggccagcagcagaggcagagccctgaaccagtgccactgcccccacgtgcaggaggaggcccagagcggcttctggggcctgcagctgctggtggccgccgccacctgcagactgtacctgtgccccagcttcagccaccagagcctgatgctgaagctgcaggcctag

SEQ ID NO: 92705 - DNA, 1563 bp, Artificial Sequence; identical to SEQ ID NO: 92700
  Description of Artificial Sequence: Synthetic coding sequence

SEQ ID NO: 92706 - DNA, 1479 bp, Artificial Sequence
  Description of Artificial Sequence: Synthetic coding sequence
atggccgtgctgctggagaccaccctgggcgacgtggtgatcgacctgtacaccgaggagagacccagagcctgcctgaacttcctgaagctgtgcaagatcaagtactacaactactgcctgatccacaacgtgcagagagacttcatcatccagaccggcgaccccaccggcaccggcagaggcggcgagagcatcttcggccagctgtacggcgaccaggccagcttcttcgaggccgagaaggtgcccagaatcaagcacaagaagaagggcaccgtgagcatggtgaacaacggcagcgaccagcacggcagccagttcctgatcaccaccggcgagaacctggactacctggacggcgtgcacaccgtgttcggcgaggtgaccgagggcatggacatcatcaagaagatcaacgagaccttcgtggacaaggacttcgtgccctaccaggacatcagaatcaaccacaccgtgatcctggacgaccccttcgacgacccccccgacctgctgatccccgacagaagccccgagcccaccagagagcagctggacagcggcagaatcggcgccgacgaggagatcgacgacttcaagggcagaagcgccgaggaggtggaggagatcaaggccgagaaggaggccaagacccaggccatcctgctggagatggtgggcgacctgcccgacgccgacatcaagccccccgagaacgtgctgttcgtgtgcaagctgaaccccgtgaccaccgacgaggacctggagatcatcttcagcagattcggccccatcagaagctgcgaggtgatcagagactggaagaccggcgagagcctgtgctacgccttcatcgagttcgagaaggaggaggactgcgagaaggccttcttcaagatggacaacgtgctgatcgacgacagaagaatccacgtggacttcagccagagcgtggccaaggtgaagtggaagggcaagggcggcaagtacaccaagagcgacttcaaggagtacgagaaggagcaggacaagccccccaacctggtgctgaaggacaaggtgaagcccaagcaggacaccaagtacgacctgatcctggacgagcaggccgaggacagcaagagcagccacagccacaccagcaagaagcacaagaagaagacccaccactgcagcgaggagaaggaggacgaggactacatgcccatcaagaacaccaaccaggacatctacagagagatgggcttcggccactacgaggaggaggagagctgctgggagaagcagaagagcgagaagagagacagaacccagaacagaagcagaagcagaagcagagagagagacggccactacagcaacagccacaagagcaagtaccagaccgacctgtacgagagagagagaagcaagaagagagacagaagcagaagccccaagaagagcaaggacaaggagaagagcaagtacagatag

SEQ ID NO: 92707 - DNA, 384 bp, Artificial Sequence
  Description of Artificial Sequence: Synthetic coding sequence
atgagcagacccaagacccagaaccaggtgacccacacccaggtgaagaacaccagaagaaagcccatcaccgtgctgaagagaaagaagatgagaaccacctgccagagcaagatcctgatcagaatcagcatcgagaagtggggcctggtgaccatgaagaagaagaaggccgtgggcagaaacaagagagtgaagagagagaccgagctgagaaccgaggtggtggccgacctggagagaggcatggccatcatcgtgatcgtgatcaaccagaacaccaagcagatcttcatgaaggagaagggcgtgaagagagagaccgaggccgaggtgcagagaagccccaagatcaagaagaacctgagcatcgacgagagatag

SEQ ID NO: 92708 - DNA, 318 bp, Artificial Sequence
  Description of Artificial Sequence: Synthetic coding sequence
atgtgccagggcggcgacttcaccagacacaacggcaccggcggcaagagcatctacggcgagaagttcgaggacgagaacttcatcctgaagcacaccggccccggcatcctgagcatggccaacgccggccccaacaccaacggcagccagttcttcatctgcaccgccaagaccgagtggctggacggcaagcacgtggtgttcggcaaggtgaaggagggcatgaacatcgtggaggccatggagagattcggcagcagaaacggcaagaccagcaagaagatcaccatcgccgactgcggccagctggagtag

SEQ ID NO: 92709 - DNA, 390 bp, Artificial Sequence
  Description of Artificial Sequence: Synthetic coding sequence
atggtgaaccccaccgtgttcttcgacatcgccgtggacggcgagcccctgggcagagtgagcttcgagctgttcgccgacaaggtgcccaagaccgccgagaacttcagagccctgagcaccggcgagaagggcttcggctacaagggcagctgcttccacagaatcatccccggcttcatgtgccagggcggcgacttcaccagacacaacggcaccggcggcaagagcatctgcaccgccaagaccgagtggctggacggcaagcacgtggtgttcggcaaggtgaaggagggcatgaacatcgtggaggccatggagagattcggcagcagaaacggcaagaccagcaagaagatcaccatcgccgactgcggccagctggagtag

SEQ ID NO: 92710 - DNA, 498 bp, Artificial Sequence
  Description of Artificial Sequence: Synthetic coding sequence
atggtgaaccccaccgtgttcttcgacatcgccgtggacggcgagcccctgggcagagtgagcttcgagctgttcgccgacaaggtgcccaagaccgccgagaacttcagagccctgagcaccggcgagaagggcttcggctacaagggcagctgcttccacagaatcatccccggcttcatgtgccagggcggcgacttcaccagacacaacggcaccggcggcaagagcatctacggcgagaagttcgaggacgagaacttcatcctgaagcacaccggccccggcatcctgagcatggccaacgccggccccaacaccaacggcagccagttcttcatctgcaccgccaagaccgagtggctggacggcaagcacgtggtgttcggcaaggtgaaggagggcatgaacatcgtggaggccatggagagattcggcagcagaaacggcaagaccagcaagaagatcaccatcgccgactgcggccagctggagtag

SEQ ID NO: 92711 - DNA, 495 bp, Artificial Sequence
  Description of Artificial Sequence: Synthetic coding sequence
atggtgaacagcgtggtgttcttcgacatcaccgtggacggcaagcccctgggcagaatcagcatcaagctgttcgccgacaagatcctgaagaccgccgagaacttcagagccctgagcaccggcgagaagggcttcagatacaagggcagctgcttccacagaatcatccccggcttcatgtgccagggcggcgacttcaccagacacaacggcaccggcgacaagagcatctacggcgagaagttcgacgacgagaacctgatcagaaagcacaccggcagcggcatcctgagcatggccaacgccggccccaacaccaacggcagccagttcttcatctgcgccgccaagaccgagtggctggacggcaagcacgtggccttcggcaaggtgaaggagagagtgaacatcgtggaggccatggagcacttcggctacagaaacagcaagaccagcaagaagatcaccatcgccgactgcggccagttctag

SEQ ID NO: 92712 - DNA, 651 bp, Artificial Sequence
  Description of Artificial Sequence: Synthetic coding sequence
atgctgagactgagcgagagaaacatgaaggtgctgctggccgccgccctgatcgccggcagcgtgttcttcctgctgctgcccggccccagcgccgccgacgagaagaagaagggccccaaggtgaccgtgaaggtgtacttcgacctgagaatcggcgacgaggacgtgggcagagtgatcttcggcctgttcggcaagaccgtgcccaagaccgtggacaacttcgtggccctggccaccggcgagaagggcttcggctacaagaacagcaagttccacagagtgatcaaggacttcatgatccagggcggcgacttcaccagaggcgacggcaccggcggcaagagcatctacggcgagagattccccgacgagaacttcaagctgaagcactacggccccggctgggtgagcatggccaacgccggcaaggacaccaacggcagccagttcttcatcaccaccgtgaagaccgcctggctggacggcaagcacgtggtgttcggcaaggtgctggagggcatggaggtggtgagaaaggtggagagcaccaagaccgacagcagagacaagcccctgaaggacgtgatcatcgccgactgcggcaagatcgaggtggagaagcccttcgccatcgccaaggagtag

SEQ ID NO: 92713 - DNA, 639 bp, Artificial Sequence
  Description of Artificial Sequence: Synthetic coding sequence
atgggccccggccccagactgctgctgcccctggtgctgtgcgtgggcctgggcgccctggtgttcagcagcggcgccgagggcttcagaaagagaggccccagcgtgaccgccaaggtgttcttcgacgtgagaatcggcgacaaggacgtgggcagaatcgtgatcggcctgttcggcaaggtggtgcccaagaccgtggagaacttcgtggccctggccaccggcgagaagggctacggctacaagggcagcaagttccacagagtgatcaaggacttcatgatccagggcggcgacatcaccaccggcgacggcaccggcggcgtgagcatctacggcgagaccttccccgacgagaacttcaagctgaagcactacggcatcggctgggtgagcatggccaacgccggccccgacaccaacggcagccagttcttcatcaccctgaccaagcccacctggctggacggcaagcacgtggtgttcggcaaggtgatcgacggcatgaccgtggtgcacagcatcgagctgcaggccaccgacggccacgacagacccctgaccaactgcagcatcatcaacagcggcaagatcgacgtgaagacccccttcgtggtggagatcgccgactggtag

SEQ ID NO: 92714 - DNA, 1113 bp, Artificial Sequence
  Description of Artificial Sequence: Synthetic coding sequence
atgagccaccccagcccccaggccaagcccagcaaccccagcaaccccagagtgttcttcgacgtggacatcggcggcgagagagtgggcagaatcgtgctggagctgttcgccgacatcgtgcccaagaccgccgagaacttcagagccctgtgcaccggcgagaagggcatcggccacaccaccggcaagcccctgcacttcaagggctgccccttccacagaatcatcaagaagttcatgatccagggcggcgacttcagcaaccagaacggcaccggcggcgagagcatctacggcgagaagttcgaggacgagaacttccactacaagcacgacagagagggcctgctgagcatggccaacgccggcagaaacaccaacggcagccagttcttcatcaccaccgtgcccaccccccacctggacggcaagcacgtggtgttcggccaggtgatcaagggcatcggcgtggccagaatcctggagaacgtggaggtgaagggcgagaagcccgccaagctgtgcgtgatcgccgagtgcggcgagctgaaggagggcgacgacggcggcatcttccccaaggacggcagcggcgacagccaccccgacttccccgaggacgccgacatcgacctgaaggacgtggacaagatcctgctgatcaccgaggacctgaagaacatcggcaacaccttcttcaagagccagaactgggagatggccatcaagaagtacgccgaggtgctgagatacgtggacagcagcaaggccgtgatcgagaccgccgacagagccaagctgcagcccatcgccctgagctgcgtgctgaacatcggcgcctgcaagctgaagatgagcaactggcagggcgccatcgacagctgcctggaggccctggagctggaccccagcaacaccaaggccctgtacagaagagcccagggctggcagggcctgaaggagtacgaccaggccctggccgacctgaagaaggcccagggcatcgcccccgaggacaaggccatccaggccgagctgctgaaggtgaagcagaagatcaaggcccagaaggacaaggagaaggccgtgtacgccaagatgttcgcctag

SEQ ID NO: 92715 - DNA, 597 bp, Artificial Sequence
  Description of Artificial Sequence: Synthetic coding sequence
atggacgccatcctgaactacagaagcgaggacaccgaggactactacaccctgctgggctgcgacgagctgagcagcgtggagcagatcctggccgagttcaaggtgagagccctggagtgccaccccgacaagcaccccgagaaccccaaggccgtggagaccttccagaagctgcagaaggccaaggagatcctgaccaacgaggagagcagagccagatacgaccactggagaagaagccagatgagcatgcccttccagcagtgggaggccctgaacgacagcgtgaagaccagcatgcactgggtggtgagaggcaagaaggacctgatgctggaggagagcgacaagacccacaccaccaagatggagaacgaggagtgcaacgagcagagagagagaaagaaggaggagctggccagcaccgccgagaagaccgagcagaaggagcccaagcccctggagaagagcgtgagcccccagaacagcgacagcagcggcttcgccgacgtgaacggctggcacctgagattcagatggagcaaggacgcccccagcgagctgctgagaaagttcagaaactacgagatctag

SEQ ID NO: 92716 - DNA, 468 bp, Artificial Sequence
  Description of Artificial Sequence: Synthetic coding sequence
atgctggccctgagatgcggcagcagatggctgggcctgctgagcgtgcccagaagcgtgcccctgagactgcccgccgccagagcctgcagcaagggcagcggcgaccccagcagcagcagcagcagcggcaaccccctggtgtacctggacgtggacgccaacggcaagcccctgggcagagtggtgctggagctgaaggccgacgtggtgcccaagaccgccgagaacttcagagccctgtgcaccggcgagaagggcttcggctacaagggcagcaccttccacagagtgatccccagcttcatgtgccaggccggcgacttcaccaaccacaacggcaccggcggcaagagcatctacggcagcagattccccgacgagaacttcaccctgaagcacgtgggccccggctggatggccagcatgctgtgcagcgtgaccagcaagagagcctggaccagctag

SEQ ID NO: 92717 - DNA, 498 bp, Artificial Sequence
  Description of Artificial Sequence: Synthetic coding sequence
tgaagcagcagcagcagcagcggcaaccccctggtgtacctggacgtggacgccaacggcaagcccctgggcagagtggtgctggagctgaaggccgacgtggtgcccaagaccgccgagaacttcagagccctgtgcaccggcgagaagggcttcggctacaagggcagcaccttccacagagtgatccccagcttcatgtgccaggccggcgacttcaccaaccacaacggcaccggcggcaagagcatctacggcagcagattccccgacgagaacttcaccctgaagcacgtgggccccggcgtgctgagcatggccaacgccggccccaacaccaacggcagccagttcttcatctgcaccatcaagaccgactggagcatggccctggacgacatcgccctgcactgctgcagccccggcagccccgtgctgaccggctggatggccagcatgctgtgcagcgtgaccagcaagagagcctggaccagctag

SEQ ID NO: 92718 - DNA, 2265 bp, Artificial Sequence
  Description of Artificial Sequence: Synthetic coding sequence
atgggcatcaaggtgcagagacccagatgcttcttcgacatcgccatcaacaaccagcccgccggcagagtggtgttcgagctgttcagcgacgtgtgccccaagacctgcgagaacttcagatgcctgtgcaccggcgagaagggcaccggcaagagcacccagaagcccctgcactacaagagctgcctgttccacagagtggtgaaggacttcatggtgcagggcggcgacttcagcgagggcaacggcagaggcggcgagagcatctacggcggcttcttcgaggacgagagcttcgccgtgaagcacaacaaggagttcctgctgagcatggccaacagaggcaaggacaccaacggcagccagttcttcatcaccaccaagcccaccccccacctggacggccaccacgtggtgttcggccaggtgatcagcggccaggaggtggtgagagagatcgagaaccagaagaccgacgccgccagcaagcccttcgccgaggtgagaatcctgagctgcggcgagctgatccccaagagcaaggtgaagaaggaggagaagaagagacacaagagcagcagcagcagcagcagcagcagcagcgacagcgacagcagcagcgacagccagagcagcagcgacagcagcgacagcgagagcgccaccgaggagaagagcaagaagagaaagaagaagcacagaaagaacagcagaaagcacaagaaggagaagaagaagagaaagaagagcaagaagagcgccagcagcgagagcgaggccgagaacctggaggcccagccccagagcaccgtgagacccgaggagatcccccccatccccgagaacagattcctgatgagaaagagcccccccaaggccgacgagaaggagagaaagaacagagagagagagagagagagagagtgcaacccccccaacagccagcccgccagctaccagagaagactgctggtgaccagaagcggcagaaagatcaagggcagaggccccagaagatacagaacccccagcagaagcagaagcagagacagattcagaagaagcgagacccccccccactggagacaggagatgcagagagcccagagaatgagagtgagcagcggcgagagatggatcaagggcgacaagagcgagctgaacgagatcaaggagaaccagagaagccccgtgagagtgaaggagagaaagatcaccgaccacagaaacgtgagcgagagccccaacagaaagaacgagaaggagaagaaggtgaaggaccacaagagcaacagcaaggagagagacatcagaagaaacagcgagaaggacgacaagtacaagaacaaggtgaagaagagagccaagagcaagagcagaagcaagagcaaggagaagagcaagagcaaggagagagacagcaagcacaacagaaacgaggagaagagaatgagaagcagaagcaagggcagagaccacgagaacgtgaaggagaaggagaagcagagcgacagcaagggcaaggaccaggagagaagcagaagcaaggagaagagcaagcagctggagagcaagagcaacgagcacgaccacagcaagagcaaggagaaggacagaagagcccagagcagaagcagagagtgcgacatcaccaagggcaagcacagctacaacagcagaaccagagagagaagcagaagcagagacagaagcagaagagtgagaagcagaacccacgacagagacagaagcagaagcaaggagtaccacagatacagagagcaggagtacagaagaagaggcagaagcagaagcagagagagaagaaccccccccggcagaagcagaagcaaggacagaagaagaagaagaagagacagcagaagcagcgagagagaggagagccagagcagaaacaaggacaagtacagaaaccaggagagcaagagcagccacagaaaggagaacagcgagagcgagaagagaatgtacagcaagagcagagaccacaacagcagcaacaacagcagagagaagaaggccgacagagaccagagccccttcagcaagatcaagcagagcagccaggacaacgagctgaagagcagcatgctgaagaacaaggaggacgagaagatcagaagcagcgtggagaaggagaaccagaagagcaagggccaggagaacgaccacgtgcacgagaagaacaagaagttcgaccacgagagcagccccggcaccgacgaggacaagagcggctag

SEQ ID NO: 92719 - DNA, 741 bp, Artificial Sequence
  Description of Artificial Sequence: Synthetic coding sequence
atgggcatcaaggtgcagagacccagatgcttcttcgacatcgccatcaacaaccagcccgccggcagagtggtgttcgagctgttcagcgacgtgtgccccaagacctgcgagaacttcagatgcctgtgcaccggcgagaagggcaccggcaagagcacccagaagcccctgcactacaagagctgcctgttccacagagtggtgaaggacttcatggtgcagggcggcgacttcagcgagggcaacggcagaggcggcgagagcatctacggcggcttcttcgaggacgagagcttcgccgtgaagcacaacaaggagttcctgctgagcatggccaacagaggcaaggacaccaacggcagccagttcttcatcaccaccaagcccaccccccacctggacggccaccacgtggtgttcggccaggtgatcagcggccaggaggtggtgagagagatcgagaaccagaagaccgacgccgccagcaagcccttcgccgaggtgagaatcctgagctgcggcgagctgatccccaagagcaaggtgaagaaggaggagaagaagagacacaagagcagcagcagcagcagcagcagcagcagcgacagcgacagcagcagcgacagccagagcagcagcgacagcagcgacagcgagagcgccaccgaggagaagagcaagaagagaaagaagaagcacagaaagaacagcagaaagcacaagaaggagaagaagtag

SEQ ID NO: 92720 - DNA, 180 bp, Artificial Sequence
  Description of Artificial Sequence: Synthetic coding sequence
atgggcatcaaggtgcagagacccagatgcttcttcgacatcgccatcaacaaccagcccgccggcagagtggtgttcgagctgttcagcgacgtgtgccccaagacctgcgagaacttcagatgcctgtgcaccggcgagaagggcaccggcaagagcacccagaagcccctgcactag

SEQ ID NO: 92721 - DNA, 2265 bp, Artificial Sequence; identical to SEQ ID NO: 92718
  Description of Artificial Sequence: Synthetic coding sequence

SEQ ID NO: 92722 - DNA, 1347 bp, Artificial Sequence
  Description of Artificial Sequence: Synthetic coding sequence
atgggcatcaaggtgcagagacccagatgcttcttcgacatcgccatcaacaaccagcccgccggcagagtggtgttcgagctgttcagcgacgtgtgccccaagacctgcgagaacttcagatgcctgtgcaccggcgagaagggcaccggcaagagcacccagaagcccctgcactacaagagctgcctgttccacagagtggtgaaggacttcatggtgcagggcggcgacttcagcgagggcaacggcagaggcggcgagagcatctacggcggcttcttcgaggacgagagcttcgccgtgaagcacaacaaggagttcctgctgagcatggccaacagaggcaaggacaccaacggcagccagttcttcatcaccaccaagcccaccccccacctggacggccaccacgtggtgttcggccaggtgatcagcggccaggaggtggtgagagagatcgagaaccagaagaccgacgccgccagcaagcccttcgccgaggtgagaatcctgagctgcggcgagctgatccccaagagcaaggtgaagaaggaggagaagaagagacacaagagcagcagcagcagcagcagcagcagcagcgacagcgacagcagcagcgacagccagagcagcagcgacagcagcgacagcgagagcgccaccgaggagaagagcaagaagagaaagaagaagcacagaaagaacagcagaaagcacaagaaggagaagaagaagagaaagaagagcaagaagagcgccagcagcgagagcgaggccgagaacctggaggcccagccccagagcaccgtgagacccgaggagatcccccccatccccgagaacagattcctgatgagaaagagcccccccaaggccgacgagaaggagagaaagaacagagagagagagagagagagagagtgcaacccccccaacagccagcccgccagctaccagagaagactgctggtgaccagaagcggcagaaagatcaagggcagaggccccagaagatacagaacccccagcagaagcagaagcagagacagattcagaagaagcgagacccccccccactggagacaggagatgcagagagcccagagaatgagagtgagcagcggcgagagatggatcaagggcgacaagagcgagctgaacgagatcaaggagaaccagagaagccccgtgagagtgaaggagagaaagatcaccgaccacagaaacgtgagcgagagccccaacagaaagaacgagaaggagaagaaggtgaaggaccacaagagcaacagcaaggagagagacatcagaagaaagaagaagaagaagaagaagaagtag

SEQ ID NO: 92723 - DNA, 534 bp, Artificial Sequence
  Description of Artificial Sequence: Synthetic coding sequence
atggccgtggccaacagcagccccgtgaaccccgtggtgttcttcgacgtgagcatcggcggccaggaggtgggcagaatgaagatcgagctgttcgccgacgtggtgcccaagaccgccgagaacttcagacagttctgcaccggcgagttcagaaaggacggcgtgcccatcggctacaagggcagcaccttccacagagtgatcaaggacttcatgatccagggcggcgacttcgtgaacggcgacggcaccggcgtggccagcatctacagaggccccttcgccgacgagaacttcaagctgagacacagcgcccccggcctgctgagcatggccaacagcggccccagcaccaacggctgccagttcttcatcacctgcagcaagtgcgactggctggacggcaagcacgtggtgttcggcaagatcatcgacggcctgctggtgatgagaaagatcgagaacgtgcccaccggccccaacaacaagcccaagctgcccgtggtgatcagccagtgcggcgagatgtag

SEQ ID NO: 92724 - DNA, 174 bp, Artificial Sequence
  Description of Artificial Sequence: Synthetic coding sequence
atgaagatcgagctgttcgccgacgtggtgcccaagaccgccgagaacttcagacagttctgcaccggcgagttcagaagcgtgagcgacgtgttcgacttcttcgcctgcagcagaggcgtgttctggggctgcagcgagggcatcggcgagccccccgccggcctggagtag

SEQ ID NO: 92725 - DNA, 405 bp, Artificial Sequence
  Description of Artificial Sequence: Synthetic coding sequence
atgatcgccggcgacagcgacagaagaaaggacggcgtgcccatcggctacaagggcagcaccttccacagagtgatcaaggacttcatgatccagggcggcgacttcgtgaacggcgacggcaccggcgtggccagcatctacagaggccccttcgccgacgagaacttcaagctgagacacagcgcccccggcctgctgagcatggccaacagcggccccagcaccaacggctgccagttcttcatcacctgcagcaagtgcgactggctggacggcaagcacgtggtgttcggcaagatcatcgacggcctgctggtgatgagaaagatcgagaacgtgcccaccggccccaacaacaagcccaagctgcccgtggtgatcagccagtgcggcgagatgtag

SEQ ID NO: 92726 - DNA, 207 bp, Artificial Sequence
  Description of Artificial Sequence: Synthetic coding sequence
atggtgaactggaagggcctggtgctgcccgccgtgacccccagcctgttcctgttcggctacagaaaggacggcgtgcccatcggctacaagggcagcaccttccacagagtgatcaaggacttcatgatccagggcggcgacttcgtgaacgtgagcaccatccccttcctgagcaagaccagaagcttcagcttctgctgctag

SEQ ID NO: 92727 - DNA, 435 bp, Artificial Sequence
  Description of Artificial Sequence: Synthetic coding sequence
atgaagatcgagctgttcgccgacgtggtgcccaagaccgccgagaacttcagacagttctgcaccggcgagttcagaaaggacggcgtgcccatcggctacaagggcagcaccttccacagagtgatcaaggacttcatgatccagggcggcgacttcgtgaacggcgacggcaccggcgtggccagcatctacagaggccccttcgccgacgagaacttcaagctgagacacagcgcccccggcctgctgagcatggccaacagcggccccagcaccaacggctgccagttcttcatcacctgcagcaagtgcgactggctggacggcaagcacgtggtgttcggcaagatcatcgacggcctgctggtgatgagaaagatcgagaacgtgcccaccggccccaacaacaagcccaagctgcccgtggtgtag

SEQ ID NO: 92728 - DNA, 405 bp, Artificial Sequence; identical to SEQ ID NO: 92725
  Description of Artificial Sequence: Synthetic coding sequence

SEQ ID NO: 92729 - DNA, 540 bp, Artificial Sequence
  Description of Artificial Sequence: Synthetic coding sequence
atgcccagcaagagcctggtgatggagtacctggcccaccccagcaccctgggcctggccgtgggcgtggcctgcggcatgtgcctgggctggagcctgagagtgtgcttcggcatgctgcccaagagcaagaccagcaagacccacaccgacaccgagagcgaggccagcatcctgggcgacagcggcgagtacaagatgatcctggtggtgagaaacgacctgaagatgggcaagggcaaggtggccgcccagtgcagccacgccgccgtgagcgcctacaagcagatccagagaagaaaccccgagatgctgaagcagtgggagtactgcggccagcccaaggtggtggtgaaggcccccgacgaggagaccctgatcgccctgctggcccacgccaagatgctgggcctgaccgtgagcctgatccaggacgccggcagaacccagatcgcccccggcagccagaccgtgctgggcatcggccccggccccgccgacctgatcgacaaggtgaccggccacctgaagctgtactag

SEQ ID NO: 92730 - DNA, 543 bp, Artificial Sequence
  Description of Artificial Sequence: Synthetic coding sequence
atgatgcccagcaagagcctggtgatggagtacctggcccaccccagcaccctgggcctggccgtgggcgtggcctgcggcatgtgcctgggctggagcctgagagtgtgcttcggcatgctgcccaagagcaagaccagcaagacccacaccgacaccgagagcgaggccagcatcctgggcgacagcggcgagtacaagatgatcctggtggtgagaaacgacctgaagatgggcaagggcaaggtggccgcccagtgcagccacgccgccgtgagcgcctacaagcagatccagagaagaaaccccgagatgctgaagcagtgggagtactgcggccagcccaaggtggtggtgaaggcccccgacgaggagaccctgatcgccctgctggcccacgccaagatgctgggcctgaccgtgagcctgatccaggacgccggcagaacccagatcgcccccggcagccagaccgtgctgggcatcggccccggccccgccgacctgatcgacaaggtgaccggccacctgaagctgtactag

SEQ ID NO: 92731 - DNA, 540 bp, Artificial Sequence; identical to SEQ ID NO: 92729
  Description of Artificial Sequence: Synthetic coding sequence

SEQ ID NO: 92732 - DNA, 1668 bp, Artificial Sequence
  Description of Artificial Sequence: Synthetic coding sequence
atggccgccagactgctgctgctgggcatcctgctgctgctgctgcccctgcccgtgcccgccccctgccacaccgccgccagaagcgagtgcaagagaagccacaagttcgtgcccggcgcctggctggccggcgagggcgtggacgtgaccagcctgagaagaagcggcagcttccccgtggacacccagagattcctgagacccgacggcacctgcaccctgtgcgagaacgccctgcaggagggcaccctgcagagactgcccctggccctgaccaactggagagcccagggcagcggctgccagagacacgtgaccagagccaaggtgagcagcaccgaggccgtggccagagacgccgccagaagcatcagaaacgactggaaggtgggcctggacgtgacccccaagcccaccagcaacgtgcacgtgagcgtggccggcagccacagccaggccgccaacttcgccgcccagaagacccaccaggaccagtacagcttcagcaccgacaccgtggagtgcagattctacagcttccacgtggtgcacaccccccccctgcaccccgacttcaagagagccctgggcgacctgccccaccacttcaacgccagcacccagcccgcctacctgagactgatcagcaactacggcacccacttcatcagagccgtggagctgggcggcagaatcagcgccctgaccgccctgagaacctgcgagctggccctggagggcctgaccgacaacgaggtggaggactgcctgaccgtggaggcccaggtgaacatcggcatccacggcagcatcagcgccgaggccaaggcctgcgaggagaagaagaagaagcacaagatgaccgccagcttccaccagacctacagagagagacacagcgaggtggtgggcggccaccacaccagcatcaacgacctgctgttcggcatccaggccggccccgagcagtacagcgcctgggtgaacagcctgcccggcagccccggcctggtggactacaccctggagcccctgcacgtgctgctggacagccaggaccccagaagagaggccctgagaagagccctgagccagtacctgaccgacagagccagatggagagactgcagcagaccctgcccccccggcagacagaagagccccagagacccctgccagtgcgtgtgccacggcagcgccgtgaccacccaggactgctgccccagacagagaggcctggcccagctggaggtgaccttcatccaggcctggggcctgtggggcgactggttcaccgccaccgacgcctacgtgaagctgttcttcggcggccaggagctgagaaccagcaccgtgtgggacaacaacaaccccatctggagcgtgagactggacttcggcgacgtgctgctggccaccggcggccccctgagactgcaggtgtgggaccaggacagcggcagagacgacgacctgctgggcacctgcgaccaggcccccaagagcggcagccacgaggtgagatgcaacctgaaccacggccacctgaagttcagataccacgccagatgcctgccccacctgggcggcggcacctgcctggactacgtgccccagatgctgctgggcgagccccccggcaacagaagcggcgccgtgtggtag

SEQ ID NO: 92733 - DNA, 1668 bp, Artificial Sequence; identical to SEQ ID NO: 92732
  Description of Artificial Sequence: Synthetic coding sequence

SEQ ID NO: 92734 - DNA, 1668 bp, Artificial Sequence; identical to SEQ ID NO: 92732
  Description of Artificial Sequence: Synthetic coding sequence

SEQ ID NO: 92735 - DNA, 444 bp, Artificial Sequence
  Description of Artificial Sequence: Synthetic coding sequence
atggaggccagaagcagaagcgccgaggagctgagaagagccgagctggtggagatcatcgtggagaccgaggcccagaccggcgtgagcggcatcaacgtggccggcggcggcaaggagggcatcttcgtgagagagctgagagaggacagccccgccgccagaagcctgagcctgcaggagggcgaccagctgctgagcgccagagtgttcttcgagaacttcaagtacgaggacgccctgagactgctgcagtgcgccgagccctacaaggtgagcttctgcctgaagagaaccgtgcccaccggcgacctggccctgagacccggcaccgtgagcggctacgagatcaagggccccagagccaaggtggccaagctggtgagagtgctgagccccgcccccgccctggactgccccagcgaccccgtgagcgccccctag

SEQ ID NO: 92736 - DNA, 4386 bp, Artificial Sequence
  Description of Artificial Sequence: Synthetic coding sequence
atggaggccagaagcagaagcgccgaggagctgagaagagccgagctggtggagatcatcgtggagaccgaggcccagaccggcgtgagcggcatcaacgtggccggcggcggcaaggagggcatcttcgtgagagagctgagagaggacagccccgccgccagaagcctgagcctgcaggagggcgaccagctgctgagcgccagagtgttcttcgagaacttcaagtacgaggacgccctgagactgctgcagtgcgccgagccctacaaggtgagcttctgcctgaagagaaccgtgcccaccggcgacctggccctgagacccggcaccgtgagcggctacgagatcaagggccccagagccaaggtggccaagctgaacatccagagcctgagccccgtgaagaagaagaagatggtgcccggcgccctgggcgtgcccgccgacctggcccccgtggacgtggagttcagcttccccaagttcagcagactgagaagaggcctgaaggccgaggccgtgaagggccccgtgcccgccgcccccgccagaagaagactgcagctgcccagactgagagtgagagaggtggccgaggaggcccaggccgccagactggccgccgccgcccccccccccagaaaggccaaggtggaggccgaggtggccgccggcgccagattcaccgccccccaggtggagctggtgggccccagactgcccggcgccgaggtgggcgtgccccaggtgagcgcccccaaggccgcccccagcgccgaggccgccggcggcttcgccctgcacctgcccaccctgggcctgggcgcccccgccccccccgccgtggaggcccccgccgtgggcatccaggtgccccaggtggagctgcccgccctgcccagcctgcccaccctgcccaccctgccctgcctggagaccagagagggcgccgtgagcgtggtggtgcccaccctggacgtggccgcccccaccgtgggcgtggacctggccctgcccggcgccgaggtggaggccagaggcgaggcccccgaggtggccctgaagatgcccagactgagcttccccagattcggcgccagagccaaggaggtggccgaggccaaggtggccaaggtgagccccgaggccagagtgaagggccccagactgagaatgcccaccttcggcctgagcctgctggagcccagacccgccgcccccgaggtggtggagagcaagctgaagctgcccaccatcaagatgcccagcctgggcatcggcgtgagcggccccgaggtgaaggtgcccaagggccccgaggtgaagctgcccaaggcccccgaggtgaagctgcccaaggtgcccgaggccgccctgcccgaggtgagactgcccgaggtggagctgcccaaggtgagcgagatgaagctgcccaaggtgcccgagatggccgtgcccgaggtgagactgcccgaggtggagctgcccaaggtgagcgagatgaagctgcccaaggtgcccgagatggccgtgcccgaggtgagactgcccgaggtgcagctgctgaaggtgagcgagatgaagctgcccaaggtgcccgagatggccgtgcccgaggtgagactgcccgaggtgcagctgcccaaggtgagcgagatgaagctgcccgaggtgagcgaggtggccgtgcccgaggtgagactgcccgaggtgcagctgcccaaggtgcccgagatgaaggtgcccgagatgaagctgcccaaggtgcccgagatgaagctgcccgagatgaagctgcccgaggtgcagctgcccaaggtgcccgagatggccgtgcccgacgtgcacctgcccgaggtgcagctgcccaaggtgcccgagatgaagctgcccgagatgaagctgcccgaggtgaagctgcccaaggtgcccgagatggccgtgcccgacgtgcacctgcccgaggtgcagctgcccaaggtgcccgagatgaagctgcccaagatgcccgagatggccgtgcccgaggtgagactgcccgaggtgcagctgcccaaggtgagcgagatgaagctgcccaaggtgcccgagatggccgtgcccgacgtgcacctgcccgaggtgcagctgcccaaggtgtgcgagatgaaggtgcccgacatgaagctgcccgagatcaagctgcccaaggtgcccgagatggccgtgcccgacgtgcacctgcccgaggtgcagctgcccaaggtgagcgagatcagactgcccgagatgcaggtgcccaaggtgcccgacgtgcacctgcccaaggcccccgaggtgaagctgcccagagcccccgaggtgcagctgaaggccaccaaggccgagcaggccgagggcatggagttcggcttcaagatgcccaagatgaccatgcccaagctgggcagagccgagagccccagcagaggcaagcccggcgaggccggcgccgaggtgagcggcaagctggtgaccctgccctgcctgcagcccgaggtggacggcgaggcccacgtgggcgtgcccagcctgaccctgcccagcgtggagctggacctgcccggcgccctgggcctgcagggccaggtgcccgccgccaagatgggcaagggcgagagagtggagggccccgaggtggccgccggcgtgagagaggtgggcttcagagtgcccagcgtggagatcgtgaccccccagctgcccgccgtggagatcgaggagggcagactggagatgatcgagaccaaggtgaagcccagcagcaagttcagcctgcccaagttcggcctgagcggccccaaggtggccaaggccgaggccgagggcgccggcagagccaccaagctgaaggtgagcaagttcgccatcagcctgcccaaggccagagtgggcgccgaggccgaggccaagggcgccggcgaggccggcctgctgcccgccctggacctgagcatcccccagctgagcctggacgcccacctgcccagcggcaaggtggaggtggccggcgccgacctgaagttcaagggccccagattcgccctgcccaagttcggcgtgagaggcagagacaccgaggccgccgagctggtgcccggcgtggccgagctggagggcaagggctggggctgggacggcagagtgaagatgcccaagctgaagatgcccagcttcggcctggccagaggcaaggaggccgaggtgcagggcgacagagccagccccggcgagaaggccgagagcaccgccgtgcagctgaagatccccgaggtggagctggtgaccctgggcgcccaggaggagggcagagccgagggcgccgtggccgtgagcggcatgcagctgagcggcctgaaggtgagcaccgccggccaggtggtgaccgagggccacgacgccggcctgagaatgccccccctgggcatcagcctgccccaggtggagctgaccggcttcggcgaggccggcacccccggccagcaggcccagagcaccgtgcccagcgccgagggcaccgccggctacagagtgcaggtgccccaggtgaccctgagcctgcccggcgcccaggtggccggcggcgagctgctggtgggcgagggcgtgttcaagatgcccaccgtgaccgtgccccagctggagctggacgtgggcctgagcagagaggcccaggccggcgaggccgccaccggcgagggcggcctgagactgaagctgcccaccctgggcgccagagccagagtgggcggcgagggcgccgaggagcagccccccggcgccgagagaaccttctgcctgagcctgcccgacgtggagctgagccccagcggcggcaaccacgccgagtaccaggtggccgagggcgagggcgaggccggccacaagctgaaggtgagactgcccagattcggcctggtgagagccaaggagggcgccgaggagggcgagaaggccaagagccccaagctgagactgcccagagtgggcttcagccagagcgagatggtgaccggcgagggcagccccagccccgaggaggaggaggaggaggaggaggagggcagcggcgagggcgccagcggcagaagaggcagagtgagagtgagactgcccagagtgggcctggccgcccccagcaaggccagcagaggccaggagggcgacgccgcccccaagagccccgtgagagagaagagccccaagttcagattccccagagtgagcctgagccccaaggccagaagcggcagcggcgaccaggaggagggcggcctgagagtgagactgcccagcgtgggcttcagcgagaccggcgcccccggccccgccagaatggagggcgcccaggccgccgccgtgtag

SEQ ID NO: 92737 - DNA, 4191 bp, Artificial Sequence
  Description of Artificial Sequence: Synthetic coding sequence
atggaggccagaagcagaagcgccgaggagctgagaagagccgagctggtggagatcatcgtggagaccgaggcccagaccggcgtgagcggcatcaacgtggccggcggcggcaaggagggcatcttcgtgagagagctgagagaggacagccccgccgccagaagcctgagcctgcaggagggcgaccagctgctgagcgccagagtgttcttcgagaacttcaagtacgaggacgccctgagactgctgcagtgcgccgagccctacaaggtgagcttctgcctgaagagaaccgtgcccaccggcgacctggccctgagacccggcaccgtgagcggctacgagatcaagggccccagagccaaggtggccaagctgaacatccagagcctgagccccgtgaagaagaagaagatggtgcccggcgccctgggcgtgcccgccgacctggcccccgtggacgtggagttcagcttccccaagttcagcagactgagaagaggcctgaaggccgaggccgtgaagggccccgtgcccgccgcccccgccagaagaagactgcagctgcccagactgagagtgagagaggtggccgaggaggcccaggccgccagactggccgccgccgcccccccccccagaaaggccaaggtggaggccgaggtggccgccggcgccagattcaccgccccccaggtggagctggtgggccccagactgcccggcgccgaggtgggcgtgccccaggtgagcgcccccaaggccgcccccagcgccgaggccgccggcggcttcgccctgcacctgcccaccctgggcctgggcgcccccgccccccccgccgtggaggcccccgccgtgggcatccaggtgccccaggtggagctgcccgccctgcccagcctgcccaccctgcccaccctgccctgcctggagaccagagagggcgccgtgagcgtggtggtgcccaccctggacgtggccgcccccaccgtgggcgtggacctggccctgcccggcgccgaggtggaggccagaggcgaggcccccgaggtggccctgaagatgcccagactgagcttccccagattcggcgccagagccaaggaggtggccgaggccaaggtggccaaggtgagccccgaggccagagtgaagggccccagactgagaatgcccaccttcggcctgagcctgctggagcccagacccgccgcccccgaggtggtggagagcaagctgaagctgcccaccatcaagatgcccagcctgggcatcggcgtgagcggccccgaggtgaaggtgcccaagggccccgaggtgaagctgcccaaggcccccgaggtgaagctgcccaaggtgcccgaggccgccctgcccgaggtgagactgcccgaggtggagctgcccaaggtgagcgagatgaagctgcccaaggtgcccgagatggccgtgcccgaggtgagactgcccgaggtggagctgcccaaggtgagcgagatgaagctgcccaaggtgcccgagatggccgtgcccgaggtgagactgcccgaggtgcagctgctgaaggtgagcgagatgaagctgcccaaggtgcccgagatggccgtgcccgaggtgagactgcccgaggtgcagctgcccaaggtgagcgagatgaagctgcccgaggtgagcgaggtggccgtgcccgaggtgagactgcccgaggtgcagctgcccaaggtgcccgagatgaaggtgcccgagatgaagctgcccaaggtgcccgagatgaagctgcccgagatgaagctgcccgaggtgcagctgcccaaggtgcccgagatggccgtgcccgacgtgcacctgcccgaggtgcagctgcccaaggtgcccgagatgaagctgcccgagatgaagctgcccgaggtgaagctgcccaaggtgcccgagatggccgtgcccgacgtgcacctgcccgaggtgcagctgcccaaggtgcccgagatgaagctgcccaagatgcccgagatggccgtgcccgaggtgagactgcccgaggtgcagctgcccaaggtgagcgagatgaagctgcccaaggtgcccgagatggccgtgcccgacgtgcacctgcccgaggtgcagctgcccaaggtgtgcgagatgaaggtgcccgacatgaagctgcccgagatcaagctgcccaaggtgcccgagatggccgtgcccgacgtgcacctgcccgaggtgcagctgcccaaggtgagcgagatcagactgcccgagatgcaggtgcccaaggtgcccgacgtgcacctgcccaaggcccccgaggtgaagctgcccagagcccccgaggtgcagctgaaggccaccaaggccgagcaggccgagggcatggagttcggcttcaagatgcccaagatgaccatgcccaagctgggcagagccgagagccccagcagaggcaagcccggcgaggccggcgccgaggtgagcggcaagctggtgaccctgccctgcctgcagcccgaggtggacggcgaggcccacgtgggcgtgcccagcctgaccctgcccagcgtggagctggacctgcccggcgccctgggcctgcagggccaggtgcccgccgccaagatgggcaagggcgagagagtggagggccccgaggtggccgccggcgtgagagaggtgggcttcagagtgcccagcgtggagatcgtgaccccccagctgcccgccgtggagatcgaggagggcagactggagatgatcgagaccaaggtgaagcccagcagcaagttcagcctgcccaagttcggcctgagcggccccaaggtggccaaggccgaggccgagggcgccggcagagccaccaagctgaaggtgagcaagttcgccatcagcctgcccaaggccagagtgggcgccgaggccgaggccaagggcgccggcgaggccggcctgctgcccgccctggacctgagcatcccccagctgagcctggacgcccacctgcccagcggcaaggtggaggtggccggcgccgacctgaagttcaagggccccagattcgccctgcccaagttcggcgtgagaggcagagacaccgaggccgccgagctggtgcccggcgtggccgagctggagggcaagggctggggctgggacggcagagtgaagatgcccaagctgaaggtgagcaccgccggccaggtggtgaccgagggccacgacgccggcctgagaatgccccccctgggcatcagcctgccccaggtggagctgaccggcttcggcgaggccggcacccccggccagcaggcccagagcaccgtgcccagcgccgagggcaccgccggctacagagtgcaggtgccccaggtgaccctgagcctgcccggcgcccaggtggccggcggcgagctgctggtgggcgagggcgtgttcaagatgcccaccgtgaccgtgccccagctggagctggacgtgggcctgagcagagaggcccaggccggcgaggccgccaccggcgagggcggcctgagactgaagctgcccaccctgggcgccagagccagagtgggcggcgagggcgccgaggagcagccccccggcgccgagagaaccttctgcctgagcctgcccgacgtggagctgagccccagcggcggcaaccacgccgagtaccaggtggccgagggcgagggcgaggccggccacaagctgaaggtgagactgcccagattcggcctggtgagagccaaggagggcgccgaggagggcgagaaggccaagagccccaagctgagactgcccagagtgggcttcagccagagcgagatggtgaccggcgagggcagccccagccccgaggaggaggaggaggaggaggaggagggcagcggcgagggcgccagcggcagaagaggcagagtgagagtgagactgcccagagtgggcctggccgcccccagcaaggccagcagaggccaggagggcgacgccgcccccaagagccccgtgagagagaagagccccaagttcagattccccagagtgagcctgagccccaaggccagaagcggcagcggcgaccaggaggagggcggcctgagagtgagactgcccagcgtgggcttcagcgagaccggcgcccccggccccgccagaatggagggcgcccaggccgccgccgtgtag

SEQ ID NO: 92738 - DNA, 2214 bp, Artificial Sequence
  Description of Artificial Sequence: Synthetic coding sequence
atggaggtggagcaggagcagagaagaagaaaggtggaggccggcagaaccaagctggcccacttcagacagagaaagaccaagggcgacagcagccacagcgagaagaagaccgccaagagaaagggcagcgccgtggacgccagcgtgcaggaggagagccccgtgaccaaggaggacagcgccctgtgcggcggcggcgacatctgcaagagcaccagctgcgacgacacccccgacggcgccggcggcgccttcgccgcccagcccgaggactgcgacggcgagaagagagaggacctggagcagctgcagcagaagcaggtgaacgaccacccccccgagcagtgcggcatgttcaccgtgagcgaccacccccccgagcagcacggcatgttcaccgtgggcgaccacccccccgagcagagaggcatgttcaccgtgagcgaccacccccccgagcagagaggcatgttcaccatcagcgaccaccagcccgagcagagaggcatgttcaccgtgagcgaccacacccccgagcagagaggcatcttcaccatcagcgaccaccccgccgagcagagaggcatgttcaccaaggagtgcgagcaggagtgcgagctggccatcaccgacctggagagcggcagagaggacgaggccggcctgcaccagagccaggccgtgcacggcctggagctggaggccctgagactgagcctgagcaacatgcacaccgcccagctggagctgacccaggccaacctgcagaaggagaaggagaccgccctgaccgagctgagagagatgctgaacagcagaagagcccaggagctggccctgctgcagagcagacagcagcacgagctggagctgctgagagagcagcacgccagagagaaggaggaggtggtgctgagatgcggccaggaggccgccgagctgaaggagaagctgcagagcgagatggagaagaacgcccagatcgtgaagaccctgaaggaggactgggagagcgagaaggacctgtgcctggagaacctgagaaaggagctgagcgccaagcaccagagcgagatggaggacctgcagaaccagttccagaaggagctggccgagcagagagccgagctggagaagatcttccaggacaagaaccaggccgagagagccctgagaaacctggagagccaccaccaggccgccatcgagaagctgagagaggacctgcagagcgagcacggcagatgcctggaggacctggagttcaagttcaaggagagcgagaaggagaagcagctggagctggagaacctgcaggccagctacgaggacctgaaggcccagagccaggaggagatcagaagactgtggagccagctggacagcgccagaaccagcagacaggagctgagcgagctgcacgagcagctgctggccagaaccagcagagtggaggacctggagcagctgaagcagagagagaagacccagcacgagagcgagctggagcagctgagaatctacttcgagaagaagctgagagacgccgagaagacctaccaggaggacctgaccctgctgcagcagagactgcagggcgccagagaggacgccctgctggacagcgtggaggtgggcctgagctgcgtgggcctggaggagaagcccgagaagggcagaaaggaccacgtggacgagctggagcccgagagacacaaggagagcctgcccagattccaggccgagctggaggagagccacagacaccagctggaggccctggagagccccctgtgcatccagcacgagggccacgtgagcgacagatgctgcgtggagaccagcgccctgggccacgagtggagactggagcccagcgagggccacagccaggagctgccctgggtgcacctgcagggcgtgcaggacggcgacctggaggccgacaccgagagagccgccagagtgctgggcctggagaccgagcacaaggtgcagctgagcctgctgcagaccgagctgaaggaggagatcgagctgctgaagatcgagaacagaaacctgtacggcaagctgcagcacgagaccagactgaaggacgacctggagaaggtgaagcacaacctgatcgaggaccaccagaaggagctgaacaacgccaagcagaagaccgagctgatgaagcaggagttccagagaaaggagacctag

SEQ ID NO: 92739 - DNA, 10011 bp, Artificial Sequence
  Description of Artificial Sequence: Synthetic coding sequence
atggaggtggagcaggagcagagaagaagaaaggtggaggccggcagaaccaagctggcccacttcagacagagaaagaccaagggcgacagcagccacagcgagaagaagaccgccaagagaaagggcagcgccgtggacgccagcgtgcaggaggagagccccgtgaccaaggaggacagcgccctgtgcggcggcggcgacatctgcaagagcaccagctgcgacgacacccccgacggcgccggcggcgccttcgccgcccagcccgaggactgcgacggcgagaagagagaggacctggagcagctgcagcagaagcaggtgaacgaccacccccccgagcagtgcggcatgttcaccgtgagcgaccacccccccgagcagcacggcatgttcaccgtgggcgaccacccccccgagcagagaggcatgttcaccgtgagcgaccacccccccgagcagcacggcatgttcaccgtgagcgaccacccccccgagcagagaggcatgttcaccatcagcgaccaccagcccgagcagagaggcatgttcaccgtgagcgaccacacccccgagcagagaggcatcttcaccatcagcgaccaccccgccgagcagagaggcatgttcaccaaggagtgcgagcaggagtgcgagctggccatcaccgacctggagagcggcagagaggacgaggccggcctgcaccagagccaggccgtgcacggcctggagctggaggccctgagactgagcctgagcaacatgcacaccgcccagctggagctgacccaggccaacctgcagaaggagaaggagaccgccctgaccgagctgagagagatgctgaacagcagaagagcccaggagctggccctgctgcagagcagacagcagcacgagctggagctgctgagagagcagcacgccagagagaaggaggaggtggtgctgagatgcggccaggaggccgccgagctgaaggagaagctgcagagcgagatggagaagaacgcccagatcgtgaagaccctgaaggaggactgggagagcgagaaggacctgtgcctggagaacctgagaaaggagctgagcgccaagcaccagagcgagatggaggacctgcagaaccagttccagaaggagctggccgagcagagagccgagctggagaagatcttccaggacaagaaccaggccgagagagccctgagaaacctggagagccaccaccaggccgccatcgagaagctgagagaggacctgcagagcgagcacggcagatgcctggaggacctggagttcaagttcaaggagagcgagaaggagaagcagctggagctggagaacctgcaggccagctacgaggacctgaaggcccagagccaggaggagatcagaagactgtggagccagctggacagcgccagaaccagcagacaggagctgagcgagctgcacgagcagctgctggccagaaccagcagagtggaggacctggagcagctgaagcagagagagaagacccagcacgagagcgagctggagcagctgagaatctacttcgagaagaagctgagagacgccgagaagacctaccaggaggacctgaccctgctgcagcagagactgcagggcgccagagaggacgccctgctggacagcgtggaggtgggcctgagctgcgtgggcctggaggagaagcccgagaagggcagaaaggaccacgtggacgagctggagcccgagagacacaaggagagcctgcccagattccaggccgagctggaggagagccacagacaccagctggaggccctggagagccccctgtgcatccagcacgagggccacgtgagcgacagatgctgcgtggagaccagcgccctgggccacgagtggagactggagcccagcgagggccacagccaggagctgccctgggtgcacctgcagggcgtgcaggacggcgacctggaggccgacaccgagagagccgccagagtgctgggcctggagaccgagcacaaggtgcagctgagcctgctgcagaccgagctgaaggaggagatcgagctgctgaagatcgagaacagaaacctgtacggcaagctgcagcacgagaccagactgaaggacgacctggagaaggtgaagcacaacctgatcgaggaccaccagaaggagctgaacaacgccaagcagaagaccgagctgatgaagcaggagttccagagaaaggagaccgactggaaggtgatgaaggaggagctgcagagagaggccgaggagaagctgaccctgatgctgctggagctgagagagaaggccgagagcgagaagcagaccatcatcaacaagttcgagctgagagaggccgagatgagacagctgcaggaccagcaggccgcccagatcctggacctggagagaagcctgaccgagcagcagggcagactgcagcagctggagcaggacctgaccagcgacgacgccctgcactgcagccagtgcggcagagagccccccaccgcccaggacggcgagctggccgccctgcacgtgaaggaggactgcgccctgcagctgatgctggccagaagcagattcctggaggagagaaaggagatcaccgagaagttcagcgccgagcaggacgccttcctgcaggaggcccaggagcagcacgccagagagctgcagctgctgcaggagagacaccagcagcagctgctgagcgtgaccgccgagctggaggccagacaccaggccgccctgggcgagctgaccgccagcctggagagcaagcagggcgccctgctggccgccagagtggccgagctgcagaccaagcacgccgccgacctgggcgccctggagaccagacacctgagcagcctggacagcctggagagctgctacctgagcgagttccagaccatcagagaggagcacagacaggccctggagctgctgagagccgacttcgaggagcagctgtggaagaaggacagcctgcaccagaccatcctgacccaggagctggagaagctgaagagaaagcacgagggcgagctgcagagcgtgagagaccacctgagaaccgaggtgagcaccgagctggccggcaccgtggcccacgagctgcagggcgtgcaccagggcgagttcggcagcgagaagaagaccgccctgcacgagaaggaggagaccctgagactgcagagcgcccaggcccagcccttccaccaggaggagaaggagagcctgagcctgcagctgcagaagaagaaccaccaggtgcagcagctgaaggaccaggtgctgagcctgagccacgagatcgaggagtgcagaagcgagctggaggtgctgcagcagagaagagagagagagaacagagagggcgccaacctgctgagcatgctgaaggccgacgtgaacctgagccacagcgagagaggcgccctgcaggacgccctgagaagactgctgggcctgttcggcgagaccctgagagccgccgtgaccctgagaagcagaatcggcgagagagtgggcctgtgcctggacgacgccggcgccggcctggccctgagcaccgcccccgccctggaggagacctggagcgacgtggccctgcccgagctggacagaaccctgagcgagtgcgccgagatgagcagcgtggccgagatcagcagccacatgagagagagcttcctgatgagccccgagagcgtgagagagtgcgagcagcccatcagaagagtgttccagagcctgagcctggccgtggacggcctgatggagatggccctggacagcagcagacagctggaggaggccagacagatccacagcagattcgagaaggagttcagcttcaagaacgaggagaccgcccaggtggtgagaaagcaccaggagctgctggagtgcctgaaggaggagagcgccgccaaggccgagctggccctggagctgcacaagacccagggcaccctggagggcttcaaggtggagaccgccgacctgaaggaggtgctggccggcaaggaggacagcgagcacagactggtgctggagctggagagcctgagaagacagctgcagcaggccgcccaggagcaggccgccctgagagaggagtgcaccagactgtggagcagaggcgaggccaccgccaccgacgccgaggccagagaggccgccctgagaaaggaggtggaggacctgaccaaggagcagagcgagaccagaaagcaggccgagaaggacagaagcgccctgctgagccagatgaagatcctggagagcgagctggaggagcagctgagccagcacagaggctgcgccaagcaggccgaggccgtgaccgccctggagcagcaggtggccagcctggacaagcacctgagaaaccagagacagttcatggacgagcaggccgccgagagagagcacgagagagaggagttccagcaggagatccagagactggagggccagctgagacaggccgccaagccccagccctggggccccagagacagccagcaggcccccctggacggcgaggtggagctgctgcagcagaagctgagagagaagctggacgagttcaacgagctggccatccagaaggagagcgccgacagacaggtgctgatgcaggaggaggagatcaagagactggaggagatgaacatcaacatcagaaagaaggtggcccagctgcaggaggaggtggagaagcagaagaacatcgtgaagggcctggagcaggacaaggaggtgctgaagaagcagcagatgagcagcctgctgctggccagcaccctgcagagcaccctggacgccggcagatgccccgagccccccagcggcagcccccccgagggccccgagatccagctggaggtgacccagagagccctgctgagaagagagagcgaggtgctggacctgaaggagcagctggagaagatgaagggcgacctggagagcaagaacgaggagatcctgcacctgaacctgaagctggacatgcagaacagccagaccgccgtgagcctgagagagctggaggaggagaacaccagcctgaaggtgatctacaccagaagcagcgagatcgaggagctgaaggccaccatcgagaacctgcaggagaaccagaagagactgcagaaggagaaggccgaggagatcgagcagctgcacgaggtgatcgagaagctgcagcacgagctgagcctgatgggccccgtggtgcacgaggtgagcgacagccaggccggcagcctgcagagcgagctgctgtgcagccaggccggcggccccagaggccaggccctgcagggcgagctggaggccgccctggaggccaaggaggccctgagcagactgctggccgaccaggagagaagacacagccaggccctggaggccctgcagcagagactgcagggcgccgaggaggccgccgagctgcagctggccgagctggagagaaacgtggccctgagagaggccgaggtggaggacatggccagcagaatccaggagttcgaggccgccctgaaggccaaggaggccaccatcgccgagagaaacctggagatcgacgccctgaaccagagaaaggccgcccacagcgccgagctggaggccgtgctgctggccctggccagaatcagaagagccctggagcagcagcccctggccgccggcgccgccccccccgagctgcagtggctgagagcccagtgcgccagactgagcagacagctgcaggtgctgcaccagagattcctgagatgccaggtggagctggacagaagacaggccagaagagccaccgcccacaccagagtgcccggcgcccacccccagcccagaatggacggcggcgccaaggcccaggtgaccggcgacgtggaggccagccacgacgccgccctggagcccgtggtgcccgacccccagggcgacctgcagcccgtgctggtgaccctgaaggacgcccccctgtgcaagcaggagggcgtgatgagcgtgctgaccgtgtgccagagacagctgcagagcgagctgctgctggtgaagaacgagatgagactgagcctggaggacggcggcaagggcaaggagaaggtgctggaggactgccagctgcccaaggtggacctggtggcccaggtgaagcagctgcaggagaagctgaacagactgctgtacagcatgaccttccagaacgtggacgccgccgacaccaagagcctgtggcccatggccagcgcccacctgctggagagcagctggagcgacgacagctgcgacggcgaggagcccgacatcagcccccacatcgacacctgcgacgccaacaccgccaccggcggcgtgaccgacgtgatcaagaaccaggccatcgacgcctgcgacgccaacaccacccccggcggcgtgaccgacgtgatcaagaactgggacagcctgatccccgacgagatgcccgacagccccatccaggagaagagcgagtgccaggacatgagcctgagcagccccaccagcgtgctgggcggcagcagacaccagagccacaccgccgaggccggccccagaaagagccccgtgggcatgctggacctgagcagctggagcagccccgaggtgctgagaaaggactggaccctggagccctggcccagcctgcccgtgaccccccacagcggcgccctgagcctgtgcagcgccgacaccagcctgggcgacagagccgacaccagcctgccccagacccagggccccggcctgctgtgcagccccggcgtgagcgccgccgccctggccctgcagtgggccgagagcccccccgccgacgaccaccacgtgcagagaaccgccgtggagaaggacgtggaggacttcatcaccaccagcttcgacagccaggagaccctgagcagccccccccccggcctggagggcaaggccgacagaagcgagaagagcgacggcagcggcttcggcgccagactgagccccggcagcggcggccccgaggcccagaccgccggccccgtgacccccgccagcatcagcggcagattccagcccctgcccgaggccatgaaggagaaggaggtgagacccaagcacgtgaaggccctgctgcagatggtgagagacgagagccaccagatcctggccctgagcgagggcctggccccccccagcggcgagccccacccccccagaaaggaggacgagatccaggacatcagcctgcacggcggcaagacccaggaggtgcccaccgcctgccccgactggagaggcgacctgctgcaggtggtgcaggaggccttcgagaaggagcaggagatgcagggcgtggagctgcagcccagactgagcggcagcgacctgggcggccacagcagcctgctggagagactggagaagatcatcagagagcagggcgacctgcaggagaagagcctggagcacctgagactgcccgacagaagcagcctgctgagcgagatccaggccctgagagcccagctgagaatgacccacctgcagaaccaggagaagctgcagcacctgagaaccgccctgaccagcgccgaggccagaggcagccagcaggagcaccagctgagaagacaggtggagctgctggcctacaaggtggagcaggagaagtgcatcgccggcgacctgcagaagaccctgagcgaggagcaggagaaggccaacagcgtgcagaagctgctggccgccgagcagaccgtggtgagagacctgaagagcgacctgtgcgagagcagacagaagagcgagcagctgagcagaagcctgtgcgaggtgcagcaggaggtgctgcagctgagaagcatgctgagcagcaaggagaacgagctgaaggccgccctgcaggagctggagagcgagcagggcaagggcagagccctgcagagccagctggaggaggagcagctgagacacctgcagagagagagccagagcgccaaggccctggaggagctgagagccagcctggagacccagagagcccagagcagcagactgtgcgtggccctgaagcacgagcagaccgccaaggacaacctgcagaaggagctgagaatcgagcacagcagatgcgaggccctgctggcccaggagagaagccagctgagcgagctgcagaaggacctggccgccgagaagagcagaaccctggagctgagcgaggccctgagacacgagagactgctgaccgagcagctgagccagagaacccaggaggcctgcgtgcaccaggacacccaggcccaccacgccctgctgcagaagctgaaggaggagaagagcagagtggtggacctgcaggccatgctggagaaggtgcagcagcaggccctgcacagccagcagcagctggaggccgaggcccagaagcactgcgaggccctgagaagagagaaggaggtgagcgccaccctgaagagcaccgtggaggccctgcacacccagaagagagagctgagatgcagcctggagagagagagagagaagcccgcctggctgcaggccgagctggagcagagccaccccagactgaaggagcaggagggcagaaaggccgccagaagaagcgccgaggccagacagagccccgccgccgccgagcagtggagaaagtggcagagagacaaggagaagctgagagagctggagctgcagagacagagagacctgcacaagatcaagcagctgcagcagaccgtgagagacctggagagcaaggacgaggtgcccggcagcagactgcacctgggcagcgccagaagagccgccggcagcgacgccgaccacctgagagagcagcagagagagctggaggccatgagacagagactgctgagcgccgccagactgctgaccagcttcaccagccaggccgtggacagaaccgtgaacgactggaccagcagcaacgagaaggccgtgatgagcctgctgcacaccctggaggagctgaagagcgacctgagcagacccaccagcagccagaagaagatggccgccgagctgcagttccagttcgtggacgtgctgctgaaggacaacgtgagcctgaccaaggccctgagcaccgtgacccaggagaagctggagctgagcagagccgtgagcaagctggagaagctgctgaagcaccacctgcagaagggctgcagccccagcagaagcgagagaagcgcctggaagcccgacgagaccgccccccagagcagcctgagaagacccgaccccggcagactgccccccgccgccagcgaggaggcccacaccagcaacgtgaagatggagaagctgtacctgcactacctgagagccgagagcttcagaaaggccctgatctaccagaagaagtacctgctgctgctgatcggcggcttccaggacagcgagcaggagaccctgagcatgatcgcccacctgggcgtgttccccagcaaggccgagagaaagatcaccagcagacccttcaccagattcagaaccgccgtgagagtggtgatcgccatcctgagactgagattcctggtgaagaagtggcaggaggtggacagaaagggcgccctggcccagggcaaggcccccagacccggccccagagccagacagccccagagcccccccagaaccagagagagcccccccaccagagacgtgcccagcggccacaccagagaccccgccagaggcagaagactggccgccgccgccagcccccacagcggcggcagagccacccccagccccaacagcagactggagagaagcctgaccgccagccaggaccccgagcacagcctgaccgagtacatccaccacctggaggtgatccagcagagactgggcggcgtgctgcccgacagcaccagcaagaagagctgccaccccatgatcaagcagtag

SEQ ID NO: 92740 - DNA, 6075 bp, Artificial Sequence
  Description of Artificial Sequence: Synthetic coding sequence
atggccaccggcggcggccccttcgaggacggcatgaacgaccaggacctgcccaactggagcaacgagaacgtggacgacagactgaacaacatggactggggcgcccagcagaagaaggccaacagaagcagcgagaagaacaagaagaagttcggcgtggagagcgacaagagagtgaccaacgacatcagccccgagagcagccccggcgtgggcagaagaagaaccaagaccccccacaccttcccccacagcagatacatgagccagatgagcgtgcccgagcaggccgagctggagaagctgaagcagagaatcaacttcagcgacctggaccagagaagcatcggcagcgacagccagggcagagccaccgccgccaacaacaagagacagctgagcgagaacagaaagcccttcaacttcctgcccatgcagatcaacaccaacaagagcaaggacgccagcaccaacccccccaacagagagaccatcggcagcgcccagtgcaaggagctgttcgccagcgccctgagcaacgacctgctgcagaactgccaggtgagcgaggaggacggcagaggcgagcccgccatggagagcagccagatcgtgagcagactggtgcagatcagagactacatcaccaaggccagcagcatgagagaggacctggtggagaagaacgagagaagcgccaacgtggagagactgacccacctgatcgaccacctgaaggagcaggagaagagctacatgaagttcctgaagaagatcctggccagagacccccagcaggagcccatggaggagatcgagaacctgaagaagcagcacgacctgctgaagagaatgctgcagcagcaggagcagctgagagccctgcagggcagacaggccgccctgctggccctgcagcacaaggccgagcaggccatcgccgtgatggacgacagcgtggtggccgagaccgccggcagcctgagcggcgtgagcatcaccagcgagctgaacgaggagctgaacgacctgatccagagattccacaaccagctgagagacagccagccccccgccgtgcccgacaacagaagacaggccgagagcctgagcctgaccagagaggtgagccagagcagaaagcccagcgccagcgagagactgcccgacgagaaggtggagctgttcagcaagatgagagtgctgcaggagaagaagcagaagatggacaagctgctgggcgagctgcacaccctgagagaccagcacctgaacaacagcagcagcagcccccagagaagcgtggaccagagaagcaccagcgcccccagcgccagcgtgggcctggcccccgtggtgaacggcgagagcaacagcctgaccagcagcgtgccctaccccaccgccagcctggtgagccagaacgagagcgagaacgagggccacctgaaccccagcgagaagctgcagaagctgaacgaggtgagaaagagactgaacgagctgagagagctggtgcactactacgagcagaccagcgacatgatgaccgacgccgtgaacgagaacagaaaggacgaggagaccgaggagagcgagtacgacagcgagcacgagaacagcgagcccgtgaccaacatcagaaacccccaggtggccagcacctggaacgaggtgaacagccacagcaacgcccagtgcgtgagcaacaacagagacggcagaaccgtgaacagcaactgcgagatcaacaacagaagcgccgccaacatcagagccctgaacatgccccccagcctggactgcagatacaacagagagggcgagcaggagatccacgtggcccagggcgaggacgacgaggaggaggaggaggaggccgaggaggagggcgtgagcggcgccagcctgagcagccacagaagcagcctggtggacgagcaccccgaggacgccgagttcgagcagaagatcaacagactgatggccgccaagcagaagctgagacagctgcaggacctggtggccatggtgcaggacgacgacgccgcccagggcgtgatcagcgccagcgccagcaacctggacgacttctaccccgccgaggaggacaccaagcagaacagcaacaacaccagaggcaacgccaacaagacccagaaggacaccggcgtgaacgagaaggccagagagaagttctacgaggccaagctgcagcagcagcagagagagctgaagcagctgcaggaggagagaaagaagctgatcgacatccaggagaagatccaggccctgcagaccgcctgccccgacctgcagctgagcgccgccagcgtgggcaactgccccaccaagaagtacatgcccgccgtgaccagcacccccaccgtgaaccagcacgagaccagcaccagcaagagcgtgttcgagcccgaggacagcagcatcgtggacaacgagctgtggagcgagatgagaagacacgagatgctgagagaggagctgagacagagaagaaagcagctggaggccctgatggccgagcaccagagaagacagggcctggccgagaccgccagccccgtggccgtgagcctgagaagcgacggcagcgagaacctgtgcaccccccagcagagcagaaccgagaagaccatggccacctggggcggcagcacccagtgcgccctggacgaggagggcgacgaggacggctacctgagcgagggcatcgtgagaaccgacgaggaggaggaggaggagcaggacgccagcagcaacgacaacttcagcgtgtgccccagcaacagcgtgaaccacaacagctacaacggcaaggagaccaagaacagatggaagaacaactgccccttcagcgccgacgagaactacagacccctggccaagaccagacagcagaacatcagcatgcagagacaggagaacctgagatgggtgagcgagctgagctacgtggaggagaaggagcagtggcaggagcagatcaaccagctgaagaagcagctggacttcagcgtgagcatctgccagaccctgatgcaggaccagcagaccctgagctgcctgctgcagaccctgctgaccggcccctacagcgtgatgcccagcaacgtggccagcccccaggtgcacttcatcatgcaccagctgaaccagtgctacacccagctgacctggcagcagaacaacgtgcagagactgaagcagatgctgaacgagctgatgagacagcagaaccagcaccccgagaagcccggcggcaaggagagaggcagcagcgccagccacccccccagccccagcctgttctgccccttcagcttccccacccagcccgtgaacctgttcaacatccccggcttcaccaacttcagcagcttcgcccccggcatgaacttcagccccctgttccccagcaacttcggcgacttcagccagaacatcagcacccccagcgagcagcagcagcccctggcccagaacagcagcggcaagaccgagtacatggccttccccaagcccttcgagagcagcagcagcatcggcgccgagaagcccagaaacaagaagctgcccgaggaggaggtggagagcagcagaaccccctggctgtacgagcaggagggcgaggtggagaagcccttcatcaagaccggcttcagcgtgagcgtggagaagagcaccagcagcaacagaaagaaccagctggacaccaacggcagaagaagacagttcgacgaggagagcctggagagcttcagcagcatgcccgaccccgtggaccccaccaccgtgaccaagaccttcaagaccagaaaggccagcgcccaggccagcctggccagcaaggacaagacccccaagagcaagagcaagaagagaaacagcacccagctgaagagcagagtgaagaacatcagatacgagagcgccagcatgagcagcacctgcgagccctgcaagagcagaaacagacacagcgcccagaccgaggagcccgtgcaggccaaggtgttcagcagaaagaaccacgagcagctggagaagatcatcaagtgcaacagaagcaccgagatcagcagcgagaccggcagcgacttcagcatgttcgaggccctgagagacaccatctacagcgaggtggccaccctgatcagccagaacgagagcagaccccacttcctgatcgagctgttccacgagctgcagctgctgaacaccgactacctgagacagagagccctgtacgccctgcaggacatcgtgagcagacacatcagcgagagccacgagaagggcgagaacgtgaagagcgtgaacagcggcacctggatcgccagcaacagcgagctgacccccagcgagagcctggccaccaccgacgacgagaccttcgagaagaacttcgagagagagacccacaagatcagcgagcagaacgacgccgacaacgccagcgtgctgagcgtgagcagcaacttcgagcccttcgccaccgacgacctgggcaacaccgtgatccacctggaccaggccctggccagaatgagagagtacgagagaatgaagaccgaggccgagagcaacagcaacatgagatgcacctgcagaatcatcgaggacggcgacggcgccggcgccggcaccaccgtgaacaacctggaggagacccccgtgatcgagaacagaagcagccagcagcccgtgagcgaggtgagcaccatcccctgccccagaatcgacacccagcagctggacagacagatcaaggccatcatgaaggaggtgatccccttcctgaaggagcacatggacgaggtgtgcagcagccagctgctgaccagcgtgagaagaatggtgctgaccctgacccagcagaacgacgagagcaaggagttcgtgaagttcttccacaagcagctgggcagcatcctgcaggacagcctggccaagttcgccggcagaaagctgaaggactgcggcgaggacctgctggtggagatcagcgaggtgctgttcaacgagctggccttcttcaagctgatgcaggacctggacaacaacagcatcaccgtgaagcagagatgcaagagaaagatcgaggccaccggcgtgatccagagctgcgccaaggaggccaagagaatcctggaggaccacggcagccccgccggcgagatcgacgacgaggacaaggacaaggacgagaccgagaccgtgaagcagacccagaccagcgaggtgtacgacggccccaagaacgtgagaagcgacatcagcgaccaggaggaggacgaggagagcgagggctgccccgtgagcatcaacctgagcaaggccgagacccaggccctgaccaactacggcagcggcgaggacgagaacgaggacgaggagatggaggagttcgaggagggccccgtggacgtgcagaccagcctgcaggccaacaccgaggccaccgaggagaacgagcacgacgagcaggtgctgcagagagacttcaagaagaccgccgagagcaagaacgtgcccctggagagagaggccaccagcaagaacgaccagaacaactgccccgtgaagccctgctacctgaacatcctggaggacgagcagcccctgaacagcgccgcccacaaggagagcccccccaccgtggacagcacccagcagcccaaccccctgcccctgagactgcccgagatggagcccctggtgcccagagtgaaggaggtgaagagcgcccaggagacccccgagagcagcctggccggcagccccgacaccgagagccccgtgctggtgaacgactacgaggccgagagcggcaacatcagccagaagagcgacgaggaggacttcgtgaaggtggaggacctgcccctgaagctgaccatctacagcgaggccgacctgagaaagaagatggtggaggaggagcagaagaaccacctgagcggcgagatctgcgagatgcagaccgaggagctggccggcaacagcgagaccctgaaggagcccgagaccgtgggcgcccagagcatctag

SEQ ID NO: 92741 - DNA, 1590 bp, Artificial Sequence
  Description of Artificial Sequence: Synthetic coding sequence
atggccaccggcggcggccccttcgaggacggcatgaacgaccaggacctgcccaactggagcaacgagaacgtggacgacagactgaacaacatggactggggcgcccagcagaagaaggccaacagaagcagcgagaagaacaagaagaagttcggcgtggagagcgacaagagagtgaccaacgacatcagccccgagagcagccccggcgtgggcagaagaagaaccaagaccccccacaccttcccccacagcagatacatgagccagatgagcgtgcccgagcaggccgagctggagaagctgaagcagagaatcaacttcagcgacctggaccagagaagcatcggcagcgacagccagggcagagccaccgccgccaacaacaagagacagctgagcgagaacagaaagcccttcaacttcctgcccatgcagatcaacaccaacaagagcaaggacgccagcaccaacccccccaacagagagaccatcggcagcgcccagtgcaaggagctgttcgccagcgccctgagcaacgacctgctgcagaactgccaggtgagcgaggaggacggcagaggcgagcccgccatggagagcagccagatcgtgagcagactggtgcagatcagagactacatcaccaaggccagcagcatgagagaggacctggtggagaagaacgagagaagcgccaacgtggagagactgacccacctgatcgaccacctgaaggagcaggagaagagctacatgaagttcctgaagaagatcctggccagagagaacgaggaggaggacgtgagaaccatcgacagcgccgtgggcagcggcagcgtggccgagagcaccagcctgaacatcgacgtgcagagcgaggccagcgacaccaccgccagagacccccagcaggagcccatggaggagatcgagaacctgaagaagcagcacgacctgctgaagagaatgctgcagcagcaggagcagctgagagccctgcagggcagacaggccgccctgctggccctgcagcacaaggccgagcaggccatcgccgtgatggacgacagcgtggtggccgagaccgccggcagcctgagcggcgtgagcatcaccagcgagctgaacgaggagctgaacgacctgatccagagattccacaaccagctgagagacagccagccccccgccgtgcccgacaacagaagacaggccgagagcctgagcctgaccagagaggtgagccagagcagaaagcccagcgccagcgagagactgcccgacgagaaggtggagctgttcagcaagatgagagtgctgcaggagaagaagcagaagatggacaagctgctgggcgagctgcacaccctgagagaccagcacctgaacaacagcagcagcagcccccagagaagcgtggaccagagaagcaccagcgcccccagcgccagcgtgggcctggcccccgtggtgaacggcgagagcaacagcctgaccagcagcgtgccctaccccaccgccagcctggtgagccagaacgagagcgagaacgagggccacctgaaccccagcgagaagctgtag

SEQ ID NO: 92742 - DNA, 2172 bp, Artificial Sequence
  Description of Artificial Sequence: Synthetic coding sequence
atgagcagcacctgcgagccctgcaagagcagaaacagacacagcgcccagaccgaggagcccgtgcaggccaaggtgttcagcagaaagaaccacgagcagctggagaagatcatcaagtgcaacagaagcaccgagatcagcagcgcccacgccagaagaatcctgcagcagagcaacagaaacgcctgcaacgaggcccccgagaccggcagcgacttcagcatgttcgaggccctgagagacaccatctacagcgaggtggccaccctgatcagccagaacgagagcagaccccacttcctgatcgagctgttccacgagctgcagctgctgaacaccgactacctgagacagagagccctgtacgccctgcaggacatcgtgagcagacacatcagcgagagccacgagaagggcgagaacgtgaagagcgtgaacagcggcacctggatcgccagcaacagcgagctgacccccagcgagagcctggccaccaccgacgacgagaccttcgagaagaacttcgagagagagacccacaagatcagcgagcagaacgacgccgacaacgccagcgtgctgagcgtgagcagcaacttcgagcccttcgccaccgacgacctgggcaacaccgtgatccacctggaccaggccctggccagaatgagagagtacgagagaatgaagaccgaggccgagagcaacagcaacatgagatgcacctgcagaatcatcgaggacggcgacggcgccggcgccggcaccaccgtgaacaacctggaggagacccccgtgatcgagaacagaagcagccagcagcccgtgagcgaggtgagcaccatcccctgccccagaatcgacacccagcagctggacagacagatcaaggccatcatgaaggaggtgatccccttcctgaaggagcacatggacgaggtgtgcagcagccagctgctgaccagcgtgagaagaatggtgctgaccctgacccagcagaacgacgagagcaaggagttcgtgaagttcttccacaagcagctgggcagcatcctgcaggacagcctggccaagttcgccggcagaaagctgaaggactgcggcgaggacctgctggtggagatcagcgaggtgctgttcaacgagctggccttcttcaagctgatgcaggacctggacaacaacagcatcaccgtgaagcagagatgcaagagaaagatcgaggccaccggcgtgatccagagctgcgccaaggaggccaagagaatcctggaggaccacggcagccccgccggcgagatcgacgacgaggacaaggacaaggacgagaccgagaccgtgaagcagacccagaccagcgaggtgtacgacggccccaagaacgtgagaagcgacatcagcgaccaggaggaggacgaggagagcgagggctgccccgtgagcatcaacctgagcaaggccgagacccaggccctgaccaactacggcagcggcgaggacgagaacgaggacgaggagatggaggagttcgaggagggccccgtggacgtgcagaccagcctgcaggccaacaccgaggccaccgaggagaacgagcacgacgagcaggtgctgcagagagacttcaagaagaccgccgagagcaagaacgtgcccctggagagagaggccaccagcaagaacgaccagaacaactgccccgtgaagccctgctacctgaacatcctggaggacgagcagcccctgaacagcgccgcccacaaggagagcccccccaccgtggacagcacccagcagcccaaccccctgcccctgagactgcccgagatggagcccctggtgcccagagtgaaggaggtgaagagcgcccaggagacccccgagagcagcctggccggcagccccgacaccgagagccccgtgctggtgaacgactacgaggccgagagcggcaacatcagccagaagagcgacgaggaggacttcgtgaaggtggaggacctgcccctgaagctgaccatctacagcgaggccgacctgagaaagaagatggtggaggaggagcagaagaaccacctgagcggcgagatctgcgagatgcagaccgaggagctggccggcaacagcgagaccctgaaggagcccgagaccgtgggcgcccagagcatctag

SEQ ID NO: 92743 - DNA, 2295 bp, Artificial Sequence
  Description of Artificial Sequence: Synthetic coding sequence
tgaaaggccagcgcccaggccagcctggccagcaaggacaagacccccaagagcaagagcaagaagagaaacagcacccagctgaagagcagagtgaagaacatcagatacgagagcgccagcatgagcagcacctgcgagccctgcaagagcagaaacagacacagcgcccagaccgaggagcccgtgcaggccaaggtgttcagcagaaagaaccacgagcagctggagaagatcatcaagtgcaacagaagcaccgagatcagcagcgcccacgccagaagaatcctgcagcagagcaacagaaacgcctgcaacgaggcccccgagaccggcagcgacttcagcatgttcgaggccctgagagacaccatctacagcgaggtggccaccctgatcagccagaacgagagcagaccccacttcctgatcgagctgttccacgagctgcagctgctgaacaccgactacctgagacagagagccctgtacgccctgcaggacatcgtgagcagacacatcagcgagagccacgagaagggcgagaacgtgaagagcgtgaacagcggcacctggatcgccagcaacagcgagctgacccccagcgagagcctggccaccaccgacgacgagaccttcgagaagaacttcgagagagagacccacaagatcagcgagcagaacgacgccgacaacgccagcgtgctgagcgtgagcagcaacttcgagcccttcgccaccgacgacctgggcaacaccgtgatccacctggaccaggccctggccagaatgagagagtacgagagaatgaagaccgaggccgagagcaacagcaacatgagatgcacctgcagaatcatcgaggacggcgacggcgccggcgccggcaccaccgtgaacaacctggaggagacccccgtgatcgagaacagaagcagccagcagcccgtgagcgaggtgagcaccatcccctgccccagaatcgacacccagcagctggacagacagatcaaggccatcatgaaggaggtgatccccttcctgaaggagcacatggacgaggtgtgcagcagccagctgctgaccagcgtgagaagaatggtgctgaccctgacccagcagaacgacgagagcaaggagttcgtgaagttcttccacaagcagctgggcagcatcctgcaggacagcctggccaagttcgccggcagaaagctgaaggactgcggcgaggacctgctggtggagatcagcgaggtgctgttcaacgagctggccttcttcaagctgatgcaggacctggacaacaacagcatcaccgtgaagcagagatgcaagagaaagatcgaggccaccggcgtgatccagagctgcgccaaggaggccaagagaatcctggaggaccacggcagccccgccggcgagatcgacgacgaggacaaggacaaggacgagaccgagaccgtgaagcagacccagaccagcgaggtgtacgacggccccaagaacgtgagaagcgacatcagcgaccaggaggaggacgaggagagcgagggctgccccgtgagcatcaacctgagcaaggccgagacccaggccctgaccaactacggcagcggcgaggacgagaacgaggacgaggagatggaggagttcgaggagggccccgtggacgtgcagaccagcctgcaggccaacaccgaggccaccgaggagaacgagcacgacgagcaggtgctgcagagagacttcaagaagaccgccgagagcaagaacgtgcccctggagagagaggccaccagcaagaacgaccagaacaactgccccgtgaagccctgctacctgaacatcctggaggacgagcagcccctgaacagcgccgcccacaaggagagcccccccaccgtggacagcacccagcagcccaaccccctgcccctgagactgcccgagatggagcccctggtgcccagagtgaaggaggtgaagagcgcccaggagacccccgagagcagcctggccggcagccccgacaccgagagccccgtgctggtgaacgactacgaggccgagagcggcaacatcagccagaagagcgacgaggaggacttcgtgaaggtggaggacctgcccctgaagctgaccatctacagcgaggccgacctgagaaagaagatggtggaggaggagcagaagaaccacctgagcggcgagatctgcgagatgcagaccgaggagctggccggcaacagcgagaccctgaaggagcccgagaccgtgggcgcccagagcatctag

SEQ ID NO: 92744 - DNA, 1227 bp, Artificial Sequence
  Description of Artificial Sequence: Synthetic coding sequence
atggccaccggcggcggccccttcgaggacggcatgaacgaccaggacctgcccaactggagcaacgagaacgtggacgacagactgaacaacatggactggggcgcccagcagaagaaggccaacagaagcagcgagaagaacaagaagaagttcggcgtggagagcgacaagagagtgaccaacgacatcagccccgagagcagccccggcgtgggcagaagaagaaccaagaccccccacaccttcccccacagcagatacatgagccagatgagcgtgcccgagcaggccgagctggagaagctgaagcagagaatcaacttcagcgacctggaccagagaagcatcggcagcgacagccagggcagagccaccgccgccaacaacaagagacagctgagcgagaacagaaagcccttcaacttcctgcccatgcagatcaacaccaacaagagcaaggacgccagcaccaacccccccaacagagagaccatcggcagcgcccagtgcaaggagctgttcgccagcgccctgagcaacgacctgctgcagaactgccaggtgagcgaggaggacggcagaggcgagcccgccatggagagcagccagatcgtgagcagactggtgcagatcagagactacatcaccaaggccagcagcatgagagaggacctggtggagaagaacgagagaagcgccaacgtggagagactgacccacctgatcgaccacctgaaggagcaggagaagagctacatgaagttcctgaagaagatcctggccagagacccccagcaggagcccatggaggagatcgagaacctgaagaagcagcacgacctgctgaagagaatgctgcagcagcaggagcagctgagagccctgcagggcagacaggccgccctgctggccctgcagcacaaggccgagcaggccatcgccgtgatggacgacagcgtggtggccgagaccgccggcagcctgagcggcgtgagcatcaccagcgagctgaacgaggagctgaacgacctgatccagagattccacaaccagctgagagacagccagccccccgccgtgcccgacaacagaagacaggccgagagcctgagcctgaccagagaggtgagccagagcagaaagcccagcgccagcgagagactgcccgacgagaaggtggagctgttcagcaagatgagagtgctgcaggagaagaagcagtag

SEQ ID NO: 92745 - DNA, 1569 bp, Artificial Sequence
  Description of Artificial Sequence: Synthetic coding sequence
atggccgtgaacaagggcctgaccctgctggacggcgacctgcccgagcaggagaacgtgctgcagagagtgctgcagctgcccgtggtgagcggcacctgcgagtgcttccagaagacctacaccagcaccaaggaggcccaccccctggtggccagcgtgtgcaacgcctacgagaagggcgtgcagagcgccagcagcctggccgcctggagcatggagcccgtggtgagaagactgagcacccagttcaccgccgccaacgagctggcctgcagaggcctggaccacctggaggagaagatccccgccctgcagtacccccccgagaagatcgccagcgagctgaaggacaccatcagcaccagactgagaagcgccagaaacagcatcagcgtgcccatcgccagcaccagcgacaaggtgctgggcgccgccctggccggctgcgagctggcctggggcgtggccagagacaccgccgagttcgccgccaacaccagagccggcagactggccagcggcggcgccgacctggccctgggcagcatcgagaaggtggtggagtacctgctgccccccgacaaggaggagagcgcccccgcccccggccaccagcaggcccagaagagccccaaggccaagcccagcctgctgagcagagtgggcgccctgaccaacaccctgagcagatacaccgtgcagaccatggccagagccctggagcagggccacaccgtggccatgtggatccccggcgtggtgcccctgagcagcctggcccagtggggcgccagcgtggccatgcaggccgtgagcagaagaagaagcgaggtgagagtgccctggctgcacagcctggccgccgcccaggaggaggaccacgaggaccagaccgacaccgagggcgaggacaccgaggaggaggaggagctggagaccgaggagaacaagttcagcgaggtggccgccctgcccggccccagaggcctgctgggcggcgtggcccacaccctgcagaagaccctgcagaccaccatcagcgccgtgacctgggcccccgccgccgtgctgggcatggccggcagagtgctgcacctgacccccgcccccgccgtgagcagcaccaagggcagagccatgagcctgagcgacgccctgaagggcgtgaccgacaacgtggtggacaccgtggtgcactacgtgcccctgcccagactgagcctgatggagcccgagagcgagttcagagacatcgacaacccccccgccgaggtggagagaagagaggccgagagaagagccagcggcgcccccagcgccggccccgagcccgcccccagactggcccagcccagaagaagcctgagaagcgcccagagccccggcgccccccccggccccggcctggaggacgaggtggccacccccgccgcccccagacccggcttccccgccgtgcccagagagaagcccaagagaagagtgagcgacagcttcttcagacccagcgtgatggagcccatcctgggcagaacccactacagccagctgagaaagaagagctag

SEQ ID NO: 92746 - DNA, 1569 bp, Artificial Sequence; identical to SEQ ID NO: 92745
  Description of Artificial Sequence: Synthetic coding sequence

SEQ ID NO: 92747 - DNA, 1314 bp, Artificial Sequence
  Description of Artificial Sequence: Synthetic coding sequence
atggccagcgtggccgtggacccccagcccagcgtggtgaccagagtggtgaacctgcccctggtgagcagcacctacgacctgatgagcagcgcctacctgagcaccaaggaccagtacccctacctgaagagcgtgtgcgagatggccgagaacggcgtgaagaccatcaccagcgtggccatgaccagcgccctgcccatcatccagaagctggagccccagatcgccgtggccaacacctacgcctgcaagggcctggacagaatcgaggagagactgcccatcctgaaccagcccagcacccagatcgtggccaacgccaagggcgccgtgaccggcgccaaggacgccgtgaccaccaccgtgaccggcgccaaggacagcgtggccagcaccatcaccggcgtgatggacaagaccaagggcgccgtgaccggcagcgtggagaagaccaagagcgtggtgagcggcagcatcaacaccgtgctgggcagcagaatgatgcagctggtgagcagcggcgtggagaacgccctgaccaagagcgagctgctggtggagcagtacctgcccctgaccgaggaggagctggagaaggaggccaagaaggtggagggcttcgacctggtgcagaagcccagctactacgtgagactgggcagcctgagcaccaagctgcacagcagagcctaccagcaggccctgagcagagtgaaggaggccaagcagaagagccagcagaccatcagccagctgcacagcaccgtgcacctgatcgagttcgccagaaagaacgtgtacagcgccaaccagaagatccaggacgcccaggacaagctgtacctgagctgggtggagtggaagagaagcatcggctacgacgacaccgacgagagccactgcgccgagcacatcgagagcagaaccctggccatcgccagaaacctgacccagcagctgcagaccacctgccacaccctgctgagcaacatccagggcgtgccccagaacatccaggaccaggccaagcacatgggcgtgatggccggcgacatctacagcgtgttcagaaacgccgccagcttcaaggaggtgagcgacagcctgctgaccagcagcaagggccagctgcagaagatgaaggagagcctggacgacgtgatggactacctggtgaacaacacccccctgaactggctggtgggccccttctacccccagctgaccgagagccagaacgcccaggaccagggcgccgagatggacaagagcagccaggagacccagagaagcgagcacaagacccactag

SEQ ID NO: 92748 - DNA, 333 bp, Artificial Sequence
  Description of Artificial Sequence: Synthetic coding sequence
atggccagcgtggccgtggacccccagcccagcgtggtgaccagagtggtgaacctgcccctggtgagcagcacctacgacctgatgagcagcgcctacctgagcaccaaggaccagtacccctacctgaagagcgtgtgcgagatggccgagaacggcgtgaagaccatcaccagcgtggccatgaccagcgccctgcccatcatccagaagctggagccccagatcgccgtggccaacacctacgcctgcaagggcctggacagaatcgaggagagactgcccatcctgaaccagcccagcacccaggtgagcctgggccagaagtgctag

SEQ ID NO: 92749 - DNA, 381 bp, Artificial Sequence
  Description of Artificial Sequence: Synthetic coding sequence
atggccagcgtggccgtggacccccagcccagcgtggtgaccagagtggtgaacctgcccctggtgagcagcacctacgacctgatgagcagcgcctacctgagcaccaaggaccagtacccctacctgaagagcgtgtgcgagatggccgagaacggcgtgaagaccatcaccagcgtggccatgaccagcgccctgcccatcatccagaagctggagccccagatcgccgtggccaacacctacgcctgcaagggcctggacagaatcgaggagagactgcccatcctgaaccagcccagcacccaggccaacacctgcttccccaacctggacctggacgtgtgcctgaagaacaacggccacttcctgaccagctag

SEQ ID NO: 92750 - DNA, 1071 bp, Artificial Sequence
  Description of Artificial Sequence: Synthetic coding sequence
atggccagcgtggccgtggacccccagcccagcgtggtgaccagagtggtgaacctgcccctggtgagcagcacctacgacctgatgagcagcgcctacctgagcaccaaggaccagtacccctacctgaagagcgtgtgcgagatggccgagaacggcgtgaagaccatcaccagcgtggccatgaccagcgccctgcccatcatccagaagctggagccccagatcgccgtggccaacacctacgcctgcaagggcctggacagaatcgaggagagactgcccatcctgaaccagcccagcacccagatcgtggccaacgccaagggcgccgtgaccggcgccaaggacgccgtgaccaccaccgtgaccggcgccaaggacagcgtggccagcaccatcaccggcgtgatggacaagaccaagggcgccgtgaccggcagcgtggagaagaccaagagcgtgaagaagaagcagaagaagctgaaggacctgatctggttcagaagccagctgcacagcaccgtgcacctgatcgagttcgccagaaagaacgtgtacagcgccaaccagaagatccaggacgcccaggacaagctgtacctgagctgggtggagtggaagagaagcatcggctacgacgacaccgacgagagccactgcgccgagcacatcgagagcagaaccctggccatcgccagaaacctgacccagcagctgcagaccacctgccacaccctgctgagcaacatccagggcgtgccccagaacatccaggaccaggccaagcacatgggcgtgatggccggcgacatctacagcgtgttcagaaacgccgccagcttcaaggaggtgagcgacagcctgctgaccagcagcaagggccagctgcagaagatgaaggagagcctggacgacgtgatggactacctggtgaacaacacccccctgaactggctggtgggccccttctacccccagctgaccgagagccagaacgcccaggaccagggcgccgagatggacaagagcagccaggagacccagagaagcgagcacaagacccactag

SEQ ID NO: 92751 - DNA, 378 bp, Artificial Sequence
  Description of Artificial Sequence: Synthetic coding sequence
atggccagcgtggccgtggacccccagcccagcgtggtgaccagagtggtgaacctgcccctggtgagcagcacctacgacctgatgagcagcgcctacctgagcaccaaggaccagtacccctacctgaagagcgtgtgcgagatggccgagaacggcgtgaagaccatcaccagcgtggccatgaccagcgccctgcccatcatccagaagctggagccccagatcgccgtggccaacacctacgcctgcaagggcctggacagaatcgaggagagactgcccatcctgaaccagcccagcacccagatcgtggccaacgccaagggcgccgtgaccggcgccaaggacgccgtgaccaccaccgtgaccggctag

SEQ ID NO: 92752 - DNA, 735 bp, Artificial Sequence
  Description of Artificial Sequence: Synthetic coding sequence
atgggcccccccagcgccgcccccagaggcggccacagaccctggcagggcctgctgatcaccgccagcctgctgaccttctggcacccccccaccaccgtgcagttcaccatcgaggccctgcccagcagcgccgccgagggcaaggacgtgctgctgctggcctgcaacatcagcgagaccatccaggcctactactggcacaagggcaagaccgccgagggcagccccctgatcgccggctacatcaccgacatccaggccaacatccccggcgccgcctacagcggcagagagaccgtgtaccccaacggcagcctgctgttccagaacatcaccctggaggacgccggcagctacaccctgagaaccatcaacgccagctacgacagcgaccaggccaccggccagctgcacgtgcaccagaacaacgtgcccggcctgcccgtgggcgccgtggccggcatcgtgaccggcgtgctggtgggcgtggccctggtggccgccctggtgtgcttcctgctgctgagcagaaccggcagagccagcatccagagagacctgagagagcagcccccccccgccagcacccccggccacggccccagccacagaagcaccttcagcgcccccctgcccagccccagaaccgccacccccatctacgaggagctgctgtacagcgacgccaacatctactgccagatcgaccacaaggccgacgtggtgagctag

SEQ ID NO: 92753 - DNA, 1269 bp, Artificial Sequence
  Description of Artificial Sequence: Synthetic coding sequence
atgagcgccgacggcgccgaggccgacggcagcacccaggtgaccgtggaggagcccgtgcagcagcccagcgtggtggacagagtggccagcatgcccctgatcagcagcacctgcgacatggtgagcgccgcctacgccagcaccaaggagagctacccccacatcaagaccgtgtgcgacgccgccgagaagggcgtgagaaccctgaccgccgccgccgtgagcggcgcccagcccatcctgagcaagctggagccccagatcgccagcgccagcgagtacgcccacagaggcctggacaagctggaggagaacctgcccatcctgcagcagcccaccgagaaggtgagcggcgcccaggagatggtgagcagcgccaaggacaccgtggccacccagctgagcgaggccgtggacgccaccagaggcgccgtgcagagcggcgtggacaagaccaagagcgtggtgaccggcggcgtgcagagcgtgatgggcagcagactgggccagatggtgctgagcggcgtggacaccgtgctgggcaagagcgaggagtgggccgacaaccacctgcccctgaccgacgccgagctggccagaatcgccaccagcctggacggcttcgacgtggccagcgtgcagcagcagagacaggagcagagctacttcgtgagactgggcagcctgagcgagagactgagacagcacgcctacgagcacagcctgggcaagctgagagccaccaagcagagagcccaggaggccctgctgcagctgagccaggtgctgagcctgatggagaccgtgaagcagggcgtggaccagaagctggtggagggccaggagaagctgcaccagatgtggctgagctggaaccagaagcagctgcagggccccgagaaggagccccccaagcccgagcaggtggagagcagagccctgaccatgttcagagacatcgcccagcagctgcaggccacctgcaccagcctgggcagcagcatccagggcctgcccaccaacgtgaaggaccaggtgcagcaggccagaagacaggtggaggacctgcaggccaccttcagcagcatccacagcttccaggacctgagcagcagcatcctggcccagagcagagagagagtggccagcgccagagaggccctggaccacatggtggagtacgtggcccagaacacccccgtgacctggctggtgggccccttcgcccccggcatcaccgagaaggcccccgaggagaagaagtag

SEQ ID NO: 92754 - DNA, 1392 bp, Artificial Sequence
  Description of Artificial Sequence: Synthetic coding sequence
atgagcgaggaggaggccgcccagatccccagaagcagcgtgtgggagcaggaccagcagaacgtggtgcagagagtggtggccctgcccctggtgagagccacctgcaccgccgtgtgcgacgtgtacagcgccgccaaggacagacaccccctgctgggcagcgcctgcagactggccgagaactgcgtgtgcggcctgaccaccagagccctggaccacgcccagcccctgctggagcacctgcagccccagctggccaccatgaacagcctggcctgcagaggcctggacaagctggaggagaagctgcccttcctgcagcagcccagcgagaccgtggtgaccagcgccaaggacgtggtggccagcagcgtgaccggcgtggtggacctggccagaagaggcagaagatggagcgtggagctgaagagaagcgtgagccacgccgtggacgtggtgctggagaagagcgaggagctggtggaccacttcctgcccatgaccgaggaggagctggccgccctggccgccgaggccgagggccccgaggtgggcagcgtggaggaccagagaagacagcagggctacttcgtgagactgggcagcctgagcgccagaatcagacacctggcctacgagcacagcgtgggcaagctgagacagagcaagcacagagcccaggacaccctggcccagctgcaggagaccctggagctgatcgaccacatgcagtgcggcgtgacccccaccgcccccgcctgccccggcaaggtgcacgagctgtggggcgagtggggccagagaccccccgagagcagaagaagaagccaggccgagctggagaccctggtgctgagcagaagcctgacccaggagctgcagggcaccgtggaggccctggagagcagcgtgagaggcctgcccgccggcgcccaggagaaggtggccgaggtgagaagaagcgtggacgccctgcagaccgccttcgccgacgccagatgcttcagagacgtgcccgccgccgccctggccgagggcagaggcagagtggcccacgcccacgcctgcgtggacgagctgctggagctggtggtgcaggccgtgcccctgccctggctggtgggccccttcgcccccatcctggtggagagacccgagcccctgcccgacctggccgacctggtggacgaggtgatcggcggccccgaccccagatgggcccacctggactggcccgcccagcagagagcctgggaggccgagcacagagacggcagcggcaacggcgacggcgacagaatgggcgtggccggcgacatctgcgagcaggagcccgagacccccagctgccccgtgaagcacaccctgatgcccgagctggacttctag

SEQ ID NO: 92755 - DNA, 3768 bp, Artificial Sequence
  Description of Artificial Sequence: Synthetic coding sequence
atgaacggctacgccgagttcccccccagccccagcaaccccaccaaggagcccgtggagccccagcccagccaggtgcccctgcaggaggacgtggacatgagcagcggcagcagcggccacgagaccaacgagaactgcagcaccggcagagacagccagggcagcgactgcgacgacagcggcaaggagctgggcatgctggtggagccccccgacgccagacagagccccgacaccttcagcctgatgatggccaagagcgagcacaaccccagcaccagcggctgcagcagcgaccagagcagcaaggtggacacccacaaggagctgatcaagaccctgaaggagctgaaggtgcacctgcccgccgacaagaaggccaagggcaaggccagcaccctggccaccctgaagtacgccctgagaagcgtgaagcaggtgaaggccaacgaggagtactaccagctgctgatgagcagcgagggccacccctgcggcgccgacgtgcccagctacaccgtggaggagatggagagcgtgaccagcgagcacatcgtgaagaacgccgacatgttcgccgtggccgtgagcctggtgagcggcaagatcctgtacatcagcgaccaggtggccagcatcttccactgcaagagagacgccttcagcgacgccaagttcgtggagttcctggccccccacgacgtgggcgtgttccacagcttcaccagcccctacaagctgcccctgtggagcatgtgcagcggcgccgacagcttcacccaggagtgcatggaggagaagagcttcttctgcagagtgagcgtgagaaagagccacgagaacgagatcagataccaccccttcagaatgaccccctacctggtgaaggtgagagaccagcagggcgccgagagccagctgtgctgcctgctgctggccgagagagtgcacagcggctacgaggcccccagaatcccccccgagaagagaatcttcaccaccacccacacccccaactgcctgttccaggacgtggacgagagagccgtgcccctgctgggctacctgccccaggacctgatcgagacccccgtgctggtgcagctgcaccccagcgacagacccctgatgctggccatccacaagaagatcctgcagagcggcggccagcccttcgactacagccccatcagattcagagccagaaacggcgagtacatcaccctggacaccagctggagcagcttcatcaacccctggagcagaaagatcagcttcatcatcggcagacacaaggtgagagtgggccccctgaacgaggacgtgttcgccgcccacccctgcaccgaggagaaggccctgcaccccagcatccaggagctgaccgagcagatccacagactgctgctgcagcccgtgccccacagcggcagcagcggctacggcagcctgggcagcaacggcagccacgagcacctgatgagccagaccagcagcagcgacagcaacggccacgaggacagcagaagaagaagagccgagatctgcaagaacggcaacaagaccaagaacagaagccactacagccacgagagcggcgagcagaagaagaagagcgtgaccgagatgcagaccaacccccccgccgagaagaaggccgtgcccgccatggagaaggacagcctgggcgtgagcttccccgaggagctggcctgcaagaaccagcccacctgcagctaccagcagatcagctgcctggacagcgtgatcagatacctggagagctgcaacgaggccgccaccctgaagagaaagtgcgagttccccgccaacgtgcccgccctgagaagcagcgacaagagaaaggccaccgtgagccccggcccccacgccggcgaggccgagccccccagcagagtgaacagcagaaccggcgtgggcacccacctgaccagcctggccctgcccggcaaggccgagagcgtggccagcctgaccagccagtgcagctacagcagcaccatcgtgcacgtgggcgacaagaagccccagcccgagctggagatggtggaggacgccgccagcggccccgagagcctggactgcctggccggccccgccctggcctgcggcctgagccaggagaaggagcccttcaagaagctgggcctgaccaaggaggtgctggccgcccacacccagaaggaggagcagagcttcctgcagaagttcaaggagatcagaaagctgagcatcttccagagccactgccactactacctgcaggagagaagcaagggccagcccagcgagagaaccgcccccggcctgagaaacaccagcggcatcgacagcccctggaagaagaccggcaagaacagaaagctgaagagcaagagagtgaagcccagagacagcagcgagagcaccggcagcggcggccccgtgagcgccagaccccccctggtgggcctgaacgccaccgcctggagccccagcgacaccagccagagcagctgccccgccgtgcccttccccgcccccgtgcccgccgcctacagcctgcccgtgttccccgcccccggcaccgtggccgccccccccgcccccccccacgccagcttcaccgtgcccgccgtgcccgtggacctgcagcaccagttcgccgtgcagcccccccccttccccgcccccctggcccccgtgatggccttcatgctgcccagctacagcttccccagcggcacccccaacctgccccaggccttcttccccagccagccccagttccccagccaccccaccctgaccagcgagatggccagcgccagccagcccgagttccccagcagaaccagcatccccagacagccctgcgcctgccccgccaccagagccaccccccccagcgccatgggcagagccagcccccccctgttccagagcagaagcagcagccccctgcagctgaacctgctgcagctggaggaggcccccgagggcggcaccggcgccatgggcaccaccggcgccaccgagaccgccgccgtgggcgccgactgcaagcccggcaccagcagagaccagcagcccaaggcccccctgaccagagacgagcccagcgacacccagaacagcgacgccctgagcaccagcagcggcctgctgaacctgctgctgaacgaggacctgtgcagcgccagcggcagcgccgccagcgagagcctgggcagcggcagcctgggctgcgacgccagccccagcggcgccggcagcagcgacaccagccacaccagcaagtacttcggcagcatcgacagcagcgagaacaaccacaaggccaagatgaacaccggcatggaggagagcgagcacttcatcaagtgcgtgctgcaggaccccatctggctgctgatggccgacgccgacagcagcgtgatgatgacctaccagctgcccagcagaaacctggaggccgtgctgaaggaggacagagagaagctgaagctgctgcagaagctgcagcccagattcaccgagagccagaagcaggagctgagagaggtgcaccagtggatgcagaccggcggcctgcccgccgccatcgacgtggccgagtgcgtgtactgcgagaacaaggagaagggcaacatctgcatcccctacgaggaggacatccccagcctgggcctgagcgaggtgagcgacaccaaggaggacgagaacggcagccccctgaaccacagaatcgaggagcagacctag

SEQ ID NO: 92756 - DNA, 1215 bp, Artificial Sequence
  Description of Artificial Sequence: Synthetic coding sequence
atgaacggctacgccgagttcccccccagccccagcaaccccaccaaggagcccgtggagccccagcccagccaggtgcccctgcaggaggacgtggacatgagcagcggcagcagcggccacgagaccaacgagaactgcagcaccggcagagacagccagggcagcgactgcgacgacagcggcaaggagctgggcatgctggtggagccccccgacgccagacagagccccgacaccttcagcctgatgatggccaagagcgagcacaaccccagcaccagcggctgcagcagcgaccagagcagcaaggtggacacccacaaggagctgatcaagaccctgaaggagctgaaggtgcacctgcccgccgacaagaaggccaagggcaaggccagcaccctggccaccctgaagtacgccctgagaagcgtgaagcaggtgaaggccaacgaggagtactaccagctgctgatgagcagcgagggccacccctgcggcgccgacgtgcccagctacaccgtggaggagatggagagcgtgaccagcgagcacatcgtgaagaacgccgacatgttcgccgtggccgtgagcctggtgagcggcaagatcctgtacatcagcgaccaggtggccagcatcttccactgcaagagagacgccttcagcgacgccaagttcgtggagttcctggccccccacgacgtgggcgtgttccacagcttcaccagcccctacaagctgcccctgtggagcatgtgcagcggcgccgacagcttcacccaggagtgcatggaggagaagagcttcttctgcagagtgagcgtgagaaagagccacgagaacgagatcagataccaccccttcagaatgaccccctacctggtgaaggtgagagaccagcagggcgccgagagccagctgtgctgcctgctgctggccgagagagtgcacagcggctacgaggcccccagaatcccccccgagaagagaatcttcaccaccacccacacccccaactgcctgttccaggacgtggacgagagccccgccgtgagaagagccgccttcagactgttcagccacagcgtgagcagacccgagagaagagtgcaccacgtgggccaccagctggtgcagctgcaccagcccatggagcaggagaacctgctgcaccactgggaggcccagagccagggcggccccttcgagtag

SEQ ID NO: 92757 - DNA, 1215 bp, Artificial Sequence; identical to SEQ ID NO: 92756
  Description of Artificial Sequence: Synthetic coding sequence

SEQ ID NO: 92758 - DNA, 330 bp, Artificial Sequence
  Description of Artificial Sequence: Synthetic coding sequence
atgaacggctacgccgagttcccccccagccccagcaaccccaccaaggagcccgtggagccccagcccagccaggtgcccctgcaggaggacgtggacatgagcagcggcagcagcggccacgagaccaacgagaactgcagcaccggcagagacagccagggcagcgactgcgacgacagcggcaaggagctgggcatgctggtggagccccccgacgccagacagagccccgacaccttcagcctgatgatggccaagagcgagcacaaccccagcaccagcggctgcagcagcgaccagagcagcaaggtggacacccacaagtag

SEQ ID NO: 92759 - DNA, 1452 bp, Artificial Sequence
  Description of Artificial Sequence: Synthetic coding sequence
atgaacggctacgccgagttcccccccagccccagcaaccccaccaaggagcccgtggagccccagcccagccaggtgcccctgcaggaggacgtggacatgagcagcggcagcagcggccacgagaccaacgagaactgcagcaccggcagagacagccagggcagcgactgcgacgacagcggcaaggagctgggcatgctggtggagccccccgacgccagacagagccccgacaccttcagcctgatgatggccaagagcgagcacaaccccagcaccagcggctgcagcagcgaccagagcagcaaggtggacacccacaaggagctgatcaagaccctgaaggagctgaaggtgcacctgcccgccgacaagaaggccaagggcaaggccagcaccctggccaccctgaagtacgccctgagaagcgtgaagcaggtgaaggccaacgaggagtactaccagctgctgatgagcagcgagggccacccctgcggcgccgacgtgcccagctacaccgtggaggagatggagagcgtgaccagcgagcacatcgtgaagaacgccgacatgttcgccgtggccgtgagcctggtgagcggcaagatcctgtacatcagcgaccaggtggccagcatcttccactgcaagagagacgccttcagcgacgccaagttcgtggagttcctggccccccacgacgtgggcgtgttccacagcttcaccagcccctacaagctgcccctgtggagcatgtgcagcggcgccgacagcttcacccaggagtgcatggaggagaagagcttcttctgcagagtgagcgtgagaaagagccacgagaacgagatcagataccaccccttcagaatgaccccctacctggtgaaggtgagagaccagcagggcgccgagagccagctgtgctgcctgctgctggccgagagagtgcacagcggctacgaggcccccagaatcccccccgagaagagaatcttcaccaccacccacacccccaactgcctgttccaggacgtggacgagagagccgtgcccctgctgggctacctgccccaggacctgatcgagacccccgtgctggtgcagctgcaccccagcgacagacccctgatgctggccatccacaagaagatcctgcagagcggcggccagcccttcgactacagccccatcagattcagagccagaaacggcgagtacatcaccctggacaccagctggagcagcttcatcaacccctggagcagaaagatcagcttcatcatcggcagacacaaggtgagagtgggccccctgaacgaggacgtgttcgccgcccacccctgcaccgaggagaaggccctgcaccccagcatccaggagctgaccgagcagatccacagactgctgctgcaggtgggcgtggtgcccgcctgccccccccccagatag

SEQ ID NO: 92760 - DNA, 2340 bp, Artificial Sequence
  Description of Artificial Sequence: Synthetic coding sequence
atgatccccttcctgcccatgttcagcctgctgctgctgctgatcgtgaaccccatcaacgccaacaaccactacgacaagatcctggcccacagcagaatcagaggcagagaccagggccccaacgtgtgcgccctgcagcagatcctgggcaccaagaagaagtacttcagcacctgcaagaactggtacaagaagagcatctgcggccagaagaccaccgtgctgtacgagtgctgccccggctacatgagaatggagggcatgaagggctgccccgccgtgctgcccatcgaccacgtgtacggcaccctgggcatcgtgggcgccaccaccacccagagatacagcgacgccagcaagctgagagaggagatcgagggcaagggcagcttcacctacttcgcccccagcaacgaggcctgggacaacctggacagcgacatcagaagaggcctggagagcaacgtgaacgtggagctgctgaacgccctgcacagccacatgatcaacaagagaatgctgaccaaggacctgaagaacggcatgatcatccccagcatgtacaacaacctgggcctgttcatcaaccactaccccaacggcgtggtgaccgtgaactgcgccagaatcatccacggcaaccagatcgccaccaacggcgtggtgcacgtgatcgacagagtgctgacccagatcggcaccagcatccaggacttcatcgaggccgaggacgacctgagcagcttcagagccgccgccatcaccagcgacatcctggaggccctgggcagagacggccacttcaccctgttcgcccccaccaacgaggccttcgagaagctgcccagaggcgtgctggagagaatcatgggcgacaaggtggccagcgaggccctgatgaagtaccacatcctgaacaccctgcagtgcagcgagagcatcatgggcggcgccgtgttcgagaccctggagggcaacaccatcgagatcggctgcgacggcgacagcatcaccgtgaacggcatcaagatggtgaacaagaaggacatcgtgaccaacaacggcgtgatccacctgatcgaccaggtgctgatccccgacagcgccaagcaggtgatcgagctggccggcaagcagcagaccaccttcaccgacctggtggcccagctgggcctggccagcgccctgagacccgacggcgagtacaccctgctggcccccgtgaacaacgccttcagcgacgacaccctgagcatggaccagagactgctgaagctgatcctgcagaaccacatcctgaaggtgaaggtgggcctgaacgagctgtacaacggccagatcctggagaccatcggcggcaagcagctgagagtgttcgtgtacagaaccgccgtgtgcatcgagaacagctgcatggagaagggcagcaagcagggcagaaacggcgccatccacatcttcagagagatcatcaagcccgccgagaagagcctgcacgagaagctgaagcaggacaagagattcagcaccttcctgagcctgctggaggccgccgacctgaaggagctgctgacccagcccggcgactggaccctgttcgtgcccaccaacgacgccttcaagggcatgaccagcgaggagaaggagatcctgatcagagacaagaacgccctgcagaacatcatcctgtaccacctgacccccggcgtgttcatcggcaagggcttcgagcccggcgtgaccaacatcctgaagaccacccagggcagcaagatcttcctgaaggaggtgaacgacaccctgctggtgaacgagctgaagagcaaggagagcgacatcatgaccaccaacggcgtgatccacgtggtggacaagctgctgtaccccgccgacacccccgtgggcaacgaccagctgctggagatcctgaacaagctgatcaagtacatccagatcaagttcgtgagaggcagcaccttcaaggagatccccgtgaccgtgtacaagcccatcatcaagaagtacaccaagatcatcgacggcgtgcccgtggagatcaccgagaaggagaccagagaggagagaatcatcaccggccccgagatcaagtacaccagaatcagcaccggcggcggcgagaccgaggagaccctgaagaagctgctgcaggaggaggtgaccaaggtgaccaagttcatcgagggcggcgacggccacctgttcgaggacgaggagatcaagagactgctgcagggcgacacccccgtgagaaagctgcaggccaacaagaaggtgcagggcagcagaagaagactgagagagggcagaagccagtag

SEQ ID NO: 92761 - DNA, 2430 bp, Artificial Sequence
  Description of Artificial Sequence: Synthetic coding sequence
atgatccccttcctgcccatgttcagcctgctgctgctgctgatcgtgaaccccatcaacgccaacaaccactacgacaagatcctggcccacagcagaatcagaggcagagaccagggccccaacgtgtgcgccctgcagcagatcctgggcaccaagaagaagtacttcagcacctgcaagaactggtacaagaagagcatctgcggccagaagaccaccgtgctgtacgagtgctgccccggctacatgagaatggagggcatgaagggctgccccgccgtgctgcccatcgaccacgtgtacggcaccctgggcatcgtgggcgccaccaccacccagagatacagcgacgccagcaagctgagagaggagatcgagggcaagggcagcttcacctacttcgcccccagcaacgaggcctgggacaacctggacagcgacatcagaagaggcctggagagcaacgtgaacgtggagctgctgaacgccctgcacagccacatgatcaacaagagaatgctgaccaaggacctgaagaacggcatgatcatccccagcatgtacaacaacctgggcctgttcatcaaccactaccccaacggcgtggtgaccgtgaactgcgccagaatcatccacggcaaccagatcgccaccaacggcgtggtgcacgtgatcgacagagtgctgacccagatcggcaccagcatccaggacttcatcgaggccgaggacgacctgagcagcttcagagccgccgccatcaccagcgacatcctggaggccctgggcagagacggccacttcaccctgttcgcccccaccaacgaggccttcgagaagctgcccagaggcgtgctggagagaatcatgggcgacaaggtggccagcgaggccctgatgaagtaccacatcctgaacaccctgcagtgcagcgagagcatcatgggcggcgccgtgttcgagaccctggagggcaacaccatcgagatcggctgcgacggcgacagcatcaccgtgaacggcatcaagatggtgaacaagaaggacatcgtgaccaacaacggcgtgatccacctgatcgaccaggtgctgatccccgacagcgccaagcaggtgatcgagctggccggcaagcagcagaccaccttcaccgacctggtggcccagctgggcctggccagcgccctgagacccgacggcgagtacaccctgctggcccccgtgaacaacgccttcagcgacgacaccctgagcatggaccagagactgctgaagctgatcctgcagaaccacatcctgaaggtgaaggtgggcctgaacgagctgtacaacggccagatcctggagaccatcggcggcaagcagctgagagtgttcgtgtacagaaccgccgtgtgcatcgagaacagctgcatggagaagggcagcaagcagggcagaaacggcgccatccacatcttcagagagatcatcaagcccgccgagaagagcctgcacgagaagctgaagcaggacaagagattcagcaccttcctgagcctgctggaggccgccgacctgaaggagctgctgacccagcccggcgactggaccctgttcgtgcccaccaacgacgccttcaagggcatgaccagcgaggagaaggagatcctgatcagagacaagaacgccctgcagaacatcatcctgtaccacctgacccccggcgtgttcatcggcaagggcttcgagcccggcgtgaccaacatcctgaagaccacccagggcagcaagatcttcctgaaggaggtgaacgacaccctgctggtgaacgagctgaagagcaaggagagcgacatcatgaccaccaacggcgtgatccacgtggtggacaagctgctgtaccccgccgacacccccgtgggcaacgaccagctgctggagatcctgaacaagctgatcaagtacatccagatcaagttcgtgagaggcagcaccttcaaggagatccccgtgaccgtgtacagacccaccctgaccaaggtgaagatcgagggcgagcccgagttcagactgatcaaggagggcgagaccatcaccgaggtgatccacggcgagcccatcatcaagaagtacaccaagatcatcgacggcgtgcccgtggagatcaccgagaaggagaccagagaggagagaatcatcaccggccccgagatcaagtacaccagaatcagcaccggcggcggcgagaccgaggagaccctgaagaagctgctgcaggaggaggtgaccaaggtgaccaagttcatcgagggcggcgacggccacctgttcgaggacgaggagatcaagagactgctgcagggcgacacccccgtgagaaagctgcaggccaacaagaaggtgcagggcagcagaagaagactgagagagggcagaagccagtag

SEQ ID NO: 92762 - DNA, 2511 bp, Artificial Sequence
  Description of Artificial Sequence: Synthetic coding sequence
atgatccccttcctgcccatgttcagcctgctgctgctgctgatcgtgaaccccatcaacgccaacaaccactacgacaagatcctggcccacagcagaatcagaggcagagaccagggccccaacgtgtgcgccctgcagcagatcctgggcaccaagaagaagtacttcagcacctgcaagaactggtacaagaagagcatctgcggccagaagaccaccgtgctgtacgagtgctgccccggctacatgagaatggagggcatgaagggctgccccgccgtgctgcccatcgaccacgtgtacggcaccctgggcatcgtgggcgccaccaccacccagagatacagcgacgccagcaagctgagagaggagatcgagggcaagggcagcttcacctacttcgcccccagcaacgaggcctgggacaacctggacagcgacatcagaagaggcctggagagcaacgtgaacgtggagctgctgaacgccctgcacagccacatgatcaacaagagaatgctgaccaaggacctgaagaacggcatgatcatccccagcatgtacaacaacctgggcctgttcatcaaccactaccccaacggcgtggtgaccgtgaactgcgccagaatcatccacggcaaccagatcgccaccaacggcgtggtgcacgtgatcgacagagtgctgacccagatcggcaccagcatccaggacttcatcgaggccgaggacgacctgagcagcttcagagccgccgccatcaccagcgacatcctggaggccctgggcagagacggccacttcaccctgttcgcccccaccaacgaggccttcgagaagctgcccagaggcgtgctggagagaatcatgggcgacaaggtggccagcgaggccctgatgaagtaccacatcctgaacaccctgcagtgcagcgagagcatcatgggcggcgccgtgttcgagaccctggagggcaacaccatcgagatcggctgcgacggcgacagcatcaccgtgaacggcatcaagatggtgaacaagaaggacatcgtgaccaacaacggcgtgatccacctgatcgaccaggtgctgatccccgacagcgccaagcaggtgatcgagctggccggcaagcagcagaccaccttcaccgacctggtggcccagctgggcctggccagcgccctgagacccgacggcgagtacaccctgctggcccccgtgaacaacgccttcagcgacgacaccctgagcatggaccagagactgctgaagctgatcctgcagaaccacatcctgaaggtgaaggtgggcctgaacgagctgtacaacggccagatcctggagaccatcggcggcaagcagctgagagtgttcgtgtacagaaccgccgtgtgcatcgagaacagctgcatggagaagggcagcaagcagggcagaaacggcgccatccacatcttcagagagatcatcaagcccgccgagaagagcctgcacgagaagctgaagcaggacaagagattcagcaccttcctgagcctgctggaggccgccgacctgaaggagctgctgacccagcccggcgactggaccctgttcgtgcccaccaacgacgccttcaagggcatgaccagcgaggagaaggagatcctgatcagagacaagaacgccctgcagaacatcatcctgtaccacctgacccccggcgtgttcatcggcaagggcttcgagcccggcgtgaccaacatcctgaagaccacccagggcagcaagatcttcctgaaggaggtgaacgacaccctgctggtgaacgagctgaagagcaaggagagcgacatcatgaccaccaacggcgtgatccacgtggtggacaagctgctgtaccccgccgacacccccgtgggcaacgaccagctgctggagatcctgaacaagctgatcaagtacatccagatcaagttcgtgagaggcagcaccttcaaggagatccccgtgaccgtgtacaccaccaagatcatcaccaaggtggtggagcccaagatcaaggtgatcgagggcagcctgcagcccatcatcaagaccgagggccccaccctgaccaaggtgaagatcgagggcgagcccgagttcagactgatcaaggagggcgagaccatcaccgaggtgatccacggcgagcccatcatcaagaagtacaccaagatcatcgacggcgtgcccgtggagatcaccgagaaggagaccagagaggagagaatcatcaccggccccgagatcaagtacaccagaatcagcaccggcggcggcgagaccgaggagaccctgaagaagctgctgcaggaggaggtgaccaaggtgaccaagttcatcgagggcggcgacggccacctgttcgaggacgaggagatcaagagactgctgcagggcgacacccccgtgagaaagctgcaggccaacaagaaggtgcagggcagcagaagaagactgagagagggcagaagccagtag

SEQ ID NO: 92763 - DNA, 2427 bp, Artificial Sequence
  Description of Artificial Sequence: Synthetic coding sequence
atgatccccttcctgcccatgttcagcctgctgctgctgctgatcgtgaaccccatcaacgccaacaaccactacgacaagatcctggcccacagcagaatcagaggcagagaccagggccccaacgtgtgcgccctgcagcagatcctgggcaccaagaagaagtacttcagcacctgcaagaactggtacaagaagagcatctgcggccagaagaccaccgtgctgtacgagtgctgccccggctacatgagaatggagggcatgaagggctgccccgccgtgctgcccatcgaccacgtgtacggcaccctgggcatcgtgggcgccaccaccacccagagatacagcgacgccagcaagctgagagaggagatcgagggcaagggcagcttcacctacttcgcccccagcaacgaggcctgggacaacctggacagcgacatcagaagaggcctggagagcaacgtgaacgtggagctgctgaacgccctgcacagccacatgatcaacaagagaatgctgaccaaggacctgaagaacggcatgatcatccccagcatgtacaacaacctgggcctgttcatcaaccactaccccaacggcgtggtgaccgtgaactgcgccagaatcatccacggcaaccagatcgccaccaacggcgtggtgcacgtgatcgacagagtgctgacccagatcggcaccagcatccaggacttcatcgaggccgaggacgacctgagcagcttcagagccgccgccatcaccagcgacatcctggaggccctgggcagagacggccacttcaccctgttcgcccccaccaacgaggccttcgagaagctgcccagaggcgtgctggagagaatcatgggcgacaaggtggccagcgaggccctgatgaagtaccacatcctgaacaccctgcagtgcagcgagagcatcatgggcggcgccgtgttcgagaccctggagggcaacaccatcgagatcggctgcgacggcgacagcatcaccgtgaacggcatcaagatggtgaacaagaaggacatcgtgaccaacaacggcgtgatccacctgatcgaccaggtgctgatccccgacagcgccaagcaggtgatcgagctggccggcaagcagcagaccaccttcaccgacctggtggcccagctgggcctggccagcgccctgagacccgacggcgagtacaccctgctggcccccgtgaacaacgccttcagcgacgacaccctgagcatggaccagagactgctgaagctgatcctgcagaaccacatcctgaaggtgaaggtgggcctgaacgagctgtacaacggccagatcctggagaccatcggcggcaagcagctgagagtgttcgtgtacagaaccgccgtgtgcatcgagaacagctgcatggagaagggcagcaagcagggcagaaacggcgccatccacatcttcagagagatcatcaagcccgccgagaagagcctgcacgagaagctgaagcaggacaagagattcagcaccttcctgagcctgctggaggccgccgacctgaaggagctgctgacccagcccggcgactggaccctgttcgtgcccaccaacgacgccttcaagggcatgaccagcgaggagaaggagatcctgatcagagacaagaacgccctgcagaacatcatcctgtaccacctgacccccggcgtgttcatcggcaagggcttcgagcccggcgtgaccaacatcctgaagaccacccagggcagcaagatcttcctgaaggaggtgaacgacaccctgctggtgaacgagctgaagagcaaggagagcgacatcatgaccaccaacggcgtgatccacgtggtggacaagctgctgtaccccgccgacacccccgtgggcaacgaccagctgctggagatcctgaacaagctgatcaagtacatccagatcaagttcgtgagaggcagcaccttcaaggagatccccgtgaccgtgtacaccaccaagatcatcaccaaggtggtggagcccaagatcaaggtgatcgagggcagcctgcagcccatcatcaagaccgagggccccaccctgaccaaggtgaagatcgagggcgagcccgagttcagactgatcaaggagggcgagaccatcaccgaggtgatccacggcgagcccatcatcaagaagtacaccaagatcatcgacggcgtgcccgtggagatcaccgagaaggagaccagagaggagagaatcatcaccggccccgagatcaagtacaccagaatcagcaccggcggcggcgagaccgaggagaccctgaagaagctgctgcaggaggacacccccgtgagaaagctgcaggccaacaagaaggtgcagggcagcagaagaagactgagagagggcagaagccagtag

SEQ ID NO: 92764 - DNA, 834 bp, Artificial Sequence
  Description of Artificial Sequence: Synthetic coding sequence
atgagaatggagggcatgaagggctgccccgccgtgctgcccatcgaccacgtgtacggcaccctgggcatcgtgggcgccaccaccacccagagatacagcgacgccagcaagctgagagaggagatcgagggcaagggcagcttcacctacttcgcccccagcaacgaggcctgggacaacctggacagcgacatcagaagaggcctggagagcaacgtgaacgtggagctgctgaacgccctgcacagccacatgatcaacaagagaatgctgaccaaggacctgaagaacggcatgatcatccccagcatgtacaacaacctgggcctgttcatcaaccactaccccaacggcgtggtgaccgtgaactgcgccagaatcatccacggcaaccagatcgccaccaacggcgtggtgcacgtgatcgacagagtgctgacccagatcggcaccagcatccaggacttcatcgaggccgaggacgacctgagcagcttcagagccgccgccatcaccagcgacatcctggaggccctgggcagagacggccacttcaccctgttcgcccccaccaacgaggccttcgagaagctgcccagaggcgtgctggagagaatcatgggcgacaaggtggccagcgaggccctgatgaagtaccacatcctgaacaccctgcagtgcagcgagagcatcatgggcggcgccgtgttcgagaccctggagggcaacaccatcgagatcggctgcgacggcgacagcatcaccgtgaacggcatcaagatggtgaacaagaaggacatcgtgaccaactggtgcgaccccttcgactag

SEQ ID NO: 92765 - DNA, 2346 bp, Artificial Sequence
  Description of Artificial Sequence: Synthetic coding sequence
atgatccccttcctgcccatgttcagcctgctgctgctgctgatcgtgaaccccatcaacgccaacaaccactacgacaagatcctggcccacagcagaatcagaggcagagaccagggccccaacgtgtgcgccctgcagcagatcctgggcaccaagaagaagtacttcagcacctgcaagaactggtacaagaagagcatctgcggccagaagaccaccgtgctgtacgagtgctgccccggctacatgagaatggagggcatgaagggctgccccgccgtgctgcccatcgaccacgtgtacggcaccctgggcatcgtgggcgccaccaccacccagagatacagcgacgccagcaagctgagagaggagatcgagggcaagggcagcttcacctacttcgcccccagcaacgaggcctgggacaacctggacagcgacatcagaagaggcctggagagcaacgtgaacgtggagctgctgaacgccctgcacagccacatgatcaacaagagaatgctgaccaaggacctgaagaacggcatgatcatccccagcatgtacaacaacctgggcctgttcatcaaccactaccccaacggcgtggtgaccgtgaactgcgccagaatcatccacggcaaccagatcgccaccaacggcgtggtgcacgtgatcgacagagtgctgacccagatcggcaccagcatccaggacttcatcgaggccgaggacgacctgagcagcttcagagccgccgccatcaccagcgacatcctggaggccctgggcagagacggccacttcaccctgttcgcccccaccaacgaggccttcgagaagctgcccagaggcgtgctggagagaatcatgggcgacaaggtggccagcgaggccctgatgaagtaccacatcctgaacaccctgcagtgcagcgagagcatcatgggcggcgccgtgttcgagaccctggagggcaacaccatcgagatcggctgcgacggcgacagcatcaccgtgaacggcatcaagatggtgaacaagaaggacatcgtgaccaacaacggcgtgatccacctgatcgaccaggtgctgatccccgacagcgccaagcaggtgatcgagctggccggcaagcagcagaccaccttcaccgacctggtggcccagctgggcctggccagcgccctgagacccgacggcgagtacaccctgctggcccccgtgaacaacgccttcagcgacgacaccctgagcatggaccagagactgctgaagctgatcctgcagaaccacatcctgaaggtgaaggtgggcctgaacgagctgtacaacggccagatcctggagaccatcggcggcaagcagctgagagtgttcgtgtacagaaccgccgtgtgcatcgagaacagctgcatggagaagggcagcaagcagggcagaaacggcgccatccacatcttcagagagatcatcaagcccgccgagaagagcctgcacgagaagctgaagcaggacaagagattcagcaccttcctgagcctgctggaggccgccgacctgaaggagctgctgacccagcccggcgactggaccctgttcgtgcccaccaacgacgccttcaagggcatgaccagcgaggagaaggagatcctgatcagagacaagaacgccctgcagaacatcatcctgtaccacctgacccccggcgtgttcatcggcaagggcttcgagcccggcgtgaccaacatcctgaagaccacccagggcagcaagatcttcctgaaggaggtgaacgacaccctgctggtgaacgagctgaagagcaaggagagcgacatcatgaccaccaacggcgtgatccacgtggtggacaagctgctgtaccccgccgacacccccgtgggcaacgaccagctgctggagatcctgaacaagctgatcaagtacatccagatcaagttcgtgagaggcagcaccttcaaggagatccccgtgaccgtgtacagacccaccctgaccaaggtgaagatcgagggcgagcccgagttcagactgatcaaggagggcgagaccatcaccgaggtgatccacggcgagcccatcatcaagaagtacaccaagatcatcgacggcgtgcccgtggagatcaccgagaaggagaccagagaggagagaatcatcaccggccccgagatcaagtacaccagaatcagcaccggcggcggcgagaccgaggagaccctgaagaagctgctgcaggaggacacccccgtgagaaagctgcaggccaacaagaaggtgcagggcagcagaagaagactgagagagggcagaagccagtag

SEQ ID NO: 92766 - DNA, 2250 bp, Artificial Sequence
  Description of Artificial Sequence: Synthetic coding sequence
atgatccccttcctgcccatgttcagcctgctgctgctgctgatcgtgaaccccatcaacgccaacaaccactacgacaagatcctggcccacagcagaatcagaggcagagaccagggccccaacgtgtgcgccctgcagcagatcctgggcaccaagaagaagtacttcagcacctgcaagaactggtacaagaagagcatctgcggccagaagaccaccgtgctgtacgagtgctgccccggctacatgagaatggagggcatgaagggctgccccgccgtgctgcccatcgaccacgtgtacggcaccctgggcatcgtgggcgccaccaccacccagagatacagcgacgccagcaagctgagagaggagatcgagggcaagggcagcttcacctacttcgcccccagcaacgaggcctgggacaacctggacagcgacatcagaagaggcctggagagcaacgtgaacgtggagctgctgaacgccctgcacagccacatgatcaacaagagaatgctgaccaaggacctgaagaacggcatgatcatccccagcatgtacaacaacctgggcctgttcatcaaccactaccccaacggcgtggtgaccgtgaactgcgccagaatcatccacggcaaccagatcgccaccaacggcgtggtgcacgtgatcgacagagtgctgacccagatcggcaccagcatccaggacttcatcgaggccgaggacgacctgagcagcttcagagccgccgccatcaccagcgacatcctggaggccctgggcagagacggccacttcaccctgttcgcccccaccaacgaggccttcgagaagctgcccagaggcgtgctggagagaatcatgggcgacaaggtggccagcgaggccctgatgaagtaccacatcctgaacaccctgcagtgcagcgagagcatcatgggcggcgccgtgttcgagaccctggagggcaacaccatcgagatcggctgcgacggcgacagcatcaccgtgaacggcatcaagatggtgaacaagaaggacatcgtgaccaacaacggcgtgatccacctgatcgaccaggtgctgatccccgacagcgccaagcaggtgatcgagctggccggcaagcagcagaccaccttcaccgacctggtggcccagctgggcctggccagcgccctgagacccgacggcgagtacaccctgctggcccccgtgaacaacgccttcagcgacgacaccctgagcatggaccagagactgctgaagctgatcctgcagaaccacatcctgaaggtgaaggtgggcctgaacgagctgtacaacggccagatcctggagaccatcggcggcaagcagctgagagtgttcgtgtacagaaccgccgtgtgcatcgagaacagctgcatggagaagggcagcaagcagggcagaaacggcgccatccacatcttcagagagatcatcaagcccgccgagaagagcctgcacgagaagctgaagcaggacaagagattcagcaccttcctgagcctgctggaggccgccgacctgaaggagctgctgacccagcccggcgactggaccctgttcgtgcccaccaacgacgccttcaagggcatgaccagcgaggagaaggagatcctgatcagagacaagaacgccctgcagaacatcatcctgtaccacctgacccccggcgtgttcatcggcaagggcttcgagcccggcgtgaccaacatcctgaagaccacccagggcagcaagatcttcctgaaggaggtgaacgacaccctgctggtgaacgagctgaagagcaaggagagcgacatcatgaccaccaacggcgtgatccacgtggtggacaagctgctgtaccccgccgacacccccgtgggcaacgaccagctgctggagatcctgaacaagctgatcaagtacatccagatcaagttcgtgagaggcagcaccttcaaggagatccccgtgaccgtgtacagccccgagatcaagtacaccagaatcagcaccggcggcggcgagaccgaggagaccctgaagaagctgctgcaggaggaggtgaccaaggtgaccaagttcatcgagggcggcgacggccacctgttcgaggacgaggagatcaagagactgctgcagggcgacacccccgtgagaaagctgcaggccaacaagaaggtgcagggcagcagaagaagactgagagagggcagaagccagtag

SEQ ID NO: 92767 - DNA, 399 bp, Artificial Sequence
  Description of Artificial Sequence: Synthetic coding sequence
atgagcaacaagttcctgggcacctggaagctggtgagcagcgagaacttcgacgactacatgaaggccctgggcgtgggcctggccaccagaaagctgggcaacctggccaagcccaccgtgatcatcagcaagaagggcgacatcatcaccatcagaaccgagagcaccttcaagaacaccgagatcagcttcaagctgggccaggagttcgaggagaccaccgccgacaacagaaagaccaagagcatcgtgaccctgcagagaggcagcctgaaccaggtgcagagatgggacggcaaggagaccaccatcaagagaaagctggtgaacggcaagatggtggccgagtgcaagatgaagggcgtggtgtgcaccagaatctacgagaaggtgtag

SEQ ID NO: 92768 - DNA, 483 bp, Artificial Sequence
  Description of Artificial Sequence: Synthetic coding sequence
atgctgctgctgctgctgagcatcatcgtgctgcacgtggccgtgctggtgctgctgttcgtgagcaccatcgtgagccagtggatcgtgggcaacggccacgccaccgacctgtggcagaactgcagcaccagcagcagcggcaacgtgcaccactgcttcagcagcagccccaacgagtggctgcagagcgtgcaggccaccatgatcctgagcatcatcttcagcatcctgagcctgttcctgttcttctgccagctgttcaccctgaccaagggcggcagattctacatcaccggcatcttccagatcctggccggcctgtgcgtgatgagcgccgccgccatctacaccgtgagacaccccgagtggcacctgaacagcgactacagctacggcttcgcctacatcctggcctgggtggccttccccctggccctgctgagcggcgtgatctacgtgatcctgagaaagagagagtag

SEQ ID NO: 92769 - DNA, 357 bp, Artificial Sequence
  Description of Artificial Sequence: Synthetic coding sequence
atgctgctgctgctgctgagcatcatcgtgctgcacgtggccgtgctggtgctgctgttcgtgagcaccatcgtgagccagtggatcgtgggcaacggccacgccaccgacctgtggcagaactgcagcaccagcagcagcggcaacgtgcaccactgcttcagcagcagccccaacgagtggctgcagagcgtgcaggccaccatgatcctgagcatcatcttcagcatcctgagcctgttcctgttcttctgccagctgttcaccctgaccaagggcggcagattctacatcaccggcatcttccagatcctggccgagagcaacagcagccagatgtgcggctacagagactag

SEQ ID NO: 92770 - DNA, 483 bp, Artificial Sequence; identical to SEQ ID NO: 92768
  Description of Artificial Sequence: Synthetic coding sequence

SEQ ID NO: 92771 - DNA, 450 bp, Artificial Sequence
  Description of Artificial Sequence: Synthetic coding sequence
atgctgctgctgctgctgagcatcatcgtgctgcacgtggccgtgctggtgctgctgttcgtgagcaccatcgtgagccagtggatcgtgggcaacggccacgccaccgacctgtggcagaactgcagcaccagcagcagcggcaacgtgcaccactgcttcagcagcagccccaacgagtggctgcagagcgtgcaggccaccatgatcctgagcatcatcttcagcatcctgagcctgttcctgttcttctgccagctgttcaccctgaccaagggcggcagattctacatcaccggcatcttccagatcctggccggcctgtgcgtgatgagcgccgccgccatctacaccgtgagacaccccgagtggcacctgaacagcgactacagcttccccctggccctgctgagcggcgtgatctacgtgatcctgagaaagagagagtag

SEQ ID NO: 92772 - DNA, 1413 bp, Artificial Sequence
  Description of Artificial Sequence: Synthetic coding sequence
atgagccaccaccccagcggcctgagagccggcttcagcagcaccagctacagaagaaccttcggccccccccccagcctgagccccggcgccttcagctacagcagcagcagcagattcagcagcagcagactgctgggcagcgccagccccagcagcagcgtgagactgggcagcttcagaagccccagagccggcgccggcgccctgctgagactgcccagcgagagactggacttcagcatggccgaggccctgaaccaggagttcctggccaccagaagcaacgagaagcaggagctgcaggagctgaacgacagattcgccaacttcatcgagaaggtgagattcctggagcagcagaacgccgccctgagaggcgagctgagccaggccagaggccaggagcccgccagagccgaccagctgtgccagcaggagctgagagagctgagaagagagctggagctgctgggcagagagagagacagagtgcaggtggagagagacggcctggccgaggacctggccgccctgaagcagagactggaggaggagaccagaaagagagaggacgccgagcacaacctggtgctgttcagaaaggacgtggacgacgccaccctgagcagactggagctggagagaaagatcgagagcctgatggacgagatcgagttcctgaagaagctgcacgaggaggagctgagagacctgcaggtgagcgtggagagccagcaggtgcagcaggtggaggtggaggccaccgtgaagcccgagctgaccgccgccctgagagacatcagagcccagtacgagagcatcgccgccaagaacctgcaggaggccgaggagtggtacaagagcaagtacgccgacctgagcgacgccgccaacagaaaccacgaggccctgagacaggccaagcaggagatgaacgagagcagaagacagatccagagcctgacctgcgaggtggacggcctgagaggcaccaacgaggccctgctgagacagctgagagagctggaggagcagttcgccctggaggccggcggctaccaggccggcgccgccagactggaggaggagctgagacagctgaaggaggagatggccagacacctgagagagtaccaggagctgctgaacgtgaagatggccctggacatcgagatcgccacctacagaaagctgctggagggcgaggagagcagaatcagcgtgcccgtgcacagcttcgccagcctgaacatcaagaccaccgtgcccgaggtggagcccccccaggacagccacagcagaaagaccgtgctgatcaagaccatcgagaccagaaacggcgaggtggtgaccgagagccagaaggagcagagaagcgagctggacaagagcagcgcccacagctactag

SEQ ID NO: 92773 - DNA, 603 bp, Artificial Sequence
  Description of Artificial Sequence: Synthetic coding sequence
atgggccaggagttcagctgggaggaggccgaggccgccggcgagatcgacgtggccgagctgcaggagtggtacaagaagttcgtgatggagtgccccagcggcaccctgttcatgcacgagttcaagagattcttcaaggtgaccgacgacgaggaggccagccagtacgtggagggcatgttcagagccttcgacaagaacggcgacaacaccatcgacttcctggagtacgtggccgccctgaacctggtgctgagaggcaccctggagcacaagctgaagtggaccttcaagatctacgacaaggacggcaacggctgcatcgacagactggagctgctgaacatcgtggagggcatctaccagctgaagaaggcctgcagaagagagctgcagaccgagcagggccagctgctgacccccgaggaggtggtggacagaatcttcctgctggtggacgagaacggcgacggccagctgagcctgaacgagttcgtggagggcgccagaagagacaagtgggtgatgaagatgctgcagatggacatgaaccccagcagctggctggcccagcagagaagaaagagcgccatgttctag

SEQ ID NO: 92774 - DNA, 1104 bp, Artificial Sequence
  Description of Artificial Sequence: Synthetic coding sequence
atgtggagcgagggcagatacgagtacgagagaatccccagagagagagccccccccagaagccaccccagcgacggctacaacagactggtgaacatcgtgcccaagaagccccccctgctggacagacccggcgagggcagctacaacagatactacagccacgtggactacagagactacgacgagggcagaagcttcagccacgacagaagaagcggccccccccacagaggcgacgagagcggctacagatggaccagagacgaccacagcgccagcagacagcccgagtacagagacatgagagacggcttcagaagaaagagcttctacagcagccactacgccagagagagaagcccctacaagagagacaacaccttcttcagagagagccccgtgggcagaaaggacagcccccacagcagaagcggcagcagcgtgagcagcagaagctacagccccgagagaagcaagagctacagcttccaccagagccagcacagaaagagcgtgagacccggcgccagctacaagagacagaacgagggcaaccccgagagagacaaggagagacccgtgcagagcctgaagaccagcagagacaccagccccagcagcggcagcgccgtgagcagcagcaaggtgctggacaagcccagcagactgaccgagaaggagctggccgaggccgccagcaagtgggccgccgagaagctggagaagagcgacgagagcaacctgcccgagatcagcgagtacgaggccggcagcaccgcccccctgttcaccgaccagcccgaggagcccgagagcaacaccacccacggcatcgagctgttcgaggacagccagctgaccaccagaagcaaggccatcgccagcaagaccaaggagatcgagcaggtgtacagacaggactgcgagaccttcggcatggtggtgaagatgctgatcgagaaggaccccagcctggagaagagcatccagttcgccctgagacagaacctgcacgagatcggcgagagatgcgtggaggagctgaagcacttcatcgccgagtacgacaccagcacccaggacttcggcgagcccttctag

SEQ ID NO: 92775 - DNA, 1377 bp, Artificial Sequence
  Description of Artificial Sequence: Synthetic coding sequence
atgtggagcgagggcagatacgagtacgagagaatccccagagagagagccccccccagaagccaccccagcgacggctacaacagactggtgaacatcgtgcccaagaagccccccctgctggacagacccggcgagggcagctacaacagatactacagccacgtggactacagagactacgacgagggcagaagcttcagccacgacagaagaagcggccccccccacagaggcgacgagagcggctacagatggaccagagacgaccacagcgccagcagacagcccgagtacagagacatgagagacggcttcagaagaaagagcttctacagcagccactacgccagagagagaagcccctacaagagagacaacaccttcttcagagagagccccgtgggcagaaaggacagcccccacagcagaagcggcagcagcgtgagcagcagaagctacagccccgagagaagcaagagctacagcttccaccagagccagcacagaaagagcgtgagacccggcgccagctacaagagacagaacgagggcaaccccgagagagacaaggagagacccgtgcagagcctgaagaccagcagagacaccagccccagcagcggcagcgccgtgagcagcagcaaggtgctggacaagcccagcagactgaccgagaaggagctggccgaggccgccagcaagtgggccgccgagaagctggagaagagcgacgagagcaacctgcccgagatcagcgagtacgaggccggcagcaccgcccccctgttcaccgaccagcccgaggagcccgagagcaacaccacccacggcatcgagctgttcgaggacagccagctgaccaccagaagcaaggccatcgccagcaagaccaaggagatcgagcaggtgtacagacaggactgcgagaccttcggcatggtggtgaagatgctgatcgagaaggaccccagcctggagaagagcatccagttcgccctgagacagaacctgcacgagatcgagagcgccggccagacctggcagcaggtgccccccgtgagaaacaccgagatggaccacgacggcacccccgagaacgagggcgaggagaccgcccagagcgccccccagcccccccaggccccccagcccctgcagcccagaaagaagagagtgagaagaaccacccagctgagaagaaccaccggcgcccccgacatcacctggggcatgctgaagaagaccacccaggaggccgagagaatcctgctgagaacccagacccccttcacccccgagaacctgttcctggccatgctgagcgtggtgcactgcaacagcagaaaggacgtgaagcccgagaacaagcagtag

SEQ ID NO: 92776 - DNA, 1125 bp, Artificial Sequence
  Description of Artificial Sequence: Synthetic coding sequence
atggcctacagaagagacgagatgtggagcgagggcagatacgagtacgagagaatccccagagagagagccccccccagaagccaccccagcgacggctacaacagactggtgaacatcgtgcccaagaagccccccctgctggacagacccggcgagggcagctacaacagatactacagccacgtggactacagagactacgacgagggcagaagcttcagccacgacagaagaagcggccccccccacagaggcgacgagagcggctacagatggaccagagacgaccacagcgccagcagacagcccgagtacagagacatgagagacggcttcagaagaaagagcttctacagcagccactacgccagagagagaagcccctacaagagagacaacaccttcttcagagagagccccgtgggcagaaaggacagcccccacagcagaagcggcagcagcgtgagcagcagaagctacagccccgagagaagcaagagctacagcttccaccagagccagcacagaaagagcgtgagacccggcgccagctacaagagacagaacgagggcaaccccgagagagacaaggagagacccgtgcagagcctgaagaccagcagagacaccagccccagcagcggcagcgccgtgagcagcagcaaggtgctggacaagcccagcagactgaccgagaaggagctggccgaggccgccagcaagtgggccgccgagaagctggagaagagcgacgagagcaacctgcccgagatcagcgagtacgaggccggcagcaccgcccccctgttcaccgaccagcccgaggagcccgagagcaacaccacccacggcatcgagctgttcgaggacagccagctgaccaccagaagcaaggccatcgccagcaagaccaaggagatcgagcaggtgtacagacaggactgcgagaccttcggcatggtggtgaagatgctgatcgagaaggaccccagcctggagaagagcatccagttcgccctgagacagaacctgcacgagatcggcgagagatgcgtggaggagctgaagcacttcatcgccgagtacgacaccagcacccaggacttcggcgagcccttctag

SEQ ID NO: 92777 - DNA, 1305 bp, Artificial Sequence
  Description of Artificial Sequence: Synthetic coding sequence
atgtggagcgagggcagatacgagtacgagagaatccccagagagagagccccccccagaagccaccccagcgacgagagcggctacagatggaccagagacgaccacagcgccagcagacagcccgagtacagagacatgagagacggcttcagaagaaagagcttctacagcagccactacgccagagagagaagcccctacaagagagacaacaccttcttcagagagagccccgtgggcagaaaggacagcccccacagcagaagcggcagcagcgtgagcagcagaagctacagccccgagagaagcaagagctacagcttccaccagagccagcacagaaagagcgtgagacccggcgccagctacaagagacagaacgagggcaaccccgagagagacaaggagagacccgtgcagagcctgaagaccagcagagacaccagccccagcagcggcagcgccgtgagcagcagcaaggtgctggacaagcccagcagactgaccgagaaggagctggccgaggccgccagcaagtgggccgccgagaagctggagaagagcgacgagagcaacctgcccgagatcagcgagtacgaggccggcagcaccgcccccctgttcaccgaccagcccgaggagcccgagagcaacaccacccacggcatcgagctgttcgaggacagccagctgaccaccagaagcaaggccatcgccagcaagaccaaggagatcgagcaggtgtacagacaggactgcgagaccttcggcatggtggtgaagatgctgatcgagaaggaccccagcctggagaagagcatccagttcgccctgagacagaacctgcacgagatcgagagcgccggccagacctggcagcaggtgccccccgtgagaaacaccgagatggaccacgacggcacccccgagaacgagggcgaggagaccgcccagagcgccctgttcggcttccagcacgacgccagcaaccacaccatcgtgggcctgggccccaaccaggtgcccgagatgaaggagaccaccctgcaggccccccagcccccccaggccccccagcccctgcagcccagaaagaagagagtgagaagaaccacccagctgagaagaaccaccggcgcccccgacatcacctggggcatgctgaagaagaccacccaggaggccgagagaatcctgctgagaacccagacccccttcacccccgagaacctgttcctggccatgctgagcgtggtgcactgcaacagcagaaaggacgtgaagcccgagaacaagcagtag

SEQ ID NO: 92778 - DNA, 1047 bp, Artificial Sequence
  Description of Artificial Sequence: Synthetic coding sequence
atgtggagcgagggcagatacgagtacgagagaatccccagagagagagccccccccagaagccaccccagcgacggctacaacagactggtgaacatcgtgcccaagaagccccccctgctggacagacccggcgagggcagctacaacagatactacagccacgtggactacagagactacgacgagggcagaagcttcagccacgacagaagaagcggccccccccacagaggcgacgagagcggctacagatggaccagagacgaccacagcgccagcagacagcccgagtacagagacatgagagacggcttcagaagaaagagcttctacagcagccactacgccagagagagaagcccctacaagagagacaacaccttcttcagagagagccccgtgggcagaaaggacagcccccacagcagaagcggcagcagcgtgagcagcagaagctacagccccgagagaagcaagagctacagcttccaccagagccagcacagaaacaaggagagacccgtgcagagcctgaagaccagcagagacaccagccccagcagcggcagcgccgtgagcagcagcaaggtgctggacaagcccagcagactgaccgagaaggagctggccgaggccgccagcaagtgggccgccgagaagctggagaagagcgacgagagcaacctgcccgagatcagcgagtacgaggccggcagcaccgcccccctgttcaccgaccagcccgaggagcccgagagcaacaccacccacggcatcgagctgttcgaggacagccagctgaccaccagaagcaaggccatcgccagcaagaccaaggagatcgagcaggtgtacagacaggactgcgagaccttcggcatggtggtgaagatgctgatcgagaaggaccccagcctggagaagagcatccagttcgccctgagacagaacctgcacgagatcggcgagagatgcgtggaggagctgaagcacttcatcgccgagtacgacaccagcacccaggacttcggcgagcccttctag

SEQ ID NO: 92779 - DNA, 486 bp, Artificial Sequence
  Description of Artificial Sequence: Synthetic coding sequence
atggcctacagaagagacgagatgtggagcgagggcagatacgagtacgagagaatccccagagagagagccccccccagaagccaccccagcgacggctacaacagactggtgaacatcgtgcccaagaagccccccctgctggacagacccggcgagggcagctacaacagatactacagccacgtggactacagagactacgacgagggcagaagcttcagccacgacagaagaagcggccccccccacagaggcgacgagagcggctacagatggaccagagacgaccacagcgccagcagacagcccgagtacagagacatgagagacggcttcagaagaaagagcttctacagcagccactacgccagagagagaagcccctacaagagagacaacaccttcttcagagagagccccgtgggcagaaaggacagcccccacagcagaagcggcagcagcgtgagcagcagaagctactag

SEQ ID NO: 92780 - DNA, 507 bp, Artificial Sequence
  Description of Artificial Sequence: Synthetic coding sequence
atgtggagcgagggcagatacgagtacgagagaatccccagagagagagccccccccagaagccaccccagcgacggctacaacagactggtgaacatcgtgcccaagaagccccccctgctggacagacccggcgagggcagctacaacagatactacagccacgtggactacagagactacgacgagggcagaagcttcagccacgacagaagaagcggccccccccacagaggcgacgagagcggctacagatggaccagagacgaccacagcgccagcagacagcccgagtacagagacatgagagacggcttcagaagaaagagcttctacagcagccactacgccagagagagaagcccctacaagagagacaacaccttcttcagagagagccccgtgggcagaaaggacagcccccacagcagaagcggcagcagcgtgagcagcagaagctacagccccgagagaagcaagagctacagcttccaccagagccagtag

SEQ ID NO: 92781 - DNA, 960 bp, Artificial Sequence
  Description of Artificial Sequence: Synthetic coding sequence
atggcctacagaagagacgagatgtggagcgagggcagatacgagtacgagagaatccccagagagagagccccccccagaagccaccccagcgacgagagcggctacagatggaccagagacgaccacagcgccagcagacagcccgagtacagagacatgagagacggcttcagaagaaagagcttctacagcagccactacgccagagagagaagcccctacaagagagacaacaccttcttcagagagagccccgtgggcagaaaggacagcccccacagcagaagcggcagcagcgtgagcagcagaagctacagccccgagagaagcaagagctacagcttccaccagagccagcacagaaagagcgtgagacccggcgccagctacaagagacagaacgagggcaaccccgagagagacaaggagagacccgtgcagagcctgaagaccagcagagacaccagccccagcagcggcagcgccgtgagcagcagcaaggtgctggacaagcccagcagactgaccgagaaggagctggccgaggccgccagcaagtgggccgccgagaagctggagaagagcgacgagagcaacctgcccgagatcagcgagtacgaggccggcagcaccgcccccctgttcaccgaccagcccgaggagcccgagagcaacaccacccacggcatcgagctgttcgaggacagccagctgaccaccagaagcaaggccatcgccagcaagaccaaggagatcgagcaggtgtacagacaggactgcgagaccttcggcatggtggtgaagatgctgatcgagaaggaccccagcctggagaagagcatccagttcgccctgagacagaacctgcacgagatcggcgagagatgcgtggaggagctgaagcacttcatcgccgagtacgacaccagcacccaggacttcggcgagcccttctag

SEQ ID NO: 92782 - DNA, 5271 bp, Artificial Sequence
  Description of Artificial Sequence: Synthetic coding sequence
atgaacagcctgttcagaaagagaaacaagggcaagtacagccccaccgtgcagaccagaagcatcagcaacaaggagctgagcgagctgatcgagcagctgcagaagaacgccgaccaggtggagaagaacatcgtggacaccgaggccaagatgcagagcgacctggccagactgcaggagggcagacagcccgagcacagagacgtgaccctgcagaaggtgctggacagcgagaagctgctgtacgtgctggaggccgacgccgccatcgccaagcacatgaagcacccccagggcgacatgatcgccgaggacatcagacagctgaaggagagagtgaccaacctgagaggcaagcacaagcagatctacagactggccgtgaaggaggtggacccccaggtgaactgggccgccctggtggaggagaagctggacaagctgaacaaccagagcttcggcaccgacctgcccctggtggaccaccaggtggaggagcacaacatcttccacaacgaggtgaaggccatcggcccccacctggccaaggacggcgacaaggagcagaacagcgagctgagagccaagtaccagaagctgctggccgccagccaggccagacagcagcacctgagcagcctgcaggactacatgcagagatgcaccaacgagctgtactggctggaccagcaggccaagggcagaatgcagtacgactggagcgacagaaacctggactaccccagcagaagaagacagtacgagaacttcatcaacagaaacctggaggccaaggaggagagaatcaacaagctgcacagcgagggcgaccagctgctggccgccgagcaccccggcagaaacagcatcgaggcccacatggaggccgtgcacgccgactggaaggagtacctgaacctgctgatctgcgaggagagccacctgaagtacatggaggactaccaccagttccacgaggacgtgaaggacgcccaggagctgctgagaaaggtggacagcgacctgaaccagaagtacggccccgacttcaaggacagataccagatcgagctgctgctgagagagctggacgaccaggagaaggtgctggacaagtacgaggacgtggtgcagggcctgcagaagagaggccagcaggtggtgcccctgaagtacagaagagagacccccctgaagcccatccccgtggaggccctgtgcgacttcgagggcgagcagggcctgatcagcagaggctacagctacaccctgcagaagaacaacggcgagagctgggagctgatggacagcgccggcaacaagctgatcgcccccgccgtgtgcttcgtgatcccccccaccgaccccgaggccctggccctggccgacagcctgggcagccagtacagaagcgtgagacagaaggccgccggcagcaagagaaccctgcagcagagatacgaggtgctgaagaccgagaaccccggcgacgccagcgacctgcagggcagacagctgctggccggcctggacaaggtggccagcgacctggacagacaggagaaggccatcaccggcatcctgagaccccccctggagcagggcagagccgtgcaggacagcgccgagagagccaaggacctgaagaacatcaccaacgagctgctgagaatcgagcccgagaagaccagaagcaccgccgagggcgaggccttcatccaggccctgcccggcagcggcaccacccccctgctgagaaccagagtggaggacaccaacagaaagtacgagcacctgctgcagctgctggacctggcccaggagaaggtggacgtggccaacagactggagaagagcctgcagcagagctgggagctgctggccacccacgagaaccacctgaaccaggacgacaccgtgcccgagagcagcagagtgctggacagcaagggccaggagctggccgccatggcctgcgagctgcaggcccagaagagcctgctgggcgaggtggagcagaacctgcaggccgccaagcagtgcagcagcaccctggccagcagattccaggagcactgccccgacctggagagacaggaggccgaggtgcacaagctgggccagagattcaacaacctgagacagcaggtggagagaagagcccagagcctgcagagcgccaaggccgcctacgagcacttccacagaggccacgaccacgtgctgcagttcctggtgagcatccccagctacgagccccaggagaccgacagcctgagccagatggagaccaagctgaagaaccagaagaacctgctggacgagatcgccagcagagagcaggaggtgcagaagatctgcgccaacagccagcagtaccagcaggccgtgaaggactacgagctggaggccgagaagctgagaagcctgctggacctggagaacggcagaagaagccacgtgagcaagagagccagactgcagagccccgccaccaaggtgaaggaggaggaggccgccctggccgccaagttcaccgaggtgtacgccatcaacagacagagactgcagaacctggagttcgccctgaacctgctgagacagcagcccgaggtggaggtgacccacgagaccctgcagagaaacagacccgacagcggcgtggaggaggcctggaagatcagaaaggagctggacgaggagaccgagagaagaagacagctggagaacgaggtgaagagcacccaggaggagatctggaccctgagaaaccagggcccccaggagagcgtggtgagaaaggaggtgctgaagaaggtgcccgaccccgtgctggaggagagcttccagcagctgcagagaaccctggccgaggagcagcacaagaaccagctgctgcaggaggagctggaggccctgcagctgcagctgagagccctggagcaggagaccagagacggcggccaggagtacgtggtgaaggaggtgctgagaatcgagcccgacagagcccaggccgacgaggtgctgcagctgagagaggagctggaggccctgagaagacagaagggcgccagagaggccgaggtgctgctgctgcagcagagagtggccgccctggccgaggagaagagcagagcccaggagaaggtgaccgagaaggaggtggtgaagctgcagaacgacccccagctggaggccgagtaccagcagctgcaggaggaccaccagagacaggaccagctgagagagaagcaggaggaggagctgagcttcctgcaggacaagctgaagagactggagaaggagagagccatggccgagggcaagatcaccgtgaaggaggtgctgaaggtggagaaggacgccgccaccgagagagaggtgagcgacctgaccagacagtacgaggacgaggccgccaaggccagagccagccagagagagaagaccgagctgctgagaaagatctgggccctggaggaggagaacgccaaggtggtggtgcaggagaaggtgagagagatcgtgagacccgaccccaaggccgagagcgaggtggccaacctgagactggagctggtggagcaggagagaaagtacagaggcgccgaggagcagctgagaagctaccagagcgagctggaggccctgagaagaagaggcccccaggtggaggtgaaggaggtgaccaaggaggtgatcaagtacaagaccgaccccgagatggagaaggagctgcagagactgagagaggagatcgtggacaagaccagactgatcgagagatgcgacctggagatctaccagctgaagaaggagatccaggccctgaaggacaccaagccccaggtgcagaccaaggaggtggtgcaggagatcctgcagttccaggaggacccccagaccaaggaggaggtggccagcctgagagccaagctgagcgaggagcagaagaagcaggtggacctggagagagagagagccagccaggaggagcagatcgccagaaaggaggaggagctgagcagagtgaaggagagagtggtgcagcaggaggtggtgagatacgaggaggagcccggcctgagagccgaggccagcgccttcgccgagagcatcgacgtggagctgagacagatcgacaagctgagagccgagctgagaagactgcagagaagaagaaccgagctggagagacagctggaggagctggagagagagagacaggccagaagagaggccgagagagaggtgcagagactgcagcagagactggccgccctggagcaggaggaggccgaggccagagagaaggtgacccacacccagaaggtggtgctgcagcaggacccccagcaggccagagagcacgccctgctgagactgcagctggaggaggagcagcacagaagacagctgctggagggcgagctggagaccctgagaagaaagctggccgccctggagaaggccgaggtgaaggagaaggtggtgctgagcgagagcgtgcaggtggagaagggcgacaccgagcaggagatccagagactgaagagcagcctggaggaggagagcagaagcaagagagagctggacgtggaggtgagcagactggaggccagactgagcgagctggagttccacaacagcaagagcagcaaggagctggacttcctgagagaggagaaccacaagctgcagctggagagacagaacctgcagctggagaccagaagactgcagagcgagatcaacatggccgccaccgagaccagagacctgagaaacatgaccgtggccgacagcggcaccaaccacgacagcagactgtggagcctggagagagagctggacgacctgaagagactgagcaaggacaaggacctggagatcgacgagctgcagaagagactgggcagcgtggccgtgaagagagagcagagagagaaccacctgagaagaagcatcgtggtgatccaccccgacaccggcagagagctgagccccgaggaggcccacagagccggcctgatcgactggaacatgttcgtgaagctgagaagccaggagtgcgactgggaggagatcagcgtgaagggccccaacggcgagagcagcgtgatccacgacagaaagagcggcaagaagttcagcatcgaggaggccctgcagagcggcagactgacccccgcccagtacgacagatacgtgaacaaggacatgagcatccaggagctggccgtgctggtgagcggccagaagtag

SEQ ID NO: 92783 - DNA, 4440 bp, Artificial Sequence
  Description of Artificial Sequence: Synthetic coding sequence
atggccaagagaagcagaggccccggcagaagatgcctgctggccctggtgctgttctgcgcctggggcaccctggccgtggtggcccagaagcccggcgccggctgccccagcagatgcctgtgcttcagaaccaccgtgagatgcatgcacctgctgctggaggccgtgcccgccgtggccccccagaccagcatcctggacctgagattcaacagaatcagagagatccagcccggcgccttcagaagactgagaaacctgaacaccctgctgctgaacaacaaccagatcaagagaatccccagcggcgccttcgaggacctggagaacctgaagtacctgtacctgtacaagaacgagatccagagcatcgacagacaggccttcaagggcctggccagcctggagcagctgtacctgcacttcaaccagatcgagaccctggaccccgacagcttccagcacctgcccaagctggagagactgttcctgcacaacaacagaatcacccacctggtgcccggcaccttcaaccacctggagagcatgaagagactgagactggacagcaacaccctgcactgcgactgcgagatcctgtggctggccgacctgctgaagacctacgccgagagcggcaacgcccaggccgccgccatctgcgagtaccccagaagaatccagggcagaagcgtggccaccatcacccccgaggagctgaactgcgagagacccagaatcaccagcgagccccaggacgccgacgtgaccagcggcaacaccgtgtacttcacctgcagagccgagggcaaccccaagcccgagatcatctggctgagaaacaacaacgagctgagcatgaagaccgacagcagactgaacctgctggacgacggcaccctgatgatccagaacacccaggagaccgaccagggcatctaccagtgcatggccaagaacgtggccggcgaggtgaagacccaggaggtgaccctgagatacttcggcagccccgccagacccaccttcgtgatccagccccagaacaccgaggtgctggtgggcgagagcgtgaccctggagtgcagcgccaccggccaccccccccccagaatcagctggaccagaggcgacagaacccccctgcccgtggaccccagagtgaacatcacccccagcggcggcctgtacatccagaacgtggtgcagggcgacagcggcgagtacgcctgcagcgccaccaacaacatcgacagcgtgcacgccaccgccttcatcatcgtgcaggccctgccccagttcaccgtgaccccccaggacagagtggtgatcgagggccagaccgtggacttccagtgcgaggccaagggcaaccccccccccgtgatcgcctggaccaagggcggcagccagctgagcgtggacagaagacacctggtgctgagcagcggcaccctgagaatcagcggcgtggccctgcacgaccagggccagtacgagtgccaggccgtgaacatcatcggcagccagaaggtggtggcccacctgaccgtgcagcccagagtgacccccgtgttcgccagcatccccagcgacaccaccgtggaggtgggcgccaacgtgcagctgccctgcagcagccagggcgagcccgagcccgccatcacctggaacaaggacggcgtgcaggtgaccgagagcggcaagttccacatcagccccgagggcttcctgaccatcaacgacgtgggccccgccgacgccggcagatacgagtgcgtggccagaaacaccatcggcagcgccagcgtgagcatggtgctgagcgtgaacgtgcccgacgtgagcagaaacggcgaccccttcgtggccaccagcatcgtggaggccatcgccaccgtggacagagccatcaacagcaccagaacccacctgttcgacagcagacccagaagccccaacgacctgctggccctgttcagataccccagagacccctacaccgtggagcaggccagagccggcgagatcttcgagagaaccctgcagctgatccaggagcacgtgcagcacggcctgatggtggacctgaacggcaccagctaccactacaacgacctggtgagcccccagtacctgaacctgatcgccaacctgagcggctgcaccgcccacagaagagtgaacaactgcagcgacatgtgcttccaccagaagtacagaacccacgacggcacctgcaacaacctgcagcaccccatgtggggcgccagcctgaccgccttcgagagactgctgaagagcgtgtacgagaacggcttcaacacccccagaggcatcaacccccacagactgtacaacggccacgccctgcccatgcccagactggtgagcaccaccctgatcggcaccgagaccgtgacccccgacgagcagttcacccacatgctgatgcagtggggccagttcctggaccacgacctggacagcaccgtggtggccctgagccaggccagattcagcgacggccagcactgcagcaacgtgtgcagcaacgaccccccctgcttcagcgtgatgatcccccccaacgacagcagagccagaagcggcgccagatgcatgttcttcgtgagaagcagccccgtgtgcggcagcggcatgaccagcctgctgatgaacagcgtgtaccccagagagcagatcaaccagctgaccagctacatcgacgccagcaacgtgtacggcagcaccgagcacgaggccagaagcatcagagacctggccagccacagaggcctgctgagacagggcatcgtgcagagaagcggcaagcccctgctgcccttcgccaccggcccccccaccgagtgcatgagagacgagaacgagagccccatcccctgcttcctggccggcgaccacagagccaacgagcagctgggcctgaccagcatgcacaccctgtggttcagagagcacaacagaatcgccaccgagctgctgaagctgaacccccactgggacggcgacaccatctactacgagaccagaaagatcgtgggcgccgagatccagcacatcacctaccagcactggctgcccaagatcctgggcgaggtgggcatgagaaccctgggcgagtaccacggctacgaccccggcatcaacgccggcatcttcaacgccttcgccaccgccgccttcagattcggccacaccctggtgaaccccctgctgtacagactggacgagaacttccagcccatcgcccaggaccacctgcccctgcacaaggccttcttcagccccttcagaatcgtgaacgagggcggcatcgaccccctgctgagaggcctgttcggcgtggccggcaagatgagagtgcccagccagctgctgaacaccgagctgaccgagagactgttcagcatggcccacaccgtggccctggacctggccgccatcaacatccagagaggcagagaccacggcatccccccctaccacgactacagagtgtactgcaacctgagcgccgcccacaccttcgaggacctgaagaacgagatcaagaaccccgagatcagagagaagctgaagagactgtacggcagcaccctgaacatcgacctgttccccgccctggtggtggaggacctggtgcccggcagcagactgggccccaccctgatgtgcctgctgagcacccagttcaagagactgagagacggcgacagactgtggtacgagaaccccggcgtgttcagccccgcccagctgacccagatcaagcagaccagcctggccagaatcctgtgcgacaacgccgacaacatcaccagagtgcagagcgacgtgttcagagtggccgagttcccccacggctacggcagctgcgacgagatccccagagtggacctgagagtgtggcaggactgctgcgaggactgcagaaccagaggccagttcaacgccttcagctaccacttcagaggcagaagaagcctggagttcagctaccaggaggacaagcccaccaagaagaccagacccagaaagatccccagcgtgggcagacagggcgagcacctgagcaacagcaccagcgccttcagcaccagaagcgacgccagcggcaccaacgacttcagagagttcgtgctggagatgcagaagaccatcaccgacctgagaacccagatcaagaagctggagagcagactgagcaccaccgagtgcgtggacgccggcggcgagagccacgccaacaacaccaagtggaagaaggacgcctgcaccatctgcgagtgcaaggacggccaggtgacctgcttcgtggaggcctgcccccccgccacctgcgccgtgcccgtgaacatccccggcgcctgctgccccgtgtgcctgcagaagagagccgaggagaagccctag

SEQ ID NO: 92784 - DNA, 2172 bp, Artificial Sequence
  Description of Artificial Sequence: Synthetic coding sequence
tgaagaggccccggcagaagatgcctgctggccctggtgctgttctgcgcctggggcaccctggccgtggtggcccagaagcccggcgccggctgccccagcagatgcctgtgcttcagaaccaccgtgagatgcatgcacctgctgctggaggccgtgcccgccgtggccccccagaccagcatcctggacctgagattcaacagaatcagagagatccagcccggcgccttcagaagactgagaaacctgaacaccctgctgctgaacaacaaccagatcaagagaatccccagcggcgccttcgaggacctggagaacctgaagtacctgtacctgtacaagaacgagatccagagcatcgacagacaggccttcaagggcctggccagcctggagcagctgtacctgcacttcaaccagatcgagaccctggaccccgacagcttccagcacctgcccaagctggagagactgttcctgcacaacaacagaatcacccacctggtgcccggcaccttcaaccacctggagagcatgaagagactgagactggacagcaacaccctgcactgcgactgcgagatcctgtggctggccgacctgctgaagacctacgccgagagcggcaacgcccaggccgccgccatctgcgagtaccccagaagaatccagggcagaagcgtggccaccatcacccccgaggagctgaactgcgagagacccagaatcaccagcgagccccaggacgccgacgtgaccagcggcaacaccgtgtacttcacctgcagagccgagggcaaccccaagcccgagatcatctggctgagaaacaacaacgagctgagcatgaagaccgacagcagactgaacctgctggacgacggcaccctgatgatccagaacacccaggagaccgaccagggcatctaccagtgcatggccaagaacgtggccggcgaggtgaagacccaggaggtgaccctgagatacttcggcagccccgccagacccaccttcgtgatccagccccagaacaccgaggtgctggtgggcgagagcgtgaccctggagtgcagcgccaccggccaccccccccccagaatcagctggaccagaggcgacagaacccccctgcccgtggaccccagagtgaacatcacccccagcggcggcctgtacatccagaacgtggtgcagggcgacagcggcgagtacgcctgcagcgccaccaacaacatcgacagcgtgcacgccaccgccttcatcatcgtgcaggccctgccccagttcaccgtgaccccccaggacagagtggtgatcgagggccagaccgtggacttccagtgcgaggccaagggcaaccccccccccgtgatcgcctggaccaagggcggcagccagctgagcgtggacagaagacacctggtgctgagcagcggcaccctgagaatcagcggcgtggccctgcacgaccagggccagtacgagtgccaggccgtgaacatcatcggcagccagaaggtggtggcccacctgaccgtgcagcccagagtgacccccgtgttcgccagcatccccagcgacaccaccgtggaggtgggcgccaacgtgcagctgccctgcagcagccagggcgagcccgagcccgccatcacctggaacaaggacggcgtgcaggtgaccgagagcggcaagttccacatcagccccgagggcttcctgaccatcaacgacgtgggccccgccgacgccggcagatacgagtgcgtggccagaaacaccatcggcagcgccagcgtgagcatggtgctgagcgtgaacgtgcccgacgtgagcagaaacggcgaccccttcgtggccaccagcatcgtggaggccatcgccaccgtggacagagccatcaacagcaccagaacccacctgttcgacagcagacccagaagccccaacgacctgctggccctgttcagataccccagagacccctacaccgtggagcaggccagagccggcgagatcttcgagagaaccctgcagctgatccaggagcacgtgcagcacggcctgatggtggacctgaacggcaccagccagtgccagagcctgttcttcctgctgcacggcctgagcaacggcgtggagcacgccagcgtgaagagccacagctag

SEQ ID NO: 92785 - DNA, 771 bp, Artificial Sequence
  Description of Artificial Sequence: Synthetic coding sequence
atggccgccgccgtgggcagactgctgagagccagcgtggccagacacgtgagcgccatcccctggggcatcagcgccaccgccgccctgagacccgccgcctgcggcagaaccagcctgaccaacctgctgtgcagcggcagcagccaggccaagctgttcagcaccagcagcagctgccacgcccccgccgtgacccagcacgccccctacttcaagggcaccgccgtggtgaacggcgagttcaaggacctgagcctggacgacttcaagggcaagtacctggtgctgttcttctaccccctggacttcaccttcgtgtgccccaccgagatcgtggccttcagcgacaaggccaacgagttccacgacgtgaactgcgaggtggtggccgtgagcgtggacagccacttcagccacctggcctggatcaacacccccagaaagaacggcggcctgggccacatgaacatcgccctgctgagcgacctgaccaagcagatcagcagagactacggcgtgctgctggagggcagcggcctggccctgagaggcctgttcatcatcgaccccaacggcgtgatcaagcacctgagcgtgaacgacctgcccgtgggcagaagcgtggaggagaccctgagactggtgaaggccttccagtacgtggagacccacggcgaggtgtgccccgccaactggacccccgacagccccaccatcaagcccagccccgccgccagcaaggagtacttccagaaggtgaaccagtag

SEQ ID NO: 92786 - DNA, 717 bp, Artificial Sequence
  Description of Artificial Sequence: Synthetic coding sequence
atggccgccgccgtgggcagactgctgagagccagcgtggccagacacgtgagcgccatcccctggggcatcagcgccaccgccgccctgagacccgccgcctgcggcagaaccagcctgaccaacctgctgtgcagcggcagcagccaggccccctacttcaagggcaccgccgtggtgaacggcgagttcaaggacctgagcctggacgacttcaagggcaagtacctggtgctgttcttctaccccctggacttcaccttcgtgtgccccaccgagatcgtggccttcagcgacaaggccaacgagttccacgacgtgaactgcgaggtggtggccgtgagcgtggacagccacttcagccacctggcctggatcaacacccccagaaagaacggcggcctgggccacatgaacatcgccctgctgagcgacctgaccaagcagatcagcagagactacggcgtgctgctggagggcagcggcctggccctgagaggcctgttcatcatcgaccccaacggcgtgatcaagcacctgagcgtgaacgacctgcccgtgggcagaagcgtggaggagaccctgagactggtgaaggccttccagtacgtggagacccacggcgaggtgtgccccgccaactggacccccgacagccccaccatcaagcccagccccgccgccagcaaggagtacttccagaaggtgaaccagtag

SEQ ID NO: 92787 - DNA, 645 bp, Artificial Sequence
  Description of Artificial Sequence: Synthetic coding sequence
atgggcctggccggcgtgtgcgccctgagaagaagcgccggctacatcctggtgggcggcgccggcggccagagcgccgccgccgccgccagaagatacagcgagggcgagtgggccagcggcggcgtgagaagcttcagcagagccgccgccgccatggcccccatcaaggtgggcgacgccatccccgccgtggaggtgttcgagggcgagcccggcaacaaggtgaacctggccgagctgttcaagggcaagaagggcgtgctgttcggcgtgcccggcgccttcacccccggctgcagcaagacccacctgcccggcttcgtggagcaggccgaggccctgaaggccaagggcgtgcaggtggtggcctgcctgagcgtgaacgacgccttcgtgaccggcgagtggggcagagcccacaaggccgagggcaaggtgagactgctggccgaccccaccggcgccttcggcaaggagaccgacctgctgctggacgacagcctggtgagcatcttcggcaacagaagactgaagagattcagcatggtggtgcaggacggcatcgtgaaggccctgaacgtggagcccgacggcaccggcctgacctgcagcctggcccccaacatcatcagccagctgtag

SEQ ID NO: 92788 - DNA, 378 bp, Artificial Sequence
  Description of Artificial Sequence: Synthetic coding sequence
atgggcctggccggcgtgtgcgccctgagaagaagcgccggctacatcctggtgggcggcgccggcggccagagcgccgccgccgccgccagaagatacagcgagggcgagtgggccagcggcggcgtgagaagcttcagcagagccgccgccgccatggcccccatcaaggtgagactgctggccgaccccaccggcgccttcggcaaggagaccgacctgctgctggacgacagcctggtgagcatcttcggcaacagaagactgaagagattcagcatggtggtgcaggacggcatcgtgaaggccctgaacgtggagcccgacggcaccggcctgacctgcagcctggcccccaacatcatcagccagctgtag

SEQ ID NO: 92789 - DNA, 513 bp, Artificial Sequence
  Description of Artificial Sequence: Synthetic coding sequence
atgggcctggccggcgtgtgcgccctgagaagaagcgccggctacatcctggtgggcggcgccggcggccagagcgccgccgccgccgccagaagatacagcgagggcgagtgggccagcggcggcgtgagaagcttcagcagagccgccgccgccatggcccccatcaaggtgggcgacgccatccccgccgtggaggtgttcgagggcgagcccggcaacaaggtgaacctggccgagctgttcaagggcaagaagggcgtgctgttcggcgtgcccggcgccttcacccccggctgcagcaaggtgagactgctggccgaccccaccggcgccttcggcaaggagaccgacctgctgctggacgacagcctggtgagcatcttcggcaacagaagactgaagagattcagcatggtggtgcaggacggcatcgtgaaggccctgaacgtggagcccgacggcaccggcctgacctgcagcctggcccccaacatcatcagccagctgtag

SEQ ID NO: 92790 - DNA, 675 bp, Artificial Sequence
  Description of Artificial Sequence: Synthetic coding sequence
atgcccggcggcctgctgctgggcgacgtggcccccaacttcgaggccaacaccaccgtgggcagaatcagattccacgacttcctgggcgacagctggggcatcctgttcagccaccccagagacttcacccccgtgtgcaccaccgagctgggcagagccgccaagctggcccccgagttcgccaagagaaacgtgaagctgatcgccctgagcatcgacagcgtggaggaccacctggcctggagcaaggacatcaacgcctacaactgcgaggagcccaccgagaagctgcccttccccatcatcgacgacagaaacagagagctggccatcctgctgggcatgctggaccccgccgagaaggacgagaagggcatgcccgtgaccgccagagtggtgttcgtgttcggccccgacaagaagctgaagctgagcatcctgtaccccgccaccaccggcagaaacttcgacgagatcctgagagtggtgatcagcctgcagctgaccgccgagaagagagtggccacccccgtggactggaaggacggcgacagcgtgatggtgctgcccaccatccccgaggaggaggccaagaagctgttccccaagggcgtgttcaccaaggagctgcccagcggcaagaagtacctgagatacaccccccagccctag

SEQ ID NO: 92791 - DNA, 3852 bp, Artificial Sequence
  Description of Artificial Sequence: Synthetic coding sequence
atgtggggcagcgacagactggccggcgccggcggcggcggcgccgccgtgaccgtggccttcaccaacgccagagactgcttcctgcacctgcccagaagactggtggcccagctgcacctgctgcagaaccaggccatcgaggtggtgtggagccaccagcccgccttcctgagctgggtggagggcagacacttcagcgaccagggcgagaacgtggccgagatcaacagacaggtgggccagaagctgggcctgagcaacggcggccaggtgttcctgaagccctgcagccacgtggtgagctgccagcaggtggaggtggagcccctgagcgccgacgactgggagatcctggagctgcacgccgtgagcctggagcagcacctgctggaccagatcagaatcgtgttccccaaggccatcttccccgtgtgggtggaccagcagacctacatcttcatccagatcgtggccctgatccccgccgccagctacggcagactggagaccgacaccaagctgctgatccagcccaagaccagaagagccaaggagaacaccttcagcaaggccgacgccgagtacaagaagctgcacagctacggcagagaccagaagggcatgatgaaggagctgcagaccaagcagctgcagagcaacaccgtgggcatcaccgagagcaacgagaacgagagcgagatccccgtggacagcagcagcgtggccagcctgtggaccatgatcggcagcatcttcagcttccagagcgagaagaagcaggagaccagctggggcctgaccgagatcaacgccttcaagaacatgcagagcaaggtggtgcccctggacaacatcttcagagtgtgcaagagccagccccccagcatctacaacgccagcgccaccagcgtgttccacaagcactgcgccatccacgtgttcccctgggaccaggagtacttcgacgtggagcccagcttcaccgtgacctacggcaagctggtgaagctgctgagccccaagcagcagcagagcaagaccaagcagaacgtgctgagccccgagaaggagaagcagatgagcgagcccctggaccagaagaagatcagaagcgaccacaacgaggaggacgagaaggcctgcgtgctgcaggtggtgtggaacggcctggaggagctgaacaacgccatcaagtacaccaagaacgtggaggtgctgcacctgggcaaggtgtggatccccgacgacctgagaaagagactgaacatcgagatgcacgccgtggtgagaatcacccccgtggaggtgacccccaagatccccagaagcctgaagctgcagcccagagagaacctgcccaaggacatcagcgaggaggacatcaagaccgtgttctacagctggctgcagcagagcaccaccaccatgctgcccctggtgatcagcgaggaggagttcatcaagctggagaccaaggacggcctgaaggagttcagcctgagcatcgtgcacagctgggagaaggagaaggacaagaacatcttcctgctgagccccaacctgctgcagaagaccaccatccaggtgctgctggaccccatggtgaaggaggagaacagcgaggagatcgacttcatcctgcccttcctgaagctgagcagcctgggcggcgtgaacagcctgggcgtgagcagcctggagcacatcacccacagcctgctgggcagacccctgagcagacagctgatgagcctggtggccggcctgagaaacggcgccctgctgctgaccggcggcaagggcagcggcaagagcaccctggccaaggccatctgcaaggaggccttcgacaagctggacgcccacgtggagagagtggactgcaaggccctgagaggcaagagactggagaacatccagaagaccctggaggtggccttcagcgaggccgtgtggatgcagcccagcgtggtgctgctggacgacctggacctgatcgccggcctgcccgccgtgcccgagcacgagcacagccccgacgccgtgcagagccagagactggcccacgccctgaacgacatgatcaaggagttcatcagcatgggcagcctggtggccctgatcgccaccagccagagccagcagagcctgcaccccctgctggtgagcgcccagggcgtgcacatcttccagtgcgtgcagcacatccagccccccaaccaggagcagagatgcgagatcctgtgcaacgtgatcaagaacaagctggactgcgacatcaacaagttcaccgacctggacctgcagcacgtggccaaggagaccggcggcttcgtggccagagacttcaccgtgctggtggacagagccatccacagcagactgagcagacagagcatcagcaccagagagaagctggtgctgaccaccctggacttccagaaggccctgagaggcttcctgcccgccagcctgagaagcgtgaacctgcacaagcccagagacctgggctgggacaagatcggcggcctgcacgaggtgagacagatcctgatggacaccatccagctgcccgccaagtaccccgagctgttcgccaacctgcccatcagacagagaaccggcatcctgctgtacggcccccccggcaccggcaagaccctgctggccggcgtgatcgccagagagagcagaatgaacttcatcagcgtgaagggccccgagctgctgagcaagtacatcggcgccagcgagcaggccgtgagagacatcttcatcagagcccaggccgccaagccctgcatcctgttcttcgacgagttcgagagcatcgcccccagaagaggccacgacaacaccggcgtgaccgacagagtggtgaaccagctgctgacccagctggacggcgtggagggcctgcagggcgtgtacgtgctggccgccaccagcagacccgacctgatcgaccccgccctgctgagacccggcagactggacaagtgcgtgtactgccccccccccgaccaggtgagcagactggagatcctgaacgtgctgagcgacagcctgcccctggccgacgacgtggacctgcagcacgtggccagcgtgaccgacagcttcaccggcgccgacctgaaggccctgctgtacaacgcccagctggaggccctgcacggcatgctgctgagcagcggcctgcaggacggcagcagcagcagcgacagcgacctgagcctgagcagcatggtgttcctgaaccacagcagcggcagcgacgacagcgccggcgacggcgagtgcggcctggaccagagcctggtgagcctggagatgagcgagatcctgcccgacgagagcaagttcaacatgtacagactgtacttcggcagcagctacgagagcgagctgggcaacggcaccagcagcgacctgagcagccagtgcctgagcgcccccagcagcatgacccaggacctgcccggcgtgcccggcaaggaccagctgttcagccagccccccgtgctgagaaccgccagccaggagggctgccaggagctgacccaggagcagagagaccagctgagagccgacatcagcatcatcaagggcagatacagaagccagagcggcgaggacgagagcatgaaccagcccggccccatcaagaccagactggccatcagccagagccacctgatgaccgccctgggccacaccagacccagcatcagcgaggacgactggaagaacttcgccgagctgtacgagagcttccagaaccccaagagaagaaagaaccagagcggcaccatgttcagacccggccagaaggtgaccctggcctag

SEQ ID NO: 92792 - DNA, 3681 bp, Artificial Sequence
  Description of Artificial Sequence: Synthetic coding sequence
atgtggggcagcgacagactggccggcgccggcggcggcggcgccgccgtgaccgtggccttcaccaacgccagagactgcttcctgcacctgcccagaagactggtggcccagctgcacctgctgcagaaccaggccatcgaggtggtgtggagccaccagcccgccttcctgagctgggtggagggcagacacttcagcgaccagggcgagaacgtggccgagatcaacagacaggtgggccagaagctgggcctgagcaacggcggccaggtgttcctgaagccctgcagccacgtggtgagctgccagcaggtggaggtggagcccctgagcgccgacgactgggagatcctggagctgcacgccgtgagcctggagcagcacctgctggaccagatcagaatcgtgttccccaaggccatcttccccgtgtgggtggaccagcagacctacatcttcatccagatcgtggccctgatccccgccgccagctacggcagactggagaccgacaccaagctgctgatccagcccaagaccagaagagccaaggagaacaccttcagcaaggccgacgccgagtacaagaagctgcacagctacggcagagaccagaagggcatgatgaaggagctgcagaccaagcagctgcagagcaacaccgtgggcatcaccgagagcaacgagaacgagagcgagatccccgtggacagcagcagcgtggccagcctgtggaccatgatcggcagcatcttcagcttccagagcgagaagaagcaggagaccagctggggcctgaccgagatcaacgccttcaagaacatgcagagcaaggtggtgcccctggacaacatcttcagagtgtgcaagagccagccccccagcatctacaacgccagcgccaccagcgtgttccacaagcactgcgccatccacgtgttcccctgggaccaggagtacttcgacgtggagcccagcttcaccgtgacctacggcaagctggtgaagctgctgagccccaagcagcagcagagcaagaccaagcagaacgtgctgagccccgagaaggagaagcagatgagcgagcccctggaccagaagaagatcagaagcgaccacaacgaggaggacgagaaggcctgcgtgctgcaggtggtgtggaacggcctggaggagctgaacaacgccatcaagtacaccaagaacgtggaggtgctgcacctgggcaaggtgtggatccccgacgacctgagaaagagactgaacatcgagatgcacgccgtggtgagaatcacccccgtggaggtgacccccaagatccccagaagcctgaagctgcagcccagagagaacctgcccaaggacatcagcgaggaggacatcaagaccgtgttctacagctggctgcagcagagcaccaccaccatgctgcccctggtgatcagcgaggaggagttcatcaagctggagaccaaggacggcctgaaggagttcagcctgagcatcgtgcacagctgggagaaggagaaggacaagaacatcttcctgctgagccccaacctgctgcagaagaccaccatccaggtgctgctggaccccatggtgaaggaggagaacagcgaggagatcgacttcatcctgcccttcctgaagctgagcagcctgggcggcgtgaacagcctgggcgtgagcagcctggagcacatcacccacagcctgctgggcagacccctgagcagacagctgatgagcctggtggccggcctgagaaacggcgccctgctgctgaccggcggcaagggcagcggcaagagcaccctggccaaggccatctgcaaggaggccttcgacaagctggacgcccacgtggagagagtggactgcaaggccctgagagccctgaacgacatgatcaaggagttcatcagcatgggcagcctggtggccctgatcgccaccagccagagccagcagagcctgcaccccctgctggtgagcgcccagggcgtgcacatcttccagtgcgtgcagcacatccagccccccaaccaggagcagagatgcgagatcctgtgcaacgtgatcaagaacaagctggactgcgacatcaacaagttcaccgacctggacctgcagcacgtggccaaggagaccggcggcttcgtggccagagacttcaccgtgctggtggacagagccatccacagcagactgagcagacagagcatcagcaccagagagaagctggtgctgaccaccctggacttccagaaggccctgagaggcttcctgcccgccagcctgagaagcgtgaacctgcacaagcccagagacctgggctgggacaagatcggcggcctgcacgaggtgagacagatcctgatggacaccatccagctgcccgccaagtaccccgagctgttcgccaacctgcccatcagacagagaaccggcatcctgctgtacggcccccccggcaccggcaagaccctgctggccggcgtgatcgccagagagagcagaatgaacttcatcagcgtgaagggccccgagctgctgagcaagtacatcggcgccagcgagcaggccgtgagagacatcttcatcagagcccaggccgccaagccctgcatcctgttcttcgacgagttcgagagcatcgcccccagaagaggccacgacaacaccggcgtgaccgacagagtggtgaaccagctgctgacccagctggacggcgtggagggcctgcagggcgtgtacgtgctggccgccaccagcagacccgacctgatcgaccccgccctgctgagacccggcagactggacaagtgcgtgtactgccccccccccgaccaggtgagcagactggagatcctgaacgtgctgagcgacagcctgcccctggccgacgacgtggacctgcagcacgtggccagcgtgaccgacagcttcaccggcgccgacctgaaggccctgctgtacaacgcccagctggaggccctgcacggcatgctgctgagcagcggcctgcaggacggcagcagcagcagcgacagcgacctgagcctgagcagcatggtgttcctgaaccacagcagcggcagcgacgacagcgccggcgacggcgagtgcggcctggaccagagcctggtgagcctggagatgagcgagatcctgcccgacgagagcaagttcaacatgtacagactgtacttcggcagcagctacgagagcgagctgggcaacggcaccagcagcgacctgagcagccagtgcctgagcgcccccagcagcatgacccaggacctgcccggcgtgcccggcaaggaccagctgttcagccagccccccgtgctgagaaccgccagccaggagggctgccaggagctgacccaggagcagagagaccagctgagagccgacatcagcatcatcaagggcagatacagaagccagagcggcgaggacgagagcatgaaccagcccggccccatcaagaccagactggccatcagccagagccacctgatgaccgccctgggccacaccagacccagcatcagcgaggacgactggaagaacttcgccgagctgtacgagagcttccagaaccccaagagaagaaagaaccagagcggcaccatgttcagacccggccagaaggtgaccctggcctag

SEQ ID NO: 92793 - DNA, 483 bp, Artificial Sequence
  Description of Artificial Sequence: Synthetic coding sequence
atgagcctggtggccggcctgagaaacggcgccctgctgctgaccggcggcaagggcagcggcaagagcaccctggccaaggccatctgcaaggaggccttcgacaagctggacgcccacgtggagagagtggactgcaaggccctgagaggcaagagactggagaacatccagaagaccctggaggtggccttcagcgaggccgtgtggatgcagcccagcgtggtgctgctggacgacctggacctgatcgccggcctgcccgccgtgcccgagcacgagcacagccccgacgccgtgcagagccagagactggcccacgccctgaacgacatgatcaaggagttcatcagcatgggcagcctggtggccctgatcgccaccagccagagccagcagagcctgcaccccctgctggtgagcgcccagggcgtgcacatcttccagtgcgtgcagcacatccagccccccaaccagaactag

SEQ ID NO: 92794 - DNA, 1899 bp, Artificial Sequence
  Description of Artificial Sequence: Synthetic coding sequence
atgtggggcagcgacagactggccggcgccggcggcggcggcgccgccgtgaccgtggccttcaccaacgccagagactgcttcctgcacctgcccagaagactggtggcccagctgcacctgctgcagaaccaggccatcgaggtggtgtggagccaccagcccgccttcctgagctgggtggagggcagacacttcagcgaccagggcgagaacgtggccgagatcaacagacaggtgggccagaagctgggcctgagcaacggcggccaggtgttcctgaagccctgcagccacgtggtgagctgccagcaggtggaggtggagcccctgagcgccgacgactgggagatcctggagctgcacgccgtgagcctggagcagcacctgctggaccagatcagaatcgtgttccccaaggccatcttccccgtgtgggtggaccagcagacctacatcttcatccagatcgtggccctgatccccgccgccagctacggcagactggagaccgacaccaagctgctgatccagcccaagaccagaagagccaaggagaacaccttcagcaaggccgacgccgagtacaagaagctgcacagctacggcagagaccagaagggcatgatgaaggagctgcagaccaagcagctgcagagcaacaccgtgggcatcaccgagagcaacgagaacgagagcgagatccccgtggacagcagcagcgtggccagcctgtggaccatgatcggcagcatcttcagcttccagagcgagaagaagcaggagaccagctggggcctgaccgagatcaacgccttcaagaacatgcagagcaaggtggtgcccctggacaacatcttcagagtgtgcaagagccagccccccagcatctacaacgccagcgccaccagcgtgttccacaagcactgcgccatccacgtgttcccctgggaccaggagtacttcgacgtggagcccagcttcaccgtgacctacggcaagctggtgaagctgctgagccccaagcagcagcagagcaagaccaagcagaacgtgctgagccccgagaaggagaagcagatgagcgagcccctggaccagaagaagatcagaagcgaccacaacgaggaggacgagaaggcctgcgtgctgcaggtggtgtggaacggcctggaggagctgaacaacgccatcaagtacaccaagaacgtggaggtgctgcacctgggcaaggtgtggatccccgacgacctgagaaagagactgaacatcgagatgcacgccgtggtgagaatcacccccgtggaggtgacccccaagatccccagaagcctgaagctgcagcccagagagaacctgcccaaggacatcagcgaggaggacatcaagaccgtgttctacagctggctgcagcagagcaccaccaccatgctgcccctggtgatcagcgaggaggagttcatcaagctggagaccaaggacggcctgaaggagttcagcctgagcatcgtgcacagctgggagaaggagaaggacaagaacatcttcctgctgagccccaacctgctgcagaagaccaccatccaggtgctgctggaccccatggtgaaggaggagaacagcgaggagatcgacttcatcctgcccttcctgaagctgagcagcctgggcggcgtgaacagcctgggcgtgagcagcctggagcacatcacccacagcctgctgggcagacccctgagcagacagctgatgagcctggtggccggcctgagaaacggcgccctgctgctgaccggcggcaagggcagcggcaagagcaccctggccaaggccatctgcaaggaggccttcgacaagctggacgcccacgtggagagagtggactgcaaggccctgtag

SEQ ID NO: 92795 - DNA, 1041 bp, Artificial Sequence
  Description of Artificial Sequence: Synthetic coding sequence
atggcccccgccgccgccagcccccccgaggtgatcagagccgcccagaaggacgagtactacagaggcggcctgagaagcgccgccggcggcgccctgcacagcctggccggcgccagaaagtggctggagtggagaaaggaggtggagctgctgagcgacgtggcctacttcggcctgaccaccctggccggctaccagaccctgggcgaggagtacgtgagcatcatccaggtggaccccagcagaatccacgtgcccagcagcctgagaagaggcgtgctggtgaccctgcacgccgtgctgccctacctgctggacaaggccctgctgcccctggagcaggagctgcaggccgaccccgacagcggcagacccctgcagggcagcctgggccccggcggcagaggctgcagcggcgccagaagatggatgagacaccacaccgccaccctgaccgagcagcagagaagagccctgctgagagccgtgttcgtgctgagacagggcctggcctgcctgcagagactgcacgtggcctggttctacatccacggcgtgttctaccacctggccaagagactgaccggcatcacctaccaggccctgagacccgaccccctgagagtgctgatgagcgtggcccccagcgccctgcagctgagagtgagaagcctgcccggcgaggacctgagagccagagtgagctacagactgctgggcgtgatcagcctgctgcacctggtgctgagcatgggcctgcagctgtacggcttcagacagagacagagagccagaaaggagtggagactgcacagaggcctgagccacagaagagccagcctggaggagagagccgtgagcagaaaccccctgtgcaccctgtgcctggaggagagaagacaccccaccgccaccccctgcggccacctgttctgctgggagtgcatcaccgcctggtgcagcagcaaggccgagtgccccctgtgcagagagaagttccccccccagaagctgatctacctgagacactacagatag

SEQ ID NO: 92796 - DNA, 981 bp, Artificial Sequence
  Description of Artificial Sequence: Synthetic coding sequence
atggcccccgccgccgccagcccccccgaggtgatcagagccgcccagaaggacgagtactacagaggcggcctgagaagcgccgccggcggcgccctgcacagcctggccggcgccagaaagtggctggagtggagaaaggaggtggagctgctgagcgacgtggcctacttcggcctgaccaccctggccggctaccagaccctgggcgaggagtacgtgagcatcatccaggtggaccccagcagaatccacgtgcccagcagcctgagaagaggcgtgctggtgaccctgcacgccgtgctgccctacctgctggacaaggccctgctgcccctggagcaggagctgcaggccgaccccgacagcggcagacccctgcagggcagcctgggccccggcggcagaggctgcagcggcgccagaagatggatgagacaccacaccgccaccctgaccgagcagcagagaagagccctgctgagagccgtgttcgtgctgagacagggcctggcctgcctgcagagactgcacgtggcctggttctacatccacggcgtgttctaccacctggccaagagactgaccggcatcacctacctgagagtgagaagcctgcccggcgaggacctgagagccagagtgagctacagactgctgggcgtgatcagcctgctgcacctggtgctgagcatgggcctgcagctgtacggcttcagacagagacagagagccagaaaggagtggagactgcacagaggcctgagccacagaagagccagcctggaggagagagccgtgagcagaaaccccctgtgcaccctgtgcctggaggagagaagacaccccaccgccaccccctgcggccacctgttctgctgggagtgcatcaccgcctggtgcagcagcaaggccgagtgccccctgtgcagagagaagttccccccccagaagctgatctacctgagacactacagatag

SEQ ID NO: 92797 - DNA, 744 bp, Artificial Sequence
  Description of Artificial Sequence: Synthetic coding sequence
atggacgccttcaccagattcaccaaccagacccagggcagagacagactgttcagagccacccagtacacctgcatgctgctgagatacctgctggagcccaaggccggcaaggagaaggtggtgatgaagctgaagaagctggagagcagcgtgagcaccggcagaaagtggttcagactgggcaacgtggtgcacgccatccaggccaccgagcagagcatccacgccaccgacctggtgcccagactgtgcctgaccctggccaacctgaacagagtgatctacttcatctgcgacaccatcctgtgggtgagaagcgtgggcctgaccagcggcatcaacaaggagaagtggagaaccagagccgcccaccactactactacagcctgctgctgagcctggtgagagacctgtacgagatcagcctgcagatgaagagagtgacctgcgacagagccaagaaggagaagagcgccagccaggaccccctgtggttcagcgtggccgaggaggagaccgagtggctgcagagcttcctgctgctgctgttcagaagcctgaagcagcacccccccctgctgctggacaccgtgaagaacctgtgcgacatcctgaaccccctggaccagctgggcatctacaagagcaaccccggcatcatcggcctgggcggcctggtgagcagcatcgccggcatgatcaccgtggcctacccccagatgaagctgaagaccagatag

SEQ ID NO: 92798 - DNA, 1209 bp, Artificial Sequence
  Description of Artificial Sequence: Synthetic coding sequence
atgccctggaagctgtggagaggcagcgtgggctgccccggcgacctgagcagcgacggcctgctgttcagactgggcccccccaagccccccaccgagctggagcccgagcccgagatcgagggcctgctgacccccgtgctggaggccggcgacgtggacgagggccccgtggccagacccctgagccccaccagactgcagcccgccctgccccccgaggcccagagcgtgcccgagctggaggaggtggccagagtgctggccgagatccccagacccctgaagagaagaggcagcatggagcaggcccccgccgtggccctgccccccacccacaagaagcagtaccagcagatcatcagcagactgttccacagacacggcggccccggccccggcggccccgagcccgagctgagccccatcaccgagggcagcgaggccagagccggcccccccgcccccgccccccccgcccccatccccccccccgcccccagccagagcagcccccccgagcagccccagagcatggagatgagaagcgtgctgagaaaggccggcagccccagaaaggccagaagagccagactgaaccccctggtgctgctgctggacgccgccctgaccggcgagctggaggtggtgcagcaggccgtgaaggagatgaacgaccccagccagcccaacgaggagggcatcaccgccctgcacaacgccatctgcggcgccaactacagcatcgtggacttcctgatcaccgccggcgccaacgtgaacagccccgacagccacggctggacccccctgcactgcgccgccagctgcaacgacaccgtgatctgcatggccctggtgcagcacggcgccgccatcttcgccaccaccctgagcgacggcgccaccgccttcgagaagtgcgacccctacagagagggctacgccgactgcgccacctacctggccgacgtggagcagagcatgggcctgatgaacagcggcgccgtgtacgccctgtgggactacagcgccgagttcggcgacgagctgagcttcagagagggcgagagcgtgaccgtgctgagaagagacggccccgaggagaccgactggtggtgggccgccctgcacggccaggagggctacgtgcccagaaactacttcggcctgttccccagagtgaagccccagagaagcaaggtgtag

SEQ ID NO: 92799 - DNA, 507 bp, Artificial Sequence
  Description of Artificial Sequence: Synthetic coding sequence
tgatacagaggcagagacagactgatcagagtgctgggctactgctgccagctggtgggcggcgtgctggtggagcagtgccccgccagaagcgaggtgggcaccagactgctggtggtgagcacccagctgagccactgcagaaccatcctgagactgttcgacgacctggccatgttcgtgtacaccaagcagtacggcctgggcgcccaggaggaggacgccttcgtgagatgcgtgagcgtgctgggcaacctggccgaccagctgtactacccctgcgagcacgtggcctgggccgccgacgccagagtgctgcacgtggacagcagcagatggtggaccctgagcaccaccctgtgggccctgagcctgctgctgggcgtggccagaagcctgtggatgctgctgaagctgagacagagactgagaagccccaccgcccccttcaccagcatgtaccaggccgccagagccggcggccaggccgaggccaccaccccctag

SEQ ID NO: 92800 - DNA, 1212 bp, Artificial Sequence
  Description of Artificial Sequence: Synthetic coding sequence
atggccagccagcccccccccccccccaagccctgggagaccagaagaatccccggcgccggccccggccccggccccggccccaccttccagagcgccgacctgggccccaccctgatgaccagacccggccagcccgccctgaccagagtgcccccccccatcctgcccagacccagccagcagaccggcagcagcagcgtgaacaccttcagacccgcctacagcagcttcagcagcggctacggcgcctacggcaacagcttctacggcggctacagcccctacagctacggctacaacggcctgggctacaacagactgagagtggacgacctgccccccagcagattcgtgcagcaggccgaggagagcagcagaggcgccttccagagcatcgagagcatcgtgcacgccttcgccagcgtgagcatgatgatggacgccaccttcagcgccgtgtacaacagcttcagagccgtgctggacgtggccaaccacttcagcagactgaagatccacttcaccaaggtgttcagcgccttcgccctggtgagaaccatcagatacctgtacagaagactgcagagaatgctgggcctgagaagaggcagcgagaacgaggacctgtgggccgagagcgagggcaccgtggcctgcctgggcgccgaggacagagccgccaccagcgccaagagctggcccatcttcctgttcttcgccgtgatcctgggcggcccctacctgatctggaagctgctgagcacccacagcgacgaggtgaccgacagcatcaactgggccagcggcgaggacgaccacgtggtggccagagccgagtacgacttcgccgccgtgagcgaggaggagatcagcttcagagccggcgacatgctgaacctggccctgaaggagcagcagcccaaggtgagaggctggctgctggccagcctggacggccagaccaccggcctgatccccgccaactacgtgaagatcctgggcaagagaaagggcagaaagaccgtggagagcagcaaggtgagcaagcagcagcagagcttcaccaaccccaccctgaccaagggcgccaccgtggccgacagcctggacgagcaggaggccgccttcgagagcgtgttcgtggagaccaacaaggtgcccgtggcccccgacagcatcggcaaggacggcgagaagcaggacctgtag

SEQ ID NO: 92801 - DNA, 1134 bp, Artificial Sequence
  Description of Artificial Sequence: Synthetic coding sequence
atggccagcagcgagcaggccgagcagcccagccagcccagcagcacccccggcagcgagaacgtgctgcccagagagcccctgatcgccaccgccgtgaagttcctgcagaacagcagagtgagacagagccccctggccaccagaagagccttcctgaagaagaagggcctgaccgacgaggagatcgacatggccttccagcagagcggcaccgccgccgacgagcccagcagcctgggccccgccacccaggtggtgcccgtgcagcccccccacctgatcagccagccctacagccccgccggcagcagatggagagactacggcgccctggccatcatcatggccggcatcgccttcggcttccaccagctgtacaagaagtacctgctgcccctgatcctgggcggcagagaggacagaaagcagctggagagaatggaggccggcctgagcgagctgagcggcagcgtggcccagaccgtgacccagctgcagaccaccctggccagcgtgcaggagctgctgatccagcagcagcagaagatccaggagctggcccacgagctggccgccgccaaggccaccaccagcaccaactggatcctggagagccagaacatcaacgagctgaagagcgagatcaacagcctgaagggcctgctgctgaacagaagacagttcccccccagccccagcgcccccaagatccccagctggcagatccccgtgaagagccccagccccagcagccccgccgccgtgaaccaccacagcagcagcgacatcagccccgtgagcaacgagagcaccagcagcagccccggcaaggagggccacagccccgagggcagcaccgtgacctaccacctgctgggcccccaggaggagggcgagggcgtggtggacgtgaagggccaggtgagaatggaggtgcagggcgaggaggagaagagagaggacaaggaggacgaggaggacgaggaggacgacgacgtgagccacgtggacgaggaggactgcctgggcgtgcagagagaggacagaagaggcggcgacggccagatcaacgagcaggtggagaagctgagaagacccgagggcgccagcaacgagagcgagagagactag

SEQ ID NO: 92802 - DNA, 942 bp, Artificial Sequence
  Description of Artificial Sequence: Synthetic coding sequence
atggccttccagcagagcggcaccgccgccgacgagcccagcagcctgggccccgccacccaggtggtgcccgtgcagcccccccacctgatcagccagccctacagccccgccggcagcagatggagagactacggcgccctggccatcatcatggccggcatcgccttcggcttccaccagctgtacaagaagtacctgctgcccctgatcctgggcggcagagaggacagaaagcagctggagagaatggaggccggcctgagcgagctgagcggcagcgtggcccagaccgtgacccagctgcagaccaccctggccagcgtgcaggagctgctgatccagcagcagcagaagatccaggagctggcccacgagctggccgccgccaaggccaccaccagcaccaactggatcctggagagccagaacatcaacgagctgaagagcgagatcaacagcctgaagggcctgctgctgaacagaagacagttcccccccagccccagcgcccccaagatccccagctggcagatccccgtgaagagccccagccccagcagccccgccgccgtgaaccaccacagcagcagcgacatcagccccgtgagcaacgagagcaccagcagcagccccggcaaggagggccacagccccgagggcagcaccgtgacctaccacctgctgggcccccaggaggagggcgagggcgtggtggacgtgaagggccaggtgagaatggaggtgcagggcgaggaggagaagagagaggacaaggaggacgaggaggacgaggaggacgacgacgtgagccacgtggacgaggaggactgcctgggcgtgcagagagaggacagaagaggcggcgacggccagatcaacgagcaggtggagaagctgagaagacccgagggcgccagcaacgagagcgagagagactag

SEQ ID NO: 92803 - DNA, 1041 bp, Artificial Sequence
  Description of Artificial Sequence: Synthetic coding sequence
atggagaagctgagactgctgggcctgagataccaggagtacgtgaccagacaccccgccgccaccgcccagctggagaccgccgtgagaggcttcagctacctgctggccggcagattcgccgacagccacgagctgagcgagctggtgtacagcgccagcaacctgctggtgctgctgaacgacggcatcctgagaaaggagctgagaaagaagctgcccgtgagcctgagccagcagaagctgctgacctggctgagcgtgctggagtgcgtggaggtgttcatggagatgggcgccgccaaggtgtggggcgaggtgggcagatggctggtgatcgccctggtgcagctggccaaggccgtgctgagaatgctgctgctgctgtggttcaaggccggcctgcagaccagcccccccatcgtgcccctggacagagagacccaggcccagccccccgacggcgaccacagccccggcaaccacgagcagagctacgtgggcaagagaagcaacagagtggtgagaaccctgcagaacacccccagcctgcacagcagacactggggcgccccccagcagagagagggcagacagcagcagcaccacgaggagctgagcgccacccccacccccctgggcctgcaggagaccatcgccgagttcctgtacatcgccagacccctgctgcacctgctgagcctgggcctgtggggccagagaagctggaagccctggctgctggccggcgtggtggacgtgaccagcctgagcctgctgagcgacagaaagggcctgaccagaagagagagaagagagctgagaagaagaaccatcctgctgctgtactacctgctgagaagccccttctacgacagattcagcgaggccagaatcctgttcctgctgcagctgctggccgaccacgtgcccggcgtgggcctggtgaccaccagccagagagccgccagcccctgcctgcccgccagaccccacacccagccctggagcccccccgccttcctgcccggccacccctag

SEQ ID NO: 92804 - DNA, 1011 bp, Artificial Sequence
  Description of Artificial Sequence: Synthetic coding sequence
atggagaagctgagactgctgggcctgagataccaggagtacgtgaccagacaccccgccgccaccgcccagctggagaccgccgtgagaggcttcagctacctgctggccggcagattcgccgacagccacgagctgagcgagctggtgtacagcgccagcaacctgctggtgctgctgaacgacggcatcctgagaaaggagctgagaaagaagctgcccgtgagcctgagccagcagaagctgctgacctggctgagcgtgctggagtgcgtggaggtgttcatggagatgggcgccgccaaggtgtggggcgaggtgggcagatggctggtgatcgccctggtgcagctggccaaggccgtgctgagaatgctgctgctgctgtggttcaaggccggcctgcagaccagcccccccatcgtgcccctggacagagagacccaggcccagccccccgacggcgaccacagccccggcaaccacgagcagagctacgtgggcaagagaagcaacagagtggtgagaaccctgcagaacacccccagcctgcacagcagacactggggcgccccccagcagagagagggcagacagcagcagcaccacgaggagctgagcgccacccccacccccctgggcctgcaggagaccatcgccgagttcctgtacatcgccagacccctgctgcacctgctgagcctgggcctgtggggccagagaagctggaagccctggctgctggccggcgtggtggacgtgaccagcctgagcctgctgagcgacagaaagggcctgaccagaagagagagaagagagctgagaagaagaaccatcctgctgctgtactacctgctgagaagccccttctacgacagattcagcgaggccagaatcctgttcctgctgcagctgctggccgaccacgtgcccggcgtgggcctggtgaccagacccctgatggactacctgcccacctggcagaagatctacttctacagctggggctag

SEQ ID NO: 92805 - DNA, 900 bp, Artificial Sequence
  Description of Artificial Sequence: Synthetic coding sequence
atggccgccgccgaggagggctgcagcgtgggcgccgaggccgacagagagctggaggagctgctggagagcgccctggacgacttcgacaaggccaagcccagccccgccccccccagcaccaccaccgcccccgacgccagcggcccccagaagagaagccccggcgacaccgccaaggacgccctgttcgccagccaggagaagttcttccaggagctgttcgacagcgagctggccagccaggccaccgccgagttcgagaaggccatgaaggagctggccgaggaggagccccacctggtggagcagttccagaagctgagcgaggccgccggcagagtgggcagcgacatgaccagccagcaggagttcaccagctgcctgaaggagaccctgagcggcctggccaagaacgccaccgacctgcagaacagcagcatgagcgaggaggagctgaccaaggccatggagggcctgggcatggacgagggcgacggcgagggcaacatcctgcccatcatgcagagcatcatgcagaacctgctgagcaaggacgtgctgtaccccagcctgaaggagatcaccgagaagtaccccgagtggctgcagagccacagagagagcctgccccccgagcagttcgagaagtaccaggagcagcacagcgtgatgtgcaagatctgcgagcagttcgaggccgagacccccaccgacagcgagaccacccagaaggccagattcgagatggtgctggacctgatgcagcagctgcaggacctgggccacccccccaaggagctggccggcgagatgccccccggcctgaacttcgacctggacgccctgaacctgagcggcccccccggcgccagcggcgagcagtgcctgatcatgtag

SEQ ID NO: 92806 - DNA, 708 bp, Artificial Sequence
  Description of Artificial Sequence: Synthetic coding sequence
atggagagcggcgccctggacgacttcgacaaggccaagcccagccccgccccccccagcaccaccaccgcccccgacgccagcggcccccagaagagaagccccggcgacaccgccaaggacgccctgttcgccagccaggagaagttcttccaggagctgttcgacagcgagctggccagccaggccaccgccgagttcgagaaggccatgaaggagctggccgaggaggagccccacctggtggagcagttccagaagctgagcgaggccgccggcagagtgggcagcgacatgaccagccagcaggagttcaccagctgcctgaaggagaccctgagcggcctggccaagaacgccaccgacctgcagaacagcagcatgagcgaggaggagctgaccaaggccatggagggcctgggcatggacgagggcgacggcgagggcaacatcctgcccatcatgcagagcatcatgcagaacctgctgagcaaggacgtgctgtaccccagcctgaaggagatcaccgagaagtaccccgagtggctgcagagccacagagagagcctgccccccgagcagttcgagaagtaccaggagcagcacagcgtgatgtgcaagatctgcgagcagttcgaggccgagacccccaccgacagcgagaccacccagaaggccagattcgagatggtgctggacctgatgtag

SEQ ID NO: 92807 - DNA, 840 bp, Artificial Sequence
  Description of Artificial Sequence: Synthetic coding sequence
atggagagcggcgccctggacgacttcgacaaggccaagcccagccccgccccccccagcaccaccaccgcccccgacgccagcggcccccagaagagaagccccggcgacaccgccaaggacgccctgttcgccagccaggagaagttcttccaggagctgttcgacagcgagctggccagccaggccaccgccgagttcgagaaggccatgaaggagctggccgaggaggagccccacctggtggagcagttccagaagctgagcgaggccgccggcagagtgggcagcgacatgaccagccagcaggagttcaccagctgcctgaaggagaccctgagcggcctggccaagaacgccaccgacctgcagaacagcagcatgagcgaggaggagctgaccaaggccatggagggcctgggcatggacgagggcgacggcgagggcaacatcctgcccatcatgcagagcatcatgcagaacctgctgagcaaggacgtgctgtaccccagcctgaaggagatcaccgagaagtaccccgagtggctgcagagccacagagagagcctgccccccgagcagttcgagaagtaccaggagcagcacagcgtgatgtgcaagatctgcgagcagttcgaggccgagacccccaccgacagcgagaccacccagaaggccagattcgagatggtgctggacctgatgcagcagctgcaggacctgggccacccccccaaggagctggccggcgagatgccccccggcctgaacttcgacctggacgccctgaacctgagcggcccccccggcgccagcggcgagcagtgcctgatcatgtag

SEQ ID NO: 92808 - DNA, 630 bp, Artificial Sequence
  Description of Artificial Sequence: Synthetic coding sequence
atgaaggagctggccgaggaggagccccacctggtggagcagttccagaagctgagcgaggccgccggcagagtgggcagcgacatgaccagccagcaggagttcaccagctgcctgaaggagaccctgagcggcctggccaagaacgccaccgacctgcagaacagcagcatgagcgaggaggagctgaccaaggccatggagggcctgggcatggacgagggcgacggcgagggcaacatcctgcccatcatgcagagcatcatgcagaacctgctgagcaaggacgtgctgtaccccagcctgaaggagatcaccgagaagtaccccgagtggctgcagagccacagagagagcctgccccccgagcagttcgagaagtaccaggagcagcacagcgtgatgtgcaagatctgcgagcagttcgaggccgagacccccaccgacagcgagaccacccagaaggccagattcgagatggtgctggacctgatgcagcagctgcaggacctgggccacccccccaaggagctggccggcgagatgccccccggcctgaacttcgacctggacgccctgaacctgagcggcccccccggcgccagcggcgagcagtgcctgatcatgtag

SEQ ID NO: 92809 - DNA, 561 bp, Artificial Sequence
  Description of Artificial Sequence: Synthetic coding sequence
atggccgccgccgaggagggctgcagcgtgggcgccgaggccgacagagagctggaggagctgctggagagcgccctggacgacttcgacaaggccaagcccagccccgccccccccagcaccaccaccgcccccgacgccagcggcccccagaagagaagccccggcgacaccgccaaggacgccctgttcgccagccaggagaagttcttccaggagctgttcgacagcgagctggccagccaggccaccgccgagttcgagaaggccatgaaggagctggccgaggaggagccccacctggtggagcagttccagaagctgagcgaggccgccggcagagtggagctgcagcacgtgggcagaagagccgaccagggccacggcggcgccagacacggcagaagaggctggggcagagagcaccccccccaccacgccgagtactacgccgagcccaccctgcagggctgcgccgtgcccatcaccgagggcgaccacagaaaggtgagcagaatggtggccgagagcagcggcatcagcaccagcagagccgtgtag

SEQ ID NO: 92810 - DNA, 918 bp, Artificial Sequence
  Description of Artificial Sequence: Synthetic coding sequence
atggccagcagaaaggagaacgccaagagcgccaacagagtgctgagaatcagccagctggacgccctggagctgaacaaggccctggagcagctggtgtggagccagttcacccagtgcttccacggcttcaagcccggcctgctggccagattcgagcccgaggtgaaggcctgcctgtgggtgttcctgtggagattcaccatctacagcaagaacgccaccgtgggccagagcgtgctgaacatcaagtacaagaacgacttcagccccaacctgagataccagccccccagcaagaaccagaagatctggtacgccgtgtgcaccatcggcggcagatggctggaggagagatgctacgacctgttcagaaaccaccacctggccagcttcggcaaggtgaagcagtgcgtgaacttcgtgatcggcctgctgaagctgggcggcctgatcaacttcctgatcttcctgcagagaggcaagttcgccaccctgaccgagagactgctgggcatccacagcgtgttctgcaagccccagaacatctgcgaggtgggcttcgagtacatgaacagagagctgctgtggcacggcttcgccgagttcctgatcttcctgctgcccctgatcaacgtgcagaagctgaaggccaagctgagcagctggtgcatccccctgaccggcgcccccaacagcgacaacaccctggccaccagcggcaaggagtgcgccctgtgcggcgagtggcccaccatgccccacaccatcggctgcgagcacatcttctgctacttctgcgccaagagcagcttcctgttcgacgtgtacttcacctgccccaagtgcggcaccgaggtgcacagcctgcagcccctgaagagcggcatcgagatgagcgaggtgaacgccctgtag

SEQ ID NO: 92811 - DNA, 918 bp, Artificial Sequence; identical to SEQ ID NO: 92810
  Description of Artificial Sequence: Synthetic coding sequence

SEQ ID NO: 92812 - DNA, 543 bp, Artificial Sequence
  Description of Artificial Sequence: Synthetic coding sequence
atggccagcagaaaggagaacgccaagagcgccaacagagtgctgagaatcagccagctggacgccctggagctgaacaaggccctggagcagctggtgtggagccagttcacccagtgcttccacggcttcaagcccggcctgctggccagattcgagcccgaggtgaaggcctgcctgtgggtgttcctgtggagattcaccatctacagcaagaacgccaccgtgggccagagcgtgctgaacatcaagtacaagaacgacttcagccccaacctgagataccagccccccagcaagaaccagaagatctggtacgccgtgtgcaccatcggcggcagatggctggaggagagatgctacgacctgttcagaaaccaccacctggccagcttcggcaaggtgaagcagtgcgtgaacttcgtgatcggcctgctgaagctgggcggcctgatcaacttcctgatcttcctgcagagaggcaagttcgccaccctgaccgagagactgctgggcatccacagcgtgttctgcaagccctag

SEQ ID NO: 92813 - DNA, 12 bp, Artificial Sequence
  Description of Artificial Sequence: Synthetic coding sequence
atggccagctag

SEQ ID NO: 92814 - DNA, 918 bp, Artificial Sequence; identical to SEQ ID NO: 92810
  Description of Artificial Sequence: Synthetic coding sequence

SEQ ID NO: 92815 - DNA, 918 bp, Artificial Sequence; identical to SEQ ID NO: 92810
  Description of Artificial Sequence: Synthetic coding sequence

SEQ ID NO: 92816 - DNA, 918 bp, Artificial Sequence
  Description of Artificial Sequence: Synthetic coding sequence
atgaagagcgacagcagcaccagcgccgcccccctgagaggcctgggcggccccctgagaagcagcgagcccgtgagagccgtgcccgccagagcccccgccgtggacctgctggaggaggccgccgacctgctggtggtgcacctggacttcagagccgccctggagacctgcgagagagcctggcagagcctggccaaccacgccgtggccgaggagcccgccggcaccagcctggaggtgaagtgcagcctgtgcgtggtgggcatccaggccctggccgagatggacagatggcaggaggtgctgagctgggtgctgcagtactaccaggtgcccgagaagctgccccccaaggtgctggagctgtgcatcctgctgtacagcaagatgcaggagcccggcgccgtgctggacgtggtgggcgcctggctgcaggaccccgccaaccagaacctgcccgagtacggcgccctggccgagttccacgtgcagagagtgctgctgcccctgggctgcctgagcgaggccgaggagctggtggtgggcagcgccgccttcggcgaggagagaagactggacgtgctgcaggccatccacaccgccagacagcagcagaagcaggagcacagcggcagcgaggaggcccagaagcccaacctggagggcagcgtgagccacaagttcctgagcctgcccatgctggtgagacagctgtgggacagcgccgtgagccacttcttcagcctgcccttcaagaagagcctgctggccgccctgatcctgtgcctgctggtggtgagattcgaccccgccagccccagcagcctgcacttcctgtacaagctggcccagctgttcagatggatcagaaaggccgccttcagcagactgtaccagctgagaatcagagactag

SEQ ID NO: 92817 - DNA, 918 bp, Artificial Sequence; identical to SEQ ID NO: 92816
  Description of Artificial Sequence: Synthetic coding sequence

SEQ ID NO: 92818 - DNA, 1098 bp, Artificial Sequence
  Description of Artificial Sequence: Synthetic coding sequence
atgaagagcgacagcagcaccagcgccgcccccctgagaggcctgggcggccccctgagaagcagcgagcccgtgagagccgtgcccgccagagcccccgccgtggacctgctggaggaggccgccgacctgctggtggtgcacctggacttcagagccgccctggagacctgcgagagagcctggcagagcctggccaaccacgccgtggccgaggagcccgccggcaccagcctggaggtgaagtgcagcctgtgcgtggtgggcatccaggccctggccgagatggacagatggcaggaggtgctgagctgggtgctgcagtactaccaggtgcccgagaagctgccccccaaggtgctggagctgtgcatcctgctgtacagcaagatgcaggagcccggcgccgtgctggacgtggtgggcgcctggctgcaggaccccgccaaccagaacctgcccgagtacggcgccctggccgagttccacgtgcagagagtgctgctgcccctgggctgcctgagcgaggccgaggagctggtggtgggcagcgccgccttcggcgaggagagaagactggacgtgctgcaggccatccacaccgccagacagcagcagaagcaggagcacagcggcagcgaggaggcccagaagcccaacctggagggcagcgtgagccacaagttcctgagcctgcccatgctggtgagacagctgtgggacagcgccgtgagccacttcttcagcctgcccttcaagaagagcctgctggccgccctgatcctgtgcctgctggtggtgagattcgaccccgccagccccagcagcctgcacttcctgtacaagctggcccagctgttcgccggcagcggcagactgcacttcctggccagcaccagcagcgccagcgtgaccgagggcccctgcgccccccagcccctgtgcagcagcagaccctggccccagaagcagagcgacagagccacccacccccaggcccccctgggcaagtgggaccagcccaacctggccgagtgcaccgtgagctgctgcctgggcgccctgagcttcgccccctacttcggctggagcagatag

SEQ ID NO: 92819 - DNA, 771 bp, Artificial Sequence
  Description of Artificial Sequence: Synthetic coding sequence
atgaagagcgacagcagcaccagcgccgcccccctgagaggcctgggcggccccctgagaagcagcgagcccgtgagagccgtgcccgccagagcccccgccgtggacctgctggaggaggccgccgacctgctggtggtgcacctggacttcagagccgccctggagacctgcgagagagcctggcagagcctggccaaccacgccgtggccgaggagcccgccggcaccagcctggaggtgaagtgcagcctgtgcgtggtgggcatccaggccctggccgagatggacagatggcaggaggtgctgagctgggtgctgcagtactaccaggtgcccgagaagctgccccccaaggtgctggagctgtgcatcctgctgtacagcaagatgcaggagcccggcgccgtgctggacgtggtgggcgcctggctgcaggaccccgccaaccagaacctgcccgagtacggcgccctggccgagttccacgtgcagagagtgctgctgcccctgggctgcctgagcgaggccgaggagctggtggtgggcagcgccgccttcggcgaggagagaagactggacgtgctgcaggccatccacaccgccagacagcagcagaagcaggagcacagcggcagcgaggaggcccagaagcccaacctggaggccagccccagcagcctgcacttcctgtacaagctggcccagctgttcagatggatcagaaaggccgccttcagcagactgtaccagctgagaatcagagactag

SEQ ID NO: 92820 - DNA, 549 bp, Artificial Sequence
  Description of Artificial Sequence: Synthetic coding sequence
atgctgagaagcgtgtggaacttcctgaagagacacaagaagaagtgcatcttcctgggcaccgtgctgggcgtgctgagcatgctgcccaccctgagagaggccctgatgcagcagctgaacagcgagagcctgaccgccctgctgaagaacagacccagcaacaagctggagatctgggaggacctgaagatcatcagcttcaccagaagcaccgtggccgtgtacagcacctgcatgctggtggtgctgctgagagtgcagctgaacatcatcggcggctacatctacctggacaacgccgccgtgggcaagaacggcaccaccatcctggccccccccgacgtgcagcagcagtacctgagcagcatccagcacctgctgggcgacggcctgaccgagctgatcaccgtgatcaagcaggccgtgcagaaggtgctgggcagcgtgagcctgaagcacagcctgagcctgctggacctggagcagaagctgaaggagatcagaaacctggtggagcagcacaagagcagcagctggatcaactag

SEQ ID NO: 92821 - DNA, 1122 bp, Artificial Sequence
  Description of Artificial Sequence: Synthetic coding sequence
atgctgagaagcgtgtggaacttcctgaagagacacaagaagaagtgcatcttcctgggcaccgtgctgggcggcgtgtacatcctgggcaagtacggccagaagaagatcagagagatccaggagagagaggccgccgagtacatcgcccaggccagaagacagtaccacttcgagagcaaccagagaacctgcaacatgaccgtgctgagcatgctgcccaccctgagagaggccctgatgcagcagctgaacagcgagagcctgaccgccctgctgaagaacagacccagcaacaagctggagatctgggaggacctgaagatcatcagcttcaccagaagcaccgtggccgtgtacagcacctgcatgctggtggtgctgctgagagtgcagctgaacatcatcggcggctacatctacctggacaacgccgccgtgggcaagaacggcaccaccatcctggccccccccgacgtgcagcagcagtacctgagcagcatccagcacctgctgggcgacggcctgaccgagctgatcaccgtgatcaagcaggccgtgcagaaggtgctgggcagcgtgagcctgaagcacagcctgagcctgctggacctggagcagaagctgaaggagatcagaaacctggtggagcagcacaagagcagcagctggatcaacaaggacggcagcaagcccctgctgtgccactacatgatgcccgacgaggagacccccctggccgtgcaggcctgcggcctgagccccagagacatcaccaccatcaagctgctgaacgagaccagagacatgctggagagccccgacttcagcaccgtgctgaacacctgcctgaacagaggcttcagcagactgctggacaacatggccgagttcttcagacccaccgagcaggacctgcagcacggcaacagcatgaacagcctgagcagcgtgagcctgcccctggccaagatcatccccatcgtgaacggccagatccacagcgtgtgcagcgagacccccagccacttcgtgcaggacctgctgaccatggagcaggtgaaggacttcgccgccaacgtgtacgaggccttcagcaccccccagcagctggagaagtag

SEQ ID NO: 92822 - DNA, 549 bp, Artificial Sequence; identical to SEQ ID NO: 92820
  Description of Artificial Sequence: Synthetic coding sequence

SEQ ID NO: 92823 - DNA, 1809 bp, Artificial Sequence
  Description of Artificial Sequence: Synthetic coding sequence
atggccatgagagagctggtggaggccgagtgcggcggcgccaaccccctgatgaagctggccggccacttcacccaggacaaggccctgagacaggagggcctgagacccggcccctggccccccggcgcccccgccagcgaggccgccagcaagcccctgggcgtggccagcgaggacgagctggtggccgagttcctgcaggaccagaacgcccccctggtgagcagagccccccagaccttcaagatggacgacctgctggccgagatgcagcagatcgagcagagcaacttcagacaggccccccagagagcccccggcgtggccgacctggccctgagcgagaactgggcccaggagttcctggccgccggcgacgccgtggacgtgacccaggactacaacgagaccgactggagccaggagttcatcagcgaggtgaccgaccccctgagcgtgagccccgccagatgggccgaggagtacctggagcagagcgaggagaagctgtggctgggcgagcccgagggcaccgccaccgacagatggtacgacgagtaccaccccgaggaggacctgcagcacaccgccagcgacttcgtggccaaggtggacgaccccaagctggccaacagcgagggcaccagcgacgcctgggtggaccagttcaccagacccgtgaacaccagcgccctggacatggagttcgagagagccaagagcgccatcgagagcgacgtggacttctgggacaagctgcaggccgagctggaggagatggccaagagagacgccgaggcccacccctggctgagcgactacgacgacctgaccagcgccacctacgacaagggctaccagttcgaggaggagaaccccctgagagaccacccccagcccttcgaggagggcctgagaagactgcaggagggcgacctgcccaacgccgtgctgctgttcgaggccgccgtgcagcaggaccccaagcacatggaggcctggcagtacctgggcaccacccaggccgagaacgagcaggagctgctggccatcagcgccctgagaagatgcctggagctgaagcccgacaaccagaccgccctgatggccctggccgtgagcttcaccaacgagagcctgcagagacaggcctgcgagaccctgagagactggctgagatacacccccgcctacgcccacctggtgacccccgccgaggagggcgccggcggcgccggcctgggccccagcaagagaatcctgggcagcctgctgagcgacagcctgttcctggaggtgaaggagctgttcctggccgccgtgagactggaccccaccagcatcgaccccgacgtgcagtgcggcctgggcgtgctgttcaacctgagcggcgagtacgacaaggccgtggactgcttcaccgccgccctgagcgtgagacccaacgactacctgctgtggaacaagctgggcgccaccctggccaacggcaaccagagcgaggaggccgtggccgcctacagaagagccctggagctgcagcccggctacatcagaagcagatacaacctgggcatcagctgcatcaacctgggcgcccacagagaggccgtggagcacttcctggaggccctgaacatgcagagaaagagcagaggccccagaggcgagggcggcgccatgagcgagaacatctggagcaccctgagactggccctgagcatgctgggccagagcgacgcctacggcgccgccgacgccagagacctgagcaccctgctgaccatgttcggcctgccccagtag

SEQ ID NO: 92824 - DNA, 1896 bp, Artificial Sequence
  Description of Artificial Sequence: Synthetic coding sequence
atggccatgagagagctggtggaggccgagtgcggcggcgccaaccccctgatgaagctggccggccacttcacccaggacaaggccctgagacaggagggcctgagacccggcccctggccccccggcgcccccgccagcgaggccgccagcaagcccctgggcgtggccagcgaggacgagctggtggccgagttcctgcaggaccagaacgcccccctggtgagcagagccccccagaccttcaagatggacgacctgctggccgagatgcagcagatcgagcagagcaacttcagacaggccccccagagagcccccggcgtggccgacctggccctgagcgagaactgggcccaggagttcctggccgccggcgacgccgtggacgtgacccaggactacaacgagaccgactggagccaggagttcatcagcgaggtgaccgaccccctgagcgtgagccccgccagatgggccgaggagtacctggagcagagcgaggagaagctgtggctgggcgagcccgagggcaccgccaccgacagatggtacgacgagtaccaccccgaggaggacctgcagcacaccgccagcgacttcgtggccaaggtggacgaccccaagctggccaacagcgagttcctgaagttcgtgagacagatcggcgagggccaggtgagcctggagagcggcgccggcagcggcagagcccaggccgagcagtgggccgccgagttcatccagcagcagggcaccagcgacgcctgggtggaccagttcaccagacccgtgaacaccagcgccctggacatggagttcgagagagccaagagcgccatcgagctgcaggccgagctggaggagatggccaagagagacgccgaggcccacccctggctgagcgactacgacgacctgaccagcgccacctacgacaagggctaccagttcgaggaggagaaccccctgagagaccacccccagcccttcgaggagggcctgagaagactgcaggagggcgacctgcccaacgccgtgctgctgttcgaggccgccgtgcagcaggaccccaagcacatggaggcctggcagtacctgggcaccacccaggccgagaacgagcaggagctgctggccatcagcgccctgagaagatgcctggagctgaagcccgacaaccagaccgccctgatggccctggccgtgagcttcaccaacgagagcctgcagagacaggcctgcgagaccctgagagactggctgagatacacccccgcctacgcccacctggtgacccccgccgaggagggcgccggcggcgccggcctgggccccagcaagagaatcctgggcagcctgctgagcgacagcctgttcctggaggtgaaggagctgttcctggccgccgtgagactggaccccaccagcatcgaccccgacgtgcagtgcggcctgggcgtgctgttcaacctgagcggcgagtacgacaaggccgtggactgcttcaccgccgccctgagcgtgagacccaacgactacctgctgtggaacaagctgggcgccaccctggccaacggcaaccagagcgaggaggccgtggccgcctacagaagagccctggagctgcagcccggctacatcagaagcagatacaacctgggcatcagctgcatcaacctgggcgcccacagagaggccgtggagcacttcctggaggccctgaacatgcagagaaagagcagaggccccagaggcgagggcggcgccatgagcgagaacatctggagcaccctgagactggccctgagcatgctgggccagagcgacgcctacggcgccgccgacgccagagacctgagcaccctgctgaccatgttcggcctgccccagtag

SEQ ID NO: 92825 - DNA, 1233 bp, Artificial Sequence
  Description of Artificial Sequence: Synthetic coding sequence
atggccatgagagagctggtggaggccgagtgcggcggcgccaaccccctgatgaagctggccggccacttcacccaggacaaggccctgagacaggagggcctgagacccggcccctggccccccggcgcccccgccagcgaggccgtgagcgtgctggaggtggagagccccggcgccgccagcgaggccgccagcaagcccctgggcgtggccagcgaggacgagctggtggccgagttcctgcaggaccagaacgcccccctggtgagcagagccccccagaccttcaagatggacgacctgctggccgagatgcagcagatcgagcagagcaacttcagacaggccccccagagagcccccggcgtggccgacctggccctgagcgagaactgggcccaggagttcctggccgccggcgacgccgtggacgtgacccaggactacaacgagaccgactggagccaggagttcatcagcgaggtgaccgaccccctgagcgtgagccccgccagatgggccgaggagtacctggagcagagcgaggagaagctgtggctgggcgagcccgagggcaccgccaccgacagatggtacgacgagtaccaccccgaggaggacctgcagcacaccgccagcgacttcgtggccaaggtggacgaccccaagctggccaacagcgagggcaccagcgacgcctgggtggaccagttcaccagacccgtgaacaccagcgccctggacatggagttcgagagagccaagagcgccatcgagctgcaggccgagctggaggagatggccaagagagacgccgaggcccacccctggctgagcgactacgacgacctgaccagcgccacctacgacaagggctaccagttcgaggaggagaaccccctgagagaccacccccagcccttcgaggagggcctgagaagactgcaggagggcgacctgcccaacgccgtgctgctgttcgaggccgccgtgcagcaggaccccaagcacatggaggcctggcagtacctgggcaccacccaggccgagaacgagcaggagctgctggccatcagcgccctgagaagatgcctggagctgaagcccgacaaccagaccgccctgatggccctggccgtgagcttcaccaacgagagcctgcagagacaggcctgcgagaccctgagagactggctgagatacacccccgcctacgcccacctggtgtag

SEQ ID NO: 92826 - DNA, 1983 bp, Artificial Sequence
  Description of Artificial Sequence: Synthetic coding sequence
atgctgctgtgcagagcccacagagtgctgggcctgagaggcgccagagagctggccgtgaccatggccatgagagagctggtggaggccgagtgcggcggcgccaaccccctgatgaagctggccggccacttcacccaggacaaggccctgagacaggagggcctgagacccggcccctggccccccggcgcccccgccagcgaggccgccagcaagcccctgggcgtggccagcgaggacgagctggtggccgagttcctgcaggaccagaacgcccccctggtgagcagagccccccagaccttcaagatggacgacctgctggccgagatgcagcagatcgagcagagcaacttcagacaggccccccagagagcccccggcgtggccgacctggccctgagcgagaactgggcccaggagttcctggccgccggcgacgccgtggacgtgacccaggactacaacgagaccgactggagccaggagttcatcagcgaggtgaccgaccccctgagcgtgagccccgccagatgggccgaggagtacctggagcagagcgaggagaagctgtggctgggcgagcccgagggcaccgccaccgacagatggtacgacgagtaccaccccgaggaggacctgcagcacaccgccagcgacttcgtggccaaggtggacgaccccaagctggccaacagcgagttcctgaagttcgtgagacagatcggcgagggccaggtgagcctggagagcggcgccggcagcggcagagcccaggccgagcagtgggccgccgagttcatccagcagcagggcaccagcgacgcctgggtggaccagttcaccagacccgtgaacaccagcgccctggacatggagttcgagagagccaagagcgccatcgagagcgacgtggacttctgggacaagctgcaggccgagctggaggagatggccaagagagacgccgaggcccacccctggctgagcgactacgacgacctgaccagcgccacctacgacaagggctaccagttcgaggaggagaaccccctgagagaccacccccagcccttcgaggagggcctgagaagactgcaggagggcgacctgcccaacgccgtgctgctgttcgaggccgccgtgcagcaggaccccaagcacatggaggcctggcagtacctgggcaccacccaggccgagaacgagcaggagctgctggccatcagcgccctgagaagatgcctggagctgaagcccgacaaccagaccgccctgatggccctggccgtgagcttcaccaacgagagcctgcagagacaggcctgcgagaccctgagagactggctgagatacacccccgcctacgcccacctggtgacccccgccgaggagggcgccggcggcgccggcctgggccccagcaagagaatcctgggcagcctgctgagcgacagcctgttcctggaggtgaaggagctgttcctggccgccgtgagactggaccccaccagcatcgaccccgacgtgcagtgcggcctgggcgtgctgttcaacctgagcggcgagtacgacaaggccgtggactgcttcaccgccgccctgagcgtgagacccaacgactacctgctgtggaacaagctgggcgccaccctggccaacggcaaccagagcgaggaggccgtggccgcctacagaagagccctggagctgcagcccggctacatcagaagcagatacaacctgggcatcagctgcatcaacctgggcgcccacagagaggccgtggagcacttcctggaggccctgaacatgcagagaaagagcagaggccccagaggcgagggcggcgccatgagcgagaacatctggagcaccctgagactggccctgagcatgctgggccagagcgacgcctacggcgccgccgacgccagagacctgagcaccctgctgaccatgttcggcctgccccagtag

SEQ ID NO: 92827 - DNA, 1920 bp, Artificial Sequence
  Description of Artificial Sequence: Synthetic coding sequence
atggccatgagagagctggtggaggccgagtgcggcggcgccaaccccctgatgaagctggccggccacttcacccaggacaaggccctgagacaggagggcctgagacccggcccctggccccccggcgcccccgccagcgaggccgccagcaagcccctgggcgtggccagcgaggacgagctggtggccgagttcctgcaggaccagaacgcccccctggtgagcagagccccccagaccttcaagatggacgacctgctggccgagatgcagcagatcgagcagagcaacttcagacaggccccccagagagcccccggcgtggccgacctggccctgagcgagaactgggcccaggagttcctggccgccggcgacgccgtggacgtgacccaggactacaacgagaccgactggagccaggagttcatcagcgaggtgaccgaccccctgagcgtgagccccgccagatgggccgaggagtacctggagcagagcgaggagaagctgtggctgggcgagcccgagggcaccgccaccgacagatggtacgacgagtaccaccccgaggaggacctgcagcacaccgccagcgacttcgtggccaaggtggacgaccccaagctggccaacagcgagttcctgaagttcgtgagacagatcggcgagggccaggtgagcctggagagcggcgccggcagcggcagagcccaggccgagcagtgggccgccgagttcatccagcagcagggcaccagcgacgcctgggtggaccagttcaccagacccgtgaacaccagcgccctggacatggagttcgagagagccaagagcgccatcgagagcgacgtggacttctgggacaagctgcaggccgagctggaggagatggccaagagagacgccgaggcccacccctggctgagcgactacgacgacctgaccagcgccacctacgacaagggctaccagttcgaggaggagaaccccctgagagaccacccccagcccttcgaggagggcctgagaagactgcaggagggcgacctgcccaacgccgtgctgctgttcgaggccgccgtgcagcaggaccccaagcacatggaggcctggcagtacctgggcaccacccaggccgagaacgagcaggagctgctggccatcagcgccctgagaagatgcctggagctgaagcccgacaaccagaccgccctgatggccctggccgtgagcttcaccaacgagagcctgcagagacaggcctgcgagaccctgagagactggctgagatacacccccgcctacgcccacctggtgacccccgccgaggagggcgccggcggcgccggcctgggccccagcaagagaatcctgggcagcctgctgagcgacagcctgttcctggaggtgaaggagctgttcctggccgccgtgagactggaccccaccagcatcgaccccgacgtgcagtgcggcctgggcgtgctgttcaacctgagcggcgagtacgacaaggccgtggactgcttcaccgccgccctgagcgtgagacccaacgactacctgctgtggaacaagctgggcgccaccctggccaacggcaaccagagcgaggaggccgtggccgcctacagaagagccctggagctgcagcccggctacatcagaagcagatacaacctgggcatcagctgcatcaacctgggcgcccacagagaggccgtggagcacttcctggaggccctgaacatgcagagaaagagcagaggccccagaggcgagggcggcgccatgagcgagaacatctggagcaccctgagactggccctgagcatgctgggccagagcgacgcctacggcgccgccgacgccagagacctgagcaccctgctgaccatgttcggcctgccccagtag

SEQ ID NO: 92828 - DNA, 1965 bp, Artificial Sequence
  Description of Artificial Sequence: Synthetic coding sequence
atggccatgagagagctggtggaggccgagtgcggcggcgccaaccccctgatgaagctggccggccacttcacccaggacaaggccctgagacaggagggcctgagacccggcccctggccccccggcgcccccgccagcgaggccgtgagcgtgctggaggtggagagccccggcgccgccagcgaggccgccagcaagcccctgggcgtggccagcgaggacgagctggtggccgagttcctgcaggaccagaacgcccccctggtgagcagagccccccagaccttcaagatggacgacctgctggccgagatgcagcagatcgagcagagcaacttcagacaggccccccagagagcccccggcgtggccgacctggccctgagcgagaactgggcccaggagttcctggccgccggcgacgccgtggacgtgacccaggactacaacgagaccgactggagccaggagttcatcagcgaggtgaccgaccccctgagcgtgagccccgccagatgggccgaggagtacctggagcagagcgaggagaagctgtggctgggcgagcccgagggcaccgccaccgacagatggtacgacgagtaccaccccgaggaggacctgcagcacaccgccagcgacttcgtggccaaggtggacgaccccaagctggccaacagcgagttcctgaagttcgtgagacagatcggcgagggccaggtgagcctggagagcggcgccggcagcggcagagcccaggccgagcagtgggccgccgagttcatccagcagcagggcaccagcgacgcctgggtggaccagttcaccagacccgtgaacaccagcgccctggacatggagttcgagagagccaagagcgccatcgagagcgacgtggacttctgggacaagctgcaggccgagctggaggagatggccaagagagacgccgaggcccacccctggctgagcgactacgacgacctgaccagcgccacctacgacaagggctaccagttcgaggaggagaaccccctgagagaccacccccagcccttcgaggagggcctgagaagactgcaggagggcgacctgcccaacgccgtgctgctgttcgaggccgccgtgcagcaggaccccaagcacatggaggcctggcagtacctgggcaccacccaggccgagaacgagcaggagctgctggccatcagcgccctgagaagatgcctggagctgaagcccgacaaccagaccgccctgatggccctggccgtgagcttcaccaacgagagcctgcagagacaggcctgcgagaccctgagagactggctgagatacacccccgcctacgcccacctggtgacccccgccgaggagggcgccggcggcgccggcctgggccccagcaagagaatcctgggcagcctgctgagcgacagcctgttcctggaggtgaaggagctgttcctggccgccgtgagactggaccccaccagcatcgaccccgacgtgcagtgcggcctgggcgtgctgttcaacctgagcggcgagtacgacaaggccgtggactgcttcaccgccgccctgagcgtgagacccaacgactacctgctgtggaacaagctgggcgccaccctggccaacggcaaccagagcgaggaggccgtggccgcctacagaagagccctggagctgcagcccggctacatcagaagcagatacaacctgggcatcagctgcatcaacctgggcgcccacagagaggccgtggagcacttcctggaggccctgaacatgcagagaaagagcagaggccccagaggcgagggcggcgccatgagcgagaacatctggagcaccctgagactggccctgagcatgctgggccagagcgacgcctacggcgccgccgacgccagagacctgagcaccctgctgaccatgttcggcctgccccagtag

SEQ ID NO: 92829 - DNA, 1920 bp, Artificial Sequence; identical to SEQ ID NO: 92827
  Description of Artificial Sequence: Synthetic coding sequence

SEQ ID NO: 92830 - DNA, 345 bp, Artificial Sequence
  Description of Artificial Sequence: Synthetic coding sequence
atggccatgagagagctggtggaggccgagtgcggcggcgccaaccccctgatgaagctggccggccacttcacccaggacaaggccctgagacaggagggcctgagacccggcccctggccccccggcgcccccgccagcgaggccgccagcaagcccctgggcgtggccagcgaggacgagctggtggccgagttcctgcaggaccagaacgcccccctggtgagcagagccccccagaccttcaagatggacgacctgctggccgagatgcagcagatcgagcagagcaacttcagacaggccccccagagagcccccggcgtggccgacctggccctgtag

SEQ ID NO: 92831 - DNA, 309 bp, Artificial Sequence
  Description of Artificial Sequence: Synthetic coding sequence
atggccatgagagagctggtggaggccgagtgcggcggcgccaaccccctgatgaagctggccggccacttcacccaggacaaggccctgagacaggagggcctgagacccggcccctggccccccggcgcccccgccagcgaggccgccagcaagcccctgggcgtggccagcgaggacgagctggtggccgagttcctgcaggaccagaacgcccccctggtgagcagagccccccagaccttcaagatggacgacctgctggccgagatgcagcagatcgagcagagcaacttcagacaggcctag

SEQ ID NO: 92832 - DNA, 747 bp, Artificial Sequence
  Description of Artificial Sequence: Synthetic coding sequence
atggccatgagagagctggtggaggccgagtgcggcggcgccaaccccctgatgaagctggccggccacttcacccaggacaaggccctgagacaggagggcctgagacccggcccctggccccccggcgcccccgccagcgaggccgccagcaagcccctgggcgtggccagcgaggacgagctggtggccgagttcctgcaggaccagaacgcccccctggtgagcagagccccccagaccttcaagatggacgacctgctggccgagatgcagcagatcgagcagagcaacttcagacaggccccccagagagcccccggcgtggccgacctggccctgagcgagaactgggcccaggagttcctggccgccggcgacgccgtggacgtgacccaggactacaacgagaccgactggagccaggagttcatcagcgaggtgaccgaccccctgagcgtgagccccgccagatgggccgaggagtacctggagcagagcgaggagaagctgtggctgggcgagcccgagggcaccgccaccgacagatggtacgacgagtaccaccccgaggaggacctgcagcacaccgccagcgacttcgtggccaaggtggacgaccccaagctggccaacagcgagttcctgaagttcgtgagacagatcggcgagggccaggtgagcctggagagcggcgccggcagcggcagagcccaggccgagcagtgggccgccgagttcatctag

SEQ ID NO: 92833 - DNA, 315 bp, Artificial Sequence
  Description of Artificial Sequence: Synthetic coding sequence
atggccatgagagagctggtggaggccgagtgcggcggcgccaaccccctgatgaagctggccggccacttcacccaggacaaggccctgagacaggagggcctgagacccggcccctggccccccggcgcccccgccagcgaggccgccagcaagcccctgggcgtggccagcgaggacgagctggtggccgagttcctgcaggaccagaacgcccccctggtgagcagagccccccagaccttcaagatggacgacctgctggccgagatgcagcagatcgagcagagcaacttcagacaggccccccagtag

SEQ ID NO: 92834 - DNA, 1875 bp, Artificial Sequence
  Description of Artificial Sequence: Synthetic coding sequence
atgtaccagggccacatgcaggtggtgggcgtgaccctgaagaagaagtggcactgcctgcagaagagcgacctgaccctggccctgggcaagggcagcagagccgccgacaaggccgtggccatggtgatgaaggagatccccagagaggagagcgccgaggagaagcccctgctgaccatgaccagccagctggtgaacgagcagcaggagagcagacccctgctgagccccagcatcgacgacttcctgtgcgagaccaagagcgaggccatcgccagacccgtgaccagcaacaccgccgtgctgaccaccggcctggacctgctggacctgagcgagcccgtgagccagacccagaccaaggccaagaagagcgagcccagcagcaagaccagcagcctgaagaagaaggccgacggcagcgacctgatcagcaccgacgccgagcagagaggccagcccctgagagtgcccgagaccagcagcctggacctggacatccagacccagctggagaagtgggacgacgtgaagttccacggcgacagaaacaccaagggccaccccatggccgagagaaagagcagcagcagcagaaccggcagcaaggagctgctgtggagcagcgagcacagaagccagcccgagctgagcggcggcaagagcgccctgaacagcgagagcgccagcgagctggagctggtggcccccacccaggccagactgaccaaggagcacagatggggcagcgccctgctgagcagaaaccacagcctggaggaggagttcgagagagccaaggccgccgtggagagcgacaccgagttctgggacaagatgcaggccgagtgggaggagatggccagaagaaactggatcagcgagaaccaggaggcccagaaccaggtgaccatcagcgccagcgagaagggctactacttccacaccgagaaccccttcaaggactggcccggcgccttcgaggagggcctgaagagactgaaggagggcgacctgcccgtgaccatcctgttcatggaggccgccatcctgcaggaccccggcgacgccgaggcctggcagttcctgggcatcacccaggccgagaacgagaacgagcaggccgccatcgtggccctgcagagatgcctggagctgcagcccaacaacctgaaggccctgatggccctggccgtgagctacaccaacaccggccaccagcaggacgcctgcgacgccctgaagaactggatcaagcagaaccccaagtacaagtacctggtgaagagcaagaagggcagccccggcctgaccagaagaatgagcaagagccccgtggacagcagcgtgctggagggcgtgaaggagctgtacctggaggccgcccaccagaacggcgacatgatcgaccccgacctgcagaccggcctgggcgtgctgttccacctgagcggcgagttcaacagagccatcgacgccttcaacgccgccctgaccgtgagacccgaggactacagcctgtggaacagactgggcgccaccctggccaacggcgacagaagcgaggaggccgtggaggcctacaccagagccctggagatccagcccggcttcatcagaagcagatacaacctgggcatcagctgcatcaacctgggcgcctacagagaggccgtgagcaacttcctgaccgccctgagcctgcagagaaagagcagaaaccagcagcaggtgccccaccccgccatcagcggcaacatctgggccgccctgagaatcgccctgagcctgatggaccagcccgagctgttccaggccgccaacctgggcgacctggacgtgctgctgagagccttcaacctggacccctag

SEQ ID NO: 92835 - DNA, 1875 bp, Artificial Sequence
  Description of Artificial Sequence: Synthetic coding sequence
atgcaccagaacggcagccaggtggtgggcgtgaccctgaagaagaagtggcactgcctgcagaagagcgacctgaccctggccctgggcaagggcagcagagccgccgacaaggccgtggccatggtgatgaaggagatccccagagaggagagcgccgaggagaagcccctgctgaccatgaccagccagctggtgaacgagcagcaggagagcagacccctgctgagccccagcatcgacgacttcctgtgcgagaccaagagcgaggccatcgccagacccgtgaccagcaacaccgccgtgctgaccaccggcctggacctgctggacctgagcgagcccgtgagccagacccagaccaaggccaagaagagcgagcccagcagcaagaccagcagcctgaagaagaaggccgacggcagcgacctgatcagcaccgacgccgagcagagaggccagcccctgagagtgcccgagaccagcagcctggacctggacatccagacccagctggagaagtgggacgacgtgaagttccacggcgacagaaacaccaagggccaccccatggccgagagaaagagcagcagcagcagaaccggcagcaaggagctgctgtggagcagcgagcacagaagccagcccgagctgagcggcggcaagagcgccctgaacagcgagagcgccagcgagctggagctggtggcccccacccaggccagactgaccaaggagcacagatggggcagcgccctgctgagcagaaaccacagcctggaggaggagttcgagagagccaaggccgccgtggagagcgacaccgagttctgggacaagatgcaggccgagtgggaggagatggccagaagaaactggatcagcgagaaccaggaggcccagaaccaggtgaccatcagcgccagcgagaagggctactacttccacaccgagaaccccttcaaggactggcccggcgccttcgaggagggcctgaagagactgaaggagggcgacctgcccgtgaccatcctgttcatggaggccgccatcctgcaggaccccggcgacgccgaggcctggcagttcctgggcatcacccaggccgagaacgagaacgagcaggccgccatcgtggccctgcagagatgcctggagctgcagcccaacaacctgaaggccctgatggccctggccgtgagctacaccaacaccggccaccagcaggacgcctgcgacgccctgaagaactggatcaagcagaaccccaagtacaagtacctggtgaagagcaagaagggcagccccggcctgaccagaagaatgagcaagagccccgtggacagcagcgtgctggagggcgtgaaggagctgtacctggaggccgcccaccagaacggcgacatgatcgaccccgacctgcagaccggcctgggcgtgctgttccacctgagcggcgagttcaacagagccatcgacgccttcaacgccgccctgaccgtgagacccgaggactacagcctgtggaacagactgggcgccaccctggccaacggcgacagaagcgaggaggccgtggaggcctacaccagagccctggagatccagcccggcttcatcagaagcagatacaacctgggcatcagctgcatcaacctgggcgcctacagagaggccgtgagcaacttcctgaccgccctgagcctgcagagaaagagcagaaaccagcagcaggtgccccaccccgccatcagcggcaacatctgggccgccctgagaatcgccctgagcctgatggaccagcccgagctgttccaggccgccaacctgggcgacctggacgtgctgctgagagccttcaacctggacccctag

SEQ ID NO: 92836 - DNA, 1557 bp, Artificial Sequence
  Description of Artificial Sequence: Synthetic coding sequence
atggtgatgaaggagatccccagagaggagagcgccgaggagaagcccctgctgaccatgaccagccagctggtgaacgagcagcaggagagcagacccctgctgagccccagcatcgacgacttcctgtgcgagaccaagagcgaggccatcgccagacccgtgaccagcaacaccgccgacatccagacccagctggagaagtgggacgacgtgaagttccacggcgacagaaacaccaagggccaccccatggccgagagaaagagcagcagcagcagaaccggcagcaaggagctgctgtggagcagcgagcacagaagccagcccgagctgagcggcggcaagagcgccctgaacagcgagagcgccagcgagctggagctggtggcccccacccaggccagactgaccaaggagcacagatggggcagcgccctgctgagcagaaaccacagcctggaggaggagttcgagagagccaaggccgccgtggagagcgacaccgagttctgggacaagatgcaggccgagtgggaggagatggccagaagaaactggatcagcgagaaccaggaggcccagaaccaggtgaccatcagcgccagcgagaagggctactacttccacaccgagaaccccttcaaggactggcccggcgccttcgaggagggcctgaagagactgaaggagggcgacctgcccgtgaccatcctgttcatggaggccgccatcctgcaggaccccggcgacgccgaggcctggcagttcctgggcatcacccaggccgagaacgagaacgagcaggccgccatcgtggccctgcagagatgcctggagctgcagcccaacaacctgaaggccctgatggccctggccgtgagctacaccaacaccggccaccagcaggacgcctgcgacgccctgaagaactggatcaagcagaaccccaagtacaagtacctggtgaagagcaagaagggcagccccggcctgaccagaagaatgagcaagagccccgtggacagcagcgtgctggagggcgtgaaggagctgtacctggaggccgcccaccagaacggcgacatgatcgaccccgacctgcagaccggcctgggcgtgctgttccacctgagcggcgagttcaacagagccatcgacgccttcaacgccgccctgaccgtgagacccgaggactacagcctgtggaacagactgggcgccaccctggccaacggcgacagaagcgaggaggccgtggaggcctacaccagagccctggagatccagcccggcttcatcagaagcagatacaacctgggcatcagctgcatcaacctgggcgcctacagagaggccgtgagcaacttcctgaccgccctgagcctgcagagaaagagcagaaaccagcagcaggtgccccaccccgccatcagcggcaacatctgggccgccctgagaatcgccctgagcctgatggaccagcccgagctgttccaggccgccaacctgggcgacctggacgtgctgctgagagccttcaacctggacccctag

SEQ ID NO: 92837 - DNA, 1809 bp, Artificial Sequence
  Description of Artificial Sequence: Synthetic coding sequence
atgtaccagggccacatgcagggcaagggcagcagagccgccgacaaggccgtggccatggtgatgaaggagatccccagagaggagagcgccgaggagaagcccctgctgaccatgaccagccagctggtgaacgagcagcaggagagcagacccctgctgagccccagcatcgacgacttcctgtgcgagaccaagagcgaggccatcgccagacccgtgaccagcaacaccgccgtgctgaccaccggcctggacctgctggacctgagcgagcccgtgagccagacccagaccaaggccaagaagagcgagcccagcagcaagaccagcagcctgaagaagaaggccgacggcagcgacctgatcagcaccgacgccgagcagagaggccagcccctgagagtgcccgagaccagcagcctggacctggacatccagacccagctggagaagtgggacgacgtgaagttccacggcgacagaaacaccaagggccaccccatggccgagagaaagagcagcagcagcagaaccggcagcaaggagctgctgtggagcagcgagcacagaagccagcccgagctgagcggcggcaagagcgccctgaacagcgagagcgccagcgagctggagctggtggcccccacccaggccagactgaccaaggagcacagatggggcagcgccctgctgagcagaaaccacagcctggaggaggagttcgagagagccaaggccgccgtggagagcgacaccgagttctgggacaagatgcaggccgagtgggaggagatggccagaagaaactggatcagcgagaaccaggaggcccagaaccaggtgaccatcagcgccagcgagaagggctactacttccacaccgagaaccccttcaaggactggcccggcgccttcgaggagggcctgaagagactgaaggagggcgacctgcccgtgaccatcctgttcatggaggccgccatcctgcaggaccccggcgacgccgaggcctggcagttcctgggcatcacccaggccgagaacgagaacgagcaggccgccatcgtggccctgcagagatgcctggagctgcagcccaacaacctgaaggccctgatggccctggccgtgagctacaccaacaccggccaccagcaggacgcctgcgacgccctgaagaactggatcaagcagaaccccaagtacaagtacctggtgaagagcaagaagggcagccccggcctgaccagaagaatgagcaagagccccgtggacagcagcgtgctggagggcgtgaaggagctgtacctggaggccgcccaccagaacggcgacatgatcgaccccgacctgcagaccggcctgggcgtgctgttccacctgagcggcgagttcaacagagccatcgacgccttcaacgccgccctgaccgtgagacccgaggactacagcctgtggaacagactgggcgccaccctggccaacggcgacagaagcgaggaggccgtggaggcctacaccagagccctggagatccagcccggcttcatcagaagcagatacaacctgggcatcagctgcatcaacctgggcgcctacagagaggccgtgagcaacttcctgaccgccctgagcctgcagagaaagagcagaaaccagcagcaggtgccccaccccgccatcagcggcaacatctgggccgccctgagaatcgccctgagcctgatggaccagcccgagctgttccaggccgccaacctgggcgacctggacgtgctgctgagagccttcaacctggacccctag

SEQ ID NO: 92838 - DNA, 1545 bp, Artificial Sequence
  Description of Artificial Sequence: Synthetic coding sequence
atgagcagcctgagcctgaagcccctggtgcaggtgagcgtgggcgccttcgtgcagctggtgaacgagcagcaggagagcagacccctgctgagccccagcatcgacgacttcctgtgcgagaccaagagcgaggccatcgccagacccgtgaccagcaacaccgccgacatccagacccagctggagaagtgggacgacgtgaagttccacggcgacagaaacaccaagggccaccccatggccgagagaaagagcagcagcagcagaaccggcagcaaggagctgctgtggagcagcgagcacagaagccagcccgagctgagcggcggcaagagcgccctgaacagcgagagcgccagcgagctggagctggtggcccccacccaggccagactgaccaaggagcacagatggggcagcgccctgctgagcagaaaccacagcctggaggaggagttcgagagagccaaggccgccgtggagagcgacaccgagttctgggacaagatgcaggccgagtgggaggagatggccagaagaaactggatcagcgagaaccaggaggcccagaaccaggtgaccatcagcgccagcgagaagggctactacttccacaccgagaaccccttcaaggactggcccggcgccttcgaggagggcctgaagagactgaaggagggcgacctgcccgtgaccatcctgttcatggaggccgccatcctgcaggaccccggcgacgccgaggcctggcagttcctgggcatcacccaggccgagaacgagaacgagcaggccgccatcgtggccctgcagagatgcctggagctgcagcccaacaacctgaaggccctgatggccctggccgtgagctacaccaacaccggccaccagcaggacgcctgcgacgccctgaagaactggatcaagcagaaccccaagtacaagtacctggtgaagagcaagaagggcagccccggcctgaccagaagaatgagcaagagccccgtggacagcagcgtgctggagggcgtgaaggagctgtacctggaggccgcccaccagaacggcgacatgatcgaccccgacctgcagaccggcctgggcgtgctgttccacctgagcggcgagttcaacagagccatcgacgccttcaacgccgccctgaccgtgagacccgaggactacagcctgtggaacagactgggcgccaccctggccaacggcgacagaagcgaggaggccgtggaggcctacaccagagccctggagatccagcccggcttcatcagaagcagatacaacctgggcatcagctgcatcaacctgggcgcctacagagaggccgtgagcaacttcctgaccgccctgagcctgcagagaaagagcagaaaccagcagcaggtgccccaccccgccatcagcggcaacatctgggccgccctgagaatcgccctgagcctgatggaccagcccgagctgttccaggccgccaacctgggcgacctggacgtgctgctgagagccttcaacctggacccctag

SEQ ID NO: 92839 - DNA, 1881 bp, Artificial Sequence
  Description of Artificial Sequence: Synthetic coding sequence
atgtaccagggccacatgcagaagagcaaggagcagggctacggcaagctgagcagcgacgaggacctggagatcatcgtggaccagaagcagggcaagggcagcagagccgccgacaaggccgtggccatggtgatgaaggagatccccagagaggagagcgccgaggagaagcccctgctgaccatgaccagccagctggtgaacgagcagcaggagagcagacccctgctgagccccagcatcgacgacttcctgtgcgagaccaagagcgaggccatcgccagacccgtgaccagcaacaccgccgtgctgaccaccggcctggacctgctggacctgagcgagcccgtgagccagacccagaccaaggccaagaagagcgagcccagcagcaagaccagcagcctgaagaagaaggccgacggcagcgacctgatcagcaccgacgccgagcagagaggccagcccctgagagtgcccgagaccagcagcctggacctggacatccagacccagctggagaagtgggacgacgtgaagttccacggcgacagaaacaccaagggccaccccatggccgagagaaagagcagcagcagcagaaccggcagcaaggagctgctgtggagcagcgagcacagaagccagcccgagctgagcggcggcaagagcgccctgaacagcgagagcgccagcgagctggagctggtggcccccacccaggccagactgaccaaggagcacagatggggcagcgccctgctgagcagaaaccacagcctggaggaggagttcgagagagccaaggccgccgtggagagcgacaccgagttctgggacaagatgcaggccgagtgggaggagatggccagaagaaactggatcagcgagaaccaggaggcccagaaccaggtgaccatcagcgccagcgagaagggctactacttccacaccgagaaccccttcaaggactggcccggcgccttcgaggagggcctgaagagactgaaggagggcgacctgcccgtgaccatcctgttcatggaggccgccatcctgcaggaccccggcgacgccgaggcctggcagttcctgggcatcacccaggccgagaacgagaacgagcaggccgccatcgtggccctgcagagatgcctggagctgcagcccaacaacctgaaggccctgatggccctggccgtgagctacaccaacaccggccaccagcaggacgcctgcgacgccctgaagaactggatcaagcagaaccccaagtacaagtacctggtgaagagcaagaagggcagccccggcctgaccagaagaatgagcaagagccccgtggacagcagcgtgctggagggcgtgaaggagctgtacctggaggccgcccaccagaacggcgacatgatcgaccccgacctgcagaccggcctgggcgtgctgttccacctgagcggcgagttcaacagagccatcgacgccttcaacgccgccctgaccgtgagacccgaggactacagcctgtggaacagactgggcgccaccctggccaacggcgacagaagcgaggaggccgtggaggcctacaccagagccctggagatccagcccggcttcatcagaagcagatacaacctgggcatcagctgcatcaacctgggcgcctacagagaggccgtgagcaacttcctgaccgccctgagcctgcagagaaagagcagaaaccagcagcaggtgccccaccccgccatcagcggcaacatctgggccgccctgagaatcgccctgagcctgatggaccagcccgagctgttccaggccgccaacctgggcgacctggacgtgctgctgagagccttcaacctggacccctag

SEQ ID NO: 92840 - DNA, 1752 bp, Artificial Sequence
  Description of Artificial Sequence: Synthetic coding sequence
atggtgatgaaggagatccccagagaggagagcgccgaggagaagcccctgctgaccatgaccagccagctggtgaacgagcagcaggagagcagacccctgctgagccccagcatcgacgacttcctgtgcgagaccaagagcgaggccatcgccagacccgtgaccagcaacaccgccgtgctgaccaccggcctggacctgctggacctgagcgagcccgtgagccagacccagaccaaggccaagaagagcgagcccagcagcaagaccagcagcctgaagaagaaggccgacggcagcgacctgatcagcaccgacgccgagcagagaggccagcccctgagagtgcccgagaccagcagcctggacctggacatccagacccagctggagaagtgggacgacgtgaagttccacggcgacagaaacaccaagggccaccccatggccgagagaaagagcagcagcagcagaaccggcagcaaggagctgctgtggagcagcgagcacagaagccagcccgagctgagcggcggcaagagcgccctgaacagcgagagcgccagcgagctggagctggtggcccccacccaggccagactgaccaaggagcacagatggggcagcgccctgctgagcagaaaccacagcctggaggaggagttcgagagagccaaggccgccgtggagagcgacaccgagttctgggacaagatgcaggccgagtgggaggagatggccagaagaaactggatcagcgagaaccaggaggcccagaaccaggtgaccatcagcgccagcgagaagggctactacttccacaccgagaaccccttcaaggactggcccggcgccttcgaggagggcctgaagagactgaaggagggcgacctgcccgtgaccatcctgttcatggaggccgccatcctgcaggaccccggcgacgccgaggcctggcagttcctgggcatcacccaggccgagaacgagaacgagcaggccgccatcgtggccctgcagagatgcctggagctgcagcccaacaacctgaaggccctgatggccctggccgtgagctacaccaacaccggccaccagcaggacgcctgcgacgccctgaagaactggatcaagcagaaccccaagtacaagtacctggtgaagagcaagaagggcagccccggcctgaccagaagaatgagcaagagccccgtggacagcagcgtgctggagggcgtgaaggagctgtacctggaggccgcccaccagaacggcgacatgatcgaccccgacctgcagaccggcctgggcgtgctgttccacctgagcggcgagttcaacagagccatcgacgccttcaacgccgccctgaccgtgagacccgaggactacagcctgtggaacagactgggcgccaccctggccaacggcgacagaagcgaggaggccgtggaggcctacaccagagccctggagatccagcccggcttcatcagaagcagatacaacctgggcatcagctgcatcaacctgggcgcctacagagaggccgtgagcaacttcctgaccgccctgagcctgcagagaaagagcagaaaccagcagcaggtgccccaccccgccatcagcggcaacatctgggccgccctgagaatcgccctgagcctgatggaccagcccgagctgttccaggccgccaacctgggcgacctggacgtgctgctgagagccttcaacctggacccctag

SEQ ID NO: 92841 - DNA, 1776 bp, Artificial Sequence
  Description of Artificial Sequence: Synthetic coding sequence
atgtaccagggccacatgcagaagagcaaggagcagggctacggcaagctgagcagcgacgaggacctggagatcatcgtggaccagaagcagctggtgaacgagcagcaggagagcagacccctgctgagccccagcatcgacgacttcctgtgcgagaccaagagcgaggccatcgccagacccgtgaccagcaacaccgccgtgctgaccaccggcctggacctgctggacctgagcgagcccgtgagccagacccagaccaaggccaagaagagcgagcccagcagcaagaccagcagcctgaagaagaaggccgacggcagcgacctgatcagcaccgacgccgagcagagaggccagcccctgagagtgcccgagaccagcagcctggacctggacatccagacccagctggagaagtgggacgacgtgaagttccacggcgacagaaacaccaagggccaccccatggccgagagaaagagcagcagcagcagaaccggcagcaaggagctgctgtggagcagcgagcacagaagccagcccgagctgagcggcggcaagagcgccctgaacagcgagagcgccagcgagctggagctggtggcccccacccaggccagactgaccaaggagcacagatggggcagcgccctgctgagcagaaaccacagcctggaggaggagttcgagagagccaaggccgccgtggagagcgacaccgagttctgggacaagatgcaggccgagtgggaggagatggccagaagaaactggatcagcgagaaccaggaggcccagaaccaggtgaccatcagcgccagcgagaagggctactacttccacaccgagaaccccttcaaggactggcccggcgccttcgaggagggcctgaagagactgaaggagggcgacctgcccgtgaccatcctgttcatggaggccgccatcctgcaggaccccggcgacgccgaggcctggcagttcctgggcatcacccaggccgagaacgagaacgagcaggccgccatcgtggccctgcagagatgcctggagctgcagcccaacaacctgaaggccctgatggccctggccgtgagctacaccaacaccggccaccagcaggacgcctgcgacgccctgaagaactggatcaagcagaaccccaagtacaagtacctggtgaagagcaagaagggcagccccggcctgaccagaagaatgagcaagagccccgtggacagcagcgtgctggagggcgtgaaggagctgtacctggaggccgcccaccagaacggcgacatgatcgaccccgacctgcagaccggcctgggcgtgctgttccacctgagcggcgagttcaacagagccatcgacgccttcaacgccgccctgaccgtgagacccgaggactacagcctgtggaacagactgggcgccaccctggccaacggcgacagaagcgaggaggccgtggaggcctacaccagagccctggagatccagcccggcttcatcagaagcagatacaacctgggcatcagctgcatcaacctgggcgcctacagagaggccgtgagcaacttcctgaccgccctgagcctgcagagaaagagcagaaaccagcagcaggtgccccaccccgccatcagcggcaacatctgggccgccctgagaatcgccctgagcctgatggaccagcccgagctgttccaggccgccaacctgggcgacctggacgtgctgctgagagccttcaacctggacccctag

SEQ ID NO: 92842 - DNA, 2217 bp, Artificial Sequence
  Description of Artificial Sequence: Synthetic coding sequence
atggccctggccgtgctgagagtgctggagcccttccccaccgagaccccccccctggccgtgctgctgccccccggcggcccctggcccgccgccgagctgggcctggtgctggccctgagacccgccggcgagagccccgccggccccgccctgctggtggccgccctggagggccccgacgccggcaccgaggagcagggccccggccccccccagctgctggtgagcagagccctgctgagactgctggccctgggcagcggcgcctgggtgagagccagagccgtgagaagaccccccgccctgggctgggccctgctgggcaccagcctgggccccggcctgggccccagagtgggccccctgctggtgagaagaggcgagaccctgcccgtgcccggccccagagtgctggagaccagacccgccctgcagggcctgctgggccccggcaccagactggccgtgaccgagctgagaggcagagccagactgtgccccgagagcggcgacagcagcagacccccccccccccccgtggtgagcagcttcgccgtgagcggcaccgtgagaagactgcagggcgtgctgggcggcaccggcgacagcctgggcgtgagcagaagctgcctgagaggcctgggcctgttccagggcgagtgggtgtgggtggcccaggccagagagagcagcaacaccagccagccccacctggccagagtgcaggtgctggagcccagatgggacctgagcgacagactgggccccggcagcggccccctgggcgagcccctggccgacggcctggccctggtgcccgccaccctggccttcaacctgggctgcgaccccctggagatgggcgagctgagaatccagagatacctggagggcagcatcgcccccgaggacaagggcagctgcagcctgctgcccggcccccccttcgccagagagctgcacatcgagatcgtgagcagcccccactacagcaccaacggcaactacgacggcgtgctgtacagacacttccagatccccagagtggtgcaggagggcgacgtgctgtgcgtgcccaccatcggccaggtggagatcctggagggcagccccgagaagctgcccagatggagagagatgttcttcaaggtgaagaagaccgtgggcgaggcccccgacggccccgccagcgcctacctggccgacaccacccacaccagcctgtacatggtgggcagcaccctgagccccgtgccctggctgcccagcgaggagagcaccctgtggagcagcctgagcccccccggcctggaggccctggtgagcgagctgtgcgccgtgctgaagcccagactgcagcccggcggcgccctgctgaccggcaccagcagcgtgctgctgagaggcccccccggctgcggcaagaccaccgtggtggccgccgcctgcagccacctgggcctgcacctgctgaaggtgccctgcagcagcctgtgcgccgagagcagcggcgccgtggagaccaagctgcaggccatcttcagcagagccagaagatgcagacccgccgtgctgctgctgaccgccgtggacctgctgggcagagacagagacggcctgggcgaggacgccagagtgatggccgtgctgagacacctgctgctgaacgaggaccccctgaacagctgcccccccctgatggtggtggccaccaccagcagagcccaggacctgcccgccgacgtgcagaccgccttcccccacgagctggaggtgcccgccctgagcgagggccagagactgagcatcctgagagccctgaccgcccacctgcccctgggccaggaggtgaacctggcccagctggccagaagatgcgccggcttcgtggtgggcgacctgtacgccctgctgacccacagcagcagagccgcctgcaccagaatcaagaacagcggcctggccggcggcctgaccgaggaggacgagggcgagctgtgcgccgccggcttccccctgctggccgaggacttcggccaggccctggagcagctgcagaccgcccacagccaggccgtgggcgcccccaaggtggagaccaagagcctggagtgcctgcccggccccggcctgcagctgcacgccctgagcagcctgatgaactggaccctgtggccccaggccggcggcgaggtggagatcctggaggagtag

SEQ ID NO: 92843 - DNA, 2943 bp, Artificial Sequence
  Description of Artificial Sequence: Synthetic coding sequence
atggccctggccgtgctgagagtgctggagcccttccccaccgagaccccccccctggccgtgctgctgccccccggcggcccctggcccgccgccgagctgggcctggtgctggccctgagacccgccggcgagagccccgccggccccgccctgctggtggccgccctggagggccccgacgccggcaccgaggagcagggccccggccccccccagctgctggtgagcagagccctgctgagactgctggccctgggcagcggcgcctgggtgagagccagagccgtgagaagaccccccgccctgggctgggccctgctgggcaccagcctgggccccggcctgggccccagagtgggccccctgctggtgagaagaggcgagaccctgcccgtgcccggccccagagtgctggagaccagacccgccctgcagggcctgctgggccccggcaccagactggccgtgaccgagctgagaggcagagccagactgtgccccgagagcggcgacagcagcagacccccccccccccccgtggtgagcagcttcgccgtgagcggcaccgtgagaagactgcagggcgtgctgggcggcaccggcgacagcctgggcgtgagcagaagctgcctgagaggcctgggcctgttccagggcgagtgggtgtgggtggcccaggccagagagagcagcaacaccagccagccccacctggccagagtgcaggtgctggagcccagatgggacctgagcgacagactgggccccggcagcggccccctgggcgagcccctggccgacggcctggccctggtgcccgccaccctggccttcaacctgggctgcgaccccctggagatgggcgagctgagaatccagagatacctggagggcagcatcgcccccgaggacaagggcagctgcagcctgctgcccggcccccccttcgccagagagctgcacatcgagatcgtgagcagcccccactacagcaccaacggcaactacgacggcgtgctgtacagacacttccagatccccagagtggtgcaggagggcgacgtgctgtgcgtgcccaccatcggccaggtggagatcctggagggcagccccgagaagctgcccagatggagagagatgttcttcaaggtgaagaagaccgtgggcgaggcccccgacggccccgccagcgcctacctggccgacaccacccacaccagcctgtacatggtgggcagcaccctgagccccgtgccctggctgcccagcgaggagagcaccctgtggagcagcctgagcccccccggcctggaggccctggtgagcgagctgtgcgccgtgctgaagcccagactgcagcccggcggcgccctgctgaccggcaccagcagcgtgctgctgagaggcccccccggctgcggcaagaccaccgtggtggccgccgcctgcagccacctgggcctgcacctgctgaaggtgccctgcagcagcctgtgcgccgagagcagcggcgccgtggagaccaagctgcaggccatcttcagcagagccagaagatgcagacccgccgtgctgctgctgaccgccgtggacctgctgggcagagacagagacggcctgggcgaggacgccagagtgatggccgtgctgagacacctgctgctgaacgaggaccccctgaacagctgcccccccctgatggtggtggccaccaccagcagagcccaggacctgcccgccgacgtgcagaccgccttcccccacgagctggaggtgcccgccctgagcgagggccagagactgagcatcctgagagccctgaccgcccacctgcccctgggccaggaggtgaacctggcccagctggccagaagatgcgccggcttcgtggtgggcgacctgtacgccctgctgacccacagcagcagagccgcctgcaccagaatcaagaacagcggcctggccggcggcctgaccgaggaggacgagggcgagctgtgcgccgccggcttccccctgctggccgaggacttcggccaggccctggagcagctgcagaccgcccacagccaggccgtgggcgcccccaagatccccagcgtgagctggcacgacgtgggcggcctgcaggaggtgaagaaggagatcctggagaccatccagctgcccctggagcaccccgagctgctgagcctgggcctgagaagaagcggcctgctgctgcacggcccccccggcaccggcaagaccctgctggccaaggccgtggccaccgagtgcagcctgaccttcctgagcgtgaagggccccgagctgatcaacatgtacgtgggccagagcgaggagaacgtgagagaggtgttcgccagagccagagccgccgccccctgcatcatcttcttcgacgagctggacagcctggcccccagcagaggcagaagcggcgacagcggcggcgtgatggacagagtggtgagccagctgctggccgagctggacggcctgcacagcacccaggacgtgttcgtgatcggcgccaccaacagacccgacctgctggaccccgccctgctgagacccggcagattcgacaagctggtgttcgtgggcgccaacgaggacagagccagccagctgagagtgctgagcgccatcaccagaaagttcaagctggagcccagcgtgagcctggtgaacgtgctggactgctgccccccccagctgaccggcgccgacctgtacagcctgtgcagcgacgccatgaccgccgccctgaagagaagagtgcacgacctggaggagggcctggagcccggcagcagcgccctgatgctgaccatggaggacctgctgcaggccgccgccagactgcagcccagcgtgagcgagcaggagctgctgagatacaagagaatccagagaaagttcgccgcctgctag

SEQ ID NO: 92844 - DNA, 972 bp, Artificial Sequence
  Description of Artificial Sequence: Synthetic coding sequence
atgagcgccgtgtgcggcggcgccgccagaatgctgagaacccccggcagacacggctacgccgccgagttcagcccctacctgcccggcagactggcctgcgccaccgcccagcactacggcatcgccggctgcggcaccctgctgatcctggaccccgacgaggccggcctgagactgttcagaagcttcgactggaacgacggcctgttcgacgtgacctggagcgagaacaacgagcacgtgctgatcacctgcagcggcgacggcagcctgcagctgtgggacaccgccaaggccgccggccccctgcaggtgtacaaggagcacgcccaggaggtgtacagcgtggactggagccagaccagaggcgagcagctggtggtgagcggcagctgggaccagaccgtgaagctgtgggaccccaccgtgggcaagagcctgtgcaccttcagaggccacgagagcatcatctacagcaccatctggagcccccacatccccggctgcttcgccagcgccagcggcgaccagaccctgagaatctgggacgtgaaggccgccggcgtgagaatcgtgatccccgcccaccaggccgagatcctgagctgcgactggtgcaagtacaacgagaacctgctggtgaccggcgccgtggactgcagcctgagaggctgggacctgagaaacgtgagacagcccgtgttcgagctgctgggccacacctacgccatcagaagagtgaagttcagccccttccacgccagcgtgctggccagctgcagctacgacttcaccgtgagattctggaacttcagcaagcccgacagcctgctggagaccgtggagcaccacaccgagttcacctgcggcctggacttcagcctgcagagccccacccaggtggccgactgcagctgggacgagaccatcaagatctacgaccccgcctgcctgaccatccccgcctag

SEQ ID NO: 92845 - DNA, 369 bp, Artificial Sequence
  Description of Artificial Sequence: Synthetic coding sequence
atgagcgccgtgtgcggcggcgccgccagaatgctgagaacccccggcagacacggctacgccgccgagttcagcccctacctgcccggcagactggcctgcgccaccgcccagcactacggcatcgccggctgcggcaccctgctgatcctggaccccgacgaggccggcctgagactgttcagaagcttcgactggaacgacggcctgttcgacgtgacctggagcgagaacaacgagcacgtgctgatcacctgcagcggcgacggcagcctgcagctgtgggacaccgccaaggccgccggccccctgcaggtgtacaaggagcacgcccaggagtacgtgcagggcagctgcgtggtgaagtag

SEQ ID NO: 92846 - DNA, 843 bp, Artificial Sequence
  Description of Artificial Sequence: Synthetic coding sequence
atgagcgccgtgtgcggcggcgccgccagaatgctgagaacccccggcagacacggctacgccgccgagttcagcccctacctgcccggcagactggcctgcgccaccgcccagcactacggcatcgccggctgcggcaccctgctgatcctggaccccgacgaggccggcctgagactgttcagaagcttcgactggaacgacggcctgttcgacgtgacctggagcgagaacaacgagcacgtgctgatcacctgcagcggcgacggcagcctgcagctgtgggacaccgccaaggccgccggccccctgcaggtgtacaaggagcacgcccaggaggtgtacagcgtggactggagccagaccagaggcgagcagctggtggtgagcggcagctgggaccagaccgtgaagctgtgggaccccaccgtgggcaagagcctgtgcaccttcagaggccacgagagcatcatctacagcaccatctggagcccccacatccccggctgcttcgccagcgccagcggcgaccagaccctgagaatctgggacgtgaaggccgccggcgtgagaatcgtgatccccgcccaccaggccgagatcctgagctgcgactggtgcaagtacaacgagaacctgctggtgaccggcgccgtggactgcagcctgagaggctgggacctgagaaacgtgagacagcccgtgttcgagctgctgggccacacctacgccatcagaagagtgaagatggagagctgccccgtgacccagaccagaagccagctgaccgccaccagcgccttctgggtgcaggccgtgctgctgccccagcccaccgagtag

SEQ ID NO: 92847 - DNA, 912 bp, Artificial Sequence
  Description of Artificial Sequence: Synthetic coding sequence
atggccagctgggccaagggcagaagctacctggcccccggcctgctgcagggccaggtggccatcgtgaccggcggcgccaccggcatcggcaaggccatcgtgaaggagctgctggagctgggcagcaacgtggtgatcgccagcagaaagctggagagactgaagagcgccgccgacgagctgcaggccaacctgccccccaccaagcaggccagagtgatccccatccagtgcaacatcagaaacgaggaggaggtgaacaacctggtgaagagcaccctggacaccttcggcaagatcaacttcctggtgaacaacggcggcggccagttcctgagccccgccgagcacatcagcagcaagggctggcacgccgtgctggagaccaacctgaccggcaccttctacatgtgcaaggccgtgtacagcagctggatgaaggagcacggcggcagcatcgtgaacatcatcgtgcccaccaaggccggcttccccctggccgtgcacagcggcgccgccagagccggcgtgtacaacctgaccaagagcctggccctggagtgggcctgcagcggcatcagaatcaactgcgtggcccccggcgtgatctacagccagaccgccgtggagaactacggcagctggggccagagcttcttcgagggcagcttccagaagatccccgccaagagaatcggcgtgcccgaggaggtgagcagcgtggtgtgcttcctgctgagccccgccgccagcttcatcaccggccagagcgtggacgtggacggcggcagaagcctgtacacccacagctacgaggtgcccgaccacgacaactggcccaagggcgccggcgacctgagcgtggtgaagaagatgaaggagaccttcaaggagaaggccaagctgtag

SEQ ID NO: 92848 - DNA, 1407 bp, Artificial Sequence
  Description of Artificial Sequence: Synthetic coding sequence
atggtggacaccgagagccccctgtgccccctgagccccctggaggccggcgacctggagagccccctgagcgaggagttcctgcaggagatgggcaacatccaggagatcagccagagcatcggcgaggacagcagcggcagcttcggcttcaccgagtaccagtacctgggcagctgccccggcagcgacggcagcgtgatcaccgacaccctgagccccgccagcagccccagcagcgtgacctaccccgtggtgcccggcagcgtggacgagagccccagcggcgccctgaacatcgagtgcagaatctgcggcgacaaggccagcggctaccactacggcgtgcacgcctgcgagggctgcaagggcttcttcagaagaaccatcagactgaagctggtgtacgacaagtgcgacagaagctgcaagatccagaagaagaacagaaacaagtgccagtactgcagattccacaagtgcctgagcgtgggcatgagccacaacgccatcagattcggcagaatgcccagaagcgagaaggccaagctgaaggccgagatcctgacctgcgagcacgacatcgaggacagcgagaccgccgacctgaagagcctggccaagagaatctacgaggcctacctgaagaacttcaacatgaacaaggtgaaggccagagtgatcctgagcggcaaggccagcaacaacccccccttcgtgatccacgacatggagaccctgtgcatggccgagaagaccctggtggccaagctggtggccaacggcatccagaacaaggaggccgaggtgagaatcttccactgctgccagtgcaccagcgtggagaccgtgaccgagctgaccgagttcgccaaggccatccccggcttcgccaacctggacctgaacgaccaggtgaccctgctgaagtacggcgtgtacgaggccatcttcgccatgctgagcagcgtgatgaacaaggacggcatgctggtggcctacggcaacggcttcatcaccagagagttcctgaagagcctgagaaagcccttctgcgacatcatggagcccaagttcgacttcgccatgaagttcaacgccctggagctggacgacagcgacatcagcctgttcgtggccgccatcatctgctgcggcgacagacccggcctgctgaacgtgggccacatcgagaagatgcaggagggcatcgtgcacgtgctgagactgcacctgcagagcaaccaccccgacgacatcttcctgttccccaagctgctgcagaagatggccgacctgagacagctggtgaccgagcacgcccagctggtgcagatcatcaagaagaccgagagcgacgccgccctgcaccccctgctgcaggagatctacagagacatgtactag

SEQ ID NO: 92849 - DNA, 1407 bp, Artificial Sequence; identical to SEQ ID NO: 92848
  Description of Artificial Sequence: Synthetic coding sequence

SEQ ID NO: 92850 - DNA, 1407 bp, Artificial Sequence; identical to SEQ ID NO: 92848
  Description of Artificial Sequence: Synthetic coding sequence

SEQ ID NO: 92851 - DNA, 1407 bp, Artificial Sequence; identical to SEQ ID NO: 92848
  Description of Artificial Sequence: Synthetic coding sequence

SEQ ID NO: 92852 - DNA, 210 bp, Artificial Sequence
  Description of Artificial Sequence: Synthetic coding sequence
atggtggacaccgagagccccctgtgccccctgagccccctggaggccggcgacctggagagccccctgagcgaggagttcctgcaggagatgggcaacatccaggagatcagccagagcatcggcgaggacagcagcggcagcttcggcttcaccgagtaccagtacctgggcagctgccccggcagcgacggcagcgtgatcacctag

SEQ ID NO: 92853 - DNA, 402 bp, Artificial Sequence
  Description of Artificial Sequence: Synthetic coding sequence
atggtggacaccgagagccccctgtgccccctgagccccctggaggccggcgacctggagagccccctgagcgaggagttcctgcaggagatgggcaacatccaggagatcagccagagcatcggcgaggacagcagcggcagcttcggcttcaccgagtaccagtacctgggcagctgccccggcagcgacggcagcgtgatcaccgacaccctgagccccgccagcagccccagcagcgtgacctaccccgtggtgcccggcagcgtggacgagagccccagcggcgccctgaacatcgagtgcagaatctgcggcgacaaggccagcggctaccactacggcgtgcacgcctgcgagggctgcaaggtggagggcagctggaacagagcctggtggtag

SEQ ID NO: 92854 - DNA, 525 bp, Artificial Sequence
  Description of Artificial Sequence: Synthetic coding sequence
atggtggacaccgagagccccctgtgccccctgagccccctggaggccggcgacctggagagccccctgagcgaggagttcctgcaggagatgggcaacatccaggagatcagccagagcatcggcgaggacagcagcggcagcttcggcttcaccgagtaccagtacctgggcagctgccccggcagcgacggcagcgtgatcaccgacaccctgagccccgccagcagccccagcagcgtgacctaccccgtggtgcccggcagcgtggacgagagccccagcggcgccctgaacatcgagtgcagaatctgcggcgacaaggccagcggctaccactacggcgtgcacgcctgcgagggctgcaagggcttcttcagaagaaccatcagactgaagctggtgtacgacaagtgcgacagaagctgcaagatccagaagaagaacagaaacaagtgccagtactgcagattccacaagtgcctgagcgtgggcatgagccacaacgccttctgccacacctag

SEQ ID NO: 92855 - DNA, 30 bp, Artificial Sequence
  Description of Artificial Sequence: Synthetic coding sequence
atggtggacaccgagagccccctgtgctag

SEQ ID NO: 92856 - DNA, 489 bp, Artificial Sequence
  Description of Artificial Sequence: Synthetic coding sequence
atgaacaaggtgaaggccagagtgatcctgagcggcaaggccagcaacaacccccccttcgtgatccacgacatggagaccctgtgcatggccgagaagaccctggtggccaagctggtggccaacggcatccagaacaaggaggccgaggtgagaatcttccactgctgccagtgcaccagcgtggagaccgtgaccgagctgaccgagttcgccaaggccatccccggcttcgccaacctggacctgaacgaccaggtgaccctgctgaagtacggcgtgtacgaggccatcttcgccatgctgagcagcgtgatgaacaaggacggcatgctggtggcctacggcaacggcttcatcaccagagagttcctgaagagcctgagaaagcccttctgcgacatcatggagcccaagttcgacttcgccatgaagttcaacgccctggagctggacgacagcgacatcagcctgttcgtggccgcctag

SEQ ID NO: 92857 - DNA, 1326 bp, Artificial Sequence
  Description of Artificial Sequence: Synthetic coding sequence
atggagcagccccaggaggaggcccccgaggtgagagaggaggaggagaaggaggaggtggccgaggccgagggcgcccccgagctgaacggcggcccccagcacgccctgcccagcagcagctacaccgacctgagcagaagcagcagcccccccagcctgctggaccagctgcagatgggctgcgacggcgccagctgcggcagcctgaacatggagtgcagagtgtgcggcgacaaggccagcggcttccactacggcgtgcacgcctgcgagggctgcaagggcttcttcagaagaaccatcagaatgaagctggagtacgagaagtgcgagagaagctgcaagatccagaagaagaacagaaacaagtgccagtactgcagattccagaagtgcctggccctgggcatgagccacaacgccatcagattcggcagaatgcccgaggccgagaagagaaagctggtggccggcctgaccgccaacgagggcagccagtacaacccccaggtggccgacctgaaggccttcagcaagcacatctacaacgcctacctgaagaacttcaacatgaccaagaagaaggccagaagcatcctgaccggcaaggccagccacaccgcccccttcgtgatccacgacatcgagaccctgtggcaggccgagaagggcctggtgtggaagcagctggtgaacggcctgcccccctacaaggagatcagcgtgcacgtgttctacagatgccagtgcaccaccgtggagaccgtgagagagctgaccgagttcgccaagagcatccccagcttcagcagcctgttcctgaacgaccaggtgaccctgctgaagtacggcgtgcacgaggccatcttcgccatgctggccagcatcgtgaacaaggacggcctgctggtggccaacggcagcggcttcgtgaccagagagttcctgagaagcctgagaaagcccttcagcgacatcatcgagcccaagttcgagttcgccgtgaagttcaacgccctggagctggacgacagcgacctggccctgttcatcgccgccatcatcctgtgcggcgacagacccggcctgatgaacgtgcccagagtggaggccatccaggacaccatcctgagagccctggagttccacctgcaggccaaccaccccgacgcccagtacctgttccccaagctgctgcagaagatggccgacctgagacagctggtgaccgagcacgcccagatgatgcagagaatcaagaagaccgagaccgagaccagcctgcaccccctgctgcaggagatctacaaggacatgtactag

SEQ ID NO: 92858 - DNA, 1086 bp, Artificial Sequence
  Description of Artificial Sequence: Synthetic coding sequence
atggagcagccccaggaggaggcccccgaggtgagagaggaggaggagaaggaggaggtggccgaggccgagggcgcccccgagctgaacggcggcccccagcacgccctgcccagcagcagctacaccgacctgagcagaagcagcagcccccccagcctgctggaccagctgcagatgggctgcgacggcgccagctgcggcagcctgaacatggagtgcagagtgtgcggcgacaaggccagcggcttccactacggcgtgcacgcctgcgagggctgcaagggcttcttcagaagaaccatcagaatgaagctggagtacgagaagtgcgagagaagctgcaagatccagaagaagaacagaaacaagtgccagtactgcagattccagaagtgcctggccctgggcatgagccacaacgccatcagattcggcagaatgcccgaggccgagaagagaaagctggtggccggcctgaccgccaacgagggcagccagtacaacccccaggtggccgacctgaaggccttcagcaagcacatctacaacgcctacctgaagaacttcaacatgaccaagaagaaggccagaagcatcctgaccggcaaggccagccacaccgcccccttcgtgatccacgacatcgagaccctgtggcaggccgagaagggcctggtgtggaagcagctggtgaacggcctgcccccctacaaggagatcagcgtgcacgtgttctacagatgccagtgcaccaccgtggagaccgtgagagagctgaccgagttcgccaagagcatccccagcttcagcagcctgttcctgaacgaccaggtgaccctgctgaagtacggcgtgcacgaggccatcttcgccatgctggccagcatcgtgaacaaggacggcctgctggtggccaacggcagcggcttcgtgaccagagagttcctgagaagcctgagaaagcccttcagcgacatcatcgagcccaagttcgagttcgccgtgaagttcaacgccctggagctggacgacagcgacctggccctgttcatcgccgccatcatcctgtgcggcggcgagtag

SEQ ID NO: 92859 - DNA, 1326 bp, Artificial Sequence; identical to SEQ ID NO: 92857
  Description of Artificial Sequence: Synthetic coding sequence

SEQ ID NO: 92860 - DNA, 1032 bp, Artificial Sequence
  Description of Artificial Sequence: Synthetic coding sequence
atggagcagccccaggaggaggcccccgaggtgagagaggaggaggagaaggaggaggtggccgaggccgagggcgcccccgagctgaacggcggcccccagcacgccctgcccagcagcagctacaccgccatcagattcggcagaatgcccgaggccgagaagagaaagctggtggccggcctgaccgccaacgagggcagccagtacaacccccaggtggccgacctgaaggccttcagcaagcacatctacaacgcctacctgaagaacttcaacatgaccaagaagaaggccagaagcatcctgaccggcaaggccagccacaccgcccccttcgtgatccacgacatcgagaccctgtggcaggccgagaagggcctggtgtggaagcagctggtgaacggcctgcccccctacaaggagatcagcgtgcacgtgttctacagatgccagtgcaccaccgtggagaccgtgagagagctgaccgagttcgccaagagcatccccagcttcagcagcctgttcctgaacgaccaggtgaccctgctgaagtacggcgtgcacgaggccatcttcgccatgctggccagcatcgtgaacaaggacggcctgctggtggccaacggcagcggcttcgtgaccagagagttcctgagaagcctgagaaagcccttcagcgacatcatcgagcccaagttcgagttcgccgtgaagttcaacgccctggagctggacgacagcgacctggccctgttcatcgccgccatcatcctgtgcggcgacagacccggcctgatgaacgtgcccagagtggaggccatccaggacaccatcctgagagccctggagttccacctgcaggccaaccaccccgacgcccagtacctgttccccaagctgctgcagaagatggccgacctgagacagctggtgaccgagcacgcccagatgatgcagagaatcaagaagaccgagaccgagaccagcctgcaccccctgctgcaggagatctacaaggacatgtactag

SEQ ID NO: 92861 - DNA, 1086 bp, Artificial Sequence; identical to SEQ ID NO: 92858
  Description of Artificial Sequence: Synthetic coding sequence

SEQ ID NO: 92862 - DNA, 1209 bp, Artificial Sequence
  Description of Artificial Sequence: Synthetic coding sequence
atgcaccagagagacctgagcagaagcagcagcccccccagcctgctggaccagctgcagatgggctgcgacggcgccagctgcggcagcctgaacatggagtgcagagtgtgcggcgacaaggccagcggcttccactacggcgtgcacgcctgcgagggctgcaagggcttcttcagaagaaccatcagaatgaagctggagtacgagaagtgcgagagaagctgcaagatccagaagaagaacagaaacaagtgccagtactgcagattccagaagtgcctggccctgggcatgagccacaacgccatcagattcggcagaatgcccgaggccgagaagagaaagctggtggccggcctgaccgccaacgagggcagccagtacaacccccaggtggccgacctgaaggccttcagcaagcacatctacaacgcctacctgaagaacttcaacatgaccaagaagaaggccagaagcatcctgaccggcaaggccagccacaccgcccccttcgtgatccacgacatcgagaccctgtggcaggccgagaagggcctggtgtggaagcagctggtgaacggcctgcccccctacaaggagatcagcgtgcacgtgttctacagatgccagtgcaccaccgtggagaccgtgagagagctgaccgagttcgccaagagcatccccagcttcagcagcctgttcctgaacgaccaggtgaccctgctgaagtacggcgtgcacgaggccatcttcgccatgctggccagcatcgtgaacaaggacggcctgctggtggccaacggcagcggcttcgtgaccagagagttcctgagaagcctgagaaagcccttcagcgacatcatcgagcccaagttcgagttcgccgtgaagttcaacgccctggagctggacgacagcgacctggccctgttcatcgccgccatcatcctgtgcggcgacagacccggcctgatgaacgtgcccagagtggaggccatccaggacaccatcctgagagccctggagttccacctgcaggccaaccaccccgacgcccagtacctgttccccaagctgctgcagaagatggccgacctgagacagctggtgaccgagcacgcccagatgatgcagagaatcaagaagaccgagaccgagaccagcctgcaccccctgctgcaggagatctacaaggacatgtactag

SEQ ID NO: 92863 - DNA, 1017 bp, Artificial Sequence
  Description of Artificial Sequence: Synthetic coding sequence
atgaagctggagtacgagaagtgcgagagaagctgcaagatccagaagaagaacagaaacaagtgccagtactgcagattccagaagtgcctggccctgggcatgagccacaacgccatcagattcggcagaatgcccgaggccgagaagagaaagctggtggccggcctgaccgccaacgagggcagccagtacaacccccaggtggccgacctgaaggccttcagcaagcacatctacaacgcctacctgaagaacttcaacatgaccaagaagaaggccagaagcatcctgaccggcaaggccagccacaccgcccccttcgtgatccacgacatcgagaccctgtggcaggccgagaagggcctggtgtggaagcagctggtgaacggcctgcccccctacaaggagatcagcgtgcacgtgttctacagatgccagtgcaccaccgtggagaccgtgagagagctgaccgagttcgccaagagcatccccagcttcagcagcctgttcctgaacgaccaggtgaccctgctgaagtacggcgtgcacgaggccatcttcgccatgctggccagcatcgtgaacaaggacggcctgctggtggccaacggcagcggcttcgtgaccagagagttcctgagaagcctgagaaagcccttcagcgacatcatcgagcccaagttcgagttcgccgtgaagttcaacgccctggagctggacgacagcgacctggccctgttcatcgccgccatcatcctgtgcggcgacagacccggcctgatgaacgtgcccagagtggaggccatccaggacaccatcctgagagccctggagttccacctgcaggccaaccaccccgacgcccagtacctgttccccaagctgctgcagaagatggccgacctgagacagctggtgaccgagcacgcccagatgatgcagagaatcaagaagaccgagaccgagaccagcctgcaccccctgctgcaggagatctacaaggacatgtactag

SEQ ID NO: 92864 - DNA, 1518 bp, Artificial Sequence
  Description of Artificial Sequence: Synthetic coding sequence
atgggcgagaccctgggcgacagccccatcgaccccgagagcgacagcttcaccgacaccctgagcgccaacatcagccaggagatgaccatggtggacaccgagatgcccttctggcccaccaacttcggcatcagcagcgtggacctgagcgtgatggaggaccacagccacagcttcgacatcaagcccttcaccaccgtggacttcagcagcatcagcaccccccactacgaggacatccccttcaccagaaccgaccccgtggtggccgactacaagtacgacctgaagctgcaggagtaccagagcgccatcaaggtggagcccgccagccccccctactacagcgagaagacccagctgtacaacaagccccacgaggagcccagcaacagcctgatggccatcgagtgcagagtgtgcggcgacaaggccagcggcttccactacggcgtgcacgcctgcgagggctgcaagggcttcttcagaagaaccatcagactgaagctgatctacgacagatgcgacctgaactgcagaatccacaagaagagcagaaacaagtgccagtactgcagattccagaagtgcctggccgtgggcatgagccacaacgccatcagattcggcagaatgccccaggccgagaaggagaagctgctggccgagatcagcagcgacatcgaccagctgaaccccgagagcgccgacctgagagccctggccaagcacctgtacgacagctacatcaagagcttccccctgaccaaggccaaggccagagccatcctgaccggcaagaccaccgacaagagccccttcgtgatctacgacatgaacagcctgatgatgggcgaggacaagatcaagttcaagcacatcacccccctgcaggagcagagcaaggaggtggccatcagaatcttccagggctgccagttcagaagcgtggaggccgtgcaggagatcaccgagtacgccaagagcatccccggcttcgtgaacctggacctgaacgaccaggtgaccctgctgaagtacggcgtgcacgagatcatctacaccatgctggccagcctgatgaacaaggacggcgtgctgatcagcgagggccagggcttcatgaccagagagttcctgaagagcctgagaaagcccttcggcgacttcatggagcccaagttcgagttcgccgtgaagttcaacgccctggagctggacgacagcgacctggccatcttcatcgccgtgatcatcctgagcggcgacagacccggcctgctgaacgtgaagcccatcgaggacatccaggacaacctgctgcaggccctggagctgcagctgaagctgaaccaccccgagagcagccagctgttcgccaagctgctgcagaagatgaccgacctgagacagatcgtgaccgagcacgtgcagctgctgcaggtgatcaagaagaccgagaccgacatgagcctgcaccccctgctgcaggagatctacaaggacctgtactag

SEQ ID NO: 92865 - DNA, 1434 bp, Artificial Sequence
  Description of Artificial Sequence: Synthetic coding sequence
atgaccatggtggacaccgagatgcccttctggcccaccaacttcggcatcagcagcgtggacctgagcgtgatggaggaccacagccacagcttcgacatcaagcccttcaccaccgtggacttcagcagcatcagcaccccccactacgaggacatccccttcaccagaaccgaccccgtggtggccgactacaagtacgacctgaagctgcaggagtaccagagcgccatcaaggtggagcccgccagccccccctactacagcgagaagacccagctgtacaacaagccccacgaggagcccagcaacagcctgatggccatcgagtgcagagtgtgcggcgacaaggccagcggcttccactacggcgtgcacgcctgcgagggctgcaagggcttcttcagaagaaccatcagactgaagctgatctacgacagatgcgacctgaactgcagaatccacaagaagagcagaaacaagtgccagtactgcagattccagaagtgcctggccgtgggcatgagccacaacgccatcagattcggcagaatgccccaggccgagaaggagaagctgctggccgagatcagcagcgacatcgaccagctgaaccccgagagcgccgacctgagagccctggccaagcacctgtacgacagctacatcaagagcttccccctgaccaaggccaaggccagagccatcctgaccggcaagaccaccgacaagagccccttcgtgatctacgacatgaacagcctgatgatgggcgaggacaagatcaagttcaagcacatcacccccctgcaggagcagagcaaggaggtggccatcagaatcttccagggctgccagttcagaagcgtggaggccgtgcaggagatcaccgagtacgccaagagcatccccggcttcgtgaacctggacctgaacgaccaggtgaccctgctgaagtacggcgtgcacgagatcatctacaccatgctggccagcctgatgaacaaggacggcgtgctgatcagcgagggccagggcttcatgaccagagagttcctgaagagcctgagaaagcccttcggcgacttcatggagcccaagttcgagttcgccgtgaagttcaacgccctggagctggacgacagcgacctggccatcttcatcgccgtgatcatcctgagcggcgacagacccggcctgctgaacgtgaagcccatcgaggacatccaggacaacctgctgcaggccctggagctgcagctgaagctgaaccaccccgagagcagccagctgttcgccaagctgctgcagaagatgaccgacctgagacagatcgtgaccgagcacgtgcagctgctgcaggtgatcaagaagaccgagaccgacatgagcctgcaccccctgctgcaggagatctacaaggacctgtactag

SEQ ID NO: 92866 - DNA, 753 bp, Artificial Sequence
  Description of Artificial Sequence: Synthetic coding sequence
atgaccatggtggacaccgagatgcccttctggcccaccaacttcggcatcagcagcgtggacctgagcgtgatggaggaccacagccacagcttcgacatcaagcccttcaccaccgtggacttcagcagcatcagcaccccccactacgaggacatccccttcaccagaaccgaccccgtggtggccgactacaagtacgacctgaagctgcaggagtaccagagcgccatcaaggtggagcccgccagccccccctactacagcgagaagacccagctgtacaacaagccccacgaggagcccagcaacagcctgatggccatcgagtgcagagtgtgcggcgacaaggccagcggcttccactacggcgtgcacgcctgcgagggctgcaagggcttcttcagaagaaccatcagactgaagctgatctacgacagatgcgacctgaactgcagaatccacaagaagagcagaaacaagtgccagtactgcagattccagaagtgcctggccgtgggcatgagccacaacgccatcagattcggcagaatgccccaggccgagaaggagaagctgctggccgagatcagcagcgacatcgaccagctgaaccccgagagcgccgacctgagagccctggccaagcacctgtacgacagctacatcaagagcttccccctgaccaaggccaaggccagagccatcctgaccggcaagaccaccgacaagagcaccgcccaggtgtgctag

SEQ ID NO: 92867 - DNA, 1434 bp, Artificial Sequence; identical to SEQ ID NO: 92865
  Description of Artificial Sequence: Synthetic coding sequence

SEQ ID NO: 92868 - DNA, 1434 bp, Artificial Sequence; identical to SEQ ID NO: 92865
  Description of Artificial Sequence: Synthetic coding sequence

SEQ ID NO: 92869 - DNA, 1434 bp, Artificial Sequence; identical to SEQ ID NO: 92865
  Description of Artificial Sequence: Synthetic coding sequence

SEQ ID NO: 92870 - DNA, 1452 bp, Artificial Sequence
  Description of Artificial Sequence: Synthetic coding sequence
atgaagggcttcagcgagatgaccatggtggacaccgagatgcccttctggcccaccaacttcggcatcagcagcgtggacctgagcgtgatggaggaccacagccacagcttcgacatcaagcccttcaccaccgtggacttcagcagcatcagcaccccccactacgaggacatccccttcaccagaaccgaccccgtggtggccgactacaagtacgacctgaagctgcaggagtaccagagcgccatcaaggtggagcccgccagccccccctactacagcgagaagacccagctgtacaacaagccccacgaggagcccagcaacagcctgatggccatcgagtgcagagtgtgcggcgacaaggccagcggcttccactacggcgtgcacgcctgcgagggctgcaagggcttcttcagaagaaccatcagactgaagctgatctacgacagatgcgacctgaactgcagaatccacaagaagagcagaaacaagtgccagtactgcagattccagaagtgcctggccgtgggcatgagccacaacgccatcagattcggcagaatgccccaggccgagaaggagaagctgctggccgagatcagcagcgacatcgaccagctgaaccccgagagcgccgacctgagagccctggccaagcacctgtacgacagctacatcaagagcttccccctgaccaaggccaaggccagagccatcctgaccggcaagaccaccgacaagagccccttcgtgatctacgacatgaacagcctgatgatgggcgaggacaagatcaagttcaagcacatcacccccctgcaggagcagagcaaggaggtggccatcagaatcttccagggctgccagttcagaagcgtggaggccgtgcaggagatcaccgagtacgccaagagcatccccggcttcgtgaacctggacctgaacgaccaggtgaccctgctgaagtacggcgtgcacgagatcatctacaccatgctggccagcctgatgaacaaggacggcgtgctgatcagcgagggccagggcttcatgaccagagagttcctgaagagcctgagaaagcccttcggcgacttcatggagcccaagttcgagttcgccgtgaagttcaacgccctggagctggacgacagcgacctggccatcttcatcgccgtgatcatcctgagcggcgacagacccggcctgctgaacgtgaagcccatcgaggacatccaggacaacctgctgcaggccctggagctgcagctgaagctgaaccaccccgagagcagccagctgttcgccaagctgctgcagaagatgaccgacctgagacagatcgtgaccgagcacgtgcagctgctgcaggtgatcaagaagaccgagaccgacatgagcctgcaccccctgctgcaggagatctacaaggacctgtactag

SEQ ID NO: 92871 - DNA, 399 bp, Artificial Sequence
  Description of Artificial Sequence: Synthetic coding sequence
atgaccatggtggacaccgagatgcccttctggcccaccaacttcggcatcagcagcgtggacctgagcgtgatggaggaccacagccacagcttcgacatcaagcccttcaccaccgtggacttcagcagcatcagcaccccccactacgaggacatccccttcaccagaaccgaccccgtggtggccgactacaagtacgacctgaagctgcaggagtaccagagcgccatcaaggtggagcccgccagccccccctactacagcgagaagacccagctgtacaacaagccccacgaggagcccagcaacagcctgatggccatcgagtgcagagtgtgcggcgacaaggccagcggcttccactacggcgtgcacgcctgcgagggctgcaagtag

SEQ ID NO: 92872 - DNA, 300 bp, Artificial Sequence
  Description of Artificial Sequence: Synthetic coding sequence
atgaccatggtggacaccgagatgcccttctggcccaccaacttcggcatcagcagcgtggacctgagcgtgatggaggaccacagccacagcttcgacatcaagcccttcaccaccgtggacttcagcagcatcagcaccccccactacgaggacatccccttcaccagaaccgaccccgtggtggccgactacaagtacgacctgaagctgcaggagtaccagagcgccatcaaggtggagcccgccagccccccctactacagcgagaagacccagctgtacaacaagccccactag

SEQ ID NO: 92873 - DNA, 132 bp, Artificial Sequence
  Description of Artificial Sequence: Synthetic coding sequence
atgaccatggtggacaccgagatgcccttctggcccaccaacttcggcatcagcagcgtggacctgagcgtgatggaggaccacagccacagcttcgacatcaagcccttcaccaccgtggacttcagctag

SEQ ID NO: 92874 - DNA, 747 bp, Artificial Sequence
  Description of Artificial Sequence: Synthetic coding sequence
atggtggacaccgagatgcccttctggcccaccaacttcggcatcagcagcgtggacctgagcgtgatggaggaccacagccacagcttcgacatcaagcccttcaccaccgtggacttcagcagcatcagcaccccccactacgaggacatccccttcaccagaaccgaccccgtggtggccgactacaagtacgacctgaagctgcaggagtaccagagcgccatcaaggtggagcccgccagccccccctactacagcgagaagacccagctgtacaacaagccccacgaggagcccagcaacagcctgatggccatcgagtgcagagtgtgcggcgacaaggccagcggcttccactacggcgtgcacgcctgcgagggctgcaagggcttcttcagaagaaccatcagactgaagctgatctacgacagatgcgacctgaactgcagaatccacaagaagagcagaaacaagtgccagtactgcagattccagaagtgcctggccgtgggcatgagccacaacgccatcagattcggcagaatgccccaggccgagaaggagaagctgctggccgagatcagcagcgacatcgaccagctgaaccccgagagcgccgacctgagagccctggccaagcacctgtacgacagctacatcaagagcttccccctgaccaaggccaaggccagagccatcctgaccggcaagaccaccgacaagagcaccgcccaggtgtgctag

SEQ ID NO: 92875 - DNA, 2955 bp, Artificial Sequence
  Description of Artificial Sequence: Synthetic coding sequence
atggccggcaacgactgcggcgccctgctggacgaggagctgagcagcttcttcctgaactacctggccgacacccagggcggcggcagcggcgaggagcagctgtacgccgacttccccgagctggacctgagccagctggacgccagcgacttcgacagcgccacctgcttcggcgagctgcagtggtgccccgagaacagcgagaccgagcccaaccagtacagccccgacgacagcgagctgttccagatcgacagcgagaacgaggccctgctggccgagctgaccaagaccctggacgacatccccgaggacgacgtgggcctggccgccttccccgccctggacggcggcgacgccctgagctgcaccagcgccagccccgcccccagcagcgccccccccagccccgcccccgagaagcccagcgcccccgcccccgaggtggacgagctgagcctggccgacagcacccaggacaagaaggcccccatgatgcagagccagagcagaagctgcaccgagctgcacaagcacctgaccagcgcccagtgctgcctgcaggacagaggcctgcagcccccctgcctgcagagccccagactgcccgccaaggaggacaaggagcccggcgaggactgccccagcccccagcccgcccccgccagccccagagacagcctggccctgggcagagccgaccccggcgcccccgtgagccaggaggacatgcaggccatggtgcagctgatcagatacatgcacacctactgcctgccccagagaaagctgcccccccagacccccgagcccctgcccaaggcctgcagcaaccccagccagcaggtgagaagcagaccctggagcagacaccacagcaaggccagctgggccgagttcagcatcctgagagagctgctggcccaggacgtgctgtgcgacgtgagcaagccctacagactggccacccccgtgtacgccagcctgacccccagaagcagacccagaccccccaaggacagccaggccagccccggcagacccagcagcgtggaggaggtgagaatcgccgccagccccaagagcaccggccccagacccagcctgagacccctgagactggaggtgaagagagaggtgagaagacccgccagactgcagcagcaggaggaggaggacgaggaggaggaggaggaggaggaggaggaggagaaggaggaggaggaggagtggggcagaaagagacccggcagaggcctgccctggaccaagctgggcagaaagctggagagcagcgtgtgccccgtgagaagaagcagaagactgaaccccgagctgggcccctggctgaccttcgccgacgagcccctggtgcccagcgagccccagggcgccctgcccagcctgtgcctggcccccaaggcctacgacgtggagagagagctgggcagccccaccgacgaggacagcggccaggaccagcagctgctgagaggcccccagatccccgccctggagagcccctgcgagagcggctgcggcgacatggacgaggaccccagctgcccccagctgccccccagagacagccccagatgcctgatgctggccctgagccagagcgaccccaccttcggcaagaagagcttcgagcagaccctgaccgtggagctgtgcggcaccgccggcctgaccccccccaccacccccccctacaagcccaccgaggaggaccccttcaagcccgacatcaagcacagcctgggcaaggagatcgccctgagcctgcccagccccgagggcctgagcctgaaggccacccccggcgccgcccacaagctgcccaagaagcaccccgagagaagcgagctgctgagccacctgagacacgccaccgcccagcccgccagccaggccggccagaagagacccttcagctgcagcttcggcgaccacgactactgccaggtgctgagacccgagggcgtgctgcagagaaaggtgctgagaagctgggagcccagcggcgtgcacctggaggactggccccagcagggcgccccctgggccgaggcccaggcccccggcagagaggaggacagaagctgcgacgccggcgccccccccaaggacagcaccctgctgagagaccacgagatcagagccagcctgaccaagcacttcggcctgctggagaccgccctggaggaggaggacctggccagctgcaagagccccgagtacgacaccgtgttcgaggacagcagcagcagcagcggcgagagcagcttcctgcccgaggaggaggaggaggagggcgaggaggaggaggaggacgacgaggaggaggacagcggcgtgagccccacctgcagcgaccactgcccctaccagagcccccccagcaaggccaacagacagctgtgcagcagaagcagaagcagcagcggcagcagcccctgccacagctggagccccgccaccagaagaaacttcagatgcgagagcagaggcccctgcagcgacagaacccccagcatcagacacgccagaaagagaagagagaaggccatcggcgagggcagagtggtgtacatccagaacctgagcagcgacatgagcagcagagagctgaagagaagattcgaggtgttcggcgagatcgaggagtgcgaggtgctgaccagaaacagaagaggcgagaagtacggcttcatcacctacagatgcagcgagcacgccgccctgagcctgaccaagggcgccgccctgagaaagagaaacgagcccagcttccagctgagctacggcggcctgagacacttctgctggcccagatacaccgactacgacagcaacagcgaggaggccctgcccgccagcggcaagagcaagtacgaggccatggacttcgacagcctgctgaaggaggcccagcagagcctgcactag

SEQ ID NO: 92876 - DNA, 2880 bp, Artificial Sequence
  Description of Artificial Sequence: Synthetic coding sequence
atgggcggcggcagcggcgaggagcagctgtacgccgacttccccgagctggacctgagccagctggacgccagcgacttcgacagcgccacctgcttcggcgagctgcagtggtgccccgagaacagcgagaccgagcccaaccagtacagccccgacgacagcgagctgttccagatcgacagcgagaacgaggccctgctggccgagctgaccaagaccctggacgacatccccgaggacgacgtgggcctggccgccttccccgccctggacggcggcgacgccctgagctgcaccagcgccagccccgcccccagcagcgccccccccagccccgcccccgagaagcccagcgcccccgcccccgaggtggacgagctgagcctggccgacagcacccaggacaagaaggcccccatgatgcagagccagagcagaagctgcaccgagctgcacaagcacctgaccagcgcccagtgctgcctgcaggacagaggcctgcagcccccctgcctgcagagccccagactgcccgccaaggaggacaaggagcccggcgaggactgccccagcccccagcccgcccccgccagccccagagacagcctggccctgggcagagccgaccccggcgcccccgtgagccaggaggacatgcaggccatggtgcagctgatcagatacatgcacacctactgcctgccccagagaaagctgcccccccagacccccgagcccctgcccaaggcctgcagcaaccccagccagcaggtgagaagcagaccctggagcagacaccacagcaaggccagctgggccgagttcagcatcctgagagagctgctggcccaggacgtgctgtgcgacgtgagcaagccctacagactggccacccccgtgtacgccagcctgacccccagaagcagacccagaccccccaaggacagccaggccagccccggcagacccagcagcgtggaggaggtgagaatcgccgccagccccaagagcaccggccccagacccagcctgagacccctgagactggaggtgaagagagaggtgagaagacccgccagactgcagcagcaggaggaggaggacgaggaggaggaggaggaggaggaggaggaggagaaggaggaggaggaggagtggggcagaaagagacccggcagaggcctgccctggaccaagctgggcagaaagctggagagcagcgtgtgccccgtgagaagaagcagaagactgaaccccgagctgggcccctggctgaccttcgccgacgagcccctggtgcccagcgagccccagggcgccctgcccagcctgtgcctggcccccaaggcctacgacgtggagagagagctgggcagccccaccgacgaggacagcggccaggaccagcagctgctgagaggcccccagatccccgccctggagagcccctgcgagagcggctgcggcgacatggacgaggaccccagctgcccccagctgccccccagagacagccccagatgcctgatgctggccctgagccagagcgaccccaccttcggcaagaagagcttcgagcagaccctgaccgtggagctgtgcggcaccgccggcctgaccccccccaccacccccccctacaagcccaccgaggaggaccccttcaagcccgacatcaagcacagcctgggcaaggagatcgccctgagcctgcccagccccgagggcctgagcctgaaggccacccccggcgccgcccacaagctgcccaagaagcaccccgagagaagcgagctgctgagccacctgagacacgccaccgcccagcccgccagccaggccggccagaagagacccttcagctgcagcttcggcgaccacgactactgccaggtgctgagacccgagggcgtgctgcagagaaaggtgctgagaagctgggagcccagcggcgtgcacctggaggactggccccagcagggcgccccctgggccgaggcccaggcccccggcagagaggaggacagaagctgcgacgccggcgccccccccaaggacagcaccctgctgagagaccacgagatcagagccagcctgaccaagcacttcggcctgctggagaccgccctggaggaggaggacctggccagctgcaagagccccgagtacgacaccgtgttcgaggacagcagcagcagcagcggcgagagcagcttcctgcccgaggaggaggaggaggagggcgaggaggaggaggaggacgacgaggaggaggacagcggcgtgagccccacctgcagcgaccactgcccctaccagagcccccccagcaaggccaacagacagctgtgcagcagaagcagaagcagcagcggcagcagcccctgccacagctggagccccgccaccagaagaaacttcagatgcgagagcagaggcccctgcagcgacagaacccccagcatcagacacgccagaaagagaagagagaaggccatcggcgagggcagagtggtgtacatccagaacctgagcagcgacatgagcagcagagagctgaagagaagattcgaggtgttcggcgagatcgaggagtgcgaggtgctgaccagaaacagaagaggcgagaagtacggcttcatcacctacagatgcagcgagcacgccgccctgagcctgaccaagggcgccgccctgagaaagagaaacgagcccagcttccagctgagctacggcggcctgagacacttctgctggcccagatacaccgactacgacagcaacagcgaggaggccctgcccgccagcggcaagagcaagtacgaggccatggacttcgacagcctgctgaaggaggcccagcagagcctgcactag

SEQ ID NO: 92877 - DNA, 2397 bp, Artificial Sequence
  Description of Artificial Sequence: Synthetic coding sequence
atggcctgggacatgtgcaaccaggacagcgagagcgtgtggagcgacatcgagtgcgccgccctggtgggcgaggaccagcccctgtgccccgacctgcccgagctggacctgagcgagctggacgtgaacgacctggacaccgacagcttcctgggcggcctgaagtggtgcagcgaccagagcgagatcatcagcaaccagtacaacaacgagcccagcaacatcttcgagaagatcgacgaggagaacgaggccaacctgctggccgtgctgaccgagaccctggacagcctgcccgtggacgaggacggcctgcccagcttcgacgccctgaccgacggcgacgtgaccaccgacaacgaggccagccccagcagcatgcccgacggcaccccccccccccaggaggccgaggagcccagcctgctgaagaagctgctgctggcccccgccaacacccagctgagctacaacgagtgcagcggcctgagcacccagaaccacgccaaccacaaccacagaatcagaaccaaccccgccatcgtgaagaccgagaacagctggagcaacaaggccaagagcatctgccagcagcagaagccccagagaagaccctgcagcgagctgctgaagtacctgaccaccaacgacgaccccccccacaccaagcccaccgagaacagaaacagcagcagagacaagtgcaccagcaagaagaagagccacacccagagccagagccagcacctgcaggccaagcccaccaccctgagcctgcccctgacccccgagagccccaacgaccccaagggcagccccttcgagaacaagaccatcgagagaaccctgagcgtggagctgagcggcaccgccggcctgaccccccccaccacccccccccacaaggccaaccaggacaaccccttcagagccagccccaagctgaagagcagctgcaagaccgtggtgcccccccccagcaagaagcccagatacagcgagagcagcggcacccagggcaacaacagcaccaagaagggccccgagcagagcgagctgtacgcccagctgagcaagagcagcgtgctgaccggcggccacgaggagagaaagaccaagagacccagcctgagactgttcggcgaccacgactactgccagagcatcaacagcaagaccgagatcctgatcaacatcagccaggagctgcaggacagcagacagctggagaacaaggacgtgagcagcgactggcagggccagatctgcagcagcaccgacagcgaccagtgctacctgagagagaccctggaggccagcaagcaggtgagcccctgcagcaccagaaagcagctgcaggaccaggagatcagagccgagctgaacaagcacttcggccaccccagccaggccgtgttcgacgacgaggccgacaagaccggcgagctgagagacagcgacttcagcaacgagcagttcagcaagctgcccatgttcatcaacagcggcctggccatggacggcctgttcgacgacagcgaggacgagagcgacaagctgagctacccctgggacggcacccagagctacagcctgttcaacgtgagccccagctgcagcagcttcaacagcccctgcagagacagcgtgagcccccccaagagcctgttcagccagagaccccagagaatgagaagcagaagcagaagcttcagcagacacagaagctgcagcagaagcccctacagcagaagcagaagcagaagccccggcagcagaagcagcagcagaagctgctactactacgagagcagccactacagacacagaacccacagaaacagccccctgtacgtgagaagcagaagcagaagcccctacagcagaagacccagatacgacagctacgaggagtaccagcacgagagactgaagagagaggagtacagaagagagtacgagaagagagagagcgagagagccaagcagagagagagacagagacagaaggccatcgaggagagaagagtgatctacgtgggcaagatcagacccgacaccaccagaaccgagctgagagacagattcgaggtgttcggcgagatcgaggagtgcaccgtgaacctgagagacgacggcgacagctacggcttcatcacctacagatacacctgcgacgccttcgccgccctggagaacggctacaccctgagaagaagcaacgagaccgacttcgagctgtacttctgcggcagaaagcagttcttcaagagcaactacgccgacctggacagcaacagcgacgacttcgaccccgccagcaccaagagcaagtacgacagcctggacttcgacagcctgctgaaggaggcccagagaagcctgagaagatag

SEQ ID NO: 92878 - DNA, 3072 bp, Artificial Sequence
  Description of Artificial Sequence: Synthetic coding sequence
atggccggcaacgactgcggcgccctgctggacgaggagctgagcagcttcttcctgaactacctggccgacacccagggcggcggcagcggcgaggagcagctgtacgccgacttccccgagctggacctgagccagctggacgccagcgacttcgacagcgccacctgcttcggcgagctgcagtggtgccccgagaacagcgagaccgagcccaaccagtacagccccgacgacagcgagctgttccagatcgacagcgagaacgaggccctgctggccgagctgaccaagaccctggacgacatccccgaggacgacgtgggcctggccgccttccccgccctggacggcggcgacgccctgagctgcaccagcgccagccccgcccccagcagcgccccccccagccccgcccccgagaagcccagcgcccccgcccccgaggtggacgagctgagcctgctgcagaagctgctgctggccaccagctaccccaccagcagcagcgacacccagaaggagggcaccgcctggagacaggccggcctgagaagcaagagccagagaccctgcgtgaaggccgacagcacccaggacaagaaggcccccatgatgcagagccagagcagaagctgcaccgagctgcacaagcacctgaccagcgcccagtgctgcctgcaggacagaggcctgcagcccccctgcctgcagagccccagactgcccgccaaggaggacaaggagcccggcgaggactgccccagcccccagcccgcccccgccagccccagagacagcctggccctgggcagagccgaccccggcgcccccgtgagccaggaggacatgcaggccatggtgcagctgatcagatacatgcacacctactgcctgccccagagaaagctgcccccccagacccccgagcccctgcccaaggcctgcagcaaccccagccagcaggtgagaagcagaccctggagcagacaccacagcaaggccagctgggccgagttcagcatcctgagagagctgctggcccaggacgtgctgtgcgacgtgagcaagccctacagactggccacccccgtgtacgccagcctgacccccagaagcagacccagaccccccaaggacagccaggccagccccggcagacccagcagcgtggaggaggtgagaatcgccgccagccccaagagcaccggccccagacccagcctgagacccctgagactggaggtgaagagagaggtgagaagacccgccagactgcagcagcaggaggaggaggacgaggaggaggaggaggaggaggaggaggaggagaaggaggaggaggaggagtggggcagaaagagacccggcagaggcctgccctggaccaagctgggcagaaagctggagagcagcgtgtgccccgtgagaagaagcagaagactgaaccccgagctgggcccctggctgaccttcgccgacgagcccctggtgcccagcgagccccagggcgccctgcccagcctgtgcctggcccccaaggcctacgacgtggagagagagctgggcagccccaccgacgaggacagcggccaggaccagcagctgctgagaggcccccagatccccgccctggagagcccctgcgagagcggctgcggcgacatggacgaggaccccagctgcccccagctgccccccagagacagccccagatgcctgatgctggccctgagccagagcgaccccaccttcggcaagaagagcttcgagcagaccctgaccgtggagctgtgcggcaccgccggcctgaccccccccaccacccccccctacaagcccaccgaggaggaccccttcaagcccgacatcaagcacagcctgggcaaggagatcgccctgagcctgcccagccccgagggcctgagcctgaaggccacccccggcgccgcccacaagctgcccaagaagcaccccgagagaagcgagctgctgagccacctgagacacgccaccgcccagcccgccagccaggccggccagaagagacccttcagctgcagcttcggcgaccacgactactgccaggtgctgagacccgagggcgtgctgcagagaaaggtgctgagaagctgggagcccagcggcgtgcacctggaggactggccccagcagggcgccccctgggccgaggcccaggcccccggcagagaggaggacagaagctgcgacgccggcgccccccccaaggacagcaccctgctgagagaccacgagatcagagccagcctgaccaagcacttcggcctgctggagaccgccctggaggaggaggacctggccagctgcaagagccccgagtacgacaccgtgttcgaggacagcagcagcagcagcggcgagagcagcttcctgcccgaggaggaggaggaggagggcgaggaggaggaggaggacgacgaggaggaggacagcggcgtgagccccacctgcagcgaccactgcccctaccagagcccccccagcaaggccaacagacagctgtgcagcagaagcagaagcagcagcggcagcagcccctgccacagctggagccccgccaccagaagaaacttcagatgcgagagcagaggcccctgcagcgacagaacccccagcatcagacacgccagaaagagaagagagaaggccatcggcgagggcagagtggtgtacatccagaacctgagcagcgacatgagcagcagagagctgaagagaagattcgaggtgttcggcgagatcgaggagtgcgaggtgctgaccagaaacagaagaggcgagaagtacggcttcatcacctacagatgcagcgagcacgccgccctgagcctgaccaagggcgccgccctgagaaagagaaacgagcccagcttccagctgagctacggcggcctgagacacttctgctggcccagatacaccgactacgacagcaacagcgaggaggccctgcccgccagcggcaagagcaagtacgaggccatggacttcgacagcctgctgaaggaggcccagcagagcctgcactag

SEQ ID NO: 92879 - DNA, 3054 bp, Artificial Sequence
  Description of Artificial Sequence: Synthetic coding sequence
atggccggcaacgactgcggcgccctgctggacgaggagctgagcagcttcttcctgaactacctggccgacacccagggcggcggcagcggcgaggagcagctgtacgccgacttccccgagctggacctgagccagctggacgccagcgacttcgacagcgccacctgcttcggcgagctgcagtggtgccccgagaacagcgagaccgagcccaaccagtacagccccgacgacagcgagctgttccagatcgacagcgagaacgaggccctgctggccgagctgaccaagaccctggacgacatccccgaggacgacgtgggcctggccgccttccccgccctggacggcggcgacgccctgagctgcaccagcgccagccccgcccccagcagcgccccccccagccccgcccccgagaagcccagcgcccccgcccccgaggtggacgagctgagcctgctgcagaagctgctgctggccaccagctaccccaccagcagcagcgacacccagaaggagggcaccgcctggagacaggccggcctgagaagcaagagccagagaccctgcgtgaaggccgacagcacccaggacaagaaggcccccatgatgcagagccagagcagaagctgcaccgagctgcacaagcacctgaccagcgcccagtgctgcctgcaggacagaggcctgcagcccccctgcctgcagagccccagactgcccgccaaggaggacaaggagcccggcgaggactgccccagcccccagcccgcccccgccagccccagagacagcctggccctgggcagagccgaccccggcgcccccgtgagccaggaggacatgcaggccatggtgcagctgatcagatacatgcacacctactgcctgccccagagaaagctgcccccccagacccccgagcccctgcccaaggcctgcagcaaccccagccagcaggtgagaagcagaccctggagcagacaccacagcaaggccagctgggccgagttcagcatcctgagagagctgctggcccaggacgtgctgtgcgacgtgagcaagccctacagactggccacccccgtgtacgccagcctgacccccagaagcagacccagaccccccaaggacagccaggccagccccggcagacccagcagcgtggaggaggtgagaatcgccgccagccccaagagcaccggccccagacccagcctgagacccctgagactggaggtgaagagagaggtgagaagacccgccagactgcagcagcaggaggaggaggacgaggaggaggaggaggaggaggaggaggaggagaaggaggaggaggaggagtggggcagaaagagacccggcagaggcctgccctggaccaagctgggcagaaagctggagagcagcgtgtgccccgtgagaagaagcagaagactgaaccccgagctgggcccctggctgaccttcgccgacgagcccctggtgcccagcgagccccagggcgccctgcccagcctgtgcctggcccccaaggcctacgacgtggagagagagctgggcagccccaccgacgaggacagcggccaggaccagcagctgctgagaggcccccagatccccgccctggagagcccctgcgagagcggctgcggcgacatggacgaggaccccagctgcccccagctgccccccagagacagccccagatgcctgatgctggccctgagccagagcgaccccaccttcggcaagaagagcttcgagcagaccctgaccgtggagctgtgcggcaccgccggcctgaccccccccaccacccccccctacaagcccaccgaggaggaccccttcaagcccgacatcaagcacagcctgggcaaggagatcgccctgagcctgcccagccccgagggcctgagcctgaaggccacccccggcgccgcccacaagctgcccaagaagcaccccgagagaagcgagctgctgagccacctgagacacgccaccgcccagcccgccagccaggccggccagaagagacccttcagctgcagcttcggcgaccacgactactgccaggtgctgagacccgagggcgtgctgcagagaaaggtgctgagaagctgggagcccagcggcgtgcacctggaggactggccccagcagggcgccccctgggccgaggcccaggcccccggcagagaggaggacagaagctgcgacgccggcgccccccccaaggacagcaccctgctgagagaccacgagatcagagccagcctgaccaagcacttcggcctgctggagaccgccctggaggaggaggacctggccagctgcaagagccccgagtacgacaccgtgttcgaggacagcagcagcagcagcggcgagagcagcttcctgcccgaggaggaggaggaggagggcgaggaggaggaggaggacgacgaggaggaggacagcggcgtgagccccacctgcagcgaccactgcccctaccagagcccccccagcaaggccaacagacagctgtgcagcagaagcagaagcagcagcggcagcagcccctgccacagctggagccccgccaccagaagaaacttcagatgcgagagcagaggcccctgcagcgacagaacccccagcatcagacacgccagaaagagaagagagaaggccatcggcgagggcagagtggtgtacatccagaacctgagcagcgacatgagcagcagagagctgaagagaagattcgaggtgttcggcgagatcgaggagtgcgaggtgctgaccagaaacagaagaggcgagaagtacggcttcatcacctacagatgcagcgagcacgccgccctgagcctgaccaagggcgccgccctgagaaagagaaacgagcccagcttccagctgagctacggcggcctgagacacttctgctggcccagatacaccgactacggcaagcccctgaagcccagccacagcctggtgagactgaaggcctgggaggccgtgcccagcctgaacaagacccagagctag

SEQ ID NO: 92880 - DNA, 471 bp, Artificial Sequence
  Description of Artificial Sequence: Synthetic coding sequence
atggccgtgggcaagttcctgctgggcagcctgctgctgctgagcctgcagctgggccagggctggggccccgacgccagaggcgtgcccgtggccgacggcgagttcagcagcgagcaggtggccaaggccggcggcacctggctgggcacccacagacccctggccagactgagaagagccctgagcggcccctgccagctgtggagcctgaccctgagcgtggccgagctgggcctgggctacgccagcgaggagaaggtgatcttcagatactgcgccggcagctgccccagaggcgccagaacccagcacggcctggccctggccagactgcagggccagggcagagcccacggcggcccctgctgcagacccaccagatacaccgacgtggccttcctggacgacagacacagatggcagagactgccccagctgagcgccgccgcctgcggctgcggcggctag

SEQ ID NO: 92881 - DNA, 1422 bp, Artificial Sequence
  Description of Artificial Sequence: Synthetic coding sequence
atgggccagagcggcagaagcagacaccagaagagagccagagcccaggcccagctgagaaacctggaggcctacgccgccaacccccacagcttcgtgttcaccagaggctgcaccggcagaaacatcagacagctgagcctggacgtgagaagagtgatggagcccctgaccgccagcagactgcaggtgagaaagaagaacagcctgaaggactgcgtggccgtggccggccccctgggcgtgacccacttcctgatcctgagcaagaccgagaccaacgtgtacttcaagctgatgagactgcccggcggccccaccctgaccttccaggtgaagaagtacagcctggtgagagacgtggtgagcagcctgagaagacacagaatgcacgagcagcagttcgcccacccccccctgctggtgctgaacagcttcggcccccacggcatgcacgtgaagctgatggccaccatgttccagaacctgttccccagcatcaacgtgcacaaggtgaacctgaacaccatcaagagatgcctgctgatcgactacaaccccgacagccaggagctggacttcagacactacagcatcaaggtggtgcccgtgggcgccagcagaggcatgaagaagctgctgcaggagaagttccccaacatgagcagactgcaggacatcagcgagctgctggccaccggcgccggcctgagcgagagcgaggccgagcccgacggcgaccacaacatcaccgagctgccccaggccgtggccggcagaggcaacatgagagcccagcagagcgccgtgagactgaccgagatcggccccagaatgaccctgcagctgatcaaggtgcaggagggcgtgggcgagggcaaggtgatgttccacagcttcgtgagcaagaccgaggaggagctgcaggccatcctggaggccaaggagaagaagctgagactgaaggcccagagacaggcccagcaggcccagaacgtgcagagaaagcaggagcagagagaggcccacagaaagaagagcctggagggcatgaagaaggccagagtgggcggcagcgacgaggaggccagcggcatccccagcagaaccgccagcctggagctgggcgaggacgacgacgagcaggaggacgacgacatcgagtacttctgccaggccgtgggcgaggcccccagcgaggacctgttccccgaggccaagcagaagagactggccaagagccccggcagaaagagaaagagatgggagatggacagaggcagaggcagactgtgcgaccagaagttccccaagaccaaggacaagagccagggcgcccaggccagaagaggccccagaggcgccagcagagacggcggcagaggcagaggcagaggcagacccggcaagagagtggcctag

SEQ ID NO: 92882 - DNA, 1383 bp, Artificial Sequence
  Description of Artificial Sequence: Synthetic coding sequence
atgggccagagcggcagaagcagacaccagaagagagccagagcccaggcccagctgagaaacctggaggcctacgccgccaacccccacagcttcgtgttcaccagaggctgcaccggcagaaacatcagacagctgagcctggacgtgagaagagtgatggagcccctgaccgccagcagactgcaggtgagaaagaagaacagcctgaaggactgcgtggccgtggccggccccctgggcgtgacccacttcctgatcctgagcaagaccgagaccaacgtgtacttcaagctgatgagactgcccggcggccccaccctgaccttccaggtgaagaagtacagcctggtgagagacgtggtgagcagcctgagaagacacagaatgcacgagcagcagttcgcccacccccccctgctggtgctgaacagcttcggcccccacggcatgcacgtgaagctgatggccaccatgttccagaacctgttccccagcatcaacgtgcacaaggtgaacctgaacaccatcaagagatgcctgctgatcgactacaaccccgacagccaggagctggacttcagacactacagcatcaaggtggtgcccgtgggcgccagcagaggcatgaagaagctgctgcaggagaagttccccaacatgagcagactgcaggacatcagcgagctgctggccaccggcgccggcctgagcgagagcgaggccgagcccgacggcgaccacaacatcaccgagctgccccaggccgtggccggcagaggcaacatgagagcccagcagagcgccgtgagactgaccgagatcggccccagaatgaccctgcagctgatcaaggtgcaggagggcgtgggcgagggcaaggtgatgttccacagcttcgtgagcaagaccgaggaggagctgcaggccatcctggaggccaaggagaagaagctgagactgaaggcccagagacaggcccagcaggcccagaacgtgcagagaaagcaggagcagagagaggcccacagaaagaagagcctggagggcatgaagaaggccagagtgggcggcagcgacgaggaggccagcggcatccccagcagaaccgccagcctggagctgggcgaggacgacgacgagcaggaggacgacgacatcgagtacttctgccaggccgtgggcgaggcccccagcgaggacctgttccccgaggccaagcagaagagactggccaagagccccggcagaaagagaaagagatgggagatggacagaggcagaggcagactgtgcgaccagaagttccccaagaccaaggacaagagccaggacggcggcagaggcagaggcagaggcagacccggcaagagagtggcctag

SEQ ID NO: 92883 - DNA, 2385 bp, Artificial Sequence
  Description of Artificial Sequence: Synthetic coding sequence
atgggccagagcggcagaagcagacaccagaagagagccagagcccaggcccagctgagaaacctggaggcctacgccgccaacccccacagcttcgtgttcaccagaggctgcaccggcagaaacatcagacagctgagcctggacgtgagaagagtgatggagcccctgaccgccagcagactgcaggtgagaaagaagaacagcctgaaggactgcgtggccgtggccggccccctgggcgtgacccacttcctgatcctgagcaagaccgagaccaacgtgtacttcaagctgatgagactgcccggcggccccaccctgaccttccaggtgaagaagtacagcctggtgagagacgtggtgagcagcctgagaagacacagaatgcacgagcagcagttcgcccacccccccctgctggtgctgaacagcttcggcccccacggcatgcacgtgaagctgatggccaccatgttccagaacctgttccccagcatcaacgtgcacaaggtgaacctgaacaccatcaagagatgcctgctgatcgactacaaccccgacagccaggagctggacttcagacactacagcatcaaggtggtgcccgtgggcgccagcagaggcatgaagaagctgctgcaggagaagttccccaacatgagcagactgcaggacatcagcgagctgctggccaccggcgccggcctgagcgagagcgaggccgagcccgacggcgaccacaacatcaccgagctgccccaggccgtggccggcagaggcaacatgagagcccagcagagcgccgtgagactgaccgagatcggccccagaatgaccctgcagctgatcaaggtgcaggagggcgtgggcgagggcaaggtgatgttccacagcttcgtgagcaagaccgaggaggagctgcaggccatcctggaggccaaggagaagaagctgagactgaaggcccagagacaggcccagcaggcccagaacgtgcagagaaagcaggagcagagagaggcccacagaaagaagagcctggagggcatgaagaaggccagagtgggcggcagcgacgaggaggccagcggcatccccagcagaaccgccagcctggagctgggcgaggacgacgacgagcaggaggacgacgacatcgagtacttctgccaggccgtgggcgaggcccccagcgaggacctgttccccgaggccaagcagaagagactggccaagagccccggcagaaagagaaagagatgggagatggacagaggcgccaagagctgccccgccaacttcctggccgccgccgacgacaagctgagcggcttccagggcgacttcctgtggcccatcctggtggtggagttcctggtggccgtggccagcaacggcctggccctgtacagattcagcatcagaaagcagagaccctggcaccccgccgtggtgttcagcgtgcagctggccgtgagcgacctgctgtgcgccctgaccctgccccccctggccgcctacctgtacccccccaagcactggagatacggcgaggccgcctgcagactggagagattcctgttcacctgcaacctgctgggcagcgtgatcttcatcacctgcatcagcctgaacagatacctgggcatcgtgcaccccttcttcgccagaagccacctgagacccaagcacgcctgggccgtgagcgccgccggctgggtgctggccgccctgctggccatgcccaccctgagcttcagccacctgaagagaccccagcagggcgccggcaactgcagcgtggccagacccgaggcctgcatcaagtgcctgggcaccgccgaccacggcctggccgcctacagagcctacagcctggtgctggccggcctgggctgcggcctgcccctgctgctgaccctggccgcctacggcgccctgggcagagccgtgctgagaagccccggcatgaccgtggccgagaagctgagagtggccgccctggtggccagcggcgtggccctgtacgccagcagctacgtgccctaccacatcatgagagtgctgaacgtggacgccagaagaagatggagcaccagatgccccagcttcgccgacatcgcccaggccaccgccgccctggagctgggcccctacgtgggctaccaggtgatgagaggcctgatgcccctggccttctgcgtgcaccccctgctgtacatggccgccgtgcccagcctgggctgctgctgcagacactgccccggctacagagacagctggaaccccgaggacgccaagagcaccggccaggccctgcccctgaacgccaccgccgcccccaagcccagcgagccccagagcagagagctgagccagtag

SEQ ID NO: 92884 - DNA, 1374 bp, Artificial Sequence
  Description of Artificial Sequence: Synthetic coding sequence
atggcccagccccccagactgagcagaagcggcgccagcagcctgtgggaccccgccagccccgcccccaccagcggccccagacccagactgtgggagggccaggacgtgctggccagatggaccgacggcctgctgtacctgggcaccatcaagaaggtggacagcgccagagaggtgtgcctggtgcagttcgaggacgacagccagttcctggtgctgtggaaggacatcagccccgccgccctgcccggcgaggagctgctgtgctgcgtgtgcagaagcgagaccgtggtgcccggcaacagactggtgagctgcgagaagtgcagacacgcctaccaccaggactgccacgtgcccagagcccccgcccccggcgagggcgagggcaccagctgggtgtgcagacagtgcgtgttcgccatcgccaccaagagaggcggcgccctgaagaagggcccctacgccagagccatgctgggcatgaagctgagcctgccctacggcctgaagggcctggactgggacgccggccacctgagcaacagacagcagagctactgctactgcggcggccccggcgagtggaacctgaagatgctgcagtgcagaagctgcctgcagtggttccacgaggcctgcacccagtgcctgagcaagcccctgctgtacggcgacagattctacgagttcgagtgctgcgtgtgcagaggcggccccgagaaggtgagaagactgcagctgagatgggtggacgtggcccacctggtgctgtaccacctgagcgtgtgctgcaagaagaagtacttcgacttcgacagagagatcctgcccttcaccagcgagaactgggacagcctgctgctgggcgagctgagcgacacccccaagggcgagagaagcagcagactgctgagcgccctgaacagccacaaggacagattcatcagcggcagagagatcaagaagagaaagtgcctgttcggcctgcacgccagaatgcccccccccgtggagccccccaccggcgacggcgccctgaccagagccggcccctggggcagaggcctgaccagccccggcgaggcccccgaggccggcgccagagcccccgaggaggaggccgagggcgagagcggcggcgccggcgccaccctgagcagcgcccagagcgccagagcccccggcgccgagggcgccggcagcagcgccgagggcaccgccgccgcccccagcggctgcctgctgcccagcaccctgctgcccgccccccagggccccctgggcaccgtggacccccagaccggccacccctggaacttcaccctggtgagcccccagaccagcctgaaggtgccccccaccagatag

SEQ ID NO: 92885 - DNA, 1704 bp, Artificial Sequence
  Description of Artificial Sequence: Synthetic coding sequence
atggcccagccccccagactgagcagaagcggcgccagcagcctgtgggaccccgccagccccgcccccaccagcggccccagacccagactgtgggagggccaggacgtgctggccagatggaccgacggcctgctgtacctgggcaccatcaagaaggtggacagcgccagagaggtgtgcctggtgcagttcgaggacgacagccagttcctggtgctgtggaaggacatcagccccgccgccctgcccggcgaggagctgctgtgctgcgtgtgcagaagcgagaccgtggtgcccggcaacagactggtgagctgcgagaagtgcagacacgcctaccaccaggactgccacgtgcccagagcccccgcccccggcgagggcgagggcaccagctgggtgtgcagacagtgcgtgttcgccatcgccaccaagagaggcggcgccctgaagaagggcccctacgccagagccatgctgggcatgaagctgagcctgccctacggcctgaagggcctggactgggacgccggccacctgagcaacagacagcagagctactgctactgcggcggccccggcgagtggaacctgaagatgctgcagtgcagaagctgcctgcagtggttccacgaggcctgcacccagtgcctgagcaagcccctgctgtacggcgacagattctacgagttcgagtgctgcgtgtgcagaggcggccccgagaaggtgagaagactgcagctgagatgggtggacgtggcccacctggtgctgtaccacctgagcgtgtgctgcaagaagaagtacttcgacttcgacagagagatcctgcccttcaccagcgagaactgggacagcctgctgctgggcgagctgagcgacacccccaagggcgagagaagcagcagactgctgagcgccctgaacagccacaaggacagattcatcagcggcagagagatcaagaagagaaagtgcctgttcggcctgcacgccagaatgcccccccccgtggagccccccaccggcgacggcgccctgaccagcttccccagcggccagggccccggcggcggcgtgagcagacccctgggcaagagaagaagacccgagcccgagcccctgagaagaagacagaagggcaaggtggaggagctgggcccccccagcgccgtgagaaaccagcccgagccccaggagcagagagagagagcccacctgcagagagccctgcaggccagcgtgagcccccccagccccagccccaaccagagctaccagggcagcagcggctacaacttcagacccaccgacgccagatgcctgcccagcagccccatcagaatgttcgccagcttccaccccagcgccagcaccgccggcaccagcggcgacagcggcccccccgacagaagccccctggagctgcacatcggcttccccaccgacatccccaagagcgccccccacagcatgaccgccagcagcagcagcgtgagcagccccagccccggcctgcccagaagaagcgccccccccagccccctgtgcagaagcctgagccccggcaccggcggcggcgtgagaggcggcgtgggctacctgagcagaggcgaccccgtgagagtgctggccagaagagtgagacccgacggcagcgtgcagtacctggtggagtggggcggcggcggcatcttctag

SEQ ID NO: 92886 - DNA, 732 bp, Artificial Sequence
  Description of Artificial Sequence: Synthetic coding sequence
tgaagcctgctgctgaccgccaccagaaccgtgagcttccagggcgagagactgagaagaggcaacgtgtgcctggtgagcatgctgggctgcctgcccctgtggagccccctgctggagatggagcacagccccggccagggccccggcggcggcgtgagcagacccctgggcaagagaagaagacccgagcccgagcccctgagaagaagacagaagggcaaggtggaggagctgggcccccccagcgccgtgagaaaccagcccgagccccaggagcagagagagagagcccacctgcagagagccctgcaggccagcgtgagcccccccagccccagccccaaccagagctaccagggcagcagcggctacaacttcagacccaccgacgccagatgcctgcccagccccatcagaatgttcgccagcttccaccccagcgccagcaccgccggcaccagcggcgacagcggcccccccgacagaagccccctggagctgcacatcggcttccccaccgacatccccaagagcgccccccacagcatgaccgccagcagcagcagcgtgagcagccccagccccggcctgcccagaagaagcgccccccccagccccctgtgcagaagcctgagccccggcaccggcggcggcgtgagaggcggcgtgggctacctgagcagaggcgaccccgtgagagtgctggccagaagagtgagacccgactag

SEQ ID NO: 92887 - DNA, 438 bp, Artificial Sequence
  Description of Artificial Sequence: Synthetic coding sequence
atggcccagccccccagactgagcagaagcggcgccagcagcctgtgggaccccgccagccccgcccccaccagcggccccagacccagactgtgggagggccaggacgtgctggccagatggaccgacggcctgctgtacctgggcaccatcaagaaggtggacagcgccagagaggtgtgcctggtgcagttcgaggacgacagccagttcctggtgctgtggaaggacatcagccccgccgccctgcccggcgaggagctgctgtgctgcgtgtgcagaagcgagaccgtggtgcccggcaacagactggtgagctgcgagaagtgcagacacgcctaccaccaggactgccacgtgcccagagcccccgcccccggcgagggcgagggcaccagctgggtgtgcagacagtgcgtgttcgccatcgccacctag

SEQ ID NO: 92888 - DNA, 546 bp, Artificial Sequence
  Description of Artificial Sequence: Synthetic coding sequence
tggggccacccccagcagtgcgccatcagccccagccccagaagcagaggcagcggcctgatctgcagaggccactgcagaccccagtgcctgcaccacccccccgccctgaccagagtgaccagagccgccgccgccaccaccagcggcccccagatgcccgccgcctgccccggccaccccatcagaatgttcgccagcttccaccccagcgccagcaccgccggcaccagcggcgacagcggcccccccgacagaagccccctggagctgcacatcggcttccccaccgacatccccaagagcgccccccacagcatgaccgccagcagcagcagcgtgagcagccccagccccggcctgcccagaagaagcgccccccccagccccctgtgcagaagcctgagccccggcaccggcggcggcgtgagaggcggcgtgggctacctgagcagaggcgaccccgtgagagtgctggccagaagagtgagacccgacggcagcgtgcagtacctggtggagtggggcggcggcggcatcttctag

SEQ ID NO: 92889 - DNA, 438 bp, Artificial Sequence; identical to SEQ ID NO: 92887
  Description of Artificial Sequence: Synthetic coding sequence

SEQ ID NO: 92890 - DNA, 1704 bp, Artificial Sequence
  Description of Artificial Sequence: Synthetic coding sequence
atggcccagccccccagactgagcagaagcggcgccagcagcctgtgggaccccgccagccccgcccccaccagcggccccagacccagactgtgggagggccaggacgtgctggccagatggaccgacggcctgctgtacctgggcaccatcaagaaggtggacagcgccagagaggtgtgcctggtgcagttcgaggacgacagccagttcctggtgctgtggaaggacatcagccccgccgccctgcccggcgaggagctgctgtgctgcgtgtgcagaagcgagaccgtggtgcccggcaacagactggtgagctgcgagaagtgcagacacgcctaccaccaggactgccacgtgcccagagcccccgcccccggcgagggcgagggcaccagctgggtgtgcagacagtgcgtgttcgccatcgccaccaagagaggcggcgccctgaagaagggcccctacgccagagccatgctgggcatgaagctgagcctgccctacggcctgaagggcctggactgggacgccggccacctgagcaacagacagcagagctactgctactgcggcggccccggcgagtggaacctgaagatgctgcagtgcagaagctgcctgcagtggttccacgaggcctgcacccagtgcctgagcaagcccctgctgtacggcgacagattctacgagttcgagtgctgcgtgtgcagaggcggccccgagaaggtgagaagactgcagctgagatgggtggacgtggcccacctggtgctgtaccacctgagcgtgtgctgcaagaagaagtacttcgacttcgacagagagatcctgcccttcaccagcgagaactgggacagcctgctgctgggcgagctgagcgacacccccaagggcgagagaagcagcaagctgctgagcgccctgaacagccacaaggacagattcatcagcggcagagagatcaagaagagaaagtgcctgttcggcctgcacgccagaatgcccccccccgtggagccccccaccggcgacggcgccctgaccagcttccccagcggccagggccccggcggcggcgtgagcagacccctgggcaagagaagaagacccgagcccgagcccctgagaagaagacagaagggcaaggtggaggagctgggcccccccagcgccgtgagaaaccagcccgagccccaggagcagagagagagagcccacctgcagagagccctgcaggccagcgtgagcccccccagccccagccccaaccagagctaccagggcagcagcggctacaacttcagacccaccgacgccagatgcctgcccagcagccccatcagaatgttcgccagcttccaccccagcgccagcaccgccggcaccagcggcgacagcggcccccccgacagaagccccctggagctgcacatcggcttccccaccgacatccccaagagcgccccccacagcatgaccgccagcagcagcagcgtgagcagccccagccccggcctgcccagaagaagcgccccccccagccccctgtgcagaagcctgagccccggcaccggcggcggcgtgagaggcggcgtgggctacctgagcagaggcgaccccgtgagagtgctggccagaagagtgagacccgacggcagcgtgcagtacctggtggagtggggcggcggcggcatcttctag

SEQ ID NO: 92891 - DNA, 684 bp, Artificial Sequence
  Description of Artificial Sequence: Synthetic coding sequence
atggcccagccccccagactgagcagaagcggcgccagcagcctgtgggaccccgccagccccgcccccaccagcggccccagacccagactgtgggagggccaggacgtgctggccagatggaccgacggcctgctgtacctgggcaccatcaagaaggtggacagcgccagagaggtgtgcctggtgcagttcgaggacgacagccagttcctggtgctgtggaaggacatcagccccgccgccctgcccggcgaggagctgctgtgctgcgtgtgcagaagcgagaccgtggtgcccggcaacagactggtgagctgcgagaagtgcagacacgcctaccaccaggactgccacgtgcccagagcccccgcccccggcgagggcgagggcaccagctgggtgtgcagacagtgcgtgttcgccatcgccaccaagagaggcggcgccctgaagaagggcccctacgccagagccatgctgggcatgaagctgagcctgccctacggcctgaagggcctggactgggacgccggccacctgagcaacagacagcagagctactgctactgcggcggccccggcgagtggaacctgaagatgctgcagtgcagaagctgcctgcagtggttccacgaggcctgcacccagtgcctgagcaagcccctgctgtacggcgactag

SEQ ID NO: 92892 - DNA, 684 bp, Artificial Sequence; identical to SEQ ID NO: 92891
  Description of Artificial Sequence: Synthetic coding sequence

SEQ ID NO: 92893 - DNA, 1374 bp, Artificial Sequence
  Description of Artificial Sequence: Synthetic coding sequence
atggcccagccccccagactgagcagaagcggcgccagcagcctgtgggaccccgccagccccgcccccaccagcggccccagacccagactgtgggagggccaggacgtgctggccagatggaccgacggcctgctgtacctgggcaccatcaagaaggtggacagcgccagagaggtgtgcctggtgcagttcgaggacgacagccagttcctggtgctgtggaaggacatcagccccgccgccctgcccggcgaggagctgctgtgctgcgtgtgcagaagcgagaccgtggtgcccggcaacagactggtgagctgcgagaagtgcagacacgcctaccaccaggactgccacgtgcccagagcccccgcccccggcgagggcgagggcaccagctgggtgtgcagacagtgcgtgttcgccatcgccaccaagagaggcggcgccctgaagaagggcccctacgccagagccatgctgggcatgaagctgagcctgccctacggcctgaagggcctggactgggacgccggccacctgagcaacagacagcagagctactgctactgcggcggccccggcgagtggaacctgaagatgctgcagtgcagaagctgcctgcagtggttccacgaggcctgcacccagtgcctgagcaagcccctgctgtacggcgacagattctacgagttcgagtgctgcgtgtgcagaggcggccccgagaaggtgagaagactgcagctgagatgggtggacgtggcccacctggtgctgtaccacctgagcgtgtgctgcaagaagaagtacttcgacttcgacagagagatcctgcccttcaccagcgagaactgggacagcctgctgctgggcgagctgagcgacacccccaagggcgagagaagcagcaagctgctgagcgccctgaacagccacaaggacagattcatcagcggcagagagatcaagaagagaaagtgcctgttcggcctgcacgccagaatgcccccccccgtggagccccccaccggcgacggcgccctgaccagagccggcccctggggcagaggcctgaccagccccggcgaggcccccgaggccggcgccagagcccccgaggaggaggccgagggcgagagcggcggcgccggcgccaccctgagcagcgcccagagcgccagagcccccggcgccgagggcgccggcagcagcgccgagggcaccgccgccgcccccagcggctgcctgctgcccagcaccctgctgcccgccccccagggccccctgggcaccgtggacccccagaccggccacccctggaacttcaccctggtgagcccccagaccagcctgaaggtgccccccaccagatag

SEQ ID NO: 92894 - DNA, 1497 bp, Artificial Sequence
  Description of Artificial Sequence: Synthetic coding sequence
atggccgccgccgccggccccggcgccgccctgagccccagaccctgcgacagcgaccccgccacccccggcgcccagagccccaaggacgacaacgaggacaacagcaacgacggcacccagcccagcaagagaagaagaatgggcagcggcgacagcagcagaagctgcgagaccagcagccaggacctgggcttcagctactaccccgccgagaacctgatcgagtacaagtggccccccgacgagaccggcgagtactacatgctgcaggagcaggtgagcgagtacctgggcgtgaccagcttcaagagaaagtaccccgacctggagagaagagacctgagccacaaggagaagctgtacctgagagagctgaacgtgatcaccgagacccagtgcaccctgggcctgaccgccctgagaagcgacgaggtgatcgacctgatgatcaaggagtaccccgccaagcacgccgagtacagcgtgatcctgcaggagaaggagagacagagaatcaccgaccactacaaggagtacagccagatgcagcagcagaacacccagaaggtggaggccagcaaggtgcccgagtacatcaagaaggccgccaagaaggccgccgagttcaacagcaacctgaacagagagagaatggaggagagaagagcctacttcgacctgcagacccacgtgatccaggtgccccagggcaagtacaaggtgctgcccaccgagagaaccaaggtgagcagctaccccgtggccctgatccccggccagttccaggagtactacaagagatacagccccgacgagctgagatacctgcccctgaacaccgccctgtacgagccccccctggaccccgagctgcccgccctggacagcgacggcgacagcgacgacggcgaggacggcagaggcgacgagaagagaaagaacaagggcaccagcgacagcagcagcggcaacgtgagcgagggcgagagcccccccgacagccaggaggacagcttccagggcagacagaagagcaaggacaaggccgccacccccagaaaggacggccccaagagaagcgtgctgagcaagagcgtgcccggctacaagcccaaggtgatccccaacgccatctgcggcatctgcctgaagggcaaggagagcaacaagaagggcaaggccgagagcctgatccactgcagccagtgcgagaacagcggccaccccagctgcctggacatgaccatggagctggtgagcatgatcaagacctacccctggcagtgcatggagtgcaagacctgcatcatctgcggccagccccaccacgaggaggagatgatgttctgcgacatgtgcgacagaggctaccacaccttctgcgtgggcctgggcgccatccccagcggcagatggatctgcgactgctgccagagagccccccccacccccagaaaggtgggcagaagaggcaagaacagcaaggagggctag

SEQ ID NO: 92895 - DNA, 1491 bp, Artificial Sequence
  Description of Artificial Sequence: Synthetic coding sequence
atggccgccgccgccggccccggcgccgccctgagccccagaccctgcgacagcgaccccgccacccccggcgcccagagccccaaggacgacaacgaggacaacagcaacgacggcacccagcccagcaagagaagaagaatgggcagcggcgacagcagcagaagctgcgagaccagcagccaggacctgggcttcagctactaccccgccgagaacctgatcgagtacaagtggccccccgacgagaccggcgagtactacatgctgcaggagcaggtgagcgagtacctgggcgtgaccagcttcaagagaaagtaccccgagagaagagacctgagccacaaggagaagctgtacctgagagagctgaacgtgatcaccgagacccagtgcaccctgggcctgaccgccctgagaagcgacgaggtgatcgacctgatgatcaaggagtaccccgccaagcacgccgagtacagcgtgatcctgcaggagaaggagagacagagaatcaccgaccactacaaggagtacagccagatgcagcagcagaacacccagaaggtggaggccagcaaggtgcccgagtacatcaagaaggccgccaagaaggccgccgagttcaacagcaacctgaacagagagagaatggaggagagaagagcctacttcgacctgcagacccacgtgatccaggtgccccagggcaagtacaaggtgctgcccaccgagagaaccaaggtgagcagctaccccgtggccctgatccccggccagttccaggagtactacaagagatacagccccgacgagctgagatacctgcccctgaacaccgccctgtacgagccccccctggaccccgagctgcccgccctggacagcgacggcgacagcgacgacggcgaggacggcagaggcgacgagaagagaaagaacaagggcaccagcgacagcagcagcggcaacgtgagcgagggcgagagcccccccgacagccaggaggacagcttccagggcagacagaagagcaaggacaaggccgccacccccagaaaggacggccccaagagaagcgtgctgagcaagagcgtgcccggctacaagcccaaggtgatccccaacgccatctgcggcatctgcctgaagggcaaggagagcaacaagaagggcaaggccgagagcctgatccactgcagccagtgcgagaacagcggccaccccagctgcctggacatgaccatggagctggtgagcatgatcaagacctacccctggcagtgcatggagtgcaagacctgcatcatctgcggccagccccaccacgaggaggagatgatgttctgcgacatgtgcgacagaggctaccacaccttctgcgtgggcctgggcgccatccccagcggcagatggatctgcgactgctgccagagagccccccccacccccagaaaggtgggcagaagaggcaagaacagcaaggagggctag

SEQ ID NO: 92896 - DNA, 879 bp, Artificial Sequence
  Description of Artificial Sequence: Synthetic coding sequence
atggagaagagaacctgcgccctgtgccccaaggacgtggagtacaacgtgctgtacttcgcccagagcgagaacatcgccgcccacgagaactgcctgctgtacagcagcggcctggtggagtgcgaggaccaggaccccctgaaccccgacagaagcttcgacgtggagagcgtgaagaaggagatccagagaggcagaaagctgaagtgcaagttctgccacaagagaggcgccaccgtgggctgcgacctgaagaactgcaacaagaactaccacttcttctgcgccaagaaggacgacgccgtgccccagagcgacggcgtgagaggcatctacaagctgctgtgccagcagcacgcccagttccccatcatcgcccagagcgccaagttcagcggcgtgaagagaaagagaggcagaaagaagcccctgagcggcaaccacgtgcagccccccgagaccatgaagtgcaacaccttcatcagacaggtgaaggaggagcacggcagacacaccgacgccaccgtgaaggtgcccttcctgaagaagtgcaaggaggccggcctgctgaactacctgctggaggagatcctggacaaggtgcacagcatccccgagaagctgatggacgagaccaccagcgagagcgactacgaggagatcggcagcgccctgttcgactgcagactgttcgaggacaccttcgtgaacttccaggccgccatcgagaagaagatccacgccagccagcagagatggcagcagctgaaggaggagatcgagctgctgcaggacctgaagcagaccctgtgcagcttccaggagaacagagacctgatgagcagcagcaccagcatcagcagcctgagctactag

SEQ ID NO: 92897 - DNA, 996 bp, Artificial Sequence
  Description of Artificial Sequence: Synthetic coding sequence
atggcccaggccagcccccccagacccgagagagtgctgggcgccagcagccccgaggccagacccgcccaggaggccctgctgctgcccaccggcgtgttccaggtggccgagaagatggagaagagaacctgcgccctgtgccccaaggacgtggagtacaacgtgctgtacttcgcccagagcgagaacatcgccgcccacgagaactgcctgctgtacagcagcggcctggtggagtgcgaggaccaggaccccctgaaccccgacagaagcttcgacgtggagagcgtgaagaaggagatccagagaggcagaaagctgaagtgcaagttctgccacaagagaggcgccaccgtgggctgcgacctgaagaactgcaacaagaactaccacttcttctgcgccaagaaggacgacgccgtgccccagagcgacggcgtgagaggcatctacaagctgctgtgccagcagcacgcccagttccccatcatcgcccagagcgccaagttcagcggcgtgaagagaaagagaggcagaaagaagcccctgagcggcaaccacgtgcagccccccgagaccatgaagtgcaacaccttcatcagacaggtgaaggaggagcacggcagacacaccgacgccaccgtgaaggtgcccttcctgaagaagtgcaaggaggccggcctgctgaactacctgctggaggagatcctggacaaggtgcacagcatccccgagaagctgatggacgagaccaccagcgagagcgactacgaggagatcggcagcgccctgttcgactgcagactgttcgaggacaccttcgtgaacttccaggccgccatcgagaagaagatccacgccagccagcagagatggcagcagctgaaggaggagatcgagctgctgcaggacctgaagcagaccctgtgcagcttccaggagaacagagacctgatgagcagcagcaccagcatcagcagcctgagctactag

SEQ ID NO: 92898 - DNA, 861 bp, Artificial Sequence
  Description of Artificial Sequence: Synthetic coding sequence
tgaagacccggccccagaggctgcagcgcccccgccgccagaagacccggccccagaagaagaagaagcagcttcccccccctgtacagcagcggcctggtggagtgcgaggaccaggaccccctgaaccccgacagaagcttcgacgtggagagcgtgaagaaggagatccagagaggcagaaagctgaagtgcaagttctgccacaagagaggcgccaccgtgggctgcgacctgaagaactgcaacaagaactaccacttcttctgcgccaagaaggacgacgccgtgccccagagcgacggcgtgagaggcatctacaagctgctgtgccagcagcacgcccagttccccatcatcgcccagagcgccaagttcagcggcgtgaagagaaagagaggcagaaagaagcccctgagcggcaaccacgtgcagccccccgagaccatgaagtgcaacaccttcatcagacaggtgaaggaggagcacggcagacacaccgacgccaccgtgaaggtgcccttcctgaagaagtgcaaggaggccggcctgctgaactacctgctggaggagatcctggacaaggtgcacagcatccccgagaagctgatggacgagaccaccagcgagagcgactacgaggagatcggcagcgccctgttcgactgcagactgttcgaggacaccttcgtgaacttccaggccgccatcgagaagaagatccacgccagccagcagagatggcagcagctgaaggaggagatcgagctgctgcaggacctgaagcagaccctgtgcagcttccaggagaacagagacctgatgagcagcagcaccagcatcagcagcctgagctactag

SEQ ID NO: 92899 - DNA, 507 bp, Artificial Sequence
  Description of Artificial Sequence: Synthetic coding sequence
atggagaagagaacctgcgccctgtgccccaaggacgtggagtacaacgtgctgtacttcgcccagagcgagaacatcgccgcccacgagaactgcctgctgtacagcagcggcctggtggagtgcgaggaccaggaccccctgaaccccgacagaagcttcgacgtggagagcgtgaagaaggagatccagagaggcagaaagctgaagtgcaagttctgccacaagagaggcgccaccgtgggctgcgacctgaagaactgcaacaagaactaccacttcttctgcgccaagaaggacgacgccgtgccccagagcgacggcgtgagaggcatctacaagctgctgtgccagcagcacgcccagttccccatcatcgcccagagcgccaagttcagcggcgtgaagagaaagagaggcagaaagaagcccctgagcggcaaccacgtgcagccccccgagaccatgaagtgcaacaccttcatcagacaggtgaaggaggagtag

SEQ ID NO: 92900 - DNA, 297 bp, Artificial Sequence
  Description of Artificial Sequence: Synthetic coding sequence
atggagaagagaacctgcgccctgtgccccaaggacgtggagtacaacgtgctgtacttcgcccagagcgagaacatcgccgcccacgagaactgcctgctgtacagcagcggcctggtggagtgcgaggaccaggaccccctgaaccccgacagaagcttcgacgtggagagcgtgaagaaggagatccagagaggcagaaagctgaagtgcaagttctgccacaagagaggcgccaccgtgggctgcgacctgaagaactgcaacaagaactaccacttcttctgcgccaagtag

SEQ ID NO: 92901 - DNA, 879 bp, Artificial Sequence; identical to SEQ ID NO: 92896
  Description of Artificial Sequence: Synthetic coding sequence

SEQ ID NO: 92902 - DNA, 624 bp, Artificial Sequence
  Description of Artificial Sequence: Synthetic coding sequence
atggagaacagagccctggaccccggcaccagagacagctacggcgccaccagccacctgcccaacaagggcgccctggccaaggtgaagaacaacttcaaggacctgatgagcaagctgaccgagggccagtacgtgctgtgcagatggaccgacggcctgtactacctgggcaagatcaagagagtgagcagcagcaagcagagctgcctggtgaccttcgaggacaacagcaagtactgggtgctgtggaaggacatccagcacgccggcgtgcccggcgaggagcccaagtgcaacatctgcctgggcaagaccagcggccccctgaacgagatcctgatctgcggcaagtgcggcctgggctaccaccagcagtgccacatccccatcgccggcagcgccgaccagcccctgctgaccccctggttctgcagaagatgcatcttcgccctggccgtgagagtgagcctgcccagcagccccgtgcccgccagccccgccagcagcagcggcgccgaccagagactgcccagccagagcctgagcagcaagcagaagggccacacctgggccctggagaccgacagcgccagcgccaccgtgctgggccaggacctgtag

SEQ ID NO: 92903 - DNA, 1743 bp, Artificial Sequence
  Description of Artificial Sequence: Synthetic coding sequence
atggagaacagagccctggaccccggcaccagagacagctacggcgccaccagccacctgcccaacaagggcgccctggccaaggtgaagaacaacttcaaggacctgatgagcaagctgaccgagggccagtacgtgctgtgcagatggaccgacggcctgtactacctgggcaagatcaagagagtgagcagcagcaagcagagctgcctggtgaccttcgaggacaacagcaagtactgggtgctgtggaaggacatccagcacgccggcgtgcccggcgaggagcccaagtgcaacatctgcctgggcaagaccagcggccccctgaacgagatcctgatctgcggcaagtgcggcctgggctaccaccagcagtgccacatccccatcgccggcagcgccgaccagcccctgctgaccccctggttctgcagaagatgcatcttcgccctggccgtgagaaagggcggcgccctgaagaagggcgccatcgccagaaccctgcaggccgtgaagatggtgctgagctaccagcccgaggagctggagtgggacagcccccacagaaccaaccagcagcagtgctactgctactgcggcggccccggcgagtggtacctgagaatgctgcagtgctacagatgcagacagtggttccacgaggcctgcacccagtgcctgaacgagcccatgatgttcggcgacagattctacctgttcttctgcagcgtgtgcaaccagggccccgagtacatcgagagactgcccctgagatgggtggacgtggtgcacctggccctgtacaacctgggcgtgcagagcaagaagaagtacttcgacttcgaggagatcctggccttcgtgaaccaccactgggagctgctgcagctgggcaagctgaccagcacccccgtgaccgacagaggcccccacctgctgaacgccctgaacagctacaagagcagattcctgtgcggcaaggagatcaagaagaagaagtgcatcttcagactgagaatcagagtgccccccaacccccccggcaagctgctgcccgacaagggcctgctgcccaacgagaacagcgccagcagcgagctgagaaagagaggcaagagcaagcccggcctgctgccccacgagttccagcagcagaagagaagagtgtacagaagaaagagaagcaagttcctgctggaggacgccatccccagcagcgacttcaccagcgcctggagcaccaaccaccacctggccagcatcttcgacttcaccctggacgagatccagagcctgaagagcgccagcagcggccagaccttcttcagcgacgtggacagcaccgacgccgccagcaccagcggcagcgccagcaccagcctgagctacgacagcagatggaccgtgggcagcagaaagagaaagctggccgccaaggcctacatgcccctgagagccaagagatgggccgccgagctggacggcagatgccccagcgacagcagcgccgagggcgccagcgtgcccgagagacccgacgagggcatcgacagccacaccttcgagagcatcagcgaggacgacagcagcctgagccacctgaagagcagcatcaccaactacttcggcgccgccggcagactggcctgcggcgagaagtaccaggtgctggccagaagagtgacccccgagggcaaggtgcagtacctggtggagtgggagggcaccaccccctactag

SEQ ID NO: 92904 - DNA, 1116 bp, Artificial Sequence
  Description of Artificial Sequence: Synthetic coding sequence
atgctgcagtgctacagatgcagacagtggttccacgaggcctgcacccagtgcctgaacgagcccatgatgttcggcgacagattctacctgttcttctgcagcgtgtgcaaccagggccccgagtacatcgagagactgcccctgagatgggtggacgtggtgcacctggccctgtacaacctgggcgtgcagagcaagaagaagtacttcgacttcgaggagatcctggccttcgtgaaccaccactgggagctgctgcagctgggcaagctgaccagcacccccgtgaccgacagaggcccccacctgctgaacgccctgaacagctacaagagcagattcctgtgcggcaaggagatcaagaagaagaagtgcatcttcagactgagaatcagagtgccccccaacccccccggcaagctgctgcccgacaagggcctgctgcccaacgagaacagcgccagcagcgagctgagaaagagaggcaagagcaagcccggcctgctgccccacgagttccagcagcagaagagaagagtgtacagaagaaagagaagcaagttcctgctggaggacgccatccccagcagcgacttcaccagcgcctggagcaccaaccaccacctggccagcatcttcgacttcaccctggacgagatccagagcctgaagagcgccagcagcggccagaccttcttcagcgacgtggacagcaccgacgccgccagcaccagcggcagcgccagcaccagcctgagctacgacagcagatggaccgtgggcagcagaaagagaaagctggccgccaaggcctacatgcccctgagagccaagagatgggccgccgagctggacggcagatgccccagcgacagcagcgccgagggcgccagcgtgcccgagagacccgacgagggcatcgacagccacaccttcgagagcatcagcgaggacgacagcagcctgagccacctgaagagcagcatcaccaactacttcggcgccgccggcagactggcctgcggcgagaagtaccaggtgctggccagaagagtgacccccgagggcaaggtgcagtacctggtggagtgggagggcaccaccccctactag

SEQ ID NO: 92905 - DNA, 501 bp, Artificial Sequence
  Description of Artificial Sequence: Synthetic coding sequence
atggagaacagagccctggaccccggcaccagagacagctacggcgccaccagccacctgcccaacaagggcgccctggccaaggtgaagaacaacttcaaggacctgatgagcaagctgaccgagggccagtacgtgctgtgcagatggaccgacggcctgtactacctgggcaagatcaagagagtgagcagcagcaagcagagctgcctggtgaccttcgaggacaacagcaagtactgggtgctgtggaaggacatccagcacgccggcgtgcccggcgaggagcccaagtgcaacatctgcctgggcaagaccagcggccccctgaacgagatcctgatctgcggcaagtgcggcctgggctaccaccagcagtgccacatccccatcgccggcagcgccgaccagcccctgctgaccccctggttctgcagaagatgcatcttcgccctggccgtgagaaagggcggcgccctgaagaagggcgccatcgcctag

SEQ ID NO: 92906 - DNA, 324 bp, Artificial Sequence
  Description of Artificial Sequence: Synthetic coding sequence
atggagaacagagccctggaccccggcaccagagacagctacggcgccaccagccacctgcccaacaagggcgccctggccaaggtgaagaacaacttcaaggacctgatgagcaagctgaccgagggccagtacgtgctgtgcagatggaccgacggcctgtactacctgggcaagatcaagagagtgagcagcagcaagcagagctgcctggtgaccttcgaggacaacagcaagtactgggtgctgtggaaggacatccagcacgccggcgtgcccggcgaggagcccaagtgcaacatctgcctgggcaagaccagctag

SEQ ID NO: 92907 - DNA, 1692 bp, Artificial Sequence
  Description of Artificial Sequence: Synthetic coding sequence
atggagaacagagccctggaccccggcaccagagacagctacggcgccaccagccacctgcccaacaagggcgccctggccaaggtgaagaacaacttcaaggacctgatgagcaagctgaccgagggccagtacgtgctgtgcagatggaccgacggcctgtactacctgggcaagatcaagagagtgagcagcagcaagcagagctgcctggtgaccttcgaggacaacagcaagtactgggtgctgtggaaggacatccagcacgccggcgtgcccggcgaggagcccaagtgcaacatctgcctgggcaagaccagcggccccctgaacgagatcctgatctgcggcaagtgcggcctgggctaccaccagcagtgccacatccccatcgccggcagcgccgaccagcccctgctgaccccctggttctgcagaagatgcatcttcgccctggccgtgagaaagggcggcgccctgaagaagggcgccatcgccagaaccctgcaggccgtgaagatggtgctgagctaccagcccgaggagctggagtgggacagcccccacagaaccaaccagcagcagtgctactgctactgcggcggccccggcgagtggtacctgagaatgctgcagtgctacagatgcagacagtggttccacgaggcctgcacccagtgcctgaacgagcccatgatgttcggcgacagattctacctgttcttctgcagcgtgtgcaaccagggccccgagtacatcgagagactgcccctgagatgggtggacgtggtgcacctggccctgtacaacctgggcgtgcagagcaagaagaagtacttcgacttcgaggagatcctggccttcgtgaaccaccactgggagctgctgcagctgggcaagctgaccagcacccccgtgaccgacagaggcccccacctgctgaacgccctgaacagctacaagagcagattcctgtgcggcaaggagatcaagaagaagaagtgcatcttcagactgagaatcagagtgccccccaacccccccggcaagctgctgcccgacaagggcctgctgcccaacgagaacagcgccagcagcgagctgagaaagagaggcaagagcaagcccggcctgctgccccacgagttccagcagcagaagagaagagtgtacagaagaaagagaagcaagttcctgctggaggacgccatccccagcagcgacttcaccagcgcctggagcaccaaccaccacctggccagcatcttcgacttcaccctggacgagatccagagcctgaagagcgccagcagcggccagaccttcttcagcgacgtggacagcaccgacgccgccagcaccagcggcagcgccagcaccagcctgagctacgacagcagatggaccgtgggcagcagaaagagaaagctggccgccaaggcctacatgcccctgagagccaagagatgggccgccgagctggacggcagatgccccagcgacagcagcgccgagggcgccagcgtgcccgagagacccgacgagggcatcgacagccacaccttcgagagcatcagcgaggacgacagcagcctgagccacctgaagagcagcatcaccaactacttcggcgccgccggcagactggcctggggcgaggtgcccggcgtgggcagcgagggccacacctag

SEQ ID NO: 92908 - DNA, 3291 bp, Artificial Sequence
  Description of Artificial Sequence: Synthetic coding sequence
atggccaccgtgcccgtgtactgcgtgtgcagactgccctacgacgtgaccagattcatgatcgagtgcgacgcctgcaaggactggttccacggcagctgcgtgggcgtggaggaggaggaggcccccgacatcgacatctaccactgccccaactgcgagaagacccacggcaagagcaccctgaagaagaagagaacctggcacaagcacggccccggccaggcccccgacgtgaagcccgtgcagaacggcagccagctgttcatcaaggagctgagaagcagaaccttccccagcgccgaggacgtggtggccagagtgcccggcagccagctgaccctgggctacatggaggagcacggcttcaccgagcccatcctggtgcccaagaaggacggcctgggcctggccgtgcccgcccccaccttctacgtgagcgacgtggagaactacgtgggccccgagagaagcgtggacgtgaccgacgtgaccaagcagaaggactgcaagatgaagctgaaggagttcgtggactactactacagcaccaacagaaagagagtgctgaacgtgaccaacctggagttcagcgacaccagaatgagcagcttcgtggagccccccgacatcgtgaagaagctgagctgggtggagaactactggcccgacgacgccctgctggccaagcccaaggtgaccaagtactgcctgatctgcgtgaaggacagctacaccgacttccacatcgacagcggcggcgccagcgcctggtaccacgtgctgaagggcgagaagaccttctacctgatcagacccgccagcgccaacatcagcctgtacgagagatggagaagcgccagcaaccacagcgagatgttcttcgccgaccaggtggacaagtgctacaagtgcatcgtgaagcagggccagaccctgttcatccccagcggctggatctacgccaccctgacccccgtggactgcctggccttcgccggccacttcctgcacagcctgagcgtggagatgcagatgagagcctacgaggtggagagaagactgaagctgggcagcctgacccagttccccaacttcgagaccgcctgctggtacatgggcaagcacctgctggaggccttcaagggcagccacaagagcggcaagcagctgcccccccacctggtgcagggcgccaagatcctgaacggcgccttcagaagctggaccaagaagcaggccctggccgagcacgaggacgagctgcccgagcacttcaagcccagccagctgatcaaggacctggccaaggagatcagactgagcgagaacgccagcaaggccgtgagacccgaggtgaacaccgtggccagcagcgacgaggtgtgcgacggcgacagagagaaggaggagccccccagccccatcgaggccacccccccccagagcctgctggagaaggtgagcaagaagaagacccccaagaccgtgaagatgcccaagcccagcaagatccccaagccccccaagccccccaagccccccagaccccccaagaccctgaagctgaaggacggcggcaagaagaagggcaagaagagcagagagagcgccagccccaccatccccaacctggacctgctggaggcccacaccaaggaggccctgaccaagatggagccccccaagaagggcaaggccaccaagagcgtgctgagcgtgcccaacaaggacgtggtgcacatgcagaacgacgtggagagactggagatcagagagcagaccaagagcaagagcgaggccaagtggaagtacaagaacagcaagcccgacagcctgctgaagatggaggaggagcagaagctggagaagagccccctggccggcaacaaggacaacaagttcagcttcagcttcagcaacaagaagctgctgggcagcaaggccctgagaccccccaccagccccggcgtgttcggcgccctgcagaacttcaaggaggacaagcccaagcccgtgagagacgagtacgagtacgtgagcgacgacggcgagctgaagatcgacgagttccccatcagaagaaagaagaacgcccccaagagagacctgagcttcctgctggacaagaaggccgtgctgcccacccccgtgaccaagcccaagctggacagcgccgcctacaagagcgacgacagcagcgacgagggcagcctgcacatcgacaccgacaccaagcccggcagaaacgccagagtgaagaaggagagcggcagcagcgccgccggcatcctggacctgctgcaggccagcgaggaggtgggcgccctggagtacaaccccagcagccagccccccgccagccccagcacccaggaggccatccagggcatgctgagcatggccaacctgcaggccagcgacagctgcctgcagaccacctggggcgccggccaggccaagggcagcagcctggccgcccacggcgccagaaagaacggcggcggcagcggcaagagcgccggcaagagactgctgaagagagccgccaagaacagcgtggacctggacgactacgaggaggagcaggaccacctggacgcctgcttcaaggacagcgactacgtgtaccccagcctggagagcgacgaggacaaccccatcttcaagagcagaagcaagaagagaaagggcagcgacgacgccccctacagccccaccgccagagtgggccccagcgtgcccagacaggacagacccgtgagagagggcaccagagtggccagcatcgagaccggcctggccgccgccgccgccaagctgagccagcaggaggagcagaagagcaagaagaagaagagcgccaagagaaagctgacccccaacaccaccagccccagcaccagcaccagcatcagcgccggcaccaccagcaccagcaccacccccgccagcaccacccccgccagcaccacccccgccagcaccagcaccgccagcagccaggccagccaggagggcagcagccccgagcccccccccgagagccacagcagcagcctggccgaccacgagtacaccgccgccggcaccttcaccggcgcccaggccggcagaaccagccagcccatggcccccggcgtgttcctgacccagagaagacccagcgccagcagccccaacaacaacaccgccgccaagggcaagagaaccaagaagggcatggccaccgccaagcagagactgggcaagatcctgaagatccacagaaacggcaagctgctgctgtag

SEQ ID NO: 92909 - DNA, 984 bp, Artificial Sequence
  Description of Artificial Sequence: Synthetic coding sequence
atggccaccgtgcccgtgtactgcgtgtgcagactgccctacgacgtgaccagattcatgatcgagtgcgacgcctgcaaggactggttccacggcagctgcgtgggcgtggaggaggaggaggcccccgacatcgacatctaccactgccccaactgcgagaagacccacggcaagagcaccctgaagaagaagagaacctggcacaagcacggccccggccaggcccccgacgtgaagcccaagaacagcgtggacctggacgactacgaggaggagcaggaccacctggacgcctgcttcaaggacagcgactacgtgtaccccagcctggagagcgacgaggacaaccccatcttcaagagcagaagcaagaagagaaagggcagcgacgacgccccctacagccccaccgccagagtgggccccagcgtgcccagacaggacagacccgtgagagagggcaccagagtggccagcatcgagaccggcctggccgccgccgccgccaagctgagccagcaggaggagcagaagagcaagaagaagaagagcgccaagagaaagctgacccccaacaccaccagccccagcaccagcaccagcatcagcgccggcaccaccagcaccagcaccacccccgccagcaccacccccgccagcaccacccccgccagcaccagcaccgccagcagccaggccagccaggagggcagcagccccgagcccccccccgagagccacagcagcagcctggccgaccacgagtacaccgccgccggcaccttcaccggcgcccaggccggcagaaccagccagcccatggcccccggcgtgttcctgacccagagaagacccagcgccagcagccccaacaacaacaccgccgccaagggcaagagaaccaagaagggcatggccaccgccaagcagagactgggcaagatcctgaagatccacagaaacggcaagctgctgctgtag

SEQ ID NO: 92910 - DNA, 2046 bp, Artificial Sequence
  Description of Artificial Sequence: Synthetic coding sequence
atggagctgcagaccctgcaggaggccctgaaggtggagatccaggtgcaccagaagctggtggcccagatgaagcaggacccccagaacgccgacctgaagaagcagctgcacgagctgcaggccaagatcaccgccctgagcgagaagcagaagagagtggtggagcagctgagaaagaacctgatcgtgaagcaggagcagcccgacaagttccagatccagcccctgccccagagcgagaacaagctgcagaccgcccagcagcagcccctgcagcagctgcagcagcagcagcagtaccaccaccaccacgcccagcagagcgccgccgccagccccaacctgaccgccagccagaagaccgtgaccaccgccagcatgatcaccaccaagaccctgcccctggtgctgaaggccgccaccgccaccatgcccgccagcgtggtgggccagagacccaccatcgccatggtgaccgccatcaacagccagaaggccgtgctgagcaccgacgtgcagaacacccccgtgaacctgcagaccagcagcaaggtgaccggccccggcgccgaggccgtgcagatcgtggccaagaacaccgtgaccctgcaggtgcaggccacccccccccagcccatcaaggtgccccagttcatccccccccccagactgacccccagacccaacttcctgccccaggtgagacccaagcccgtggcccagaacaacatccccatcgcccccgcccccccccccatgctggccgccccccagctgatccagagacccgtgatgctgaccaagttcacccccaccaccctgcccaccagccagaacagcatccaccccgtgagagtggtgaacggccagaccgccaccatcgccaagaccttccccatggcccagctgaccagcatcgtgatcgccacccccggcaccagactggccggcccccagaccgtgcagctgagcaagcccagcctggagaagcagaccgtgaagagccacaccgagaccgacgagaagcagaccgagagcagaaccatcaccccccccgccgcccccaagcccaagagagaggagaacccccagaagctggccttcatggtgagcctgggcctggtgacccacgaccacctggaggagatccagagcaagagacaggagagaaagagaagaaccaccgccaaccccgtgtacagcggcgccgtgttcgagcccgagagaaagaagagcgccgtgacctacctgaacagcaccatgcaccccggcaccagaaagagaggcagaccccccaagtacaacgccgtgctgggcttcggcgccctgacccccaccagcccccagagcagccaccccgacagccccgagaacgagaagaccgagaccaccttcaccttccccgcccccgtgcagcccgtgagcctgcccagccccaccagcaccgacggcgacatccacgaggacttctgcagcgtgtgcagaaagagcggccagctgctgatgtgcgacacctgcagcagagtgtaccacctggactgcctggacccccccctgaagaccatccccaagggcatgtggatctgccccagatgccaggaccagatgctgaagaaggaggaggccatcccctggcccggcaccctggccatcgtgcacagctacatcgcctacaaggccgccaaggaggaggagaagcagaagctgctgaagtggagcagcgacctgaagcaggagagagagcagctggagcagaaggtgaagcagctgagcaacagcatcagcaagtgcatggagatgaagaacaccatcctggccagacagaaggagatgcacagcagcctggagaaggtgaagcagctgatcagactgatccacggcatcgacctgagcaagcccgtggacagcgaggccaccgtgggcgccatcagcaacggccccgactgcaccccccccgccaacgccgccaccagcacccccgcccccagccccagcagccagagctgcaccgccaactgcaaccagggcgaggagaccaagtag

SEQ ID NO: 92911 - DNA, 1905 bp, Artificial Sequence
  Description of Artificial Sequence: Synthetic coding sequence
atggagctgcagaccctgcaggaggccctgaaggtggagatccaggtgcaccagaagctggtggcccagatgaagcaggacccccagaacgccgacctgaagaagcagctgcacgagctgcaggccaagatcaccgccctgagcgagaagcagaagagagtggtggagcagctgagaaagaacctgatcgtgaagcaggagcagcccgacaagttccagatccagcccctgccccagagcgagaacaagctgcagaccgcccagcagcagcccctgcagcagctgcagcagcagcagcagtaccaccaccaccacgcccagcagagcgccgccgccagccccaacctgaccgccagccagaagaccgtgaccaccgccagcatgatcaccaccaagaccctgcccctggtgctgaaggccgccaccgccaccatgcccgccagcgtggtgggccagagacccaccatcgccatggtgaccgccatcaacagccagaaggccgtgctgagcaccgacgtgcagaacacccccgtgaacctgcagaccagcagcaaggtgaccggccccggcgccgaggccgtgcagatcgtggccaagaacaccgtgaccctgcaggtgcaggccacccccccccagcccatcaaggtgccccagttcatccccccccccagactgacccccagacccaacttcctgccccaggtgagacccaagcccgtggcccagaacaacatccccatcgcccccgcccccccccccatgctggccgccccccagctgatccagagacccgtgatgctgaccaagttcacccccaccaccctgcccaccagccagaacagcatccaccccgtgagagtggtgaacggccagaccgccaccatcgccaagaccttccccatggcccagctgaccagcatcgtgatcgccacccccggcaccagactggccggcccccagaccgtgcagctgagcaagcccagcctggagaagcagaccgtgaagagccacaccgagaccgacgagaagcagaccgagagcagaaccatcaccccccccgccgcccccaagcccaagagagaggagaacccccagaagctggccttcatggtgagcctgggcctggtgacccacgaccacctggaggagatccagagcaagagacaggagagaaagagaagaaccaccgccaaccccgtgtacagcggcgccgtgttcgagcccgagagaaagaagagcgccgtgacctacctgaacagcaccatgcaccccggcaccagaaagagagccaacgaggagcactggcccaagggcgacatccacgaggacttctgcagcgtgtgcagaaagagcggccagctgctgatgtgcgacacctgcagcagagtgtaccacctggactgcctggacccccccctgaagaccatccccaagggcatgtggatctgccccagatgccaggaccagatgctgaagaaggaggaggccatcccctggcccggcaccctggccatcgtgcacagctacatcgcctacaaggccgccaaggaggaggagaagcagaagctgctgaagtggagcagcgacctgaagcaggagagagagcagctggagcagaaggtgaagcagctgagcaacagcatcagcaagtgcatggagatgaagaacaccatcctggccagacagaaggagatgcacagcagcctggagaaggtgaagcagctgatcagactgatccacggcatcgacctgagcaagcccgtggacagcgaggccaccgtgggcgccatcagcaacggccccgactgcaccccccccgccaacgccgccaccagcacccccgcccccagccccagcagccagagctgcaccgccaactgcaaccagggcgaggagaccaagtag

SEQ ID NO: 92912 - DNA, 2043 bp, Artificial Sequence
  Description of Artificial Sequence: Synthetic coding sequence
atggagctgcagaccctgcaggaggccctgaaggtggagatccaggtgcaccagaagctggtggcccagatgaagcaggacccccagaacgccgacctgaagaagcagctgcacgagctgcaggccaagatcaccgccctgagcgagaagcagaagagagtggtggagcagctgagaaagaacctgatcgtgaagcaggagcagcccgacaagttccagatccagcccctgccccagagcgagaacaagctgcagaccgcccagcagcagcccctgcagcagctgcagcagcagcagcagtaccaccaccaccacgcccagcagagcgccgccgccagccccaacctgaccgccagccagaagaccgtgaccaccgccagcatgatcaccaccaagaccctgcccctggtgctgaaggccgccaccgccaccatgcccgccagcgtggtgggccagagacccaccatcgccatggtgaccgccatcaacagccagaaggccgtgctgagcaccgacgtgcagaacacccccgtgaacctgcagaccagcagcaaggtgaccggccccggcgccgaggccgtgcagatcgtggccaagaacaccgtgaccctggtgcaggccacccccccccagcccatcaaggtgccccagttcatccccccccccagactgacccccagacccaacttcctgccccaggtgagacccaagcccgtggcccagaacaacatccccatcgcccccgcccccccccccatgctggccgccccccagctgatccagagacccgtgatgctgaccaagttcacccccaccaccctgcccaccagccagaacagcatccaccccgtgagagtggtgaacggccagaccgccaccatcgccaagaccttccccatggcccagctgaccagcatcgtgatcgccacccccggcaccagactggccggcccccagaccgtgcagctgagcaagcccagcctggagaagcagaccgtgaagagccacaccgagaccgacgagaagcagaccgagagcagaaccatcaccccccccgccgcccccaagcccaagagagaggagaacccccagaagctggccttcatggtgagcctgggcctggtgacccacgaccacctggaggagatccagagcaagagacaggagagaaagagaagaaccaccgccaaccccgtgtacagcggcgccgtgttcgagcccgagagaaagaagagcgccgtgacctacctgaacagcaccatgcaccccggcaccagaaagagaggcagaccccccaagtacaacgccgtgctgggcttcggcgccctgacccccaccagcccccagagcagccaccccgacagccccgagaacgagaagaccgagaccaccttcaccttccccgcccccgtgcagcccgtgagcctgcccagccccaccagcaccgacggcgacatccacgaggacttctgcagcgtgtgcagaaagagcggccagctgctgatgtgcgacacctgcagcagagtgtaccacctggactgcctggacccccccctgaagaccatccccaagggcatgtggatctgccccagatgccaggaccagatgctgaagaaggaggaggccatcccctggcccggcaccctggccatcgtgcacagctacatcgcctacaaggccgccaaggaggaggagaagcagaagctgctgaagtggagcagcgacctgaagcaggagagagagcagctggagcagaaggtgaagcagctgagcaacagcatcagcaagtgcatggagatgaagaacaccatcctggccagacagaaggagatgcacagcagcctggagaaggtgaagcagctgatcagactgatccacggcatcgacctgagcaagcccgtggacagcgaggccaccgtgggcgccatcagcaacggccccgactgcaccccccccgccaacgccgccaccagcacccccgcccccagccccagcagccagagctgcaccgccaactgcaaccagggcgaggagaccaagtag

SEQ ID NO: 92913 - DNA, 81 bp, Artificial Sequence
  Description of Artificial Sequence: Synthetic coding sequence
atggagctgcagaccctgcaggaggccctgaaggtggagatccaggtgcaccagaagctggtggcccagatgaagcagtag

SEQ ID NO: 92914 - DNA, 36 bp, Artificial Sequence
  Description of Artificial Sequence: Synthetic coding sequence
atggagctgcagaccctgcaggaggccctgaagtag

SEQ ID NO: 92915 - DNA, 306 bp, Artificial Sequence
  Description of Artificial Sequence: Synthetic coding sequence
atggagctgcagaccctgcaggaggccctgaaggtggagatccaggtgcaccagaagctggtggcccagatgaagcaggacccccagaacgccgacctgaagaagcagctgcacgagctgcaggccaagatcaccgccctgagcgagaagcagaagagagtggtggagcagctgagaaagaacctgatcgtgaagcaggagcagcccgacaagttccagatccagcccctgccccagagcgagaacaagctgcagaccgcccagcagcagcccctgcagcagctgcagcagcagcagcagtactag

SEQ ID NO: 92916 - DNA, 30 bp, Artificial Sequence
  Description of Artificial Sequence: Synthetic coding sequence
atggagctgcagaccctgcaggaggcctag

SEQ ID NO: 92917 - DNA, 156 bp, Artificial Sequence
  Description of Artificial Sequence: Synthetic coding sequence
atggagctgcagaccctgcaggaggccctgaaggtggagatccaggtgcaccagaagctggtggcccagatgaagcaggacccccagaacgccgacctgaagaagcagctgcacgagctgcaggccaagatcaccgccctgagcgagaagcagtag

SEQ ID NO: 92918 - DNA, 477 bp, Artificial Sequence
  Description of Artificial Sequence: Synthetic coding sequence
atgctggaggccatggccgagcccagccccgaggaccccccccccaccctgaagcccgagacccagccccccgagaagagaagaagaaccatcgaggacttcaacaagttctgcagcttcgtgctggcctacgccggctacatcccccccagcaaggaggagagcgactggcccgccagcggcagcagcagccccctgagaggcgagagcgccgccgacagcgacggctgggacagcgcccccagcgacctgagaaccatccagaccttcgtgaagaaggccaagagcagcaagagaagagccgcccaggccggccccacccagcccggcccccccagaagcaccttcagcagactgcaggcccccgacagcgccaccctgctggagaagatgaagctgaaggacagcctgttcgacctggacggccccaaggtggccagccccctgagccccccctgcgccgccaacaccccctag

SEQ ID NO: 92919 - DNA, 1212 bp, Artificial Sequence
  Description of Artificial Sequence: Synthetic coding sequence
atgctggaggccatggccgagcccagccccgaggaccccccccccaccctgaagcccgagacccagccccccgagaagagaagaagaaccatcgaggacttcaacaagttctgcagcttcgtgctggcctacgccggctacatcccccccagcaaggaggagagcgactggcccgccagcggcagcagcagccccctgagaggcgagagcgccgccgacagcgacggctgggacagcgcccccagcgacctgagaaccatccagaccttcgtgaagaaggccaagagcagcaagagaagagccgcccaggccggccccacccagcccggcccccccagaagcaccttcagcagactgcaggcccccgacagcgccaccctgctggagaagatgaagctgaaggacagcctgttcgacctggacggccccaaggtggccagccccctgagccccaccagcctgacccacaccagcagaccccccgccgccctgacccccgtgcccctgagccagggcgacctgagccacccccccagaaagaaggacagaaagaacagaaagctgggccccggcgccggcgccggcttcggcgtgctgagaagacccagacccacccccggcgacggcgagaagagaagcagaatcaagaagagcaagaagagaaagctgaagaaggccgagagaggcgacagactgcccccccccggccccccccaggccccccccagcgacaccgacagcgaggaggaggaggaggaggaggaggaggaggaggaggaggagatggccaccgtggtgggcggcgaggcccccgtgcccgtgctgcccaccccccccgaggcccccagaccccccgccaccgtgcaccccgagggcgtgccccccgccgacagcgagagcaaggaggtgggcagcaccgagaccagccaggacggcgacgccagcagcagcgagggcgagatgagagtgatggacgaggacatcatggtggagagcggcgacgacagctgggacctgatcacctgctactgcagaaagcccttcgccggcagacccatgatcgagtgcagcctgtgcggcacctggatccacctgagctgcgccaagatcaagaagaccaacgtgcccgacttcttctactgccagaagtgcaaggagctgagacccgaggccagaagactgggcggcccccccaagagcggcgagccctag

SEQ ID NO: 92920 - DNA, 1200 bp, Artificial Sequence
  Description of Artificial Sequence: Synthetic coding sequence
atgcccggcgactgcagaagagaccccccccccaccctgaagcccgagacccagccccccgagaagagaagaagaaccatcgaggacttcaacaagttctgcagcttcgtgctggcctacgccggctacatcccccccagcaaggaggagagcgactggcccgccagcggcagcagcagccccctgagaggcgagagcgccgccgacagcgacggctgggacagcgcccccagcgacctgagaaccatccagaccttcgtgaagaaggccaagagcagcaagagaagagccgcccaggccggccccacccagcccggcccccccagaagcaccttcagcagactgcaggcccccgacagcgccaccctgctggagaagatgaagctgaaggacagcctgttcgacctggacggccccaaggtggccagccccctgagccccaccagcctgacccacaccagcagaccccccgccgccctgacccccgtgcccctgagccagggcgacctgagccacccccccagaaagaaggacagaaagaacagaaagctgggccccggcgccggcgccggcttcggcgtgctgagaagacccagacccacccccggcgacggcgagaagagaagcagaatcaagaagagcaagaagagaaagctgaagaaggccgagagaggcgacagactgcccccccccggccccccccaggccccccccagcgacaccgacagcgaggaggaggaggaggaggaggaggaggaggaggaggaggagatggccaccgtggtgggcggcgaggcccccgtgcccgtgctgcccaccccccccgaggcccccagaccccccgccaccgtgcaccccgagggcgtgccccccgccgacagcgagagcaaggaggtgggcagcaccgagaccagccaggacggcgacgccagcagcagcgagggcgagatgagagtgatggacgaggacatcatggtggagagcggcgacgacagctgggacctgatcacctgctactgcagaaagcccttcgccggcagacccatgatcgagtgcagcctgtgcggcacctggatccacctgagctgcgccaagatcaagaagaccaacgtgcccgacttcttctactgccagaagtgcaaggagctgagacccgaggccagaagactgggcggcccccccaagagcggcgagccctag

SEQ ID NO: 92921 - DNA, 6120 bp, Artificial Sequence
  Description of Artificial Sequence: Synthetic coding sequence
atggacatcgtggacaccttcaaccacctgatccccaccgagcacctggacgacgccctgttcctgggcagcaacctggagaacgaggtgtgcgaggacttcagcgccagccagaacgtgctggaggacagcctgaagaacatgctgagcgacaaggaccccatgctgggcagcgccagcaaccagttctgcctgcccgtgctggacagcaacgaccccaacttccagatgccctgcagcaccgtggtgggcctggacgacatcatggacgagggcgtggtgaaggagagcggcaacgacaccatcgacgaggaggagctgatcctgcccaacagaaacctgagagacaaggtggaggagaacagcgtgagaagccccagaaagagccccagactgatggcccaggagcaggtgagaagcctgagacagagcaccatcgccaagagaagcaacgccgcccccctgagcaacaccaagaaggccagcggcaagaccgtgagcaccgccaaggccggcgtgaagcagcccgagagaagccaggtgaaggaggaggtgtgcatgagcctgaagcccgagtaccacaaggagaacagaagatgcagcagaaacagcggccagatcgaggtggtgcccgaggtgagcgtgagcagcagccacagcagcgtgagcagctgcctggagatgaaggacgaggacggcctggacagcaagcacaagtgcaacaaccccggcgagatcgacgtgcccagccacgagctgaactgcagcctgctgagcgagacctgcgtgaccatcggcgagaagaagaacgaggccctgatggagtgcaaggccaagcccgtgggcagccccctgttcaagttcagcgacaaggaggagcacgagcagaacgacagcatcagcggcaagaccggcgagaccgtggtggaggagatgatcgccaccagaaaggtggagcaggacagcaaggagaccgtgaagctgagccacgaggacgaccacatcctggaggacgccggcagcagcgacatcagcagcgacgccgcctgcaccaaccccaacaagaccgagaacagcctggtgggcctgcccagctgcgtggacgaggtgaccgagtgcaacctggagctgaaggacaccatgggcatcgccgacaagaccgagaacaccctggagagaaacaagatcgagcccctgggctactgcgaggacgccgagagcaacagacagctggagagcaccgagttcaacaagagcaacctggaggtggtggacaccagcaccttcggccccgagagcaacatcctggagaacgccatctgcgacgtgcccgaccagaacagcaagcagctgaacgccatcgagagcaccaagatcgagagccacgagaccgccaacctgcaggacgacagaaacagccagagcagcagcgtgagctacctggagagcaagagcgtgaagagcaagcacaccaagcccgtgatccacagcaagcagaacatgaccaccgacgcccccaagaagatcgtggccgccaagtacgaggtgatccacagcaagaccaaggtgaacgtgaagagcgtgaagagaaacaccgacgtgcccgagagccagcagaacttccacagacccgtgaaggtgagaaagaagcagatcgacaaggagcccaagatccagagctgcaacagcggcgtgaagagcgtgaagaaccaggcccacagcgtgctgaagaagaccctgcaggaccagaccctggtgcagatcttcaagcccctgacccacagcctgagcgacaagagccacgcccaccccggctgcctgaaggagccccaccaccccgcccagaccggccacgtgagccacagcagccagaagcagtgccacaagccccagcagcaggcccccgccatgaagaccaacagccacgtgaaggaggagctggagcaccccggcgtggagcacttcaaggaggaggacaagctgaagctgaagaagcccgagaagaacctgcagcccagacagagaagaagcagcaagagcttcagcctggacgagccccccctgttcatccccgacaacatcgccaccatcagaagagagggcagcgaccacagcagcagcttcgagagcaagtacatgtggacccccagcaagcagtgcggcttctgcaagaagccccacggcaacagattcatggtgggctgcggcagatgcgacgactggttccacggcgactgcgtgggcctgagcctgagccaggcccagcagatgggcgaggaggacaaggagtacgtgtgcgtgaagtgctgcgccgaggaggacaagaagaccgagatcctggaccccgacaccctggagaaccaggccaccgtggagttccacagcggcgacaagaccatggagtgcgagaagctgggcctgagcaagcacaccaccaacgacagaaccaagtacatcgacgacaccgtgaagcacaaggtgaagatcctgaagagagagagcggcgagggcagaaacagcagcgactgcagagacaacgagatcaagaagtggcagctggcccccctgagaaagatgggccagcccgtgctgcccagaagaagcagcgaggagaagagcgagaagatccccaaggagagcaccaccgtgacctgcaccggcgagaaggccagcaagcccggcacccacgagaagcaggagatgaagaagaagaaggtggagaagggcgtgctgaacgtgcaccccgccgccagcgccagcaagcccagcgccgaccagatcagacagagcgtgagacacagcctgaaggacatcctgatgaagagactgaccgacagcaacctgaaggtgcccgaggagaaggccgccaaggtggccaccaagatcgagaaggagctgttcagcttcttcagagacaccgacgccaagtacaagaacaagtacagaagcctgatgttcaacctgaaggaccccaagaacaacatcctgttcaagaaggtgctgaagggcgaggtgacccccgaccacctgatcagaatgagccccgaggagctggccagcaaggagctggccgcctggagaagaagagagaacagacacaccatcgagatgatcgagaaggagcagagagaggtggagagaagacccatcaccaagatcacccacaagggcgagatcgagatcgagagcgacgcccccatgaaggagcaggaggccgccatggagatccaggagcccgccgccaacaagagcctggagaagcccgagggcagcgagaagcagaaggaggaggtggacagcatgagcaaggacaccaccagccagcacagacagcacctgttcgacctgaactgcaagatctgcatcggcagaatggccccccccgtggacgacctgagccccaagaaggtgaaggtggtggtgggcgtggccagaaagcacagcgacaacgaggccgagagcatcgccgacgccctgagcagcaccagcaacatcctggccagcgagttcttcgaggaggagaagcaggagagccccaagagcaccttcagccccgcccccagacccgagatgcccggcaccgtggaggtggagagcaccttcctggccagactgaacttcatctggaagggcttcatcaacatgcccagcgtggccaagttcgtgaccaaggcctaccccgtgagcggcagccccgagtacctgaccgaggacctgcccgacagcatccaggtgggcggcagaatcagcccccagaccgtgtgggactacgtggagaagatcaaggccagcggcaccaaggagatctgcgtggtgagattcacccccgtgaccgaggaggaccagatcagctacaccctgctgttcgcctacttcagcagcagaaagagatacggcgtggccgccaacaacatgaagcaggtgaaggacatgtacctgatccccctgggcgccaccgacaagatcccccaccccctggtgcccttcgacggccccggcctggagctgcacagacccaacctgctgctgggcctgatcatcagacagaagctgaagagacagcacagcgcctgcgccagcaccagccacatcgccgagacccccgagagcgccccccccatcgccctgccccccgacaagaagagcaagatcgaggtgagcaccgaggaggcccccgaggaggagaacgacttcttcaacagcttcaccaccgtgctgcacaagcagagaaacaagccccagcagaacctgcaggaggacctgcccaccgccgtggagcccctgatggaggtgaccaagcaggagccccccaagcccctgagattcctgcccggcgtgctgatcggctgggagaaccagcccaccaccctggagctggccaacaagcccctgcccgtggacgacatcctgcagagcctgctgggcaccaccggccaggtgtacgaccaggcccagagcgtgatggagcagaacaccgtgaaggagatccccttcctgaacgagcagaccaacagcaagatcgagaagaccgacaacgtggaggtgaccgacggcgagaacaaggagatcaaggtgaaggtggacaacatcagcgagagcaccgacaagagcgccgagatcgagaccagcgtggtgggcagcagcagcatcagcgccggcagcctgaccagcctgagcctgagaggcaagccccccgacgtgagcaccgaggccttcctgaccaacctgagcatccagagcaagcaggaggagaccgtggagagcaaggagaagaccctgaagagacagctgcaggaggaccaggagaacaacctgcaggacaaccagaccagcaacagcagcccctgcagaagcaacgtgggcaagggcaacatcgacggcaacgtgagctgcagcgagaacctggtggccaacaccgccagaagcccccagttcatcaacctgaagagagaccccagacaggccgccggcagaagccagcccgtgaccaccagcgagagcaaggacggcgacagctgcagaaacggcgagaagcacatgctgcccggcctgagccacaacaaggagcacctgaccgagcagatcaacgtggaggagaagctgtgcagcgccgagaagaacagctgcgtgcagcagagcgacaacctgaaggtggcccagaacagccccagcgtggagaacatccagaccagccaggccgagcaggccaagcccctgcaggaggacatcctgatgcagaacatcgagaccgtgcaccccttcagaagaggcagcgccgtggccaccagccacttcgaggtgggcaacacctgccccagcgagttccccagcaagagcatcaccttcaccagcagaagcaccagccccagaaccagcaccaacttcagccccatgagaccccagcagcccaacctgcagcacctgaagagcagcccccccggcttccccttccccggcccccccaacttccccccccagagcatgttcggcttccccccccacctgcccccccccctgctgcccccccccggcttcggcttcgcccagaaccccatggtgccctggccccccgtggtgcacctgcccggccagccccagagaatgatgggccccctgagccaggccagcagatacatcggcccccagaacttctaccaggtgaaggacatcagaagacccgagagaagacacagcgacccctggggcagacaggaccagcagcagctggacagacccttcaacagaggcaagggcgacagacagagattctacagcgacagccaccacctgaagagagagagacacgagaaggagtgggagcaggagagcgagagacacagaagaagagacagaagccaggacaaggacagagacagaaagagcagagaggagggccacaaggacaaggagagagccagactgagccacggcgacagaggcaccgacggcaaggccagcagagacagcagaaacgtggacaagaagcccgacaagcccaagagcgaggactacgagaaggacaaggagagagagaagagcaagcacagagagggcgagaaggacagagacagataccacaaggacagagaccacaccgacagaaccaagagcaagagatag

SEQ ID NO: 92922 - DNA, 6120 bp, Artificial Sequence; identical to SEQ ID NO: 92921
  Description of Artificial Sequence: Synthetic coding sequence

SEQ ID NO: 92923 - DNA, 1098 bp, Artificial Sequence
  Description of Artificial Sequence: Synthetic coding sequence
atgagcagcagcgtggagcagaagaagggccccaccagacagagaaagtgcggcttctgcaagagcaacagagacaaggagtgcggccagctgctgatcagcgagaaccagaaggtggccgcccaccacaagtgcatgctgttcagcagcgccctggtgagcagccacagcgacaacgagagcctgggcggcttcagcatcgaggacgtgcagaaggagatcaagagaggcaccaagctgatgtgcagcctgtgccactgccccggcgccaccatcggctgcgacgtgaagacctgccacagaacctaccactaccactgcgccctgcacgacaaggcccagatcagagagaagcccagccagggcatctacatggtgtactgcagaaagcacaagaagaccgcccacaacagcgaggccgacctggaggagagcttcaacgagcacgagctggagcccagcagccccaagagcaagaagaagagcagaaagggcagacccagaaagaccaacttcaagggcctgagcgaggacaccagaagcaccagcagccacggcaccgacgagatggagagcagcagctacagagacagaagcccccacagaagcagccccagcgacaccagacccaagtgcggcttctgccacgtgggcgaggaggagaacgaggccagaggcaagctgcacatcttcaacgccaagaaggccgccgcccactacaagtgcatgctgttcagcagcggcaccgtgcagctgaccaccaccagcagagccgagttcggcgacttcgacatcaagaccgtgctgcaggagatcaagagaggcaagagaatgaagtgcaccctgtgcagccagcccggcgccaccatcggctgcgagatcaaggcctgcgtgaagacctaccactaccactgcggcgtgcaggacaaggccaagtacatcgagaacatgagcagaggcatctacaagctgtactgcaagaaccacagcggcaacgacgagagagacgaggaggacgaggagagagagagcaagagcagaggcaaggtggagatcgaccagcagcagctgacccagcagcagctgaacggcaactag

SEQ ID NO: 92924 - DNA, 975 bp, Artificial Sequence
  Description of Artificial Sequence: Synthetic coding sequence
atgagcagcagcgtggagcagaagaagggccccaccagacagagaaagtgcggcttctgcaagagcaacagagacaaggagtgcggccagctgctgatcagcgagaaccagaaggtggccgcccaccacaagtgcatgctgttcagcagcgccctggtgagcagccacagcgacaacgagagcctgggcggcttcagcatcgaggacgtgcagaaggagatcaagagaggcaccaagctgatgtgcagcctgtgccactgccccggcgccaccatcggctgcgacgtgaagacctgccacagaacctaccactaccactgcgccctgcacgacaaggcccagatcagagagaagcccagccagggcatctacatggtgtactgcagaaagcacaagaagaccgcccacaacagcgaggccgccgacctggaggagagcttcaacgagcacgagctggagcccagcagccccaagagcaagaagaagagcagaaagggcagacccagaaagaccaacttcaagggcctgagcgaggacaccagaagcaccagcagccacggcaccgacgagatggagagcagcagctacagagacagaagcccccacagaagcagccccagcgacaccagacccaagtgcggcttctgccacgtgggcgaggaggagaacgaggccagaggcaagctgcacatcttcaacgccaagaaggccgccgcccactacaagtgcatgctgttcagcagcggcaccgtgcagctgaccaccaccagcagagccgagttcggcgacttcgacatcaagaccgtgctgcaggagatcaagagaggcaagagaatgaagtgcaccctgtgcagccagcccggcgccaccatcggctgcgagatcaaggcctgcgtgaagacctaccactaccactgcggcgtgcaggacaaggccaagtacatcgagaacatgagcagaggcatctacaagtag

SEQ ID NO: 92925 - DNA, 939 bp, Artificial Sequence
  Description of Artificial Sequence: Synthetic coding sequence
atgagcagcagcgtggagcagaagaagggccccaccagacagagaaagtgcggcttctgcaagagcaacagagacaaggagtgcggccagctgctgatcagcgagaaccagaaggtggccgcccaccacaagtgcatgctgttcagcagcgccctggtgagcagccacagcgacaacgagagcctgggcggcttcagcatcgaggacgtgcagaaggagatcaagagaggcaccaagctgatgtgcagcctgtgccactgccccggcgccaccatcggctgcgacgtgaagacctgccacagaacctaccactaccactgcgccctgcacgacaaggcccagatcagagagaagcccagccagggcatctacatggtgtactgcagaaagcacaagaagaccgcccacaacagcgaggccgccgacctggaggagagcttcaacgagcacgagctggagcccagcagccccaagagcaagaagaagagcagaaagggcagacccagaaagaccaacttcaagggcctgagcgaggacaccagaagcaccagcagccacggcaccgacgagatggagagcagcagctacagagacagaagcccccacagaagcagccccagcgacaccagacccaagtgcggcttctgccacgtgggcgaggaggagaacgaggccagaggcaagctgcacatcttcaacgccaagaaggccgccgcccactacaagtgcatgctgttcagcagcggcaccgtgcagctgaccaccaccagcagagccgagttcggcgacttcgacatcaagaccgtgctgcaggagatcaagagaggcaagagaatggtgtgcagcttctacatctgctacgccaccctgcacctgatctgctgcttcaagttcagagtgcaccccaagttcatccagagcagcgagaacctgaagtag

SEQ ID NO: 92926 - DNA, 1098 bp, Artificial Sequence; identical to SEQ ID NO: 92923
  Description of Artificial Sequence: Synthetic coding sequence

SEQ ID NO: 92927 - DNA, 1101 bp, Artificial Sequence
  Description of Artificial Sequence: Synthetic coding sequence
atgagcagcagcgtggagcagaagaagggccccaccagacagagaaagtgcggcttctgcaagagcaacagagacaaggagtgcggccagctgctgatcagcgagaaccagaaggtggccgcccaccacaagtgcatgctgttcagcagcgccctggtgagcagccacagcgacaacgagagcctgggcggcttcagcatcgaggacgtgcagaaggagatcaagagaggcaccaagctgatgtgcagcctgtgccactgccccggcgccaccatcggctgcgacgtgaagacctgccacagaacctaccactaccactgcgccctgcacgacaaggcccagatcagagagaagcccagccagggcatctacatggtgtactgcagaaagcacaagaagaccgcccacaacagcgaggccgccgacctggaggagagcttcaacgagcacgagctggagcccagcagccccaagagcaagaagaagagcagaaagggcagacccagaaagaccaacttcaagggcctgagcgaggacaccagaagcaccagcagccacggcaccgacgagatggagagcagcagctacagagacagaagcccccacagaagcagccccagcgacaccagacccaagtgcggcttctgccacgtgggcgaggaggagaacgaggccagaggcaagctgcacatcttcaacgccaagaaggccgccgcccactacaagtgcatgctgttcagcagcggcaccgtgcagctgaccaccaccagcagagccgagttcggcgacttcgacatcaagaccgtgctgcaggagatcaagagaggcaagagaatgaagtgcaccctgtgcagccagcccggcgccaccatcggctgcgagatcaaggcctgcgtgaagacctaccactaccactgcggcgtgcaggacaaggccaagtacatcgagaacatgagcagaggcatctacaagctgtactgcaagaaccacagcggcaacgacgagagagacgaggaggacgaggagagagagagcaagagcagaggcaaggtggagatcgaccagcagcagctgacccagcagcagctgaacggcaactag

SEQ ID NO: 92928 - DNA, 996 bp, Artificial Sequence
  Description of Artificial Sequence: Synthetic coding sequence
atgagcagcagcgtggagcagaagaagggccccaccagacagagaaagtgcggcttctgcaagagcaacagagacaaggagtgcggccagctgctgatcagcgagaaccagaaggtggccgcccaccacaagtgcatgatgtgcagcctgtgccactgccccggcgccaccatcggctgcgacgtgaagacctgccacagaacctaccactaccactgcgccctgcacgacaaggcccagatcagagagaagcccagccagggcatctacatggtgtactgcagaaagcacaagaagaccgcccacaacagcgaggccgacctggaggagagcttcaacgagcacgagctggagcccagcagccccaagagcaagaagaagagcagaaagggcagacccagaaagaccaacttcaagggcctgagcgaggacaccagaagcaccagcagccacggcaccgacgagatggagagcagcagctacagagacagaagcccccacagaagcagccccagcgacaccagacccaagtgcggcttctgccacgtgggcgaggaggagaacgaggccagaggcaagctgcacatcttcaacgccaagaaggccgccgcccactacaagtgcatgctgttcagcagcggcaccgtgcagctgaccaccaccagcagagccgagttcggcgacttcgacatcaagaccgtgctgcaggagatcaagagaggcaagagaatgaagtgcaccctgtgcagccagcccggcgccaccatcggctgcgagatcaaggcctgcgtgaagacctaccactaccactgcggcgtgcaggacaaggccaagtacatcgagaacatgagcagaggcatctacaagctgtactgcaagaaccacagcggcaacgacgagagagacgaggaggacgaggagagagagagcaagagcagaggcaaggtggagatcgaccagcagcagctgacccagcagcagctgaacggcaactag

SEQ ID NO: 92929 - DNA, 3075 bp, Artificial Sequence
  Description of Artificial Sequence: Synthetic coding sequence
atggccagcgtgcccgtgtactgcctgtgcagactgccctacgacgtgaccagattcatgatcgagtgcgacatgtgccaggactggttccacggcagctgcgtgggcgtggaggaggagaaggccgccgacatcgacctgtaccactgccccaactgcgaggtgctgcacggccccagcatcatgaagaagagaagaggcagcagcaagggccacgacacccacaagggcaagcccgtgaagaccggcagccccaccttcgtgagagagctgagaagcagaaccttcgacagcagcgacgaggtgatcctgaagcccaccggcaaccagctgaccgtggagttcctggaggagaacagcttcagcgtgcccatcctggtgctgaagaaggacggcctgggcatgaccctgcccagccccagcttcaccgtgagagacgtggagcactacgtgggcagcgacaaggagatcgacgtgatcgacgtgaccagacaggccgactgcaagatgaagctgggcgacttcgtgaagtactactacagcggcaagagagagaaggtgctgaacgtgatcagcctggagttcagcgacaccagactgagcaacctggtggagacccccaagatcgtgagaaagctgagctgggtggagaacctgtggcccgaggagtgcgtgttcgagagacccaacgtgcagaagtactgcctgatgagcgtgagagacagctacaccgacttccacatcgacttcggcggcaccagcgtgtggtaccacgtgctgaagggcgagaagatcttctacctgatcagacccaccaacgccaacctgaccctgttcgagtgctggagcagcagcagcaaccagaacgagatgttcttcggcgaccaggtggacaagtgctacaagtgcagcgtgaagcagggccagaccctgttcatccccaccggctggatccacgccgtgctgacccccgtggactgcctggccttcggcggcaacttcctgcacagcctgaacatcgagatgcagctgaaggcctacgagatcgagaagagactgagcaccgccgacctgttcagattccccaacttcgagaccatctgctggtacgtgggcaagcacatcctggacatcttcagaggcctgagagagaacagaagacaccccgccagctacctggtgcacggcggcaaggccctgaacctggccttcagagcctggaccagaaaggaggccctgcccgaccacgaggacgagatccccgagaccgtgagaaccgtgcagctgatcaaggacctggccagagagatcagactggtggaggacatcttccagcagaacgtgggcaagaccagcaacatcttcggcctgcagagaatcttccccgccggcagcatccccctgaccagacccgcccacagcaccagcgtgagcatgagcagactgagcctgcccagcaagaacggcagcaagaagaagggcctgaagcccaaggagctgttcaagaaggccgagagaaagggcaaggagagcagcgccctgggccccgccggccagctgagctacaacctgatggacacctacagccaccaggccctgaagaccggcagcttccagaaggccaagttcaacatcaccggcgcctgcctgaacgacagcgacgacgacagccccgacctggacctggacggcaacgagagccccctggccctgctgatgagcaacggcagcaccaagagagtgaagagcctgagcaagagcagaagaaccaagatcgccaagaaggtggacaaggccagactgatggccgagcaggtgatggaggacgagttcgacctggacagcgacgacgagctgcagatcgacgagagactgggcaaggagaaggccaccctgatcatcagacccaagttccccagaaagctgcccagagccaagccctgcagcgaccccaacagagtgagagagcccggcgaggtggagttcgacatcgaggaggactacaccaccgacgaggacatggtggagggcgtggagggcaagctgggcaacggcagcggcgccggcggcatcctggacctgctgaaggccagcagacaggtgggcggccccgactacgccgccctgaccgaggcccccgccagccccagcacccaggaggccatccagggcatgctgtgcatggccaacctgcagagcagcagcagcagccccgccaccagcagcctgcaggcctggtggaccggcggccaggacagaagcagcggcagcagcagcagcggcctgggcaccgtgagcaacagccccgccagccagagaacccccggcaagagacccatcaagagacccgcctactggagaaccgagagcgaggaggaggaggagaacgccagcctggacgagcaggacagcctgggcgcctgcttcaaggacgccgagtacatctaccccagcctggagagcgacgacgacgaccccgccctgaagagcagacccaagaagaagaagaacagcgacgacgccccctggagccccaaggccagagtgacccccaccctgcccaagcaggacagacccgtgagagagggcaccagagtggccagcatcgagaccggcctggccgccgccgccgccaagctggcccagcaggagctgcagaaggcccagaagaagaagtacatcaagaagaagcccctgctgaaggaggtggagcagcccagaccccaggacagcaacctgagcctgaccgtgcccgcccccaccgtggccgccaccccccagctggtgaccagcagcagccccctgcccccccccgagcccaagcaggaggccctgagcggcagcctggccgaccacgagtacaccgccagacccaacgccttcggcatggcccaggccaacagaagcaccacccccatggcccccggcgtgttcctgacccagagaagacccagcgtgggcagccagagcaaccaggccggccagggcaagagacccaagaagggcctggccaccgccaagcagagactgggcagaatcctgaagatccacagaaacggcaagctgctgctgtag

SEQ ID NO: 92930 - DNA, 2847 bp, Artificial Sequence
  Description of Artificial Sequence: Synthetic coding sequence
atggccagcgtgcccgtgtactgcctgtgcagactgccctacgacgtgaccagattcatgatcgagtgcgacatgtgccaggactggttccacggcagctgcgtgggcgtggaggaggagaaggccgccgacatcgacctgtaccactgccccaactgcgaggtgctgcacggccccagcatcatgaagaagagaagaggcagcagcaagggccacgacacccacaagggcaagcccgtgaagaccggcagccccaccttcgtgagagagctgagaagcagaaccttcgacagcagcgacgaggtgatcctgaagcccaccggcaaccagctgaccgtggagttcctggaggagaacagcttcagcgtgcccatcctggtgctgaagaaggacggcctgggcatgaccctgcccagccccagcttcaccgtgagagacgtggagcactacgtgggcagcgacaaggagatcgacgtgatcgacgtgaccagacaggccgactgcaagatgaagctgggcgacttcgtgaagtactactacagcggcaagagagagaaggtgctgaacgtgatcagcctggagttcagcgacaccagactgagcaacctggtggagacccccaagatcgtgagaaagctgagctgggtggagaacctgtggcccgaggagtgcgtgttcgagagacccaacgtgcagaagtactgcctgatgagcgtgagagacagctacaccgacttccacatcgacttcggcggcaccagcgtgtggtaccacgtgctgaagggcgagaagatcttctacctgatcagacccaccaacgccaacctgaccctgttcgagtgctggagcagcagcagcaaccagaacgagatgttcttcggcgaccaggtggacaagtgctacaagtgcagcgtgaagcagggccagaccctgttcatccccaccggctggatccacgccgtgctgacccccgtggactgcctggccttcggcggcaacttcctgcacagcctgaacatcgagatgcagctgaaggcctacgagatcgagaagagactgagcaccgccgacctgttcagattccccaacttcgagaccatctgctggtacgtgggcaagcacatcctggacatcttcagaggcctgagagagaacagaagacaccccgccagctacctggtgcacggcggcaaggccctgaacctggccttcagagcctggaccagaaaggaggccctgcccgaccacgaggacgagatccccgagaccgtgagaaccgtgcagctgatcaaggacctggccagagagatcagactggtggagttcaacatcaccggcgcctgcctgaacgacagcgacgacgacagccccgacctggacctggacggcaacgagagccccctggccctgctgatgagcaacggcagcaccaagagagtgaagagcctgagcaagagcagaagaaccaagatcgccaagaaggtggacaaggccagactgatggccgagcaggtgatggaggacgagttcgacctggacagcgacgacgagctgcagatcgacgagagactgggcaaggagaaggccaccctgatcatcagacccaagttccccagaaagctgcccagagccaagccctgcagcgaccccaacagagtgagagagcccggcgaggtggagttcgacatcgaggaggactacaccaccgacgaggacatggtggagggcgtggagggcaagctgggcaacggcagcggcgccggcggcatcctggacctgctgaaggccagcagacaggtgggcggccccgactacgccgccctgaccgaggcccccgccagccccagcacccaggaggccatccagggcatgctgtgcatggccaacctgcagagcagcagcagcagccccgccaccagcagcctgcaggcctggtggaccggcggccaggacagaagcagcggcagcagcagcagcggcctgggcaccgtgagcaacagccccgccagccagagaacccccggcaagagacccatcaagagacccgcctactggagaaccgagagcgaggaggaggaggagaacgccagcctggacgagcaggacagcctgggcgcctgcttcaaggacgccgagtacatctaccccagcctggagagcgacgacgacgaccccgccctgaagagcagacccaagaagaagaagaacagcgacgacgccccctggagccccaaggccagagtgacccccaccctgcccaagcaggacagacccgtgagagagggcaccagagtggccagcatcgagaccggcctggccgccgccgccgccaagctggcccagcaggagctgcagaaggcccagaagaagaagtacatcaagaagaagcccctgctgaaggaggtggagcagcccagaccccaggacagcaacctgagcctgaccgtgcccgcccccaccgtggccgccaccccccagctggtgaccagcagcagccccctgcccccccccgagcccaagcaggaggccctgagcggcagcctggccgaccacgagtacaccgccagacccaacgccttcggcatggcccaggccaacagaagcaccacccccatggcccccggcgtgttcctgacccagagaagacccagcgtgggcagccagagcaaccaggccggccagggcaagagacccaagaagggcctggccaccgccaagcagagactgggcagaatcctgaagatccacagaaacggcaagctgctgctgagacaggtgatcgtgcaggccgagtgcagacaggccatccacgagcccaagctgaagagaagagacgcccacccctag

SEQ ID NO: 92931 - DNA, 3183 bp, Artificial Sequence
  Description of Artificial Sequence: Synthetic coding sequence
atgaacagaagcagagccatcgtgcagagaggcagagtgctgcccccccccgcccccctggacaccaccaacctggccggcagaagaaccctgcagggcagagccaagatggccagcgtgcccgtgtactgcctgtgcagactgccctacgacgtgaccagattcatgatcgagtgcgacatgtgccaggactggttccacggcagctgcgtgggcgtggaggaggagaaggccgccgacatcgacctgtaccactgccccaactgcgaggtgctgcacggccccagcatcatgaagaagagaagaggcagcagcaagggccacgacacccacaagggcaagcccgtgaagaccggcagccccaccttcgtgagagagctgagaagcagaaccttcgacagcagcgacgaggtgatcctgaagcccaccggcaaccagctgaccgtggagttcctggaggagaacagcttcagcgtgcccatcctggtgctgaagaaggacggcctgggcatgaccctgcccagccccagcttcaccgtgagagacgtggagcactacgtgggcagcgacaaggagatcgacgtgatcgacgtgaccagacaggccgactgcaagatgaagctgggcgacttcgtgaagtactactacagcggcaagagagagaaggtgctgaacgtgatcagcctggagttcagcgacaccagactgagcaacctggtggagacccccaagatcgtgagaaagctgagctgggtggagaacctgtggcccgaggagtgcgtgttcgagagacccaacgtgcagaagtactgcctgatgagcgtgagagacagctacaccgacttccacatcgacttcggcggcaccagcgtgtggtaccacgtgctgaagggcgagaagatcttctacctgatcagacccaccaacgccaacctgaccctgttcgagtgctggagcagcagcagcaaccagaacgagatgttcttcggcgaccaggtggacaagtgctacaagtgcagcgtgaagcagggccagaccctgttcatccccaccggctggatccacgccgtgctgacccccgtggactgcctggccttcggcggcaacttcctgcacagcctgaacatcgagatgcagctgaaggcctacgagatcgagaagagactgagcaccgccgacctgttcagattccccaacttcgagaccatctgctggtacgtgggcaagcacatcctggacatcttcagaggcctgagagagaacagaagacaccccgccagctacctggtgcacggcggcaaggccctgaacctggccttcagagcctggaccagaaaggaggccctgcccgaccacgaggacgagatccccgagaccgtgagaaccgtgcagctgatcaaggacctggccagagagatcagactggtggaggacatcttccagcagaacgtgggcaagaccagcaacatcttcggcctgcagagaatcttccccgccggcagcatccccctgaccagacccgcccacagcaccagcgtgagcatgagcagactgagcctgcccagcaagaacggcagcaagaagaagggcctgaagcccaaggagctgttcaagaaggccgagagaaagggcaaggagagcagcgccctgggccccgccggccagctgagctacaacctgatggacacctacagccaccaggccctgaagaccggcagcttccagaaggccaagttcaacatcaccggcgcctgcctgaacgacagcgacgacgacagccccgacctggacctggacggcaacgagagccccctggccctgctgatgagcaacggcagcaccaagagagtgaagagcctgagcaagagcagaagaaccaagatcgccaagaaggtggacaaggccagactgatggccgagcaggtgatggaggacgagttcgacctggacagcgacgacgagctgcagatcgacgagagactgggcaaggagaaggccaccctgatcatcagacccaagttccccagaaagctgcccagagccaagccctgcagcgaccccaacagagtgagagagcccggcgaggtggagttcgacatcgaggaggactacaccaccgacgaggacatggtggagggcgtggagggcaagctgggcaacggcagcggcgccggcggcatcctggacctgctgaaggccagcagacaggtgggcggccccgactacgccgccctgaccgaggcccccgccagccccagcacccaggaggccatccagggcatgctgtgcatggccaacctgcagagcagcagcagcagccccgccaccagcagcctgcaggcctggtggaccggcggccaggacagaagcagcggcagcagcagcagcggcctgggcaccgtgagcaacagccccgccagccagagaacccccggcaagagacccatcaagagacccgcctactggagaaccgagagcgaggaggaggaggagaacgccagcctggacgagcaggacagcctgggcgcctgcttcaaggacgccgagtacatctaccccagcctggagagcgacgacgacgaccccgccctgaagagcagacccaagaagaagaagaacagcgacgacgccccctggagccccaaggccagagtgacccccaccctgcccaagcaggacagacccgtgagagagggcaccagagtggccagcatcgagaccggcctggccgccgccgccgccaagctggcccagcaggagctgcagaaggcccagaagaagaagtacatcaagaagaagcccctgctgaaggaggtggagcagcccagaccccaggacagcaacctgagcctgaccgtgcccgcccccaccgtggccgccaccccccagctggtgaccagcagcagccccctgcccccccccgagcccaagcaggaggccctgagcggcagcctggccgaccacgagtacaccgccagacccaacgccttcggcatggcccaggccaacagaagcaccacccccatggcccccggcgtgttcctgacccagagaagacccagcgtgggcagccagagcaaccaggccggccagggcaagagacccaagaagggcctggccaccgccaagcagagactgggcagaatcctgaagatccacagaaacggcaagctgctgctgtag

SEQ ID NO: 92932 - DNA, 912 bp, Artificial Sequence
  Description of Artificial Sequence: Synthetic coding sequence
atggacacctacagccaccaggccctgaagaccggcagcttccagaaggccaagttcaacatcaccggcgcctgcctgaacgacagcgacgacgacagccccgacctggacctggacggcaacgagagccccctggccctgctgatgagcaacggcagcaccaagagagtgaagagcctgagcaagagcagaagaaccaagatcgccaagaaggtggacaaggccagactgatggccgagcaggtgatggaggacgagttcgacctggacagcgacgacgagctgcagatcgacgagagactgggcaaggagaaggccaccctgatcatcagacccaagttccccagaaagctgcccagagccagcctggccctgacccccaccgagttcgtgaaccaggagaagctgagcctgaccctgagaagaaccatccagcagatgagaacctggtggaagggcctgaaggccagcctgggcatggtggtggccctggtggccttcctgatctgcagcagacccgccggcagatggggcgacctgaccatgctgcccagccccagaccccagctgctgcccgccctgagaagacccagcagagcctgctgcgcctggcccacctgcagcccccacagaccccacagactgcccctggcctgcagacccggcggcctgggcgacagaatcgaggccgtgggcgcccccgccgtgggctgggcccagtgcctgaccgtgctgctgcccagcgccccccagggcagcggccccagcagcggccagcacaccggcgagcccagagccagaagaagaagaagaacccccgtgtggatgaacagaaccgcctgggagagagccagcagaatgcagagcatcagcatcctgcactggagcctgatgatgatgaccctgctgtag

SEQ ID NO: 92933 - DNA, 2862 bp, Artificial Sequence
  Description of Artificial Sequence: Synthetic coding sequence
atcgtgcagagaggcagagtgctgcccccccccgcccccctggacaccaccaacctggccggcagaagaaccctgcagggcagagccaagatggccagcgtgcccgtgtactgcctgtgcagactgccctacgacgtgaccagattcatgatcgagtgcgacatgtgccaggactggttccacggcagctgcgtgggcgtggaggaggagaaggccgccgacatcgacctgtaccactgccccaactgcgaggtgctgcacggccccagcatcatgaagaagagaagaggcagcagcaagggccacgacacccacaagggcaagcccgtgaagaccggcagccccaccttcgtgagagagctgagaagcagaaccttcgacagcagcgacgaggtgatcctgaagcccaccggcaaccagctgaccgtggagttcctggaggagaacagcttcagcgtgcccatcctggtgctgaagaaggacggcctgggcatgaccctgcccagccccagcttcaccgtgagagacgtggagcactacgtgggcagcgacaaggagatcgacgtgatcgacgtgaccagacaggccgactgcaagatgaagctgggcgacttcgtgaagtactactacagcggcaagagagagaaggtgctgaacgtgatcagcctggagttcagcgacaccagactgagcaacctggtggagacccccaagatcgtgagaaagctgagctgggtggagaacctgtggcccgaggagtgcgtgttcgagagacccaacgtgcagaagtactgcctgatgagcgtgagagacagctacaccgacttccacatcgacttcggcggcaccagcgtgtggtaccacgtgctgaagggcgagaagatcttctacctgatcagacccaccaacgccaacctgaccctgttcgagtgctggagcagcagcagcaaccagaacgagatgttcttcggcgaccaggtggacaagtgctacaagtgcagcgtgaagcagggccagaccctgttcatccccaccggctggatccacgccgtgctgacccccgtggactgcctggccttcggcggcaacttcctgcacagcctgaacatcgagatgcagctgaaggcctacgagatcgagaagagactgagcaccgccgacctgttcagattccccaacttcgagaccatctgctggtacgtgggcaagcacatcctggacatcttcagaggcctgagagagaacagaagacaccccgccagctacctggtgcacggcggcaaggccctgaacctggccttcagagcctggaccagaaaggaggccctgcccgaccacgaggacgagatccccgagaccgtgagaaccgtgcagctgatcaaggacctggccagagagatcagactggtggagttcaacatcaccggcgcctgcctgaacgacagcgacgacgacagccccgacctggacctggacggcaacgagagccccctggccctgctgatgagcaacggcagcaccaagagagtgaagagcctgagcaagagcagaagaaccaagatcgccaagaaggtggacaaggccagactgatggccgagcaggtgatggaggacgagttcgacctggacagcgacgacgagctgcagatcgacgagagactgggcaaggagaaggccaccctgatcatcagacccaagttccccagaaagctgcccagagccaagccctgcagcgaccccaacagagtgagagagcccggcgaggtggagttcgacatcgaggaggactacaccaccgacgaggacatggtggagggcgtggagggcaagctgggcaacggcagcggcgccggcggcatcctggacctgctgaaggccagcagacaggtgggcggccccgactacgccgccctgaccgaggcccccgccagccccagcacccaggaggccatccagggcatgctgtgcatggccaacctgcagagcagcagcagcagccccgccaccagcagcctgcaggcctggtggaccggcggccaggacagaagcagcggcagcagcagcagcggcctgggcaccgtgagcaacagccccgccagccagagaacccccggcaagagacccatcaagagacccgcctactggagaaccgagagcgaggaggaggaggagaacgccagcctggacgagcaggacagcctgggcgcctgcttcaaggacgccgagtacatctaccccagcctggagagcgacgacgacgaccccgccctgaagagcagacccaagaagaagaagaacagcgacgacgccccctggagccccaaggccagagtgacccccaccctgcccaagcaggacagacccgtgagagagggcaccagagtggccagcatcgagaccggcctggccgccgccgccgccaagctggcccagcaggagctgcagaaggcccagaagaagaagtacatcaagaagaagcccctgctgaaggaggtggagcagcccagaccccaggacagcaacctgagcctgaccgtgcccgcccccaccgtggccgccaccccccagctggtgaccagcagcagccccctgcccccccccgagcccaagcaggaggccctgagcggcagcctggccgaccacgagtacaccgccagacccaacgccttcggcatggcccaggccaacagaagcaccacccccatggcccccggcgtgttcctgacccagagaagacccagcgtgggcagccagagcaaccaggccggccagggcaagagacccaagaagggcctggccaccgccaagcagagactgggcagaatcctgaagatccacagaaacggcaagctgctgctgtag

SEQ ID NO: 92934 - DNA, 345 bp, Artificial Sequence
  Description of Artificial Sequence: Synthetic coding sequence
atggccagcgtgcccgtgtactgcctgtgcagactgccctacgacgtgaccagattcatgatcgagtgcgacatgtgccaggactggttccacggcagctgcgtgggcgtggaggaggagaaggccgccgacatcgacctgtaccactgccccaactgcgaggtgctgcacggccccagcatcatgaagaagagaagaggcagcagcaagggccacgacacccacaagggcaagcccgtgaagaccggcagccccaccttcgtgagagagctgagaagcagaaccttcgacagcagcgacgaggtgatcctgaagcccaccggcaaccagctgaccgtggagtag

SEQ ID NO: 92935 - DNA, 381 bp, Artificial Sequence
  Description of Artificial Sequence: Synthetic coding sequence
atggccagcgtgcccgtgtactgcctgtgcagactgccctacgacgtgaccagattcatgatcgagtgcgacatgtgccaggactggttccacggcagctgcgtgggcgtggaggaggagaaggccgccgacatcgacctgtaccactgccccaactgcgaggtgctgcacggccccagcatcatgaagaagagaagaggcagcagcaagggccacgacacccacaagggcaagcccgtgaagaccggcagccccaccttcgtgagagagctgagaagcagaaccttcgacagcagcgacgaggtgatcctgaagcccaccggcaaccagctgaccgtggagttcctggaggagaacagcttcagcgtgcccatcctgtag

SEQ ID NO: 92936 - DNA, 294 bp, Artificial Sequence
  Description of Artificial Sequence: Synthetic coding sequence
atggccagcgtgcccgtgtactgcctgtgcagactgccctacgacgtgaccagattcatgatcgagtgcgacatgtgccaggactggttccacggcagctgcgtgggcgtggaggaggagaaggccgccgacatcgacctgtaccactgccccaactgcgaggtgctgcacggccccagcatcatgaagaagagaagaggcagcagcaagggccacgacacccacaagggcaagcccgtgaagaccggcagccccaccttcgtgagagagctgagaagcagaaccttcgactag

SEQ ID NO: 92937 - DNA, 348 bp, Artificial Sequence
  Description of Artificial Sequence: Synthetic coding sequence
atggccagcgtgcccgtgtactgcctgtgcagactgccctacgacgtgaccagattcatgatcgagtgcgacatgtgccaggactggttccacggcagctgcgtgggcgtggaggaggagaaggccgccgacatcgacctgtaccactgccccaactgcgaggtgctgcacggccccagcatcatgaagaagagaagaggcagcagcaagggccacgacacccacaagggcaagcccgtgaagaccggcagccccaccttcgtgagagagctgagaagcagaaccttcgacagcagcgacgaggtgatcctgaagcccaccggcaaccagctgaccgtggagttctag

SEQ ID NO: 92938 - DNA, 294 bp, Artificial Sequence; identical to SEQ ID NO: 92936
  Description of Artificial Sequence: Synthetic coding sequence

SEQ ID NO: 92939 - DNA, 447 bp, Artificial Sequence
  Description of Artificial Sequence: Synthetic coding sequence
atgaacagaagcagagccatcgtgcagagaggcagagtgctgcccccccccgcccccctggacaccaccaacctggccggcagaagaaccctgcagggcagagccaagatggccagcgtgcccgtgtactgcctgtgcagactgccctacgacgtgaccagattcatgatcgagtgcgacatgtgccaggactggttccacggcagctgcgtgggcgtggaggaggagaaggccgccgacatcgacctgtaccactgccccaactgcgaggtgctgcacggccccagcatcatgaagaagagaagaggcagcagcaagggccacgacacccacaagggcaagcccgtgaagaccggcagccccaccttcgtgagagagctgagaagcagaaccttcgacagcagcgacgaggtgatcctgaagcccaccggcaaccagctgacctag

SEQ ID NO: 92940 - DNA, 2637 bp, Artificial Sequence
  Description of Artificial Sequence: Synthetic coding sequence
atggccagcgtgcccgtgtactgcctgtgcagactgccctacgacgtgaccagattcatgatcgagtgcgacatgtgccaggactggttccacggcagctgcgtgggcgtggaggaggagaaggccgccgacatcgacctgtaccactgccccaactgcgaggtgctgcacggccccagcatcatgaagaagagaagaggcagcagcaagggccacgacacccacaagggcaagcccgtgaagaccggcagccccaccttcgtgagagagctgagaagcagaaccttcgacagcagcgacgaggtgatcctgaagcccaccggcaaccagctgaccgtggagttcctggaggagaacagcttcagcgtgcccatcctggtgctgaagaaggacggcctgggcatgaccctgcccagccccagcttcaccgtgagagacgtggagcactacgtgggcagcgacaaggagatcgacgtgatcgacgtgaccagacaggccgactgcaagatgaagctgggcgacttcgtgaagtactactacagcggcaagagagagaaggtgctgaacgtgatcagcctggagttcagcgacaccagactgagcaacctggtggagacccccaagatcgtgagaaagctgagctgggtggagaacctgtggcccgaggagtgcgtgttcgagagacccaacgtgcagaagtactgcctgatgagcgtgagagacagctacaccgacttccacatcgacttcggcggcaccagcgtgtggtaccacgtgctgaagggcgagaagatcttctacctgatcagacccaccaacgccaacctgaccctgttcgagtgctggagcagcagcagcaaccagaacgagatgttcttcggcgaccaggtggacaagtgctacaagtgcagcgtgaagcagggccagaccctgttcatccccaccggctggatccacgccgtgctgacccccgtggactgcctggccttcggcggcaacttcctgcacagcctgaacatcgagatgcagctgaaggcctacgagatcgagaagagactgagcaccgccgacctgttcagattccccaacttcgagaccatctgctggtacgtgggcaagcacatcctggacatcttcagaggcctgagagagaacagaagacaccccgccagctacctggtgcacggcggcaaggccctgaacctggccttcagagcctggaccagaaaggaggccctgcccgaccacgaggacgagatccccgagaccgtgagaaccgtgcagctgatcaaggacctggccagagagatcagactggtggaggacatcttccagcagaacgtgggcaagaccagcaacatcttcggcctgcagagaatcttccccgccggcagcatccccctgaccagacccgcccacagcaccagcgtgagcatgagcagactgagcctgcccagcaagaacggcagcaagaagaagggcctgaagcccaaggagctgttcaagaaggccgagagaaagggcaaggagagcagcgccctgggccccgccggccagctgagctacaacctgatggacacctacagccaccaggccctgaagaccggcagcttccagaaggccaagttcaacatcaccggcgcctgcctgaacgacagcgacgacgacagccccgacctggacctggacggcaacgagagccccctggccctgctgatgagcaacggcagcaccaagagagtgaagagcctgagcaagagcagaagaaccaagatcgccaagaaggtggacaaggccagactgatggccgagcaggtgatggaggacgagttcgacctggacagcgacgacgagctgcagatcgacgagagactgggcaaggagaaggccaccctgatcatcagacccaagttccccagaaagctgcccagagccaagccctgcagcgaccccaacagagtgagagagcccggcgaggtggagttcgacatcgaggaggactacaccaccgacgaggacatggtggagggcgtggagggctaccagaccgccacccccgcccccgcccagggcgccagcgaggcccccgccagccccagcacccaggaggccatccagggcatgctgtgcatggccaacctgcagagcagcagcagcagccccgccaccagcagcctgcaggcctggtggaccggcggccaggacagaagcagcggcagcagcagcagcggcctgggcaccgtgagcaacagccccgccagccagagaacccccggcaagagacccatcaagagacccgcctactggagaaccgagagcgaggaggaggaggagaacgccagcctggacgagcaggacagcctgggcgcctgcttcaaggacgccgagtacatctaccccagcctggagagcgacgacgacgaccccgccctgaagagcagacccaagaagaagaagaacagcgacgacgccccctggagccccaaggccagagtgacccccaccctgcccaagcaggacagacccgtgagagagggcaccagagtggccagcatcgagaccggcctggccgccgccgccgccaagctggcccagcaggtgaagaagatgaagctgagcctgaccgacagcggctag

SEQ ID NO: 92941 - DNA, 417 bp, Artificial Sequence
  Description of Artificial Sequence: Synthetic coding sequence
atgaagctgcccatcttcatcgccgacgccttcaccgccagagccttcagaggcaaccccgccgccgtgtgcctgctggagaacgagctggacgaggacatgcaccagaagatcgccagagagatgaacctgagcgagaccgccttcatcagaaagctgcaccccaccgacaacttcgcccagaagaacatgaacagcaccctgaccttcgtgaccctgagcggcgagctgagagccagaagagccgaggacggcatcgtgctggacctgcccctgtaccccgcccacccccaggacttccacgaggtggaggacctgatcaagaccgccatcggcaacaccctggtgcaggacatctgctacagccccgacacccagaagctgctggtgagactgagcgacgtgtacaacagatag

SEQ ID NO: 92942 - DNA, 867 bp, Artificial Sequence
  Description of Artificial Sequence: Synthetic coding sequence
atgaagctgcccatcttcatcgccgacgccttcaccgccagagccttcagaggcaaccccgccgccgtgtgcctgctggagaacgagctggacgaggacatgcaccagaagatcgccagagagatgaacctgagcgagaccgccttcatcagaaagctgcaccccaccgacaacttcgcccagagcagctgcttcggcctgagatggttcacccccgccagcgaggtgcccctgtgcggccacgccaccctggccagcgccgccgtgctgttccacaagatcaagaacatgaacagcaccctgaccttcgtgaccctgagcggcgagctgagagccagaagagccgaggacggcatcgtgctggacctgcccctgtaccccgcccacccccaggacttccacgaggtggaggacctgatcaagaccgccatcggcaacaccctggtgcaggacatctgctacagccccgacacccagaagctgctggtgagactgagcgacgtgtacaacagaagcttcctggagaacctgaaggtgaacaccgagaacctgctgcaggtggagaacaccggcaaggtgaagggcctgatcctgaccctgaagggcgagcccggcggccagacccaggccttcgacttctacagcagatacttcgccccctgggtgggcgtggccgaggaccccgtgaccggcagcgcccacgccgtgctgagcagctactggagccagcacctgggcaagaaggagatgcacgccttccagtgcagccacagaggcggcgagctgggcatcagcctgagacccgacggcagagtggacatcagaggcggcgccgccgtggtgctggagggcaccctgaccgcctag

SEQ ID NO: 92943 - DNA, 768 bp, Artificial Sequence
  Description of Artificial Sequence: Synthetic coding sequence
atgcaccagaagatcgccagagagatgaacctgagcgagaccgccttcatcagaaagctgcaccccaccgacaacttcgcccagagcagctgcttcggcctgagatggttcacccccgccagcgaggtgcccctgtgcggccacgccaccctggccagcgccgccgtgctgttccacaagatcaagaacatgaacagcaccctgaccttcgtgaccctgagcggcgagctgagagccagaagagccgaggacggcatcgtgctggacctgcccctgtaccccgcccacccccaggacttccacgaggtggaggacctgatcaagaccgccatcggcaacaccctggtgcaggacatctgctacagccccgacacccagaagctgctggtgagactgagcgacgtgtacaacagaagcttcctggagaacctgaaggtgaacaccgagaacctgctgcaggtggagaacaccggcaaggtgaagggcctgatcctgaccctgaagggcgagcccggcggccagacccaggccttcgacttctacagcagatacttcgccccctgggtgggcgtggccgaggaccccgtgaccggcagcgcccacgccgtgctgagcagctactggagccagcacctgggcaagaaggagatgcacgccttccagtgcagccacagaggcggcgagctgggcatcagcctgagacccgacggcagagtggacatcagaggcggcgccgccgtggtgctggagggcaccctgaccgcctag

SEQ ID NO: 92944 - DNA, 867 bp, Artificial Sequence; identical to SEQ ID NO: 92942
  Description of Artificial Sequence: Synthetic coding sequence

SEQ ID NO: 92945 - DNA, 843 bp, Artificial Sequence
  Description of Artificial Sequence: Synthetic coding sequence
atgaagctgcccatcttcatcgccgacgccttcaccgccagagccttcagaggcaaccccgccgccgtgtgcctgctggagaacgagctggacgaggacatgcaccagaagatcgccagagagatgaacctgagcgagaccgccttcatcagaaagctgcaccccaccgacaacttcgcccagagcagctgcttcggcctgagatggttcacccccgccagcgaggtgcccctgtgcggccacgccaccctggccagcgccgccgtgctgttccacaagatcaagaacatgaacagcaccctgaccttcgtgaccctgagcggcgagctgagagccagaagagccgaggacggcatcgtgctggacctgcccctgtaccccgcccacccccaggacttccacgaggtggaggacctgatcaagaccgccatcggcaacaccctggtgcaggacatctgctacagccccgacacccagaagctgctggtgagactgagcgacgtgtacaacagaagcttcctggagaacctgaaggtgaacaccgagaacctgctgcaggtggagaacaccggcaaggtgaagggcctgatcctgaccctgaagggcgagcccggcggccagacccaggccttcgacttctacagcagatacttcgccccctgggtgggcgtggccgaggaccccgtgaccggcagcgcccacgccgtgctgagcagctactggagccagcacctgggcaagaaggagatgcacggcagaaccgccctgtaccagttcctgttctacctgcccaacagcaagctggtgttcctgctgatctgcaccatccccctgaagatgtag

SEQ ID NO: 92946 - DNA, 1356 bp, Artificial Sequence
  Description of Artificial Sequence: Synthetic coding sequence
atggtgggcagcgccctgagaagaggcgcccacgcctacgtgtacctggtgagcaaggccagccacatcagcagaggccaccagcaccaggcctggggcagcagaccccccgccgccgagtgcgccacccagagagcccccggcagcgtggtggagctgctgggcaagagctacccccaggacgaccacagcaacctgaccagaaaggtgctgaccagagtgggcagaaacctgcacaaccagcagcaccaccccctgtggctgatcaaggagagagtgaaggagcacttctacaagcagtacgtgggcagattcggcacccccctgttcagcgtgtacgacaacctgagccccgtggtgaccacctggcagaacttcgacagcctgctgatccccgccgaccaccccagcagaaagaagggcgacaactactacctgaacagaacccacatgctgagagcccacaccagcgcccaccagtgggacctgctgcacgccggcctggacgccttcctggtggtgggcgacgtgtacagaagagaccagatcgacagccagcactaccccatcttccaccagctggaggccgtgagactgttcagcaagcacgagctgttcgccggcatcaaggacggcgagagcctgcagctgttcgagcagagcagcagaagcgcccacaagcaggagacccacaccatggaggccgtgaagctggtggagttcgacctgaagcagaccctgaccagactgatggcccacctgttcggcgacgagctggagatcagatgggtggactgctacttccccttcacccaccccagcttcgagatggagatcaacttccacggcgagtggctggaggtgctgggctgcggcgtgatggagcagcagctggtgaacagcgccggcgcccaggacagaatcggctgggccttcggcctgggcctggagagactggccatgatcctgtacgacatccccgacatcagactgttctggtgcgaggacgagagattcctgaagcagttctgcgtgagcaacatcaaccagaaggtgaagttccagcccctgagcaagtaccccgccgtgatcaacgacatcagcttctggctgcccagcgagaactacgccgagaacgacttctacgacctggtgagaaccatcggcggcgacctggtggagaaggtggacctgatcgacaagttcgtgcaccccaagacccacaagaccagccactgctacagaatcacctacagacacatggagagaaccctgagccagagagaggtgagacacatccaccaggccctgcaggaggccgccgtgcagctgctgggcgtggagggcagattctag

SEQ ID NO: 92947 - DNA, 1356 bp, Artificial Sequence; identical to SEQ ID NO: 92946
  Description of Artificial Sequence: Synthetic coding sequence

SEQ ID NO: 92948 - DNA, 468 bp, Artificial Sequence
  Description of Artificial Sequence: Synthetic coding sequence
atgctgagagcccacaccagcgcccaccagtgggacctgctgcacgccggcctggacgccttcctggtggtgggcgacgtgtacagaagagaccagatcgacagccagcactaccccatcttccaccagctggaggccgtgagactgttcagcaagcacgagctgttcgccggcatcaaggacggcgagagcctgcagctgttcgagcagagcagcagaagcgcccacaagcaggagacccacaccatggaggccgtgaagctggtggagttcgacctgaagcagaccctgaccagactgatggcccacctgttcggcgacgagctggagatcagatgggtggactgctacttccccttcacccaccccagcttcgagatggagatcaacttccacggcgagtggctggaggtgctgggctgcggcgtgatggagcagcagctggtgaacagcggcggcgccacctag

SEQ ID NO: 92949 - DNA, 306 bp, Artificial Sequence
  Description of Artificial Sequence: Synthetic coding sequence
ctgttcgccggcatcaaggacggcgagagcctgcagctgttcgagcagagcagcagaagcgcccacaagcaggagacccacaccatggaggccgtgaagctggtggagttcgacctgaagcagaccctgaccagactgatggcccacctgttcggcgacgagctggagatcagatgggtggactgctacttccccttcacccaccccagcttcgagatggagatcaacttccacggcgagtggctggaggtgctgggctgcggcgtgatggagcagcagctggtgaacagcggcggcgccacctag

SEQ ID NO: 92950 - DNA, 849 bp, Artificial Sequence
  Description of Artificial Sequence: Synthetic coding sequence
atgagcggcgccgacagaagccccaacgccggcgccgcccccgacagcgcccccggccaggccgccgtggccagcgcctaccagagattcgagcccagagcctacctgagaaacaactacgccccccccagaggcgacctgtgcaaccccaacggcgtgggcccctggaagctgagatgcctggcccagaccttcgccaccggcgaggtgagcggcagaaccctgatcgacatcggcagcggccccaccgtgtaccagctgctgagcgcctgcagccacttcgaggacatcaccatgaccgacttcctggaggtgaacagacaggagctgggcagatggctgcaggaggagcccggcgccttcaactggagcatgtacagccagcacgcctgcctgatcgagggcaagggcgagtgctggcaggacaaggagagacagctgagagccagagtgaagagagtgctgcccatcgacgtgcaccagccccagcccctgggcgccggcagccccgcccccctgcccgccgacgccctggtgagcgccttctgcctggaggccgtgagccccgacctggccagcttccagagagccctggaccacatcaccaccctgctgagacccggcggccacctgctgctgatcggcgccctggaggagagctggtacctggccggcgaggccagactgaccgtggtgcccgtgagcgaggaggaggtgagagaggccctggtgagaagcggctacaaggtgagagacctgagaacctacatcatgcccgcccacctgcagaccggcgtggacgacgtgaagggcgtgttcttcgcctgggcccagaaggtgggcctgtag

SEQ ID NO: 92951 - DNA, 555 bp, Artificial Sequence
  Description of Artificial Sequence: Synthetic coding sequence
atgaccgacttcctggaggtgaacagacaggagctgggcagatggctgcaggaggagcccggcgccttcaactggagcatgtacagccagcacgcctgcctgatcgagggcaagggcgagtgctggcaggacaaggagagacagctgagagccagagtgaagagagtgctgcccatcgacgtgcaccagccccagcccctgggcgccggcagccccgcccccctgcccgccgacgccctggtgagcgccttctgcctggaggccgtgagccccgacctggccagcttccagagagccctggaccacatcaccaccctgctgagacccggcggccacctgctgctgatcggcgccctggaggagagctggtacctggccggcgaggccagactgaccgtggtgcccgtgagcgaggaggaggtgagagaggccctggtgagaagcggctacaaggtgagagacctgagaacctacatcatgcccgcccacctgcagaccggcgtggacgacgtgaagggcgtgttcttcgcctgggcccagaaggtgggcctgtag

SEQ ID NO: 92952 - DNA, 741 bp, Artificial Sequence
  Description of Artificial Sequence: Synthetic coding sequence
atggaggaggccaagagccagagcctggaggaggacttcgagggccaggccacccacaccggccccaagggcgtgatcaacgactggagaaagttcaagctggagagccaggacagcgacagcatcccccccagcaagaaggagatcctgagacagatgagcagcccccagagcagaaacggcaaggacagcaaggagagagtgagcagaaagatgagcatccaggagtacgagctgatccacaaggagaaggaggacgagaactgcctgagaaagtacagaagacagtgcatgcaggacatgcaccagaagctgagcttcggccccagatacggcttcgtgtacgagctggagaccggcaagcagttcctggagaccatcgagaaggagctgaagatcaccaccatcgtggtgcacatctacgaggacggcatcaagggctgcgacgccctgaacagcagcctgacctgcctggccgccgagtaccccatcgtgaagttctgcaagatcaaggccagcaacaccggcgccggcgacagattcagcctggacgtgctgcccaccctgctgatctacaagggcggcgagctgatcagcaacttcatcagcgtggccgagcagttcgccgaggagttcttcgccggcgacgtggagagcttcctgaacgagtacggcctgctgcccgagagagaggtgcacgtgctggagcacaccaagatcgaggaggaggacgtggagtag

SEQ ID NO: 92953 - DNA, 741 bp, Artificial Sequence; identical to SEQ ID NO: 92952
  Description of Artificial Sequence: Synthetic coding sequence

SEQ ID NO: 92954 - DNA, 585 bp, Artificial Sequence
  Description of Artificial Sequence: Synthetic coding sequence
atgagcagcccccagagcagaaacggcaaggacagcaaggagagagtgagcagaaagatgagcatccaggagtacgagctgatccacaaggagaaggaggacgagaactgcctgagaaagtacagaagacagtgcatgcaggacatgcaccagaagctgagcttcggccccagatacggcttcgtgtacgagctggagaccggcaagcagttcctggagaccatcgagaaggagctgaagatcaccaccatcgtggtgcacatctacgaggacggcatcaagggctgcgacgccctgaacagcagcctgacctgcctggccgccgagtaccccatcgtgaagttctgcaagatcaaggccagcaacaccggcgccggcgacagattcagcctggacgtgctgcccaccctgctgatctacaagggcggcgagctgatcagcaacttcatcagcgtggccgagcagttcgccgaggagttcttcgccggcgacgtggagagcttcctgaacgagtacggcctgctgcccgagagagaggtgcacgtgctggagcacaccaagatcgaggaggaggacgtggagtag

SEQ ID NO: 92955 - DNA, 585 bp, Artificial Sequence; identical to SEQ ID NO: 92954
  Description of Artificial Sequence: Synthetic coding sequence

SEQ ID NO: 92956 - DNA, 906 bp, Artificial Sequence
  Description of Artificial Sequence: Synthetic coding sequence
atgaccaccctggacgacaagctgctgggcgagaagctgcagtactactacagcagcagcgaggacgaggacagcgaccacgaggacaaggacagaggcagatgcgcccccgccagcagcagcgtgcccgccgaggccgagctggccggcgagggcatcagcgtgaacaccggccccaagggcgtgatcaacgactggagaagattcaagcagctggagaccgagcagagagaggagcagtgcagagagatggagagactgatcaagaagctgagcatgacctgcagaagccacctggacgaggaggaggagcagcagaagcagaaggacctgcaggagaagatcagcggcaagatgaccctgaaggagttcgccatcatgaacgaggaccaggacgacgaggagttcctgcagcagtacagaaagcagagaatggaggagatgagacagcagctgcacaagggcccccagttcaagcaggtgttcgagatcagcagcggcgagggcttcctggacatgatcgacaaggagcagaagagcatcgtgatcatggtgcacatctacgaggacggcatccccggcaccgaggccatgaacggctgcatgatctgcctggccgccgagtaccccgccgtgaagttctgcaaggtgaagagcagcgtgatcggcgccagcagccagttcaccagaaacgccctgcccgccctgctgatctacaagggcggcgagctgatcggcaacttcgtgagagtgaccgaccagctgggcgacgacttcttcgccgtggacctggaggccttcctgcaggagttcggcctgctgcccgagaaggaggtgctggtgctgaccagcgtgagaaacagcgccacctgccacagcgaggacagcgacctggagatcgactag

SEQ ID NO: 92957 - DNA, 330 bp, Artificial Sequence
  Description of Artificial Sequence: Synthetic coding sequence
tgactgcagtactactacagcagcagcgaggacgaggacagcgaccacgaggacaaggacagaggcagatgcgcccccgccagcagcagcgtgcccgccgaggccgagctggccggcgagggcatcagcgtgaacaccggccccaagggcgtgatcaacgactggagaagattcaagcagctggagaccgagcagagagaggagcagtgcagagagatggagagactgatcaagaagctgagcatgacctgcagaagccacctggacgaggaggaggagcagcagaagcagaaggacctgcaggagaagatcagcggcaaggagagatag

SEQ ID NO: 92958 - DNA, 276 bp, Artificial Sequence
  Description of Artificial Sequence: Synthetic coding sequence
tgatgcgcccccgccagcagcagcgtgcccgccgaggccgagctggccggcgagggcatcagcgtgaacaccggccccaagggcgtgatcaacgactggagaagattcaagcagctggagaccgagcagagagaggagcagtgcagagagatggagagactgatcaagaagctgagcatgacctgcagaagccacctggacgaggaggaggagcagcagaagcagaaggacctgcaggagaagatcagcggcaagaagagctgggccatcctgtag

SEQ ID NO: 92959 - DNA, 726 bp, Artificial Sequence
  Description of Artificial Sequence: Synthetic coding sequence
atgcaggaccccaacgaggacaccgagtggaacgacatcctgagagacttcggcatcctgccccccaaggaggagagcaaggacgagatcgaggagatggtgctgagactgcagaaggaggccatggtgaagcccttcgagaagatgaccctggcccagctgaaggaggccgaggacgagttcgacgaggaggacatgcaggccgtggagacctacagaaagaagagactgcaggagtggaaggccctgaagaagaagcagaagttcggcgagctgagagagatcagcggcaaccagtacgtgaacgaggtgaccaacgccgaggaggacgtgtgggtgatcatccacctgtacagaagcagcatccccatgtgcctgctggtgaaccagcacctgagcctgctggccagaaagttccccgagaccaagttcgtgaaggccatcgtgaacagctgcatccagcactaccacgacaactgcctgcccaccatcttcgtgtacaagaacggccagatcgaggccaagttcatcggcatcatcgagtgcggcggcatcaacctgaagctggaggagctggagtggaagctggccgaggtgggcgccatccagaccgacctggaggagaaccccagaaaggacatggtggacatgatggtgagcagcatcagaaacaccagcatccacgacgacagcgacagcagcaacagcgacaacgacaccaagtag

SEQ ID NO: 92960 - DNA, 720 bp, Artificial Sequence
  Description of Artificial Sequence: Synthetic coding sequence
atgcaggaccccaacgccgacaccgagtggaacgacatcctgagaaagaagggcatcctgccccccaaggagagcctgaaggagctggaggaggaggccgaggaggagcagagaatcctgcagcagagcgtggtgaagacctacgaggacatgaccctggaggagctggaggaccacgaggacgagttcaacgaggaggacgagagagccatcgagatgtacagaagaagaagactggccgagtggaaggccaccaagctgaagaacaagttcggcgaggtgctggagatcagcggcaaggactacgtgcaggaggtgaccaaggccggcgagggcctgtgggtgatcctgcacctgtacaagcagggcatccccctgtgcgccctgatcaaccagcacctgagcggcctggccagaaagttccccgacgtgaagttcatcaaggccatcagcaccacctgcatccccaactaccccgacagaaacctgcccaccatcttcgtgtacctggagggcgacatcaaggcccagttcatcggccccctggtgttcggcggcatgaacctgaccagagacgagctggagtggaagctgagcgagagcggcgccatcatgaccgacctggaggagaaccccaagaagcccatcgaggacgtgctgctgagcagcgtgagaagaagcgtgctgatgaagagagacagcgacagcgagggcgactag

SEQ ID NO: 92961 - DNA, 1104 bp, Artificial Sequence
  Description of Artificial Sequence: Synthetic coding sequence
atggacgcccagtgcagcgccaaggtgaacgccagaaagagaagaaaggaggcccccggccccaacggcgccaccgaggaggacggcgtgcccagcaaggtgcagagatgcgccgtgggcctgagacagcccgcccccttcagcgacgagatcgaggtggacttcagcaagccctacgtgagagtgaccatggaggaggccagcagaggcaccccctgcgagagacccgtgagagtgtacgccgacggcatcttcgacctgttccacagcggccacgccagagccctgatgcaggccaagaacctgttccccaacacctacctgatcgtgggcgtgtgcagcgacgagctgacccacaacttcaagggcttcaccgtgatgaacgagaacgagagatacgacgccgtgcagcactgcagatacgtggacgaggtggtgagaaacgccccctggaccctgacccccgagttcctggccgagcacagaatcgacttcgtggcccacgacgacatcccctacagcagcgccggcagcgacgacgtgtacaagcacatcaaggaggccggcatgttcgcccccacccagagaaccgagggcatcagcaccagcgacatcatcaccagaatcgtgagagactacgacgtgtacgccagaagaaacctgcagagaggctacaccgccaaggagctgaacgtgagcttcatcaacgagaagaagtaccacctgcaggagagagtggacaaggtgaagaagaaggtgaaggacgtggaggagaagagcaaggagttcgtgcagaaggtggaggagaagagcatcgacctgatccagaagtgggaggagaagagcagagagttcatcggcagcttcctggagatgttcggccccgagggcgccctgaagcacatgctgaaggagggcaagggcagaatgctgcaggccatcagccccaagcagagccccagcagcagccccaccagagagagaagccccagccccagcttcagatggcccttcagcggcaagaccagccccccctgcagccccgccaacctgagcagacacaaggccgccgcctacgacatcagcgaggacgaggaggactag

SEQ ID NO: 92962 - DNA, 882 bp, Artificial Sequence
  Description of Artificial Sequence: Synthetic coding sequence
atggacgcccagtgcagcgccaaggtgaacgccagaaagagaagaaaggaggcccccggccccaacggcgccaccgaggaggacggcgtgcccagcaaggtgcagagatgcgccgtgggcctgagacagcccgcccccttcagcgacgagatcgaggtggacttcagcaagccctacgtgagagtgaccatggaggaggccagcagaggcaccccctgcgagagacccgtgagagtgtacgccgacggcatcttcgacctgttccacagcggccacgccagagccctgatgcaggccaagaacctgttccccaacacctacctgatcgtgggcgtgtgcagcgacgagctgacccacaacttcaagggcttcaccgtgatgaacgagaacgagagatacgacgccgtgcagcactgcagatacgtggacgaggtggtgagaaacgccccctggaccctgacccccgagttcctggccgagcacagaatcgacttcgtggcccacgacgacatcccctacagcagcgccggcagcgacgacgtgtacaagcacatcaaggaggccggcatgttcgcccccacccagagaaccgagggcatcagcaccagcgacatcatcaccagaatcgtgagagactacgacgtgtacgccagaagaaacctgcagagaggctacaccgccaaggagctgaacgtgagcttcatcaacgagaagaagtaccacctgcaggagagagtggacaaggtgaagaagaaggtgaaggacgtggaggagaagagcaaggagttcgtgcagaaggtggaggagaagagcatcgacctgatccagaagtgggaggagaagagcagagagttcatcggcagcttcctggagatgttctag

SEQ ID NO: 92963 - DNA, 402 bp, Artificial Sequence
  Description of Artificial Sequence: Synthetic coding sequence
atggacgcccagtgcagcgccaaggtgaacgccagaaagagaagaaaggaggcccccggccccaacggcgccaccgaggaggacggcgtgcccagcaaggtgcagagatgcgccgtgggcctgagacagcccgcccccttcagcgacgagatcgaggtggacttcagcaagccctacgtgagagtgaccatggaggaggccagcagaggcaccccctgcgagagacccgtgagagtgtacgccgacggcatcttcgacctgttccacagcggccacgccagagccctgatgcaggccaagaacctgttccccaacacctacctgatcgtgggcgtgtgcagcgacgagctgacccacaacttcaagggcttcaccgtgatgaacgagaacgagagatactag

SEQ ID NO: 92964 - DNA, 987 bp, Artificial Sequence
  Description of Artificial Sequence: Synthetic coding sequence
atggacgcccagtgcagcgccaaggtgaacgccagaaagagaagaaaggaggcccccggccccaacggcgccaccgaggaggccagcagaggcaccccctgcgagagacccgtgagagtgtacgccgacggcatcttcgacctgttccacagcggccacgccagagccctgatgcaggccaagaacctgttccccaacacctacctgatcgtgggcgtgtgcagcgacgagctgacccacaacttcaagggcttcaccgtgatgaacgagaacgagagatacgacgccgtgcagcactgcagatacgtggacgaggtggtgagaaacgccccctggaccctgacccccgagttcctggccgagcacagaatcgacttcgtggcccacgacgacatcccctacagcagcgccggcagcgacgacgtgtacaagcacatcaaggaggccggcatgttcgcccccacccagagaaccgagggcatcagcaccagcgacatcatcaccagaatcgtgagagactacgacgtgtacgccagaagaaacctgcagagaggctacaccgccaaggagctgaacgtgagcttcatcaacgagaagaagtaccacctgcaggagagagtggacaaggtgaagaagaaggtgaaggacgtggaggagaagagcaaggagttcgtgcagaaggtggaggagaagagcatcgacctgatccagaagtgggaggagaagagcagagagttcatcggcagcttcctggagatgttcggccccgagggcgccctgaagcacatgctgaaggagggcaagggcagaatgctgcaggccatcagccccaagcagagccccagcagcagccccaccagagagagaagccccagccccagcttcagatggcccttcagcggcaagaccagccccccctgcagccccgccaacctgagcagacacaaggccgccgcctacgacatcagcgaggacgaggaggactag

SEQ ID NO: 92965 - DNA, 1104 bp, Artificial Sequence; identical to SEQ ID NO: 92961
  Description of Artificial Sequence: Synthetic coding sequence

SEQ ID NO: 92966 - DNA, 348 bp, Artificial Sequence
  Description of Artificial Sequence: Synthetic coding sequence
atggacgcccagtgcagcgccaaggtgaacgccagaaagagaagaaaggaggcccccggccccaacggcgccaccgaggaggacggcgtgcccagcaaggtgcagagatgcgccgtgggcctgagacagcccgcccccttcagcgacgagatcgaggtggacttcagcaagccctacgtgagagtgaccatggaggaggccagcagaggcaccccctgcgagagacccgtgagagtgtacgccgacggcatcttcgacctgttccacagcggccacgccagagccctgatgcaggccaagaacctgttccccaacacctacctgatcgtgggcgtgtgcagcgactag

SEQ ID NO: 92967 - DNA, 2250 bp, Artificial Sequence
  Description of Artificial Sequence: Synthetic coding sequence
atggaggccgagaccggcagcagcgtggagaccggcaagaaggccaacagaggcaccagaatcgccctggtggtgttcgtgggcggcaccctggtgctgggcaccatcctgttcctggtgagccagggcctgctgagcctgcaggccaagcaggagtactgcctgaagcccgagtgcatcgaggccgccgccgccatcctgagcaaggtgaacctgagcgtggacccctgcgacaacttcttcagattcgcctgcgacggctggatcagcaacaaccccatccccgaggacatgcccagctacggcgtgtacccctggctgagacacaacgtggacctgaagctgaaggagctgctggagaagagcatcagcagaagaagagacaccgaggccatccagaaggccaagatcctgtacagcagctgcatgaacgagaaggccatcgagaaggccgacgccaagcccctgctgcacatcctgagacacagccccttcagatggcccgtgctggagagcaacatcggccccgagggcgtgtggagcgagagaaagttcagcctgctgcagaccctggccaccttcagaggccagtacagcaacagcgtgttcatcagactgtacgtgagccccgacgacaaggccagcaacgagcacatcctgaagctggaccaggccaccctgagcctggccgtgagagaggactacctggacaacagcaccgaggccaagagctacagagacgccctgtacaagttcatggtggacaccgccgtgctgctgggcgccaacagcagcagagccgagcacgacatgaagagcgtgctgagactggagatcaagatcgccgagatcatgatcccccacgagaacagaaccagcgaggccatgtacaacaagatgaacatcagcgagctgagcgccatgatcccccagttcgactggctgggctacatcaagaaggtgatcgacaccagactgtacccccacctgaaggacatcagccccagcgagaacgtggtggtgagagtgccccagtacttcaaggacctgttcagaatcctgggcagcgagagaaagaagaccatcgccaactacctggtgtggagaatggtgtacagcagaatccccaacctgagcagaagattccagtacagatggctggagttcagcagagtgatccagggcaccaccaccctgctgccccagtgggacaagtgcgtgaacttcatcgagagcgccctgccctacgtggtgggcaagatgttcgtggacgtgtacttccaggaggacaagaaggagatgatggaggagctggtggagggcgtgagatgggccttcatcgacatgctggagaaggagaacgagtggatggacgccggcaccaagagaaaggccaaggagaaggccagagccgtgctggccaaggtgggctaccccgagttcatcatgaacgacacccacgtgaacgaggacctgaaggccatcaagttcagcgaggccgactacttcggcaacgtgctgcagaccagaaagtacctggcccagagcgacttcttctggctgagaaaggccgtgcccaagaccgagtggttcaccaaccccaccaccgtgaacgccttctacagcgccagcaccaaccagatcagattccccgccggcgagctgcagaagcccttcttctggggcaccgagtaccccagaagcctgagctacggcgccatcggcgtgatcgtgggccacgagttcacccacggcttcgacaacaacggcagaaagtacgacaagaacggcaacctggacccctggtggagcaccgagagcgaggagaagttcaaggagaagaccaagtgcatgatcaaccagtacagcaactactactggaagaaggccggcctgaacgtgaagggcaagagaaccctgggcgagaacatcgccgacaacggcggcctgagagaggccttcagagcctacagaaagtggatcaacgacagaagacagggcctggaggagcccctgctgcccggcatcaccttcaccaacaaccagctgttcttcctgagctacgcccacgtgagatgcaacagctacagacccgaggccgccagagagcaggtgcagatcggcgcccacagccccccccagttcagagtgaacggcgccatcagcaacttcgaggagttccagaaggccttcaactgcccccccaacagcaccatgaacagaggcatggacagctgcagactgtggtag

SEQ ID NO: 92968 - DNA, 1359 bp, Artificial Sequence
  Description of Artificial Sequence: Synthetic coding sequence
atgatccacctgcccagaccccccaaggtgctgggcctgcagttcgactggctgggctacatcaagaaggtgatcgacaccagactgtacccccacctgaaggacatcagccccagcgagaacgtggtggtgagagtgccccagtacttcaaggacctgttcagaatcctgggcagcgagagaaagaagaccatcgccaactacctggtgtggagaatggtgtacagcagaatccccaacctgagcagaagattccagtacagatggctggagttcagcagagtgatccagggcaccaccaccctgctgccccagtgggacaagtgcgtgaacttcatcgagagcgccctgccctacgtggtgggcaagatgttcgtggacgtgtacttccaggaggacaagaaggagatgatggaggagctggtggagggcgtgagatgggccttcatcgacatgctggagaaggagaacgagtggatggacgccggcaccaagagaaaggccaaggagaaggccagagccgtgctggccaaggtgggctaccccgagttcatcatgaacgacacccacgtgaacgaggacctgaaggccatcaagttcagcgaggccgactacttcggcaacgtgctgcagaccagaaagtacctggcccagagcgacttcttctggctgagaaaggccgtgcccaagaccgagtggttcaccaaccccaccaccgtgaacgccttctacagcgccagcaccaaccagatcagattccccgccggcgagctgcagaagcccttcttctggggcaccgagtaccccagaagcctgagctacggcgccatcggcgtgatcgtgggccacgagttcacccacggcttcgacaacaacggcagaaagtacgacaagaacggcaacctggacccctggtggagcaccgagagcgaggagaagttcaaggagaagaccaagtgcatgatcaaccagtacagcaactactactggaagaaggccggcctgaacgtgaagggcaagagaaccctgggcgagaacatcgccgacaacggcggcctgagagaggccttcagagcctacagaaagtggatcaacgacagaagacagggcctggaggagcccctgctgcccggcatcaccttcaccaacaaccagctgttcttcctgagctacgcccacgtgagatgcaacagctacagacccgaggccgccagagagcaggtgcagatcggcgcccacagccccccccagttcagagtgaacggcgccatcagcaacttcgaggagttccagaaggccttcaactgcccccccaacagcaccatgaacagaggcatggacagctgcagactgtggtag

SEQ ID NO: 92969 - DNA, 1959 bp, Artificial Sequence
  Description of Artificial Sequence: Synthetic coding sequence
atgcccagctacggcgtgtacccctggctgagacacaacgtggacctgaagctgaaggagctgctggagaagagcatcagcagaagaagagacaccgaggccatccagaaggccaagatcctgtacagcagctgcatgaacgagaaggccatcgagaaggccgacgccaagcccctgctgcacatcctgagacacagccccttcagatggcccgtgctggagagcaacatcggccccgagggcgtgtggagcgagagaaagttcagcctgctgcagaccctggccaccttcagaggccagtacagcaacagcgtgttcatcagactgtacgtgagccccgacgacaaggccagcaacgagcacatcctgaagctggaccaggccaccctgagcctggccgtgagagaggactacctggacaacagcaccgaggccaagagctacagagacgccctgtacaagttcatggtggacaccgccgtgctgctgggcgccaacagcagcagagccgagcacgacatgaagagcgtgctgagactggagatcaagatcgccgagatcatgatcccccacgagaacagaaccagcgaggccatgtacaacaagatgaacatcagcgagctgagcgccatgatcccccagttcgactggctgggctacatcaagaaggtgatcgacaccagactgtacccccacctgaaggacatcagccccagcgagaacgtggtggtgagagtgccccagtacttcaaggacctgttcagaatcctgggcagcgagagaaagaagaccatcgccaactacctggtgtggagaatggtgtacagcagaatccccaacctgagcagaagattccagtacagatggctggagttcagcagagtgatccagggcaccaccaccctgctgccccagtgggacaagtgcgtgaacttcatcgagagcgccctgccctacgtggtgggcaagatgttcgtggacgtgtacttccaggaggacaagaaggagatgatggaggagctggtggagggcgtgagatgggccttcatcgacatgctggagaaggagaacgagtggatggacgccggcaccaagagaaaggccaaggagaaggccagagccgtgctggccaaggtgggctaccccgagttcatcatgaacgacacccacgtgaacgaggacctgaaggccatcaagttcagcgaggccgactacttcggcaacgtgctgcagaccagaaagtacctggcccagagcgacttcttctggctgagaaaggccgtgcccaagaccgagtggttcaccaaccccaccaccgtgaacgccttctacagcgccagcaccaaccagatcagattccccgccggcgagctgcagaagcccttcttctggggcaccgagtaccccagaagcctgagctacggcgccatcggcgtgatcgtgggccacgagttcacccacggcttcgacaacaacggcagaaagtacgacaagaacggcaacctggacccctggtggagcaccgagagcgaggagaagttcaaggagaagaccaagtgcatgatcaaccagtacagcaactactactggaagaaggccggcctgaacgtgaagggcaagagaaccctgggcgagaacatcgccgacaacggcggcctgagagaggccttcagagcctacagaaagtggatcaacgacagaagacagggcctggaggagcccctgctgcccggcatcaccttcaccaacaaccagctgttcttcctgagctacgcccacgtgagatgcaacagctacagacccgaggccgccagagagcaggtgcagatcggcgcccacagccccccccagttcagagtgaacggcgccatcagcaacttcgaggagttccagaaggccttcaactgcccccccaacagcaccatgaacagaggcatggacagctgcagactgtggtag

SEQ ID NO: 92970 - DNA, 2088 bp, Artificial Sequence
  Description of Artificial Sequence: Synthetic coding sequence
atggaggccgagaccggcagcagcgtggagaccggcaagaaggccaacagaggcaccagaatcgccctggtggtgttcgtgggcggcaccctggtgctgggcaccatcctgttcctggtgagccagggcctgctgagcctgcaggccaagcaggagtactgcctgaagcccgagtgcatcgaggccgccgccgccatcctgagcaaggtgaacctgagcgtggacccctgcgacaacttcttcagattcgcctgcgacggctggatcagcaacaaccccatccccgaggacatgcccagctacggcgtgtacccctggctgagacacaacgtggacctgaagctgaaggagctgctggagaagagcatcagcagaagaagagacaccgaggccatccagaaggccaagatcctgtacagcagctgcatgaacgagaaggccatcgagaaggccgacgccaagcccctgctgcacatcctgagacacagccccttcagatggcccgtgctggagagcaacatcggccccgagggcgtgtggagcgagagaaagttcagcctgctgcagaccctggccaccttcagaggccagtacagcaacagcgtgttcatcagactgtacgtgagccccgacgacaaggccagcaacgagcacatcctgaagctggaccaggccaccctgagcctggccgtgagagaggactacctggacaacagcaccgaggccaagagctacagagacgccctgtacaagttcatggtggacaccgccgtgctgctgggcgccaacagcagcagagccgagcacgacatgaagagcgtgctgagactggagatcaagatcgccgagatcatgatcccccacgagaacagaaccagcgaggccatgtacaacaagatgaacatcagcgagctgagcgccatgatcccccagttcgactggctgggctacatcaagaaggtgatcgacaccagactgtacccccacctgaaggacatcagccccagcgagaacgtggtggtgagagtgccccagtacttcaaggacctgttcagaatcctgggcagcgagagaaagaagaccatcgccaactacctggtgtggagaatggtgtacagcagaatccccaacctgagcagaagattccagtacagatggctggagttcagcagagtgatccagggcaccaccaccctgctgccccagtgggacaagtgcgtgaacttcatcgagagcgccctgccctacgtggtgggcaagatgttcgtggacgtgtacttccaggaggacaagaaggagatgatggaggagctggtggagggcgtgagatgggccttcatcgacatgctggagaaggagaacgagtggatggacgccggcaccaagagaaaggccaaggagaaggccagagccgtgctggccaaggtgggctaccccgagttcatcatgaacgacacccacgtgaacgaggacctgaaggccatcaagttcagcgaggccgactacttcggcaacgtgctgcagaccagaaagtacctggcccagagcgacttcttctggctgagaaaggccgtgcccaagaccgagtggttcaccaaccccaccaccgtgaacgccttctacagcgccagcaccaaccagatcagattccccgccggcgagctgcagaagcccttcttctggggcaccgagtaccccagaagcctgagctacggcgccatcggcgtgatcgtgggccacgagttcacccacggcttcgacaacaacggcagaaagtacgacaagaacggcaacctggacccctggtggagcaccgagagcgaggagaagttcaaggagaagaccaagtgcatgatcaaccagtacagcaactactactggaagaaggccggcctgaacgtgaagggcaagagaaccctgggcgagaacatcgccgacaacggcggcctgagagaggccttcagagcctacagaaagtggatcaacgacagaagacagggcctggaggagcccctgctgcccggcatcaccttcaccaacaaccagctgttcttcctgagctacgcccacggccagtggtgcaactag

SEQ ID NO: 92971 - DNA, 888 bp, Artificial Sequence
  Description of Artificial Sequence: Synthetic coding sequence
atgcccagccccagaagaagcatggagggcagacccctgggcgtgagcgccagcagcagcagcagcagccccggcagccccgcccacggcggcggcggcggcggcagcagattcgagttccagagcctgctgagcagcagagccaccgccgtggaccccacctgcgccagactgagagccagcgagagccccgtgcacagaagaggcagcttccccctggccgccgccggccccagccagagccccgccccccccctgcccgaggaggacagaatggacctgaaccccagcttcctgggcatcgccctgagaagcctgctggccatcgacctgtggctgagcaagaagctgggcgtgtgcgccggcgagagcagcagctggggcagcgtgagacccctgatgaagctgctggagatcagcggccacggcatcccctggctgctgggcaccctgtactgcctgtgcagaagcgacagctgggccggcagagaggtgctgatgaacctgctgttcgccctgctgctggacctgctgctggtggccctgatcaagggcctggtgagaagaagaagacccgcccacaaccagatggacatgttcgtgaccctgagcgtggacaagtacagcttccccagcggccacgccaccagagccgccctgatgagcagattcatcctgaaccacctggtgctggccatccccctgagagtgctggtggtgctgtgggccttcgtgctgggcctgagcagagtgatgctgggcagacacaacgtgaccgacgtggccttcggcttcttcctgggctacatgcagtacagcatcgtggactactgctggctgagcccccacaacgcccccgtgctgttcctgctgtggagccagagatag

SEQ ID NO: 92972 - DNA, 615 bp, Artificial Sequence
  Description of Artificial Sequence: Synthetic coding sequence
atggacctgaaccccagcttcctgggcatcgccctgagaagcctgctggccatcgacctgtggctgagcaagaagctgggcgtgtgcgccggcgagagcagcagctggggcagcgtgagacccctgatgaagctgctggagatcagcggccacggcatcccctggctgctgggcaccctgtactgcctgtgcagaagcgacagctgggccggcagagaggtgctgatgaacctgctgttcgccctgctgctggacctgctgctggtggccctgatcaagggcctggtgagaagaagaagacccgcccacaaccagatggacatgttcgtgaccctgagcgtggacaagtacagcttccccagcggccacgccaccagagccgccctgatgagcagattcatcctgaaccacctggtgctggccatccccctgagagtgctggtggtgctgtgggccttcgtgctgggcctgagcagagtgatgctgggcagacacaacgtgaccgacgtggccttcggcttcttcctgggctacatgcagtacagcatcgtggactactgctggctgagcccccacaacgcccccgtgctgttcctgctgtggagccagagatag

SEQ ID NO: 92973 - DNA, 645 bp, Artificial Sequence
  Description of Artificial Sequence: Synthetic coding sequence
atggagctggccgccggcagcttcagcgaggagcagttctgggaggcctgcgccgagctgcagcagcccgccctggccggcgccgactggcagctgctggtggagaccagcggcatcagcatctacagactgctggacaagaagaccggcctgtacgagtacaaggtgttcggcgtgctggaggactgcagccccaccctgctggccgacatctacatggacagcgactacagaaagcagtgggaccagtacgtgaaggagctgtacgagcaggagtgcaacggcgagaccgtggtgtactgggaggtgaagtaccccttccccatgagcaacagagactacgtgtacctgagacagagaagagacctggacatggagggcagaaagatccacgtgatcctggccagaagcaccagcatgccccagctgggcgagagaagcggcgtgatcagagtgaagcagtacaagcagagcctggccatcgagagcgacggcaagaagggcagcaaggtgttcatgtactacttcgacaaccccggcggccagatccccagctggctgatcaactgggccgccaagaacggcgtgcccaacttcctgaaggacatggccagagcctgccagaactacctgaagaagacctag

SEQ ID NO: 92974 - DNA, 582 bp, Artificial Sequence
  Description of Artificial Sequence: Synthetic coding sequence
ctggcccagggcagatgcctgcaggtgaccgccgtgcagatccagggcagctggaaggtgaccggcgtgcagccccagaagaccggcctgtacgagtacaaggtgttcggcgtgctggaggactgcagccccaccctgctggccgacatctacatggacagcgactacagaaagcagtgggaccagtacgtgaaggagctgtacgagcaggagtgcaacggcgagaccgtggtgtactgggaggtgaagtaccccttccccatgagcaacagagactacgtgtacctgagacagagaagagacctggacatggagggcagaaagatccacgtgatcctggccagaagcaccagcatgccccagctgggcgagagaagcggcgtgatcagagtgaagcagtacaagcagagcctggccatcgagagcgacggcaagaagggcagcaaggtgttcatgtactacttcgacaaccccggcggccagatccccagctggctgatcaactgggccgccaagaacggcgtgcccaacttcctgaaggacatggccagagcctgccagaactacctgaagaagacctag

SEQ ID NO: 92975 - DNA, 429 bp, Artificial Sequence
  Description of Artificial Sequence: Synthetic coding sequence
atggacagcgactacagaaagcagtgggaccagtacgtgaaggagctgtacgagcaggagtgcaacggcgagaccgtggtgtactgggaggtgaagtaccccttccccatgagcaacagagactacgtgtacctgagacagagaagagacctggacatggagggcagaaagatccacgtgatcctggccagaagcaccagcatgccccagctgggcgagagaagcggcgtgatcagagtgaagcagtacaagcagagcctggccatcgagagcgacggcaagaagggcagcaaggtgttcatgtactacttcgacaaccccggcggccagatccccagctggctgatcaactgggccgccaagaacggcgtgcccaacttcctgaaggacatggccagagcctgccagaactacctgaagaagacctag

SEQ ID NO: 92976 - DNA, 564 bp, Artificial Sequence
  Description of Artificial Sequence: Synthetic coding sequence
atgcccgtggacctgagcaagtggagcggccccctgagcctgcaggaggtggacgagcagccccagcaccccctgcacgtgacctacgccggcgccgccgtggacgagctgggcaaggtgctgacccccacccaggtgaagaacagacccaccagcatcagctgggacggcctggacagcggcaagctgtacaccctggtgctgaccgaccccgacgcccccagcagaaaggaccccaagtacagagagtggcaccacttcctggtggtgaacatgaagggcaacgacatcagcagcggcaccgtgctgagcgactacgtgggcagcggcccccccaagggcaccggcctgcacagatacgtgtggctggtgtacgagcaggacagacccctgaagtgcgacgagcccatcctgagcaacagaagcggcgaccacagaggcaagttcaaggtggccagcttcagaaagaagtacgagctgagagcccccgtggccggcacctgctaccaggccgagtgggacgactacgtgcccaagctgtacgagcagctgagcggcaagtag

SEQ ID NO: 92977 - DNA, 468 bp, Artificial Sequence
  Description of Artificial Sequence: Synthetic coding sequence
atgcccgtggacctgagcaagtggagcggccccctgagcctgcaggaggtggacgagcagccccagcaccccctgcacgtgacctacgccggcgccgccgtggacgagctgggcaaggtgctgacccccacccaggtgaagaacagacccaccagcatcagctgggacggcctggacagcggcaagctgtacaccctggtgctgaccgaccccgacgcccccagcagaaaggaccccaagtacagagagtggcaccacttcctggtggtgaacatgaagggcaacgacatcagcagcggcaccgtgctgagcgactacgtgggcagcggcccccccaagggcaccggcctgcacagatacgtgtggctggtgtacgagcaggacagacccctgaagtgcgacttcagctgctgcctggccttcatcatcctgctgacccacagcgacctgtgcttcgaccagatctag

SEQ ID NO: 92978 - DNA, 6135 bp, Artificial Sequence
  Description of Artificial Sequence: Synthetic coding sequence
atgtgccccgtggacttccacggcatcttccagctggacgagagaagaagagacgccgtgatcgccctgggcatcttcctgatcgagagcgacctgcagcacaaggactgcgtggtgccctacctgctgagactgctgaagggcctgcccaaggtgtactgggtggaggagagcaccgccagaaagggcagaggcgccctgcccgtggccgagagcttcagcttctgcctggtgaccctgctgagcgacgtggcctacagagaccccagcctgagagacgagatcctggaggtgctgctgcaggtgctgcacgtgctgctgggcatgtgccaggccctggagatccaggacaaggagtacctgtgcaagtacgccatcccctgcctgatcggcatcagcagagccttcggcagatacagcaacatggaggagagcctgctgagcaagctgttccccaagatccccccccacagcctgagagtgctggaggagctggagggcgtgagaagaagaagcttcaacgacttcagaagcatcctgcccagcaacctgctgaccgtgtgccaggagggcaccctgaagagaaagaccagcagcgtgagcagcatcagccaggtgagccccgagagaggcatgcccccccccagcagccccggcggcagcgccttccactacttcgaggccagctgcctgcccgacggcaccgccctggagcccgagtactacttcagcaccatcagcagcagcttcagcgtgagccccctgttcaacggcgtgacctacaaggagttcaacatccccctggagatgctgagagagctgctgaacctggtgaagaagatcgtggaggaggccgtgctgaagagcctggacgccatcgtggccagcgtgatggaggccaaccccagcgccgacctgtactacaccagcttcagcgaccccctgtacctgaccatgttcaagatgctgagagacaccctgtactacatgaaggacctgcccaccagcttcgtgaaggagatccacgacttcgtgctggagcagttcaacaccagccagggcgagctgcagaagatcctgcacgacgccgacagaatccacaacgagctgagccccctgaagctgagatgccaggccaacgccgcctgcgtggacctgatggtgtgggccgtgaaggacgagcagggcgccgagaacctgtgcatcaagctgagcgagaagctgcagagcaagaccagcagcaaggtgatcatcgcccacctgcccctgctgatctgctgcctgcagggcctgggcagactgtgcgagagattccccgtggtggtgcacagcgtgacccccagcctgagagacttcctggtgatccccagccccgtgctggtgaagctgtacaagtaccacagccagtaccacaccgtggccggcaacgacatcaagatcagcgtgaccaacgagcacagcgagagcaccctgaacgtgatgagcggcaagaagagccagcccagcatgtacgagcagctgagagacatcgccatcgacaacatctgcagatgcctgaaggccggcctgaccgtggaccccgtgatcgtggaggccttcctggccagcctgagcaacagactgtacatcagccaggagagcgacaaggacgcccacctgatccccgaccacaccatcagagccctgggccacatcgccgtggccctgagagacacccccaaggtgatggagcccatcctgcagatcctgcagcagaagttctgccagccccccagccccctggacgtgctgatcatcgaccagctgggctgcctggtgatcaccggcaaccagtacatctaccaggaggtgtggaacctgttccagcagatcagcgtgaaggccagcagcgtggtgtacagcgccaccaaggactacaaggaccacggctacagacactgcagcctggccgtgatcaacgccctggccaacatcgccgccaacatccaggacgagcacctggtggacgagctgctgatgaacctgctggagctgttcgtgcagctgggcctggagggcaagagagccagcgagagagccagcgagaagggccccgccctgaaggccagcagcagcgccggcaacctgggcgtgctgatccccgtgatcgccgtgctgaccagaagactgccccccatcaaggaggccaagcccagactgcagaagctgttcagagacttctggctgtacagcgtgctgatgggcttcgccgtggagggcagcggcctgtggcccgaggagtggtacgagggcgtgtgcgagatcgccaccaagagccccctgctgaccttccccagcaaggagcccctgagaagcgtgctgcagtacaacagcgccatgaagaacgacaccgtgacccccgccgagctgagcgagctgagaagcaccatcatcaacctgctggaccccccccccgaggtgagcgccctgatcaacaagctggacttcgccatgagcacctacctgctgagcgtgtacagactggagtacatgagagtgctgagaagcaccgaccccgacagattccaggtgatgttctgctacttcgaggacaaggccatccagaaggacaagagcggcatgatgcagtgcgtgatcgccgtggccgacaaggtgttcgacgccttcctgaacatgatggccgacaaggccaagaccaaggagaacgaggaggagctggagagacacgcccagttcctgctggtgaacttcaaccacatccacaagagaatcagaagagtggccgacaagtacctgagcggcctggtggacaagttcccccacctgctgtggagcggcaccgtgctgaagaccatgctggacatcctgcagaccctgagcctgagcctgagcgccgacatccacaaggaccagccctactacgacatccccgacgccccctacagaatcaccgtgcccgacacctacgaggccagagagagcatcgtgaaggacttcgccgccagatgcggcatgatcctgcaggaggccatgaagtgggcccccaccgtgaccaagagccacctgcaggagtacctgaacaagcaccagaactgggtgagcggcctgagccagcacaccggcctggccatggccaccgagagcatcctgcacttcgccggctacaacaagcagaacaccaccctgggcgccacccagctgagcgagagacccgcctgcgtgaagaaggactacagcaacttcatggccagcctgaacctgagaaacagatacgccggcgaggtgtacggcatgatcagattcagcggcaccaccggccagatgagcgacctgaacaagatgatggtgcaggacctgcacagcgccctggacagaagccacccccagcactacacccaggccatgttcaagctgaccgccatgctgatcagcagcaaggactgcgacccccagctgctgcaccacctgtgctggggccccctgagaatgttcaacgagcacggcatggagaccgccctggcctgctgggagtggctgctggccggcaaggacggcgtggaggtgcccttcatgagagagatggccggcgcctggcacatgaccgtggagcagaagttcggcctgttcagcgccgagatcaaggaggccgaccccctggccgccagcgaggccagccagcccaagccctgcccccccgaggtgaccccccactacatctggatcgacttcctggtgcagagattcgagatcgccaagtactgcagcagcgaccaggtggagatcttcagcagcctgctgcagagaagcatgagcctgaacatcggcggcgccaagggcagcatgaacagacacgtggccgccatcggccccagattcaagctgctgaccctgggcctgagcctgctgcacgccgacgtggtgcccaacgccaccatcagaaacgtgctgagagagaagatctacagcaccgccttcgactacttcagctgcccccccaagttccccacccagggcgagaagagactgagagaggacatcagcatcatgatcaagttctggaccgccatgttcagcgacaagaagtacctgaccgccagccagctggtgccccccgacaaccaggacaccagaagcaacctggacatcaccgtgggcagcagacagcaggccacccagggctggatcaacacctaccccctgagcagcggcatgagcaccatcagcaagaagagcggcatgagcaagaagaccaacagaggcagccagctgcacaagtactacatgaagagaagaaccctgctgctgagcctgctggccaccgagatcgagagactgatcacctggtacaaccccctgagcgcccccgagctggagctggaccaggccggcgagaacagcgtggccaactggagaagcaagtacatcagcctgagcgagaagcagtggaaggacaacgtgaacctggcctggagcatcagcccctacctggccgtgcagctgcccgccagattcaagaacaccgaggccatcggcaacgaggtgaccagactggtgagactggaccccggcgccgtgagcgacgtgcccgaggccatcaagttcctggtgacctggcacaccatcgacgccgacgcccccgagctgagccacgtgctgtgctgggcccccaccgacccccccaccggcctgagctacttcagcagcatgtaccccccccaccccctgaccgcccagtacggcgtgaaggtgctgagaagcttcccccccgacgccatcctgttctacatcccccagatcgtgcaggccctgagatacgacaagatgggctacgtgagagagtacatcctgtgggccgccagcaagagccagctgctggcccaccagttcatctggaacatgaagaccaacatctacctggacgaggagggccaccagaaggaccccgacatcggcgacctgctggaccagctggtggaggagatcaccggcagcctgagcggccccgccaaggacttctaccagagagagttcgacttcttcaacaagatcaccaacgtgagcgccatcatcaagccctaccccaagggcgacgagagaaagaaggcctgcctgagcgccctgagcgaggtgaaggtgcagcccggctgctacctgcccagcaaccccgaggccatcgtgctggacatcgactacaagagcggcacccccatgcagagcgccgccaaggccccctacctggccaagttcaaggtgaagagatgcggcgtgagcgagctggagaaggagggcctgagatgcagaagcgacagcgaggacgagtgcagcacccaggaggccgacggccagaagatcagctggcaggccgccatcttcaaggtgggcgacgactgcagacaggacatgctggccctgcagatcatcgacctgttcaagaacatcttccagctggtgggcctggacctgttcgtgttcccctacagagtggtggccaccgcccccggctgcggcgtgatcgagtgcatccccgactgcaccagcagagaccagctgggcagacagaccgacttcggcatgtacgactacttcaccagacagtacggcgacgagagcaccctggccttccagcaggccagatacaacttcatcagaagcatggccgcctacagcctgctgctgttcctgctgcagatcaaggacagacacaacggcaacatcatgctggacaagaagggccacatcatccacatcgacttcggcttcatgttcgagagcagccccggcggcaacctgggctgggagcccgacatcaagctgaccgacgagatggtgatgatcatgggcggcaagatggaggccacccccttcaagtggttcatggagatgtgcgtgagaggctacctggccgtgagaccctacatggacgccgtggtgagcctggtgaccctgatgctggacaccggcctgccctgcttcagaggccagaccatcaagctgctgaagcacagattcagccccaacatgaccgagagagaggccgccaacttcatcatgaaggtgatccagagctgcttcctgagcaacagaagcagaacctacgacatgatccagtactaccagaacgacatcccctactag

SEQ ID NO: 92979 - DNA, 1440 bp, Artificial Sequence
  Description of Artificial Sequence: Synthetic coding sequence
atggacgagaccagccccctggtgagccccgagagagcccagccccccgactacaccttccccagcggcagcggcgcccacttcccccaggtgcccggcggcgccgtgagagtggccgccgccgccggcagcggccccagcccccccggcagccccggccacgacagagagagacagcccctgctggacagagccagaggcgccgccgcccagggccagacccagaccgtggccgcccaggcccaggccctggccgcccaggccgccgccgccgcccacgccgcccaggcccacagagagagaaacgagttccccgaggaccccgagttcgaggccgtggtgagacaggccgagctggccatcgagagatgcatcttccccgagagaatctaccagggcagcagcggcagctacttcgtgaaggacccccagggcagaatcatcgccgtgttcaagcccaagaacgaggagccctacggccacctgaaccccaagtggaccaagtggctgcagaagctgtgctgcccctgctgcttcggcagagactgcctggtgctgaaccagggctacctgagcgaggccggcgccagcctggtggaccagaagctggagctgaacatcgtgcccagaaccaaggtggtgtacctggccagcgagaccttcaactacagcgccatcgacagagtgaagagcagaggcaagagactggccctggagaaggtgcccaaggtgggccagagattcaacagaatcggcctgccccccaaggtgggcagcttccagctgttcgtggagggctacaaggacgccgactactggctgagaagattcgaggccgagcccctgcccgagaacaccaacagacagctgctgctgcagttcgagagactggtggtgctggactacatcatcagaaacaccgacagaggcaacgacaactggctgatcaagtacgactgccccatggacagcagcagcagcagagacaccgactgggtggtggtgaaggagcccgtgatcaaggtggccgccatcgacaacggcctggccttccccctgaagcaccccgacagctggagagcctaccccttctactgggcctggctgccccaggccaaggtgcccttcagccaggagatcaaggacctgatcctgcccaagatcagcgaccccaacttcgtgaaggacctggaggaggacctgtacgagctgttcaagaaggaccccggcttcgacagaggccagttccacaagcagatcgccgtgatgagaggccagatcctgaacctgacccaggccctgaaggacaacaagagccccctgcacctggtgcagatgccccccgtgatcgtggagaccgccagaagccaccagagaagcagcagcgagagctacacccagagcttccagagcagaaagcccttcttcagctggtggtag

SEQ ID NO: 92980 - DNA, 1350 bp, Artificial Sequence
  Description of Artificial Sequence: Synthetic coding sequence
atgctgggcccccaggtgtggagcagcgtgagacagggcctgagcagaagcctgagcagaaacgtgggcgtgtgggccagcggcgagggcaagaaggtggacatcgccggcatctacccccccgtgaccacccccttcaccgccaccgccgaggtggactacggcaagctggaggagaacctgcacaagctgggcaccttccccttcagaggcgccgtgggcggcgtgtgcgccctggccaacgtgctgggcgcccaggtgtgccagctggagagactgtgctgcaccggccagtgggaggacgcccagaagctgcagcacagactgatcgagcccaacgccgccagaatcatcgccgtgttcaagcccaagaacgaggagccctacggccacctgaaccccaagtggaccaagtggctgcagaagctgtgctgcccctgctgcttcggcagagactgcctggtgctgaaccagggctacctgagcgaggccggcgccagcctggtggaccagaagctggagctgaacatcgtgcccagaaccaaggtggtgtacctggccagcgagaccttcaactacagcgccatcgacagagtgaagagcagaggcaagagactggccctggagaaggtgcccaaggtgggccagagattcaacagaatcggcctgccccccaaggtgggcagcttccagctgttcgtggagggctacaaggacgccgactactggctgagaagattcgaggccgagcccctgcccgagaacaccaacagacagctgctgctgcagttcgagagactggtggtgctggactacatcatcagaaacaccgacagaggcaacgacaactggctgatcaagtacgactgccccatggacagcagcagcagcagagacaccgactgggtggtggtgaaggagcccgtgatcaaggtggccgccatcgacaacggcctggccttccccctgaagcaccccgacagctggagagcctaccccttctactgggcctggctgccccaggccaaggtgcccttcagccaggagatcaaggacctgatcctgcccaagatcagcgaccccaacttcgtgaaggacctggaggaggacctgtacgagctgttcaagaaggaccccggcttcgacagaggccagttccacaagcagatcgccgtgatgagaggccagatcctgaacctgacccaggccctgaaggacaacaagagccccctgcacctggtgcagatgccccccgtgatcgtggagaccgccagaagccaccagagaagcagcagcgagagctacacccagagcttccagagcagaaagcccttcttcagctggtggtag

SEQ ID NO: 92981 - DNA, 1446 bp, Artificial Sequence
  Description of Artificial Sequence: Synthetic coding sequence
atggaggaccccagcgagcccgacagactggccagcgccgacggcggcagccccgaggaggaggaggacggcgagagagagcccctgctgcccagaatcgcctgggcccaccccagaagaggcgcccccggcagcgccgtgagactgctggacgccgccggcgaggagggcgaggccggcgacgaggagctgcccctgccccccggcgacgtgggcgtgagcagaagcagcagcgccgagctggacagaagcagacccgccgtgagcgtgaccatcggcaccagcgagatgaacgccttcctggacgaccccgagttcgccgacatcatgctgagagccgagcaggccatcgaggtgggcatcttccccgagagaatcagccagggcagcagcggcagctacttcgtgaaggaccccaagagaaagatcatcggcgtgttcaagcccaagagcgaggagccctacggccagctgaaccccaagtggaccaagtacgtgcacaaggtgtgctgcccctgctgcttcggcagaggctgcctgatccccaaccagggctacctgagcgaggccggcgcctacctggtggacaacaagctgcacctgagcatcgtgcccaagaccaaggtggtgtggctggtgagcgagaccttcaactacaacgccatcgacagagccaagagcagaggcaagaagtacgccctggagaaggtgcccaaggtgggcagaaagttccacagaatcggcctgccccccaagatcggcagcttccagctgttcgtggagggctacaaggaggccgagtactggctgagaaagttcgaggccgaccccctgcccgagaacatcagaaagcagttccagagccagttcgagagactggtgatcctggactacatcatcagaaacaccgacagaggcaacgacaactggctggtgagatacgagaagcagaagtgcgagaaggagatcgaccacaaggagagcaagtggatcgacgacgaggagttcctgatcaagatcgccgccatcgacaacggcctggccttccccttcaagcaccccgacgagtggagagcctaccccttccactgggcctggctgccccaggccaaggtgcccttcagcgaggagatcagaaacctgatcctgccctacatcagcgacatgaacttcgtgcaggacctgtgcgaggacctgtacgagctgttcaagaccgacaagggcttcgacaaggccaccttcgagagccagatgagcgtgatgagaggccagatcctgaacctgacccaggccctgagagacggcaagagccccttccagctggtgcagatcccctgcgtgatcgtggagagaagccagggcggcagccagggcagaatcgtgcacctgagcaacagcttcacccagaccgtgaactgcagaaagcccttcttcagcagctggtag

SEQ ID NO: 92982 - DNA, 1353 bp, Artificial Sequence
  Description of Artificial Sequence: Synthetic coding sequence
atggaggaccccagcgagcccgacagactggccagcgccgacggcggcagccccgaggaggaggaggacggcgagagagagcccctgctgcccagaatcgcctgggcccaccccagaagaggcgcccccggcagcgccgtgagactgctggacagaagcagacccgccgtgagcgtgaccatcggcaccagcgagatgaacgccttcctggacgaccccgagttcgccgacatcatgctgagagccgagcaggccatcgaggtgggcatcttccccgagagaatcagccagggcagcagcggcagctacttcgtgaaggaccccaagagaaagatcatcggcgtgttcaagcccaagagcgaggagccctacggccagctgaaccccaagtggaccaagtacgtgcacaaggtgtgctgcccctgctgcttcggcagaggctgcctgatccccaaccagggctacctgagcgaggccggcgcctacctggtggacaacaagctgcacctgagcatcgtgcccaagaccaaggtggtgtggctggtgagcgagaccttcaactacaacgccatcgacagagccaagagcagaggcaagaagtacgccctggagaaggtgcccaaggtgggcagaaagttccacagaatcggcctgccccccaagatcggcagcttccagctgttcgtggagggctacaaggaggccgagtactggctgagaaagttcgaggccgaccccctgcccgagaacatcagaaagcagttccagagccagttcgagagactggtgatcctggactacatcatcagaaacaccgacagaggcaacgacaactggctggtgagatacgagaagcagaagtgcgagaaggagatcgaccacaaggagagcaagtggatcgacgacgaggagttcctgatcaagatcgccgccatcgacaacggcctggccttccccttcaagcaccccgacgagtggagagcctaccccttccactgggcctggctgccccaggccaaggtgcccttcagcgaggagatcagaaacctgatcctgccctacatcagcgacatgaacttcgtgcaggacctgtgcgaggacctgtacgagctgttcaagaccgacaagggcttcgacaaggccaccttcgagagccagatgagcgtgatgagaggccagatcctgaacctgacccaggccctgagagacggcaagagccccttccagctggtgcagatcccctgcgtgatcgtggagagaagccagggcggcagccagggcagaatcgtgcacctgagcaacagcttcacccagaccgtgaactgcagaaagcccttcttcagcagctggtag

SEQ ID NO: 92983 - DNA, 6135 bp, Artificial Sequence; identical to SEQ ID NO: 92978
  Description of Artificial Sequence: Synthetic coding sequence

SEQ ID NO: 92984 - DNA, 2565 bp, Artificial Sequence
  Description of Artificial Sequence: Synthetic coding sequence
atgagagagatggccggcgcctggcacatgaccgtggagcagaagttcggcctgttcagcgccgagatcaaggaggccgaccccctggccgccagcgaggccagccagcccaagccctgcccccccgaggtgaccccccactacatctggatcgacttcctggtgcagagattcgagatcgccaagtactgcagcagcgaccaggtggagatcttcagcagcctgctgcagagaagcatgagcctgaacatcggcggcgccaagggcagcatgaacagacacgtggccgccatcggccccagattcaagctgctgaccctgggcctgagcctgctgcacgccgacgtggtgcccaacgccaccatcagaaacgtgctgagagagaagatctacagcaccgccttcgactacttcagctgcccccccaagttccccacccagggcgagaagagactgagagaggacatcagcatcatgatcaagttctggaccgccatgttcagcgacaagaagtacctgaccgccagccagctggtgccccccgacaaccaggacaccagaagcaacctggacatcaccgtgggcagcagacagcaggccacccagggctggatcaacacctaccccctgagcagcggcatgagcaccatcagcaagaagagcggcatgagcaagaagaccaacagaggcagccagctgcacaagtactacatgaagagaagaaccctgctgctgagcctgctggccaccgagatcgagagactgatcacctggtacaaccccctgagcgcccccgagctggagctggaccaggccggcgagaacagcgtggccaactggagaagcaagtacatcagcctgagcgagaagcagtggaaggacaacgtgaacctggcctggagcatcagcccctacctggccgtgcagctgcccgccagattcaagaacaccgaggccatcggcaacgaggtgaccagactggtgagactggaccccggcgccgtgagcgacgtgcccgaggccatcaagttcctggtgacctggcacaccatcgacgccgacgcccccgagctgagccacgtgctgtgctgggcccccaccgacccccccaccggcctgagctacttcagcagcatgtaccccccccaccccctgaccgcccagtacggcgtgaaggtgctgagaagcttcccccccgacgccatcctgttctacatcccccagatcgtgcaggccctgagatacgacaagatgggctacgtgagagagtacatcctgtgggccgccagcaagagccagctgctggcccaccagttcatctggaacatgaagaccaacatctacctggacgaggagggccaccagaaggaccccgacatcggcgacctgctggaccagctggtggaggagatcaccggcagcctgagcggccccgccaaggacttctaccagagagagttcgacttcttcaacaagatcaccaacgtgagcgccatcatcaagccctaccccaagggcgacgagagaaagaaggcctgcctgagcgccctgagcgaggtgaaggtgcagcccggctgctacctgcccagcaaccccgaggccatcgtgctggacatcgactacaagagcggcacccccatgcagagcgccgccaaggccccctacctggccaagttcaaggtgaagagatgcggcgtgagcgagctggagaaggagggcctgagatgcagaagcgacagcgaggacgagtgcagcacccaggaggccgacggccagaagatcagctggcaggccgccatcttcaaggtgggcgacgactgcagacaggacatgctggccctgcagatcatcgacctgttcaagaacatcttccagctggtgggcctggacctgttcgtgttcccctacagagtggtggccaccgcccccggctgcggcgtgatcgagtgcatccccgactgcaccagcagagaccagctgggcagacagaccgacttcggcatgtacgactacttcaccagacagtacggcgacgagagcaccctggccttccagcaggccagatacaacttcatcagaagcatggccgcctacagcctgctgctgttcctgctgcagatcaaggacagacacaacggcaacatcatgctggacaagaagggccacatcatccacatcgacttcggcttcatgttcgagagcagccccggcggcaacctgggctgggagcccgacatcaagctgaccgacgagatggtgatgatcatgggcggcaagatggaggccacccccttcaagtggttcatggagatgtgcgtgagaggctacctggccgtgagaccctacatggacgccgtggtgagcctggtgaccctgatgctggacaccggcctgccctgcttcagaggccagaccatcaagctgctgaagcacagattcagccccaacatgaccgagagagaggccgccaacttcatcatgaaggtgatccagagctgcttcctgagcaacagaagcagaacctacgacatgatccagtactaccagaacgacatcccctactag

SEQ ID NO: 92985 - DNA, 264 bp, Artificial Sequence
  Description of Artificial Sequence: Synthetic coding sequence
atgtgccccgtggacttccacggcatcttccagctggacgagagaagaagagacgccgtgatcgccctgggcatcttcctgatcgagagcgacctgcagcacaaggactgcgtggtgccctacctgctgagactgctgaagggcctgcccaaggtgtactgggtggaggagagcaccgccagaaagggcagaggcgccctgcccgtggccgagagcttcagcttctgcctggtgaccctgctgagcgacgtggcctacagatag

SEQ ID NO: 92986 - DNA, 1959 bp, Artificial Sequence
  Description of Artificial Sequence: Synthetic coding sequence
atgagcggccagagcctgaccgacagaatcaccgccgcccagcacagcgtgaccggcagcgccgtgagcaagaccgtgtgcaaggccaccacccacgagatcatgggccccaagaagaagcacctggactacctgatccagtgcaccaacgagatgaacgtgaacatcccccagctggccgacagcctgttcgagagaaccaccaacagcagctgggtggtggtgttcaagagcctgatcaccacccaccacctgatggtgtacggcaacgagagattcatccagtacctggccagcagaaacaccctgttcaacctgagcaacttcctggacaagagcggcctgcagggctacgacatgagcaccttcatcagaagatacagcagatacctgaacgagaaggccgtgagctacagacaggtggccttcgacttcaccaaggtgaagagaggcgccgacggcgtgatgagaaccatgaacaccgagaagctgctgaagaccgtgcccatcatccagaaccagatggacgccctgctggacttcaacgtgaacagcaacgagctgaccaacggcgtgatcaacgccgccttcatgctgctgttcaaggacgccatcagactgttcgccgcctacaacgagggcatcatcaacctgctggagaagtacttcgacatgaagaagaaccagtgcaaggagggcctggacatctacaagaagttcctgaccagaatgaccagaatcagcgagttcctgaaggtggccgagcaggtgggcatcgacagaggcgacatccccgacctgagccaggcccccagcagcctgctggacgccctggagcagcacctggccagcctggagggcaagaagatcaaggacagcaccgccgccagcagagccaccaccctgagcaacgccgtgagcagcctggccagcaccggcctgagcctgaccaaggtggacgagagagagaagcaggccgccctggaggaggagcaggccagactgaaggccctgaaggagcagagactgaaggagctggccaagaagccccacaccagcctgaccaccgccgccagccccgtgagcaccagcgccggcggcatcatgaccgcccccgccatcgacatcttcagcacccccagcagcagcaacagcaccagcaagctgcccaacgacctgctggacctgcagcagcccaccttccaccccagcgtgcaccccatgagcaccgccagccaggtggccagcacctggggcgaccccttcagcgccaccgtggacgccgtggacgacgccatccccagcctgaaccccttcctgaccaagagcagcggcgacgtgcacctgagcatcagcagcgacgtgagcaccttcaccaccagaacccccacccacgagatgttcgtgggcttcacccccagccccgtggcccagccccaccccagcgccggcctgaacgtggacttcgagagcgtgttcggcaacaagagcaccaacgtgatcgtggacagcggcggcttcgacgagctgggcggcctgctgaagcccaccgtggccagccagaaccagaacctgcccgtggccaagctgccccccagcaagctggtgagcgacgacctggacagcagcctggccaacctggtgggcaacctgggcatcggcaacggcaccaccaagaacgacgtgaactggagccagcccggcgagaagaagctgaccggcggcagcaactggcagcccaaggtggcccccaccaccgcctggaacgccgccaccatggccccccccgtgatggcctaccccgccaccacccccaccggcatgatcggctacggcatccccccccagatgggcagcgtgcccgtgatgacccagcccaccctgatctacagccagcccgtgatgagaccccccaaccccttcggccccgtgagcggcgcccagatccagttcatgtag

SEQ ID NO: 92987 - DNA, 1959 bp, Artificial Sequence; identical to SEQ ID NO: 92986
  Description of Artificial Sequence: Synthetic coding sequence

SEQ ID NO: 92988 - DNA, 1938 bp, Artificial Sequence
  Description of Artificial Sequence: Synthetic coding sequence
atgagcggccagagcctgaccgacagaatcaccgccgcccagcacagcgtgaccggcagcgccgtgagcaagaccgtgtgcaaggccaccacccacgagatcatgggccccaagaagaagcacctggactacctgatccagtgcaccaacgagatgaacgtgaacatcccccagctggccgacagcctgttcgagagaaccaccaacagcagctgggtggtggtgttcaagagcctgatcaccacccaccacctgatggtgtacggcaacgagagattcatccagtacctggccagcagaaacaccctgttcaacctgagcaacttcctggacaagagcggcctgcagggctacgacatgagcaccttcatcagaagatacagcagatacctgaacgagaaggccgtgagctacagacaggtggccttcgacttcaccaaggtgaagagaggcgccgacggcgtgatgagaaccatgaacaccgagaagctgctgaagaccgtgcccatcatccagaaccagatggacgccctgctggacttcaacgtgaacagcaacgagctgaccaacggcgtgatcaacgccgccttcatgctgctgttcaaggacgccatcagactgttcgccgcctacaacgagggcatcatcaacctgctggagaagtacttcgacatgaagaagaaccagtgcaaggagggcctggacatctacaagaagttcctgaccagaatgaccagaatcagcgagttcctgaaggtggccgagcaggtgggcatcgacagaggcgacatccccgacctgagccaggcccccagcagcctgctggacgccctggagcagcacctggccagcctggagggcaagaagatcaaggacagcaccgccgccagcagagccaccaccctgagcaacgccgtgagcagcctggccagcaccggcctgagcctgaccaaggtggacgagagagagaagcaggccgccctggaggaggagcaggccagactgaaggccctgaaggagcagagactgaaggagctggccaagaagccccacaccagcctgaccaccgccgccagccccgtgagcaccagcgccggcggcatcatgaccgcccccgccatcgacatcttcagcacccccagcagcagcaacagcaccagcaagctgcccaacgacctgctggacctgcagcagcccaccttccaccccagcgtgcaccccatgagcaccgccagccaggtggccagcacctggggcgacgccgtggacgacgccatccccagcctgaaccccttcctgaccaagagcagcggcgacgtgcacctgagcatcagcagcgacgtgagcaccttcaccaccagaacccccacccacgagatgttcgtgggcttcacccccagccccgtggcccagccccaccccagcgccggcctgaacgtggacttcgagagcgtgttcggcaacaagagcaccaacgtgatcgtggacagcggcggcttcgacgagctgggcggcctgctgaagcccaccgtggccagccagaaccagaacctgcccgtggccaagctgccccccagcaagctggtgagcgacgacctggacagcagcctggccaacctggtgggcaacctgggcatcggcaacggcaccaccaagaacgacgtgaactggagccagcccggcgagaagaagctgaccggcggcagcaactggcagcccaaggtggcccccaccaccgcctggaacgccgccaccatggccccccccgtgatggcctaccccgccaccacccccaccggcatgatcggctacggcatccccccccagatgggcagcgtgcccgtgatgacccagcccaccctgatctacagccagcccgtgatgagaccccccaaccccttcggccccgtgagcggcgcccagatccagttcatgtag

SEQ ID NO: 92989 - DNA, 1833 bp, Artificial Sequence
  Description of Artificial Sequence: Synthetic coding sequence
atgagcggccagagcctgaccgacagaatcaccgccgcccagcacagcgtgaccggcagcgccgtgagcaagaccgtgtgcaaggccaccacccacgagatcatgggccccaagaagaagcacctggactacctgatccagtgcaccaacgagatgaacgtgaacatcccccagctggccgacagcctgttcgagagaaccaccaacagcagctgggtggtggtgttcaagagcctgatcaccacccaccacctgatggtgtacggcaacgagagattcatccagtacctggccagcagaaacaccctgttcaacctgagcaacttcctggacaagagcggcctgcagggctacgacatgagcaccttcatcagaagatacagcagatacctgaacgagaaggccgtgagctacagacaggtggccttcgacttcaccaaggtgaagagaggcgccgacggcgtgatgagaaccatgaacaccgagaagctgctgaagaccgtgcccatcatccagaaccagatggacgccctgctggacttcaacgtgaacagcaacgagctgaccaacggcgtgatcaacgccgccttcatgctgctgttcaaggacgccatcagactgttcgccgcctacaacgagggcatcatcaacctgctggagaagtacttcgacatgaagaagaaccagtgcaaggagggcctggacatctacaagaagttcctgaccagaatgaccagaatcagcgagttcctgaaggtggccgagcaggtgggcatcgacagaggcgacatccccgacctgagccaggcccccagcagcctgctggacgccctggagcagcacctggccagcctggagggcaagaagatcaaggacagcaccgccgccagcagagccaccaccctgagcaacgccgtgagcagcctggccagcaccggcctgagcctgaccaaggtggacgagagagagaagcaggccgccctggaggaggagcaggccagactgaaggccctgaaggagcagagactgaaggagctggccaagaagccccacaccagcctgaccaccgccgccagccccgtgagcaccagcgccggcggcatcatgaccgcccccgccatcgacatcttcagcacccccagcagcagcaacagcaccagcaagctgcccaacgacctgctggacctgcagcagcccaccttccaccccagcgtgcaccccatgagcaccgccagccaggtggccagcacctggggcggcttcacccccagccccgtggcccagccccaccccagcgccggcctgaacgtggacttcgagagcgtgttcggcaacaagagcaccaacgtgatcgtggacagcggcggcttcgacgagctgggcggcctgctgaagcccaccgtggccagccagaaccagaacctgcccgtggccaagctgccccccagcaagctggtgagcgacgacctggacagcagcctggccaacctggtgggcaacctgggcatcggcaacggcaccaccaagaacgacgtgaactggagccagcccggcgagaagaagctgaccggcggcagcaactggcagcccaaggtggcccccaccaccgcctggaacgccgccaccatgaacggcatgcacttcccccagtacgccccccccgtgatggcctaccccgccaccacccccaccggcatgatcggctacggcatccccccccagatgggcagcgtgcccgtgatgacccagcccaccctgatctacagccagcccgtgatgagaccccccaaccccttcggccccgtgagcggcgcccagatccagttcatgtag

SEQ ID NO: 92990 - DNA, 1656 bp, Artificial Sequence
  Description of Artificial Sequence: Synthetic coding sequence
atgaacgtgaacatcccccagctggccgacagcctgttcgagagaaccaccaacagcagctgggtggtggtgttcaagagcctgatcaccacccaccacctgatggtgtacggcaacgagagattcatccagtacctggccagcagaaacaccctgttcaacctgagcaacttcctggacaagagcggcctgcagggctacgacatgagcaccttcatcagaagatacagcagatacctgaacgagaaggccgtgagctacagacaggtggccttcgacttcaccaaggtgaagagaggcgccgacggcgtgatgagaaccatgaacaccgagaagctgctgaagaccgtgcccatcatccagaaccagatggacgccctgctggacttcaacgtgaacagcaacgagctgaccaacggcgtgatcaacgccgccttcatgctgctgttcaaggacgccatcagactgttcgccgcctacaacgagggcatcatcaacctgctggagaagtacttcgacatgaagaagaaccagtgcaaggagggcctggacatctacaagaagttcctgaccagaatgaccagaatcagcgagttcctgaaggtggccgagcaggtgggcatcgacagaggcgacatccccgacctgagccaggcccccagcagcctgctggacgccctggagcagcacctggccagcctggagggcaagaagatcaaggacagcaccgccgccagcagagccaccaccctgagcaacgccgtgagcagcctggccagcaccggcctgagcctgaccaaggtggacgagagagagaagcaggccgccctggaggaggagcaggccagactgaaggccctgaaggagcagagactgaaggagctggccaagaagccccacaccagcctgaccaccgccgccagccccgtgagcaccagcgccggcggcatcatgaccgcccccgccatcgacatcttcagcacccccagcagcagcaacagcaccagcaagctgcccaacgacctgctggacctgcagcagcccaccttccaccccagcgtgcaccccatgagcaccgccagccaggtggccagcacctggggcggcttcacccccagccccgtggcccagccccaccccagcgccggcctgaacgtggacttcgagagcgtgttcggcaacaagagcaccaacgtgatcgtggacagcggcggcttcgacgagctgggcggcctgctgaagcccaccgtggccagccagaaccagaacctgcccgtggccaagctgccccccagcaagctggtgagcgacgacctggacagcagcctggccaacctggtgggcaacctgggcatcggcaacggcaccaccaagaacgacgtgaactggagccagcccggcgagaagaagctgaccggcggcagcaactggcagcccaaggtggcccccaccaccgcctggaacgccgccaccatggccccccccgtgatggcctaccccgccaccacccccaccggcatgatcggctacggcatccccccccagatgggcagcgtgcccgtgatgacccagcccaccctgatctacagccagcccgtgatgagaccccccaaccccttcggccccgtgagcggcgcccagatccagttcatgtag

SEQ ID NO: 92991 - DNA, 1455 bp, Artificial Sequence
  Description of Artificial Sequence: Synthetic coding sequence
atggcctgcagaggcggcgccggcaacggccacagagccagcgccaccctgagcagagtgagccccggcagcctgtacacctgcagaaccagaacccacaacatctgcatggtgagcgacttcttctaccccaacatgggcggcgtggagagccacatctaccagctgagccagtgcctgatcgagagaggccacaaggtgatcatcgtgacccacgcctacggcaacagaaagggcatcagatacctgaccagcggcctgaaggtgtactacctgcccctgaaggtgatgtacaaccagagcaccgccaccaccctgttccacagcctgcccctgctgagatacatcttcgtgagagagagagtgaccatcatccacagccacagcagcttcagcgccatggcccacgacgccctgttccacgccaagaccatgggcctgcagaccgtgttcaccgaccacagcctgttcggcttcgccgacgtgagcagcgtgctgaccaacaagctgctgaccgtgagcctgtgcgacaccaaccacatcatctgcgtgagctacaccagcaaggagaacaccgtgctgagagccgccctgaaccccgagatcgtgagcgtgatccccaacgccgtggaccccaccgacttcacccccgaccccttcagaagacacgacagcatcaccatcgtggtggtgagcagactggtgtacagaaagggcatcgacctgctgagcggcatcatccccgagctgtgccagaagtaccccgacctgaacttcatcatcggcggcgagggccccaagagaatcatcctggaggaggtgagagagagataccagctgcacgacagagtgagactgctgggcgccctggagcacaaggacgtgagaaacgtgctggtgcagggccacatcttcctgaacaccagcctgaccgaggccttctgcatggccatcgtggaggccgccagctgcggcctgcaggtggtgagcaccagagtgggcggcatccccgaggtgctgcccgagaacctgatcatcctgtgcgagcccagcgtgaagagcctgtgcgagggcctggagaaggccatcttccagctgaagagcggcaccctgcccgcccccgagaacatccacaacatcgtgaagaccttctacacctggagaaacgtggccgagagaaccgagaaggtgtacgacagagtgagcgtggaggccgtgctgcccatggacaagagactggacagactgatcagccactgcggccccgtgaccggctacatcttcgccctgctggccgtgttcaacttcctgttcctgatcttcctgagatggatgacccccgacagcatcatcgacgtggccatcgacgccaccggccccagaggcgcctggaccaacaactacagccacagcaagagaggcggcgagaacaacgagatcagcgagaccagatag

SEQ ID NO: 92992 - DNA, 510 bp, Artificial Sequence
  Description of Artificial Sequence: Synthetic coding sequence
atggccatcgtggaggccgccagctgcggcctgcaggtggtgagcaccagagtgggcggcatccccgaggtgctgcccgagaacctgatcatcctgtgcgagcccagcgtgaagagcctgtgcgagggcctggagaaggccatcttccagctgaagagcggcaccctgcccgcccccgagaacatccacaacatcgtgaagaccttctacacctggagaaacgtggccgagagaaccgagaaggtgtacgacagagtgagcgtggaggccgtgctgcccatggacaagagactggacagactgatcagccactgcggccccgtgaccggctacatcttcgccctgctggccgtgttcaacttcctgttcctgatcttcctgagatggatgacccccgacagcatcatcgacgtggccatcgacgccaccggccccagaggcgcctggaccaacaactacagccacagcaagagaggcggcgagaacaacgagatcagcgagaccagatag

SEQ ID NO: 92993 - DNA, 753 bp, Artificial Sequence
  Description of Artificial Sequence: Synthetic coding sequence
atggagctgaccggcatcgacctgctgagcggcatcatccccgagctgtgccagaagtaccccgacctgaacttcatcatcggcggcgagggccccaagagaatcatcctggaggaggtgagagagagataccagctgcacgacagagtgagactgctgggcgccctggagcacaaggacgtgagaaacgtgctggtgcagggccacatcttcctgaacaccagcctgaccgaggccttctgcatggccatcgtggaggccgccagctgcggcctgcaggtggtgagcaccagagtgggcggcatccccgaggtgctgcccgagaacctgatcatcctgtgcgagcccagcgtgaagagcctgtgcgagggcctggagaaggccatcttccagctgaagagcggcaccctgcccgcccccgagaacatccacaacatcgtgaagaccttctacacctggagaaacgtggccgagagaaccgagaaggtgtacgacagagtgagcgtggaggccgtgctgcccatggacaagagactggacagactgatcagccactgcggccccgtgaccggctacatcttcgccctgctggccgtgttcaacttcctgttcctgatcttcctgagatggatgacccccgacagcatcatcgacgtggccatcgacgccaccggccccagaggcgcctggaccaacaactacagccacagcaagagaggcggcgagaacaacgagatcagcgagaccagatag

SEQ ID NO: 92994 - DNA, 1665 bp, Artificial Sequence
  Description of Artificial Sequence: Synthetic coding sequence
atgagaagacccctgagcaagtgcggcatggagcccggcggcggcgacgccagcctgaccctgcacggcctgcagaacagaagccacggcaagatcaagctgagaaagagaaagagcaccctgtacttcaacacccaggagaagagcgccagaagaagaggcgacctgctgggcgagaacatctacctgctgctgttcaccatcgccctgagaatcctgaactgcttcctggtgcagaccagcttcgtgcccgacgagtactggcagagcctggaggtgagccaccacatggtgttcaactacggctacctgacctgggagtggaccgagagactgagaagctacacctaccccctgatcttcgccagcatctacaagatcctgcacctgctgggcaaggacagcgtgcagctgctgatctggatccccagactggcccaggccctgctgagcgccgtggccgacgtgagactgtacagcctgatgaagcagctggagaaccaggaggtggccagatgggtgttcttctgccagctgtgcagctggttcacctggtactgctgcaccagaaccctgaccaacaccatggagaccgtgctgaccatcatcgccctgttctactaccccctggagggcagcaagagcatgaacagcgtgaagtacagcagcctggtggccctggccttcatcatcagacccaccgccgtgatcctgtggacccccctgctgttcagacacttctgccaggagcccagaaagctggacctgatcctgcaccacttcctgcccgtgggcttcgtgaccctgagcctgagcctgatgatcgacagaatcttcttcggccagtggaccctggtgcagttcaacttcctgaagttcaacgtgctgcagaactggggcaccttctacggcagccacccctggcactggtacttcagccagggcttccccgtgatcctgggcacccacctgcccttcttcatccacggctgctacctggcccccaagagatacagaatcctgctggtgaccgtgctgtggaccctgctggtgtacagcatgctgagccacaaggagttcagattcatctaccccgtgctgcccttctgcatggtgttctgcggctacagcctgacccacctgaagacctggaagaagcccgccctgagcttcctgttcctgagcaacctgttcctggccctgtacaccggcctggtgcaccagagaggcaccctggacgtgatgagccacatccagaaggtgtgctacaacaaccccaacaagagcagcgccagcatcttcatcatgatgccctgccacagcaccccctactacagccacgtgcactgccccctgcccatgagattcctgcagtgcccccccgacctgaccggcaagagccactacctggacgaggccgacgtgttctacctgaaccccctgaactggctgcacagagagttccacgacgacgccagcctgcccacccacctgatcaccttcagcatcctggaggaggagatcagcgccttcctgatcagcagcaactacaagagaaccgccgtgttcttccacacccacctgcccgagggcagaatcggcagccacatctacgtgtacgagagaaagctgaagggcaagttcaacatgaagatgaagttctag

SEQ ID NO: 92995 - DNA, 1080 bp, Artificial Sequence
  Description of Artificial Sequence: Synthetic coding sequence
atggagaccgtgctgaccatcatcgccctgttctactaccccctggagggcagcaagagcatgaacagcgtgaagtacagcagcctggtggccctggccttcatcatcagacccaccgccgtgatcctgtggacccccctgctgttcagacacttctgccaggagcccagaaagctggacctgatcctgcaccacttcctgcccgtgggcttcgtgaccctgagcctgagcctgatgatcgacagaatcttcttcggccagtggaccctggtgcagttcaacttcctgaagttcaacgtgctgcagaactggggcaccttctacggcagccacccctggcactggtacttcagccagggcttccccgtgatcctgggcacccacctgcccttcttcatccacggctgctacctggcccccaagagatacagaatcctgctggtgaccgtgctgtggaccctgctggtgtacagcatgctgagccacaaggagttcagattcatctaccccgtgctgcccttctgcatggtgttctgcggctacagcctgacccacctgaagacctggaagaagcccgccctgagcttcctgttcctgagcaacctgttcctggccctgtacaccggcctggtgcaccagagaggcaccctggacgtgatgagccacatccagaaggtgtgctacaacaaccccaacaagagcagcgccagcatcttcatcatgatgccctgccacagcaccccctactacagccacgtgcactgccccctgcccatgagattcctgcagtgcccccccgacctgaccggcaagagccactacctggacgaggccgacgtgttctacctgaaccccctgaactggctgcacagagagttccacgacgacgccagcctgcccacccacctgatcaccttcagcatcctggaggaggagatcagcgccttcctgatcagcagcaactacaagagaaccgccgtgttcttccacacccacctgcccgagggcagaatcggcagccacatctacgtgtacgagagaaagctgaagggcaagttcaacatgaagatgaagttctag

SEQ ID NO: 92996 - DNA, 894 bp, Artificial Sequence
  Description of Artificial Sequence: Synthetic coding sequence
atgtacgcccagcccgtgaccaacaccaaggaggtgaagtggcagaaggtgctgtacgagagacagcccttccccgacaactacgtggacagaagattcctggaggagctgagaaagaacatccacgccagaaagtaccagtactgggccgtggtgttcgagagcagcgtggtgatccagcagctgtgcagcgtgtgcgtgttcgtggtgatctggtggtacatggacgagggcctgctggccccccactggctgctgggcaccggcctggccagcagcctgatcggctacgtgctgttcgacctgatcgacggcggcgagggcagaaagaagagcggccagaccagatgggccgacctgaagagcgccctggtgttcatcaccttcacctacggcttcagccccgtgctgaagaccctgaccgagagcgtgagcaccgacaccatctacgccatgagcgtgttcatgctgctgggccacctgatcttcttcgactacggcgccaacgccgccatcgtgagcagcaccctgagcctgaacatggccatcttcgccagcgtgtgcctggccagcagactgcccagaagcctgcacgccttcatcatggtgaccttcgccatccagatcttcgccctgtggcccatgctgcagaagaagctgaaggcctgcacccccagaagctacgtgggcgtgaccctgctgttcgccttcagcgccgtgggcggcctgctgagcatcagcgccgtgggcgccgtgctgttcgccctgctgctgatgagcatcagctgcctgtgccccttctacctgatcagactgcagctgttcaaggagaacatccacggcccctgggacgaggccgagatcaaggaggacctgagcagattcctgagctag

SEQ ID NO: 92997 - DNA, 894 bp, Artificial Sequence; identical to SEQ ID NO: 92996
  Description of Artificial Sequence: Synthetic coding sequence

SEQ ID NO: 92998 - DNA, 894 bp, Artificial Sequence; identical to SEQ ID NO: 92996
  Description of Artificial Sequence: Synthetic coding sequence

SEQ ID NO: 92999 - DNA, 660 bp, Artificial Sequence
  Description of Artificial Sequence: Synthetic coding sequence
atgaaggacaacgacatcaagagactgctgtacacccacctgctgtgcatcttcagcatcatcctgagcgtgttcatccccagcctgttcctggagaacttcagcatcctggagacccacctgacctggctgtgcatctgcagcggcttcgtgaccgccgtgaacctggtgctgtacctggtggtgaagcccaacaccagcagcaagagaagcagcctgagccacaaggtgaccggcttcctgaagtgctgcatctacttcctgatgagctgcttcagcttccacgtgatcttcgtgctgtacggcgcccccctgatcgagctggccctggagaccttcctgttcgccgtgatcctgagcaccttcaccaccgtgccctgcctgtgcctgctgggccccaacctgaaggcctggctgagagtgttcagcagaaacggcgtgaccagcatctgggagaacagcctgcagatcaccaccatcagcagcttcgtgggcgcctggctgggcgccctgcccatccccctggactgggagagaccctggcaggtgtggcccatcagctgcaccctgggcgccaccttcggctacgtggccggcctggtgatcagccccctgtggatctactggaacagaaagcagctgacctacaagaacaactag

SEQ ID NO: 93000 - DNA, 621 bp, Artificial Sequence
  Description of Artificial Sequence: Synthetic coding sequence
atgaaggacaacgacatcaagagactgctgtacacccacctgctgtgcatcttcagcatcatcctgagcgtgttcatccccagcctgttcctggagaacttcagcatcctggagacccacctgacctggctgtgcatctgcagcggcttcgtgaccgccgtgaacctggtgctgtacctggtggtgaagcccaacaccagcagcaagagaagcagcctgagccacaaggtgaccggcttcctgaagtgctgcatctacttcctgatgagctgcttcagcttccacgtgatcttcgtgctgtacggcgcccccctgatcgagctggccctggagaccttcctgttcgccgtgatcctgagcaccttcaccaccgtgccctgcctgtgcctgctgggccccaacctgaaggcctggctgagagtgttcagcagaaacggcgtgaccagcatctgggagaacagcctgcagatcaccaccatcagcagcttcgtgggcgcctggctgggcgccctgcccatccccctggactgggagagaccctggcagatgaccgtggagagaaagagaagcacctacagaagcctgcacgtgccctgcagaggcctgggcaccgtgaagtag

SEQ ID NO: 93001 - DNA, 150 bp, Artificial Sequence
  Description of Artificial Sequence: Synthetic coding sequence
atgaaggacaacgacatcaagagactgctgtacacccacctgctgtgcatcttcagcatcatcctgagcgtgttcatccccagcctgttcctggagaacttcagcatcctggagacccacctgacctggctgtgcatctgcagcggctag

SEQ ID NO: 93002 - DNA, 999 bp, Artificial Sequence
  Description of Artificial Sequence: Synthetic coding sequence
atggccgtgaccgacagcctgagcagagccgccaccgtgctggccaccgtgctgctgctgagcttcggcagcgtggccgccagccacatcgaggaccaggccgagcagttcttcagaagcggccacaccaacaactgggccgtgctggtgtgcaccagcagattctggttcaactacagacacgtggccaacaccctgagcgtgtacagaagcgtgaagagactgggcatccccgacagccacatcgtgctgatgctggccgacgacatggcctgcaaccccagaaaccccaagcccgccaccgtgttcagccacaagaacatggagctgaacgtgtacggcgacgacgtggaggtggactacagaagctacgaggtgaccgtggagaacttcctgagagtgctgaccggcagaatcccccccagcacccccagaagcaagagactgctgagcgacgacagaagcaacatcctgatctacatgaccggccacggcggcaacggcttcctgaagttccaggacagcgaggagatcaccaacatcgagctggccgacgccttcgagcagatgtggcagaagagaagatacaacgagctgctgttcatcatcgacacctgccagggcgccagcatgtacgagagattctacagccccaacatcatggccctggccagcagccaggtgggcgaggacagcctgagccaccagcccgaccccgccatcggcgtgcacctgatggacagatacaccttctacgtgctggagttcctggaggagatcaaccccgccagccagaccaacatgaacgacctgttccaggtgtgccccaagagcctgtgcgtgagcacccccggccacagaaccgacctgttccagagagaccccaagaacgtgctgatcaccgacttcttcggcagcgtgagaaaggtggagatcaccaccgagaccatcaagctgcagcaggacagcgagatcatggagagcagatacagcagctag

SEQ ID NO: 93003 - DNA, 1188 bp, Artificial Sequence
  Description of Artificial Sequence: Synthetic coding sequence
atggccgtgaccgacagcctgagcagagccgccaccgtgctggccaccgtgctgctgctgagcttcggcagcgtggccgccagccacatcgaggaccaggccgagcagttcttcagaagcggccacaccaacaactgggccgtgctggtgtgcaccagcagattctggttcaactacagacacgtggccaacaccctgagcgtgtacagaagcgtgaagagactgggcatccccgacagccacatcgtgctgatgctggccgacgacatggcctgcaaccccagaaaccccaagcccgccaccgtgttcagccacaagaacatggagctgaacgtgtacggcgacgacgtggaggtggactacagaagctacgaggtgaccgtggagaacttcctgagagtgctgaccggcagaatcccccccagcacccccagaagcaagagactgctgagcgacgacagaagcaacatcctgatctacatgaccggccacggcggcaacggcttcctgaagttccaggacagcgaggagatcaccaacatcgagctggccgacgccttcgagcagatgtggcagaagagaagatacaacgagctgctgttcatcatcgacacctgccagggcgccagcatgtacgagagattctacagccccaacatcatggccctggccagcagccaggtgggcgaggacagcctgagccaccagcccgaccccgccatcggcgtgcacctgatggacagatacaccttctacgtgctggagttcctggaggagatcaaccccgccagccagaccaacatgaacgacctgttccaggtgtgccccaagagcctgtgcgtgagcacccccggccacagaaccgacctgttccagagagaccccaagaacgtgctgatcaccgacttcttcggcagcgtgagaaaggtggagatcaccaccgagaccatcaagctgcagcaggacagcgagatcatggagagcagctacaaggaggaccagatggacgagaagctgatggagcccctgaagtacgccgagcagctgcccgtggcccagatcatccaccagaagcccaagctgaaggactggcacccccccggcggcttcatcctgggcctgtgggccctgatcatcatggtgttcttcaagacctacggcatcaagcacatgaagttcatcttctag

SEQ ID NO: 93004 - DNA, 960 bp, Artificial Sequence
  Description of Artificial Sequence: Synthetic coding sequence
atggccgtgaccgacagcctgagcagagccgccaccgtgctggccaccgtgctgctgctgagcttcggcagcgtggccgccagccacatcgaggaccaggccgagcagttcttcagaagcggccacaccaacaactgggccgtgctggtgaccgtggagaacttcctgagagtgctgaccggcagaatcccccccagcacccccagaagcaagagactgctgagcgacgacagaagcaacatcctgatctacatgaccggccacggcggcaacggcttcctgaagttccaggacagcgaggagatcaccaacatcgagctggccgacgccttcgagcagatgtggcagaagagaagatacaacgagctgctgttcatcatcgacacctgccagggcgccagcatgtacgagagattctacagccccaacatcatggccctggccagcagccaggtgggcgaggacagcctgagccaccagcccgaccccgccatcggcgtgcacctgatggacagatacaccttctacgtgctggagttcctggaggagatcaaccccgccagccagaccaacatgaacgacctgttccaggtgtgccccaagagcctgtgcgtgagcacccccggccacagaaccgacctgttccagagagaccccaagaacgtgctgatcaccgacttcttcggcagcgtgagaaaggtggagatcaccaccgagaccatcaagctgcagcaggacagcgagatcatggagagcagctacaaggaggaccagatggacgagaagctgatggagcccctgaagtacgccgagcagctgcccgtggcccagatcatccaccagaagcccaagctgaaggactggcacccccccggcggcttcatcctgggcctgtgggccctgatcatcatggtgttcttcaagacctacggcatcaagcacatgaagttcatcttctag

SEQ ID NO: 93005 - DNA, 906 bp, Artificial Sequence
  Description of Artificial Sequence: Synthetic coding sequence
atggccgtgaccgacagcctgagcagagccgccaccgtgctggccaccgtgctgctgctgagcttcggcagcgtggccgccagccacatcgaggtgaccgtggagaacttcctgagagtgctgaccggcagaatcccccccagcacccccagaagcaagagactgctgagcgacgacagaagcaacatcctgatctacatgaccggccacggcggcaacggcttcctgaagttccaggacagcgaggagatcaccaacatcgagctggccgacgccttcgagcagatgtggcagaagagaagatacaacgagctgctgttcatcatcgacacctgccagggcgccagcatgtacgagagattctacagccccaacatcatggccctggccagcagccaggtgggcgaggacagcctgagccaccagcccgaccccgccatcggcgtgcacctgatggacagatacaccttctacgtgctggagttcctggaggagatcaaccccgccagccagaccaacatgaacgacctgttccaggtgtgccccaagagcctgtgcgtgagcacccccggccacagaaccgacctgttccagagagaccccaagaacgtgctgatcaccgacttcttcggcagcgtgagaaaggtggagatcaccaccgagaccatcaagctgcagcaggacagcgagatcatggagagcagctacaaggaggaccagatggacgagaagctgatggagcccctgaagtacgccgagcagctgcccgtggcccagatcatccaccagaagcccaagctgaaggactggcacccccccggcggcttcatcctgggcctgtgggccctgatcatcatggtgttcttcaagacctacggcatcaagcacatgaagttcatcttctag

SEQ ID NO: 93006 - DNA, 558 bp, Artificial Sequence
  Description of Artificial Sequence: Synthetic coding sequence
atgggcaagaagcagaacaagaagaaggtggaggaggtgctggaggaggaggaggaggagtacgtggtggagaaggtgctggacagaagagtggtgaagggcaaggtggagtacctgctgaagtggaagggcttcagcgacgaggacaacacctgggagcccgaggagaacctggactgccccgacctgatcgccgagttcctgcagagccagaagaccgcccacgagaccgacaagagcgagggcggcaagagaaaggccgacagcgacagcgaggacaagggcgaggagagcaagcccaagaagaagaaggaggagagcgagaagcccagaggcttcgccagaggcctggagcccgagagaatcatcggcgccaccgacagcagcggcgagctgatgttcctgatgaagtggaagaacagcgacgaggccgacctggtgcccgccaaggaggccaacgtgaagtgcccccaggtggtgatcagcttctacgaggagagactgacctggcacagctaccccagcgaggacgacgacaagaaggacgacaagaactag

SEQ ID NO: 93007 - DNA, 735 bp, Artificial Sequence
  Description of Artificial Sequence: Synthetic coding sequence
atggaggccatgtggctgctgtgcgtggccctggccgtgctggcctggggcttcctgtgggtgtgggacagcagcgagagaatgaagagcagagagcagggcggcagactgggcgccgagagcagaaccctgctggtgatcgcccaccccgacgacgaggccatgttcttcgcccccaccgtgctgggcctggccagactgagacactgggtgtacctgctgtgcttcagcgccggcaactactacaaccagggcgagaccagaaagaaggagctgctgcagagctgcgacgtgctgggcatccccctgagcagcgtgatgatcatcgacaacagagacttccccgacgaccccggcatgcagtgggacaccgagcacgtggccagagtgctgctgcagcacatcgaggtgaacggcatcaacctggtggtgaccttcgacgccggcggcgtgagcggccacagcaaccacatcgccctgtacgccgccgtgagagtgctgtgcgcccacgccagcgtgtgcgagtgcgccgcccaggtgcacctgcccagcggcagcgccctggtgagcgccagctacgccggctgccccctgagagcccagcagcagagaagcggcaccggccaggagagccacgtgctgcccccccagcccgcccccctggtgcccccccccctgcactacctgctgcccgtgcacgagaaccagctgaccgagctgcccctgaagccctag

SEQ ID NO: 93008 - DNA, 1272 bp, Artificial Sequence
  Description of Artificial Sequence: Synthetic coding sequence
atgggcagcaccaagcactggggcgagtggctgctgaacctgaaggtggcccccgccggcgtgttcggcgtggccttcctggccagagtggccctggtgttctacggcgtgttccaggacagaaccctgcacgtgagatacaccgacatcgactaccaggtgttcaccgacgccgccagattcgtgaccgagggcagaagcccctacctgagagccacctacagatacacccccctgctgggctggctgctgacccccaacatctacctgagcgagctgttcggcaagttcctgttcatcagctgcgacctgctgaccgccttcctgctgtacagactgctgctgctgaagggcctgggcagaagacaggcctgcggctactgcgtgttctggctgctgaaccccctgcccatggccgtgagcagcagaggcaacgccgacagcatcgtggccagcctggtgctgatggtgctgtacctgatcaagaagagactggtggcctgcgccgccgtgttctacggcttcgccgtgcacatgaagatctaccccgtgacctacatcctgcccatcaccctgcacctgctgcccgacagagacaacgacaagagcctgagacagttcagatacaccttccaggcctgcctgtacgagctgctgaagagactgtgcaacagagccgtgctgctgttcgtggccgtggccggcctgaccttcttcgccctgagcttcggcttctactacgagtacggctgggagttcctggagcacacctacttctaccacctgaccagaagagacatcagacacaacttcagcccctacttctacatgctgtacctgaccgccgagagcaagtggagcttcagcctgggcatcgccgccttcctgccccagctgatcctgctgagcgccgtgagcttcgcctactacagagacctggtgttctgctgcttcctgcacaccagcatcttcgtgaccttcaacaaggtgtgcaccagccagtacttcctgtggtacctgtgcctgctgcccctggtgatgcccctggtgagaatgccctggaagagagccgtggtgctgctgatgctgtggttcatcggccaggccatgtggctggcccccgcctacgtgctggagttccagggcaagaacaccttcctgttcatctggctggccggcctgttcttcctgctgatcaactgcagcatcctgatccagatcatcagccactacaaggaggagcccctgaccgagagaatcaagtacgactag

SEQ ID NO: 93009 - DNA, 2796 bp, Artificial Sequence
  Description of Artificial Sequence: Synthetic coding sequence
atgctgctgttcttcaccctgggcctgctgatccacttcgtgttcttcgccagcatcttcgacatctacttcaccagccccctggtgcacggcatgaccccccagttcacccccctgcccccccccgccagaagactggtgctgttcgtggccgacggcctgagagccgacgccctgtacgagctggacgagaacggcaacagcagagcccccttcatcagaaacatcatcatgcacgagggcagctggggcatcagccacaccagagtgcccaccgagagcagacccggccacgtggccctgatcgccggcttctacgaggacgtgagcgccgtggccaagggctggaaggagaaccccgtggagttcgacagcctgttcaacgagagcaagtacacctggagctggggcagccccgacatcctgcccatgttcgccaagggcgccagcggcgaccacgtgtacacctacagctacgacgccaagagagaggacttcggcgcccaggacgccaccaagctggacacctgggtgttcgacaacgtgaaggacttcttccaccacgccagaaacaaccagagcctgttcagcaagatcaacgaggagaagatcgtgttcttcctgcacctgctgggcatcgacaccaacggccacgcccacagacccagcagcagagactacaagcacaacatcaagaaggtggacgacggcgtgaaggagatcgtgagcatgttcaaccacttctacggcaacgacggcaagaccaccttcatcttcaccagcgaccacggcatgaccgactggggcagccacggcgccggccaccccagcgagaccctgacccccctggtgacctggggcgccggcatcaagtacccccagagagtgagcgcccagcagttcgacgacgccttcctgaaggagtggagactggagaactggaagagactggacgtgaaccaggccgacatcgcccccctgatgaccagcctgatcggcgtgcccttccccctgaacagcgtgggcatcctgcccgtggactacctgaacaacaccgacctgttcaaggccgagagcatgttcaccaacgccgtgcagatcctggagcagttcaaggtgaagatgacccagaagaaggaggtgaccctgcccttcctgttcacccccttcaagctgctgagcgacagcaagcagttcaacatcctgagaaaggccagaagctacatcaagcacagaaagttcgacgaggtggtgagcctgtgcaaggagctgatccacctggccctgaagggcctgagctactaccacacctacgacagattcttcctgggcgtgaacgtggtgatcggcttcgtgggctggatcagctacgccagcctgctgatcatcaagagccacagcaacctgatcaagggcgtgagcaaggaggtgaagaagcccagccacctgctgccctgcagcttcgtggccatcggcatcctggtggccttcttcctgctgatccaggcctgcccctggacctactacgtgtacggcctgctgcccctgcccatctggtacgccgtgctgagagagttccaggtgatccaggacctggtggtgagcgtgctgacctaccccctgagccacttcgtgggctacctgctggccttcaccctgggcatcgaggtgctggtgctgagcttcttctacagatacatgctgaccgccggcctgaccgccttcgccgcctggcccttcctgaccagactgtggaccagagccaagatgaccagcctgagctggaccttcttcagcctgctgctggccgtgttccccctgatgcccgtggtgggcagaaagcccgacatcagcctggtgatgggcgccggcctgctggtgctgctgctgagcctgtgcgtggtgaccagcctgatgaagagaaaggacagcttcatcaaggaggagctgctggtgcacctgctgcaggtgctgagcaccgtgctgagcatgtacgtggtgtacagcacccagagcagcctgctgagaaagcagggcctgcccctgatgaaccagatcatcagctgggccaccctggccagcagcctggtggtgcccctgctgagcagccccgtgctgttccagagactgttcagcatcctgctgagcctgatgagcacctacctgctgctgagcaccggctacgaggccctgttccccctggtgctgagctgcctgatgttcgtgtggatcaacatcgagcaggagaccctgcagcagagcggcgtgtgctgcaagcagaagctgaccagcatccagttcagctacaacaccgacatcacccagttcagacagctgtacctggacgacatcagaagagccttcttcctggtgttcttcctggtgaccgccttcttcggcaccggcaacatcgccagcatcaacagcttcgacctggccagcgtgtactgcttcctgaccgtgttcagccccttcatgatgggcgccctgatgatgtggaagatcctgatccccttcgtgctggtgatgtgcgccttcgaggccgtgcagctgaccacccagctgagcagcaagagcctgttcctgatcgtgctggtgatcagcgacatcatggccctgcacttcttcttcctggtgaaggactacggcagctggctggacatcggcaccagcatcagccactacgtgatcgtgatgagcatgaccatcttcctggtgttcctgaacggcctggcccagctgctgaccaccaagaagctgagactgtgcggcaagcccaagagccacttcatgtag

SEQ ID NO: 93010 - DNA, 2796 bp, Artificial Sequence; identical to SEQ ID NO: 93009
  Description of Artificial Sequence: Synthetic coding sequence

SEQ ID NO: 93011 - DNA, 405 bp, Artificial Sequence
  Description of Artificial Sequence: Synthetic coding sequence
atggtggagaacagccccagccccctgcccgagagagccatctacggcttcgtgctgttcctgagcagccagttcggcttcatcctgtacctggtgtgggccttcatccccgagagctggctgaacagcctgggcctgacctactggccccagaagtactgggccgtggccctgcccgtgtacctgctgatcgccatcgtgatcggctacgtgctgctgttcggcatcaacatgatgagcaccagccccctggacagcatccacaccatcaccgacaactacgccaagaaccagcagcagaagaagtaccaggaggaggccatccccgccctgagagacatcagcatcagcgaggtgaaccagatgttcttcctggccgccaaggagctgtacaccaagaactag

SEQ ID NO: 93012 - DNA, 327 bp, Artificial Sequence
  Description of Artificial Sequence: Synthetic coding sequence
atggtgctgtacctggtgtgggccttcatccccgagagctggctgaacagcctgggcctgacctactggccccagaagtactgggccgtggccctgcccgtgtacctgctgatcgccatcgtgatcggctacgtgctgctgttcggcatcaacatgatgagcaccagccccctggacagcatccacaccatcaccgacaactacgccaagaaccagcagcagaagaagtaccaggaggaggccatccccgccctgagagacatcagcatcagcgaggtgaaccagatgttcttcctggccgccaaggagctgtacaccaagaactag

SEQ ID NO: 93013 - DNA, 405 bp, Artificial Sequence; identical to SEQ ID NO: 93011
  Description of Artificial Sequence: Synthetic coding sequence

SEQ ID NO: 93014 - DNA, 405 bp, Artificial Sequence; identical to SEQ ID NO: 93011
  Description of Artificial Sequence: Synthetic coding sequence

SEQ ID NO: 93015 - DNA, 78 bp, Artificial Sequence
  Description of Artificial Sequence: Synthetic coding sequence
atggtgctgtacctggtgtgggccttcatccccgagagctggctgaacagcctgggcctgacctactggccccagtag

SEQ ID NO: 93016 - DNA, 477 bp, Artificial Sequence
  Description of Artificial Sequence: Synthetic coding sequence
atggtgcccagaagcaccagcctggccctgatcgtgttcctgttccacagactgagcaaggcccccggcaagatggtggagaacagccccagccccctgcccgagagagccatctacggcttcgtgctgttcctgagcagccagttcggcttcatcctgtacctggtgtgggccttcatccccgagagctggctgaacagcctgggcctgacctactggccccagaagtactgggccgtggccctgcccgtgtacctgctgatcgccatcgtgatcggctacgtgctgctgttcggcatcaacatgatgagcaccagccccctggacagcatccacaccatcaccgacaactacgccaagaaccagcagcagaagaagtaccaggaggaggccatccccgccctgagagacatcagcatcagcgaggtgaaccagatgttcttcctggccgccaaggagctgtacaccaagaactag

SEQ ID NO: 93017 - DNA, 1848 bp, Artificial Sequence
  Description of Artificial Sequence: Synthetic coding sequence
atggccagagcctgcctgatccagagactgcccatcaagagagactgcacccccgtgttcgtgagaggcctgagcagccccagcgccgccatggccctgctgagcgagggcctggacgaggtgcccgccgcctgcctgagcccctgcggcccccccaaccccaccgagctgttcagcgagagcagaagactggccctggaggagctggtggccggcggccccgaggccttcgccgccttcctgagaagagagagactggccagattcctgaaccccgacgaggtgcacgccatcctgagagccgccgagagacccggcgaggagggcgccgccgccgccgccgccgccgaggacagcttcggcagcagccacgactgcagcagcggcacctacttccccgagcagagcgacctggagccccccctgctggagctgggctggcccgccttctaccagggcgcctacagaggcgccaccagagtggagacccacttccagcccagaggcgccggcgagggcggcccctacggctgcaaggacgccctgagacagcagctgagaagcgccagagaggtgatcgccgtggtgatggacgtgttcaccgacatcgacatcttcagagacctgcaggagatctgcagaaagcagggcgtggccgtgtacatcctgctggaccaggccctgctgagccagttcctggacatgtgcatggacctgaaggtgcaccccgagcaggagaagctgatgaccgtgagaaccatcaccggcaacatctactacgccagaagcggcaccaagatcatcggcaaggtgcacgagaagttcaccctgatcgacggcatcagagtggccaccggcagctacagcttcacctggaccgacggcaagctgaacagcagcaacctggtgatcctgagcggccaggtggtggagcacttcgacctggagttcagaatcctgtacgcccagagcaagcccatcagccccaagctgctgagccacttccagagcagcaacaagttcgaccacctgaccaacagaaagccccagagcaaggagctgaccctgggcaacctgctgagaatgagactggccagactgagcagcacccccagaaaggccgacctggaccccgagatgcccgccgagggcaaggccgagagaaagccccacgactgcgagagcagcaccgtgagcgaggaggactacttcagcagccacagagacgagctgcagagcagaaaggccatcgacgccgccacccagaccgagcccggcgaggagatgcccggcctgagcgtgagcgaggtgggcacccagaccagcatcaccaccgcctgcgccggcacccagaccgccgtgatcaccagaatcgccagcagccagaccaccatctggagcagaagcaccaccacccagaccgacatggacgagaacatcctgttccccagaggcacccagagcaccgagggcagccccgtgagcaagatgagcgtgagcagaagcagcagcctgaagagcagcagcagcgtgagcagccagggcagcgtggccagcagcaccggcagccccgccagcatcagaaccaccgacttccacaaccccggctaccccaagtacctgggcaccccccacctggagctgtacctgagcgacagcctgagaaacctgaacaaggagagacagttccacttcgccggcatcagaagcagactgaaccacatgctggccatgctgagcagaagaaccctgttcaccgagaaccacctgggcctgcacagcggcaacttcagcagagtgaacctgctggccgtgagagacgtggccctgtaccccagctaccagtag

SEQ ID NO: 93018 - DNA, 1248 bp, Artificial Sequence
  Description of Artificial Sequence: Synthetic coding sequence
atggccgcccccctggtgctggtgctggtggtggccgtgaccgtgagagccgccctgttcagaagcagcctggccgagttcatcagcgagagagtggaggtggtgagccccctgagcagctggaagagagtggtggagggcctgagcctgctggacctgggcgtgagcccctacagcggcgccgtgttccacgagatcaccgacgccctgaccgccatcgccctgtacttcgccatccaggacttcaacaaggtggtgttcaagaagcagaagctgctgctggagctggaccagtacgcccccgacgtggccgagctgatcagaacccccatggagatgagatacatccccctgaaggtggccctgttctacctgctgaacccctacaccatcctgagctgcgtggccaagagcacctgcgccatcaacaacaccctgatcgccttcttcatcctgaccaccatcaagggcagcgccttcctgagcgccatcttcctggccctggccacctaccagagcctgtaccccctgaccctgttcgtgcccggcctgctgtacctgctgcagagacagtacatccccgtgaagatgaagagcaaggccttctggatcttcagctgggagtacgccatgatgtacgtgggcagcctggtggtgatcatctgcctgagcttcttcctgctgagcagctgggacttcatccccgccgtgtacggcttcatcctgagcgtgcccgacctgacccccaacatcggcctgttctggtacttcttcgccgagatgttcgagcacttcagcctgttcttcgtgtgcgtgttccagatcaacgtgttcttctacaccatccccctggccatcaagctgaaggagcaccccatcttcttcatgttcatccagatcgccgtgatcgccatcttcaagagctaccccaccgtgggcgacgtggccctgtacatggccttcttccccgtgtggaaccacctgtacagattcctgagaaacatcttcgtgctgacctgcatcatcatcgtgtgcagcctgctgttccccgtgctgtggcacctgtggatctacgccggcagcgccaacagcaacttcttctacgccatcaccctgaccttcaacgtgggccagatcctgctgatcagcgactacttctacgccttcctgagaagagagtactacctgacccacggcctgtacctgaccgccaaggacggcaccgaggccatgctggtgctgaagtag

SEQ ID NO: 93019 - DNA, 513 bp, Artificial Sequence
  Description of Artificial Sequence: Synthetic coding sequence
gtgagcgtgcccacccacctggtgtgccccagaacccccctgagcccccccgccgccgtgcacacctgcgagaacgaggagcagagcctgctggacctgttcctgggcgtgtgccacgacatcaacgtgttcttctacaccatccccctggccatcaagctgaaggagcaccccatcttcttcatgttcatccagatcgccgtgatcgccatcttcaagagctaccccaccgtgggcgacgtggccctgtacatggccttcttccccgtgtggaaccacctgtacagattcctgagaaacatcttcgtgctgacctgcatcatcatcgtgtgcagcctgctgttccccgtgctgtggcacctgtggatctacgccggcagcgccaacagcaacttcttctacgccatcaccctgaccttcaacgtgggccagatcctgctgatcagcgactacttctacgccttcctgagaagagagtactacctgacccacggcctgtacctgaccgcctag

SEQ ID NO: 93020 - DNA, 1272 bp, Artificial Sequence
  Description of Artificial Sequence: Synthetic coding sequence
atggccgcccccctggtgctggtgctggtggtggccgtgaccgtgagagccgccctgttcagaagcagcctggccgagttcatcagcgagagagtggaggtggtgagccccctgagcagctggaagagagtggtggagggcctgagcctgctggacctgggcgtgagcccctacagcggcgccgtgttccacgagacccccctgatcatctacctgttccacttcctgatcgactacgccgagctggtgttcatgatcaccgacgccctgaccgccatcgccctgtacttcgccatccaggacttcaacaaggtggtgttcaagaagcagaagctgctgctggagctggaccagtacgcccccgacgtggccgagctgatcagaacccccatggagatgagatacatccccctgaaggtggccctgttctacctgctgaacccctacaccatcctgagctgcgtggccaagagcacctgcgccatcaacaacaccctgatcgccttcttcatcctgaccaccatcaagggcagcgccttcctgagcgccatcttcctggccctggccacctaccagagcctgtaccccctgaccctgttcgtgcccggcctgctgtacctgctgcagagacagtacatccccgtgaagatgaagagcaaggccttctggatcttcagctgggagtacgccatgatgtacgtgggcagcctggtggtgatcatctgcctgagcttcttcctgctgagcagctgggacttcatccccgccgtgtacggcttcatcctgagcgtgcccgacctgacccccaacatcggcctgttctggtacttcttcgccgagatgttcgagcacttcagcctgttcttcgtgtgcgtgttccagatcaacgtgttcttctacaccatccccctggccatcaagctgaaggagcaccccatcttcttcatgttcatccagatcgccgtgatcgccatcttcaagagctaccccaccgtgggcgacgtggccctgtacatggccttcttccccgtgtggaaccacctgtacagattcctgagaaacatcttcgtgctgacctgcatcatcatcgtgtgcagcctgctgttccccgtgctgtggcacctgtggatctacgccggcagcgccaacagcaacttcttctacgccatcaccctgaccttcaacgtgggccagatgggcttctgcggcgacagaatggccggcacctgccccgaggccatcagagccgccggcgacagaacccccagctag

SEQ ID NO: 93021 - DNA, 1482 bp, Artificial Sequence
  Description of Artificial Sequence: Synthetic coding sequence
atgtggccccaggaccccagcagaaaggaggtgctgagattcgccgtgagctgcagaatcctgaccctgatgctgcaggccctgttcaacgccatcatccccgaccaccacgccgaggccttcagcccccccagactggcccccagcggcttcgtggaccagctggtggagggcctgctgggcggcctgagccactgggacgccgagcacttcctgttcatcgccgagcacggctacctgtacgagcacaacttcgccttcttccccggcttccccctggccctgctggtgggcaccgagctgctgagacccctgagaggcctgctgagcctgagaagctgcctgctgatcagcgtggccagcctgaacttcctgttcttcatgctggccgccgtggccctgcacgacctgggctgcctggtgctgcactgcccccaccagagcttctacgccgccctgctgttctgcctgagccccgccaacgtgttcctggccgccggctacagcgaggccctgttcgccctgctgaccttcagcgccatgggccagctggagagaggcagagtgtggaccagcgtgctgctgttcgccttcgccaccggcgtgagaagcaacggcctggtgagcgtgggcttcctgatgcacagccagtgccagggcttcttcagcagcctgaccatgctgaaccccctgagacagctgttcaagctgatggccagcctgttcctgagcgtgttcaccctgggcctgcccttcgccctgttccagtactacgcctacacccagttctgcctgcccggcagcgccagacccatccccgagcccctggtgcagctggccgtggacaagggctacagaatcgccgagggcaacgagcccccctggtgcttctgggacgtgcccctgatctacagctacatccaggacgtgtactggaacgtgggcttcctgaagtactacgagctgaagcaggtgcccaacttcctgctggccgcccccgtggccatcctggtggcctgggccacctggacctacgtgaccacccacccctggctgtgcctgaccctgggcctgcagagaagcaagaacaacaagaccctggagaagcccgacctgggcttcctgagcccccaggtgttcgtgtacgtggtgcacgccgccgtgctgctgctgttcggcggcctgtgcatgcacgtgcaggtgctgaccagattcctgggcagcagcacccccatcatgtactggttccccgcccacctgctgcaggaccaggagcccctgctgagaagcctgaagaccgtgccctggaagcccctggccgaggacagcccccccggccagaaggtgcccagaaaccccatcatgggcctgctgtaccactggaagacctgcagccccgtgaccagatacatcctgggctacttcctgacctactggctgctgggcctgctgctgcactgcaacttcctgccctggacctag

SEQ ID NO: 93022 - DNA, 1482 bp, Artificial Sequence; identical to SEQ ID NO: 93021
  Description of Artificial Sequence: Synthetic coding sequence

SEQ ID NO: 93023 - DNA, 219 bp, Artificial Sequence
  Description of Artificial Sequence: Synthetic coding sequence
atgtggccccaggaccccagcagaaaggaggtgctgagattcgccgtgagctgcagaatcctgaccctgatgctgcaggccctgttcaacgccatcatccccgaccaccacgccgaggccttcagcccccccagactggcccccagcggcttcgtggaccagctggtggagggcctgctgggcggcctgagccactgggacgccgagcacttcctgtag

SEQ ID NO: 93024 - DNA, 366 bp, Artificial Sequence
  Description of Artificial Sequence: Synthetic coding sequence
atgtggccccaggaccccagcagaaaggaggtgctgagattcgccgtgagctgcagaatcctgaccctgatgctgcaggccctgttcaacgccatcatccccgaccaccacgccgaggccttcagcccccccagactggcccccagcggcttcgtggaccagctggtggagggcctgctgggcggcctgagccactgggacgccgagcacttcctgttcatcgccgagcacggctacctgtacgagcacaacttcgccttcttccccggcttccccctggccctgctggtgggcaccgagctgctgagacccctgagaggcctgctgagcctgagaagctgcctgctgatcagcgtggccagctag

SEQ ID NO: 93025 - DNA, 798 bp, Artificial Sequence
  Description of Artificial Sequence: Synthetic coding sequence
atgcccagcagccagatcaccatgcagaagcccagcctgctgctggcctggcccccccaggccctgtggaccaacagctggaagtactacgcctacacccagttctgcctgcccggcagcgccagacccatccccgagcccctggtgcagctggccgtggacaagggctacagaatcgccgagggcaacgagcccccctggtgcttctgggacgtgcccctgatctacagctacatccaggacgtgtactggaacgtgggcttcctgaagtactacgagctgaagcaggtgcccaacttcctgctggccgcccccgtggccatcctggtggcctgggccacctggacctacgtgaccacccacccctggctgtgcctgaccctgggcctgcagagaagcaagaacaacaagaccctggagaagcccgacctgggcttcctgagcccccaggtgttcgtgtacgtggtgcacgccgccgtgctgctgctgttcggcggcctgtgcatgcacgtgcaggtgctgaccagattcctgggcagcagcacccccatcatgtactggttccccgcccacctgctgcaggaccaggagcccctgctgagaagcctgaagaccgtgccctggaagcccctggccgaggacagcccccccggccagaaggtgcccagaaaccccatcatgggcctgctgtaccactggaagacctgcagccccgtgaccagatacatcctgggctacttcctgacctactggctgctgggcctgctgctgcactgcaacttcctgccctggacctag

SEQ ID NO: 93026 - DNA, 549 bp, Artificial Sequence
  Description of Artificial Sequence: Synthetic coding sequence
atgtggccccaggaccccagcagaaaggaggtgctgagattcgccgtgagctgcagaatcctgaccctgatgctgcaggccctgttcaacgccatcatccccgaccaccacgccgaggccttcagcccccccagactggcccccagcggcttcgtggaccagctggtggagggcctgctgggcggcctgagccactgggacgccgagcacttcctgttcatcgccgagcacggctacctgtacgagcacaacttcgccttcttccccggcttccccctggccctgctggtgggcaccgagctgctgagacccctgagaggcctgctgagcctgagaagctgcctgctgatcagcgtggccagcctgaacttcctgttcttcatgctggccgccgtggccctgcacgacctgggctgcctggtgctgcactgcccccaccagagcttctacgccgccctgctgttctgcctgagccccgccaacgtgttcctggccgccggctacagcgaggccctgttcgccctgctgaccttcagcgccatgggctag

SEQ ID NO: 93027 - DNA, 1515 bp, Artificial Sequence
  Description of Artificial Sequence: Synthetic coding sequence
atgagcgagaagcagatgaaggaggccttcgtgagcaacctgaacggcaccaccgtgctggagatcacccagggcctgtgcttccccgccttctgcatcctgtgcagaggcttcctgatcatcttcagccagtacctgtgcagcttcagccccacctggaagaccagattcctgaccgacttcgtggtgctgatcgtgcccatggtggccaccctgaccatctgggccagcttcatcctgctggagctgctgggcgtgatcatcttcggcgccggcctgctgtaccagatctacagaagaagaacctgctacgccagactgcccttcctgaagatcctggagaagttcctgaacatcagcctggagagcgagtacaaccccgccatcagctgcttcagagtgatcaccagcgccttcaccgccatcgccatcctggccgtggacttccccctgttccccagaagattcgccaagaccgagctgtacggcaccggcgccatggacttcggcgtgggcggcttcgtgttcggcagcgccatggtgtgcctggaggtgagaagaagaaagtacatggagggcagcaagctgcactacttcaccaacagcctgtacagcgtgtggcccctggtgttcctgggcatcggcagactggccatcatcaagagcatcggctaccaggagcacctgaccgagtacggcgtgcactggaacttcttcttcaccatcatcgtggtgaagctgatcacccccctgctgctgatcatcttccccctgaacaagagctggatcatcgccctgggcatcaccgtgctgtaccagctggccctggacttcaccagcctgaagagactgatcctgtacggcaccgacggcagcggcaccagagtgggcctgctgaacgccaacagagagggcatcatcagcaccctgggctacgtggccatccacatggccggcgtgcagaccggcctgtacatgcacaagaacagaagccacatcaaggacctgatcaaggtggcctgcttcctgctgctggccgccatcagcctgttcatcagcctgtacgtggtgcaggtgaacgtggaggccgtgagcagaagaatggccaacctggccttctgcatctggatcgtggccagcagcctgatcctgctgagcagcctgctgctgggcgacatcatcctgagcttcgccaagttcctgatcaagggcgccctggtgccctgcagctggaagctgatccagagccccgtgaccaacaagaagcacagcgagagcctggtgcccgaggccgagagaatggagcccagcctgtgcctgatcaccgccctgaacagaaagcagctgatcttcttcctgctgagcaacatcaccaccggcctgatcaacctgatggtggacaccctgcacagcagcaccctgtgggccctgttcgtggtgaacctgtacatgttcagcaactgcctgatcgtgtacgtgctgtacctgcaggacaagaccgtgcagttctggtag

SEQ ID NO: 93028 - DNA, 318 bp, Artificial Sequence
  Description of Artificial Sequence: Synthetic coding sequence
atgagcgagaagcagatgaaggaggccttcgtgagcaacctgaacggcaccaccgtgctggagatcacccagggcctgtgcttccccgccttctgcatcctgtgcagaggcttcctgatcatcttcagccagtacctgtgcagcttcagccccacctggaagaccagattcctgaccgacttcgtggtgctgatcgtgcccatggtggccaccctgaccatctgggccagcttcatcctgctggagctgctgggcgtgatcatcttcggcgccggcctgctgtaccagatctacagaagaagaacctgctacgcctag

SEQ ID NO: 93029 - DNA, 831 bp, Artificial Sequence
  Description of Artificial Sequence: Synthetic coding sequence
ctggccgccagagtggccgccgtgagagccgccgcctggctgctgctgggcgccgccaccggcctgaccagaggccccgccgccgccttcaccgccgccagaagcgacgccggcatcagagccatgtgcagcgagatcatcctgagacaggaggtgctgaaggacggcttccacagagacctgctgatcaaggtgaagttcggcgagagcatcgaggacctgcacacctgcagactgctgatcaagcaggacatccccgccggcctgtacgtggacccctacgagctggccagcctgagagagagaaacatcaccgaggccgtgatggtgagcgagaacttcgacatcgaggcccccaactacctgagcaaggagagcgaggtgctgatctacgccagaagagacagccagtgcatcgactgcttccaggccttcctgcccgtgcactgcagataccacagaccccacagcgaggacggcgaggccagcatcgtggtgaacaaccccgacctgctgatgttctgcgaccaggccggcagcagaagaatgatcagattcagattcgacagcttcgacaagaccatcgagttccccatcctgaagtgctgggcccacagcgaggtggccgccccctgcgccctggagaacgaggacatctgccagtggaacaagatgaagtacaagagcgtgtacaagaacgtgatcctgcaggtgcccgtgggcctgaccgtgcacaccagcctggtgtgcagcgtgaccctgctgatcaccatcctgtgcagcaccctgatcctggtggccgtgttcaagtacggccacttcagcctgtag

SEQ ID NO: 93030 - DNA, 654 bp, Artificial Sequence
  Description of Artificial Sequence: Synthetic coding sequence
atgtgcagcgagatcatcctgagacaggaggtgctgaaggacggcttccacagagacctgctgatcaaggtgaagttcggcgagagcatcgaggacctgcacacctgcagactgctgatcaagcaggacatccccgccggcctgtacgtggacccctacgagctggccagcctgagagagagaaacatcaccgaggccgtgatggtgagcgagaacttcgacatcgaggcccccaactacctgagcaaggagagcgaggtgctgatctacgccagaagagacagccagtgcatcgactgcttccaggccttcctgcccgtgcactgcagataccacagaccccacagcgaggacggcgaggccagcatcgtggtgaacaaccccgacctgctgatgttctgcgaccaggagttccccatcctgaagtgctgggcccacagcgaggtggccgccccctgcgccctggagaacgaggacatctgccagtggaacaagatgaagtacaagagcgtgtacaagaacgtgatcctgcaggtgcccgtgggcctgaccgtgcacaccagcctggtgtgcagcgtgaccctgctgatcaccatcctgtgcagcaccctgatcctggtggccgtgttcaagtacggccacttcagcctgtag

SEQ ID NO: 93031 - DNA, 777 bp, Artificial Sequence
  Description of Artificial Sequence: Synthetic coding sequence
ctggccgccagagtggccgccgtgagagccgccgcctggctgctgctgggcgccgccaccggcctgaccagaggccccgccgccgccttcaccgccgccagaagcgacgccggcatcagagccatgtgcagcgagatcatcctgagacaggaggtgctgaaggacggcttccacagagacctgctgatcaaggtgaagttcggcgagagcatcgaggacctgcacacctgcagactgctgatcaagcaggacatccccgccggcctgtacgtggacccctacgagctggccagcctgagagagagaaacatcaccgaggccgtgatggtgagcgagaacttcgacatcgaggcccccaactacctgagcaaggagagcgaggtgctgatctacgccagaagagacagccagtgcatcgactgcttccaggccttcctgcccgtgcactgcagataccacagaccccacagcgaggacggcgaggccagcatcgtggtgaacaaccccgacctgctgatgttctgcgaccaggagttccccatcctgaagtgctgggcccacagcgaggtggccgccccctgcgccctggagaacgaggacatctgccagtggaacaagatgaagtacaagagcgtgtacaagaacgtgatcctgcaggtgcccgtgggcctgaccgtgcacaccagcctggtgtgcagcgtgaccctgctgatcaccatcctgtgcagcaccctgatcctggtggccgtgttcaagtacggccacttcagcctgtag

SEQ ID NO: 93032 - DNA, 507 bp, Artificial Sequence
  Description of Artificial Sequence: Synthetic coding sequence
atggtgagcgagaacttcgacatcgaggcccccaactacctgagcaaggagagcgaggtgctgatctacgccagaagagacagccagtgcatcgactgcttccaggccttcctgcccgtgcactgcagataccacagaccccacagcgaggacggcgaggccagcatcgtggtgaacaaccccgacctgctgatgttctgcgaccaggccggcagcagaagaatgatcagattcagattcgacagcttcgacaagaccatcgagttccccatcctgaagtgctgggcccacagcgaggtggccgccccctgcgccctggagaacgaggacatctgccagtggaacaagatgaagtacaagagcgtgtacaagaacgtgatcctgcaggtgcccgtgggcctgaccgtgcacaccagcctggtgtgcagcgtgaccctgctgatcaccatcctgtgcagcaccctgatcctggtggccgtgttcaagtacggccacttcagcctgtag

SEQ ID NO: 93033 - DNA, 1740 bp, Artificial Sequence
  Description of Artificial Sequence: Synthetic coding sequence
atgcagatctgcggcagcagcgtggccagcgtggccgccggcaccagcttccaggtgctgggccccgtgtgctggcagcagctggacctgaagatggccgtgagagtgctgtggggcggcctgagcctgctgagagtgctgtggtgcctgctgccccagaccggctacgtgcaccccgacgagttcttccagagccccgaggtgatggccgaggacatcctgggcgtgcaggccgccagaccctgggagttctaccccagcagcagctgcagaagcgtgctgttccccctgctgatcagcggcagcaccttctggctgctgagactgtgggaggagctgggcccctggcccggcctggtgagcggctacgccctgctggtgggccccagactgctgctgaccgccctgagcttcgccctggacggcgccgtgtaccacctggccccccccatgggcgccgacagatggaacgccctggccctgctgagcggcagctacgtgaccctggtgttctacaccagaaccttcagcaacaccatcgagggcctgctgttcacctggctgctggtgctggtgagcagccacgtgacctggggccccaccagaaaggagcccgcccccggccccagatggagaagctggctgctgggcggcatcgtggccgccggcttcttcaacagacccaccttcctggccttcgccgtggtgcccctgtacctgtggggcaccagaggcgccaccaaccccggcctgaagagcctgaccagagaggccctggtgctgctgcccggcgccgccctgaccgccgccgtgttcgtggccaccgacagctggtacttcagcagccccgccaccagcagaaacctggtgctgacccccgtgaacttcctgcactacaacctgaacccccagaacctggccagacacggcacccacgccagactgacccacctggccgtgaacggcttcctgctgttcggcgtgctgcacgcccaggccctgcaggccgcctggcagagactgcaggtgggcctgcaggccagcgcccagatgggcctgctgagagccctgggcgccagaagcctgctgagcagccccagaagctacctgctgctgctgtacttcatgcccctggccctgctgagcgccttcagccaccaggaggccagattcctgatccccctgctggtgcccctggtgctgctgtgcagcccccagacccagcccgtgccctggaagggcaccgtggtgctgttcaacgccctgggcgccctgctgttcggctgcctgcaccagggcggcctggtgcccggcctggagtacctggagcaggtggtgcacgcccccgtgctgcccagcacccccacccactacaccctgctgttcacccacacctacatgccccccagacacctgctgcacctgcccggcctgggcgcccccgtggaggtggtggacatgggcggcaccgaggactgggccctgtgccagaccctgaagagcttcaccagacagcccgcctgccaggtggccggcggcccctggctgtgcagactgttcgtggtgacccccggcaccaccagaagagccgtggagaagtgcagcttccccttcaagaacgagaccctgctgttcccccacctgaccctggaggacccccccgccctgagcagcctgctgagcggcgcctggagagaccacctgagcctgcacatcgtggagctgggcgaggagacctag

SEQ ID NO: 93034 - DNA, 813 bp, Artificial Sequence
  Description of Artificial Sequence: Synthetic coding sequence
atggtgctgctgaaggagtacagagtgatcctgcccgtgagcgtggacgagtaccaggtgggccagctgtacagcgtggccgaggccagcaagaacgagaccggcggcggcgagggcgtggaggtgctggtgaacgagccctacgagaaggacggcgagaagggccagtacacccacaagatctaccacctgcagagcaaggtgcccaccttcgtgagaatgctggcccccgagggcgccctgaacatccacgagaaggcctggaacgcctacccctactgcagaaccgtgatcaccaacgagtacatgaaggaggacttcctgatcaagatcgagacctggcacaagcccgacctgggcacccaggagaacgtgcacaagctggagcccgaggcctggaagcacgtggaggccgtgtacatcgacatcgccgacagaagccaggtgctgagcaaggactacaaggccgaggaggaccccgccaagttcaagagcatcaagaccggcagaggccccctgggccccaactggaagcaggagctggtgaaccagaaggactgcccctacatgtgcgcctacaagctggtgaccgtgaagttcaagtggtggggcctgcagaacaaggtggagaacttcatccacaagcaggagagaagactgttcaccaacttccacagacagctgttctgctggctggacaagtgggtggacctgaccatggacgacatcagaagaatggaggaggagaccaagagacagctggacgagatgagacagaaggaccccgtgaagggcatgaccgccgacgactag

SEQ ID NO: 93035 - DNA, 813 bp, Artificial Sequence
  Description of Artificial Sequence: Synthetic coding sequence
atggtgctgctgaaggagtacagagtgatcctgcccgtgagcgtggacgagtaccaggtgggccagctgtacagcgtggccgaggccagcaagaacgagaccggcggcggcgagggcgtggaggtgctggtgaacgagccctacgagaaggacggcgagaagggccagtacacccacaagatctaccacctgcagagcaaggtgcccaccttcgtgagaatgctggcccccgagggcgccctgaacatccacgagaaggcctggaacgcctacccctactgcagaaccgtgctgcccaacgagtacatgaaggaggacttcctgatcaagatcgagacctggcacaagcccgacctgggcacccaggagaacgtgcacaagctggagcccgaggcctggaagcacgtggaggccgtgtacatcgacatcgccgacagaagccaggtgctgagcaaggactacaaggccgaggaggaccccgccaagttcaagagcatcaagaccggcagaggccccctgggccccaactggaagcaggagctggtgaaccagaaggactgcccctacatgtgcgcctacaagctggtgaccgtgaagttcaagtggtggggcctgcagaacaaggtggagaacttcatccacaagcaggagagaagactgttcaccaacttccacagacagctgttctgctggctggacaagtgggtggacctgaccatggacgacatcagaagaatggaggaggagaccaagagacagctggacgagatgagacagaaggaccccgtgaagggcatgaccgccgacgactag

SEQ ID NO: 93036 - DNA, 594 bp, Artificial Sequence
  Description of Artificial Sequence: Synthetic coding sequence
atgctggcccccgagggcgccctgaacatccacgagaaggcctggaacgcctacccctactgcagaaccgtgctgcccaacgagtacatgaaggaggacttcctgatcaagatcgagacctggcacaagcccgacctgggcacccaggagaacgtgcacaagctggagcccgaggcctggaagcacgtggaggccgtgtacatcgacatcgccgacagaagccaggtgctgagcaaggactacaaggccgaggaggaccccgccaagttcaagagcatcaagaccggcagaggccccctgggccccaactggaagcaggagctggtgaaccagaaggactgcccctacatgtgcgcctacaagctggtgaccgtgaagttcaagtggtggggcctgcagaacaaggtggagaacttcatccacaagcaggagagaagactgttcaccaacttccacagacagctgttctgctggctggacaagtgggtggacctgaccatggacgacatcagaagaatggaggaggagaccaagagacagctggacgagatgagacagaaggaccccgtgaagggcatgaccgccgacgactag

SEQ ID NO: 93037 - DNA, 819 bp, Artificial Sequence
  Description of Artificial Sequence: Synthetic coding sequence
atggtgctgatcaaggagttcagagtggtgctgccctgcagcgtgcaggagtaccaggtgggccagctgtacagcgtggccgaggccagcaagaacgagaccggcggcggcgagggcatcgaggtgctgaagaacgagccctacgagaaggacggcgagaagggccagtacacccacaagatctaccacctgaagagcaaggtgcccgccttcgtgagaatgatcgcccccgagggcagcctggtgttccacgagaaggcctggaacgcctacccctactgcagaaccatcgtgaccaacgagtacatgaaggacgacttcttcatcaagatcgagacctggcacaagcccgacctgggcaccctggagaacgtgcacggcctggaccccaacacctggaagaccgtggagatcgtgcacatcgacatcgccgacagaagccaggtggagcccgccgactacaaggccgacgaggaccccgccctgttccagagcgtgaagaccaagagaggccccctgggccccaactggaagaaggagctggccaacagccccgactgcccccagatgtgcgcctacaagctggtgaccatcaagttcaagtggtggggcctgcagagcaaggtggagaacttcatccagaagcaggagaagagaatcttcaccaacttccacagacagctgttctgctggatcgacaagtggatcgacctgaccatggaggacatcagaagaatggaggacgagacccagaaggagctggagaccctgagaaaccagggccaggtgagaggcaccagcgccgccagcgacgagtag

SEQ ID NO: 93038 - DNA, 816 bp, Artificial Sequence
  Description of Artificial Sequence: Synthetic coding sequence
atggtgctgatcaaggagttcagagtggtgctgccctgcagcgtgcaggagtaccaggtgggccagctgtacagcgtggccgaggccagcaagaacgagaccggcggcggcgagggcatcgaggtgctgaagaacgagccctacgagaaggacggcgagaagggccagtacacccacaagatctaccacctgaagagcaaggtgcccgccttcgtgagaatgatcgcccccgagggcagcctggtgttccacgagaaggcctggaacgcctacccctactgcagaaccatcgtgaccaacgagtacatgaaggacgacttcttcatcaagatcgagacctggcacaagcccgacctgggcaccctggagaacgtgcacggcctggaccccaacacctggaagaccgtggagatcgtgcacatcgacatcgccgacagaagccaggtggagcccgccgactacaaggccgacgaggaccccgccctgttccagagcgtgaagaccaagagaggccccctgggccccaactggaagaaggagctggccaacagccccgactgcccccagatgtgcgcctacaagctggtgaccatcaagttcaagtggtggggcctgcagagcaaggtggagaacttcatccagaagcaggagaagagaatcttcaccaacttccacagacagctgttctgctggatcgacaagtggatcgacctgaccatggaggacatcagaagaatggaggacgagacccagaaggagctggagaccatgagaaagagaggcagcgtgagaggcaccagcgccgccgacgtgtag

SEQ ID NO: 93039 - DNA, 363 bp, Artificial Sequence
  Description of Artificial Sequence: Synthetic coding sequence
atgatcgcccccgagggcagcctggtgttccacgagaaggcctggaacgcctacccctactgcagaaccatcgtgaccaacgagtacatgaaggacgacttcttcatcaagatcgagacctggcacaagcccgacctgggcaccctggagaacgtgcacggcctggaccccaacacctggaagaccgtggagatcgtgcacatcgacatcgccgacagaagccaggtggagcccgccgactacaaggccgacgaggaccccgccctgttccagagcgtgaagaccaagagaggccccctgggccccaactggaagaaggagctggccaacagccccgactgcccccagatgtgcgcctactag

SEQ ID NO: 93040 - DNA, 507 bp, Artificial Sequence
  Description of Artificial Sequence: Synthetic coding sequence
atgggcgacctgctgatggagaagtgcagagtggtgctgccctgcagcgtgcaggagtaccaggtgggccagctgtacagcgtggccgaggccagcaagaacgagaccggcggcggcgagggcatcgaggtgctgaagaacgagccctacgagaaggacggcgagaagggccagtacacccacaagatctaccacctgaagagcaaggtgcccgccttcgtgagaatgatcgcccccgagggcagcctggtgttccacgagaaggcctggaacgcctacccctactgcagaaccatcgtgaccaacgagtacatgaaggacgacttcttcatcaagatcgagacctggcacaagcccgacctgggcaccctggagaacgtgcacggcctggaccccaacacctggaagaccgtggagatcgtgcacatcgacatcgccgacagaagccaggtggagcccgccgactacaaggccgacgaggaccccgccctgttccagagcgtgtag

SEQ ID NO: 93041 - DNA, 822 bp, Artificial Sequence
  Description of Artificial Sequence: Synthetic coding sequence
atgggcgacctgctgatggagaagtgcagagtggtgctgccctgcagcgtgcaggagtaccaggtgggccagctgtacagcgtggccgaggccagcaagaacgagaccggcggcggcgagggcatcgaggtgctgaagaacgagccctacgagaaggacggcgagaagggccagtacacccacaagatctaccacctgaagagcaaggtgcccgccttcgtgagaatgatcgcccccgagggcagcctggtgttccacgagaaggcctggaacgcctacccctactgcagaaccatcgtgaccaacgagtacatgaaggacgacttcttcatcaagatcgagacctggcacaagcccgacctgggcaccctggagaacgtgcacggcctggaccccaacacctggaagaccgtggagatcgtgcacatcgacatcgccgacagaagccaggtggagcccgccgactacaaggccgacgaggaccccgccctgttccagagcgtgaagaccaagagaggccccctgggccccaactggaagaaggagctggccaacagccccgactgcccccagatgtgcgcctacaagctggtgaccatcaagttcaagtggtggggcctgcagagcaaggtggagaacttcatccagaagcaggagaagagaatcttcaccaacttccacagacagctgttctgctggatcgacaagtggatcgacctgaccatggaggacatcagaagaatggaggacgagacccagaaggagctggagaccatgagaaagagaggcagcgtgagaggcaccagcgccgccgacgtgtag

SEQ ID NO: 93042 - DNA, 4980 bp, Artificial Sequence
  Description of Artificial Sequence: Synthetic coding sequence
atggaggcccccagcggcagcgagcccggcggcgacggcgccggcgactgcgcccaccccgaccccagagcccccggcgccgccgcccccagcagcggccccggcccctgcgccgccgccagagagagcgagagacagctgagactgagactgtgcgtgctgaacgagatcctgggcaccgagagagactacgtgggcaccctgagattcctgcagagcgccttcctgcacagaatcagacagaacgtggccgacagcgtggagaagggcctgaccgaggagaacgtgaaggtgctgttcagcaacatcgaggacatcctggaggtgcacaaggacttcctggccgccctggagtactgcctgcaccccgagccccagagccagcacgagctgggcaacgtgttcctgaagttcaaggacaagttctgcgtgtacgaggagtactgcagcaaccacgagaaggccctgagactgctggtggagctgaacaagatccccaccgtgagagccttcctgctgagctgcatgctgctgggcggcagaaagaccaccgacatccccctggagggctacctgctgagccccatccagagaatctgcaagtaccccctgctgctgaaggagctggccaagagaacccccggcaagcaccccgaccaccccgccgtgcagagcgccctgcaggccatgaagaccgtgtgcagcaacatcaacgagaccaagagacagatggagaagctggaggccctggagcagctgcagagccacatcgagggctgggagggcagcaacctgaccgacatctgcacccagctgctgctgcagggcaccctgctgaagatcagcgccggcaacatccaggagagagccttcttcctgttcgacaacctgctggtgtactgcaagagaaagagcagagtgaccggcagcaagaagagcaccaagagaaccaagagcatcaacggcagcctgtacatcttcagaggcagaatcaacaccgaggtgatggaggtggagaacgtggaggacggcaccgccgactaccacagcaacggctacaccgtgaccaacggctggaagatccacaacaccgccaagaacaagtggttcgtgtgcatggccaagaccgccgaggagaagcagaagtggctggacgccatcatcagagagagagagcagagagagagcctgaagctgggcatggagagagacgcctacgtgatgatcgccgagaagggcgagaagctgtaccacatgatgatgaacaagaaggtgaacctgatcaaggacagaagaagaaagctgagcaccgtgcccaagtgcttcctgggcaacgagttcgtggcctggctgctggagatcggcgagatcagcaagaccgaggagggcgtgaacctgggccaggccctgctggagaacggcatcatccaccacgtgagcgacaagcaccagttcaagaacgagcaggtgatgtacagattcagatacgacgacggcacctacaaggccagaagcgagctggaggacatcatgagcaagggcgtgagactgtactgcagactgcacagcctgtacacccccgtgatcaaggacagagactaccacctgaagacctacaagagcgtgctgcccggcagcaagctggtggactggctgctggcccagggcgactgccagaccagagaggaggccgtggccctgggcgtgggcctgtgcaacaacggcttcatgcaccacgtgctggagaagagcgagttcagagacgagagccagtacttcagattccacgccgacgaggagatggagggcaccagcagcaagaacaagcagctgagaaacgacttcaagctggtggagaacatcctggccaagagactgctgatcctgccccaggaggaggactacggcttcgacatcgaggagaagaacaaggccgtggtggtgaagagcgtgcagagaggcagcctggccgaggtggccggcctgcaggtgggcagaaagatctacagcatcaacgaggacctggtgttcctgagacccttcagcgaggtggagagcatcctgaaccagagcttctgcagcagaagacccctgagactgctggtggccaccaaggccaaggagatcatcaagatccccgaccagcccgacaccctgtgcttccagatcagaggcgccgcccccccctacgtgtacgccgtgggcagaggcagcgaggccatggccgccggcctgtgcgccggccagtgcatcctgaaggtgaacggcagcaacgtgatgaacgacggcgcccccgaggtgctggagcacttccaggccttcagaagcagaagagaggaggccctgggcctgtaccagtggatctaccacacccacgaggacgcccaggaggccagagccagccaggaggccagcaccgaggaccccagcggcgagcaggcccaggaggaggaccaggccgacagcgccttccccctgctgagcctgggccccagactgagcctgtgcgaggacagccccatggtgaccctgaccgtggacaacgtgcacctggagcacggcgtggtgtacgagtacgtgagcaccgccggcgtgagatgccacgtgctggagaagatcgtggagcccagaggctgcttcggcctgaccgccaagatcctggaggccttcgccgccaacgacagcgtgttcgtggagaactgcagaagactgatggccctgagcagcgccatcgtgaccatgccccacttcgagttcagaaacatctgcgacaccaagctggagagcatcggccagagaatcgcctgctaccaggagttcgccgcccagctgaagagcagagtgagcccccccttcaagcaggcccccctggagccccaccccctgtgcggcctggacttctgccccaccaactgccacatcaacctgatggaggtgagctaccccaagaccacccccagcgtgggcagaagcttcagcatcagattcggcagaaagcccagcctgatcggcctggaccccgagcagggccacctgaaccccatgagctacacccagcactgcatcaccaccatggccgcccccagctggaagtgcctgcccgccgccgagggcgacccccagggccagggcctgcacgacggcagcttcggccccgccagcggcaccctgggccaggaggacagaggcctgagcttcctgctgaagcaggaggacagagagatccaggacgcctacctgcagctgttcaccaagctggacgtggccctgaaggagatgaagcagtacgtgacccagatcaacagactgctgagcaccatcaccgagcccaccagcggcggcagctgcgacgccagcctggccgaggaggccagcagcctgcccctggtgagcgaggagagcgagatggacagaagcgaccacggcggcatcaagaaggtgtgcttcaaggtggccgaggaggaccaggaggacagcggccacgacaccatgagctacagagacagctacagcgagtgcaacagcaacagagacagcgtgctgagctacaccagcgtgagaagcaacagcagctacctgggcagcgacgagatgggcagcggcgacgagctgccctgcgacatgagaatccccagcgacaagcaggacaagctgcacggctgcctggagcacctgttcaaccaggtggacagcatcaacgccctgctgaagggccccgtgatgagcagagccttcgaggagaccaagcacttccccatgaaccacagcctgcaggagttcaagcagaaggaggagtgcaccatcagaggcagaagcctgatccagatcagcatccaggaggacccctggaacctgcccaacagcatcaagaccctggtggacaacatccagagatacgtggaggacggcaagaaccagctgctgctggccctgctgaagtgcaccgacaccgagctgcagctgagaagagacgccatcttctgccaggccctggtggccgccgtgtgcaccttcagcaagcagctgctggccgccctgggctacagatacaacaacaacggcgagtacgaggagagcagcagagacgccagcagaaagtggctggagcaggtggccgccaccggcgtgctgctgcactgccagagcctgctgagccccgccaccgtgaaggaggagagaaccatgctggaggacatctgggtgaccctgagcgagctggacaacgtgaccttcagcttcaagcagctggacgagaactacgtggccaacaccaacgtgttctaccacatcgagggcagcagacaggccctgaaggtgatcttctacctggacagctaccacttcagcaagctgcccagcagactggagggcggcgccagcctgagactgcacaccgccctgttcaccaaggtgctggagaacgtggagggcctgcccagccccggcagccaggccgccgaggacctgcagcaggacatcaacgcccagagcctggagaaggtgcagcagtactacagaaagctgagagccttctacctggagagaagcaacctgcccaccgacgccagcaccaccgccgtgaagatcgaccagctgatcagacccatcaacgccctggacgagctgtgcagactgatgaagagcttcgtgcaccccaagcccggcgccgccggcagcgtgggcgccggcctgatccccatcagcagcgagctgtgctacagactgggcgcctgccagatggtgatgtgcggcaccggcatgcagagaagcaccctgagcgtgagcctggagcaggccgccatcctggccagaagccacggcctgctgcccaagtgcatcatgcaggccaccgacatcatgagaaagcagggccccagagtggagatcctggccaagaacctgagagtgaaggaccagatgccccagggcgcccccagactgtacagactgtgccagccccccgtggacggcgacctgtag

SEQ ID NO: 93043 - DNA, 4686 bp, Artificial Sequence
  Description of Artificial Sequence: Synthetic coding sequence
atggaggcccccagcggcagcgagcccggcggcgacggcgccggcgactgcgcccaccccgaccccagagcccccggcgccgccgcccccagcagcggccccggcccctgcgccgccgccagagagagcgagagacagctgagactgagactgtgcgtgctgaacgagatcctgggcaccgagagagactacgtgggcaccctgagattcctgcagagcgccttcctgcacagaatcagacagaacgtggccgacagcgtggagaagggcctgaccgaggagaacgtgaaggtgctgttcagcaacatcgaggacatcctggaggtgcacaaggacttcctggccgccctggagtactgcctgcaccccgagccccagagccagcacgagctgggcaacgtgttcctgaagttcaaggacaagttctgcgtgtacgaggagtactgcagcaaccacgagaaggccctgagactgctggtggagctgaacaagatccccaccgtgagagccttcctgctgagctgcatgctgctgggcggcagaaagaccaccgacatccccctggagggctacctgctgagccccatccagagaatctgcaagtaccccctgctgctgaaggagctggccaagagaacccccggcaagcaccccgaccaccccgccgtgcagagcgccctgcaggccatgaagaccgtgtgcagcaacatcaacgagaccaagagacagatggagaagctggaggccctggagcagctgcagagccacatcgagggctgggagggcagcaacctgaccgacatctgcacccagctgctgctgcagggcaccctgctgaagatcagcgccggcaacatccaggagagagccttcttcctgttcgacaacctgctggtgtactgcaagagaaagagcagagtgaccggcagcaagaagagcaccaagagaaccaagagcatcaacggcagcctgtacatcttcagaggcagaatcaacaccgaggtgatggaggtggagaacgtggaggacggcaccgccgactaccacagcaacggctacaccgtgaccaacggctggaagatccacaacaccgccaagaacaagtggttcgtgtgcatggccaagaccgccgaggagaagcagaagtggctggacgccatcatcagagagagagagcagagagagagcctgaagctgggcatggagagagacgcctacgtgatgatcgccgagaagggcgagaagctgtaccacatgatgatgaacaagaaggtgaacctgatcaaggacagaagaagaaagctgagcaccgtgcccaagtgcttcctgggcaacgagttcgtggcctggctgctggagatcggcgagatcagcaagaccgaggagggcgtgaacctgggccaggccctgctggagaacggcatcatccaccacgtgagcgacaagcaccagttcaagaacgagcaggtgatgtacagattcagatacgacgacggcacctacaaggccagaagcgagctggaggacatcatgagcaagggcgtgagactgtactgcagactgcacagcctgtacacccccgtgatcaaggacagagactaccacctgaagacctacaagagcgtgctgcccggcagcaagctggtggactggctgctggcccagggcgactgccagaccagagaggaggccgtggccctgggcgtgggcctgtgcaacaacggcttcatgcaccacgtgctggagaagagcgagttcagagacgagagccagtacttcagattccacgccgacgaggagatggagggcaccagcagcaagaacaagcagctgagaaacgacttcaagctggtggagaacatcctggccaagagactgctgatcctgccccaggaggaggactacggcttcgacatcgaggagaagaacaaggccgtggtggtgaagagcgtgcagagaggcagcctggccgaggtggccggcctgcaggtgggcagaaagatctacagcatcaacgaggacctggtgttcctgagacccttcagcgaggtggagagcatcctgaaccagagcttctgcagcagaagacccctgagactgctggtggccaccaaggccaaggagatcatcaagatccccgaccagcccgacaccctgtgcttccagatcagaggcgccgcccccccctacgtgtacgccgtgggcagaggcagcgaggccatggccgccggcctgtgcgccggccagtgcatcctgaaggtgaacggcagcaacgtgatgaacgacggcgcccccgaggtgctggagcacttccaggccttcagaagcagaagagaggaggccctgggcctgtaccagtggatctaccacacccacgaggacgcccaggaggccagagccagccaggaggccagcaccgaggaccccagcggcgagcaggcccaggaggaggaccaggccgacagcgccttccccctgctgagcctgggccccagactgagcctgtgcgaggacagccccatggtgaccctgaccgtggacaacgtgcacctggagcacggcgtggtgtacgagtacgtgagcaccgccggcgtgagatgccacgtgctggagaagatcgtggagcccagaggctgcttcggcctgaccgccaagatcctggaggccttcgccgccaacgacagcgtgttcgtggagaactgcagaagactgatggccctgagcagcgccatcgtgaccatgccccacttcgagttcagaaacatctgcgacaccaagctggagagcatcggccagagaatcgcctgctaccaggagttcgccgcccagctgaagagcagagtgagcccccccttcaagcaggcccccctggagccccaccccctgtgcggcctggacttctgccccaccaactgccacatcaacctgatggaggtgagctaccccaagaccacccccagcgtgggcagaagcttcagcatcagattcggcagaaagcccagcctgatcggcctggaccccgagcagggccacctgaaccccatgagctacacccagcactgcatcaccaccatggccgcccccagctggaagtgcctgcccgccgccgagggcgacccccagggccagggcctgcacgacggcagcttcggccccgccagcggcaccctgggccaggaggacagaggcctgagcttcctgctgaagcaggaggacagagagatccaggacgcctacctgcagctgttcaccaagctggacgtggccctgaaggagatgaagcagtacgtgacccagatcaacagactgctgagcaccatcaccgagcccaccagcggcggcagctgcgacgccagcctggccgaggaggccagcagcctgcccctggtgagcgaggagagcgagatggacagaagcgaccacggcggcatcaagaaggtgtgcttcaaggtggccgaggaggaccaggaggacagcggccacgacaccatgagctacagagacagctacagcgagtgcaacagcaacagagacagcgtgctgagctacaccagcgtgagaagcaacagcagctacctgggcagcgacgagatgggcagcggcgacgagctgccctgcgacatgagaatccccagcgacaagcaggacaagctgcacggctgcctggagcacctgttcaaccaggtggacagcatcaacgccctgctgaagggccccgtgatgagcagagccttcgaggagaccaagcacttccccatgaaccacagcctgcaggagttcaagcagaaggaggagtgcaccatcagaggcagaagcctgatccagatcagcatccaggaggacccctggaacctgcccaacagcatcaagaccctggtggacaacatccagagatacgtggaggacggcaagaaccagctgctgctggccctgctgaagtgcaccgacaccgagctgcagctgagaagagacgccatcttctgccaggccctggtggccgccgtgtgcaccttcagcaagcagctgctggccgccctgggctacagatacaacaacaacggcgagtacgaggagagcagcagagacgccagcagaaagtggctggagcaggtggccgccaccggcgtgctgctgcactgccagagcctgctgagccccgccaccgtgaaggaggagagaaccatgctggaggacatctgggtgaccctgagcgagctggacaacgtgaccttcagcttcaagcagctggacgagaactacgtggccaacaccaacgtgttctaccacatcgagggcagcagacaggccctgaaggtgatcttctacctggacagctaccacttcagcaagctgcccagcagactggagggcggcgccagcctgagactgcacaccgccctgttcaccaagggcgagctgcaggcctggggcagagaggaccacggcggcagagccaaggccaccaagcacaccggcagccagccccccgccagacccagacacctgcccagccagtgctggagaacctggagaggctgcctgctgcaggccgccagacccagaagaatctgcagcagaaccagcaccagaagcccctggagaaagttcagcagcatcaccgccaacagcggccacttcacctggagcggcctgacctgccccagaatgcccgcccccagaagatag

SEQ ID NO: 93044 - DNA, 4821 bp, Artificial Sequence
  Description of Artificial Sequence: Synthetic coding sequence
atgagcgaggacagcagaggcgacagcagagccgagagcgccaaggacctggagaagcagctgagactgagagtgtgcgtgctgagcgagctgcagaagaccgagagagactacgtgggcaccctggagttcctggtgagcgccttcctgcacagaatgaaccagtgcgccgccagcaaggtggacaagaacgtgaccgaggagaccgtgaagatgctgttcagcaacatcgaggacatcctggccgtgcacaaggagttcctgaaggtggtggaggagtgcctgcaccccgagcccaacgcccagcaggaggtgggcacctgcttcctgcacttcaaggacaagttcagaatctacgacgagtactgcagcaaccacgagaaggcccagaagctgctgctggagctgaacaagatcagaaccatcagaaccttcctgctgaactgcatgctgctgggcggcagaaagaacaccgacgtgcccctggagggctacctggtgacccccatccagagaatctgcaagtaccccctgatcctgaaggagctgctgaagagaacccccagaaagcacagcgactacgccgccgtgatggaggccctgcaggccatgaaggccgtgtgcagcaacatcaacgaggccaagagacagatggagaagctggaggtgctggaggagtggcagagccacatcgagggctgggagggcagcaacatcaccgacacctgcaccgagatgctgatgtgcggcgtgctgctgaagatcagcagcggcaacatccaggagagagtgttcttcctgttcgacaacctgctggtgtactgcaagagaaagcacagaagactgaagaacagcaaggccagcaccgacggccacagatacctgttcagaggcagaatcaacaccgaggtgatggaggtggagaacgtggacgacggcaccgccgacttccacagcagcggccacatcgtggtgaacggctggaagatccacaacaccgccaagaacaagtggttcgtgtgcatggccaagacccccgaggagaagcacgagtggttcgaggccatcctgaaggagagagagagaagaaagggcctgaagctgggcatggagcaggacacctgggtgatgatcagcgagcagggcgagaagctgtacaagatgatgtgcagacagggcaacctgatcaaggacagaaagagaaagctgaccaccttccccaagtgcttcctgggcagcgagttcgtgagctggctgctggagatcggcgagatccacagacccgaggagggcgtgcacctgggccaggccctgctggagaacggcatcatccaccacgtgaccgacaagcaccagttcaagcccgagcagatgctgtacagattcagatacgacgacggcaccttctaccccagaaacgagatgcaggacgtgatcagcaagggcgtgagactgtactgcagactgcacagcctgttcacccccgtgatcagagacaaggactaccacctgagaacctacaagagcgtggtgatggccaacaagctgatcgactggctgatcgcccagggcgactgcagaaccagagaggaggccatgatcttcggcgtgggcctgtgcgacaacggcttcatgcaccacgtgctggagaagagcgagttcaaggacgagcccctgctgttcagattcttcagcgacgaggagatggagggcagcaacatgaagcacagactgatgaagcacgacctgaaggtggtggagaacgtgatcgccaagagcctgctgatcaagagcaacgagggcagctacggcttcggcctggaggacaagaacaaggtgcccatcatcaagctggtggagaagggcagcaacgccgagatggccggcatggaggtgggcaagaagatcttcgccatcaacggcgacctggtgttcatgagacccttcaacgaggtggactgcttcctgaagagctgcctgaacagcagaaagcccctgagagtgctggtgagcaccaagcccagagagaccgtgaagatccccgacagcgccgacggcctgggcttccagatcagaggcttcggccccagcgtggtgcacgccgtgggcagaggcaccgtggccgccgccgccggcctgcaccccggccagtgcatcatcaaggtgaacggcatcaacgtgagcaaggagacccacgccagcgtgatcgcccacgtgaccgcctgcagaaagtacagaagacccaccaagcaggacagcatccagtgggtgtacaacagcatcgagagcgcccaggaggacctgcagaagagccacagcaagccccccggcgacgaggccggcgacgccttcgactgcaaggtggaggaggtgatcgacaagttcaacaccatggccatcatcgacggcaagaaggagcacgtgagcctgaccgtggacaacgtgcacctggagtacggcgtggtgtacgagtacgacagcaccgccggcatcaagtgcaacgtggtggagaagatgatcgagcccaagggcttcttcagcctgaccgccaagatcctggaggccctggccaagagcgacgagcacttcgtgcagaactgcaccagcctgaacagcctgaacgaggtgatccccaccgacctgcagagcaagttcagcgccctgtgcagcgagagaatcgagcacctgtgccagagaatcagcagctacaagaagttcagcagagtgctgaagaacagagcctggcccaccttcaagcaggccaagagcaagatcagccccctgcacagcagcgacttctgccccaccaactgccacgtgaacgtgatggaggtgagctaccccaagaccagcaccagcctgggcagcgccttcggcgtgcagctggacagcagaaagcacaacagccacgacaaggagaacaagagcagcgagcagggcaagctgagccccatggtgtacatccagcacaccatcaccaccatggccgcccccagcggcctgagcctgggccagcaggacggccacggcctgagatacctgctgaaggaggaggacctggagacccaggacatctaccagaagctgctgggcaagctgcagaccgccctgaaggaggtggagatgtgcgtgtgccagatcgacgacctgctgagcagcatcacctacagccccaagctggagagaaagaccagcgagggcatcatccccaccgacagcgacaacgagaagggcgagagaaacagcaagagagtgtgcttcaacgtggccggcgacgagcaggaggacagcggccacgacaccatcagcaacagagacagctacagcgactgcaacagcaacagaaacagcatcgccagcttcaccagcatctgcagcagccagtgcagcagctacttccacagcgacgagatggacagcggcgacgagctgcccctgagcgtgagaatcagccacgacaagcaggacaagatccacagctgcctggagcacctgttcagccaggtggacagcatcaccaacctgctgaagggccaggccgtggtgagagccttcgaccagaccaagtacctgacccccggcagaggcctgcaggagttccagcaggagatggagcccaagctgagctgccccaagagactgagactgcacatcaagcaggacccctggaacctgcccagcagcgtgagaaccctggcccagaacatcagaaagttcgtggaggaggtgaagtgcagactgctgctggccctgctggagtacagcgacagcgagacccagctgagaagagacatggtgttctgccagaccctggtggccaccgtgtgcgccttcagcgagcagctgatggccgccctgaaccagatgttcgacaacagcaaggagaacgagatggagacctgggaggccagcagaagatggctggaccagatcgccaacgccggcgtgctgttccacttccagagcctgctgagccccaacctgaccgacgagcaggccatgctggaggacaccctggtggccctgttcgacctggagaaggtgagcttctacttcaagcccagcgaggaggagcccctggtggccaacgtgcccctgacctaccaggccgagggcagcagacaggccctgaaggtgtacttctacatcgacagctaccacttcgagcagctgccccagagactgaagaacggcggcggcttcaagatccaccccgtgctgttcgcccaggccctggagagcatggagggctactactacagagacaacgtgagcgtggaggagttccaggcccagatcaacgccgccagcctggagaaggtgaagcagtacaaccagaagctgagagccttctacctggacaagagcaacagcccccccaacagcaccagcaaggccgcctacgtggacaagctgatgagacccctgaacgccctggacgagctgtacagactggtggccagcttcatcagaagcaagagaaccgccgcctgcgccaacaccgcctgcagcgccagcggcgtgggcctgctgagcgtgagcagcgagctgtgcaacagactgggcgcctgccacatcatcatgtgcagcagcggcgtgcacagatgcaccctgagcgtgaccctggagcaggccatcatcctggccagaagccacggcctgccccccagatacatcatgcaggccaccgacgtgatgagaaagcagggcgccagagtgcagaacaccgccaagaacctgggcgtgagagacagaaccccccagagcgcccccagactgtacaagctgtgcgagccccccccccccgccggcgaggagtag

SEQ ID NO: 93045 - DNA, 3525 bp, Artificial Sequence
  Description of Artificial Sequence: Synthetic coding sequence
atgagcgaggacagcagaggcgacagcagagccgagagcgccaaggacctggagaagcagctgagactgagagtgtgcgtgctgagcgagctgcagaagaccgagagagactacgtgggcaccctggagttcctggtgagcgccttcctgcacagaatgaaccagtgcgccgccagcaaggtggacaagaacgtgaccgaggagaccgtgaagatgctgttcagcaacatcgaggacatcctggccgtgcacaaggagttcctgaaggtggtggaggagtgcctgcaccccgagcccaacgcccagcaggaggtgggcacctgcttcctgcacttcaaggacaagttcagaatctacgacgagtactgcagcaaccacgagaaggcccagaagctgctgctggagctgaacaagatcagaaccatcagaaccttcctgctgaactgcatgctgctgggcggcagaaagaacaccgacgtgcccctggagggctacctggtgacccccatccagagaatctgcaagtaccccctgatcctgaaggagctgctgaagagaacccccagaaagcacagcgactacgccgccgtgatggaggccctgcaggccatgaaggccgtgtgcagcaacatcaacgaggccaagagacagatggagaagctggaggtgctggaggagtggcagagccacatcgagggctgggagggcagcaacatcaccgacacctgcaccgagatgctgatgtgcggcgtgctgctgaagatcagcagcggcaacatccaggagagagtgttcttcctgttcgacaacctgctggtgtactgcaagagaaagcacagaagactgaagaacagcaaggccagcaccgacggccacagatacctgttcagaggcagaatcaacaccgaggtgatggaggtggagaacgtggacgacggcaccgccgacttccacagcagcggccacatcgtggtgaacggctggaagatccacaacaccgccaagaacaagtggttcgtgtgcatggccaagacccccgaggagaagcacgagtggttcgaggccatcctgaaggagagagagagaagaaagggcctgaagctgggcatggagcaggacacctgggtgatgatcagcgagcagggcgagaagctgtacaagatgatgtgcagacagggcaacctgatcaaggacagaaagagaaagctgaccaccttccccaagtgcttcctgggcagcgagttcgtgagctggctgctggagatcggcgagatccacagacccgaggagggcgtgcacctgggccaggccctgctggagaacggcatcatccaccacgtgaccgacaagcaccagttcaagcccgagcagatgctgtacagattcagatacgacgacggcaccttctaccccagaaacgagatgcaggacgtgatcagcaagggcgtgagactgtactgcagactgcacagcctgttcacccccgtgatcagagacaaggactaccacctgagaacctacaagagcgtggtgatggccaacaagctgatcgactggctgatcgcccagggcgactgcagaaccagagaggaggccatgatcttcggcgtgggcctgtgcgacaacggcttcatgcaccacgtgctggagaagagcgagttcaaggacgagcccctgctgttcagattcttcagcgacgaggagatggagggcagcaacatgaagcacagactgatgaagcacgacctgaaggtggtggagaacgtgatcgccaagagcctgctgatcaagagcaacgagggcagctacggcttcggcctggaggacaagaacaaggtgcccatcatcaagctggtggagaagggcagcaacgccgagatggccggcatggaggtgggcaagaagatcttcgccatcaacggcgacctggtgttcatgagacccttcaacgaggtggactgcttcctgaagagctgcctgaacagcagaaagcccctgagagtgctggtgagcaccaagcccagagagaccgtgaagatccccgacagcgccgacggcctgggcttccagatcagaggcttcggccccagcgtggtgcacgccgtgggcagaggcaccgtggccgccgccgccggcctgcaccccggccagtgcatcatcaaggtgaacggcatcaacgtgagcaaggagacccacgccagcgtgatcgcccacgtgaccgcctgcagaaagtacagaagacccaccaagcaggacagcatccagtgggtgtacaacagcatcgagagcgcccaggaggacctgcagaagagccacagcaagccccccggcgacgaggccggcgacgccttcgactgcaaggtggaggaggtgatcgacaagttcaacaccatggccatcatcgacggcaagaaggagcacgtgagcctgaccgtggacaacgtgcacctggagtacggcgtggtgtacgagtacgacagcaccgccggcatcaagtgcaacgtggtggagaagatgatcgagcccaagggcttcttcagcctgaccgccaagatcctggaggccctggccaagagcgacgagcacttcgtgcagaactgcaccagcctgaacagcctgaacgaggtgatccccaccgacctgcagagcaagttcagcgccctgtgcagcgagagaatcgagcacctgtgccagagaatcagcagctacaagaaggtgagcgtgctgctgatcctgtacaccatcatcgtggagatgtaccacttcaccgagatgatcaccctgtacaacatcctggagctggtgagaccccccaacagcgagttcttcttcagcttcctgcccaccaagagaatgaagaccctgaaccagaagaaggtgacccacatgaagaagaccaacatccagctgcagttcagcagagtgctgaagaacagagcctggcccaccttcaagcaggccaagagcaagatcagccccctgcacagcagcgacttctgccccaccaactgccacgtgaacgtgatggaggtgagctaccccaagaccagcaccagcctgggcagcgccttcggcgtgcagtggaagctgagccccatggtgtacatccagcacaccatcaccaccatggccgcccccagcggcctgagcctgggccagcaggacggccacggcctgagatacctgctggagagaaagaccagcgagggcatcatccccaccgacagcgacaacgagaagggcgagagaaacagcaagagagtgtgcttcaacgtggccggcgacgagcaggaggacagcggccacgacaccatcagcaacagagacagctacagcttcagcgactgcaacagcaacagaaacagcatcgccagcttcaccagcatctgcagcagccagtgcagcagctacttccacagcgacgagatggacagcggcagcgacgagctgcccctgagcgtgagaatcagccacgacaagcaggacaagatccacagctgcctggagcacctgttcagccagtag

SEQ ID NO: 93046 - DNA, 1650 bp, Artificial Sequence
  Description of Artificial Sequence: Synthetic coding sequence
atggccagcgccagcagcggccccagcagcagcgtgggcttcagcagcttcgaccccgccgtgcccagctgcaccctgagcagcgccagcggcatcaagagacccatggccagcgaggtgccctacgccagcggcatgcccatcaagaagatcggccacagaagcgtggacagcagcggcgagaccacctacaagaagaccaccagcagcgccctgaagggcgccatccagctgggcatcacccacaccgtgggcagcctgagcaccaagcccgagagagacgtgctgatgcaggacttctacgtggtggagagcatcttcttccccagcgagggcagcaacctgacccccgcccaccactacaacgacttcagattcaagacctacgcccccgtggccttcagatacttcagagagctgttcggcatcagacccgacgactacctgtacagcctgtgcagcgagcccctgatcgagctgtgcagcagcggcgccagcggcagcctgttctacgtgagcagcgacgacgagttcatcatcaagaccgtgcagcacaaggaggccgagttcctgcagaagctgctgcccggctactacatgaacctgaaccagaaccccagaaccctgctgcccaagttctacggcctgtactgcgtgcaggccggcggcaagaacatcagaatcgtggtgatgaacaacctgctgcccagaagcgtgaagatgcacatcaagtacgacctgaagggcagcacctacaagagaagagccagccagaaggagagagagaagcccctgcccaccttcaaggacctggacttcctgcaggacatccccgacggcctgttcctggacgccgacatgtacaacgccctgtgcaagaccctgcagagagactgcctggtgctgcagagcttcaagatcatggactacagcctgctgatgagcatccacaacatcgaccacgcccagagagagcccctgagcagcgagacccagtacagcgtggacaccagaagacccgccccccagaaggccctgtacagcaccgccatggagagcatccagggcgaggccagaagaggcggcaccatggagaccgacgaccacatgggcggcatccccgccagaaacagcaagggcgagagactgctgctgtacatcggcatcatcgacatcctgcagagctacagattcgtgaagaagctggagcacagctggaaggccctggtgcacgacggcgacaccgtgagcgtgcacagacccggcttctacgccgagagattccagagattcatgtgcaacaccgtgttcaagaagatccccctgaagcccagccccagcaagaagttcagaagcggcagcagcttcagcagaagagccggcagcagcggcaacagctgcatcacctaccagcccagcgtgagcggcgagcacaaggcccaggtgaccaccaaggccgaggtggagcccggcgtgcacctgggcagacccgacgtgctgccccagaccccccccctggaggagatcagcgagggcagccccatccccgaccccagcttcagccccctggtgggcgagaccctgcagatgctgaccaccagcaccaccctggagaagctggaggtggccgagagcgagttcacccactag

SEQ ID NO: 93047 - DNA, 1689 bp, Artificial Sequence
  Description of Artificial Sequence: Synthetic coding sequence
atggccagcgccagcagcggccccagcagcagcgtgggcttcagcagcttcgaccccgccgtgcccagctgcaccctgagcagcgccgccagcggcatcaagagacccatggccagcgaggtgctggaggccagacaggacagctacatcagcctggtgccctacgccagcggcatgcccatcaagaagatcggccacagaagcgtggacagcagcggcgagaccacctacaagaagaccaccagcagcgccctgaagggcgccatccagctgggcatcacccacaccgtgggcagcctgagcaccaagcccgagagagacgtgctgatgcaggacttctacgtggtggagagcatcttcttccccagcgagggcagcaacctgacccccgcccaccactacaacgacttcagattcaagacctacgcccccgtggccttcagatacttcagagagctgttcggcatcagacccgacgactacctgtacagcctgtgcagcgagcccctgatcgagctgtgcagcagcggcgccagcggcagcctgttctacgtgagcagcgacgacgagttcatcatcaagaccgtgcagcacaaggaggccgagttcctgcagaagctgctgcccggctactacatgaacctgaaccagaaccccagaaccctgctgcccaagttctacggcctgtactgcgtgcaggccggcggcaagaacatcagaatcgtggtgatgaacaacctgctgcccagaagcgtgaagatgcacatcaagtacgacctgaagggcagcacctacaagagaagagccagccagaaggagagagagaagcccctgcccaccttcaaggacctggacttcctgcaggacatccccgacggcctgttcctggacgccgacatgtacaacgccctgtgcaagaccctgcagagagactgcctggtgctgcagagcttcaagatcatggactacagcctgctgatgagcatccacaacatcgaccacgcccagagagagcccctgagcagcgagacccagtacagcgtggacaccagaagacccgccccccagaaggccctgtacagcaccgccatggagagcatccagggcgaggccagaagaggcggcaccatggagaccgacgaccacatgggcggcatccccgccagaaacagcaagggcgagagactgctgctgtacatcggcatcatcgacatcctgcagagctacagattcgtgaagaagctggagcacagctggaaggccctggtgcacgacggcgacaccgtgagcgtgcacagacccggcttctacgccgagagattccagagattcatgtgcaacaccgtgttcaagaagatccccctgaagcccagccccagcaagaagttcagaagcggcagcagcttcagcagaagagccggcagcagcggcaacagctgcatcacctaccagcccagcgtgagcggcgagcacaaggcccaggtgaccaccaaggccgaggtggagcccggcgtgcacctgggcagacccgacgtgctgccccagaccccccccctggaggagatcagcgagggcagccccatccccgaccccagcttcagccccctggtgggcgagaccctgcagatgctgaccaccagcaccaccctggagaagctggaggtggccgagagcgagttcacccactag

SEQ ID NO: 93048 - DNA, 1503 bp, Artificial Sequence
  Description of Artificial Sequence: Synthetic coding sequence
atggccagcgccagcagcggccccagcagcagcgtgggcttcagcagcttcgaccccgccgtgcccagctgcaccctgagcagcgccagcggcatcaagagacccatggccagcgaggtgccctacgccagcggcatgcccatcaagaagatcggccacagaagcgtggacagcagcggcgagaccacctacaagaagaccaccagcagcgccctgaagggcgccatccagctgggcatcacccacaccgtgggcagcctgagcaccaagcccgagagagacgtgctgatgcaggacttctacgtggtggagagcatcttcttccccagcgagggcagcaacctgacccccgcccaccactacaacgacttcagattcaagacctacgcccccgtggccttcagatacttcagagagctgttcggcatcagacccgacgactacctgtacagcctgtgcagcgagcccctgatcgagctgtgcagcagcggcgccagcggcagcctgttctacgtgagcagcgacgacgagttcatcatcaagaccgtgcagcacaaggaggccgagttcctgcagaagctgctgcccggctactacatgaacctgaaccagaaccccagaaccctgctgcccaagttctacggcctgtactgcgtgcaggccggcggcaagaacatcagaatcgtggtgatgaacaacctgctgcccagaagcgtgaagatgcacatcaagtacgacctgaagggcagcacctacaagagaagagccagccagaaggagagagagaagcccctgcccaccttcaaggacctggacttcctgcaggacatccccgacggcctgttcctggacgccgacatgtacaacgccctgtgcaagaccctgcagagagactgcctggtgctgcagagcttcaagatcatggactacagcctgctgatgagcatccacaacatcgaccacgcccagagagagcccctgagcagcgagacccagtacagcgtggacaccagaagacccgccccccagaaggccctgtacagcaccgccatggagagcatccagggcgaggccagaagaggcggcaccatggagaccgacgaccacatgggcggcatccccgccagaaacagcaagggcgagagactgctgctgtacatcggcatcatcgacatcctgcagagctacagattcgtgaagaagctggagcacagctggaaggccctggtgcacgacggcgacaccgtgagcgtgcacagacccggcttctacgccgagagattccagagattcatgtgcaacaccgtgttcaagaagatcccctgcgtgcacctgggcagacccgacgtgctgccccagaccccccccctggaggagatcagcgagggcagccccatccccgaccccagcttcagccccctggtgggcgagaccctgcagatgctgaccaccagcaccaccctggagaagctggaggtggccgagagcgagttcacccactag

SEQ ID NO: 93049 - DNA, 1653 bp, Artificial Sequence
  Description of Artificial Sequence: Synthetic coding sequence
atggccagcgccagcagcggccccagcagcagcgtgggcttcagcagcttcgaccccgccgtgcccagctgcaccctgagcagcgccgccagcggcatcaagagacccatggccagcgaggtgccctacgccagcggcatgcccatcaagaagatcggccacagaagcgtggacagcagcggcgagaccacctacaagaagaccaccagcagcgccctgaagggcgccatccagctgggcatcacccacaccgtgggcagcctgagcaccaagcccgagagagacgtgctgatgcaggacttctacgtggtggagagcatcttcttccccagcgagggcagcaacctgacccccgcccaccactacaacgacttcagattcaagacctacgcccccgtggccttcagatacttcagagagctgttcggcatcagacccgacgactacctgtacagcctgtgcagcgagcccctgatcgagctgtgcagcagcggcgccagcggcagcctgttctacgtgagcagcgacgacgagttcatcatcaagaccgtgcagcacaaggaggccgagttcctgcagaagctgctgcccggctactacatgaacctgaaccagaaccccagaaccctgctgcccaagttctacggcctgtactgcgtgcaggccggcggcaagaacatcagaatcgtggtgatgaacaacctgctgcccagaagcgtgaagatgcacatcaagtacgacctgaagggcagcacctacaagagaagagccagccagaaggagagagagaagcccctgcccaccttcaaggacctggacttcctgcaggacatccccgacggcctgttcctggacgccgacatgtacaacgccctgtgcaagaccctgcagagagactgcctggtgctgcagagcttcaagatcatggactacagcctgctgatgagcatccacaacatcgaccacgcccagagagagcccctgagcagcgagacccagtacagcgtggacaccagaagacccgccccccagaaggccctgtacagcaccgccatggagagcatccagggcgaggccagaagaggcggcaccatggagaccgacgaccacatgggcggcatccccgccagaaacagcaagggcgagagactgctgctgtacatcggcatcatcgacatcctgcagagctacagattcgtgaagaagctggagcacagctggaaggccctggtgcacgacggcgacaccgtgagcgtgcacagacccggcttctacgccgagagattccagagattcatgtgcaacaccgtgttcaagaagatccccctgaagcccagccccagcaagaagttcagaagcggcagcagcttcagcagaagagccggcagcagcggcaacagctgcatcacctaccagcccagcgtgagcggcgagcacaaggcccaggtgaccaccaaggccgaggtggagcccggcgtgcacctgggcagacccgacgtgctgccccagaccccccccctggaggagatcagcgagggcagccccatccccgaccccagcttcagccccctggtgggcgagaccctgcagatgctgaccaccagcaccaccctggagaagctggaggtggccgagagcgagttcacccactag

SEQ ID NO: 93050 - DNA, 597 bp, Artificial Sequence
  Description of Artificial Sequence: Synthetic coding sequence
atgtacaacgccctgtgcaagaccctgcagagagactgcctggtgctgcagagcttcaagatcatggactacagcctgctgatgagcatccacaacatcgaccacgcccagagagagcccctgagcagcgagacccagtacagcgtggacaccagaagacccgccccccagaaggccctgtacagcaccgccatggagagcatccagggcgaggccagaagaggcggcaccatggagaccgacgaccacatgggcggcatccccgccagaaacagcaagggcgagagactgctgctgtacatcggcatcatcgacatcctgcagagctacagattcgtgaagaagctggagcacagctggaaggccctggtgcacgacggcgacaccgtgagcgtgcacagacccggcttctacgccgagagattccagagattcatgtgcaacaccgtgttcaagaagatccccctgcagccctggaagagcctgaagctgcagagccagagcagccccatcaagagaaaggccagcgaggacctggagcaggacagcgccatcagcgtgatccccagatgccagcccctgccccagcagtgctag

SEQ ID NO: 93051 - DNA, 261 bp, Artificial Sequence
  Description of Artificial Sequence: Synthetic coding sequence
atggccagcgaggtgctggaggccagacaggacagctacatcagcctggtgccctacgccagcggcatgcccatcaagaagatcggccacagaagcgtggacagcagcggcgagaccacctacaagaagaccaccagcagcgccctgaagggcgccatccagctgggcatcacccacaccgtgggcagcctgagcaccaagcccgagagagacgtgctgatgcaggacttctacgtggtggagagcatcttcttcccctag

SEQ ID NO: 93052 - DNA, 1569 bp, Artificial Sequence
  Description of Artificial Sequence: Synthetic coding sequence
atggccagcgccagcagcggccccagcagcagcgtgggcttcagcagcttcgaccccgccgtgcccagctgcaccctgagcagcgccgccagcggcatcaagagacccatggccagcgaggtgccctacgccagcggcatgcccatcaagaagatcggccacagaagcgtggacagcagcggcgagaccacctacaagaagaccaccagcagcgccctgaagggcgccatccagctgggcatcacccacaccgtgggcagcctgagcaccaagcccgagagagacgtgctgatgcaggacttctacgtggtggagagcatcttcttccccagcgagggcagcaacctgacccccgcccaccactacaacgacttcagattcaagacctacgcccccgtggccttcagatacttcagagagctgttcggcatcagacccgacgactacctgtacagcctgtgcagcgagcccctgatcgagctgtgcagcagcggcgccagcggcagcctgttctacgtgagcagcgacgacgagttcatcatcaagaccgtgcagcacaaggaggccgagttcctgcagaagctgctgcccggctactacatgaacctgaaccagaaccccagaaccctgctgcccaagttctacggcctgtactgcgtgcaggccggcggcaagaacatcagaatcgtggtgatgaacaacctgctgcccagaagcgtgaagatgcacatcaagtacgacctgaagggcagcacctacaagagaagagccagccagaaggagagagagaagcccctgcccaccttcaaggacctggacttcctgcaggacatccccgacggcctgttcctggacgccgacatgtacaacgccctgtgcaagaccctgcagagagactgcctggtgctgcagagcttcaagatcatggactacagcctgctgatgagcatccacaacatcgaccacgcccagagagagcccctgagcagcgagacccagtacagcgtggacaccagaagacccgccccccagaaggccctgtacagcaccgccatggagagcatccagggcgaggccagaagaggcggcaccatggagaccgacgaccagttcgtgaagaagctggagcacagctggaaggccctggtgcacgacggcgacaccgtgagcgtgcacagacccggcttctacgccgagagattccagagattcatgtgcaacaccgtgttcaagaagatccccctgaagcccagccccagcaagaagttcagaagcggcagcagcttcagcagaagagccggcagcagcggcaacagctgcatcacctaccagcccagcgtgagcggcgagcacaaggcccaggtgaccaccaaggccgaggtggagcccggcgtgcacctgggcagacccgacgtgctgccccagaccccccccctggaggagatcagcgagggcagccccatccccgaccccagcttcagccccctggtgggcgagaccctgcagatgctgaccaccagcaccaccctggagaagctggaggtggccgagagcgagttcacccactag

SEQ ID NO: 93053 - DNA, 1623 bp, Artificial Sequence
  Description of Artificial Sequence: Synthetic coding sequence
atgagcagcgccgccgagaacggcgaggccgcccccggcaagcagaacgaggagaagacctacaagaagaccgccagcagcgccatcaagggcgccatccagctgggcatcggctacaccgtgggcaacctgaccagcaagcccgagagagacgtgctgatgcaggacttctacgtggtggagagcgtgttcctgcccagcgagggcagcaacctgacccccgcccaccactaccccgacttcagattcaagacctacgcccccctggccttcagatacttcagagagctgttcggcatcaagcccgacgactacctgtacagcatctgcagcgagcccctgatcgagctgagcaaccccggcgccagcggcagcctgttcttcgtgaccagcgacgacgagttcatcatcaagaccgtgcagcacaaggaggccgagttcctgcagaagctgctgcccggctactacatgaacctgaaccagaaccccagaaccctgctgcccaagttctacggcctgtactgcatgcagagcggcggcatcaacatcagaatcgtggtgatgaacaacgtgctgcccagaagcatgagaatgcacttcacctacgacctgaagggcagcacctacaagagaagagccagcagaaaggagagagagaagagcaaccccaccttcaaggacctggacttcctgcaggacatgcacgagggcctgtacttcgacaccgagacctacaacgccctgatgaagaccctgcagagagactgcagagtgctggagagcttcaagatcatggactacagcctgctgctgggcatccacttcctggaccacagcctgaaggagaaggaggaggagaccccccagaacgtgcccgacgccaagagaaccggcatgcagaaggtgctgtacagcaccgccatggagagcatccagggccccggcaagagcggcgacggcatcatcaccgagaaccccgacaccatgggcggcatccccgccaagagccacagaggcgagaagctgctgctgttcatgggcatcatcgacatcctgcagagctacagactgatgaagaagctggagcacagctggaaggccctggtgtacgacggcgacaccgtgagcgtgcacagacccagcttctacgccgacagattcctgaagttcatgaacagcagagtgttcaagaagatccaggccctgaaggccagccccagcaagaagagatgcaacagcatcgccgccctgaaggccaccagccaggagatcgtgagcagcatcagccaggagtggaaggacgagaagagagacctgctgaccgagggccagagcttcagcagcctggacgaggaggccctgggcagcagacacagacccgacctggtgcccagcacccccagcctgttcgaggccgccagcctggccaccaccatcagcagcagcagcctgtacgtgaacgagcactacccccacgacagacccaccctgtacagcaacagcaagggcctgcccagcagcagcaccttcaccctggaggagggcaccatctacctgaccgccgagcccaacaccctggaggtgcaggacgacaacgccagcgtgctggacgtgtacctgtag

SEQ ID NO: 93054 - DNA, 312 bp, Artificial Sequence
  Description of Artificial Sequence: Synthetic coding sequence
atgagcagcgccgccgagaacggcgaggccgcccccggcaagcagaacgaggagaagacctacaagaagaccgccagcagcgccatcaagggcgccatccagctgggcatcggctacaccgtgggcaacctgaccagcaagcccgagagagacgtgctgatgcaggacttctacgtggtggagagcgtgttcctgcccagcgagggcagcaacctgacccccgcccaccactaccccgacttcagattcaagacctacgcccccctggccttcagatacttcagagagctgttcggcatcaagcccgactag

SEQ ID NO: 93055 - DNA, 1623 bp, Artificial Sequence; identical to SEQ ID NO: 93053
  Description of Artificial Sequence: Synthetic coding sequence

SEQ ID NO: 93056 - DNA, 1350 bp, Artificial Sequence
  Description of Artificial Sequence: Synthetic coding sequence
atgcaggacttctacgtggtggagagcgtgttcctgcccagcgagggcagcaacctgacccccgcccaccactaccccgacttcagattcaagacctacgcccccctggccttcagatacttcagagagctgttcggcatcaagcccgacgactacctgtacagcatctgcagcgagcccctgatcgagctgagcaaccccggcgccagcggcagcctgttcttcgtgaccagcgacgacgagttcatcatcaagaccgtgcagcacaaggaggccgagttcctgcagaagctgctgcccggctactacatgaacctgaaccagaaccccagaaccctgctgcccaagttctacggcctgtactgcatgcagagcggcggcatcaacatcagaatcgtggtgatgaacaacgtgctgcccagaagcatgagaatgcacttcacctacgacctgaagggcagcacctacaagagaagagccagcagaaaggagagagagaagagcaaccccaccttcaaggacctggacttcctgcaggacatgcacgagggcctgtacttcgacaccgagacctacaacgccctgatgaagaccctgcagagagactgcagagtgctggagagcttcaagatcatggactacagcctgctgctgggcatccacttcctggaccacagcctgaaggagaaggaggaggagaccccccagaacgtgcccgacgccaagagaaccggcatgcagaaggtgctgtacagcaccgccatggagagcatccagggccccggcaagagcggcgacggcatcatcaccgagaaccccgacaccatgggcggcatccccgccaagagccacagaggcgagaagctgctgctgttcatgggcatcatcgacatcctgcagagctacagactgatgaagaagctggagcacagctggaaggccctggtgtacgacggcgacaccgtgagcgtgcacagacccagcttctacgccgacagattcctgaagttcatgaacagcagagtgttcaagaagatccaggccctgaaggccagccccagcaagaagagatgcaacagcatcgccgccctgaaggccaccagccaggagatcgtgagcagcatcagccaggagtggaaggacgagaagagagacctgctgaccgagggccagagcttcagcagcctggacgaggaggccctgggcagcagacacagacccgacctggtgcccagcacccccagcctgttcgaggccgccagcctggccaccaccatcagcagcagcagcctgtacgtgaacgagcactacccccacgacagacccaccctgtacagcaacagcaagtag

SEQ ID NO: 93057 - DNA, 489 bp, Artificial Sequence
  Description of Artificial Sequence: Synthetic coding sequence
atgagcagcgccgccgagaacggcgaggccgcccccggcaagcagaacgaggagaagacctacaagaagaccgccagcagcgccatcaagggcgccatccagctgggcatcggctacaccgtgggcaacctgaccagcaagcccgagagagacgtgctgatgcaggacttctacgtggtggagagcgtgttcctgcccagcgagggcagcaacctgacccccgcccaccactaccccgacttcagattcaagacctacgcccccctggccttcagatacttcagagagctgttcggcatcaagcccgacgactacctgtacagcatctgcagcgagcccctgatcgagctgagcaaccccggcgccagcggcagcctgttcttcgtgaccagcgacgacgagttcatcatcaagaccgtgcagcacaaggaggccgagttcctgcagaagctgctgcccggctactacatgaacctgaaccagaactag

SEQ ID NO: 93058 - DNA, 474 bp, Artificial Sequence
  Description of Artificial Sequence: Synthetic coding sequence
atgagcagcgccgccgagaacggcgaggccgcccccggcaagcagaacgaggagaagacctacaagaagaccgccagcagcgccatcaagggcgccatccagctgggcatcggctacaccgtgggcaacctgaccagcaagcccgagagagacgtgctgatgcaggacttctacgtggtggagagcgtgttcctgcccagcgagggcagcaacctgacccccgcccaccactaccccgacttcagattcaagacctacgcccccctggccttcagatacttcagagagctgttcggcatcaagcccgacgactacctgtacagcatctgcagcgagcccctgatcgagctgagcaaccccggcgccagcggcagcctgttcttcgtgaccagcgacgacgagttcatcatcaagaccgtgcagcacaaggaggccgagttcctgcagaagctgctgcccggctactacatgtag

SEQ ID NO: 93059 - DNA, 1509 bp, Artificial Sequence
  Description of Artificial Sequence: Synthetic coding sequence
atgagcagcgccgccgagaacggcgaggccgcccccggcaagcagaacgaggagaagacctacaagaagaccgccagcagcgccatcaagggcgccatccagctgggcatcggctacaccgtgggcaacctgaccagcaagcccgagagagacgtgctgatgcaggacttctacgtggtggagagcgtgttcctgcccagcgagggcagcaacctgacccccgcccaccactaccccgacttcagattcaagacctacgcccccctggccttcagatacttcagagagctgttcggcatcaagcccgacgactacctgtacagcatctgcagcgagcccctgatcgagctgagcaaccccggcgccagcggcagcctgttcttcgtgaccagcgacgacgagttcatcatcaagaccgtgcagcacaaggaggccgagttcctgcagaagctgctgcccggctactacatgaacctgaaccagaaccccagaaccctgctgcccaagttctacggcctgtactgcatgcagagcggcggcatcaacatcagaatcgtggtgatgaacaacgtgctgcccagaagcatgagaatgcacttcacctacgacctgaagggcagcacctacaagagaagagccagcagaaaggagagagagaagagcaaccccaccttcaaggacctggacttcctgcaggacatgcacgagggcctgtacttcgacaccgagacctacaacgccctgatgaagaccctgcagagagactgcagagtgctggagagcttcaagatcatggactacagcctgctgctgggcatccacttcctggaccacagcctgaaggagaaggaggaggagaccccccagaacgtgcccgacgccaagagaaccggcatgcagaaggtgctgtacagcaccgccatggagagcatccagggccccggcaagagcggcgacggcatcatcaccgagaaccccgacaccatgggcggcatccccgccaagagccacagaggcgagaagctgctgctgttcatgggcatcatcgacatcctgcagagctacagactgatgaagaagctggagcacagctggaaggccctggtgtacgacggcgacaccgtgagcgtgcacagacccagcttctacgccgacagattcctgaagttcatgaacagcagagtgttcaagaagatccaggccctgaaggccagccccagcaagaagagatgcaacagcatcgccgccctgaaggccaccagccaggagatcgtgagcagcatcagccaggagtggaaggacgagaagagagacctgctgaccgagggccagagcttcagcagcctggacgaggaggccctgggcagcagacacagacccgacctggtgcccagcacccccagcctgttcgaggccgccagcctggccaccaccatcagcagcagcagcctgtacgtgaacgagcactacccccacgacagacccaccctgtacagcaacagcaagtag

SEQ ID NO: 93060 - DNA, 2007 bp, Artificial Sequence
  Description of Artificial Sequence: Synthetic coding sequence
atggagctggaggtgcccgacgaggccgagagcgccgaggccggcgccgtgcccagcgaggccgcctgggccgccgagagcggcgccgccgccggcctggcccagaagaaggccgcccccaccgaggtgctgagcatgaccgcccagcccggccccggccacggcaagaagctgggccacagaggcgtggacgccagcggcgagaccacctacaagaagaccaccagcagcaccctgaagggcgccatccagctgggcatcggctacaccgtgggccacctgagcagcaagcccgagagagacgtgctgatgcaggacttctacgtggtggagagcatcttcttccccagcgagggcagcaacctgacccccgcccaccacttccaggacttcagattcaagacctacgcccccgtggccttcagatacttcagagagctgttcggcatcagacccgacgactacctgtacagcctgtgcaacgagcccctgatcgagctgagcaaccccggcgccagcggcagcctgttctacgtgaccagcgacgacgagttcatcatcaagaccgtgatgcacaaggaggccgagttcctgcagaagctgctgcccggctactacatgaacctgaaccagaaccccagaaccctgctgcccaagttctacggcctgtactgcgtgcagagcggcggcaagaacatcagagtggtggtgatgaacaacatcctgcccagagtggtgaagatgcacctgaagttcgacctgaagggcagcacctacaagagaagagccagcaagaaggagaaggagaagagcttccccacctacaaggacctggacttcatgcaggacatgcccgagggcctgctgctggacgccgacaccttcagcgccctggtgaagaccctgcagagagactgcctggtgctggagagcttcaagatcatggactacagcctgctgctgggcgtgcacaacatcgaccagcacgagagagagagacaggcccagggcgcccagagcaccagcgacgagaagagacccgtgggccagaaggccctgtacagcaccgccatggagagcatccagggcggcgccgccagaggcgaggccatcgagagcgacgacaccatgggcggcatccccgccgtgaacggcagaggcgagagactgctgctgcacatcggcatcatcgacatcctgcagagctacagattcatcaagaagctggagcacacctggaaggccctggtgcacgacggcgacaccgtgagcgtgcacagacccagcttctacgccgagagattcttcaagttcatgagcaacaccgtgttcagaaagaacagcagcctgaagagcagccccagcaagaagggcagaggcggcgccctgctggccgtgaagcccctgggccccaccgccgccttcagcgccagccagatccccagcgagagagaggaggcccagtacgacctgagaggcgccagaagctaccccaccctggaggacgagggcagacccgacctgctgccctgcaccccccccagcttcgaggaggccaccaccgccagcatcgccaccaccctgagcagcaccagcctgagcatccccgagagaagccccagcgagaccagcgagcagcccagatacagaagaagaacccagagcagcggccaggacggcagaccccaggaggagccccccgccgaggaggacctgcagcagatcaccgtgcaggtggagcccgcctgcagcgtggagatcgtggtgcccaaggaggaggacgccggcgtggaggccagccccgccggcgccagcgccgccgtggaggtggagaccgccagccaggccagcgacgaggagggcgcccccgccagccaggccagcgacgaggaggacgcccccgccaccgacatctacttccccaccgacgagagaagctgggtgtacagccccctgcactacagcgcccaggccccccccgccagcgacggcgagagcgacacctag

SEQ ID NO: 93061 - DNA, 2103 bp, Artificial Sequence
  Description of Artificial Sequence: Synthetic coding sequence
atggagctggaggtgcccgacgaggccgagagcgccgaggccggcgccgtgcccagcgaggccgcctgggccgccgagagcggcgccgccgccggcctggcccagaagaaggccgcccccaccgaggtgctgagcatgaccgcccagcccggccccggccacggcaagaagctgggccacagaggcgtggacgccagcggcgagaccacctacaagaagaccaccagcagcaccctgaagggcgccatccagctgggcatcggctacaccgtgggccacctgagcagcaagcccgagagagacgtgctgatgcaggacttctacgtggtggagagcatcttcttccccagcgagggcagcaacctgacccccgcccaccacttccaggacttcagattcaagacctacgcccccgtggccttcagatacttcagagagctgttcggcatcagacccgacgactacctgtacagcctgtgcaacgagcccctgatcgagctgagcaaccccggcgccagcggcagcctgttctacgtgaccagcgacgacgagttcatcatcaagaccgtgatgcacaaggaggccgagttcctgcagaagctgctgcccggctactacatgaacctgaaccagaaccccagaaccctgctgcccaagttctacggcctgtactgcgtgcagagcggcggcaagaacatcagagtggtggtgatgaacaacatcctgcccagagtggtgaagatgcacctgaagttcgacctgaagggcagcacctacaagagaagagccagcaagaaggagaaggagaagagcttccccacctacaaggacctggacttcatgcaggacatgcccgagggcctgctgctggacgccgacaccttcagcgccctggtgaagaccctgcagagagactgcctggtgctggagagcttcaagatcatggactacagcctgctgctgggcgtgcacaacatcgaccagcacgagagagagagacaggcccagggcgcccagagcaccagcgacgagaagagacccgtgggccagaaggccctgtacagcaccgccatggagagcatccagggcggcgccgccagaggcgaggccatcgagagcgacgacaccatgggcggcatccccgccgtgaacggcagaggcgagagactgctgctgcacatcggcatcatcgacatcctgcagagctacagattcatcaagaagctggagcacacctggaaggccctggtgcacgacggcgacaccgtgagcgtgcacagacccagcttctacgccgagagattcttcaagttcatgagcaacaccgtgttcagaaagaacagcagcctgaagagcagccccagcaagaagggcagaggcggcgccctgctggccgtgaagcccctgggccccaccgccgccttcagcgccagccagatccccagcgagagagaggaggcccagtacgacctgagaggcgccagaagctaccccaccctggaggacgagggcagacccgacctgctgccctgcaccccccccagcttcgaggaggccaccaccgccagcatcgccaccaccctgagcagcaccagcctgagcatccccgagagaagccccagcgagaccagcgagcagcccagatacagaagaagaacccagagcagcggccaggacggcagaccccaggaggagccccccgccgaggaggacctgcagcagatcaccgtgcaggtggagcccgcctgcagcgtggagatcgtggtgcccaaggaggaggacgccggcgtggaggccagccccgccggcgccagcgccgccgtggaggtggagaccgccagccaggccagcgacgaggagggcgcccccgccagccaggccagcgacgaggaggacgcccccgccaccgacatctacttctggagactgtggggcccccacgcccccacctggccctggagaagagagggcagagccgcctgcctgtgcccctaccccccccacgtggtgacccccttccccggcaccggcctgtgcgccagctggagccccgacggcaccggcggcctgggcgccatgagctgctgcgtgagcgtgagctag

SEQ ID NO: 93062 - DNA, 1923 bp, Artificial Sequence
  Description of Artificial Sequence: Synthetic coding sequence
atggagctggaggtgcccgacgaggccgagagcgccgaggccggcgccgtgcccagcgaggccgcctgggccgccgagagcggcgccgccgccggcctggcccagaagaaggccgcccccaccgaggtgctgagcatgaccgcccagcccggccccggccacggcaagaagctgggccacagaggcgtggacgccagcggcgagaccacctacaagaagaccaccagcagcaccctgaagggcgccatccagctgggcatcggctacaccgtgggccacctgagcagcaagcccgagagagacgtgctgatgcaggacttctacgtggtggagagcatcttcttccccagcgagggcagcaacctgacccccgcccaccacttccaggacttcagattcaagacctacgcccccgtggccttcagatacttcagagagctgttcggcatcagacccgacgactacctgtacagcctgtgcaacgagcccctgatcgagctgagcaaccccggcgccagcggcagcctgttctacgtgaccagcgacgacgagttcatcatcaagaccgtgatgcacaaggaggccgagttcctgcagaagctgctgcccggctactacatgaacctgaaccagaaccccagaaccctgctgcccaagttctacggcctgtactgcgtgcagagcggcggcaagaacatcagagtggtggtgatgaacaacatcctgcccagagtggtgaagatgcacctgaagttcgacctgaagggcagcacctacaagagaagagccagcaagaaggagaaggagaagagcttccccacctacaaggacctggacttcatgcaggacatgcccgagggcctgctgctggacgccgacaccttcagcgccctggtgaagaccctgcagagagactgcctggtgctggagagcttcaagatcatggactacagcctgctgctgggcgtgcacaacatcgaccagcacgagagagagagacaggcccagggcgcccagagcaccagcgacgagaagagacccgtgggccagaaggccctgtacagcaccgccatggagagcatccagggcggcgccgccagaggcgaggccatcgagagcgacgacaccatgggcggcatccccgccgtgaacggcagaggcgagagactgctgctgcacatcggcatcatcgacatcctgcagagctacagattcatcaagaagctggagcacacctggaaggccctggtgcacgacggcgacaccgtgagcgtgcacagacccagcttctacgccgagagattcttcaagttcatgagcaacaccgtgttcagaaagaacagcagcctgaagagcagccccagcaagaagggcagaggcggcgccctgctggccgtgaagcccctgggccccaccgccgccttcagcgccagccagatccccagcgagagagaggaggcccagtacgacctgagaggcgccagaagctaccccaccctggaggacgagggcagacccgacctgctgccctgcaccccccccagcttcgaggaggccaccaccgccagcatcgccaccaccctgagcagcaccagcctgagcatccccgagagaagccccagcgagaccagcgagcagcccagatacagaagaagaacccagagcagcggccaggacggcagaccccaggaggagccccccgccgaggaggacctgcagcagatcaccgtgcaggtggagcccgcctgcagcgtggagatcgtggtgcccaaggaggaggacgccggcgtggaggccagccccgccggcgccagcgccgccgtggaggtggagaccgccagccaggccagcgacgaggagggcgcccccgccagccaggccagcgacgaggaggacgcccccgccaccgacatctacttctag

SEQ ID NO: 93063 - DNA, 576 bp, Artificial Sequence
  Description of Artificial Sequence: Synthetic coding sequence
atgcagagcgtgttctaccccgccggcagaatcagcgagagatacgacatcaagggctgcgaggtgagcagatgggtggaccccgcccccgagggcagccccctggtgctggtgctgaaggacctgaacttccagggcaagaccatcaacctgggcccccagagaagctggttcctgagacagatggagctggacaccaccttcctgagagagctgaacgtgctggactacagcctgctgatcgccttccagagactgcacgaggacgagagaggccccggcagcagcctgatcttcagaaccgccagaagcgtgcagggcgcccagagccccgaggagagcagagcccagaacagaagactgctgcccgacgcccccaacgccctgcacatcctggacggccccgagcagagatacttcctgggcgtggtggacctggccaccgtgtacggcctgagaaagagactggagcacctgtggaagaccctgagataccccggcagaaccttcagcaccgtgagccccgccagatacgccagaagactgtgccagtgggtggaggcccacaccgagtag

SEQ ID NO: 93064 - DNA, 1185 bp, Artificial Sequence
  Description of Artificial Sequence: Synthetic coding sequence
atggccgcccccagccccggccccagagaggtgctggcccccagccccgaggccggctgcagagccgtgaccagcagcagaagaggcctgctgtggagactgagagacaagcagagcagactgggcctgttcgagatcagccccggccacgagctgcacggcatgacctgcatgatgcaggccggcctgtgggccgccacccaggtgagcatggaccacccccccaccggcccccccagcagagacgacttcagcgaggtgctgacccaggtgcacgagggcttcgagctgggcaccctggccggccccgccttcgcctggctgagaagaagcctgggcctggccgaggaggactaccaggccgccctgggccccggcggcccctacctgcagttcctgagcaccagcaagagcaaggccagcttcttcctgagccacgaccagagattcttcctgaagacccagggcagaagagaggtgcaggccctgctggcccacctgcccagatacgtgcagcacctgcagagacacccccacagcctgctggccagactgctgggcgtgcacagcctgagagtggacagaggcaagaagacctacttcatcgtgatgcagagcgtgttctaccccgccggcagaatcagcgagagatacgacatcaagggctgcgaggtgagcagatgggtggaccccgcccccgagggcagccccctggtgctggtgctgaaggacctgaacttccagggcaagaccatcaacctgggcccccagagaagctggttcctgagacagatggagctggacaccaccttcctgagagagctgaacgtgctggactacagcctgctgatcgccttccagagactgcacgaggacgagagaggccccggcagcagcctgatcttcagaaccgccagaagcgtgcagggcgcccagagccccgaggagagcagagcccagaacagaagactgctgcccgacgcccccaacgccctgcacatcctggacggccccgagcagagatacttcctgggcgtggtggacctggccaccgtgtacggcctgagaaagagactggagcacctgtggaagaccctgagataccccggcagaaccttcagcaccgtgagccccgccagatacgccagaagactgtgccagtgggtggaggcccacaccgagtag

SEQ ID NO: 93065 - DNA, 1128 bp, Artificial Sequence
  Description of Artificial Sequence: Synthetic coding sequence
atgatgtgccagagcgaggccagacagggccccgagctgagagccgccaagtggctgcacttcccccagctggccctgagaagaagactgggccagctgagctgcatgagcagacccgccctgaagctgagaagctggcccctgaccgtgctgtactacctgctgcccttcggcgccctgagacccctgagcagagtgggctggagacccgtgagcagagtggccctgtacaagagcgtgcccaccagactgctgagcagagcctggggcagactgaaccaggtggagctgccccactggctgagaagacccgtgtacagcctgtacatctggaccttcggcgtgaacatgaaggaggccgccgtggaggacctgcaccactacagaaacctgagcgagttcttcagaagaaagctgaagccccaggccagacccgtgtgcggcctgcacagcgtgatcagccccagcgacggcagaatcctgaacttcggccaggtgaagaactgcgaggtggagcaggtgaagggcgtgacctacagcctggagagcttcctgggccccagaatgtgcaccgaggacctgcccttcccccccgccgccagctgcgacagcttcaagaaccagctggtgaccagagagggcaacgagctgtaccactgcgtgatctacctggcccccggcgactaccactgcttccacagccccaccgactggaccgtgagccacagaagacacttccccggcagcctgatgagcgtgaaccccggcatggccagatggatcaaggagctgttctgccacaacgagagagtggtgctgaccggcgactggaagcacggcttcttcagcctgaccgccgtgggcgccaccaacgtgggcagcatcagaatctacttcgacagagacctgcacaccaacagccccagacacagcaagggcagctacaacgacttcagcttcgtgacccacaccaacagagagggcgtgcccatgagaaagggcgagcacctgggcgagttcaacctgggcagcaccatcgtgctgatcttcgaggcccccaaggacttcaacttccagctgaagaccggccagaagatcagattcggcgaggccctgggcagcctgtag

SEQ ID NO: 93066 - DNA, 1227 bp, Artificial Sequence
  Description of Artificial Sequence: Synthetic coding sequence
atggccaccagcgtgggccacagatgcctgggcctgctgcacggcgtggccccctggagaagcagcctgcacccctgcgagatcaccgccctgagccagagcctgcagcccctgagaaagctgcccttcagagccttcagaaccgacgccagaaagatccacaccgcccccgccagaaccatgttcctgctgagacccctgcccatcctgctggtgaccggcggcggctacgccggctacagacagtacgagaagtacagagagagagagctggagaagctgggcctggagatcccccccaagctggccggccactgggaggtggccctgtacaagagcgtgcccaccagactgctgagcagagcctggggcagactgaaccaggtggagctgccccactggctgagaagacccgtgtacagcctgtacatctggaccttcggcgtgaacatgaaggaggccgccgtggaggacctgcaccactacagaaacctgagcgagttcttcagaagaaagctgaagccccaggccagacccgtgtgcggcctgcacagcatcagccccagcgacggcagaatcctgaacttcggccaggtgaagaactgcgaggtggagcaggtgaagggcgtgacctacagcctggagagcttcctgggccccagaatgtgcaccgaggacctgcccttcccccccgccgccagctgcgacagcttcaagaaccagctggtgaccagagagggcaacgagctgtaccactgcgtgatctacctggcccccggcgactaccactgcttccacagccccaccgactggaccgtgagccacagaagacacttccccggcagcctgatgagcgtgaaccccggcatggccagatggatcaaggagctgttctgccacaacgagagagtggtgctgaccggcgactggaagcacggcttcttcagcctgaccgccgtgggcgccaccaacgtgggcagcatcagaatctacttcgacagagacctgcacaccaacagccccagacacagcaagggcagctacaacgacttcagcttcgtgacccacaccaacagagagggcgtgcccatgagaaagggcgagcacctgggcgagttcaacctgggcagcaccatcgtgctgatcttcgaggcccccaaggacttcaacttccagctgaagaccggccagaagatcagattcggcgaggccctgggcagcctgtag

SEQ ID NO: 93067 - DNA, 1128 bp, Artificial Sequence; identical to SEQ ID NO: 93065
  Description of Artificial Sequence: Synthetic coding sequence

SEQ ID NO: 93068 - DNA, 789 bp, Artificial Sequence
  Description of Artificial Sequence: Synthetic coding sequence
atgatgtgccagagcgaggccagacagggccccgagctgagagccgccaagtggctgcacttcccccagctggccctgagaagaagactgggccagctgagctgcatgagcagacccgccctgaagctgagaagctggcccctgaccgtgctgtactacctgctgcccttcggcgccctgagacccctgagcagagtgggctggagacccgtgagcagagtggccctgtacaagagcgtgcccaccagactgctgagcagagcctggggcagactgaaccaggtggagctgccccactggctgagaagacccgtgtacagcctgtacatctggaccttcggcgtgaacatgaaggaggccgccgtggaggacctgcaccactacagaaacctgagcgagttcttcagaagaaagctgaagccccaggccagacccgtgtgcggcctgcacagcgtgatcagccccagcgacggcagaatcctgaacttcggccaggtgaagaactgcgaggtggagcaggtgaagggcgtgacctacagcctggagagcttcctgggccccagaatgtgcaccgaggacctgcccttcccccccgccgccagctgcgacagcttcaagaaccagctggtgaccagagagggcaacgagctgtaccactgcgtgatctacctggcccccggcgactaccactgcttccacagccccaccgactggaccgtgagccacagaagacacttccccggccccgcccacaagcagcccaaggcccagcagggcctgctgcagtag

SEQ ID NO: 93069 - DNA, 687 bp, Artificial Sequence
  Description of Artificial Sequence: Synthetic coding sequence
atgatgtgccagagcgaggccagacagggccccgagctgagagccgccaagtggctgcacttcccccagctggccctgagaagaagactgggccagctgagctgcatgagcagacccgccctgaagctgagaagctggcccctgaccgtgctgtactacctgctgcccttcggcgccctgagacccctgagcagagtgggctggagacccgtgagcagagtggccctgtacaagagcgtgcccaccagactgctgagcagagcctggggcagactgaaccaggtggagctgccccactggctgagaagacccgtgtacagcctgtacatctggaccttcggcgtgaacatgaaggaggccgccgtggaggacctgcaccactacagaaacctgagcgagttcttcagaagaaagctgaagccccaggccagacccgtgtgcggcctgcacagcgtgatcagccccagcgacggcagaatcctgaacttcggccaggtgaagaactgcgaggtggagcaggtgaagggcgtgacctacagcctggagagcttcctgggccccagaatgtgcaccgaggacctgcccttcccccccgccgccagctgcgacagcttcaagaaccagctggtgaccagagagggcaacgagctgtaccactgcgtgatctacctggcccccggcgactag

SEQ ID NO: 93070 - DNA, 222 bp, Artificial Sequence
  Description of Artificial Sequence: Synthetic coding sequence
atgatgtgccagagcgaggccagacagggccccgagctgagagccgccaagtggctgcacttcccccagctggccctgagaagaagactgggccagctgagctgcatgagcagacccgccctgaagctgagaagctggcccctgaccgtgctgtactacctgctgcccttcggcgccctgagacccctgagcagagtgggctggagacccgtgagcagatag

SEQ ID NO: 93071 - DNA, 222 bp, Artificial Sequence; identical to SEQ ID NO: 93070
  Description of Artificial Sequence: Synthetic coding sequence

SEQ ID NO: 93072 - DNA, 1230 bp, Artificial Sequence
  Description of Artificial Sequence: Synthetic coding sequence
atggccaccagcgtgggccacagatgcctgggcctgctgcacggcgtggccccctggagaagcagcctgcacccctgcgagatcaccgccctgagccagagcctgcagcccctgagaaagctgcccttcagagccttcagaaccgacgccagaaagatccacaccgcccccgccagaaccatgttcctgctgagacccctgcccatcctgctggtgaccggcggcggctacgccggctacagacagtacgagaagtacagagagagagagctggagaagctgggcctggagatcccccccaagctggccggccactgggaggtggccctgtacaagagcgtgcccaccagactgctgagcagagcctggggcagactgaaccaggtggagctgccccactggctgagaagacccgtgtacagcctgtacatctggaccttcggcgtgaacatgaaggaggccgccgtggaggacctgcaccactacagaaacctgagcgagttcttcagaagaaagctgaagccccaggccagacccgtgtgcggcctgcacagcgtgatcagccccagcgacggcagaatcctgaacttcggccaggtgaagaactgcgaggtggagcaggtgaagggcgtgacctacagcctggagagcttcctgggccccagaatgtgcaccgaggacctgcccttcccccccgccgccagctgcgacagcttcaagaaccagctggtgaccagagagggcaacgagctgtaccactgcgtgatctacctggcccccggcgactaccactgcttccacagccccaccgactggaccgtgagccacagaagacacttccccggcagcctgatgagcgtgaaccccggcatggccagatggatcaaggagctgttctgccacaacgagagagtggtgctgaccggcgactggaagcacggcttcttcagcctgaccgccgtgggcgccaccaacgtgggcagcatcagaatctacttcgacagagacctgcacaccaacagccccagacacagcaagggcagctacaacgacttcagcttcgtgacccacaccaacagagagggcgtgcccatgagaaagggcgagcacctgggcgagttcaacctgggcagcaccatcgtgctgatcttcgaggcccccaaggacttcaacttccagctgaagaccggccagaagatcagattcggcgaggccctgggcagcctgtag

SEQ ID NO: 93073 - DNA, 246 bp, Artificial Sequence
  Description of Artificial Sequence: Synthetic coding sequence
atgatgtgccagagcgaggccagacagggccccgagctgagagccgccaagtggctgcacttcccccagctggccctgagaagaagactgggccagctgagctgcatgagcagacccgccctgaagctgagaagctggcccctgaccgtgctgtactacctgctgcccttcggcgccctgagacccctgagcagagtgggctggagacccgtgagcagagtggccctgtacaagagcgtgccctag

SEQ ID NO: 93074 - DNA, 981 bp, Artificial Sequence
  Description of Artificial Sequence: Synthetic coding sequence
atgatgtgccagagcgaggccagacagggccccgagctgagagccgccaagtggctgcacttcccccagctggccctgagaagaagactgggccagctgagctgcatgagcagacccgccctgaagctgagaagctggcccctgaccgtgctgtactacctgctgcccttcggcgccctgagacccctgagcagagtgggctggagacccgtgagcagagtggccctgtacaagagcgtgcccaccagactgctgagcagagcctggggcagactgaaccaggtggagctgccccactggctgagaagacccgtgtacagcctgtacatctggaccttcggcgtgaacatgaaggaggccgccgtggaggacctgcaccactacagaaacctgagcgagttcttcagaagaaagctgaagccccaggccagacccgtgtgcggcctgcacagcgtgatcagccccagcgacggcagaatcctgaacttcggccaggtgaagaactgcgaggtggagcaggtgaagggcgtgacctacagcctggagagcttcctgggccccagaatgtgcaccgaggacctgcccttcccccccgccgccagctgcgacagcttcaagaaccagctggtgaccagagagggcaacgagctgtaccactgcgtgatctacctggcccccggcgactaccactgcttccacagccccaccgactggaccgtgagccacagaagacacttccccggcagcctgatgagcgtgaaccccggcatggccagatggatcaaggagctgttctgccacaacgagagagtggtgctgaccggcgactggaagcacggcttcttcagcctgaccgccgtgggcgccaccaacgtgggcagcatcagaatctacttcgacagagacctgcacaccaacagccccagacacagcaagggcagctacaacgacttcagcgtggtgggcagcctgaccagatag

SEQ ID NO: 93075 - DNA, 984 bp, Artificial Sequence
  Description of Artificial Sequence: Synthetic coding sequence
atggagtacgccgtgaactgccacgtgatcacctgggagagaatcatcagccacttcgacatcttcgccttcggccacttctggggctgggccatgaaggccctgctgatcagaagctacggcctgtgctggaccatcagcatcacctgggagctgaccgagctgttcttcatgcacctgctgcccaacttcgccgagtgctggtgggaccaggtgatcctggacatcctgctgtgcaacggcggcggcatctggctgggcatggtggtgtgcagattcctggagatgagaacctaccactgggccagcttcaaggacatccacaccaccaccggcaagatcaagagagccgtgctgcagttcacccccgccagctggacctacgtgagatggttcgaccccaagagcagcttccagagagtggccggcgtgtacctgttcatgatcatctggcagctgaccgagctgaacaccttcttcctgaagcacatcttcgtgttccaggccagccaccccctgagctggggcagaatcctgttcatcggcggcatcaccgcccccaccgtgagacagtactacgcctacctgaccgacacccagtgcaagagagtgggcacccagtgctgggtgttcggcgtgatcggcttcctggaggccatcgtgtgcatcaagttcggccaggacctgttcagcaagacccagatcctgtacgtggtgctgtggctgctgtgcgtggccttcaccaccttcctgtgcctgtacggcatgatctggtacgccgagcactacggccacagagagaagacctacagcgagtgcgaggacggcacctacagccccgagatcagctggcaccacagaaagggcaccaagggcagcgaggacagcccccccaagcacgccggcaacaacgagagccacagcagcagaagaagaaacagacacagcaagagcaaggtgaccaacggcgtgggcaagaagtag

SEQ ID NO: 93076 - DNA, 1422 bp, Artificial Sequence
  Description of Artificial Sequence: Synthetic coding sequence
atggccagctgcgtgggcagcagaaccctgagcaaggacgacgtgaactacaagatgcacttcagaatgatcaacgagcagcaggtggaggacatcaccatcgacttcttctacagaccccacaccatcaccctgctgagcttcaccatcgtgagcctgatgtacttcgccttcaccagagacgacagcgtgcccgaggacaacatctggagaggcatcctgagcgtgatcttcttcttcctgatcatcagcgtgctggccttccccaacggccccttcaccagaccccaccccgccctgtggagaatggtgttcggcctgagcgtgctgtacttcctgttcctggtgttcctgctgttcctgaacttcgagcaggtgaagagcctgatgtactggctggaccccaacctgagatacgccaccagagaggccgacgtgatggagtacgccgtgaactgccacgtgatcacctgggagagaatcatcagccacttcgacatcttcgccttcggccacttctggggctgggccatgaaggccctgctgatcagaagctacggcctgtgctggaccatcagcatcacctgggagctgaccgagctgttcttcatgcacctgctgcccaacttcgccgagtgctggtgggaccaggtgatcctggacatcctgctgtgcaacggcggcggcatctggctgggcatggtggtgtgcagattcctggagatgagaacctaccactgggccagcttcaaggacatccacaccaccaccggcaagatcaagagagccgtgctgcagttcacccccgccagctggacctacgtgagatggttcgaccccaagagcagcttccagagagtggccggcgtgtacctgttcatgatcatctggcagctgaccgagctgaacaccttcttcctgaagcacatcttcgtgttccaggccagccaccccctgagctggggcagaatcctgttcatcggcggcatcaccgcccccaccgtgagacagtactacgcctacctgaccgacacccagtgcaagagagtgggcacccagtgctgggtgttcggcgtgatcggcttcctggaggccatcgtgtgcatcaagttcggccaggacctgttcagcaagacccagatcctgtacgtggtgctgtggctgctgtgcgtggccttcaccaccttcctgtgcctgtacggcatgatctggtacgccgagcactacggccacagagagaagacctacagcgagtgcgaggacggcacctacagccccgagatcagctggcaccacagaaagggcaccaagggcagcgaggacagcccccccaagcacgccggcaacaacgagagccacagcagcagaagaagaaacagacacagcaagagcaaggtgaccaacggcgtgggcaagaagtag

SEQ ID NO: 93077 - DNA, 1464 bp, Artificial Sequence
  Description of Artificial Sequence: Synthetic coding sequence
atgagaagaggcgagagaagagacgccggcggccccagacccgagagccccgtgcccgccggcagagccagcctggaggagccccccgacggccccagcgccggccaggccaccggccccggcgagggcagaagaagcaccgagagcgaggtgtacgacgacggcaccaacaccttcttctggagagcccacaccctgaccgtgctgttcatcctgacctgcaccctgggctacgtgaccctgctggaggagaccccccaggacaccgcctacaacaccaagagaggcatcgtggccagcatcctggtgttcctgtgcttcggcgtgacccaggccaaggacggccccttcagcagaccccaccccgcctactggagattctggctgtgcgtgagcgtggtgtacgagctgttcctgatcttcatcctgttccagaccgtgcaggacggcagacagttcctgaagtacgtggaccccaagctgggcgtgcccctgcccgagagagactacggcggcaactgcctgatctacgaccccgacaacgagaccgaccccttccacaacatctgggacaagctggacggcttcgtgcccgcccacttcctgggctggtacctgaagaccctgatgatcagagactggtggatgtgcatgatcatcagcgtgatgttcgagttcctggagtacagcctggagcaccagctgcccaacttcagcgagtgctggtgggaccactggatcatggacgtgctggtgtgcaacggcctgggcatctactgcggcatgaagaccctggagtggctgagcctgaagacctacaagtggcagggcctgtggaacatccccacctacaagggcaagatgaagagaatcgccttccagttcaccccctacagctgggtgagattcgagtggaagcccgccagcagcctgagaagatggctggccgtgtgcggcatcatcctggtgttcctgctggccgagctgaacaccttctacctgaagttcgtgctgtggatgccccccgagcactacctggtgctgctgagactggtgttcttcgtgaacgtgggcggcgtggccatgagagagatctacgacttcatggacgaccccaagccccacaagaagctgggcccccaggcctggctggtggccgccatcaccgccaccgagctgctgatcgtggtgaagtacgacccccacaccctgaccctgagcctgcccttctacatcagccagtgctggaccctgggcagcgtgctggccctgacctggaccgtgtggagattcttcctgagagacatcaccctgagatacaaggagaccagatggcagaagtggcagaacaaggacgaccagggcagcaccgtgggcaacggcgaccagcaccccctgggcctggacgaggacctgctgggccccggcgtggccgagggcgagggcgcccccacccccaactag

SEQ ID NO: 93078 - DNA, 2802 bp, Artificial Sequence
  Description of Artificial Sequence: Synthetic coding sequence
atggccgccagcagactggacttcggcgaggtggagaccttcctggacagacaccccgagctgttcgaggactacctgatgagaaagggcaagcaggagatggtggagaagtggctgcagagacacagccagggccagggcgccctgggccccagacccagcctggccggcaccagcagcctggcccacagcacctgcagaggcggcagcagcgtgggcggcggcaccggccccaacggcagcgcccacagccagcccctgcccggcggcggcgactgcggcggcgtgcccctgagccccagctgggccggcggcagcagaggcgacggcaacctgcagagaagagccagccagaaggagctgagaaagagcttcgccagaagcaaggccatccacgtgaacagaacctacgacgagcaggtgaccagcagagcccaggagcccctgagcagcgtgagaagaagagccctgctgagaaaggccagcagcctgccccccaccaccgcccacatcctgagcgccctgctggagagcagagtgaacctgcccagatacccccccaccgccatcgactacaagtgccacctgaagaagcacaacgagagacagttcttcctggagctggtgaaggacatcagcaacgacctggacctgaccagcctgagctacaagatcctgatcttcgtgtgcctgatggtggacgccgacagatgcagcctgttcctggtggagggcgccgccgccggcaagaagaccctggtgagcaagttcttcgacgtgcacgccggcacccccctgctgccctgcagcagcaccgagaacagcaacgaggtgcaggtgccctggggcaagggcatcatcggctacgtgggcgagcacggcgagaccgtgaacatccccgacgcctaccaggacagaagattcaacgacgagatcgacaagctgaccggctacaagaccaagagcctgctgtgcatgcccatcagaagcagcgacggcgagatcatcggcgtggcccaggccatcaacaagatccccgagggcgcccccttcaccgaggacgacgagaaggtgatgcagatgtacctgcccttctgcggcatcgccatcagcaacgcccagctgttcgccgccagcagaaaggagtacgagagaagcagagccctgctggaggtggtgaacgacctgttcgaggagcagaccgacctggagaagatcgtgaagaagatcatgcacagagcccagaccctgctgaagtgcgagagatgcagcgtgctgctgctggaggacatcgagagccccgtggtgaagttcaccaagagcttcgagctgatgagccccaagtgcagcgccgacgccgagaacagcttcaaggagagcatggagaagagcagctacagcgactggctgatcaacaacagcatcgccgagctggtggccagcaccggcctgcccgtgaacatcagcgacgcctaccaggaccccagattcgacgccgaggccgaccagatcagcggcttccacatcagaagcgtgctgtgcgtgcccatctggaacagcaaccaccagatcatcggcgtggcccaggtgctgaacagactggacggcaagcccttcgacgacgccgaccagagactgttcgaggccttcgtgatcttctgcggcctgggcatcaacaacaccatcatgtacgaccaggtgaagaagagctgggccaagcagagcgtggccctggacgtgctgagctaccacgccacctgcagcaaggccgaggtggacaagttcaaggccgccaacatccccctggtgagcgagctggccatcgacgacatccacttcgacgacttcagcctggacgtggacgccatgatcaccgccgccctgagaatgttcatggagctgggcatggtgcagaagttcaagatcgactacgagaccctgtgcagatggctgctgaccgtgagaaagaactacagaatggtgctgtaccacaactggagacacgccttcaacgtgtgccagctgatgttcgccatgctgaccaccgccggcttccaggacatcctgaccgaggtggagatcctggccgtgatcgtgggctgcctgtgccacgacctggaccacagaggcaccaacaacgccttccaggccaagagcggcagcgccctggcccagctgtacggcaccagcgccaccctggagcaccaccacttcaaccacgccgtgatgatcctgcagagcgagggccacaacatcttcgccaacctgagcagcaaggagtacagcgacctgatgcagctgctgaagcagagcatcctggccaccgacctgaccctgtacttcgagagaagaaccgagttcttcgagctggtgagcaagggcgagtacgactggaacatcaagaaccacagagacatcttcagaagcatgctgatgaccgcctgcgacctgggcgccgtgaccaagccctgggagatcagcagacaggtggccgagctggtgaccagcgagttcttcgagcagggcgacagagagagactggagctgaagctgacccccagcgccatcttcgacagaaacagaaaggacgagctgcccagactgcagctggagtggatcgacagcatctgcatgcccctgtaccaggccctggtgaaggtgaacgtgaagctgaagcccatgctggacagcgtggccaccaacagaagcaagtgggaggagctgcaccagaagagactgctggccagcaccgccagcagcagccccgccagcgtgatggtggccaaggaggacagaaactag

SEQ ID NO: 93079 - DNA, 2052 bp, Artificial Sequence
  Description of Artificial Sequence: Synthetic coding sequence
atgctgaagcaggccagaagacccctgttcagaaacgtgctgagcgccacccagtggaagaaggtgaagatcaccagactggtgcagatcagcggcgccagcctggccgagaagcaggagaagcaccaggacttcctgatccagagacagaccaagaccaaggacagaagattcaacgacgagatcgacaagctgaccggctacaagaccaagagcctgctgtgcatgcccatcagaagcagcgacggcgagatcatcggcgtggcccaggccatcaacaagatccccgagggcgcccccttcaccgaggacgacgagaaggtgatgcagatgtacctgcccttctgcggcatcgccatcagcaacgcccagctgttcgccgccagcagaaaggagtacgagagaagcagagccctgctggaggtggtgaacgacctgttcgaggagcagaccgacctggagaagatcgtgaagaagatcatgcacagagcccagaccctgctgaagtgcgagagatgcagcgtgctgctgctggaggacatcgagagccccgtggtgaagttcaccaagagcttcgagctgatgagccccaagtgcagcgccgacgccgagaacagcttcaaggagagcatggagaagagcagctacagcgactggctgatcaacaacagcatcgccgagctggtggccagcaccggcctgcccgtgaacatcagcgacgcctaccaggaccccagattcgacgccgaggccgaccagatcagcggcttccacatcagaagcgtgctgtgcgtgcccatctggaacagcaaccaccagatcatcggcgtggcccaggtgctgaacagactggacggcaagcccttcgacgacgccgaccagagactgttcgaggccttcgtgatcttctgcggcctgggcatcaacaacaccatcatgtacgaccaggtgaagaagagctgggccaagcagagcgtggccctggacgtgctgagctaccacgccacctgcagcaaggccgaggtggacaagttcaaggccgccaacatccccctggtgagcgagctggccatcgacgacatccacttcgacgacttcagcctggacgtggacgccatgatcaccgccgccctgagaatgttcatggagctgggcatggtgcagaagttcaagatcgactacgagaccctgtgcagatggctgctgaccgtgagaaagaactacagaatggtgctgtaccacaactggagacacgccttcaacgtgtgccagctgatgttcgccatgctgaccaccgccggcttccaggacatcctgaccgaggtggagatcctggccgtgatcgtgggctgcctgtgccacgacctggaccacagaggcaccaacaacgccttccaggccaagagcggcagcgccctggcccagctgtacggcaccagcgccaccctggagcaccaccacttcaaccacgccgtgatgatcctgcagagcgagggccacaacatcttcgccaacctgagcagcaaggagtacagcgacctgatgcagctgctgaagcagagcatcctggccaccgacctgaccctgtacttcgagagaagaaccgagttcttcgagctggtgagcaagggcgagtacgactggaacatcaagaaccacagagacatcttcagaagcatgctgatgaccgcctgcgacctgggcgccgtgaccaagccctgggagatcagcagacaggtggccgagctggtgaccagcgagttcttcgagcagggcgacagagagagactggagctgaagctgacccccagcgccatcttcgacagaaacagaaaggacgagctgcccagactgcagctggagtggatcgacagcatctgcatgcccctgtaccaggccctggtgaaggtgaacgtgaagctgaagcccatgctggacagcgtggccaccaacagaagcaagtgggaggagctgcaccagaagagactgctggccagcaccgccagcagcagccccgccagcgtgatggtggccaaggaggacagaaactag

SEQ ID NO: 93080 - DNA, 1470 bp, Artificial Sequence
  Description of Artificial Sequence: Synthetic coding sequence
atgagccccaagtgcagcgccgacgccgagaacagcttcaaggagagcatggagaagagcagctacagcgactggctgatcaacaacagcatcgccgagctggtggccagcaccggcctgcccgtgaacatcagcgacgcctaccaggaccccagattcgacgccgaggccgaccagatcagcggcttccacatcagaagcgtgctgtgcgtgcccatctggaacagcaaccaccagatcatcggcgtggcccaggtgctgaacagactggacggcaagcccttcgacgacgccgaccagagactgttcgaggccttcgtgatcttctgcggcctgggcatcaacaacaccatcatgtacgaccaggtgaagaagagctgggccaagcagagcgtggccctggacgtgctgagctaccacgccacctgcagcaaggccgaggtggacaagttcaaggccgccaacatccccctggtgagcgagctggccatcgacgacatccacttcgacgacttcagcctggacgtggacgccatgatcaccgccgccctgagaatgttcatggagctgggcatggtgcagaagttcaagatcgactacgagaccctgtgcagatggctgctgaccgtgagaaagaactacagaatggtgctgtaccacaactggagacacgccttcaacgtgtgccagctgatgttcgccatgctgaccaccgccggcttccaggacatcctgaccgaggtggagatcctggccgtgatcgtgggctgcctgtgccacgacctggaccacagaggcaccaacaacgccttccaggccaagagcggcagcgccctggcccagctgtacggcaccagcgccaccctggagcaccaccacttcaaccacgccgtgatgatcctgcagagcgagggccacaacatcttcgccaacctgagcagcaaggagtacagcgacctgatgcagctgctgaagcagagcatcctggccaccgacctgaccctgtacttcgagagaagaaccgagttcttcgagctggtgagcaagggcgagtacgactggaacatcaagaaccacagagacatcttcagaagcatgctgatgaccgcctgcgacctgggcgccgtgaccaagccctgggagatcagcagacaggtggccgagctggtgaccagcgagttcttcgagcagggcgacagagagagactggagctgaagctgacccccagcgccatcttcgacagaaacagaaaggacgagctgcccagactgcagctggagtggatcgacagcatctgcatgcccctgtaccaggccctggtgaaggtgaacgtgaagctgaagcccatgctggacagcgtggccaccaacagaagcaagtgggaggagctgcaccagaagagactgctggccagcaccgccagcagcagccccgccagcgtgatggtggccaaggaggacagaaactag

SEQ ID NO: 93081 - DNA, 1728 bp, Artificial Sequence
  Description of Artificial Sequence: Synthetic coding sequence
atgcagatgtacctgcccttctgcggcatcgccatcagcaacgcccagctgttcgccgccagcagaaaggagtacgagagaagcagagccctgctggaggtggtgaacgacctgttcgaggagcagaccgacctggagaagatcgtgaagaagatcatgcacagagcccagaccctgctgaagtgcgagagatgcagcgtgctgctgctggaggacatcgagagccccgtggtgaagttcaccaagagcttcgagctgatgagccccaagtgcagcgccgacgccgagaacagcttcaaggagagcatggagaagagcagctacagcgactggctgatcaacaacagcatcgccgagctggtggccagcaccggcctgcccgtgaacatcagcgacgcctaccaggaccccagattcgacgccgaggccgaccagatcagcggcttccacatcagaagcgtgctgtgcgtgcccatctggaacagcaaccaccagatcatcggcgtggcccaggtgctgaacagactggacggcaagcccttcgacgacgccgaccagagactgttcgaggccttcgtgatcttctgcggcctgggcatcaacaacaccatcatgtacgaccaggtgaagaagagctgggccaagcagagcgtggccctggacgtgctgagctaccacgccacctgcagcaaggccgaggtggacaagttcaaggccgccaacatccccctggtgagcgagctggccatcgacgacatccacttcgacgacttcagcctggacgtggacgccatgatcaccgccgccctgagaatgttcatggagctgggcatggtgcagaagttcaagatcgactacgagaccctgtgcagatggctgctgaccgtgagaaagaactacagaatggtgctgtaccacaactggagacacgccttcaacgtgtgccagctgatgttcgccatgctgaccaccgccggcttccaggacatcctgaccgaggtggagatcctggccgtgatcgtgggctgcctgtgccacgacctggaccacagaggcaccaacaacgccttccaggccaagagcggcagcgccctggcccagctgtacggcaccagcgccaccctggagcaccaccacttcaaccacgccgtgatgatcctgcagagcgagggccacaacatcttcgccaacctgagcagcaaggagtacagcgacctgatgcagctgctgaagcagagcatcctggccaccgacctgaccctgtacttcgagagaagaaccgagttcttcgagctggtgagcaagggcgagtacgactggaacatcaagaaccacagagacatcttcagaagcatgctgatgaccgcctgcgacctgggcgccgtgaccaagccctgggagatcagcagacaggtggccgagctggtgaccagcgagttcttcgagcagggcgacagagagagactggagctgaagctgacccccagcgccatcttcgacagaaacagaaaggacgagctgcccagactgcagctggagtggatcgacagcatctgcatgcccctgtaccaggccctggtgaaggtgaacgtgaagctgaagcccatgctggacagcgtggccaccaacagaagcaagtgggaggagctgcaccagaagagactgctggccagcaccgccagcagcagccccgccagcgtgatggtggccaaggaggacagaaactag

SEQ ID NO: 93082 - DNA, 393 bp, Artificial Sequence
  Description of Artificial Sequence: Synthetic coding sequence
atgcccatcagaagcagcgacggcgagatcatcggcgtggcccaggccatcaacaagatccccgagggcgcccccttcaccgaggacgacgagaaggtgatgcagatgtacctgcccttctgcggcatcgccatcagcaacgcccagctgttcgccgccagcagaaaggagtacgagagaagcagagccctgctggaggtggtgaacgacctgttcgaggagcagaccgacctggagaagatcgtgaagaagatcatgcacagagcccagaccctgctgaagtgcgagagatgcagcgtgctgctgctggaggacatcgagagccccgtggtgaagttcaccaagagcttcgagctgatgagccccaagtgcagcgccgacgccgagaactag

SEQ ID NO: 93083 - DNA, 1728 bp, Artificial Sequence; identical to SEQ ID NO: 93081
  Description of Artificial Sequence: Synthetic coding sequence

SEQ ID NO: 93084 - DNA, 375 bp, Artificial Sequence
  Description of Artificial Sequence: Synthetic coding sequence
atgctgatgaccgcctgcgacctgggcgccgtgaccaagccctgggagatcagcagacaggtggccgagctggtgaccagcgagttcttcgagcagggcgacagagagagactggagctgaagctgacccccagcgccatcttcgacagaaacagaaaggacgagctgcccagactgcagctggagtggatcgacagcatctgcatgcccctgtaccaggccctggtgaaggtgaacgtgaagctgaagcccatgctggacagcgtggccaccaacagaagcaagtgggaggagctgcaccagaagagactgctggccagcaccgccagcagcagccccgccagcgtgatggtggccaaggaggacagaaactag

SEQ ID NO: 93085 - DNA, 1638 bp, Artificial Sequence
  Description of Artificial Sequence: Synthetic coding sequence
atgggcagcagcgccaccgagatcgaggagctggagaacaccaccttcaagtacctgaccggcgagcagaccgagaagatgtggcagagactgaagggcatcctgagatgcctggtgaagcagctggagagaggcgacgtgaacgtggtggacctgaagaagaacatcgagtacgccgccagcgtgctggaggccgtgtacatcgacgagaccagaagactgctggacaccgaggacgagctgagcgacatccagaccgacagcgtgcccagcgaggtgagagactggctggccagcaccttcaccagaaagatgggcatgaccaagaagaagcccgaggagaagcccaagttcagaagcatcgtgcacgccgtgcaggccggcatcttcgtggagagaatgtacagaaagacctaccacatggtgggcctggcctaccccgccgccgtgatcgtgaccctgaaggacgtggacaagtggagcttcgacgtgttcgccctgaacgaggccagcggcgagcacagcctgaagttcatgatctacgagctgttcaccagatacgacctgatcaacagattcaagatccccgtgagctgcctgatcaccttcgccgaggccctggaggtgggctacagcaagtacaagaacccctaccacaacctgatccacgccgccgacgtgacccagaccgtgcactacatcatgctgcacaccggcatcatgcactggctgaccgagctggagatcctggccatggtgttcgccgccgccatccacgactacgagcacaccggcaccaccaacaacttccacatccagaccagaagcgacgtggccatcctgtacaacgacagaagcgtgctggagaaccaccacgtgagcgccgcctacagactgatgcaggaggaggagatgaacatcctgatcaacctgagcaaggacgactggagagacctgagaaacctggtgatcgagatggtgctgagcaccgacatgagcggccacttccagcagatcaagaacatcagaaacagcctgcagcagcccgagggcatcgacagagccaagaccatgagcctgatcctgcacgccgccgacatcagccaccccgccaagagctggaagctgcactacagatggaccatggccctgatggaggagttcttcctgcagggcgacaaggaggccgagctgggcctgcccttcagccccctgtgcgacagaaagagcaccatggtggcccagagccagatcggcttcatcgacttcatcgtggagcccaccttcagcctgctgaccgacagcaccgagaagatcgtgatccccctgatcgaggaggccagcaaggccgagaccagcagctacgtggccagcagcagcaccaccatcgtgggcctgcacatcgccgacgccctgagaagaagcaacaccaagggcagcatgagcgacggcagctacagccccgactacagcctggccgccgtggacctgaagagcttcaagaacaacctggtggacatcatccagcagaacaaggagagatggaaggagctggccgcccagggcgagagcgacctgcacaagaacagcgaggacctggtgaacgccgaggagaagcacgacgagacccacagctag

SEQ ID NO: 93086 - DNA, 1536 bp, Artificial Sequence
  Description of Artificial Sequence: Synthetic coding sequence
atgggcaagaagatcaacaagctgttctgcttcaacttcctggtgcagtgcttcagaggcaagagcaagcccagcaagtgccagatcagaaagaaggtgaagaaccacatcgagagactgctggacaccgaggacgagctgagcgacatccagaccgacagcgtgcccagcgaggtgagagactggctggccagcaccttcaccagaaagatgggcatgaccaagaagaagcccgaggagaagcccaagttcagaagcatcgtgcacgccgtgcaggccggcatcttcgtggagagaatgtacagaaagacctaccacatggtgggcctggcctaccccgccgccgtgatcgtgaccctgaaggacgtggacaagtggagcttcgacgtgttcgccctgaacgaggccagcggcgagcacagcctgaagttcatgatctacgagctgttcaccagatacgacctgatcaacagattcaagatccccgtgagctgcctgatcaccttcgccgaggccctggaggtgggctacagcaagtacaagaacccctaccacaacctgatccacgccgccgacgtgacccagaccgtgcactacatcatgctgcacaccggcatcatgcactggctgaccgagctggagatcctggccatggtgttcgccgccgccatccacgactacgagcacaccggcaccaccaacaacttccacatccagaccagaagcgacgtggccatcctgtacaacgacagaagcgtgctggagaaccaccacgtgagcgccgcctacagactgatgcaggaggaggagatgaacatcctgatcaacctgagcaaggacgactggagagacctgagaaacctggtgatcgagatggtgctgagcaccgacatgagcggccacttccagcagatcaagaacatcagaaacagcctgcagcagcccgagggcatcgacagagccaagaccatgagcctgatcctgcacgccgccgacatcagccaccccgccaagagctggaagctgcactacagatggaccatggccctgatggaggagttcttcctgcagggcgacaaggaggccgagctgggcctgcccttcagccccctgtgcgacagaaagagcaccatggtggcccagagccagatcggcttcatcgacttcatcgtggagcccaccttcagcctgctgaccgacagcaccgagaagatcgtgatccccctgatcgaggaggccagcaaggccgagaccagcagctacgtggccagcagcagcaccaccatcgtgggcctgcacatcgccgacgccctgagaagaagcaacaccaagggcagcatgagcgacggcagctacagccccgactacagcctggccgccgtggacctgaagagcttcaagaacaacctggtggacatcatccagcagaacaaggagagatggaaggagctggccgcccagggcgagagcgacctgcacaagaacagcgaggacctggtgaacgccgaggagaagcacgacgagacccacagctag

SEQ ID NO: 93087 - DNA, 1560 bp, Artificial Sequence
  Description of Artificial Sequence: Synthetic coding sequence
atggacgaccacgtgaccatcagaaagaagcacctgcagagacccatcttcagactgagatgcctggtgaagcagctggagagaggcgacgtgaacgtggtggacctgaagaagaacatcgagtacgccgccagcgtgctggaggccgtgtacatcgacgagaccagaagactgctggacaccgaggacgagctgagcgacatccagaccgacagcgtgcccagcgaggtgagagactggctggccagcaccttcaccagaaagatgggcatgaccaagaagaagcccgaggagaagcccaagttcagaagcatcgtgcacgccgtgcaggccggcatcttcgtggagagaatgtacagaaagacctaccacatggtgggcctggcctaccccgccgccgtgatcgtgaccctgaaggacgtggacaagtggagcttcgacgtgttcgccctgaacgaggccagcggcgagcacagcctgaagttcatgatctacgagctgttcaccagatacgacctgatcaacagattcaagatccccgtgagctgcctgatcaccttcgccgaggccctggaggtgggctacagcaagtacaagaacccctaccacaacctgatccacgccgccgacgtgacccagaccgtgcactacatcatgctgcacaccggcatcatgcactggctgaccgagctggagatcctggccatggtgttcgccgccgccatccacgactacgagcacaccggcaccaccaacaacttccacatccagaccagaagcgacgtggccatcctgtacaacgacagaagcgtgctggagaaccaccacgtgagcgccgcctacagactgatgcaggaggaggagatgaacatcctgatcaacctgagcaaggacgactggagagacctgagaaacctggtgatcgagatggtgctgagcaccgacatgagcggccacttccagcagatcaagaacatcagaaacagcctgcagcagcccgagggcatcgacagagccaagaccatgagcctgatcctgcacgccgccgacatcagccaccccgccaagagctggaagctgcactacagatggaccatggccctgatggaggagttcttcctgcagggcgacaaggaggccgagctgggcctgcccttcagccccctgtgcgacagaaagagcaccatggtggcccagagccagatcggcttcatcgacttcatcgtggagcccaccttcagcctgctgaccgacagcaccgagaagatcgtgatccccctgatcgaggaggccagcaaggccgagaccagcagctacgtggccagcagcagcaccaccatcgtgggcctgcacatcgccgacgccctgagaagaagcaacaccaagggcagcatgagcgacggcagctacagccccgactacagcctggccgccgtggacctgaagagcttcaagaacaacctggtggacatcatccagcagaacaaggagagatggaaggagctggccgcccaggaggccagaaccagcagccagaagtgcgagttcatccaccagtag

SEQ ID NO: 93088 - DNA, 1608 bp, Artificial Sequence
  Description of Artificial Sequence: Synthetic coding sequence
atgggcagcagcgccaccgagatcgaggagctggagaacaccaccttcaagtacctgaccggcgagcagaccgagaagatgtggcagagactgaagggcatcctgagatgcctggtgaagcagctggagagaggcgacgtgaacgtggtggacctgaagaagaacatcgagtacgccgccagcgtgctggaggccgtgtacatcgacgagaccagaagactgctggacaccgaggacgagctgagcgacatccagaccgacagcgtgcccagcgaggtgagagactggctggccagcaccttcaccagaaagatgggcatgaccaagaagaagcccgaggagaagcccaagttcagaagcatcgtgcacgccgtgcaggccggcatcttcgtggagagaatgtacagaaagacctaccacatggtgggcctggcctaccccgccgccgtgatcgtgaccctgaaggacgtggacaagtggagcttcgacgtgttcgccctgaacgaggccagcggcgagcacagcctgaagttcatgatctacgagctgttcaccagatacgacctgatcaacagattcaagatccccgtgagctgcctgatcaccttcgccgaggccctggaggtgggctacagcaagtacaagaacccctaccacaacctgatccacgccgccgacgtgacccagaccgtgcactacatcatgctgcacaccggcatcatgcactggctgaccgagctggagatcctggccatggtgttcgccgccgccatccacgactacgagcacaccggcaccaccaacaacttccacatccagaccagaagcgacgtggccatcctgtacaacgacagaagcgtgctggagaaccaccacgtgagcgccgcctacagactgatgcaggaggaggagatgaacatcctgatcaacctgagcaaggacgactggagagacctgagaaacctggtgatcgagatggtgctgagcaccgacatgagcggccacttccagcagatcaagaacatcagaaacagcctgcagcagcccgagggcatcgacagagccaagaccatgagcctgatcctgcacgccgccgacatcagccaccccgccaagagctggaagctgcactacagatggaccatggccctgatggaggagttcttcctgcagggcgacaaggaggccgagctgggcctgcccttcagccccctgtgcgacagaaagagcaccatggtggcccagagccagatcggcttcatcgacttcatcgtggagcccaccttcagcctgctgaccgacagcaccgagaagatcgtgatccccctgatcgaggaggccagcaaggccgagaccagcagctacgtggccagcagcagcaccaccatcgtgggcctgcacatcgccgacgccctgagaagaagcaacaccaagggcagcatgagcgacggcagctacagccccgactacagcctggccgccgtggacctgaagagcttcaagaacaacctggtggacatcatccagcagaacaaggagagatggaaggagctggccgcccaggaggccagaaccagcagccagaagtgcgagttcatccaccagtag

SEQ ID NO: 93089 - DNA, 1590 bp, Artificial Sequence
  Description of Artificial Sequence: Synthetic coding sequence
atggacgaccacgtgaccatcagaaagaagcacctgcagagacccatcttcagactgagatgcctggtgaagcagctggagagaggcgacgtgaacgtggtggacctgaagaagaacatcgagtacgccgccagcgtgctggaggccgtgtacatcgacgagaccagaagactgctggacaccgaggacgagctgagcgacatccagaccgacagcgtgcccagcgaggtgagagactggctggccagcaccttcaccagaaagatgggcatgaccaagaagaagcccgaggagaagcccaagttcagaagcatcgtgcacgccgtgcaggccggcatcttcgtggagagaatgtacagaaagacctaccacatggtgggcctggcctaccccgccgccgtgatcgtgaccctgaaggacgtggacaagtggagcttcgacgtgttcgccctgaacgaggccagcggcgagcacagcctgaagttcatgatctacgagctgttcaccagatacgacctgatcaacagattcaagatccccgtgagctgcctgatcaccttcgccgaggccctggaggtgggctacagcaagtacaagaacccctaccacaacctgatccacgccgccgacgtgacccagaccgtgcactacatcatgctgcacaccggcatcatgcactggctgaccgagctggagatcctggccatggtgttcgccgccgccatccacgactacgagcacaccggcaccaccaacaacttccacatccagaccagaagcgacgtggccatcctgtacaacgacagaagcgtgctggagaaccaccacgtgagcgccgcctacagactgatgcaggaggaggagatgaacatcctgatcaacctgagcaaggacgactggagagacctgagaaacctggtgatcgagatggtgctgagcaccgacatgagcggccacttccagcagatcaagaacatcagaaacagcctgcagcagcccgagggcatcgacagagccaagaccatgagcctgatcctgcacgccgccgacatcagccaccccgccaagagctggaagctgcactacagatggaccatggccctgatggaggagttcttcctgcagggcgacaaggaggccgagctgggcctgcccttcagccccctgtgcgacagaaagagcaccatggtggcccagagccagatcggcttcatcgacttcatcgtggagcccaccttcagcctgctgaccgacagcaccgagaagatcgtgatccccctgatcgaggaggccagcaaggccgagaccagcagctacgtggccagcagcagcaccaccatcgtgggcctgcacatcgccgacgccctgagaagaagcaacaccaagggcagcatgagcgacggcagctacagccccgactacagcctggccgccgtggacctgaagagcttcaagaacaacctggtggacatcatccagcagaacaaggagagatggaaggagctggccgcccagggcgagagcgacctgcacaagaacagcgaggacctggtgaacgccgaggagaagcacgacgagacccacagctag

SEQ ID NO: 93090 - DNA, 1608 bp, Artificial Sequence; identical to SEQ ID NO: 93088
  Description of Artificial Sequence: Synthetic coding sequence

SEQ ID NO: 93091 - DNA, 1638 bp, Artificial Sequence; identical to SEQ ID NO: 93085
  Description of Artificial Sequence: Synthetic coding sequence

SEQ ID NO: 93092 - DNA, 1659 bp, Artificial Sequence
  Description of Artificial Sequence: Synthetic coding sequence
atgggcagcagcgccaccgagatcgaggagctggagaacaccaccttcaagtacctgaccggcgagcagaccgagaagatgtggcagagactgaagggcatcctgagatgcctggtgaagcagctggagagaggcgacgtgaacgtggtggacctgaagaagaacatcgagtacgccgccagcgtgctggaggccgtgtacatcgacgagaccagaagactgctggacaccgaggacgagctgagcgacatccagaccgacagcgtgcccagcgaggtgagagactggctggccagcaccttcaccagaaagatgggcatgaccaagaagaagcccgaggagaagcccaagttcagaagcatcgtgcacgccgtgcaggccggcatcttcgtggagagaatgtacagaaagacctaccacatggtgggcctggcctaccccgccgccgtgatcgtgaccctgaaggacgtggacaagtggagcttcgacgtgttcgccctgaacgaggccagcggcgagcacagcctgaagttcatgatctacgagctgttcaccagatacgacctgatcaacagattcaagatccccgtgagctgcctgatcaccttcgccgaggccctggaggtgggctacagcaagtacaagaacccctaccacaacctgatccacgccgccgacgtgacccagaccgtgcactacatcatgctgcacaccggcatcatgcactggctgaccgagctggagatcctggccatggtgttcgccgccgccatccacgactacgagcacaccggcaccaccaacaacttccacatccagaccagaagcgacgtggccatcctgtacaacgacagaagcgtgctggagaaccaccacgtgagcgccgcctacagactgatgcaggaggaggagatgaacatcctgatcaacctgagcaaggacgactggagagacctgagaaacctggtgatcgagatggtgctgagcaccgacatgagcggccacttccagcagatcaagaacatcagaaacagcctgcagcagcccgagggcatcgacagagccaagaccatgagcctgatcctgcacgccgccgacatcagccaccccgccaagagctggaagctgcactacagatggaccatggccctgatggaggagttcttcctgcagggcgacaaggaggccgagctgggcctgcccttcagccccctgtgcgacagaaagagcaccatggtggcccagagccagatcggcttcatcgacttcatcgtggagcccaccttcagcctgctgaccgacagcaccgagaagatcgtgatccccctgatcgaggaggccagcaaggccgagaccagcagctacgtggccagcagcagcaccaccatcgtgggcctgcacatcgccgacgccctgagaagaagcaacaccaagggcagcatgagcgacggcagctacagccccgactacagcctggccgccgtggacctgaagagcttcaagaacaacctggtggacatcatccagcagaacaaggagagatggaaggagctggccgcccagggcagcgtggtgtacgaggccctgctgcccagcctgagcgtgttcaccagccccctgagagtgtggatcaccagcagcagattcctgctgctgtag

SEQ ID NO: 93093 - DNA, 1326 bp, Artificial Sequence
  Description of Artificial Sequence: Synthetic coding sequence
atgggcatgaccaagaagaagcccgaggagaagcccaagttcagaagcatcgtgcacgccgtgcaggccggcatcttcgtggagagaatgtacagaaagacctaccacatggtgggcctggcctaccccgccgccgtgatcgtgaccctgaaggacgtggacaagtggagcttcgacgtgttcgccctgaacgaggccagcggcgagcacagcctgaagttcatgatctacgagctgttcaccagatacgacctgatcaacagattcaagatccccgtgagctgcctgatcaccttcgccgaggccctggaggtgggctacagcaagtacaagaacccctaccacaacctgatccacgccgccgacgtgacccagaccgtgcactacatcatgctgcacaccggcatcatgcactggctgaccgagctggagatcctggccatggtgttcgccgccgccatccacgactacgagcacaccggcaccaccaacaacttccacatccagaccagaagcgacgtggccatcctgtacaacgacagaagcgtgctggagaaccaccacgtgagcgccgcctacagactgatgcaggaggaggagatgaacatcctgatcaacctgagcaaggacgactggagagacctgagaaacctggtgatcgagatggtgctgagcaccgacatgagcggccacttccagcagatcaagaacatcagaaacagcctgcagcagcccgagggcatcgacagagccaagaccatgagcctgatcctgcacgccgccgacatcagccaccccgccaagagctggaagctgcactacagatggaccatggccctgatggaggagttcttcctgcagggcgacaaggaggccgagctgggcctgcccttcagccccctgtgcgacagaaagagcaccatggtggcccagagccagatcggcttcatcgacttcatcgtggagcccaccttcagcctgctgaccgacagcaccgagaagatcgtgatccccctgatcgaggaggccagcaaggccgagaccagcagctacgtggccagcagcagcaccaccatcgtgggcctgcacatcgccgacgccctgagaagaagcaacaccaagggcagcatgagcgacggcagctacagccccgactacagcctggccgccgtggacctgaagagcttcaagaacaacctggtggacatcatccagcagaacaaggagagatggaaggagctggccgcccagggcgagagcgacctgcacaagaacagcgaggacctggtgaacgccgaggagaagcacgacgagacccacagctag

SEQ ID NO: 93094 - DNA, 1611 bp, Artificial Sequence
  Description of Artificial Sequence: Synthetic coding sequence
atggagctgagccccagaagcccccccgagatgctggaggagagcgactgccccagccccctggagctgaagagcgcccccagcaagaagatgtggatcaagctgagaagcctgctgagatacatggtgaagcagctggagaacggcgagatcaacatcgaggagctgaagaagaacctggagtacaccgccagcctgctggaggccgtgtacatcgacgagaccagacagatcctggacaccgaggacgagctgcaggagctgagaagcgacgccgtgcccagcgaggtgagagactggctggccagcaccttcacccagcaggccagagccaagggcagaagagccgaggagaagcccaagttcagaagcatcgtgcacgccgtgcaggccggcatcttcgtggagagaatgttcagaagaacctacaccagcgtgggccccacctacagcaccgccgtgctgaactgcctgaagaacctggacctgtggtgcttcgacgtgttcagcctgaaccaggccgccgacgaccacgccctgagaaccatcgtgttcgagctgctgaccagacacaacctgatcagcagattcaagatccccaccgtgttcctgatgagcttcctggacgccctggagaccggctacggcaagtacaagaacccctaccacaaccagatccacgccgccgacgtgacccagaccgtgcactgcttcctgctgagaaccggcatggtgcactgcctgagcgagatcgagctgctggccatcatcttcgccgccgccatccacgactacgagcacaccggcaccaccaacagcttccacatccagaccaagagcgagtgcgccatcgtgtacaacgacagaagcgtgctggagaaccaccacatcagcagcgtgttcagactgatgcaggacgacgagatgaacatcttcatcaacctgaccaaggacgagttcgtggagctgagagccctggtgatcgagatggtgctggccaccgacatgagctgccacttccagcaggtgaagaccatgaagaccgccctgcagcagctggagagaatcgacaagcccaaggccctgagcctgctgctgcacgccgccgacatcagccaccccaccaagcagtggctggtgcacagcagatggaccaaggccctgatggaggagttcttcagacagggcgacaaggaggccgagctgggcctgcccttcagccccctgtgcgacagaaccagcaccctggtggcccagagccagatcggcttcatcgacttcatcgtggagcccaccttcagcgtgctgaccgacgtggccgagaagagcgtgcagcccctggccgacgaggacagcaagagcaagaaccagcccagcttccagtggagacagcccagcctggacgtggaggtgggcgaccccaaccccgacgtggtgagcttcagaagcacctgggtgaagagaatccaggagaacaagcagaagtggaaggagagagccgccagcggcatcaccaaccagatgagcatcgacgagctgagcccctgcgaggaggaggccccccccagccccgccgaggacgagcacaaccagaacggcaacctggactag

SEQ ID NO: 93095 - DNA, 1488 bp, Artificial Sequence
  Description of Artificial Sequence: Synthetic coding sequence
atggtgaagcagctggagaacggcgagatcaacatcgaggagctgaagaagaacctggagtacaccgccagcctgctggaggccgtgtacatcgacgagaccagacagatcctggacaccgaggacgagctgcaggagctgagaagcgacgccgtgcccagcgaggtgagagactggctggccagcaccttcacccagcaggccagagccaagggcagaagagccgaggagaagcccaagttcagaagcatcgtgcacgccgtgcaggccggcatcttcgtggagagaatgttcagaagaacctacaccagcgtgggccccacctacagcaccgccgtgctgaactgcctgaagaacctggacctgtggtgcttcgacgtgttcagcctgaaccaggccgccgacgaccacgccctgagaaccatcgtgttcgagctgctgaccagacacaacctgatcagcagattcaagatccccaccgtgttcctgatgagcttcctggacgccctggagaccggctacggcaagtacaagaacccctaccacaaccagatccacgccgccgacgtgacccagaccgtgcactgcttcctgctgagaaccggcatggtgcactgcctgagcgagatcgagctgctggccatcatcttcgccgccgccatccacgactacgagcacaccggcaccaccaacagcttccacatccagaccaagagcgagtgcgccatcgtgtacaacgacagaagcgtgctggagaaccaccacatcagcagcgtgttcagactgatgcaggacgacgagatgaacatcttcatcaacctgaccaaggacgagttcgtggagctgagagccctggtgatcgagatggtgctggccaccgacatgagctgccacttccagcaggtgaagaccatgaagaccgccctgcagcagctggagagaatcgacaagcccaaggccctgagcctgctgctgcacgccgccgacatcagccaccccaccaagcagtggctggtgcacagcagatggaccaaggccctgatggaggagttcttcagacagggcgacaaggaggccgagctgggcctgcccttcagccccctgtgcgacagaaccagcaccctggtggcccagagccagatcggcttcatcgacttcatcgtggagcccaccttcagcgtgctgaccgacgtggccgagaagagcgtgcagcccctggccgacgaggacagcaagagcaagaaccagcccagcttccagtggagacagcccagcctggacgtggaggtgggcgaccccaaccccgacgtggtgagcttcagaagcacctgggtgaagagaatccaggagaacaagcagaagtggaaggagagagccgccagcggcatcaccaaccagatgagcatcgacgagctgagcccctgcgaggaggaggccccccccagccccgccgaggacgagcacaaccagaacggcaacctggactag

SEQ ID NO: 93096 - DNA, 1551 bp, Artificial Sequence
  Description of Artificial Sequence: Synthetic coding sequence
atggccaaccccgtgcccgtgcagagaagccacctgcagggccccatcctgagactgagatacatggtgaagcagctggagaacggcgagatcaacatcgaggagctgaagaagaacctggagtacaccgccagcctgctggaggccgtgtacatcgacgagaccagacagatcctggacaccgaggacgagctgcaggagctgagaagcgacgccgtgcccagcgaggtgagagactggctggccagcaccttcacccagcaggccagagccaagggcagaagagccgaggagaagcccaagttcagaagcatcgtgcacgccgtgcaggccggcatcttcgtggagagaatgttcagaagaacctacaccagcgtgggccccacctacagcaccgccgtgctgaactgcctgaagaacctggacctgtggtgcttcgacgtgttcagcctgaaccaggccgccgacgaccacgccctgagaaccatcgtgttcgagctgctgaccagacacaacctgatcagcagattcaagatccccaccgtgttcctgatgagcttcctggacgccctggagaccggctacggcaagtacaagaacccctaccacaaccagatccacgccgccgacgtgacccagaccgtgcactgcttcctgctgagaaccggcatggtgcactgcctgagcgagatcgagctgctggccatcatcttcgccgccgccatccacgactacgagcacaccggcaccaccaacagcttccacatccagaccaagagcgagtgcgccatcgtgtacaacgacagaagcgtgctggagaaccaccacatcagcagcgtgttcagactgatgcaggacgacgagatgaacatcttcatcaacctgaccaaggacgagttcgtggagctgagagccctggtgatcgagatggtgctggccaccgacatgagctgccacttccagcaggtgaagaccatgaagaccgccctgcagcagctggagagaatcgacaagcccaaggccctgagcctgctgctgcacgccgccgacatcagccaccccaccaagcagtggctggtgcacagcagatggaccaaggccctgatggaggagttcttcagacagggcgacaaggaggccgagctgggcctgcccttcagccccctgtgcgacagaaccagcaccctggtggcccagagccagatcggcttcatcgacttcatcgtggagcccaccttcagcgtgctgaccgacgtggccgagaagagcgtgcagcccctggccgacgaggacagcaagagcaagaaccagcccagcttccagtggagacagcccagcctggacgtggaggtgggcgaccccaaccccgacgtggtgagcttcagaagcacctgggtgaagagaatccaggagaacaagcagaagtggaaggagagagccgccagcggcatcaccaaccagatgagcatcgacgagctgagcccctgcgaggaggaggccccccccagccccgccgaggacgagcacaaccagaacggcaacctggactag

SEQ ID NO: 93097 - DNA, 2310 bp, Artificial Sequence
  Description of Artificial Sequence: Synthetic coding sequence
atgaccgacgccggcaacagaaaggagggcttcaagaagtgcagaagcgccaccttcagcatcgacggctacagcttcaccatcgtggccaacgaggccggcgacaagaacgccagacccctggccagattcagcagaagcaagagccagaactgcctgtggaacagcctgatcgacggcctgaccggcaacgtgaaggagaagcccagacccaccatcgtgcacgaccccagaccccccgaggagatcctggccgacgagctgccccagctggacagcagcgaggtgctggtgaagaccagcttcagactgagaagcctggtgaagcagctggagagaggcgaggccagcgtggtggacctgaagaagaacctggagtacgccgccaccgtgctggagagcgtgtacatcgacgagaccagaagactgctggacaccgaggacgagctgagcgacatccagagcgacgccgtgcccagcgaggtgagagactggctggccagcaccttcaccagacagatgggcatgatgctgagaagaagcgacgagaagcccagattcaagagcatcgtgcacgccgtgcaggccggcatcttcgtggagagaatgtacagaagaaccagcaacatggtgggcctgagctacccccccgccgtgatcgaggccctgaaggacgtggacaagtggagcttcgacgtgttcagcctgaacgaggccagcggcgaccacgccctgaagttcatcttctacgagctgctgaccagatacgacctgatcagcagattcaagatccccatcagcgccctggtgagcttcgtggaggccctggaggtgggctacagcaagcacaagaacccctaccacaacctgatgcacgccgccgacgtgacccagaccgtgcactacctgctgtacaagaccggcgtggccaactggctgaccgagctggagatcttcgccatcatcttcagcgccgccatccacgactacgagcacaccggcaccaccaacaacttccacatccagaccagaagcgaccccgccatcctgtacaacgacagaagcgtgctggagaaccaccacctgagcgccgcctacagactgctgcaggacgacgaggagatgaacatcctgatcaacctgagcaaggacgactggagagagttcagaaccctggtgatcgagatggtgatggccaccgacatgagctgccacttccagcagatcaaggccatgaagaccgccctgcagcagcccgaggccatcgagaagcccaaggccctgagcctgatgctgcacaccgccgacatcagccaccccgccaaggcctgggacctgcaccacagatggaccatgagcctgctggaggagttcttcagacagggcgacagagaggccgagctgggcctgcccttcagccccctgtgcgacagaaagagcaccatggtggcccagagccaggtgggcttcatcgacttcatcgtggagcccaccttcaccgtgctgaccgacatgaccgagaagatcgtgagccccctgatcgacgagaccagccagaccggcggcaccggccagagaagaagcagcctgaacagcatcagcagcagcgacgccaagagaagcggcgtgaagaccagcggcagcgagggcagcgcccccatcaacaacagcgtgatcagcgtggactacaagagcttcaaggccacctggaccgaggtggtgcacatcaacagagagagatggagagccaaggtgcccaaggaggagaaggccaagaaggaggccgaggagaaggccagactggccgccgaggagcagcagaaggagatggaggccaagagccaggccgaggagggcgccagcggcaaggccgagaagaagaccagcggcgagaccaagaaccaggtgaacggcaccagagccaacaagagcgacaaccccagaggcaagaacagcaaggccgagaagagcagcggcgagcagcagcagaacggcgacttcaaggacggcaagaacaagaccgacaagaaggaccacagcaacatcggcaacgacagcaagaagaccgacggcaccaagcagagaagccacggcagccccgcccccagcaccagcagcacctgcagactgaccctgcccgtgatcaagccccccctgagacacttcaagagacccgcctacgccagcagcagctacgcccccagcgtgagcaagaagaccgacgagcaccccgccagatacaagatgctggaccagagaatcaagatgaagaagatccagaacatcagccacaactggaacagaaagtag

SEQ ID NO: 93098 - DNA, 2130 bp, Artificial Sequence
  Description of Artificial Sequence: Synthetic coding sequence
atggagagccccaccaaggagatcgaggagttcgagagcaacagcctgaagtacctgcagcccgagcagatcgagaagatctggctgagactgagaggcctgagaaagtacaagaagaccagccagagactgagaagcctggtgaagcagctggagagaggcgaggccagcgtggtggacctgaagaagaacctggagtacgccgccaccgtgctggagagcgtgtacatcgacgagaccagaagactgctggacaccgaggacgagctgagcgacatccagagcgacgccgtgcccagcgaggtgagagactggctggccagcaccttcaccagacagatgggcatgatgctgagaagaagcgacgagaagcccagattcaagagcatcgtgcacgccgtgcaggccggcatcttcgtggagagaatgtacagaagaaccagcaacatggtgggcctgagctacccccccgccgtgatcgaggccctgaaggacgtggacaagtggagcttcgacgtgttcagcctgaacgaggccagcggcgaccacgccctgaagttcatcttctacgagctgctgaccagatacgacctgatcagcagattcaagatccccatcagcgccctggtgagcttcgtggaggccctggaggtgggctacagcaagcacaagaacccctaccacaacctgatgcacgccgccgacgtgacccagaccgtgcactacctgctgtacaagaccggcgtggccaactggctgaccgagctggagatcttcgccatcatcttcagcgccgccatccacgactacgagcacaccggcaccaccaacaacttccacatccagaccagaagcgaccccgccatcctgtacaacgacagaagcgtgctggagaaccaccacctgagcgccgcctacagactgctgcaggacgacgaggagatgaacatcctgatcaacctgagcaaggacgactggagagagttcagaaccctggtgatcgagatggtgatggccaccgacatgagctgccacttccagcagatcaaggccatgaagaccgccctgcagcagcccgaggccatcgagaagcccaaggccctgagcctgatgctgcacaccgccgacatcagccaccccgccaaggcctgggacctgcaccacagatggaccatgagcctgctggaggagttcttcagacagggcgacagagaggccgagctgggcctgcccttcagccccctgtgcgacagaaagagcaccatggtggcccagagccaggtgggcttcatcgacttcatcgtggagcccaccttcaccgtgctgaccgacatgaccgagaagatcgtgagccccctgatcgacgagaccagccagaccggcggcaccggccagagaagaagcagcctgaacagcatcagcagcagcgacgccaagagaagcggcgtgaagaccagcggcagcgagggcagcgcccccatcaacaacagcgtgatcagcgtggactacaagagcttcaaggccacctggaccgaggtggtgcacatcaacagagagagatggagagccaaggtgcccaaggaggagaaggccaagaaggaggccgaggagaaggccagactggccgccgaggagcagcagaaggagatggaggccaagagccaggccgaggagggcgccagcggcaaggccgagaagaagaccagcggcgagaccaagaaccaggtgaacggcaccagagccaacaagagcgacaaccccagaggcaagaacagcaaggccgagaagagcagcggcgagcagcagcagaacggcgacttcaaggacggcaagaacaagaccgacaagaaggaccacagcaacatcggcaacgacagcaagaagaccgacggcaccaagcagagaagccacggcagccccgcccccagcaccagcagcacctgcagactgaccctgcccgtgatcaagccccccctgagacacttcaagagacccgcctacgccagcagcagctacgcccccagcgtgagcaagaagaccgacgagcaccccgccagatacaagatgctggaccagagaatcaagatgaagaagatccagaacatcagccacaactggaacagaaagtag

SEQ ID NO: 93099 - DNA, 1905 bp, Artificial Sequence
  Description of Artificial Sequence: Synthetic coding sequence
atggagagccccaccaaggagatcgaggagttcgagagcaacagcctgaagtacctgcagcccgagcagatcgagaagatctggctgagactgagaggcctgagaaagtacaagaagaccagccagagactgagaagcctggtgaagcagctggagagaggcgaggccagcgtggtggacctgaagaagaacctggagtacgccgccaccgtgctggagagcgtgtacatcgacgagaccagaagactgctggacaccgaggacgagctgagcgacatccagagcgacgccgtgcccagcgaggtgagagactggctggccagcaccttcaccagacagatgggcatgatgctgagaagaagcgacgagaagcccagattcaagagcatcgtgcacgccgtgcaggccggcatcttcgtggagagaatgtacagaagaaccagcaacatggtgggcctgagctacccccccgccgtgatcgaggccctgaaggacgtggacaagtggagcttcgacgtgttcagcctgaacgaggccagcggcgaccacgccctgaagttcatcttctacgagctgctgaccagatacgacctgatcagcagattcaagatccccatcagcgccctggtgagcttcgtggaggccctggaggtgggctacagcaagcacaagaacccctaccacaacctgatgcacgccgccgacgtgacccagaccgtgcactacctgctgtacaagaccggcgtggccaactggctgaccgagctggagatcttcgccatcatcttcagcgccgccatccacgactacgagcacaccggcaccaccaacaacttccacatccagaccagaagcgaccccgccatcctgtacaacgacagaagcgtgctggagaaccaccacctgagcgccgcctacagactgctgcaggacgacgaggagatgaacatcctgatcaacctgagcaaggacgactggagagagttcagaaccctggtgatcgagatggtgatggccaccgacatgagctgccacttccagcagatcaaggccatgaagaccgccctgcagcagcccgaggccatcgagaagcccaaggccctgagcctgatgctgcacaccgccgacatcagccaccccgccaaggcctgggacctgcaccacagatggaccatgagcctgctggaggagttcttcagacagggcgacagagaggccgagctgggcctgcccttcagccccctgtgcgacagaaagagcaccatggtggcccagagccaggtgggcttcatcgacttcatcgtggagcccaccttcaccgtgctgaccgacatgaccgagaagatcgtgagccccctgatcgacgagaccagccagaccggcggcaccggccagagaagaagcagcctgaacagcatcagcagcagcgacgccaagagaagcggcgtgaagaccagcggcagcgagggcagcgcccccatcaacaacagcgtgatcagcgtggactacaagagcttcaaggccacctggaccgaggtggtgcacatcaacagagagagatggagagccaaggtgcccaaggaggagaaggccaagaaggaggccgaggagaaggccagactggccgccgaggagcagcagaaggagatggaggccaagagccaggccgaggagggcgccagcggcaaggccgagaagaagaccagcggcgagaccaagaaccaggtgaacggcaccagagccaacaagagcgacaaccccagaggcaagaacagcaaggccgagaagagcagcggcgagcagcagcagaacggcgacttcaaggacggcaagaacaagaccgacaagaaggaccacagcaacatcggcaacgacagcaagaagaccgacgacagccaggagtag

SEQ ID NO: 93100 - DNA, 1905 bp, Artificial Sequence; identical to SEQ ID NO: 93099
  Description of Artificial Sequence: Synthetic coding sequence

SEQ ID NO: 93101 - DNA, 141 bp, Artificial Sequence
  Description of Artificial Sequence: Synthetic coding sequence
atggagagccccaccaaggagatcgaggagttcgagagcaacagcctgaagtacctgcagcccgagcagatcgagaagatctggctgagactgagaggcctgagaaagtacaagaagaccagccagagactgagaagctag

SEQ ID NO: 93102 - DNA, 2130 bp, Artificial Sequence; identical to SEQ ID NO: 93098
  Description of Artificial Sequence: Synthetic coding sequence

SEQ ID NO: 93103 - DNA, 3339 bp, Artificial Sequence
  Description of Artificial Sequence: Synthetic coding sequence
atgagaagagacgagagagacgccaaggccatgagaagcctgcagccccccgacggcgccggcagcccccccgagagcctgagaaacggctacgtgaagagctgcgtgagccccctgagacaggacccccccagaggcttcttcttccacctgtgcagattctgcaacgtggagctgagacccccccccgccagcccccagcagcccagaagatgcagccccttctgcagagccagactgagcctgggcgccctggccgccttcgtgctggccctgctgctgggcgccgagcccgagagctgggccgccggcgccgcctggctgagaaccctgctgagcgtgtgcagccacagcctgagccccctgttcagcatcgcctgcgccttcttcttcctgacctgcttcctgaccagaaccaagagaggccccggccccggcagaagctgcggcagctggtggctgctggccctgcccgcctgctgctacctgggcgacttcctggtgtggcagtggtggagctggccctggggcgacggcgacgccggcagcgccgccccccacaccccccccgaggccgccgccggcagactgctgctggtgctgagctgcgtgggcctgctgctgaccctggcccaccccctgagactgagacactgcgtgctggtgctgctgctggccagcttcgtgtggtgggtgagcttcaccagcctgggcagcctgcccagcgccctgagacccctgctgagcggcctggtgggcggcgccggctgcctgctggccctgggcctggaccacttcttccagatcagagaggcccccctgcaccccagactgagcagcgccgccgaggagaaggtgcccgtgatcagacccagaagaagaagcagctgcgtgagcctgggcgagaccgccgccagctactacggcagctgcaagatcttcagaagacccagcctgccctgcatcagcagagagcagatgatcctgtgggactgggacctgaagcagtggtacaagccccactaccagaacagcggcggcggcaacggcgtggacctgagcgtgctgaacgaggccagaaacatggtgagcgacctgctgaccgaccccagcctgcccccccaggtgatcagcagcctgagaagcatcagcagcctgatgggcgccttcagcggcagctgcagacccaagatcaaccccctgacccccttccccggcttctacccctgcagcgagatcgaggaccccgccgagaagggcgacagaaagctgaacaagggcctgaacagaaacagcctgcccaccccccagctgagaagaagcagcggcaccagcggcctgctgcccgtggagcagagcagcagatgggacagaaacaacggcaagagaccccaccaggagttcggcatcagcagccagggctgctacctgaacggccccttcaacagcaacctgctgaccatccccaagcagagaagcagcagcgtgagcctgacccaccacgtgggcctgagaagagccggcgtgctgagcagcctgagccccgtgaacagcagcaaccacggccccgtgagcaccggcagcctgaccaacagaagccccatcgagttccccgacaccgccgacttcctgaacaagcccagcgtgatcctgcagagaagcctgggcaacgcccccaacacccccgacttctaccagcagctgagaaacagcgacagcaacctgtgcaacagctgcggccaccagatgctgaagtacgtgagcaccagcgagagcgacggcaccgactgctgcagcggcaagagcggcgaggaggagaacatcttcagcaaggagagcttcaagctgatggagacccagcaggaggaggagaccgagaagaaggacagcagaaagctgttccaggagggcgacaagtggctgaccgaggaggcccagagcgagcagcagaccaacatcgagcaggaggtgagcctggacctgatcctggtggaggagtacgacagcctgatcgagaagatgagcaactggaacttccccatcttcgagctggtggagaagatgggcgagaagagcggcagaatcctgagccaggtgatgtacaccctgttccaggacaccggcctgctggagatcttcaagatccccacccagcagttcatgaactacttcagagccctggagaacggctacagagacatcccctaccacaacagaatccacgccaccgacgtgctgcacgccgtgtggtacctgaccaccagacccgtgcccggcctgcagcagatccacaacggctgcggcaccggcaacgagaccgacagcgacggcagaatcaaccacggcagaatcgcctacatcagcagcaagagctgcagcaaccccgacgagagctacggctgcctgagcagcaacatccccgccctggagctgatggccctgtacgtggccgccgccatgcacgactacgaccaccccggcagaaccaacgccttcctggtggccaccaacgccccccaggccgtgctgtacaacgacagaagcgtgctggagaaccaccacgccgccagcgcctggaacctgtacctgagcagacccgagtacaacttcctgctgcacctggaccacgtggagttcaagagattcagattcctggtgatcgaggccatcctggccaccgacctgaagaagcacttcgacttcctggccgagttcaacgccaaggccaacgacgtgaacagcaacggcatcgagtggagcaacgagaacgacagactgctggtgtgccaggtgtgcatcaagctggccgacatcaacggccccgccaaggtgagagacctgcacctgaagtggaccgagggcatcgtgaacgagttctacgagcagggcgacgaggaggccaacctgggcctgcccatcagccccttcatggacagaagcagcccccagctggccaagctgcaggagagcttcatcacccacatcgtgggccccctgtgcaacagctacgacgccgccggcctgctgcccggccagtggctggaggccgaggaggacaacgacaccgagagcggcgacgacgaggacggcgaggagctggacaccgaggacgaggagatggagaacaacctgaaccccaagccccccagaagaaagagcagaagaagaatcttctgccagctgatgcaccacctgaccgagaaccacaagatctggaaggagatcgtggaggaggaggagaagtgcaaggccgacggcaacaagctgcaggtggagaacagcagcctgccccaggccgacgagatccaggtgatcgaggaggccgacgaggaggagtag

SEQ ID NO: 93104 - DNA, 3186 bp, Artificial Sequence
  Description of Artificial Sequence: Synthetic coding sequence
atgagaagagacgagagagacgccaaggccatgagaagcctgcagccccccgacggcgccggcagcccccccgagagcctgagaaacggctacgtgaagagctgcgtgagccccctgagacaggacccccccagaggcttcttcttccacctgtgcagattctgcaacgtggagctgagacccccccccgccagcccccagcagcccagaagatgcagccccttctgcagagccagactgagcctgggcgccctggccgccttcgtgctggccctgctgctgggcgccgagcccgagagctgggccgccggcgccgcctggctgagaaccctgctgagcgtgtgcagccacagcctgagccccctgttcagcatcgcctgcgccttcttcttcctgacctgcttcctgaccagaaccaagagaggccccggccccggcagaagctgcggcagctggtggctgctggccctgcccgcctgctgctacctgggcgacttcctggtgtggcagtggtggagctggccctggggcgacggcgacgccggcagcgccgccccccacaccccccccgaggccgccgccggcagactgctgctggtgctgagctgcgtgggcctgctgctgaccctggcccaccccctgagactgagacactgcgtgctggtgctgctgctggccagcttcgtgtggtgggtgagcttcaccagcctgggcagcctgcccagcgccctgagacccctgctgagcggcctggtgggcggcgccggctgcctgctggccctgggcctggaccacttcttccagatcagagaggcccccctgcaccccagactgagcagcgccgccgaggagaaggtgcccgtgatcagacccagaagaagaagcagctgcgtgagcctgggcgagaccgccgccagctactacggcagctgcaagatcttcagaagacccagcctgccctgcatcagcagagagcagatgatcctgtgggactgggacctgaagcagtggtacaagccccactaccagaacagcggcggcggcaacggcgtggacctgagcgtgctgaacgaggccagaaacatggtgagcgacctgctgaccgaccccagcctgcccccccagggcctgaacagaaacagcctgcccaccccccagctgagaagaagcagcggcaccagcggcctgctgcccgtggagcagagcagcagatgggacagaaacaacggcaagagaccccaccaggagttcggcatcagcagccagggctgctacctgaacggccccttcaacagcaacctgctgaccatccccaagcagagaagcagcagcgtgagcctgacccaccacgtgggcctgagaagagccggcgtgctgagcagcctgagccccgtgaacagcagcaaccacggccccgtgagcaccggcagcctgaccaacagaagccccatcgagttccccgacaccgccgacttcctgaacaagcccagcgtgatcctgcagagaagcctgggcaacgcccccaacacccccgacttctaccagcagctgagaaacagcgacagcaacctgtgcaacagctgcggccaccagatgctgaagtacgtgagcaccagcgagagcgacggcaccgactgctgcagcggcaagagcggcgaggaggagaacatcttcagcaaggagagcttcaagctgatggagacccagcaggaggaggagaccgagaagaaggacagcagaaagctgttccaggagggcgacaagtggctgaccgaggaggcccagagcgagcagcagaccaacatcgagcaggaggtgagcctggacctgatcctggtggaggagtacgacagcctgatcgagaagatgagcaactggaacttccccatcttcgagctggtggagaagatgggcgagaagagcggcagaatcctgagccaggtgatgtacaccctgttccaggacaccggcctgctggagatcttcaagatccccacccagcagttcatgaactacttcagagccctggagaacggctacagagacatcccctaccacaacagaatccacgccaccgacgtgctgcacgccgtgtggtacctgaccaccagacccgtgcccggcctgcagcagatccacaacggctgcggcaccggcaacgagaccgacagcgacggcagaatcaaccacggcagaatcgcctacatcagcagcaagagctgcagcaaccccgacgagagctacggctgcctgagcagcaacatccccgccctggagctgatggccctgtacgtggccgccgccatgcacgactacgaccaccccggcagaaccaacgccttcctggtggccaccaacgccccccaggccgtgctgtacaacgacagaagcgtgctggagaaccaccacgccgccagcgcctggaacctgtacctgagcagacccgagtacaacttcctgctgcacctggaccacgtggagttcaagagattcagattcctggtgatcgaggccatcctggccaccgacctgaagaagcacttcgacttcctggccgagttcaacgccaaggccaacgacgtgaacagcaacggcatcgagtggagcaacgagaacgacagactgctggtgtgccaggtgtgcatcaagctggccgacatcaacggccccgccaaggtgagagacctgcacctgaagtggaccgagggcatcgtgaacgagttctacgagcagggcgacgaggaggccaacctgggcctgcccatcagccccttcatggacagaagcagcccccagctggccaagctgcaggagagcttcatcacccacatcgtgggccccctgtgcaacagctacgacgccgccggcctgctgcccggccagtggctggaggccgaggaggacaacgacaccgagagcggcgacgacgaggacggcgaggagctggacaccgaggacgaggagatggagaacaacctgaaccccaagccccccagaagaaagagcagaagaagaatcttctgccagctgatgcaccacctgaccgagaaccacaagatctggaaggagatcgtggaggaggaggagaagtgcaaggccgacggcaacaagctgcaggtggagaacagcagcctgccccaggccgacgagatccaggtgatcgaggaggccgacgaggaggagtag

SEQ ID NO: 93105 - DNA, 2583 bp, Artificial Sequence
  Description of Artificial Sequence: Synthetic coding sequence
atggccagacccagaggcctgggcagaatccccgagctgcagctggtggccttccccgtggccgtggccgccgaggacgaggccttcctgcccgagcccctggcccccagagcccccagaagacccagaagcccccccagcagccccgtgttcttcgccagccccagccccaccttcagaagaagactgagactgctgagaagctgccaggacctgggcagacaggcctgggccggcgccggcttcgaggccgagaacggccccacccccagccccggcagaagccccctggacagccaggccagccccggcctggtgctgcacgccggcgccgccaccagccagagaagagagagcttcctgtacagaagcgacagcgactacgacatgagccccaagaccatgagcagaaacagcagcgtgaccagcgaggcccacgccgaggacctgatcgtgacccccttcgcccaggtgctggccagcctgagaagcgtgagaagcaacttcagcctgctgaccaacgtgcccgtgcccagcaacaagagaagccccctgggcggccccacccccgtgtgcaaggccaccctgagcgaggagacctgccagcagctggccagagagaccctggaggagctggactggtgcctggagcagctggagaccatgcagacctacagaagcgtgagcgagatggccagccacaagttcaagagaatgctgaacagagagctgacccacctgagcgagatgagcagaagcggcaaccaggtgagcgagtacatcagcaccaccttcctggacaagcagaacgaggtggagatccccagccccaccatgaaggagagagagaagcagcaggcccccagacccagacccagccagcccccccccccccccgtgccccacctgcagcccatgagccagatcaccggcctgaagaagctgatgcacagcaacagcctgaacaacagcaacatccccagattcggcgtgaagaccgaccaggaggagctgctggcccaggagctggagaacctgaacaagtggggcctgaacatcttctgcgtgagcgactacgccggcggcagaagcctgacctgcatcatgtacatgatcttccaggagagagacctgctgaagaagttcagaatccccgtggacaccatggtgacctacatgctgaccctggaggaccactaccacgccgacgtggcctaccacaacagcctgcacgccgccgacgtgctgcagagcacccacgtgctgctggccacccccgccctggacgccgtgttcaccgacctggagatcctggccgccctgttcgccgccgccatccacgacgtggaccaccccggcgtgagcaaccagttcctgatcaacaccaacagcgagctggccctgatgtacaacgacgagagcgtgctggagaaccaccacctggccgtgggcttcaagctgctgcaggaggacaactgcgacatcttccagaacctgagcaagagacagagacagagcctgagaaagatggtgatcgacatggtgctggccaccgacatgagcaagcacatgaccctgctggccgacctgaagaccatggtggagaccaagaaggtgaccagcagcggcgtgctgctgctggacaactacagcgacagaatccaggtgctgagaaacatggtgcactgcgccgacctgagcaaccccaccaagcccctggagctgtacagacagtggaccgacagaatcatggccgagttcttccagcagggcgacagagagagagagagaggcatggagatcagccccatgtgcgacaagcacaccgccagcgtggagaagagccaggtgggcttcatcgactacatcgtgcaccccctgtgggagacctgggccgacctggtgcaccccgacgcccaggagatcctggacaccctggaggacaacagagactggtactacagcgccatcagacagagccccagccccccccccgaggaggagagcagaggccccggccacccccccctgcccgacaagttccagttcgagctgaccctggaggaggaggaggaggaggagatcagcatggcccagatcccctgcaccgcccaggaggccctgaccgcccagggcctgagcggcgtggaggaggccctggacgccaccatcgcctgggaggccagccccgcccaggagagcctggaggtgatggcccaggaggccagcctggaggccgagctggaggccgtgtacctgacccagcaggcccagagcaccggcagcgcccccgtggcccccgacgagttcagcagcagagaggagttcgtggtggccgtgagccacagcagccccagcgccctggccctgcagagccccctgctgcccgcctggagaaccctgagcgtgagcgagcacgcccccggcctgcccggcctgcccagcaccgccgccgaggtggaggcccagagagagcaccaggccgccaagagagcctgcagcgcctgcgccggcaccttcggcgaggacaccagcgccctgcccgcccccggcggcggcggcagcggcggcgaccccacctag

SEQ ID NO: 93106 - DNA, 1944 bp, Artificial Sequence
  Description of Artificial Sequence: Synthetic coding sequence
atgcccctggtggacttcttctgcgagacctgcagcaagccctggctggtgggctggtgggaccagttcaagagaatgctgaacagagagctgacccacctgagcgagatgagcagaagcggcaaccaggtgagcgagtacatcagcaccaccttcctggacaagcagaacgaggtggagatccccagccccaccatgaaggagagagagaagcagcaggcccccagacccagacccagccagcccccccccccccccgtgccccacctgcagcccatgagccagatcaccggcctgaagaagctgatgcacagcaacagcctgaacaacagcaacatccccagattcggcgtgaagaccgaccaggaggagctgctggcccaggagctggagaacctgaacaagtggggcctgaacatcttctgcgtgagcgactacgccggcggcagaagcctgacctgcatcatgtacatgatcttccaggagagagacctgctgaagaagttcagaatccccgtggacaccatggtgacctacatgctgaccctggaggaccactaccacgccgacgtggcctaccacaacagcctgcacgccgccgacgtgctgcagagcacccacgtgctgctggccacccccgccctggacgccgtgttcaccgacctggagatcctggccgccctgttcgccgccgccatccacgacgtggaccaccccggcgtgagcaaccagttcctgatcaacaccaacagcgagctggccctgatgtacaacgacgagagcgtgctggagaaccaccacctggccgtgggcttcaagctgctgcaggaggacaactgcgacatcttccagaacctgagcaagagacagagacagagcctgagaaagatggtgatcgacatggtgctggccaccgacatgagcaagcacatgaccctgctggccgacctgaagaccatggtggagaccaagaaggtgaccagcagcggcgtgctgctgctggacaactacagcgacagaatccaggtgctgagaaacatggtgcactgcgccgacctgagcaaccccaccaagcccctggagctgtacagacagtggaccgacagaatcatggccgagttcttccagcagggcgacagagagagagagagaggcatggagatcagccccatgtgcgacaagcacaccgccagcgtggagaagagccaggtgggcttcatcgactacatcgtgcaccccctgtgggagacctgggccgacctggtgcaccccgacgcccaggagatcctggacaccctggaggacaacagagactggtactacagcgccatcagacagagccccagccccccccccgaggaggagagcagaggccccggccacccccccctgcccgacaagttccagttcgagctgaccctggaggaggaggaggaggaggagatcagcatggcccagatcccctgcaccgcccaggaggccctgaccgcccagggcctgagcggcgtggaggaggccctggacgccaccatcgcctgggaggccagccccgcccaggagagcctggaggtgatggcccaggaggccagcctggaggccgagctggaggccgtgtacctgacccagcaggcccagagcaccggcagcgcccccgtggcccccgacgagttcagcagcagagaggagttcgtggtggccgtgagccacagcagccccagcgccctggccctgcagagccccctgctgcccgcctggagaaccctgagcgtgagcgagcacgcccccggcctgcccggcctgcccagcaccgccgccgaggtggaggcccagagagagcaccaggccgccaagagagcctgcagcgcctgcgccggcaccttcggcgaggacaccagcgccctgcccgcccccggcggcggcggcagcggcggcgaccccacctag

SEQ ID NO: 93107 - DNA, 2661 bp, Artificial Sequence
  Description of Artificial Sequence: Synthetic coding sequence
atggagccccccaccgtgcccagcgagagaagcctgagcctgagcctgcccggccccagagagggccaggccaccctgaagccccccccccagcacctgtggagacagcccagaacccccatcagaatccagcagagaggctacagcgacagcgccgagagagccgagagagagagacagccccacagacccatcgagagagccgacgccatggacaccagcgacagacccggcctgagaaccaccagaatgagctggcccagcagcttccacggcaccggcaccggcagcggcggcgccggcggcggcagcagcagaagattcgaggccgagaacggccccacccccagccccggcagaagccccctggacagccaggccagccccggcctggtgctgcacgccggcgccgccaccagccagagaagagagagcttcctgtacagaagcgacagcgactacgacatgagccccaagaccatgagcagaaacagcagcgtgaccagcgaggcccacgccgaggacctgatcgtgacccccttcgcccaggtgctggccagcctgagaagcgtgagaagcaacttcagcctgctgaccaacgtgcccgtgcccagcaacaagagaagccccctgggcggccccacccccgtgtgcaaggccaccctgagcgaggagacctgccagcagctggccagagagaccctggaggagctggactggtgcctggagcagctggagaccatgcagacctacagaagcgtgagcgagatggccagccacaagttcaagagaatgctgaacagagagctgacccacctgagcgagatgagcagaagcggcaaccaggtgagcgagtacatcagcaccaccttcctggacaagcagaacgaggtggagatccccagccccaccatgaaggagagagagaagcagcaggcccccagacccagacccagccagcccccccccccccccgtgccccacctgcagcccatgagccagatcaccggcctgaagaagctgatgcacagcaacagcctgaacaacagcaacatccccagattcggcgtgaagaccgaccaggaggagctgctggcccaggagctggagaacctgaacaagtggggcctgaacatcttctgcgtgagcgactacgccggcggcagaagcctgacctgcatcatgtacatgatcttccaggagagagacctgctgaagaagttcagaatccccgtggacaccatggtgacctacatgctgaccctggaggaccactaccacgccgacgtggcctaccacaacagcctgcacgccgccgacgtgctgcagagcacccacgtgctgctggccacccccgccctggacgccgtgttcaccgacctggagatcctggccgccctgttcgccgccgccatccacgacgtggaccaccccggcgtgagcaaccagttcctgatcaacaccaacagcgagctggccctgatgtacaacgacgagagcgtgctggagaaccaccacctggccgtgggcttcaagctgctgcaggaggacaactgcgacatcttccagaacctgagcaagagacagagacagagcctgagaaagatggtgatcgacatggtgctggccaccgacatgagcaagcacatgaccctgctggccgacctgaagaccatggtggagaccaagaaggtgaccagcagcggcgtgctgctgctggacaactacagcgacagaatccaggtgctgagaaacatggtgcactgcgccgacctgagcaaccccaccaagcccctggagctgtacagacagtggaccgacagaatcatggccgagttcttccagcagggcgacagagagagagagagaggcatggagatcagccccatgtgcgacaagcacaccgccagcgtggagaagagccaggtgggcttcatcgactacatcgtgcaccccctgtgggagacctgggccgacctggtgcaccccgacgcccaggagatcctggacaccctggaggacaacagagactggtactacagcgccatcagacagagccccagccccccccccgaggaggagagcagaggccccggccacccccccctgcccgacaagttccagttcgagctgaccctggaggaggaggaggaggaggagatcagcatggcccagatcccctgcaccgcccaggaggccctgaccgcccagggcctgagcggcgtggaggaggccctggacgccaccatcgcctgggaggccagccccgcccaggagagcctggaggtgatggcccaggaggccagcctggaggccgagctggaggccgtgtacctgacccagcaggcccagagcaccggcagcgcccccgtggcccccgacgagttcagcagcagagaggagttcgtggtggccgtgagccacagcagccccagcgccctggccctgcagagccccctgctgcccgcctggagaaccctgagcgtgagcgagcacgcccccggcctgcccggcctgcccagcaccgccgccgaggtggaggcccagagagagcaccaggccgccaagagagcctgcagcgcctgcgccggcaccttcggcgaggacaccagcgccctgcccgcccccggcggcggcggcagcggcggcgaccccacctag

SEQ ID NO: 93108 - DNA, 972 bp, Artificial Sequence
  Description of Artificial Sequence: Synthetic coding sequence
atggtgctgcccagcgaccagggcttcaagctgctgggcaacgtgctgcagggccccgagccctacagactgctgaccagcggcctgagactgcaccaggagctggagaacctgaacaagtggggcctgaacatcttctgcgtgagcgactacgccggcggcagaagcctgacctgcatcatgtacatgatcttccaggagagagacctgctgaagaagttcagaatccccgtggacaccatggtgacctacatgctgaccctggaggaccactaccacgccgacgtggcctaccacaacagcctgcacgccgccgacgtgctgcagagcacccacgtgctgctggccacccccgccctggacgccgtgttcaccgacctggagatcctggccgccctgttcgccgccgccatccacgacgtggaccaccccggcgtgagcaaccagttcctgatcaacaccaacagcgagctggccctgatgtacaacgacgagagcgtgctggagaaccaccacctggccgtgggcttcaagctgctgcaggaggacaactgcgacatcttccagaacctgagcaagagacagagacagagcctgagaaagatggtgatcgacatggtgctggccaccgacatgagcaagcacatgaccctgctggccgacctgaagaccatggtggagaccaagaaggtgaccagcagcggcgtgctgctgctggacaactacagcgacagaatccaggtgctgagaaacatggtgcactgcgccgacctgagcaaccccaccaagcccctggagctgtacagacagtggaccgacagaatcatggccgagttcttccagcagggcgacagagagagagagagaggcatggagatcagccccatgtgcgacaagcacaccgccagcgtggagaagagccaggtgcaggccagaggcatcgacggcagagcccagggcgagttctactag

SEQ ID NO: 93109 - DNA, 2595 bp, Artificial Sequence
  Description of Artificial Sequence: Synthetic coding sequence
atgaagagaagcagaagcgccctgagcgtggccggcaccggcgacgagagaagcagagagacccccgagagcgacagagccaacatgctgggcgccgacctgagaagacccagaagaagactgagcagcggccccggcctgggctgggcccagcccgagcccagcgaccccggcgtgcccctgccccccagacccaccaccctgcccctgctgatcccccccagaatcagcatcaccagagccgagaacgacagcttcgaggccgagaacggccccacccccagccccggcagaagccccctggacagccaggccagccccggcctggtgctgcacgccggcgccgccaccagccagagaagagagagcttcctgtacagaagcgacagcgactacgacatgagccccaagaccatgagcagaaacagcagcgtgaccagcgaggcccacgccgaggacctgatcgtgacccccttcgcccaggtgctggccagcctgagaagcgtgagaagcaacttcagcctgctgaccaacgtgcccgtgcccagcaacaagagaagccccctgggcggccccacccccgtgtgcaaggccaccctgagcgaggagacctgccagcagctggccagagagaccctggaggagctggactggtgcctggagcagctggagaccatgcagacctacagaagcgtgagcgagatggccagccacaagttcaagagaatgctgaacagagagctgacccacctgagcgagatgagcagaagcggcaaccaggtgagcgagtacatcagcaccaccttcctggacaagcagaacgaggtggagatccccagccccaccatgaaggagagagagaagcagcaggcccccagacccagacccagccagcccccccccccccccgtgccccacctgcagcccatgagccagatcaccggcctgaagaagctgatgcacagcaacagcctgaacaacagcaacatccccagattcggcgtgaagaccgaccaggaggagctgctggcccaggagctggagaacctgaacaagtggggcctgaacatcttctgcgtgagcgactacgccggcggcagaagcctgacctgcatcatgtacatgatcttccaggagagagacctgctgaagaagttcagaatccccgtggacaccatggtgacctacatgctgaccctggaggaccactaccacgccgacgtggcctaccacaacagcctgcacgccgccgacgtgctgcagagcacccacgtgctgctggccacccccgccctggacgccgtgttcaccgacctggagatcctggccgccctgttcgccgccgccatccacgacgtggaccaccccggcgtgagcaaccagttcctgatcaacaccaacagcgagctggccctgatgtacaacgacgagagcgtgctggagaaccaccacctggccgtgggcttcaagctgctgcaggaggacaactgcgacatcttccagaacctgagcaagagacagagacagagcctgagaaagatggtgatcgacatggtgctggccaccgacatgagcaagcacatgaccctgctggccgacctgaagaccatggtggagaccaagaaggtgaccagcagcggcgtgctgctgctggacaactacagcgacagaatccaggtgctgagaaacatggtgcactgcgccgacctgagcaaccccaccaagcccctggagctgtacagacagtggaccgacagaatcatggccgagttcttccagcagggcgacagagagagagagagaggcatggagatcagccccatgtgcgacaagcacaccgccagcgtggagaagagccaggtgggcttcatcgactacatcgtgcaccccctgtgggagacctgggccgacctggtgcaccccgacgcccaggagatcctggacaccctggaggacaacagagactggtactacagcgccatcagacagagccccagccccccccccgaggaggagagcagaggccccggccacccccccctgcccgacaagttccagttcgagctgaccctggaggaggaggaggaggaggagatcagcatggcccagatcccctgcaccgcccaggaggccctgaccgcccagggcctgagcggcgtggaggaggccctggacgccaccatcgcctgggaggccagccccgcccaggagagcctggaggtgatggcccaggaggccagcctggaggccgagctggaggccgtgtacctgacccagcaggcccagagcaccggcagcgcccccgtggcccccgacgagttcagcagcagagaggagttcgtggtggccgtgagccacagcagccccagcgccctggccctgcagagccccctgctgcccgcctggagaaccctgagcgtgagcgagcacgcccccggcctgcccggcctgcccagcaccgccgccgaggtggaggcccagagagagcaccaggccgccaagagagcctgcagcgcctgcgccggcaccttcggcgaggacaccagcgccctgcccgcccccggcggcggcggcagcggcggcgaccccacctag

SEQ ID NO: 93110 - DNA, 309 bp, Artificial Sequence
  Description of Artificial Sequence: Synthetic coding sequence
atggtggagaccaagaaggtgaccagcagcggcgtgctgctgctggacaactacagcgacagaatccaggtgctgagaaacatggtgcactgcgccgacctgagcaaccccaccaagcccctggagctgtacagacagtggaccgacagaatcatggccgagttcttccagcagggcgacagagagagagagagaggcatggagatcagccccatgtgcgacaagcacaccgccagcgtggagaagagccaggtgggcttcatcgactacatcgtgcaccccctgtgggagacctgggccgacctgtag

SEQ ID NO: 93111 - DNA, 2478 bp, Artificial Sequence
  Description of Artificial Sequence: Synthetic coding sequence
atgagaagcggcgccgcccccagagccagacccagaccccccgccctggccctgccccccaccggccccgagagcctgacccacttccccttcagcgacgaggacaccagaagacacccccccggcagaagcgtgagcttcgaggccgagaacggccccacccccagccccggcagaagccccctggacagccaggccagccccggcctggtgctgcacgccggcgccgccaccagccagagaagagagagcttcctgtacagaagcgacagcgactacgacatgagccccaagaccatgagcagaaacagcagcgtgaccagcgaggcccacgccgaggacctgatcgtgacccccttcgcccaggtgctggccagcctgagaagcgtgagaagcaacttcagcctgctgaccaacgtgcccgtgcccagcaacaagagaagccccctgggcggccccacccccgtgtgcaaggccaccctgagcgaggagacctgccagcagctggccagagagaccctggaggagctggactggtgcctggagcagctggagaccatgcagacctacagaagcgtgagcgagatggccagccacaagttcaagagaatgctgaacagagagctgacccacctgagcgagatgagcagaagcggcaaccaggtgagcgagtacatcagcaccaccttcctggacaagcagaacgaggtggagatccccagccccaccatgaaggagagagagaagcagcaggcccccagacccagacccagccagcccccccccccccccgtgccccacctgcagcccatgagccagatcaccggcctgaagaagctgatgcacagcaacagcctgaacaacagcaacatccccagattcggcgtgaagaccgaccaggaggagctgctggcccaggagctggagaacctgaacaagtggggcctgaacatcttctgcgtgagcgactacgccggcggcagaagcctgacctgcatcatgtacatgatcttccaggagagagacctgctgaagaagttcagaatccccgtggacaccatggtgacctacatgctgaccctggaggaccactaccacgccgacgtggcctaccacaacagcctgcacgccgccgacgtgctgcagagcacccacgtgctgctggccacccccgccctggacgccgtgttcaccgacctggagatcctggccgccctgttcgccgccgccatccacgacgtggaccaccccggcgtgagcaaccagttcctgatcaacaccaacagcgagctggccctgatgtacaacgacgagagcgtgctggagaaccaccacctggccgtgggcttcaagctgctgcaggaggacaactgcgacatcttccagaacctgagcaagagacagagacagagcctgagaaagatggtgatcgacatggtgctggccaccgacatgagcaagcacatgaccctgctggccgacctgaagaccatggtggagaccaagaaggtgaccagcagcggcgtgctgctgctggacaactacagcgacagaatccaggtgctgagaaacatggtgcactgcgccgacctgagcaaccccaccaagcccctggagctgtacagacagtggaccgacagaatcatggccgagttcttccagcagggcgacagagagagagagagaggcatggagatcagccccatgtgcgacaagcacaccgccagcgtggagaagagccaggtgggcttcatcgactacatcgtgcaccccctgtgggagacctgggccgacctggtgcaccccgacgcccaggagatcctggacaccctggaggacaacagagactggtactacagcgccatcagacagagccccagccccccccccgaggaggagagcagaggccccggccacccccccctgcccgacaagttccagttcgagctgaccctggaggaggaggaggaggaggagatcagcatggcccagatcccctgcaccgcccaggaggccctgaccgcccagggcctgagcggcgtggaggaggccctggacgccaccatcgcctgggaggccagccccgcccaggagagcctggaggtgatggcccaggaggccagcctggaggccgagctggaggccgtgtacctgacccagcaggcccagagcaccggcagcgcccccgtggcccccgacgagttcagcagcagagaggagttcgtggtggccgtgagccacagcagccccagcgccctggccctgcagagccccctgctgcccgcctggagaaccctgagcgtgagcgagcacgcccccggcctgcccggcctgcccagcaccgccgccgaggtggaggcccagagagagcaccaggccgccaagagagcctgcagcgcctgcgccggcaccttcggcgaggacaccagcgccctgcccgcccccggcggcggcggcagcggcggcgaccccacctag

SEQ ID NO: 93112 - DNA, 2211 bp, Artificial Sequence
  Description of Artificial Sequence: Synthetic coding sequence
atgaagaagagcagaagcgtgatgaccgtgatggccgacgacaacgtgaaggactacttcgagtgcagcctgagcaagagctacagcagcagcagcaacaccctgggcatcgacctgtggagaggcagaagatgctgcagcggcaacctgcagctgccccccctgagccagagacagagcgagagagccagaacccccgagggcgacggcatcagcagacccaccaccctgcccctgaccaccctgcccagcatcgccatcaccaccgtgagccaggagtgcttcgacgtggagaacggccccagccccggcagaagccccctggacccccaggccagcagcagcgccggcctggtgctgcacgccaccttccccggccacagccagagaagagagagcttcctgtacagaagcgacagcgactacgacctgagccccaaggccatgagcagaaacagcagcctgcccagcgagcagcacggcgacgacctgatcgtgacccccttcgcccaggtgctggccagcctgagaagcgtgagaaacaacttcaccatcctgaccaacctgcacggcaccagcaacaagagaagccccgccgccagccagccccccgtgagcagagtgaacccccaggaggagagctaccagaagctggccatggagaccctggaggagctggactggtgcctggaccagctggagaccatccagacctacagaagcgtgagcgagatggccagcaacaagttcaagagaatgctgaacagagagctgacccacctgagcgagatgagcagaagcggcaaccaggtgagcgagtacatcagcaacaccttcctggacaagcagaacgacgtggagatccccagccccacccagaaggacagagagaagaagaagaagcagcagctgatgacccagatcagcggcgtgaagaagctgatgcacagcagcagcctgaacaacaccagcatcagcagattcggcgtgaacaccgagaacgaggaccacctggccaaggagctggaggacctgaacaagtggggcctgaacatcttcaacgtggccggctacagccacaacagacccctgacctgcatcatgtacgccatcttccaggagagagacctgctgaagaccttcagaatcagcagcgacaccttcatcacctacatgatgaccctggaggaccactaccacagcgacgtggcctaccacaacagcctgcacgccgccgacgtggcccagagcacccacgtgctgctgagcacccccgccctggacgccgtgttcaccgacctggagatcctggccgccatcttcgccgccgccatccacgacgtggaccaccccggcgtgagcaaccagttcctgatcaacaccaacagcgagctggccctgatgtacaacgacgagagcgtgctggagaaccaccacctggccgtgggcttcaagctgctgcaggaggagcactgcgacatcttcatgaacctgaccaagaagcagagacagaccctgagaaagatggtgatcgacatggtgctggccaccgacatgagcaagcacatgagcctgctggccgacctgaagaccatggtggagaccaagaaggtgaccagcagcggcgtgctgctgctggacaactacaccgacagaatccaggtgctgagaaacatggtgcactgcgccgacctgagcaaccccaccaagagcctggagctgtacagacagtggaccgacagaatcatggaggagttcttccagcagggcgacaaggagagagagagaggcatggagatcagccccatgtgcgacaagcacaccgccagcgtggagaagagccaggtgggcttcatcgactacatcgtgcaccccctgtgggagacctgggccgacctggtgcagcccgacgcccaggacatcctggacaccctggaggacaacagaaactggtaccagagcatgatcccccagagccccagcccccccctggacgagcagaacagagactgccagggcctgatggagaagttccagttcgagctgaccctggacgaggaggacagcgagggccccgagaaggagggcgagggccacagctacttcagcagcaccaagaccctgtgcgtgatcgaccccgagaacagagacagcctgggcgagaccgacatcgacatcgccaccgaggacaagagccccgtggacacctag

SEQ ID NO: 93113 - DNA, 2211 bp, Artificial Sequence; identical to SEQ ID NO: 93112
  Description of Artificial Sequence: Synthetic coding sequence

SEQ ID NO: 93114 - DNA, 1695 bp, Artificial Sequence
  Description of Artificial Sequence: Synthetic coding sequence
atgaaggagcacggcggcaccttcagcagcaccggcatcagcggcggcagcggcgacagcgccatggacagcctgcagcccctgcagcccaactacatgcccgtgtgcctgttcgccgaggagagctaccagaagctggccatggagaccctggaggagctggactggtgcctggaccagctggagaccatccagacctacagaagcgtgagcgagatggccagcaacaagttcaagagaatgctgaacagagagctgacccacctgagcgagatgagcagaagcggcaaccaggtgagcgagtacatcagcaacaccttcctggacaagcagaacgacgtggagatccccagccccacccagaaggacagagagaagaagaagaagcagcagctgatgacccagatcagcggcgtgaagaagctgatgcacagcagcagcctgaacaacaccagcatcagcagattcggcgtgaacaccgagaacgaggaccacctggccaaggagctggaggacctgaacaagtggggcctgaacatcttcaacgtggccggctacagccacaacagacccctgacctgcatcatgtacgccatcttccaggagagagacctgctgaagaccttcagaatcagcagcgacaccttcatcacctacatgatgaccctggaggaccactaccacagcgacgtggcctaccacaacagcctgcacgccgccgacgtggcccagagcacccacgtgctgctgagcacccccgccctggacgccgtgttcaccgacctggagatcctggccgccatcttcgccgccgccatccacgacgtggaccaccccggcgtgagcaaccagttcctgatcaacaccaacagcgagctggccctgatgtacaacgacgagagcgtgctggagaaccaccacctggccgtgggcttcaagctgctgcaggaggagcactgcgacatcttcatgaacctgaccaagaagcagagacagaccctgagaaagatggtgatcgacatggtgctggccaccgacatgagcaagcacatgagcctgctggccgacctgaagaccatggtggagaccaagaaggtgaccagcagcggcgtgctgctgctggacaactacaccgacagaatccaggtgctgagaaacatggtgcactgcgccgacctgagcaaccccaccaagagcctggagctgtacagacagtggaccgacagaatcatggaggagttcttccagcagggcgacaaggagagagagagaggcatggagatcagccccatgtgcgacaagcacaccgccagcgtggagaagagccaggtgggcttcatcgactacatcgtgcaccccctgtgggagacctgggccgacctggtgcagcccgacgcccaggacatcctggacaccctggaggacaacagaaactggtaccagagcatgatcccccagagccccagcccccccctggacgagcagaacagagactgccagggcctgatggagaagttccagttcgagctgaccctggacgaggaggacagcgagggccccgagaaggagggcgagggccacagctacttcagcagcaccaagaccctgtgcgtgatcgaccccgagaacagagacagcctgggcgagaccgacatcgacatcgccaccgaggacaagagccccgtggacacctag

SEQ ID NO: 93115 - DNA, 2211 bp, Artificial Sequence; identical to SEQ ID NO: 93112
  Description of Artificial Sequence: Synthetic coding sequence

SEQ ID NO: 93116 - DNA, 2166 bp, Artificial Sequence
  Description of Artificial Sequence: Synthetic coding sequence
atgaccgccaaggacagcagcaaggagctgaccgccagcgagcccgaggtgtgcatcaagaccttcaaggagcagatgcacctggagctggagctgcccagactgcccggcaacagacccaccagccccaagatcagccccagaagcagccccagaaacagcccctgcttcttcagaaagctgctggtgaacaagagcatcagacagagaagaagattcaccgtggcccacacctgcttcgacgtggagaacggccccagccccggcagaagccccctggacccccaggccagcagcagcgccggcctggtgctgcacgccaccttccccggccacagccagagaagagagagcttcctgtacagaagcgacagcgactacgacctgagccccaaggccatgagcagaaacagcagcctgcccagcgagcagcacggcgacgacctgatcgtgacccccttcgcccaggtgctggccagcctgagaagcgtgagaaacaacttcaccatcctgaccaacctgcacggcaccagcaacaagagaagccccgccgccagccagccccccgtgagcagagtgaacccccaggaggagagctaccagaagctggccatggagaccctggaggagctggactggtgcctggaccagctggagaccatccagacctacagaagcgtgagcgagatggccagcaacaagttcaagagaatgctgaacagagagctgacccacctgagcgagatgagcagaagcggcaaccaggtgagcgagtacatcagcaacaccttcctggacaagcagaacgacgtggagatccccagccccacccagaaggacagagagaagaagaagaagcagcagctgatgacccagatcagcggcgtgaagaagctgatgcacagcagcagcctgaacaacaccagcatcagcagattcggcgtgaacaccgagaacgaggaccacctggccaaggagctggaggacctgaacaagtggggcctgaacatcttcaacgtggccggctacagccacaacagacccctgacctgcatcatgtacgccatcttccaggagagagacctgctgaagaccttcagaatcagcagcgacaccttcatcacctacatgatgaccctggaggaccactaccacagcgacgtggcctaccacaacagcctgcacgccgccgacgtggcccagagcacccacgtgctgctgagcacccccgccctggacgccgtgttcaccgacctggagatcctggccgccatcttcgccgccgccatccacgacgtggaccaccccggcgtgagcaaccagttcctgatcaacaccaacagcgagctggccctgatgtacaacgacgagagcgtgctggagaaccaccacctggccgtgggcttcaagctgctgcaggaggagcactgcgacatcttcatgaacctgaccaagaagcagagacagaccctgagaaagatggtgatcgacatggtgctggccaccgacatgagcaagcacatgagcctgctggccgacctgaagaccatggtggagaccaagaaggtgaccagcagcggcgtgctgctgctggacaactacaccgacagaatccaggtgctgagaaacatggtgcactgcgccgacctgagcaaccccaccaagagcctggagctgtacagacagtggaccgacagaatcatggaggagttcttccagcagggcgacaaggagagagagagaggcatggagatcagccccatgtgcgacaagcacaccgccagcgtggagaagagccaggtgggcttcatcgactacatcgtgcaccccctgtgggagacctgggccgacctggtgcagcccgacgcccaggacatcctggacaccctggaggacaacagaaactggtaccagagcatgatcccccagagccccagcccccccctggacgagcagaacagagactgccagggcctgatggagaagttccagttcgagctgaccctggacgaggaggacagcgagggccccgagaaggagggcgagggccacagctacttcagcagcaccaagaccctgtgcgtgatcgaccccgagaacagagacagcctgggcgagaccgacatcgacatcgccaccgaggacaagagccccgtggacacctag

SEQ ID NO: 93117 - DNA, 2043 bp, Artificial Sequence
  Description of Artificial Sequence: Synthetic coding sequence
atgcagggcccccccgcccccgcccccgtgcccggccccggcagccccagaggcagccccagaggcagccccggcctgttcagaaagctgctggtgaaccagagcatcagactgcagagaagattcaccgtggcccaccccctgtgcttcgacctggagaacggcctgagctgcggcagaagagccctggacccccagagcagccccggcctgggcagaatcatgcaggcccccgtgccccacagccagagaagagagagcttcctgtacagaagcgacagcgactacgagctgagccccaaggccatgagcagaaacagcagcgtggccagcgacctgcacggcgaggacatgatcgtgacccccttcgcccaggtgctggccagcctgagaaccgtgagaagcaacgtggccgccctggccagacagcagtgcctgggcgccgccaagcagggccccgtgggcaaccccagcagcagcaaccagctgccccccgccgaggacaccggccagaagctggccctggagaccctggacgagctggactggtgcctggaccagctggagaccctgcagaccagacacagcgtgggcgagatggccagcaacaagttcaagagaatcctgaacagagagctgacccacctgagcgagaccagcagaagcggcaaccaggtgagcgagtacatcagcagaaccttcctggaccagcagaccgaggtggagctgcccaaggtgaccgccgaggaggccccccagcccatgagcagaatcagcggcctgcacggcctgtgccacagcgccagcctgagcagcgccaccgtgcccagattcggcgtgcagaccgaccaggaggagcagctggccaaggagctggaggacaccaacaagtggggcctggacgtgttcaaggtggccgagctgagcggcaacagacccctgaccgccatcatcttcagcatcttccaggagagagacctgctgaagaccttccagatccccgccgacaccctggccacctacctgctgatgctggagggccactaccacgccaacgtggcctaccacaacagcctgcacgccgccgacgtggcccagagcacccacgtgctgctggccacccccgccctggaggccgtgttcaccgacctggagatcctggccgccctgttcgccagcgccatccacgacgtggaccaccccggcgtgagcaaccagttcctgatcaacaccaacagcgagctggccctgatgtacaacgacgccagcgtgctggagaaccaccacctggccgtgggcttcaagctgctgcaggccgagaactgcgacatcttccagaacctgagcgccaagcagagactgagcctgagaagaatggtgatcgacatggtgctggccaccgacatgagcaagcacatgaacctgctggccgacctgaagaccatggtggagaccaagaaggtgaccagcctgggcgtgctgctgctggacaactacagcgacagaatccaggtgctgcagaacctggtgcactgcgccgacctgagcaaccccaccaagcccctgcccctgtacagacagtggaccgacagaatcatggccgagttcttccagcagggcgacagagagagagagagcggcctggacatcagccccatgtgcgacaagcacaccgccagcgtggagaagagccaggtgggcttcatcgactacatcgcccaccccctgtgggagacctgggccgacctggtgcaccccgacgcccaggacctgctggacaccctggaggacaacagagagtggtaccagagcaagatccccagaagccccagcgacctgaccaaccccgagagagacggccccgacagattccagttcgagctgaccctggaggaggccgaggaggaggacgaggaggaggaggaggagggcgaggagaccgccctggccaaggaggccctggagctgcccgacaccgagctgctgagccccgaggccggccccgaccccggcgacctgcccctggacaaccagagaacctag

SEQ ID NO: 93118 - DNA, 1281 bp, Artificial Sequence
  Description of Artificial Sequence: Synthetic coding sequence
atggccagcaacaagttcaagagaatcctgaacagagagctgacccacctgagcgagaccagcagaagcggcaaccaggtgagcgagtacatcagcagaaccttcctggaccagcagaccgaggtggagctgcccaaggtgaccgccgaggaggccccccagcccatgagcagaatcagcggcctgcacggcctgtgccacagcgccagcctgagcagcgccaccgtgcccagattcggcgtgcagaccgaccaggaggagcagctggccaaggagctggaggacaccaacaagtggggcctggacgtgttcaaggtggccgagctgagcggcaacagacccctgaccgccatcatcttcagcatcttccaggccgtgttcaccgacctggagatcctggccgccctgttcgccagcgccatccacgacgtggaccaccccggcgtgagcaaccagttcctgatcaacaccaacagcgagctggccctgatgtacaacgacgccagcgtgctggagaaccaccacctggccgtgggcttcaagctgctgcaggccgagaactgcgacatcttccagaacctgagcgccaagcagagactgagcctgagaagaatggtgatcgacatggtgctggccaccgacatgagcaagcacatgaacctgctggccgacctgaagaccatggtggagaccaagaaggtgaccagcctgggcgtgctgctgctggacaactacagcgacagaatccaggtgctgcagaacctggtgcactgcgccgacctgagcaaccccaccaagcccctgcccctgtacagacagtggaccgacagaatcatggccgagttcttccagcagggcgacagagagagagagagcggcctggacatcagccccatgtgcgacaagcacaccgccagcgtggagaagagccaggtgggcttcatcgactacatcgcccaccccctgtgggagacctgggccgacctggtgcaccccgacgcccaggacctgctggacaccctggaggacaacagagagtggtaccagagcaagatccccagaagccccagcgacctgaccaaccccgagagagacggccccgacagattccagttcgagctgaccctggaggaggccgaggaggaggacgaggaggaggaggaggagggcgaggagaccgccctggccaaggaggccctggagctgcccgacaccgagctgctgagccccgaggccggccccgaccccggcgacctgcccctggacaaccagagaacctag

SEQ ID NO: 93119 - DNA, 2139 bp, Artificial Sequence
  Description of Artificial Sequence: Synthetic coding sequence
atggagaacctgggcgtgggcgagggcgccgaggcctgcagcagactgagcagaagcagaggcagacacagcatgaccagagcccccaagcacctgtggagacagcccagaagacccatcagaatccagcagagattctacagcgaccccgacaagagcgccggctgcagagagagagacctgagccccagacccgagctgagaaagagcagactgagctggcccgtgagcagctgcagaagattcgacctggagaacggcctgagctgcggcagaagagccctggacccccagagcagccccggcctgggcagaatcatgcaggcccccgtgccccacagccagagaagagagagcttcctgtacagaagcgacagcgactacgagctgagccccaaggccatgagcagaaacagcagcgtggccagcgacctgcacggcgaggacatgatcgtgacccccttcgcccaggtgctggccagcctgagaaccgtgagaagcaacgtggccgccctggccagacagcagtgcctgggcgccgccaagcagggccccgtgggcaaccccagcagcagcaaccagctgccccccgccgaggacaccggccagaagctggccctggagaccctggacgagctggactggtgcctggaccagctggagaccctgcagaccagacacagcgtgggcgagatggccagcaacaagttcaagagaatcctgaacagagagctgacccacctgagcgagaccagcagaagcggcaaccaggtgagcgagtacatcagcagaaccttcctggaccagcagaccgaggtggagctgcccaaggtgaccgccgaggaggccccccagcccatgagcagaatcagcggcctgcacggcctgtgccacagcgccagcctgagcagcgccaccgtgcccagattcggcgtgcagaccgaccaggaggagcagctggccaaggagctggaggacaccaacaagtggggcctggacgtgttcaaggtggccgagctgagcggcaacagacccctgaccgccatcatcttcagcatcttccaggagagagacctgctgaagaccttccagatccccgccgacaccctggccacctacctgctgatgctggagggccactaccacgccaacgtggcctaccacaacagcctgcacgccgccgacgtggcccagagcacccacgtgctgctggccacccccgccctggaggccgtgttcaccgacctggagatcctggccgccctgttcgccagcgccatccacgacgtggaccaccccggcgtgagcaaccagttcctgatcaacaccaacagcgagctggccctgatgtacaacgacgccagcgtgctggagaaccaccacctggccgtgggcttcaagctgctgcaggccgagaactgcgacatcttccagaacctgagcgccaagcagagactgagcctgagaagaatggtgatcgacatggtgctggccaccgacatgagcaagcacatgaacctgctggccgacctgaagaccatggtggagaccaagaaggtgaccagcctgggcgtgctgctgctggacaactacagcgacagaatccaggtgctgcagaacctggtgcactgcgccgacctgagcaaccccaccaagcccctgcccctgtacagacagtggaccgacagaatcatggccgagttcttccagcagggcgacagagagagagagagcggcctggacatcagccccatgtgcgacaagcacaccgccagcgtggagaagagccaggtgggcttcatcgactacatcgcccaccccctgtgggagacctgggccgacctggtgcaccccgacgcccaggacctgctggacaccctggaggacaacagagagtggtaccagagcaagatccccagaagccccagcgacctgaccaaccccgagagagacggccccgacagattccagttcgagctgaccctggaggaggccgaggaggaggacgaggaggaggaggaggagggcgaggagaccgccctggccaaggaggccctggagctgcccgacaccgagctgctgagccccgaggccggccccgaccccggcgacctgcccctggacaaccagagaacctag

SEQ ID NO: 93120 - DNA, 1821 bp, Artificial Sequence
  Description of Artificial Sequence: Synthetic coding sequence
atgcaggcccccgtgccccacagccagagaagagagagcttcctgtacagaagcgacagcgactacgagctgagccccaaggccatgagcagaaacagcagcgtggccagcgacctgcacggcgaggacatgatcgtgacccccttcgcccaggtgctggccagcctgagaaccgtgagaagcaacgtggccgccctggccagacagcagtgcctgggcgccgccaagcagggccccgtgggcaaccccagcagcagcaaccagctgccccccgccgaggacaccggccagaagctggccctggagaccctggacgagctggactggtgcctggaccagctggagaccctgcagaccagacacagcgtgggcgagatggccagcaacaagttcaagagaatcctgaacagagagctgacccacctgagcgagaccagcagaagcggcaaccaggtgagcgagtacatcagcagaaccttcctggaccagcagaccgaggtggagctgcccaaggtgaccgccgaggaggccccccagcccatgagcagaatcagcggcctgcacggcctgtgccacagcgccagcctgagcagcgccaccgtgcccagattcggcgtgcagaccgaccaggaggagcagctggccaaggagctggaggacaccaacaagtggggcctggacgtgttcaaggtggccgagctgagcggcaacagacccctgaccgccatcatcttcagcatcttccaggagagagacctgctgaagaccttccagatccccgccgacaccctggccacctacctgctgatgctggagggccactaccacgccaacgtggcctaccacaacagcctgcacgccgccgacgtggcccagagcacccacgtgctgctggccacccccgccctggaggccgtgttcaccgacctggagatcctggccgccctgttcgccagcgccatccacgacgtggaccaccccggcgtgagcaaccagttcctgatcaacaccaacagcgagctggccctgatgtacaacgacgccagcgtgctggagaaccaccacctggccgtgggcttcaagctgctgcaggccgagaactgcgacatcttccagaacctgagcgccaagcagagactgagcctgagaagaatggtgatcgacatggtgctggccaccgacatgagcaagcacatgaacctgctggccgacctgaagaccatggtggagaccaagaaggtgaccagcctgggcgtgctgctgctggacaactacagcgacagaatccaggtgctgcagaacctggtgcactgcgccgacctgagcaaccccaccaagcccctgcccctgtacagacagtggaccgacagaatcatggccgagttcttccagcagggcgacagagagagagagagcggcctggacatcagccccatgtgcgacaagcacaccgccagcgtggagaagagccaggtgggcttcatcgactacatcgcccaccccctgtgggagacctgggccgacctggtgcaccccgacgcccaggacctgctggacaccctggaggacaacagagagtggtaccagagcaagatccccagaagccccagcgacctgaccaaccccgagagagacggccccgacagattccagttcgagctgaccctggaggaggccgaggaggaggacgaggaggaggaggaggagggcgaggagaccgccctggccaaggaggccctggagctgcccgacaccgagctgctgagccccgaggccggccccgaccccggcgacctgcccctggacaaccagagaacctag

SEQ ID NO: 93121 - DNA, 2376 bp, Artificial Sequence
  Description of Artificial Sequence: Synthetic coding sequence
ggcacccaggccggcctgagaagcggcgcccccagcggccacagacagctgctgggcgtgggccccaccctgagccccagcagcaccttctacagattcagcaccagcggcgccgacagcagcagcctgagcccccccctgcccgccctgggcagaaccagagagcagaccctgctgggcgccagaagcagaggcagagtgctgctgcccgccatccccgaccccttcctgtggagaatggagaacctgggcgtgggcgagggcgccgaggcctgcagcagactgagcagaagcagaggcagacacagcatgaccagagcccccaagcacctgtggagacagcccagaagacccatcagaatccagcagagattctacagcgaccccgacaagagcgccggctgcagagagagagacctgagccccagacccgagctgagaaagagcagactgagctggcccgtgagcagctgcagaagattcgacctggagaacggcctgagctgcggcagaagagccctggacccccagagcagccccggcctgggcagaatcatgcaggcccccgtgccccacagccagagaagagagagcttcctgtacagaagcgacagcgactacgagctgagccccaaggccatgagcagaaacagcagcgtggccagcgacctgcacggcgaggacatgatcgtgacccccttcgcccaggtgctggccagcctgagaaccgtgagaagcaacgtggccgccctggccagacagcagtgcctgggcgccgccaagcagggccccgtgggcaaccccagcagcagcaaccagctgccccccgccgaggacaccggccagaagctggccctggagaccctggacgagctggactggtgcctggaccagctggagaccctgcagaccagacacagcgtgggcgagatggccagcaacaagttcaagagaatcctgaacagagagctgacccacctgagcgagaccagcagaagcggcaaccaggtgagcgagtacatcagcagaaccttcctggaccagcagaccgaggtggagctgcccaaggtgaccgccgaggaggccccccagcccatgagcagaatcagcggcctgcacggcctgtgccacagcgccagcctgagcagcgccaccgtgcccagattcggcgtgcagaccgaccaggaggagcagctggccaaggagctggaggacaccaacaagtggggcctggacgtgttcaaggtggccgagctgagcggcaacagacccctgaccgccatcatcttcagcatcttccaggagagagacctgctgaagaccttccagatccccgccgacaccctggccacctacctgctgatgctggagggccactaccacgccaacgtggcctaccacaacagcctgcacgccgccgacgtggcccagagcacccacgtgctgctggccacccccgccctggaggccgtgttcaccgacctggagatcctggccgccctgttcgccagcgccatccacgacgtggaccaccccggcgtgagcaaccagttcctgatcaacaccaacagcgagctggccctgatgtacaacgacgccagcgtgctggagaaccaccacctggccgtgggcttcaagctgctgcaggccgagaactgcgacatcttccagaacctgagcgccaagcagagactgagcctgagaagaatggtgatcgacatggtgctggccaccgacatgagcaagcacatgaacctgctggccgacctgaagaccatggtggagaccaagaaggtgaccagcctgggcgtgctgctgctggacaactacagcgacagaatccaggtgctgcagaacctggtgcactgcgccgacctgagcaaccccaccaagcccctgcccctgtacagacagtggaccgacagaatcatggccgagttcttccagcagggcgacagagagagagagagcggcctggacatcagccccatgtgcgacaagcacaccgccagcgtggagaagagccaggtgggcttcatcgactacatcgcccaccccctgtgggagacctgggccgacctggtgcaccccgacgcccaggacctgctggacaccctggaggacaacagagagtggtaccagagcaagatccccagaagccccagcgacctgaccaaccccgagagagacggccccgacagattccagttcgagctgaccctggaggaggccgaggaggaggacgaggaggaggaggaggagggcgaggagaccgccctggccaaggaggccctggagctgcccgacaccgagctgctgagccccgaggccggccccgaccccggcgacctgcccctggacaaccagagaacctag

SEQ ID NO: 93122 - DNA, 2103 bp, Artificial Sequence
  Description of Artificial Sequence: Synthetic coding sequence
gccgtgcagaagagaagcagagccgccggcgccagaagcagcctgcacgccgtgctggccatgcagggcccccccgcccccgcccccgtgcccggccccggcagccccagaggcagccccagaggcagccccggcctgttcagaaagctgctggtgaaccagagcatcagactgcagagaagattcaccgtggcccaccccctgtgcttcgacctggagaacggcctgagctgcggcagaagagccctggacccccagagcagccccggcctgggcagaatcatgcaggcccccgtgccccacagccagagaagagagagcttcctgtacagaagcgacagcgactacgagctgagccccaaggccatgagcagaaacagcagcgtggccagcgacctgcacggcgaggacatgatcgtgacccccttcgcccaggtgctggccagcctgagaaccgtgagaagcaacgtggccgccctggccagacagcagtgcctgggcgccgccaagcagggccccgtgggcaaccccagcagcagcaaccagctgccccccgccgaggacaccggccagaagctggccctggagaccctggacgagctggactggtgcctggaccagctggagaccctgcagaccagacacagcgtgggcgagatggccagcaacaagttcaagagaatcctgaacagagagctgacccacctgagcgagaccagcagaagcggcaaccaggtgagcgagtacatcagcagaaccttcctggaccagcagaccgaggtggagctgcccaaggtgaccgccgaggaggccccccagcccatgagcagaatcagcggcctgcacggcctgtgccacagcgccagcctgagcagcgccaccgtgcccagattcggcgtgcagaccgaccaggaggagcagctggccaaggagctggaggacaccaacaagtggggcctggacgtgttcaaggtggccgagctgagcggcaacagacccctgaccgccatcatcttcagcatcttccaggagagagacctgctgaagaccttccagatccccgccgacaccctggccacctacctgctgatgctggagggccactaccacgccaacgtggcctaccacaacagcctgcacgccgccgacgtggcccagagcacccacgtgctgctggccacccccgccctggaggccgtgttcaccgacctggagatcctggccgccctgttcgccagcgccatccacgacgtggaccaccccggcgtgagcaaccagttcctgatcaacaccaacagcgagctggccctgatgtacaacgacgccagcgtgctggagaaccaccacctggccgtgggcttcaagctgctgcaggccgagaactgcgacatcttccagaacctgagcgccaagcagagactgagcctgagaagaatggtgatcgacatggtgctggccaccgacatgagcaagcacatgaacctgctggccgacctgaagaccatggtggagaccaagaaggtgaccagcctgggcgtgctgctgctggacaactacagcgacagaatccaggtgctgcagaacctggtgcactgcgccgacctgagcaaccccaccaagcccctgcccctgtacagacagtggaccgacagaatcatggccgagttcttccagcagggcgacagagagagagagagcggcctggacatcagccccatgtgcgacaagcacaccgccagcgtggagaagagccaggtgggcttcatcgactacatcgcccaccccctgtgggagacctgggccgacctggtgcaccccgacgcccaggacctgctggacaccctggaggacaacagagagtggtaccagagcaagatccccagaagccccagcgacctgaccaaccccgagagagacggccccgacagattccagttcgagctgaccctggaggaggccgaggaggaggacgaggaggaggaggaggagggcgaggagaccgccctggccaaggaggccctggagctgcccgacaccgagctgctgagccccgaggccggccccgaccccggcgacctgcccctggacaaccagagaacctag

SEQ ID NO: 93123 - DNA, 1446 bp, Artificial Sequence
  Description of Artificial Sequence: Synthetic coding sequence
atggccagcaacaagttcaagagaatcctgaacagagagctgacccacctgagcgagaccagcagaagcggcaaccaggtgagcgagtacatcagcagaaccttcctggaccagcagaccgaggtggagctgcccaaggtgaccgccgaggaggccccccagcccatgagcagaatcagcggcctgcacggcctgtgccacagcgccagcctgagcagcgccaccgtgcccagattcggcgtgcagaccgaccaggaggagcagctggccaaggagctggaggacaccaacaagtggggcctggacgtgttcaaggtggccgagctgagcggcaacagacccctgaccgccatcatcttcagcatcttccaggagagagacctgctgaagaccttccagatccccgccgacaccctggccacctacctgctgatgctggagggccactaccacgccaacgtggcctaccacaacagcctgcacgccgccgacgtggcccagagcacccacgtgctgctggccacccccgccctggaggccgtgttcaccgacctggagatcctggccgccctgttcgccagcgccatccacgacgtggaccaccccggcgtgagcaaccagttcctgatcaacaccaacagcgagctggccctgatgtacaacgacgccagcgtgctggagaaccaccacctggccgtgggcttcaagctgctgcaggccgagaactgcgacatcttccagaacctgagcgccaagcagagactgagcctgagaagaatggtgatcgacatggtgctggccaccgacatgagcaagcacatgaacctgctggccgacctgaagaccatggtggagaccaagaaggtgaccagcctgggcgtgctgctgctggacaactacagcgacagaatccaggtgctgcagaacctggtgcactgcgccgacctgagcaaccccaccaagcccctgcccctgtacagacagtggaccgacagaatcatggccgagttcttccagcagggcgacagagagagagagagcggcctggacatcagccccatgtgcgacaagcacaccgccagcgtggagaagagccaggtgggcttcatcgactacatcgcccaccccctgtgggagacctgggccgacctggtgcaccccgacgcccaggacctgctggacaccctggaggacaacagagagtggtaccagagcaagatccccagaagccccagcgacctgaccaaccccgagagagacggccccgacagattccagttcgagctgaccctggaggaggccgaggaggaggacgaggaggaggaggaggagggcgaggagaccgccctggccaaggaggccctggagctgcccgacaccgagctgctgagccccgaggccggccccgaccccggcgacctgcccctggacaaccagagaacctag

SEQ ID NO: 93124 - DNA, 2466 bp, Artificial Sequence
  Description of Artificial Sequence: Synthetic coding sequence
atgcagagatacagaggcagacagaccgtgttcggcgccggcgtgctgggcggcgtgagcagcgcccccagcttcaacacccccagccccagaagcagccccctgttctaccccagcgcccccagcggccacagacagctgctgggcgtgggccccaccctgagccccagcagcaccttctacagattcagcaccagcggcgccgacagcagcagcctgagcccccccctgcccgccctgggcagaaccagagagcagaccctgctgggcgccagaagcagaggcagagtgctgctgcccgccatccccgaccccttcctgtggagaatggagaacctgggcgtgggcgagggcgccgaggcctgcagcagactgagcagaagcagaggcagacacagcatgaccagagcccccaagcacctgtggagacagcccagaagacccatcagaatccagcagagattctacagcgaccccgacaagagcgccggctgcagagagagagacctgagccccagacccgagctgagaaagagcagactgagctggcccgtgagcagctgcagaagattcgacctggagaacggcctgagctgcggcagaagagccctggacccccagagcagccccggcctgggcagaatcatgcaggcccccgtgccccacagccagagaagagagagcttcctgtacagaagcgacagcgactacgagctgagccccaaggccatgagcagaaacagcagcgtggccagcgacctgcacggcgaggacatgatcgtgacccccttcgcccaggtgctggccagcctgagaaccgtgagaagcaacgtggccgccctggccagacagcagtgcctgggcgccgccaagcagggccccgtgggcaaccccagcagcagcaaccagctgccccccgccgaggacaccggccagaagctggccctggagaccctggacgagctggactggtgcctggaccagctggagaccctgcagaccagacacagcgtgggcgagatggccagcaacaagttcaagagaatcctgaacagagagctgacccacctgagcgagaccagcagaagcggcaaccaggtgagcgagtacatcagcagaaccttcctggaccagcagaccgaggtggagctgcccaaggtgaccgccgaggaggccccccagcccatgagcagaatcagcggcctgcacggcctgtgccacagcgccagcctgagcagcgccaccgtgcccagattcggcgtgcagaccgaccaggaggagcagctggccaaggagctggaggacaccaacaagtggggcctggacgtgttcaaggtggccgagctgagcggcaacagacccctgaccgccatcatcttcagcatcttccaggagagagacctgctgaagaccttccagatccccgccgacaccctggccacctacctgctgatgctggagggccactaccacgccaacgtggcctaccacaacagcctgcacgccgccgacgtggcccagagcacccacgtgctgctggccacccccgccctggaggccgtgttcaccgacctggagatcctggccgccctgttcgccagcgccatccacgacgtggaccaccccggcgtgagcaaccagttcctgatcaacaccaacagcgagctggccctgatgtacaacgacgccagcgtgctggagaaccaccacctggccgtgggcttcaagctgctgcaggccgagaactgcgacatcttccagaacctgagcgccaagcagagactgagcctgagaagaatggtgatcgacatggtgctggccaccgacatgagcaagcacatgaacctgctggccgacctgaagaccatggtggagaccaagaaggtgaccagcctgggcgtgctgctgctggacaactacagcgacagaatccaggtgctgcagaacctggtgcactgcgccgacctgagcaaccccaccaagcccctgcccctgtacagacagtggaccgacagaatcatggccgagttcttccagcagggcgacagagagagagagagcggcctggacatcagccccatgtgcgacaagcacaccgccagcgtggagaagagccaggtgggcttcatcgactacatcgcccaccccctgtgggagacctgggccgacctggtgcaccccgacgcccaggacctgctggacaccctggaggacaacagagagtggtaccagagcaagatccccagaagccccagcgacctgaccaaccccgagagagacggccccgacagattccagttcgagctgaccctggaggaggccgaggaggaggacgaggaggaggaggaggagggcgaggagaccgccctggccaaggaggccctggagctgcccgacaccgagctgctgagccccgaggccggccccgaccccggcgacctgcccctggacaaccagagaacctag

SEQ ID NO: 93125 - DNA, 1557 bp, Artificial Sequence
  Description of Artificial Sequence: Synthetic coding sequence
cccctgagaatcagacccctgctgcccaccgcctaccacctgctgcccaccggccccggccagagcgccgacagaagcgagcagagaggcggcccctgcccccccgccatgcccagaagcagccagttcaagagaatcctgaacagagagctgacccacctgagcgagaccagcagaagcggcaaccaggtgagcgagtacatcagcagaaccttcctggaccagcagaccgaggtggagctgcccaaggtgaccgccgaggaggccccccagcccatgagcagaatcagcggcctgcacggcctgtgccacagcgccagcctgagcagcgccaccgtgcccagattcggcgtgcagaccgaccaggaggagcagctggccaaggagctggaggacaccaacaagtggggcctggacgtgttcaaggtggccgagctgagcggcaacagacccctgaccgccatcatcttcagcatcttccaggagagagacctgctgaagaccttccagatccccgccgacaccctggccacctacctgctgatgctggagggccactaccacgccaacgtggcctaccacaacagcctgcacgccgccgacgtggcccagagcacccacgtgctgctggccacccccgccctggaggccgtgttcaccgacctggagatcctggccgccctgttcgccagcgccatccacgacgtggaccaccccggcgtgagcaaccagttcctgatcaacaccaacagcgagctggccctgatgtacaacgacgccagcgtgctggagaaccaccacctggccgtgggcttcaagctgctgcaggccgagaactgcgacatcttccagaacctgagcgccaagcagagactgagcctgagaagaatggtgatcgacatggtgctggccaccgacatgagcaagcacatgaacctgctggccgacctgaagaccatggtggagaccaagaaggtgaccagcctgggcgtgctgctgctggacaactacagcgacagaatccaggtgctgcagaacctggtgcactgcgccgacctgagcaaccccaccaagcccctgcccctgtacagacagtggaccgacagaatcatggccgagttcttccagcagggcgacagagagagagagagcggcctggacatcagccccatgtgcgacaagcacaccgccagcgtggagaagagccaggtgggcttcatcgactacatcgcccaccccctgtgggagacctgggccgacctggtgcaccccgacgcccaggacctgctggacaccctggaggacaacagagagtggtaccagagcaagatccccagaagccccagcgacctgaccaaccccgagagagacggccccgacagattccagttcgagctgaccctggaggaggccgaggaggaggacgaggaggaggaggaggagggcgaggagaccgccctggccaaggaggccctggagctgcccgacaccgagctgctgagccccgaggccggccccgaccccggcgacctgcccctggacaaccagagaacctag

SEQ ID NO: 93126 - DNA, 6723 bp, Artificial Sequence
  Description of Artificial Sequence: Synthetic coding sequence
atggagcagacctggaccagagactacttcgccgaggacgacggcgagatggtgcccagaaccagccacaccgccgccttcctgagcgacaccaaggacagaggcccccccgtgcagagccagatctggagaagcggcgagaaggtgcccttcgtgcagacctacagcctgagagccttcgagaagcccccccaggtgcagacccaggccctgagagacttcgagaagcacctgaacgacctgaagaaggagaacttcagcctgaagctgagaatctacttcctggaggagagaatgcagcagaagtacgaggccagcagagaggacatctacaagagaaacatcgagctgaaggtggaggtggagagcctgaagagagagctgcaggacaagaagcagcacctggacaagacctgggccgacgtggagaacctgaacagccagaacgaggccgagctgagaagacagttcgaggagagacagcaggagaccgagcacgtgtacgagctgctggagaacaagatccagctgctgcaggaggagagcagactggccaagaacgaggccgccagaatggccgccctggtggaggccgagaaggagtgcaacctggagctgagcgagaagctgaagggcgtgaccaagaactgggaggacgtgcccggcgaccaggtgaagcccgaccagtacaccgaggccctggcccagagagacaagagaatcgaggagctgaaccagagcctggccgcccaggagagactggtggagcagctgagcagagagaagcagcagctgctgcacctgctggaggagcccaccagcatggaggtgcagcccatgaccgaggagctgctgaagcagcagaagctgaacagccacgagaccaccatcacccagcagagcgtgagcgacagccacctggccgagctgcaggagaagatccagcagaccgaggccaccaacaagatcctgcaggagaagctgaacgagatgagctacgagctgaagtgcgcccaggagagcagccagaagcaggacggcaccatccagaacctgaaggagaccctgaagagcagagagagagagaccgaggagctgtaccaggtgatcgagggccagaacgacaccatggccaagctgagagagatgctgcaccagagccagctgggccagctgcacagcagcgagggcaccagccccgcccagcagcaggtggccctgctggacctgcagagcgccctgttctgcagccagctggagatccagaagctgcagagagtggtgagacagaaggagagacagctggccgacgccaagcagtgcgtgcagttcgtggaggccgccgcccacgagagcgagcagcagaaggaggccagctggaagcacaaccaggagctgagaaaggccctgcagcagctgcaggaggagctgcagaacaagagccagcagctgagagcctgggaggccgagaagtacaacgagatcagaacccaggagcagaacatccagcacctgaaccacagcctgagccacaaggagcagctgctgcaggagttcagagagctgctgcagtacagagacaacagcgacaagaccctggaggccaacgagatgctgctggagaagctgagacagagaatccacgacaaggccgtggccctggagagagccatcgacgagaagttcagcgccctggaggagaaggagaaggagctgagacagctgagactggccgtgagagagagagaccacgacctggagagactgagagacgtgctgagcagcaacgaggccaccatgcagagcatggagagcctgctgagagccaagggcctggaggtggagcagctgagcaccacctgccagaacctgcagtggctgaaggaggagatggagaccaagttcagcagatggcagaaggagcaggagagcatcatccagcagctgcagaccagcctgcacgacagaaacaaggaggtggaggacctgagcgccaccctgctgtgcaagctgggccccggccagagcgagatcgccgaggagctgtgccagagactgcagagaaaggagagaatgctgcaggacctgctgagcgacagaaacaagcaggtgctggagcacgagatggagatccagggcctgctgcagagcgtgagcaccagagagcaggagagccaggccgccgccgagaagctggtgcaggccctgatggagagaaacagcgagctgcaggccctgagacagtacctgggcggcagagacagcctgatgagccaggcccccatcagcaaccagcaggccgaggtgacccccaccggctgcctgggcaagcagaccgaccagggcagcatgcagatccccagcagagacgacagcaccagcctgaccgccaaggaggacgtgagcatccccagaagcaccctgggcgacctggacaccgtggccggcctggagaaggagctgagcaacgccaaggaggagctggagctgatggccaagaaggagagagagagccagatggagctgagcgccctgcagagcatgatggccgtgcaggaggaggagctgcaggtgcaggccgccgacatggagagcctgaccagaaacatccagatcaaggaggacctgatcaaggacctgcagatgcagctggtggaccccgaggacatccccgccatggagagactgacccaggaggtgctgctgctgagagagaaggtggccagcgtggagagccagggccaggagatcagcggcaacagaagacagcagctgctgctgatgctggagggcctggtggacgagagaagcagactgaacgaggccctgcaggccgagagacagctgtacagcagcctggtgaagttccacgcccaccccgagagcagcgagagagacagaaccctgcaggtggagctggagggcgcccaggtgctgagaagcagactggaggaggtgctgggcagaagcctggagagactgaacagactggagaccctggccgccatcggcggcgccgccgccggcgacgacaccgaggacaccagcaccgagttcaccgacagcatcgaggaggaggccgcccaccacagccaccagcagctggtgaaggtggccctggagaagagcctggccaccgtggagacccagaaccccagcttcagcccccccagccccatgggcggcgacagcaacagatgcctgcaggaggagatgctgcacctgagagccgagttccaccagcacctggaggagaagagaaaggccgaggaggagctgaaggagctgaaggcccagatcgaggaggccggcttcagcagcgtgagccacatcagaaacaccatgctgagcctgtgcctggagaacgccgagctgaaggagcagatgggcgaggccatgagcgacggctgggagatcgaggaggacaaggagaagggcgagctggacaaccagagccagcccagagaccccggcccccagagcgccttcagcctgcccggcagcacccagcacctgagaagccagctgagccagtgcaagcagagataccaggacctgcaggagaagctgctgctgagcgaggccaccgtgttcgcccaggccaacgagctggagaagtacagagtgatgctgaccggcgagagcctggtgaagcaggacagcaagcagatccaggtggacctgcaggacctgggctacgagacctgcggcagaagcgagaacgaggccgagagagaggagaccaccagccccgagtgcgaggagcacaacagcctgaaggagatggtgctgatggagggcctgtgcagcgagcagggcagaagaggcagcaccctggccagcagcagcgagagaaagcccctggagaaccagctgggcaagcaggaggagttcagagtgtacggcaagagcgagaacatcctggtgctgagaaaggacatcaaggacctgaaggcccagctgcagaacgccaacaaggtgatccagaacctgaagagcagagtgagaagcctgagcgtgaccagcgactacagcagcagcctggagagaccctggaagctgagagccgtgggcaccctggagggcagcagcccccacagcgtgcccgacgaggacgagggctggctgagcgacggcaccggcgccttctacagccccggcctgcaggccaagaaggacctggagagcctgatccagagagtgagccagctggaggcccagctgcccaagaacggcctggaggagaagctggccgaggagctgagaagcgccagctggcccggcaagtacgacagcctgatccaggaccaggccagagagctgagctacctgagacagaagatcagagagggcagaggcatctgctacctgatcaccagacacgccaaggacaccgtgaagagcttcgaggacctgctgagaagcaacgacatcgactactacctgggccagagcttcagagagcagctggcccagggcagccagctgaccgagagactgaccagcaagctgagcaccaaggaccacaagagcgagaaggaccaggccggcctggagcccctggccctgagactgagcagagagctgcaggagaaggagaaggtgatcgaggtgctgcaggccaagctggacgccagaagcctgacccccagcagcagccacgccctgagcgacagccacagaagccccagcagcaccagcttcctgagcgacgagctggaggcctgcagcgacatggacatcgtgagcgagtacacccactacgaggagaagaaggccagccccagccacagcgacagcatccaccacagcagccacagcgccgtgctgagcagcaagcccagcagcaccagcgccagccagggcgccaaggccgagagcaacagcaaccccatcagcctgcccaccccccagaacacccccaaggaggccaaccaggcccacagcggcgccagcaccgtgccccccgccagcaccgccaccctgctgagcaacgacctggaggccgacagcagctactacctgaacagcgcccagccccacagcccccccagaggcaccatcgagctgggcagaatcctggagcccggctacctgggcagcagcggcaagtgggacgtgatgagaccccagaagggcagcgtgagcggcgacctgagcagcggcagcagcgtgtaccagctgaacagcaagcccaccggcgccgacctgctggaggagcacctgggcgagatcagaaacctgagacagagactggaggagagcatctgcatcaacgacagactgagagagcagctggagcacagactgaccagcaccgccagaggcagaggcagcaccagcaacttctacagccagggcctggagagcatcccccagctgtgcaacgagaacagagtgctgagagaggacaacagaagactgcaggcccagctgagccacgtgagcagagagcacagccaggagaccgagagcctgagagaggccctgctgagcagcagaagccacctgcaggagctggagaaggagctggagcaccagaaggtggagagacagcagctgctggaggacctgagagagaagcagcaggaggtgctgcacttcagagaggagagactgagcctgcaggagaacgacagcagactgcagcacaagctggtgctgctgcagcagcagtgcgaggagaagcagcagctgttcgagagcctgcagagcgagctgcagatctacgaggccctgtacggcaacagcaagaagggcctgaaggcctacagcctggacgcctgccaccagatccccctgagcagcgacctgagccacctggtggccgaggtgagagccctgagaggccagctggagcagagcatccagggcaacaactgcctgagactgcagctgcagcagcagctggagagcggcgccggcaaggccagcctgagccccagcagcatcaaccagaacttccccgccagcaccgaccccggcaacaagcagctgctgctgcaggacagcgccgtgagcccccccgtgagagacgtgggcatgaacagccccgccctggtgttccccagcagcgccagcagcacccccggcagcgagacccccatcatcaacagagccaacggcctgggcctggacaccagccccgtgatgaagaccccccccaagctggagggcgacgccaccgacggcagcttcgccaacaagcacggcagacacgtgatcggccacatcgacgactacagcgccctgagacagcagatcgccgagggcaagctgctggtgaagaagatcgtgagcctggtgagaagcgcctgcagcttccccggcctggaggcccagggcaccgaggtgctgggcagcaagggcatccacgagctgagaagcagcaccagcgccctgcaccacgccctggaggagagcgccagcctgctgaccatgttctggagagccgccctgcccagcacccacatccccgtgctgcccggcaaggtgggcgagagcaccgagagagagctgctggagctgagaaccaaggtgagcaagcaggagagactgctgcagagcaccaccgagcacctgaagaacgccaaccagcagaaggagagcatggagcagttcatcgtgagccagctgaccagaacccacgacgtgctgaagaaggccagaaccaacctggaggtgaagagcctgagagccctgccctgcacccccgccctgtag

SEQ ID NO: 93127 - DNA, 3399 bp, Artificial Sequence
  Description of Artificial Sequence: Synthetic coding sequence
atgaaggagatctgcagaatctgcgccagagagctgtgcggcaaccagagaagatggatcttccacaccgccagcaagctgaacctgcaggtgctgctgagccacgtgctgggcaaggacgtgcccagagacggcaaggccgagttcgcctgcagcaagtgcgccttcatgctggacagaatctacagattcgacaccgtgatcgccagaatcgaggccctgagcatcgagagactgcagaagctgctgctggagaaggacagactgaagttctgcatcgccagcatgtacagaaagaacaacgacgacagcggcgccgagatcaaggccggcaacggcaccgtggacatgagcgtgctgcccgacgccagatacagcgccctgctgcaggaggacttcgcctacagcggcttcgagtgctgggtggagaacgaggaccagatccaggagccccacagctgccacggcagcgagggccccggcaacagacccagaagatgcagaggctgcgccgccctgagagtggccgacagcgactacgaggccatctgcaaggtgcccagaaaggtggccagaagcatcagctgcggccccagcagcagatggagcaccagcatctgcaccgaggagcccgccctgagcgaggtgggcccccccgacctggccagcaccaaggtgccccccgacggcgagagcatggaggaggagacccccggcagcagcgtggagagcctggacgccagcgtgcaggccagccccccccagcagaaggacgaggagaccgagagaagcgccaaggagctgggcaagtgcgactgctgcagcgacgaccaggccccccagcacggctgcaaccacaagctggagctggccctgagcatgatcaagggcctggactacaagcccatccagagccccagaggcagcagactgcccatccccgtgaagagcagcctgcccggcgccaagcccggccccagcatgaccgacggcgtgagcagcggcttcctgaacagaagcctgaagcccctgtacaagacccccgtgagctaccccctggagctgagcgacctgcaggagctgtgggacgacctgtgcgaggactacctgcccctgagagtgcagcccatgaccgaggagctgctgaagcagcagaagctgaacagccacgagaccaccatcacccagcagagcgtgagcgacagccacctggccgagctgcaggagaagatccagcagaccgaggccaccaacaagatcctgcaggagaagctgaacgagatgagctacgagctgaagtgcgcccaggagagcagccagaagcaggacggcaccatccagaacctgaaggagaccctgaagagcagagagagagagaccgaggagctgtaccaggtgatcgagggccagaacgacaccatggccaagctgagagagatgctgcaccagagccagctgggccagctgcacagcagcgagggcaccagccccgcccagcagcaggtggccctgctggacctgcagagcgccctgttctgcagccagctggagatccagaagctgcagagagtggtgagacagaaggagagacagctggccgacgccaagcagtgcgtgcagttcgtggaggccgccgcccacgagagcgagcagcagaaggaggccagctggaagcacaaccaggagctgagaaaggccctgcagcagctgcaggaggagctgcagaacaagagccagcagctgagagcctgggaggccgagaagtacaacgagatcagaacccaggagcagaacatccagcacctgaaccacagcctgagccacaaggagcagctgctgcaggagttcagagagctgctgcagtacagagacaacagcgacaagaccctggaggccaacgagatgctgctggagaagctgagacagagaatccacgacaaggccgtggccctggagagagccatcgacgagaagttcagcgccctggaggagaaggagaaggagctgagacagctgagactggccgtgagagagagagaccacgacctggagagactgagagacgtgctgagcagcaacgaggccaccatgcagagcatggagagcctgctgagagccaagggcctggaggtggagcagctgagcaccacctgccagaacctgcagtggctgaaggaggagatggagaccaagttcagcagatggcagaaggagcaggagagcatcatccagcagctgcagaccagcctgcacgacagaaacaaggaggtggaggacctgagcgccaccctgctgtgcaagctgggccccggccagagcgagatcgccgaggagctgtgccagagactgcagagaaaggagagaatgctgcaggacctgctgagcgacagaaacaagcaggtgctggagcacgagatggagatccagggcctgctgcagagcgtgagcaccagagagcaggagagccaggccgccgccgagaagctggtgcaggccctgatggagagaaacagcgagctgcaggccctgagacagtacctgggcggcagagacagcctgatgagccaggcccccatcagcaaccagcaggccgaggtgacccccaccggctgcctgggcaagcagaccgaccagggcagcatgcagatccccagcagagacgacagcaccagcctgaccgccaaggaggacgtgagcatccccagaagcaccctgggcgacctggacaccgtggccggcctggagaaggagctgagcaacgccaaggaggagctggagctgatggccaagaaggagagagagagccagatggagctgagcgccctgcagagcatgatggccgtgcaggaggaggagctgcaggtgcaggccgccgacatggagagcctgaccagaaacatccagatcaaggaggacctgatcaaggacctgcagatgcagctggtggaccccgaggacatccccgccatggagagactgacccaggaggtgctgctgctgagagagaaggtggccagcgtggagagccagggccaggagatcagcggcaacagaagacagcagctgctgctgatgctggagggcctggtggacgagagaagcagactgaacgaggccctgcaggccgagagacagctgtacagcagcctggtgaagttccacgcccaccccgagagcagcgagagagacagaaccctgcaggtggagctggagggcgcccaggtgctgagaagcagactggaggaggtgctgggcagaagcctggagagactgaacagactggagaccctggccgccatcggcggcgccgccgccggcgacgacaccgaggacaccagcaccgagttcaccgacagcatcgaggaggaggccgcccaccacagccaccagcagctgtag

SEQ ID NO: 93128 - DNA, 522 bp, Artificial Sequence
  Description of Artificial Sequence: Synthetic coding sequence
atgagcaacggctacagaaccctgagccagcacctgaacgacctgaagaaggagaacttcagcctgaagctgagaatctacttcctggaggagagaatgcagcagaagtacgaggccagcagagaggacatctacaagagaaacatcgagctgaaggtggaggtggagagcctgaagagagagctgcaggacaagaagcagcacctggacaagacctgggccgacgtggagaacctgaacagccagaacgaggccgagctgagaagacagttcgaggagagacagcaggagaccgagcacgtgtacgagctgctggagaacaagatccagctgctgcaggaggagagcagactggccaagaacgaggccgccagaatggccgccctggtggaggccgagaaggagtgcaacctggagctgagcgagaagctgaagggcgtgaccaagaactgggaggacgtgcccggcgaccaggtgaagcccgaccagtacaccgaggccctggcccagagagacaagtag

SEQ ID NO: 93129 - DNA, 933 bp, Artificial Sequence
  Description of Artificial Sequence: Synthetic coding sequence
atgaagggcaccgacagcggcagctgctgcagaagaagatgcgacttcggctgctgctgcagagccagcagaagagcccactacaccccctacagaagcggcgacgccaccagaaccccccagagccccagacagacccccagcagagagagaagaagacccgagcccgccggcagctgggccgccgccgccgaggaggaggaggccgccgccgccgccaccccctggatgagagactacttcgccgaggacgacggcgagatggtgcccagaaccagccacaccgccgccttcctgagcgacaccaaggacagaggcccccccgtgcagagccagatctggagaagcggcgagaaggtgcccttcgtgcagacctacagcctgagagccttcgagaagcccccccaggtgcagacccaggccctgagagacttcgagaagcacctgaacgacctgaagaaggagaacttcagcctgaagctgagaatctacttcctggaggagagaatgcagcagaagtacgaggccagcagagaggacatctacaagagaaacatcgagctgaaggtggaggtggagagcctgaagagagagctgcaggacaagaagcagcacctggacaagacctgggccgacgtggagaacctgaacagccagaacgaggccgagctgagaagacagttcgaggagagacagcaggagaccgagcacgtgtacgagctgctggagaacaagatccagctgctgcaggaggagagcagactggccaagaacgaggccgccagaatggccgccctggtggaggccgagaaggagtgcaacctggagctgagcgagaagctgaagggcgtgaccaagaactgggaggacgtgcccggcgaccaggtgaagcccgaccagtacaccgaggccctggcccagagagacaagtag

SEQ ID NO: 93130 - DNA, 2910 bp, Artificial Sequence
  Description of Artificial Sequence: Synthetic coding sequence
atgagcaacggctacagaaccctgagccagcacctgaacgacctgaagaaggagaacttcagcctgaagctgagaatctacttcctggaggagagaatgcagcagaagtacgaggccagcagagaggacatctacaagagaaacatcgagctgaaggtggaggtggagagcctgaagagagagctgcaggacaagaagcagcacctggacaagacctgggccgacgtggagaacctgaacagccagaacgaggccgagctgagaagacagttcgaggagagacagcaggagaccgagcacgtgtacgagctgctggagaacaagatccagctgctgcaggaggagagcagactggccaagaacgaggccgccagaatggccgccctggtggaggccgagaaggagtgcaacctggagctgagcgagaagctgaagggcgtgaccaagaactgggaggacgtgcccggcgaccaggtgaagcccgaccagtacaccgaggccctggcccagagagacaagagaatcgaggagctgaaccagagcctggccgcccaggagagactggtggagcagctgagcagagagaagcagcagctgctgcacctgctggaggagcccaccagcatggaggtgcagcccatgaccgaggagctgctgaagcagcagaagctgaacagccacgagaccaccatcacccagcagagcgtgagcgacagccacctggccgagctgcaggagaagatccagcagaccgaggccaccaacaagatcctgcaggagaagctgaacgagatgagctacgagctgaagtgcgcccaggagagcagccagaagcaggacggcaccatccagaacctgaaggagaccctgaagagcagagagagagagaccgaggagctgtaccaggtgatcgagggccagaacgacaccatggccaagctgagagagatgctgcaccagagccagctgggccagctgcacagcagcgagggcaccagccccgcccagcagcaggtggccctgctggacctgcagagcgccctgttctgcagccagctggagatccagaagctgcagagagtggtgagacagaaggagagacagctggccgacgccaagcagtgcgtgcagttcgtggaggccgccgcccacgagagcgagcagcagaaggaggccagctggaagcacaaccaggagctgagaaaggccctgcagcagctgcaggaggagctgcagaacaagagccagcagctgagagcctgggaggccgagaagtacaacgagatcagaacccaggagcagaacatccagcacctgaaccacagcctgagccacaaggagcagctgctgcaggagttcagagagctgctgcagtacagagacaacagcgacaagaccctggaggccaacgagatgctgctggagaagctgagacagagaatccacgacaaggccgtggccctggagagagccatcgacgagaagttcagcgccctggaggagaaggagaaggagctgagacagctgagactggccgtgagagagagagaccacgacctggagagactgagagacgtgctgagcagcaacgaggccaccatgcagagcatggagagcctgctgagagccaagggcctggaggtggagcagctgagcaccacctgccagaacctgcagtggctgaaggaggagatggagaccaagttcagcagatggcagaaggagcaggagagcatcatccagcagctgcagaccagcctgcacgacagaaacaaggaggtggaggacctgagcgccaccctgctgtgcaagctgggccccggccagagcgagatcgccgaggagctgtgccagagactgcagagaaaggagagaatgctgcaggacctgctgagcgacagaaacaagcaggtgctggagcacgagatggagatccagggcctgctgcagagcgtgagcaccagagagcaggagagccaggccgccgccgagaagctggtgcaggccctgatggagagaaacagcgagctgcaggccctgagacagtacctgggcggcagagacagcctgatgagccaggcccccatcagcaaccagcaggccgaggtgacccccaccggctgcctgggcaagcagaccgaccagggcagcatgcagatccccagcagagacgacagcaccagcctgaccgccaaggaggacgtgagcatccccagaagcaccctgggcgacctggacaccgtggccggcctggagaaggagctgagcaacgccaaggaggagctggagctgatggccaagaaggagagagagagccagatggagctgagcgccctgcagagcatgatggccgtgcaggaggaggagctgcaggtgcaggccgccgacatggagagcctgaccagaaacatccagatcaaggaggacctgatcaaggacctgcagatgcagctggtggaccccgaggacatccccgccatggagagactgacccaggaggtgctgctgctgagagagaaggtggccagcgtggagagccagggccaggagatcagcggcaacagaagacagcagctgctgctgatgctggagggcctggtggacgagagaagcagactgaacgaggccctgcaggccgagagacagctgtacagcagcctggtgaagttccacgcccaccccgagagcagcgagagagacagaaccctgcaggtggagctggagggcgcccaggtgctgagaagcagactggaggaggtgctgggcagaagcctggagagactgaacagactggagaccctggccgccatcggcggcgccgccgccggcgacgacaccgaggacaccagcaccgagttcaccgacagcatcgaggaggaggccgcccaccacagccaccagcagctgtag

SEQ ID NO: 93131 - DNA, 2967 bp, Artificial Sequence
  Description of Artificial Sequence: Synthetic coding sequence
atgagcaacggctacagaaccctgagccagcacctgaacgacctgaagaaggagaacttcagcctgaagctgagaatctacttcctggaggagagaatgcagcagaagtacgaggccagcagagaggacatctacaagagaaacatcgagctgaaggtggaggtggagagcctgaagagagagctgcaggacaagaagcagcacctggacaagacctgggccgacgtggagaacctgaacagccagaacgaggccgagctgagaagacagttcgaggagagacagcaggagaccgagcacgtgtacgagctgctggagaacaagatccagctgctgcaggaggagagcagactggccaagaacgaggccgccagaatggccgccctggtggaggccgagaaggagtgcaacctggagctgagcgagaagctgaagggcgtgaccaagaactgggaggacgtgcccggcgaccaggtgaagcccgaccagtacaccgaggccctggcccagagagacaagagaatcgaggagctgaaccagagcctggccgcccaggagagactggtggagcagctgagcagagagaagcagcagctgctgcacctgctggaggagcccaccagcatggaggtgcagcccatgaccgaggagctgctgaagcagcagaagctgaacagccacgagaccaccatcacccagcagagcgtgagcgacagccacctggccgagctgcaggagaagatccagcagaccgaggccaccaacaagatcctgcaggagaagctgaacgagatgagctacgagctgaagtgcgcccaggagagcagccagaagcaggacggcaccatccagaacctgaaggagaccctgaagagcagagagagagagaccgaggagctgtaccaggtgatcgagggccagaacgacaccatggccaagctgagagagatgctgcaccagagccagctgggccagctgcacagcagcgagggcaccagccccgcccagcagcaggtggccctgctggacctgcagagcgccctgttctgcagccagctggagatccagaagctgcagagagtggtgagacagaaggagagacagctggccgacgccaagcagtgcgtgcagttcgtggaggccgccgcccacgagagcgagcagcagaaggaggccagctggaagcacaaccaggagctgagaaaggccctgcagcagctgcaggaggagctgcagaacaagagccagcagctgagagcctgggaggccgagaagtacaacgagatcagaacccaggagcagaacatccagcacctgaaccacagcctgagccacaaggagcagctgctgcaggagttcagagagctgctgcagtacagagacaacagcgacaagaccctggaggccaacgagatgctgctggagaagctgagacagagaatccacgacaaggccgtggccctggagagagccatcgacgagaagttcagcgccctggaggagaaggagaaggagctgagacagctgagactggccgtgagagagagagaccacgacctggagagactgagagacgtgctgagcagcaacgaggccaccatgcagagcatggagagcctgctgagagccaagggcctggaggtggagcagctgagcaccacctgccagaacctgcagtggctgaaggaggagatggagaccaagttcagcagatggcagaaggagcaggagagcatcatccagcagctgcagaccagcctgcacgacagaaacaaggaggtggaggacctgagcgccaccctgctgtgcaagctgggccccggccagagcgagatcgccgaggagctgtgccagagactgcagagaaaggagagaatgctgcaggacctgctgagcgacagaaacaagcaggtgctggagcacgagatggagatccagggcctgctgcagagcgtgagcaccagagagcaggagagccaggccgccgccgagaagctggtgcaggccctgatggagagaaacagcgagctgcaggccctgagacagtacctgggcggcagagacagcctgatgagccaggcccccatcagcaaccagcaggccgaggtgacccccaccggctgcctgggcaagcagaccgaccagggcagcatgcagatccccagcagagacgacagcaccagcctgaccgccaaggaggacgtgagcatccccagaagcaccctgggcgacctggacaccgtggccggcctggagaaggagctgagcaacgccaaggaggagctggagctgatggccaagaaggagagagagagccagatggagctgagcgccctgcagagcatgatggccgtgcaggaggaggagctgcaggtgcaggccgccgacatggagagcctgaccagaaacatccagatcaaggaggacctgatcaaggacctgcagatgcagctggtggaccccgaggacatccccgccatggagagactgacccaggaggtgctgctgctgagagagaaggtggccagcgtggagagccagggccaggagatcagcggcaacagaagacagcagctgctgctgatgctggagggcctggtggacgagagaagcagactgaacgaggccctgcaggccgagagacagctgtacagcagcctggtgaagttccacgcccaccccgagagcagcgagagagacagaaccctgcaggtggagctggagggcgcccaggtgctgagaagcagactggaggaggtgctgggcagaagcctggagagactgaacagactggagaccctggccgccatcggcggcgccgccgccggcgacgacaccgaggacaccagcaccgagttcaccgacagcatcgaggaggaggccgcccaccacagccaccagcaggtgagccagtgccagggcctgggcctgcccggctggaccgcccacagccccagcgaggtgtag

SEQ ID NO: 93132 - DNA, 3396 bp, Artificial Sequence
  Description of Artificial Sequence: Synthetic coding sequence
atgaaggagatctgcagaatctgcgccagagagctgtgcggcaaccagagaagatggatcttccacaccgccagcaagctgaacctgcaggtgctgctgagccacgtgctgggcaaggacgtgcccagagacggcaaggccgagttcgcctgcagcaagtgcgccttcatgctggacagaatctacagattcgacaccgtgatcgccagaatcgaggccctgagcatcgagagactgcagaagctgctgctggagaaggacagactgaagttctgcatcgccagcatgtacagaaagaacaacgacgacagcggcgccgagatcaaggccggcaacggcaccgtggacatgagcgtgctgcccgacgccagatacagcgccctgctgcaggaggacttcgcctacagcggcttcgagtgctgggtggagaacgaggaccagatccaggagccccacagctgccacggcagcgagggccccggcaacagacccagaagatgcagaggctgcgccgccctgagagtggccgacagcgactacgaggccatctgcaaggtgcccagaaaggtggccagaagcatcagctgcggccccagcagcagatggagcaccagcatctgcaccgaggagcccgccctgagcgaggtgggcccccccgacctggccagcaccaaggtgccccccgacggcgagagcatggaggaggagacccccggcagcagcgtggagagcctggacgccagcgtgcaggccagccccccccagcagaaggacgaggagaccgagagaagcgccaaggagctgggcaagtgcgactgctgcagcgacgaccaggccccccagcacggctgcaaccacaagctggagctggccctgagcatgatcaagggcctggactacaagcccatccagagccccagaggcagcagactgcccatccccgtgaagagcagcctgcccggcgccaagcccggccccagcatgaccgacggcgtgagcagcggcttcctgaacagaagcctgaagcccctgtacaagacccccgtgagctaccccctggagctgagcgacctgcaggagctgtgggacgacctgtgcgaggactacctgcccctgagagtgcagcccatgaccgaggagctgctgaagcagcagaagctgaacagccacgagaccaccatcacccagcagagcgtgagcgacagccacctggccgagctgcaggagaagatccagcagaccgaggccaccaacaagatcctgcaggagaagctgaacgagatgagctacgagctgaagtgcgcccaggagagcagccagaagcaggacggcaccatccagaacctgaaggagaccctgaagagcagagagagagagaccgaggagctgtaccaggtgatcgagggccagaacgacaccatggccaagctgagagagatgctgcaccagagccagctgggccagctgcacagcagcgagggcaccagccccgcccagcagcaggtggccctgctggacctgcagagcgccctgttctgcagccagctggagatccagaagctgcagagagtggtgagacagaaggagagacagctggccgacgccaagcagtgcgtgcagttcgtggaggccgccgcccacgagagcgagcagcagaaggaggccagctggaagcacaaccaggagctgagaaaggccctgcagcagctgcaggaggagctgcagaacaagagccagcagctgagagcctgggaggccgagaagtacaacgagatcagaacccaggagcagaacatccagcacctgaaccacagcctgagccacaaggagcagctgctgcaggagttcagagagctgctgcagtacagagacaacagcgacaagaccctggaggccaacgagatgctgctggagaagctgagacagagaatccacgacaaggccgtggccctggagagagccatcgacgagaagttcagcgccctggaggagaaggagaaggagctgagacagctgagactggccgtgagagagagagaccacgacctggagagactgagagacgtgctgagcagcaacgaggccaccatgcagagcatggagagcctgctgagagccaagggcctggaggtggagcagctgagcaccacctgccagaacctgcagtggctgaaggaggagatggagaccaagttcagcagatggcagaaggagcaggagagcatcatccagcagctgcagaccagcctgcacgacagaaacaaggaggtggaggacctgagcgccaccctgctgtgcaagctgggccccggccagagcgagatcgccgaggagctgtgccagagactgcagagaaaggagagaatgctgcaggacctgctgagcgacagaaacaagcaggtgctggagcacgagatggagatccagggcctgctgcagagcgtgagcaccagagagcaggagagccaggccgccgccgagaagctggtgcaggccctgatggagagaaacagcgagctgcaggccctgagacagtacctgggcggcagagacagcctgatgagccaggcccccatcagcaaccagcaggccgaggtgacccccaccggctgcctgggcaagcagaccgaccagggcagcatgcagatccccagcagagacgacagcaccagcctgaccgccaaggaggacgtgagcatccccagaagcaccctgggcgacctggacaccgtggccggcctggagaaggagctgagcaacgccaaggaggagctggagctgatggccaagaaggagagagagagccagatggagctgagcgccctgcagagcatgatggccgtgcaggaggaggagctgcaggtgcaggccgccgacatggagagcctgaccagaaacatccagatcaaggaggacctgatcaaggacctgcagatgcagctggtggaccccgaggacatccccgccatggagagactgacccaggaggtgctgctgctgagagagaaggtggccagcgtggagagccagggccaggagatcagcggcaacagaagacagcagctgctgctgatgctggagggcctggtggacgagagaagcagactgaacgaggccctgcaggccgagagacagctgtacagcagcctggtgaagttccacgcccaccccgagagcagcgagagagacagaaccctgcaggtggagctggagggcgcccaggtgctgagaagcagactggaggaggtgctgggcagaagcctggagagactgaacagactggagaccctggccgccatcggcggcgccgccgccggcgacgacaccgaggacaccagcaccgagttcaccgacagcatcgaggaggaggccgcccaccacagccaccagcagtag

SEQ ID NO: 93133 - DNA, 7041 bp, Artificial Sequence
  Description of Artificial Sequence: Synthetic coding sequence
atgagcaacggctacagaaccctgagccagcacctgaacgacctgaagaaggagaacttcagcctgaagctgagaatctacttcctggaggagagaatgcagcagaagtacgaggccagcagagaggacatctacaagagaaacatcgagctgaaggtggaggtggagagcctgaagagagagctgcaggacaagaagcagcacctggacaagacctgggccgacgtggagaacctgaacagccagaacgaggccgagctgagaagacagttcgaggagagacagcaggagaccgagcacgtgtacgagctgctggagaacaagatccagctgctgcaggaggagagcagactggccaagaacgaggccgccagaatggccgccctggtggaggccgagaaggagtgcaacctggagctgagcgagaagctgaagggcgtgaccaagaactgggaggacgtgcccggcgaccaggtgaagcccgaccagtacaccgaggccctggcccagagagacaagagaatcgaggagctgaaccagagcctggccgcccaggagagactggtggagcagctgagcagagagaagcagcagctgctgcacctgctggaggagcccaccagcatggaggtgcagcccatgaccgaggagctgctgaagcagcagaagctgaacagccacgagaccaccatcacccagcagagcgtgagcgacagccacctggccgagctgcaggagaagatccagcagaccgaggccaccaacaagatcctgcaggagaagctgaacgagatgagctacgagctgaagtgcgcccaggagagcagccagaagcaggacggcaccatccagaacctgaaggagaccctgaagagcagagagagagagaccgaggagctgtaccaggtgatcgagggccagaacgacaccatggccaagctgagagagatgctgcaccagagccagctgggccagctgcacagcagcgagggcaccagccccgcccagcagcaggtggccctgctggacctgcagagcgccctgttctgcagccagctggagatccagaagctgcagagagtggtgagacagaaggagagacagctggccgacgccaagcagtgcgtgcagttcgtggaggccgccgcccacgagagcgagcagcagaaggaggccagctggaagcacaaccaggagctgagaaaggccctgcagcagctgcaggaggagctgcagaacaagagccagcagctgagagcctgggaggccgagaagtacaacgagatcagaacccaggagcagaacatccagcacctgaaccacagcctgagccacaaggagcagctgctgcaggagttcagagagctgctgcagtacagagacaacagcgacaagaccctggaggccaacgagatgctgctggagaagctgagacagagaatccacgacaaggccgtggccctggagagagccatcgacgagaagttcagcgccctggaggagaaggagaaggagctgagacagctgagactggccgtgagagagagagaccacgacctggagagactgagagacgtgctgagcagcaacgaggccaccatgcagagcatggagagcctgctgagagccaagggcctggaggtggagcagctgagcaccacctgccagaacctgcagtggctgaaggaggagatggagaccaagttcagcagatggcagaaggagcaggagagcatcatccagcagctgcagaccagcctgcacgacagaaacaaggaggtggaggacctgagcgccaccctgctgtgcaagctgggccccggccagagcgagatcgccgaggagctgtgccagagactgcagagaaaggagagaatgctgcaggacctgctgagcgacagaaacaagcaggtgctggagcacgagatggagatccagggcctgctgcagagcgtgagcaccagagagcaggagagccaggccgccgccgagaagctggtgcaggccctgatggagagaaacagcgagctgcaggccctgagacagtacctgggcggcagagacagcctgatgagccaggcccccatcagcaaccagcaggccgaggtgacccccaccggctgcctgggcaagcagaccgaccagggcagcatgcagatccccagcagagacgacagcaccagcctgaccgccaaggaggacgtgagcatccccagaagcaccctgggcgacctggacaccgtggccggcctggagaaggagctgagcaacgccaaggaggagctggagctgatggccaagaaggagagagagagccagatggagctgagcgccctgcagagcatgatggccgtgcaggaggaggagctgcaggtgcaggccgccgacatggagagcctgaccagaaacatccagatcaaggaggacctgatcaaggacctgcagatgcagctggtggaccccgaggacatccccgccatggagagactgacccaggaggtgctgctgctgagagagaaggtggccagcgtggagagccagggccaggagatcagcggcaacagaagacagcagctgctgctgatgctggagggcctggtggacgagagaagcagactgaacgaggccctgcaggccgagagacagctgtacagcagcctggtgaagttccacgcccaccccgagagcagcgagagagacagaaccctgcaggtggagctggagggcgcccaggtgctgagaagcagactggaggaggtgctgggcagaagcctggagagactgaacagactggagaccctggccgccatcggcggcgccgccgccggcgacgacaccgaggacaccagcaccgagttcaccgacagcatcgaggaggaggccgcccaccacagccaccagcagctggtgaaggtggccctggagaagagcctggccaccgtggagacccagaaccccagcttcagcccccccagccccatgggcggcgacagcaacagatgcctgcaggaggagatgctgcacctgagagccgagttccaccagcacctggaggagaagagaaaggccgaggaggagctgaaggagctgaaggcccagatcgaggaggccggcttcagcagcgtgagccacatcagaaacaccatgctgagcctgtgcctggagaacgccgagctgaaggagcagatgggcgaggccatgagcgacggctgggagatcgaggaggacaaggagaagggcgaggtgatggtggagaccgtggtgaccaaggagggcctgagcgagagcagcctgcaggccgagttcagaaagctgcagggcaagctgaagaacgcccacaacatcatcaacctgctgaaggagcagctggtgctgagcagcaaggagggcaacagcaagctgacccccgagctgctggtgcacctgaccagcaccatcgagagaatcaacaccgagctggtgggcagccccggcaagcaccagcaccaggaggagggcaacgtgaccgtgagacccttccccagaccccagagcctggacctgggcgccaccttcaccgtggacgcccaccagctggacaaccagagccagcccagagaccccggcccccagagcgccttcagcctgcccggcagcacccagcacctgagaagccagctgagccagtgcaagcagagataccaggacctgcaggagaagctgctgctgagcgaggccaccgtgttcgcccaggccaacgagctggagaagtacagagtgatgctgaccggcgagagcctggtgaagcaggacagcaagcagatccaggtggacctgcaggacctgggctacgagacctgcggcagaagcgagaacgaggccgagagagaggagaccaccagccccgagtgcgaggagcacaacagcctgaaggagatggtgctgatggagggcctgtgcagcgagcagggcagaagaggcagcaccctggccagcagcagcgagagaaagcccctggagaaccagctgggcaagcaggaggagttcagagtgtacggcaagagcgagaacatcctggtgctgagaaaggacatcaaggacctgaaggcccagctgcagaacgccaacaaggtgatccagaacctgaagagcagagtgagaagcctgagcgtgaccagcgactacagcagcagcctggagagaccctggaagctgagagccgtgggcaccctggagggcagcagcccccacagcgtgcccgacgaggacgagggctggctgagcgacggcaccggcgccttctacagccccggcctgcaggccaagaaggacctggagagcctgatccagagagtgagccagctggaggcccagctgcccaagaacggcctggaggagaagctggccgaggagctgagaagcgccagctggcccggcaagtacgacagcctgatccaggaccaggccagagagctgagctacctgagacagaagatcagagagggcagaggcatctgctacctgatcaccagacacgccaaggacaccgtgaagagcttcgaggacctgctgagaagcaacgacatcgactactacctgggccagagcttcagagagcagctggcccagggcagccagctgaccgagagactgaccagcaagctgagcaccaaggaccacaagagcgagaaggaccaggccggcctggagcccctggccctgagactgagcagagagctgcaggagaaggagaaggtgatcgaggtgctgcaggccaagctggacgccagaagcctgacccccagcagcagccacgccctgagcgacagccacagaagccccagcagcaccagcttcctgagcgacgagctggaggcctgcagcgacatggacatcgtgagcgagtacacccactacgaggagaagaaggccagccccagccacagcgacagcatccaccacagcagccacagcgccgtgctgagcagcaagcccagcagcaccagcgccagccagggcgccaaggccgagagcaacagcaaccccatcagcctgcccaccccccagaacacccccaaggaggccaaccaggcccacagcggcttccacttccacagcatccccaagctggccagcctgccccaggcccccctgcccagcgcccccagcagcttcctgcccttcagccccaccggccccctgctgctgggctgctgcgagacccccgtggtgagcctggccgaggcccagcaggagctgcagatgctgcagaagcagctgggcgagagcgccagcaccgtgccccccgccagcaccgccaccctgctgagcaacgacctggaggccgacagcagctactacctgaacagcgcccagccccacagcccccccagaggcaccatcgagctgggcagaatcctggagcccggctacctgggcagcagcggcaagtgggacgtgatgagaccccagaagggcagcgtgagcggcgacctgagcagcggcagcagcgtgtaccagctgaacagcaagcccaccggcgccgacctgctggaggagcacctgggcgagatcagaaacctgagacagagactggaggagagcatctgcatcaacgacagactgagagagcagctggagcacagactgaccagcaccgccagaggcagaggcagcaccagcaacttctacagccagggcctggagagcatcccccagctgtgcaacgagaacagagtgctgagagaggacaacagaagactgcaggcccagctgagccacgtgagcagagagcacagccaggagaccgagagcctgagagaggccctgctgagcagcagaagccacctgcaggagctggagaaggagctggagcaccagaaggtggagagacagcagctgctggaggacctgagagagaagcagcaggaggtgctgcacttcagagaggagagactgagcctgcaggagaacgacagcagactgcagcacaagctggtgctgctgcagcagcagtgcgaggagaagcagcagctgttcgagagcctgcagagcgagctgcagatctacgaggccctgtacggcaacagcaagaagggcctgaaggcctacagcctggacgcctgccaccagatccccctgagcagcgacctgagccacctggtggccgaggtgagagccctgagaggccagctggagcagagcatccagggcaacaactgcctgagactgcagctgcagcagcagctggagagcggcgccggcaaggccagcctgagccccagcagcatcaaccagaacttccccgccagcaccgaccccggcaacaagcagctgctgctgcaggacagcgccgtgagcccccccgtgagagacgtgggcatgaacagccccgccctggtgttccccagcagcgccagcagcacccccggcagcgagacccccatcatcaacagagccaacggcctgggcctggacaccagccccgtgatgaagaccccccccaagctggagggcgacgccaccgacggcagcttcgccaacaagcacggcagacacgtgatcggccacatcgacgactacagcgccctgagacagcagatcgccgagggcaagctgctggtgaagaagatcgtgagcctggtgagaagcgcctgcagcttccccggcctggaggcccagggcaccgaggtgctgggcagcaagggcatccacgagctgagaagcagcaccagcgccctgcaccacgccctggaggagagcgccagcctgctgaccatgttctggagagccgccctgcccagcacccacatccccgtgctgcccggcaaggtgggcgagagcaccgagagagagctgctggagctgagaaccaaggtgagcaagcaggagagactgctgcagagcaccaccgagcacctgaagaacgccaaccagcagaaggagagcatggagcagttcatcgtgagccagctgaccagaacccacgacgtgctgaagaaggccagaaccaacctggaggtgaagagcctgagagccctgccctgcacccccgccctgtag

SEQ ID NO: 93134 - DNA, 7089 bp, Artificial Sequence
  Description of Artificial Sequence: Synthetic coding sequence
atgagcaacggctacagaaccctgagccagcacctgaacgacctgaagaaggagaacttcagcctgaagctgagaatctacttcctggaggagagaatgcagcagaagtacgaggccagcagagaggacatctacaagagaaacatcgagctgaaggtggaggtggagagcctgaagagagagctgcaggacaagaagcagcacctggacaagacctgggccgacgtggagaacctgaacagccagaacgaggccgagctgagaagacagttcgaggagagacagcaggagaccgagcacgtgtacgagctgctggagaacaagatccagctgctgcaggaggagagcagactggccaagaacgaggccgccagaatggccgccctggtggaggccgagaaggagtgcaacctggagctgagcgagaagctgaagggcgtgaccaagaactgggaggacgtgcccggcgaccaggtgaagcccgaccagtacaccgaggccctggcccagagagacaagagaatcgaggagctgaaccagagcctggccgcccaggagagactggtggagcagctgagcagagagaagcagcagctgctgcacctgctggaggagcccaccagcatggaggtgcagcccatgaccgaggagctgctgaagcagcagaagctgaacagccacgagaccaccatcacccagcagagcgtgagcgacagccacctggccgagctgcaggagaagatccagcagaccgaggccaccaacaagatcctgcaggagaagctgaacgagatgagctacgagctgaagtgcgcccaggagagcagccagaagcaggacggcaccatccagaacctgaaggagaccctgaagagcagagagagagagaccgaggagctgtaccaggtgatcgagggccagaacgacaccatggccaagctgagagagatgctgcaccagagccagctgggccagctgcacagcagcgagggcaccagccccgcccagcagcaggtggccctgctggacctgcagagcgccctgttctgcagccagctggagatccagaagctgcagagagtggtgagacagaaggagagacagctggccgacgccaagcagtgcgtgcagttcgtggaggccgccgcccacgagagcgagcagcagaaggaggccagctggaagcacaaccaggagctgagaaaggccctgcagcagctgcaggaggagctgcagaacaagagccagcagctgagagcctgggaggccgagaagtacaacgagatcagaacccaggagcagaacatccagcacctgaaccacagcctgagccacaaggagcagctgctgcaggagttcagagagctgctgcagtacagagacaacagcgacaagaccctggaggccaacgagatgctgctggagaagctgagacagagaatccacgacaaggccgtggccctggagagagccatcgacgagaagttcagcgccctggaggagaaggagaaggagctgagacagctgagactggccgtgagagagagagaccacgacctggagagactgagagacgtgctgagcagcaacgaggccaccatgcagagcatggagagcctgctgagagccaagggcctggaggtggagcagctgagcaccacctgccagaacctgcagtggctgaaggaggagatggagaccaagttcagcagatggcagaaggagcaggagagcatcatccagcagctgcagaccagcctgcacgacagaaacaaggaggtggaggacctgagcgccaccctgctgtgcaagctgggccccggccagagcgagatcgccgaggagctgtgccagagactgcagagaaaggagagaatgctgcaggacctgctgagcgacagaaacaagcaggtgctggagcacgagatggagatccagggcctgctgcagagcgtgagcaccagagagcaggagagccaggccgccgccgagaagctggtgcaggccctgatggagagaaacagcgagctgcaggccctgagacagtacctgggcggcagagacagcctgatgagccaggcccccatcagcaaccagcaggccgaggtgacccccaccggctgcctgggcaagcagaccgaccagggcagcatgcagatccccagcagagacgacagcaccagcctgaccgccaaggaggacgtgagcatccccagaagcaccctgggcgacctggacaccgtggccggcctggagaaggagctgagcaacgccaaggaggagctggagctgatggccaagaaggagagagagagccagatggagctgagcgccctgcagagcatgatggccgtgcaggaggaggagctgcaggtgcaggccgccgacatggagagcctgaccagaaacatccagatcaaggaggacctgatcaaggacctgcagatgcagctggtggaccccgaggacatccccgccatggagagactgacccaggaggtgctgctgctgagagagaaggtggccagcgtggagagccagggccaggagatcagcggcaacagaagacagcagctgctgctgatgctggagggcctggtggacgagagaagcagactgaacgaggccctgcaggccgagagacagctgtacagcagcctggtgaagttccacgcccaccccgagagcagcgagagagacagaaccctgcaggtggagctggagggcgcccaggtgctgagaagcagactggaggaggtgctgggcagaagcctggagagactgaacagactggagaccctggccgccatcggcggcgccgccgccggcgacgacaccgaggacaccagcaccgagttcaccgacagcatcgaggaggaggccgcccaccacagccaccagcagctggtgaaggtggccctggagaagagcctggccaccgtggagacccagaaccccagcttcagcccccccagccccatgggcggcgacagcaacagatgcctgcaggaggagatgctgcacctgagagccgagttccaccagcacctggaggagaagagaaaggccgaggaggagctgaaggagctgaaggcccagatcgaggaggccggcttcagcagcgtgagccacatcagaaacaccatgctgagcctgtgcctggagaacgccgagctgaaggagcagatgggcgaggccatgagcgacggctgggagatcgaggaggacaaggagaagggcgaggtgatggtggagaccgtggtgaccaaggagggcctgagcgagagcagcctgcaggccgagttcagaaagctgcagggcaagctgaagaacgcccacaacatcatcaacctgctgaaggagcagctggtgctgagcagcaaggagggcaacagcaagctgacccccgagctgctggtgcacctgaccagcaccatcgagagaatcaacaccgagctggtgggcagccccggcaagcaccagcaccaggaggagggcaacgtgaccgtgagacccttccccagaccccagagcctggacctgggcgccaccttcaccgtggacgcccaccagctggacaaccagagccagcccagagaccccggcccccagagcgccttcagcctgcccggcagcacccagcacctgagaagccagctgagccagtgcaagcagagataccaggacctgcaggagaagctgctgctgagcgaggccaccgtgttcgcccaggccaacgagctggagaagtacagagtgatgctgaccggcgagagcctggtgaagcaggacagcaagcagatccaggtggacctgcaggacctgggctacgagacctgcggcagaagcgagaacgaggccgagagagaggagaccaccagccccgagtgcgaggagcacaacagcctgaaggagatggtgctgatggagggcctgtgcagcgagcagggcagaagaggcagcaccctggccagcagcagcgagagaaagcccctggagaaccagctgggcaagcaggaggagttcagagtgtacggcaagagcgagaacatcctggtgctgagaaaggacatcaaggacctgaaggcccagctgcagaacgccaacaaggtgatccagaacctgaagagcagagtgagaagcctgagcgtgaccagcgactacagcagcagcctggagagaccctggaagctgagagccgtgggcaccctggagggcagcagcccccacagcgtgcccgacgaggacgagggctggctgagcgacggcaccggcgccttctacagccccggcctgcaggccaagaaggacctggagagcctgatccagagagtgagccagctggaggcccagctgcccaagaacggcctggaggagaagctggccgaggagctgagaagcgccagctggcccggcaagtacgacagcctgatccaggaccaggccagagagctgagctacctgagacagaagatcagagagggcagaggcatctgctacctgatcaccagacacgccaaggacaccgtgaagagcttcgaggacctgctgagaagcaacgacatcgactactacctgggccagagcttcagagagcagctggcccagggcagccagctgaccgagagactgaccagcaagctgagcaccaaggaccacaagagcgagaaggaccaggccggcctggagcccctggccctgagactgagcagagagctgcaggagaaggagaaggtgatcgaggtgctgcaggccaagctggacgccagaagcctgacccccagcagcagccacgccctgagcgacagccacagaagccccagcagcaccagcttcctgagcgacgagctggaggcctgcagcgacatggacatcgtgagcgagtacacccactacgaggagaagaaggccagccccagccacagcgacagcatccaccacagcagccacagcgccgtgctgagcagcaagcccagcagcaccagcgccagccagggcgccaaggccgagagcaacagcaaccccatcagcctgcccaccccccagaacacccccaaggaggccaaccaggcccacagcggcttccacttccacagcatccccaagctggccagcctgccccaggcccccctgcccagcgcccccagcagcttcctgcccttcagccccaccggccccctgctgctgggctgctgcgagacccccgtggtgagcctggccgaggcccagcaggagctgcagatgctgcagaagcagctgggcgagagcgccagcaccgtgccccccgccagcaccgccaccctgctgagcaacgacctggaggccgacagcagctactacctgaacagcgcccagccccacagcccccccagaggcaccatcgagctgggcagaatcctggagcccggctacctgggcagcagcggcaagtgggacgtgatgagaccccagaagggcagcgtgagcggcgacctgagcagcggcagcagcgtgtaccagctgaacagcaagcccaccggcgccgacctgctggaggagcacctgggcgagatcagaaacctgagacagagactggaggagagcatctgcatcaacgacagactgagagagcagctggagcacagactgaccagcaccgccagaggcagaggcagcaccagcaacttctacagccagggcctggagagcatcccccagctgtgcaacgagaacagagtgctgagagaggacaacagaagactgcaggcccagctgagccacgtgagcagagagcacagccaggagaccgagagcctgagagaggccctgctgagcagcagaagccacctgcaggagctggagaaggagctggagcaccagaaggtggagagacagcagctgctggaggacctgagagagaagcagcaggaggtgctgcacttcagagaggagagactgagcctgcaggagaacgacagcagactgcagcacaagctggtgctgctgcagcagcagtgcgaggagaagcagcagctgttcgagagcctgcagagcgagctgcagatctacgaggccctgtacggcaacagcaagaagggcctgaaggcctacagcctggacgcctgccaccagatccccctgagcagcgacctgagccacctggtggccgaggtgagagccctgagaggccagctggagcagagcatccagggcaacaactgcctgagactgcagctgcagcagcagctggagagcggcgccggcaaggccagcctgagccccagcagcatcaaccagaacttccccgccagcaccgaccccggcaacaagcagctgctgctgcaggacagcgccgtgagcccccccgtgagagacgtgggcatgaacagccccgccctggtgttccccagcagcgccagcagcacccccggcagcgagacccccatcatcaacagagccaacggcctgggcctggacaccagccccgtgatgaagaccccccccaagctggagggcgacgccaccgacggcagcttcgccaacaagcacggcagacacgtgatcggccacatcgacgactacagcgccctgagacagcagatcgccgagggcaagctgctggtgaagaagatcgtgagcctggtgagaagcgcctgcagcttccccggcctggaggcccagggcaccgaggtgctgggcagcaagggcatccacgagctgagaagcagcaccagcgccctgcaccacgccctggaggagagcgccagcctgctgaccatgttctggagagccgccctgcccagcacccacatccccgtgctgcccggcaaggtgggcgagagcaccgagagagagctgctggagctgagaaccaaggtgagcaagcaggagagactgctgcagagcaccaccgagcacctgaagaacgccaaccagcagaaggagagcatggagcagttcatcgtgagccagctgaccagaacccacgacgtgctgaagaaggccagaaccaacctggaggagccctgcaagaagagaagccaccagaagagcctgaagcagcaggagagatgggcctgcccccccttcgtgcagctgcccatctgctag

SEQ ID NO: 93135 - DNA, 1557 bp, Artificial Sequence
  Description of Artificial Sequence: Synthetic coding sequence
atgcccgaggccaactacctgctgagcgtgagctggggctacatcaagttcaagagaatgctgaacagagagctgacccacctgagcgagatgagcagaagcggcaaccaggtgagcgagttcatcagcaacaccttcctggacaagcagcacgaggtggagatccccagccccacccagaaggagaaggagaagaagaagagacccatgagccagatcagcggcgtgaagaagctgatgcacagcagcagcctgaccaacagcagcatccccagattcggcgtgaagaccgagcaggaggacgtgctggccaaggagctggaggacgtgaacaagtggggcctgcacgtgttcagaatcgccgagctgagcggcaacagacccctgaccgtgatcatgcacaccatcttccaggagagagacctgctgaagaccttcaagatccccgtggacaccctgatcacctacctgatgaccctggaggaccactaccacgccgacgtggcctaccacaacaacatccacgccgccgacgtggtgcagagcacccacgtgctgctgagcacccccgccctggaggccgtgttcaccgacctggagatcctggccgccatcttcgccagcgccatccacgacgtggaccaccccggcgtgagcaaccagttcctgatcaacaccaacagcgagctggccctgatgtacaacgacagcagcgtgctggagaaccaccacctggccgtgggcttcaagctgctgcaggaggagaactgcgacatcttccagaacctgaccaagaagcagagacagagcctgagaaagatggtgatcgacatcgtgctggccaccgacatgagcaagcacatgaacctgctggccgacctgaagaccatggtggagaccaagaaggtgaccagcagcggcgtgctgctgctggacaactacagcgacagaatccaggtgctgcagaacatggtgcactgcgccgacctgagcaaccccaccaagcccctgcagctgtacagacagtggaccgacagaatcatggaggagttcttcagacagggcgacagagagagagagagaggcatggagatcagccccatgtgcgacaagcacaacgccagcgtggagaagagccaggtgggcttcatcgactacatcgtgcaccccctgtgggagacctgggccgacctggtgcaccccgacgcccaggacatcctggacaccctggaggacaacagagagtggtaccagagcaccatcccccagagccccagccccgcccccgacgaccccgaggagggcagacagggccagaccgagaagttccagttcgagctgaccctggaggaggacggcgagagcgacaccgagaaggacagcggcagccaggtggaggaggacaccagctgcagcgacagcaagaccctgtgcacccaggacagcgagagcaccgagatccccctggacgagcaggtggaggaggaggccgtgggcgaggaggaggagagccagcccgaggcctgcgtgatcgacgacagaagccccgacacctag

SEQ ID NO: 93136 - DNA, 2430 bp, Artificial Sequence
  Description of Artificial Sequence: Synthetic coding sequence
atggaggccgagggcagcagcgcccccgccagagccggcagcggcgagggcagcgacagcgccggcggcgccaccctgaaggcccccaagcacctgtggagacacgagcagcaccaccagtaccccctgagacagccccagttcagactgctgcacccccaccaccacctgccccccccccccccccccagcccccagccccagccccagtgccccctgcagccccccccccccccccccctgcccccccccccccccccccccggcgccgccagaggcagatacgccagcagcggcgccaccggcagagtgagacacagaggctacagcgacaccgagagatacctgtactgcagagccatggacagaaccagctacgccgtggagaccggccacagacccggcctgaagaagagcagaatgagctggcccagcagcttccagggcctgagaagattcgacgtggacaacggcaccagcgccggcagaagccccctggaccccatgaccagccccggcagcggcctgatcctgcaggccaacttcgtgcacagccagagaagagagagcttcctgtacagaagcgacagcgactacgacctgagccccaagagcatgagcagaaacagcagcatcgccagcgacatccacggcgacgacctgatcgtgacccccttcgcccaggtgctggccagcctgagaaccgtgagaaacaacttcgccgccctgaccaacctgcaggacagagcccccagcaagagaagccccatgtgcaaccagcccagcatcaacaaggccaccatcaccgaggaggcctaccagaagctggccagcgagaccctggaggagctggactggtgcctggaccagctggagaccctgcagaccagacacagcgtgagcgagatggccagcaacaagttcaagagaatgctgaacagagagctgacccacctgagcgagatgagcagaagcggcaaccaggtgagcgagttcatcagcaacaccttcctggacaagcagcacgaggtggagatccccagccccacccagaaggagaaggagaagaagaagagacccatgagccagatcagcggcgtgaagaagctgatgcacagcagcagcctgaccaacagcagcatccccagattcggcgtgaagaccgagcaggaggacgtgctggccaaggagctggaggacgtgaacaagtggggcctgcacgtgttcagaatcgccgagctgagcggcaacagacccctgaccgtgatcatgcacaccatcttccaggagagagacctgctgaagaccttcaagatccccgtggacaccctgatcacctacctgatgaccctggaggaccactaccacgccgacgtggcctaccacaacaacatccacgccgccgacgtggtgcagagcacccacgtgctgctgagcacccccgccctggaggccgtgttcaccgacctggagatcctggccgccatcttcgccagcgccatccacgacgtggaccaccccggcgtgagcaaccagttcctgatcaacaccaacagcgagctggccctgatgtacaacgacagcagcgtgctggagaaccaccacctggccgtgggcttcaagctgctgcaggaggagaactgcgacatcttccagaacctgaccaagaagcagagacagagcctgagaaagatggtgatcgacatcgtgctggccaccgacatgagcaagcacatgaacctgctggccgacctgaagaccatggtggagaccaagaaggtgaccagcagcggcgtgctgctgctggacaactacagcgacagaatccaggtgctgcagaacatggtgcactgcgccgacctgagcaaccccaccaagcccctgcagctgtacagacagtggaccgacagaatcatggaggagttcttcagacagggcgacagagagagagagagaggcatggagatcagccccatgtgcgacaagcacaacgccagcgtggagaagagccaggtgggcttcatcgactacatcgtgcaccccctgtgggagacctgggccgacctggtgcaccccgacgcccaggacatcctggacaccctggaggacaacagagagtggtaccagagcaccatcccccagagccccagccccgcccccgacgaccccgaggagggcagacagggccagaccgagaagttccagttcgagctgaccctggaggaggacggcgagagcgacaccgagaaggacagcggcagccaggtggaggaggacaccagctgcagcgacagcaagaccctgtgcacccaggacagcgagagcaccgagatccccctggacgagcaggtggaggaggaggccgtgggcgaggaggaggagagccagcccgaggcctgcgtgatcgacgacagaagccccgacacctag

SEQ ID NO: 93137 - DNA, 2037 bp, Artificial Sequence
  Description of Artificial Sequence: Synthetic coding sequence
atgttcatctacagcttcaacaagttcttcttcaagaccacccactgctgggccatcatcagcttcgacgtggacaacggcaccagcgccggcagaagccccctggaccccatgaccagccccggcagcggcctgatcctgcaggccaacttcgtgcacagccagagaagagagagcttcctgtacagaagcgacagcgactacgacctgagccccaagagcatgagcagaaacagcagcatcgccagcgacatccacggcgacgacctgatcgtgacccccttcgcccaggtgctggccagcctgagaaccgtgagaaacaacttcgccgccctgaccaacctgcaggacagagcccccagcaagagaagccccatgtgcaaccagcccagcatcaacaaggccaccatcaccgaggaggcctaccagaagctggccagcgagaccctggaggagctggactggtgcctggaccagctggagaccctgcagaccagacacagcgtgagcgagatggccagcaacaagttcaagagaatgctgaacagagagctgacccacctgagcgagatgagcagaagcggcaaccaggtgagcgagttcatcagcaacaccttcctggacaagcagcacgaggtggagatccccagccccacccagaaggagaaggagaagaagaagagacccatgagccagatcagcggcgtgaagaagctgatgcacagcagcagcctgaccaacagcagcatccccagattcggcgtgaagaccgagcaggaggacgtgctggccaaggagctggaggacgtgaacaagtggggcctgcacgtgttcagaatcgccgagctgagcggcaacagacccctgaccgtgatcatgcacaccatcttccaggagagagacctgctgaagaccttcaagatccccgtggacaccctgatcacctacctgatgaccctggaggaccactaccacgccgacgtggcctaccacaacaacatccacgccgccgacgtggtgcagagcacccacgtgctgctgagcacccccgccctggaggccgtgttcaccgacctggagatcctggccgccatcttcgccagcgccatccacgacgtggaccaccccggcgtgagcaaccagttcctgatcaacaccaacagcgagctggccctgatgtacaacgacagcagcgtgctggagaaccaccacctggccgtgggcttcaagctgctgcaggaggagaactgcgacatcttccagaacctgaccaagaagcagagacagagcctgagaaagatggtgatcgacatcgtgctggccaccgacatgagcaagcacatgaacctgctggccgacctgaagaccatggtggagaccaagaaggtgaccagcagcggcgtgctgctgctggacaactacagcgacagaatccaggtgctgcagaacatggtgcactgcgccgacctgagcaaccccaccaagcccctgcagctgtacagacagtggaccgacagaatcatggaggagttcttcagacagggcgacagagagagagagagaggcatggagatcagccccatgtgcgacaagcacaacgccagcgtggagaagagccaggtgggcttcatcgactacatcgtgcaccccctgtgggagacctgggccgacctggtgcaccccgacgcccaggacatcctggacaccctggaggacaacagagagtggtaccagagcaccatcccccagagccccagccccgcccccgacgaccccgaggagggcagacagggccagaccgagaagttccagttcgagctgaccctggaggaggacggcgagagcgacaccgagaaggacagcggcagccaggtggaggaggacaccagctgcagcgacagcaagaccctgtgcacccaggacagcgagagcaccgagatccccctggacgagcaggtggaggaggaggccgtgggcgaggaggaggagagccagcccgaggcctgcgtgatcgacgacagaagccccgacacctag

SEQ ID NO: 93138 - DNA, 1524 bp, Artificial Sequence
  Description of Artificial Sequence: Synthetic coding sequence
atggccagcaacaagttcaagagaatgctgaacagagagctgacccacctgagcgagatgagcagaagcggcaaccaggtgagcgagttcatcagcaacaccttcctggacaagcagcacgaggtggagatccccagccccacccagaaggagaaggagaagaagaagagacccatgagccagatcagcggcgtgaagaagctgatgcacagcagcagcctgaccaacagcagcatccccagattcggcgtgaagaccgagcaggaggacgtgctggccaaggagctggaggacgtgaacaagtggggcctgcacgtgttcagaatcgccgagctgagcggcaacagacccctgaccgtgatcatgcacaccatcttccaggagagagacctgctgaagaccttcaagatccccgtggacaccctgatcacctacctgatgaccctggaggaccactaccacgccgacgtggcctaccacaacaacatccacgccgccgacgtggtgcagagcacccacgtgctgctgagcacccccgccctggaggccgtgttcaccgacctggagatcctggccgccatcttcgccagcgccatccacgacgtggaccaccccggcgtgagcaaccagttcctgatcaacaccaacagcgagctggccctgatgtacaacgacagcagcgtgctggagaaccaccacctggccgtgggcttcaagctgctgcaggaggagaactgcgacatcttccagaacctgaccaagaagcagagacagagcctgagaaagatggtgatcgacatcgtgctggccaccgacatgagcaagcacatgaacctgctggccgacctgaagaccatggtggagaccaagaaggtgaccagcagcggcgtgctgctgctggacaactacagcgacagaatccaggtgctgcagaacatggtgcactgcgccgacctgagcaaccccaccaagcccctgcagctgtacagacagtggaccgacagaatcatggaggagttcttcagacagggcgacagagagagagagagaggcatggagatcagccccatgtgcgacaagcacaacgccagcgtggagaagagccaggtgggcttcatcgactacatcgtgcaccccctgtgggagacctgggccgacctggtgcaccccgacgcccaggacatcctggacaccctggaggacaacagagagtggtaccagagcaccatcccccagagccccagccccgcccccgacgaccccgaggagggcagacagggccagaccgagaagttccagttcgagctgaccctggaggaggacggcgagagcgacaccgagaaggacagcggcagccaggtggaggaggacaccagctgcagcgacagcaagaccctgtgcacccaggacagcgagagcaccgagatccccctggacgagcaggtggaggaggaggccgtgggcgaggaggaggagagccagcccgaggcctgcgtgatcgacgacagaagccccgacacctag

SEQ ID NO: 93139 - DNA, 2022 bp, Artificial Sequence
  Description of Artificial Sequence: Synthetic coding sequence
atgatgcacgtgaacaacttccccttcagaagacacagctggatctgcttcgacgtggacaacggcaccagcgccggcagaagccccctggaccccatgaccagccccggcagcggcctgatcctgcaggccaacttcgtgcacagccagagaagagagagcttcctgtacagaagcgacagcgactacgacctgagccccaagagcatgagcagaaacagcagcatcgccagcgacatccacggcgacgacctgatcgtgacccccttcgcccaggtgctggccagcctgagaaccgtgagaaacaacttcgccgccctgaccaacctgcaggacagagcccccagcaagagaagccccatgtgcaaccagcccagcatcaacaaggccaccatcaccgaggaggcctaccagaagctggccagcgagaccctggaggagctggactggtgcctggaccagctggagaccctgcagaccagacacagcgtgagcgagatggccagcaacaagttcaagagaatgctgaacagagagctgacccacctgagcgagatgagcagaagcggcaaccaggtgagcgagttcatcagcaacaccttcctggacaagcagcacgaggtggagatccccagccccacccagaaggagaaggagaagaagaagagacccatgagccagatcagcggcgtgaagaagctgatgcacagcagcagcctgaccaacagcagcatccccagattcggcgtgaagaccgagcaggaggacgtgctggccaaggagctggaggacgtgaacaagtggggcctgcacgtgttcagaatcgccgagctgagcggcaacagacccctgaccgtgatcatgcacaccatcttccaggagagagacctgctgaagaccttcaagatccccgtggacaccctgatcacctacctgatgaccctggaggaccactaccacgccgacgtggcctaccacaacaacatccacgccgccgacgtggtgcagagcacccacgtgctgctgagcacccccgccctggaggccgtgttcaccgacctggagatcctggccgccatcttcgccagcgccatccacgacgtggaccaccccggcgtgagcaaccagttcctgatcaacaccaacagcgagctggccctgatgtacaacgacagcagcgtgctggagaaccaccacctggccgtgggcttcaagctgctgcaggaggagaactgcgacatcttccagaacctgaccaagaagcagagacagagcctgagaaagatggtgatcgacatcgtgctggccaccgacatgagcaagcacatgaacctgctggccgacctgaagaccatggtggagaccaagaaggtgaccagcagcggcgtgctgctgctggacaactacagcgacagaatccaggtgctgcagaacatggtgcactgcgccgacctgagcaaccccaccaagcccctgcagctgtacagacagtggaccgacagaatcatggaggagttcttcagacagggcgacagagagagagagagaggcatggagatcagccccatgtgcgacaagcacaacgccagcgtggagaagagccaggtgggcttcatcgactacatcgtgcaccccctgtgggagacctgggccgacctggtgcaccccgacgcccaggacatcctggacaccctggaggacaacagagagtggtaccagagcaccatcccccagagccccagccccgcccccgacgaccccgaggagggcagacagggccagaccgagaagttccagttcgagctgaccctggaggaggacggcgagagcgacaccgagaaggacagcggcagccaggtggaggaggacaccagctgcagcgacagcaagaccctgtgcacccaggacagcgagagcaccgagatccccctggacgagcaggtggaggaggaggccgtgggcgaggaggaggagagccagcccgaggcctgcgtgatcgacgacagaagccccgacacctag

SEQ ID NO: 93140 - DNA, 2064 bp, Artificial Sequence
  Description of Artificial Sequence: Synthetic coding sequence
atggccttcgtgtgggaccccctgggcgccaccgtgcccggccccagcaccagagccaagagcagactgagattcagcaagagctacagcttcgacgtggacaacggcaccagcgccggcagaagccccctggaccccatgaccagccccggcagcggcctgatcctgcaggccaacttcgtgcacagccagagaagagagagcttcctgtacagaagcgacagcgactacgacctgagccccaagagcatgagcagaaacagcagcatcgccagcgacatccacggcgacgacctgatcgtgacccccttcgcccaggtgctggccagcctgagaaccgtgagaaacaacttcgccgccctgaccaacctgcaggacagagcccccagcaagagaagccccatgtgcaaccagcccagcatcaacaaggccaccatcaccgaggaggcctaccagaagctggccagcgagaccctggaggagctggactggtgcctggaccagctggagaccctgcagaccagacacagcgtgagcgagatggccagcaacaagttcaagagaatgctgaacagagagctgacccacctgagcgagatgagcagaagcggcaaccaggtgagcgagttcatcagcaacaccttcctggacaagcagcacgaggtggagatccccagccccacccagaaggagaaggagaagaagaagagacccatgagccagatcagcggcgtgaagaagctgatgcacagcagcagcctgaccaacagcagcatccccagattcggcgtgaagaccgagcaggaggacgtgctggccaaggagctggaggacgtgaacaagtggggcctgcacgtgttcagaatcgccgagctgagcggcaacagacccctgaccgtgatcatgcacaccatcttccaggagagagacctgctgaagaccttcaagatccccgtggacaccctgatcacctacctgatgaccctggaggaccactaccacgccgacgtggcctaccacaacaacatccacgccgccgacgtggtgcagagcacccacgtgctgctgagcacccccgccctggaggccgtgttcaccgacctggagatcctggccgccatcttcgccagcgccatccacgacgtggaccaccccggcgtgagcaaccagttcctgatcaacaccaacagcgagctggccctgatgtacaacgacagcagcgtgctggagaaccaccacctggccgtgggcttcaagctgctgcaggaggagaactgcgacatcttccagaacctgaccaagaagcagagacagagcctgagaaagatggtgatcgacatcgtgctggccaccgacatgagcaagcacatgaacctgctggccgacctgaagaccatggtggagaccaagaaggtgaccagcagcggcgtgctgctgctggacaactacagcgacagaatccaggtgctgcagaacatggtgcactgcgccgacctgagcaaccccaccaagcccctgcagctgtacagacagtggaccgacagaatcatggaggagttcttcagacagggcgacagagagagagagagaggcatggagatcagccccatgtgcgacaagcacaacgccagcgtggagaagagccaggtgggcttcatcgactacatcgtgcaccccctgtgggagacctgggccgacctggtgcaccccgacgcccaggacatcctggacaccctggaggacaacagagagtggtaccagagcaccatcccccagagccccagccccgcccccgacgaccccgaggagggcagacagggccagaccgagaagttccagttcgagctgaccctggaggaggacggcgagagcgacaccgagaaggacagcggcagccaggtggaggaggacaccagctgcagcgacagcaagaccctgtgcacccaggacagcgagagcaccgagatccccctggacgagcaggtggaggaggaggccgtgggcgaggaggaggagagccagcccgaggcctgcgtgatcgacgacagaagccccgacacctag

SEQ ID NO: 93141 - DNA, 2247 bp, Artificial Sequence
  Description of Artificial Sequence: Synthetic coding sequence
atgaagagaaacacctgcgacctgctgagcagaagcaagagcgccagcgaggagaccctgcacagcagcaacgaggaggaggaccccttcagaggcatggagccctacctggtgagaagactgagctgcagaaacatccagctgccccccctggccttcagacagctggagcaggccgacctgaagagcgagagcgagaacatccagagacccaccagcctgcccctgaagatcctgcccctgatcgccatcaccagcgccgagagcagcggcttcgacgtggacaacggcaccagcgccggcagaagccccctggaccccatgaccagccccggcagcggcctgatcctgcaggccaacttcgtgcacagccagagaagagagagcttcctgtacagaagcgacagcgactacgacctgagccccaagagcatgagcagaaacagcagcatcgccagcgacatccacggcgacgacctgatcgtgacccccttcgcccaggtgctggccagcctgagaaccgtgagaaacaacttcgccgccctgaccaacctgcaggacagagcccccagcaagagaagccccatgtgcaaccagcccagcatcaacaaggccaccatcaccgaggaggcctaccagaagctggccagcgagaccctggaggagctggactggtgcctggaccagctggagaccctgcagaccagacacagcgtgagcgagatggccagcaacaagttcaagagaatgctgaacagagagctgacccacctgagcgagatgagcagaagcggcaaccaggtgagcgagttcatcagcaacaccttcctggacaagcagcacgaggtggagatccccagccccacccagaaggagaaggagaagaagaagagacccatgagccagatcagcggcgtgaagaagctgatgcacagcagcagcctgaccaacagcagcatccccagattcggcgtgaagaccgagcaggaggacgtgctggccaaggagctggaggacgtgaacaagtggggcctgcacgtgttcagaatcgccgagctgagcggcaacagacccctgaccgtgatcatgcacaccatcttccaggagagagacctgctgaagaccttcaagatccccgtggacaccctgatcacctacctgatgaccctggaggaccactaccacgccgacgtggcctaccacaacaacatccacgccgccgacgtggtgcagagcacccacgtgctgctgagcacccccgccctggaggccgtgttcaccgacctggagatcctggccgccatcttcgccagcgccatccacgacgtggaccaccccggcgtgagcaaccagttcctgatcaacaccaacagcgagctggccctgatgtacaacgacagcagcgtgctggagaaccaccacctggccgtgggcttcaagctgctgcaggaggagaactgcgacatcttccagaacctgaccaagaagcagagacagagcctgagaaagatggtgatcgacatcgtgctggccaccgacatgagcaagcacatgaacctgctggccgacctgaagaccatggtggagaccaagaaggtgaccagcagcggcgtgctgctgctggacaactacagcgacagaatccaggtgctgcagaacatggtgcactgcgccgacctgagcaaccccaccaagcccctgcagctgtacagacagtggaccgacagaatcatggaggagttcttcagacagggcgacagagagagagagagaggcatggagatcagccccatgtgcgacaagcacaacgccagcgtggagaagagccaggtgggcttcatcgactacatcgtgcaccccctgtgggagacctgggccgacctggtgcaccccgacgcccaggacatcctggacaccctggaggacaacagagagtggtaccagagcaccatcccccagagccccagccccgcccccgacgaccccgaggagggcagacagggccagaccgagaagttccagttcgagctgaccctggaggaggacggcgagagcgacaccgagaaggacagcggcagccaggtggaggaggacaccagctgcagcgacagcaagaccctgtgcacccaggacagcgagagcaccgagatccccctggacgagcaggtggaggaggaggccgtgggcgaggaggaggagagccagcccgaggcctgcgtgatcgacgacagaagccccgacacctag

SEQ ID NO: 93142 - DNA, 660 bp, Artificial Sequence
  Description of Artificial Sequence: Synthetic coding sequence
atggcccagcagaccagccccgacaccctgaccgtgcccgaggtggacaacccccactgccccaacccctggctgaacgaggacctggtgaagagcctgagagagaacctgctgcagcacgagaagagcaagaccgccagaaagagcgtgagccccaagctgagccccgtgatcagccccagaaacagccccagactgctgagaagaatgctgctgagcagcaacatccccaagcagagaagattcaccgtggcccacacctgcttcgacgtggacaacggcaccagcgccggcagaagccccctggaccccatgaccagccccggcagcggcctgatcctgcaggccaacttcgtgcacagccagagaagagagagcttcctgtacagaagcgacagcgactacgacctgagccccaagagcatgagcagaaacagcagcatcgccagcgacatccacggcgacgacctgatcgtgacccccttcgcccaggtgctggccagcctgagaaccgtgagaaacaacttcgccgccctgaccaacctgcaggacagagcccccagcaagagaagccccatgtgcaaccagcccagcatcaacaaggccaccatcaccggcagctggatggagctgaacccctacaccctgctggacatgtag

SEQ ID NO: 93143 - DNA, 2040 bp, Artificial Sequence
  Description of Artificial Sequence: Synthetic coding sequence
atgagcatcatcatgaagcccagaagcagaagcaccagcagcctgagaaccgccgaggccgtgtgcttcgacgtggacaacggcaccagcgccggcagaagccccctggaccccatgaccagccccggcagcggcctgatcctgcaggccaacttcgtgcacagccagagaagagagagcttcctgtacagaagcgacagcgactacgacctgagccccaagagcatgagcagaaacagcagcatcgccagcgacatccacggcgacgacctgatcgtgacccccttcgcccaggtgctggccagcctgagaaccgtgagaaacaacttcgccgccctgaccaacctgcaggacagagcccccagcaagagaagccccatgtgcaaccagcccagcatcaacaaggccaccatcaccgaggaggcctaccagaagctggccagcgagaccctggaggagctggactggtgcctggaccagctggagaccctgcagaccagacacagcgtgagcgagatggccagcaacaagttcaagagaatgctgaacagagagctgacccacctgagcgagatgagcagaagcggcaaccaggtgagcgagttcatcagcaacaccttcctggacaagcagcacgaggtggagatccccagccccacccagaaggagaaggagaagaagaagagacccatgagccagatcagcggcgtgaagaagctgatgcacagcagcagcctgaccaacagcagcatccccagattcggcgtgaagaccgagcaggaggacgtgctggccaaggagctggaggacgtgaacaagtggggcctgcacgtgttcagaatcgccgagctgagcggcaacagacccctgaccgtgatcatgcacaccatcttccaggagagagacctgctgaagaccttcaagatccccgtggacaccctgatcacctacctgatgaccctggaggaccactaccacgccgacgtggcctaccacaacaacatccacgccgccgacgtggtgcagagcacccacgtgctgctgagcacccccgccctggaggccgtgttcaccgacctggagatcctggccgccatcttcgccagcgccatccacgacgtggaccaccccggcgtgagcaaccagttcctgatcaacaccaacagcgagctggccctgatgtacaacgacagcagcgtgctggagaaccaccacctggccgtgggcttcaagctgctgcaggaggagaactgcgacatcttccagaacctgaccaagaagcagagacagagcctgagaaagatggtgatcgacatcgtgctggccaccgacatgagcaagcacatgaacctgctggccgacctgaagaccatggtggagaccaagaaggtgaccagcagcggcgtgctgctgctggacaactacagcgacagaatccaggtgctgcagaacatggtgcactgcgccgacctgagcaaccccaccaagcccctgcagctgtacagacagtggaccgacagaatcatggaggagttcttcagacagggcgacagagagagagagagaggcatggagatcagccccatgtgcgacaagcacaacgccagcgtggagaagagccaggtgggcttcatcgactacatcgtgcaccccctgtgggagacctgggccgacctggtgcaccccgacgcccaggacatcctggacaccctggaggacaacagagagtggtaccagagcaccatcccccagagccccagccccgcccccgacgaccccgaggagggcagacagggccagaccgagaagttccagttcgagctgaccctggaggaggacggcgagagcgacaccgagaaggacagcggcagccaggtggaggaggacaccagctgcagcgacagcaagaccctgtgcacccaggacagcgagagcaccgagatccccctggacgagcaggtggaggaggaggccgtgggcgaggaggaggagagccagcccgaggcctgcgtgatcgacgacagaagccccgacacctag

SEQ ID NO: 93144 - DNA, 1269 bp, Artificial Sequence
  Description of Artificial Sequence: Synthetic coding sequence
atggccagcaacaagttcaagagaatgctgaacagagagctgacccacctgagcgagatgagcagaagcggcaaccaggtgagcgagttcatcagcaacaccttcctggacaagcagcacgaggtggagatccccagccccacccagaaggagaaggagaagaagaagagacccatgagccagatcagcggcgtgaagaagctgatgcacagcagcagcctgaccaacagcagcatccccagattcggcgtgaagaccgagcaggaggacgtgctggccaaggagctggaggacgtgaacaagtggggcctgcacgtgttcagaatcgccgagctgagcggcaacagacccctgaccgtgatcatgcacaccatcttccaggagagagacctgctgaagaccttcaagatccccgtggacaccctgatcacctacctgatgaccctggaggaccactaccacgccgacgtggcctaccacaacaacatccacgccgccgacgtggtgcagagcacccacgtgctgctgagcacccccgccctggaggccgtgttcaccgacctggagatcctggccgccatcttcgccagcgccatccacgacgtggaccaccccggcgtgagcaaccagttcctgatcaacaccaacagcgagctggccctgatgtacaacgacagcagcgtgctggagaaccaccacctggccgtgggcttcaagctgctgcaggaggagaactgcgacatcttccagaacctgaccaagaagcagagacagagcctgagaaagatggtgatcgacatcgtgctggccaccgacatgagcaagcacatgaacctgctggccgacctgaagaccatggtggagaccaagaaggtgaccagcagcggcgtgctgctgctggacaactacagcgacagaatccaggtgctgcagaacatggtgcactgcgccgacctgagcaaccccaccaagcccctgcagctgtacagacagtggaccgacagaatcatggaggagttcttcagacagggcgacagagagagagagagaggcatggagatcagccccatgtgcgacaagcacaacgccagcgtggagaagagccaggtgggcttcatcgactacatcgtgcaccccctgtgggagacctgggccgacctggtgcaccccgacgcccaggacatcctggacaccctggaggacaacagagagtggtaccagagcaccatcccccagagccccagccccgcccccgacgaccccgagtag

SEQ ID NO: 93145 - DNA, 246 bp, Artificial Sequence
  Description of Artificial Sequence: Synthetic coding sequence
atgaagagaaacacctgcgacctgctgagcagaagcaagagcgccagcgaggagaccctgcacagcagcaacgaggaggaggaccccttcagaggcatggagccctacctggtgagaagactgagctgcagaaacatccagctgccccccctggccttcagacagctggagcaggccgacctgaagagcgagagcgagaacatccagagacccaccagcctgcccctgaagatcctgcccctgtag

SEQ ID NO: 93146 - DNA, 2238 bp, Artificial Sequence
  Description of Artificial Sequence: Synthetic coding sequence
atggcccagcagaccagccccgacaccctgaccgtgcccgaggtggacaacccccactgccccaacccctggctgaacgaggacctggtgaagagcctgagagagaacctgctgcagcacgagaagagcaagaccgccagaaagagcgtgagccccaagctgagccccgtgatcagccccagaaacagccccagactgctgagaagaatgctgctgagcagcaacatccccaagcagagaagattcaccgtggcccacacctgcttcgacgtggacaacggcaccagcgccggcagaagccccctggaccccatgaccagccccggcagcggcctgatcctgcaggccaacttcgtgcacagccagagaagagagagcttcctgtacagaagcgacagcgactacgacctgagccccaagagcatgagcagaaacagcagcatcgccagcgacatccacggcgacgacctgatcgtgacccccttcgcccaggtgctggccagcctgagaaccgtgagaaacaacttcgccgccctgaccaacctgcaggacagagcccccagcaagagaagccccatgtgcaaccagcccagcatcaacaaggccaccatcaccgaggaggcctaccagaagctggccagcgagaccctggaggagctggactggtgcctggaccagctggagaccctgcagaccagacacagcgtgagcgagatggccagcaacaagttcaagagaatgctgaacagagagctgacccacctgagcgagatgagcagaagcggcaaccaggtgagcgagttcatcagcaacaccttcctggacaagcagcacgaggtggagatccccagccccacccagaaggagaaggagaagaagaagagacccatgagccagatcagcggcgtgaagaagctgatgcacagcagcagcctgaccaacagcagcatccccagattcggcgtgaagaccgagcaggaggacgtgctggccaaggagctggaggacgtgaacaagtggggcctgcacgtgttcagaatcgccgagctgagcggcaacagacccctgaccgtgatcatgcacaccatcttccaggagagagacctgctgaagaccttcaagatccccgtggacaccctgatcacctacctgatgaccctggaggaccactaccacgccgacgtggcctaccacaacaacatccacgccgccgacgtggtgcagagcacccacgtgctgctgagcacccccgccctggaggccgtgttcaccgacctggagatcctggccgccatcttcgccagcgccatccacgacgtggaccaccccggcgtgagcaaccagttcctgatcaacaccaacagcgagctggccctgatgtacaacgacagcagcgtgctggagaaccaccacctggccgtgggcttcaagctgctgcaggaggagaactgcgacatcttccagaacctgaccaagaagcagagacagagcctgagaaagatggtgatcgacatcgtgctggccaccgacatgagcaagcacatgaacctgctggccgacctgaagaccatggtggagaccaagaaggtgaccagcagcggcgtgctgctgctggacaactacagcgacagaatccaggtgctgcagaacatggtgcactgcgccgacctgagcaaccccaccaagcccctgcagctgtacagacagtggaccgacagaatcatggaggagttcttcagacagggcgacagagagagagagagaggcatggagatcagccccatgtgcgacaagcacaacgccagcgtggagaagagccaggtgggcttcatcgactacatcgtgcaccccctgtgggagacctgggccgacctggtgcaccccgacgcccaggacatcctggacaccctggaggacaacagagagtggtaccagagcaccatcccccagagccccagccccgcccccgacgaccccgaggagggcagacagggccagaccgagaagttccagttcgagctgaccctggaggaggacggcgagagcgacaccgagaaggacagcggcagccaggtggaggaggacaccagctgcagcgacagcaagaccctgtgcacccaggacagcgagagcaccgagatccccctggacgagcaggtggaggaggaggccgtgggcgaggaggaggagagccagcccgaggcctgcgtgatcgacgacagaagccccgacacctag

SEQ ID NO: 93147 - DNA, 228 bp, Artificial Sequence
  Description of Artificial Sequence: Synthetic coding sequence
atgaagagaaacacctgcgacctgctgagcagaagcaagagcgccagcgaggagaccctgcacagcagcaacgaggaggaggaccccttcagaggcatggagccctacctggtgagaagactgagctgcagaaacatccagctgccccccctggccttcagacagctggagcaggccgacctgaagagcgagagcgagaacatccagagacccaccagcctgccctag

SEQ ID NO: 93148 - DNA, 2247 bp, Artificial Sequence; identical to SEQ ID NO: 93141
  Description of Artificial Sequence: Synthetic coding sequence

SEQ ID NO: 93149 - DNA, 2502 bp, Artificial Sequence
  Description of Artificial Sequence: Synthetic coding sequence
atgctgcccttcggcgacaagaccagagagatggtgaacgcctggttcgccgagagagtgcacaccatccccgtgtgcaaggagggcatcagaggccacaccgagagctgcagctgccccctgcagcagagccccagagccgacaacagcgcccccggcacccccaccagaaagatcagcgccagcgagttcgacagacccctgagacccatcgtggtgaaggacagcgagggcaccgtgagcttcctgagcgacagcgagaagaaggagcagatgcccctgaccccccccagattcgaccacgacgagggcgaccagtgcagcagactgctggagctggtgaaggacatcagcagccacctggacgtgaccgccctgtgccacaagatcttcctgcacatccacggcctgatcagcgccgacagatacagcctgttcctggtgtgcgaggacagcagcaacgacaagttcctgatcagcagactgttcgacgtggccgagggcagcaccctggaggaggtgagcaacaactgcatcagactggagtggaacaagggcatcgtgggccacgtggccgccctgggcgagcccctgaacatcaaggacgcctacgaggaccccagattcaacgccgaggtggaccagatcaccggctacaagacccagagcatcctgtgcatgcccatcaagaaccacagagaggaggtggtgggcgtggcccaggccatcaacaagaagagcggcaacggcggcaccttcaccgagaaggacgagaaggacttcgccgcctacctggccttctgcggcatcgtgctgcacaacgcccagctgtacgagaccagcctgctggagaacaagagaaaccaggtgctgctggacctggccagcctgatcttcgaggagcagcagagcctggaggtgatcctgaagaagatcgccgccaccatcatcagcttcatgcaggtgcagaagtgcaccatcttcatcgtggacgaggactgcagcgacagcttcagcagcgtgttccacatggagtgcgaggagctggagaagagcagcgacaccctgaccagagagcacgacgccaacaagatcaactacatgtacgcccagtacgtgaagaacaccatggagcccctgaacatccccgacgtgagcaaggacaagagattcccctggaccaccgagaacaccggcaacgtgaaccagcagtgcatcagaagcctgctgtgcacccccatcaagaacggcaagaagaacaaggtgatcggcgtgtgccagctggtgaacaagatggaggagaacaccggcaaggtgaagcccttcaacagaaacgacgagcagttcctggaggccttcgtgatcttctgcggcctgggcatccagaacacccagatgtacgaggccgtggagagagccatggccaagcagatggtgaccctggaggtgctgagctaccacgccagcgccgccgaggaggagaccagagagctgcagagcctggccgccgccgtggtgcccagcgcccagaccctgaagatcaccgacttcagcttcagcgacttcgagctgagcgacctggagaccgccctgtgcaccatcagaatgttcaccgacctgaacctggtgcagaacttccagatgaagcacgaggtgctgtgcagatggatcctgagcgtgaagaagaactacagaaagaacgtggcctaccacaactggagacacgccttcaacaccgcccagtgcatgttcgccgccctgaaggccggcaagatccagaacaagctgaccgacctggagatcctggccctgctgatcgccgccctgagccacgacctggaccacagaggcgtgaacaacagctacatccagagaagcgagcaccccctggcccagctgtactgccacagcatcatggagcaccaccacttcgaccagtgcctgatgatcctgaacagccccggcaaccagatcctgagcggcctgagcatcgaggagtacaagaccaccctgaagatcatcaagcaggccatcctggccaccgacctggccctgtacatcaagagaagaggcgagttcttcgagctgatcagaaagaaccagttcaacctggaggacccccaccagaaggagctgttcctggccatgctgatgaccgcctgcgacctgagcgccatcaccaagccctggcccatccagcagagaatcgccgagctggtggccaccgagttcttcgaccagggcgacagagagagaaaggagctgaacatcgagcccaccgacctgatgaacagagagaagaagaacaagatccccagcatgcaggtgggcttcatcgacgccatctgcctgcagctgtacgaggccctgacccacgtgagcgaggactgcttccccctgctggacggctgcagaaagaacagacagaagtggcaggccctggccgagcagcaggagaagatgctgatcaacggcgagagcggccaggccaagagaaactag

SEQ ID NO: 93150 - DNA, 2628 bp, Artificial Sequence
  Description of Artificial Sequence: Synthetic coding sequence
atggagagagccggccccagcttcggccagcagagacagcagcagcagccccagcagcagaagcagcagcagagagaccaggacagcgtggaggcctggctggacgaccactgggacttcaccttcagctacttcgtgagaaaggccaccagagagatggtgaacgcctggttcgccgagagagtgcacaccatccccgtgtgcaaggagggcatcagaggccacaccgagagctgcagctgccccctgcagcagagccccagagccgacaacagcgcccccggcacccccaccagaaagatcagcgccagcgagttcgacagacccctgagacccatcgtggtgaaggacagcgagggcaccgtgagcttcctgagcgacagcgagaagaaggagcagatgcccctgaccccccccagattcgaccacgacgagggcgaccagtgcagcagactgctggagctggtgaaggacatcagcagccacctggacgtgaccgccctgtgccacaagatcttcctgcacatccacggcctgatcagcgccgacagatacagcctgttcctggtgtgcgaggacagcagcaacgacaagttcctgatcagcagactgttcgacgtggccgagggcagcaccctggaggaggtgagcaacaactgcatcagactggagtggaacaagggcatcgtgggccacgtggccgccctgggcgagcccctgaacatcaaggacgcctacgaggaccccagattcaacgccgaggtggaccagatcaccggctacaagacccagagcatcctgtgcatgcccatcaagaaccacagagaggaggtggtgggcgtggcccaggccatcaacaagaagagcggcaacggcggcaccttcaccgagaaggacgagaaggacttcgccgcctacctggccttctgcggcatcgtgctgcacaacgcccagctgtacgagaccagcctgctggagaacaagagaaaccaggtgctgctggacctggccagcctgatcttcgaggagcagcagagcctggaggtgatcctgaagaagatcgccgccaccatcatcagcttcatgcaggtgcagaagtgcaccatcttcatcgtggacgaggactgcagcgacagcttcagcagcgtgttccacatggagtgcgaggagctggagaagagcagcgacaccctgaccagagagcacgacgccaacaagatcaactacatgtacgcccagtacgtgaagaacaccatggagcccctgaacatccccgacgtgagcaaggacaagagattcccctggaccaccgagaacaccggcaacgtgaaccagcagtgcatcagaagcctgctgtgcacccccatcaagaacggcaagaagaacaaggtgatcggcgtgtgccagctggtgaacaagatggaggagaacaccggcaaggtgaagcccttcaacagaaacgacgagcagttcctggaggccttcgtgatcttctgcggcctgggcatccagaacacccagatgtacgaggccgtggagagagccatggccaagcagatggtgaccctggaggtgctgagctaccacgccagcgccgccgaggaggagaccagagagctgcagagcctggccgccgccgtggtgcccagcgcccagaccctgaagatcaccgacttcagcttcagcgacttcgagctgagcgacctggagaccgccctgtgcaccatcagaatgttcaccgacctgaacctggtgcagaacttccagatgaagcacgaggtgctgtgcagatggatcctgagcgtgaagaagaactacagaaagaacgtggcctaccacaactggagacacgccttcaacaccgcccagtgcatgttcgccgccctgaaggccggcaagatccagaacaagctgaccgacctggagatcctggccctgctgatcgccgccctgagccacgacctggaccacagaggcgtgaacaacagctacatccagagaagcgagcaccccctggcccagctgtactgccacagcatcatggagcaccaccacttcgaccagtgcctgatgatcctgaacagccccggcaaccagatcctgagcggcctgagcatcgaggagtacaagaccaccctgaagatcatcaagcaggccatcctggccaccgacctggccctgtacatcaagagaagaggcgagttcttcgagctgatcagaaagaaccagttcaacctggaggacccccaccagaaggagctgttcctggccatgctgatgaccgcctgcgacctgagcgccatcaccaagccctggcccatccagcagagaatcgccgagctggtggccaccgagttcttcgaccagggcgacagagagagaaaggagctgaacatcgagcccaccgacctgatgaacagagagaagaagaacaagatccccagcatgcaggtgggcttcatcgacgccatctgcctgcagctgtacgaggccctgacccacgtgagcgaggactgcttccccctgctggacggctgcagaaagaacagacagaagtggcaggccctggccgagcagcaggagaagatgctgatcaacggcgagagcggccaggccaagagaaactag

SEQ ID NO: 93151 - DNA, 2472 bp, Artificial Sequence
  Description of Artificial Sequence: Synthetic coding sequence
atggtgaacgcctggttcgccgagagagtgcacaccatccccgtgtgcaaggagggcatcagaggccacaccgagagctgcagctgccccctgcagcagagccccagagccgacaacagcgcccccggcacccccaccagaaagatcagcgccagcgagttcgacagacccctgagacccatcgtggtgaaggacagcgagggcaccgtgagcttcctgagcgacagcgagaagaaggagcagatgcccctgaccccccccagattcgaccacgacgagggcgaccagtgcagcagactgctggagctggtgaaggacatcagcagccacctggacgtgaccgccctgtgccacaagatcttcctgcacatccacggcctgatcagcgccgacagatacagcctgttcctggtgtgcgaggacagcagcaacgacaagttcctgatcagcagactgttcgacgtggccgagggcagcaccctggaggaggtgagcaacaactgcatcagactggagtggaacaagggcatcgtgggccacgtggccgccctgggcgagcccctgaacatcaaggacgcctacgaggaccccagattcaacgccgaggtggaccagatcaccggctacaagacccagagcatcctgtgcatgcccatcaagaaccacagagaggaggtggtgggcgtggcccaggccatcaacaagaagagcggcaacggcggcaccttcaccgagaaggacgagaaggacttcgccgcctacctggccttctgcggcatcgtgctgcacaacgcccagctgtacgagaccagcctgctggagaacaagagaaaccaggtgctgctggacctggccagcctgatcttcgaggagcagcagagcctggaggtgatcctgaagaagatcgccgccaccatcatcagcttcatgcaggtgcagaagtgcaccatcttcatcgtggacgaggactgcagcgacagcttcagcagcgtgttccacatggagtgcgaggagctggagaagagcagcgacaccctgaccagagagcacgacgccaacaagatcaactacatgtacgcccagtacgtgaagaacaccatggagcccctgaacatccccgacgtgagcaaggacaagagattcccctggaccaccgagaacaccggcaacgtgaaccagcagtgcatcagaagcctgctgtgcacccccatcaagaacggcaagaagaacaaggtgatcggcgtgtgccagctggtgaacaagatggaggagaacaccggcaaggtgaagcccttcaacagaaacgacgagcagttcctggaggccttcgtgatcttctgcggcctgggcatccagaacacccagatgtacgaggccgtggagagagccatggccaagcagatggtgaccctggaggtgctgagctaccacgccagcgccgccgaggaggagaccagagagctgcagagcctggccgccgccgtggtgcccagcgcccagaccctgaagatcaccgacttcagcttcagcgacttcgagctgagcgacctggagaccgccctgtgcaccatcagaatgttcaccgacctgaacctggtgcagaacttccagatgaagcacgaggtgctgtgcagatggatcctgagcgtgaagaagaactacagaaagaacgtggcctaccacaactggagacacgccttcaacaccgcccagtgcatgttcgccgccctgaaggccggcaagatccagaacaagctgaccgacctggagatcctggccctgctgatcgccgccctgagccacgacctggaccacagaggcgtgaacaacagctacatccagagaagcgagcaccccctggcccagctgtactgccacagcatcatggagcaccaccacttcgaccagtgcctgatgatcctgaacagccccggcaaccagatcctgagcggcctgagcatcgaggagtacaagaccaccctgaagatcatcaagcaggccatcctggccaccgacctggccctgtacatcaagagaagaggcgagttcttcgagctgatcagaaagaaccagttcaacctggaggacccccaccagaaggagctgttcctggccatgctgatgaccgcctgcgacctgagcgccatcaccaagccctggcccatccagcagagaatcgccgagctggtggccaccgagttcttcgaccagggcgacagagagagaaaggagctgaacatcgagcccaccgacctgatgaacagagagaagaagaacaagatccccagcatgcaggtgggcttcatcgacgccatctgcctgcagctgtacgaggccctgacccacgtgagcgaggactgcttccccctgctggacggctgcagaaagaacagacagaagtggcaggccctggccgagcagcaggagaagatgctgatcaacggcgagagcggccaggccaagagaaactag

SEQ ID NO: 93152 - DNA, 2583 bp, Artificial Sequence
  Description of Artificial Sequence: Synthetic coding sequence
atgggcgaggtgaccgccgaggaggtggagaagttcctggacagcaacatcggcttcgccaagcagtactacaacctgcactacagagccaagctgatcagcgacctgctgggcgccaaggaggccgccgtggacttcagcaactaccacagccccagcagcatggaggagagcgagatcatcttcgacctgctgagagacttccaggagaacctgcagaccgagaagtgcatcttcaacgtgatgaagaagctgtgcttcctgctgcaggccgacagaatgagcctgttcatgtacagaaccagaaacggcatcgccgagctggccaccagactgttcaacgtgcacaaggacgccgtgctggaggactgcctggtgatgcccgaccaggagatcgtgttccccctggacatgggcatcgtgggccacgtggcccacagcaagaagatcgccaacgtgcccaacaccgaggaggacgagcacttctgcgacttcgtggacatcctgaccgagtacaagaccaagaacatcctggccagccccatcatgaacggcaaggacgtggtggccatcatcatggccgtgaacaaggtggacggcagccacttcaccaagagagacgaggagatcctgctgaagtacctgaacttcgccaacctgatcatgaaggtgtaccacctgagctacctgcacaactgcgagaccagaagaggccagatcctgctgtggagcggcagcaaggtgttcgaggagctgaccgacatcgagagacagttccacaaggccctgtacaccgtgagagccttcctgaactgcgacagatacagcgtgggcctgctggacatgaccaagcagaaggagttcttcgacgtgtggcccgtgctgatgggcgaggtgcccccctacagcggccccagaacccccgacggcagagagatcaacttctacaaggtgatcgactacatcctgcacggcaaggaggacatcaaggtgatccccaaccccccccccgaccactgggccctggtgagcggcctgcccgcctacgtggcccagaacggcctgatctgcaacatcatgaacgcccccgccgaggacttcttcgccttccagaaggagcccctggacgagagcggctggatgatcaagaacgtgctgagcatgcccatcgtgaacaagaaggaggagatcgtgggcgtggccaccttctacaacagaaaggacggcaagcccttcgacgagatggacgagaccctgatggagagcctgacccagttcctgggctggagcgtgctgaaccccgacacctacgagagcatgaacaagctggagaacagaaaggacatcttccaggacatcgtgaagtaccacgtgaagtgcgacaacgaggagatccagaagatcctgaagaccagagaggtgtacggcaaggagccctgggagtgcgaggaggaggagctggccgagatcctgcaggccgagctgcccgacgccgacaagtacgagatcaacaagttccacttcagcgacctgcccctgaccgagctggagctggtgaagtgcggcatccagatgtactacgagctgaaggtggtggacaagttccacatcccccaggaggccctggtgagattcatgtacagcctgagcaagggctacagaaagatcacctaccacaactggagacacggcttcaacgtgggccagaccatgttcagcctgctggtgaccggcaagctgaagagatacttcaccgacctggaggccctggccatggtgaccgccgccttctgccacgacatcgaccacagaggcaccaacaacctgtaccagatgaagagccagaaccccctggccaagctgcacggcagcagcatcctggagagacaccacctggagttcggcaagaccctgctgagagacgagagcctgaacatcttccagaacctgaacagaagacagcacgagcacgccatccacatgatggacatcgccatcatcgccaccgacctggccctgtacttcaagaagagaaccatgttccagaagatcgtggaccagagcaagacctacgagagcgagcaggagtggacccagtacatgatgctggagcagaccagaaaggagatcgtgatggccatgatgatgaccgcctgcgacctgagcgccatcaccaagccctgggaggtgcagagccaggtggccctgctggtggccgccgagttctgggagcagggcgacctggagagaaccgtgctgcagcagaaccccatccccatgatggacagaaacaaggccgacgagctgcccaagctgcaggtgggcttcatcgacttcgtgtgcaccttcgtgtacaaggagttcagcagattccacgaggagatcacccccatgctggacggcatcaccaacaacagaaaggagtggaaggccctggccgacgagtacgacgccaagatgaaggtgcaggaggagaagaagcagaagcagcagagcgccaagagcgccgccgccggcaaccagcccggcggcaaccccagccccggcggcgccaccaccagcaagagctgctgcatccagtag

SEQ ID NO: 93153 - DNA, 1728 bp, Artificial Sequence
  Description of Artificial Sequence: Synthetic coding sequence
atgaccaaggagaaggagttcttcgacgtgtggagcgtgctgatgggcgagagccagccctacagcggccccagaacccccgacggcagagagatcgtgttctacaaggtgatcgactacgtgctgcacggcaaggaggagatcaaggtgatccccacccccagcgccgaccactgggccctggccagcggcctgcccagctacgtggccgagagcggcttcatctgcaacatcatgaacgccagcgccgacgagatgttcaagttccaggagggcgccctggacgacagcggctggctgatcaagaacgtgctgagcatgcccatcgtgaacaagaaggaggagatcgtgggcgtggccaccttctacaacagaaaggacggcaagcccttcgacgagcaggacgaggtgctgatggagagcctgacccagttcctgggctggagcgtgatgaacaccgacacctacgacaagatgaacaagctggagaacagaaaggacatcgcccaggacatggtgctgtaccacgtgaagtgcgacagagacgagatccagctgatcctgcccaccagagccagactgggcaaggagcccgccgactgcgacgaggacgagctgggcgagatcctgaaggaggagctgcccggccccaccaccttcgacatctacgagttccacttcagcgacctggagtgcaccgagctggacctggtgaagtgcggcatccagatgtactacgagctgggcgtggtgagaaagttccagatcccccaggaggtgctggtgagattcctgttcagcatcagcaagggctacagaagaatcacctaccacaactggagacacggcttcaacgtggcccagaccatgttcaccctgctgatgaccggcaagctgaagagctactacaccgacctggaggccttcgccatggtgaccgccggcctgtgccacgacatcgaccacagaggcaccaacaacctgtaccagatgaagagccagaaccccctggccaagctgcacggcagcagcatcctggagagacaccacctggagttcggcaagttcctgctgagcgaggagaccctgaacatctaccagaacctgaacagaagacagcacgagcacgtgatccacctgatggacatcgccatcatcgccaccgacctggccctgtacttcaagaagagagccatgttccagaagatcgtggacgagagcaagaactaccaggacaagaagagctgggtggagtacctgagcctggagaccaccagaaaggagatcgtgatggccatgatgatgaccgcctgcgacctgagcgccatcaccaagccctgggaggtgcagagcaaggtggccctgctggtggccgccgagttctgggagcagggcgacctggagagaaccgtgctggaccagcagcccatccccatgatggacagaaacaaggccgccgagctgcccaagctgcaggtgggcttcatcgacttcgtgtgcaccttcgtgtacaaggagttcagcagattccacgaggagatcctgcccatgttcgacagactgcagaacaacagaaaggagtggaaggccctggccgacgagtacgaggccaaggtgaaggccctggaggagaaggaggaggaggagagagtggccgccaagaaggtgggcaccgagatctgcaacggcggccccgcccccaagagcagcacctgctgcatcctgtag

SEQ ID NO: 93154 - DNA, 2562 bp, Artificial Sequence
  Description of Artificial Sequence: Synthetic coding sequence
atgagcctgagcgaggagcaggccagaagcttcctggaccagaaccccgacttcgccagacagtacttcggcaagaagctgagccccgagaacgtggccgccgcctgcgaggacggctgcccccccgactgcgacagcctgagagacctgtgccaggtggaggagagcaccgccctgctggagctggtgcaggacatgcaggagagcatcaacatggagagagtggtgttcaaggtgctgagaagactgtgcaccctgctgcaggccgacagatgcagcctgttcatgtacagacagagaaacggcgtggccgagctggccaccagactgttcagcgtgcagcccgacagcgtgctggaggactgcctggtgccccccgacagcgagatcgtgttccccctggacatcggcgtggtgggccacgtggcccagaccaagaagatggtgaacgtggaggacgtggccgagtgcccccacttcagcagcttcgccgacgagctgaccgactacaagaccaagaacatgctggccacccccatcatgaacggcaaggacgtggtggccgtgatcatggccgtgaacaagctgaacggccccttcttcaccagcgaggacgaggacgtgttcctgaagtacctgaacttcgccaccctgtacctgaagatctaccacctgagctacctgcacaactgcgagaccagaagaggccaggtgctgctgtggagcgccaacaaggtgttcgaggagctgaccgacatcgagagacagttccacaaggccttctacaccgtgagagcctacctgaactgcgagagatacagcgtgggcctgctggacatgaccaaggagaaggagttcttcgacgtgtggagcgtgctgatgggcgagagccagccctacagcggccccagaacccccgacggcagagagatcgtgttctacaaggtgatcgactacgtgctgcacggcaaggaggagatcaaggtgatccccacccccagcgccgaccactgggccctggccagcggcctgcccagctacgtggccgagagcggcttcatctgcaacatcatgaacgccagcgccgacgagatgttcaagttccaggagggcgccctggacgacagcggctggctgatcaagaacgtgctgagcatgcccatcgtgaacaagaaggaggagatcgtgggcgtggccaccttctacaacagaaaggacggcaagcccttcgacgagcaggacgaggtgctgatggagagcctgacccagttcctgggctggagcgtgatgaacaccgacacctacgacaagatgaacaagctggagaacagaaaggacatcgcccaggacatggtgctgtaccacgtgaagtgcgacagagacgagatccagctgatcctgcccaccagagccagactgggcaaggagcccgccgactgcgacgaggacgagctgggcgagatcctgaaggaggagctgcccggccccaccaccttcgacatctacgagttccacttcagcgacctggagtgcaccgagctggacctggtgaagtgcggcatccagatgtactacgagctgggcgtggtgagaaagttccagatcccccaggaggtgctggtgagattcctgttcagcatcagcaagggctacagaagaatcacctaccacaactggagacacggcttcaacgtggcccagaccatgttcaccctgctgatgaccggcaagctgaagagctactacaccgacctggaggccttcgccatggtgaccgccggcctgtgccacgacatcgaccacagaggcaccaacaacctgtaccagatgaagagccagaaccccctggccaagctgcacggcagcagcatcctggagagacaccacctggagttcggcaagttcctgctgagcgaggagaccctgaacatctaccagaacctgaacagaagacagcacgagcacgtgatccacctgatggacatcgccatcatcgccaccgacctggccctgtacttcaagaagagagccatgttccagaagatcgtggacgagagcaagaactaccaggacaagaagagctgggtggagtacctgagcctggagaccaccagaaaggagatcgtgatggccatgatgatgaccgcctgcgacctgagcgccatcaccaagccctgggaggtgcagagcaaggtggccctgctggtggccgccgagttctgggagcagggcgacctggagagaaccgtgctggaccagcagcccatccccatgatggacagaaacaaggccgccgagctgcccaagctgcaggtgggcttcatcgacttcgtgtgcaccttcgtgtacaaggagttcagcagattccacgaggagatcctgcccatgttcgacagactgcagaacaacagaaaggagtggaaggccctggccgacgagtacgaggccaaggtgaaggccctggaggagaaggaggaggaggagagagtggccgccaagaagggcaccgagatctgcaacggcggccccgcccccaagagcagcacctgctgcatcctgtag

SEQ ID NO: 93155 - DNA, 2565 bp, Artificial Sequence
  Description of Artificial Sequence: Synthetic coding sequence
atgagcctgagcgaggagcaggccagaagcttcctggaccagaaccccgacttcgccagacagtacttcggcaagaagctgagccccgagaacgtggccgccgcctgcgaggacggctgcccccccgactgcgacagcctgagagacctgtgccaggtggaggagagcaccgccctgctggagctggtgcaggacatgcaggagagcatcaacatggagagagtggtgttcaaggtgctgagaagactgtgcaccctgctgcaggccgacagatgcagcctgttcatgtacagacagagaaacggcgtggccgagctggccaccagactgttcagcgtgcagcccgacagcgtgctggaggactgcctggtgccccccgacagcgagatcgtgttccccctggacatcggcgtggtgggccacgtggcccagaccaagaagatggtgaacgtggaggacgtggccgagtgcccccacttcagcagcttcgccgacgagctgaccgactacaagaccaagaacatgctggccacccccatcatgaacggcaaggacgtggtggccgtgatcatggccgtgaacaagctgaacggccccttcttcaccagcgaggacgaggacgtgttcctgaagtacctgaacttcgccaccctgtacctgaagatctaccacctgagctacctgcacaactgcgagaccagaagaggccaggtgctgctgtggagcgccaacaaggtgttcgaggagctgaccgacatcgagagacagttccacaaggccttctacaccgtgagagcctacctgaactgcgagagatacagcgtgggcctgctggacatgaccaaggagaaggagttcttcgacgtgtggagcgtgctgatgggcgagagccagccctacagcggccccagaacccccgacggcagagagatcgtgttctacaaggtgatcgactacgtgctgcacggcaaggaggagatcaaggtgatccccacccccagcgccgaccactgggccctggccagcggcctgcccagctacgtggccgagagcggcttcatctgcaacatcatgaacgccagcgccgacgagatgttcaagttccaggagggcgccctggacgacagcggctggctgatcaagaacgtgctgagcatgcccatcgtgaacaagaaggaggagatcgtgggcgtggccaccttctacaacagaaaggacggcaagcccttcgacgagcaggacgaggtgctgatggagagcctgacccagttcctgggctggagcgtgatgaacaccgacacctacgacaagatgaacaagctggagaacagaaaggacatcgcccaggacatggtgctgtaccacgtgaagtgcgacagagacgagatccagctgatcctgcccaccagagccagactgggcaaggagcccgccgactgcgacgaggacgagctgggcgagatcctgaaggaggagctgcccggccccaccaccttcgacatctacgagttccacttcagcgacctggagtgcaccgagctggacctggtgaagtgcggcatccagatgtactacgagctgggcgtggtgagaaagttccagatcccccaggaggtgctggtgagattcctgttcagcatcagcaagggctacagaagaatcacctaccacaactggagacacggcttcaacgtggcccagaccatgttcaccctgctgatgaccggcaagctgaagagctactacaccgacctggaggccttcgccatggtgaccgccggcctgtgccacgacatcgaccacagaggcaccaacaacctgtaccagatgaagagccagaaccccctggccaagctgcacggcagcagcatcctggagagacaccacctggagttcggcaagttcctgctgagcgaggagaccctgaacatctaccagaacctgaacagaagacagcacgagcacgtgatccacctgatggacatcgccatcatcgccaccgacctggccctgtacttcaagaagagagccatgttccagaagatcgtggacgagagcaagaactaccaggacaagaagagctgggtggagtacctgagcctggagaccaccagaaaggagatcgtgatggccatgatgatgaccgcctgcgacctgagcgccatcaccaagccctgggaggtgcagagcaaggtggccctgctggtggccgccgagttctgggagcagggcgacctggagagaaccgtgctggaccagcagcccatccccatgatggacagaaacaaggccgccgagctgcccaagctgcaggtgggcttcatcgacttcgtgtgcaccttcgtgtacaaggagttcagcagattccacgaggagatcctgcccatgttcgacagactgcagaacaacagaaaggagtggaaggccctggccgacgagtacgaggccaaggtgaaggccctggaggagaaggaggaggaggagagagtggccgccaagaaggtgggcaccgagatctgcaacggcggccccgcccccaagagcagcacctgctgcatcctgtag

SEQ ID NO: 93156 - DNA, 2577 bp, Artificial Sequence
  Description of Artificial Sequence: Synthetic coding sequence
atgggcgagatcaaccaggtggccgtggagaagtacctggaggagaacccccagttcgccaaggagtacttcgacagaaagctgagagtggaggtgctgggcgagatcttcaagaacagccaggtgcccgtgcagagcagcatgagcttcagcgagctgacccaggtggaggagagcgccctgtgcctggagctgctgtggaccgtgcaggaggagggcggcacccccgagcagggcgtgcacagagccctgcagagactggcccacctgctgcaggccgacagatgcagcatgttcctgtgcagaagcagaaacggcatccccgaggtggccagcagactgctggacgtgacccccaccagcaagttcgaggacaacctggtgggccccgacaaggaggtggtgttccccctggacatcggcatcgtgggctgggccgcccacaccaagaagacccacaacgtgcccgacgtgaagaagaacagccacttcagcgacttcatggacaagcagaccggctacgtgaccaagaacctgctggccacccccatcgtggtgggcaaggaggtgctggccgtgatcatggccgtgaacaaggtgaacgccagcgagttcagcaagcaggacgaggaggtgttcagcaagtacctgaacttcgtgagcatcatcctgagactgcaccacaccagctacatgtacaacatcgagagcagaagaagccagatcctgatgtggagcgccaacaaggtgttcgaggagctgaccgacgtggagagacagttccacaaggccctgtacaccgtgagaagctacctgaactgcgagagatacagcatcggcctgctggacatgaccaaggagaaggagttctacgacgagtggcccatcaagctgggcgaggtggagccctacaagggccccaagacccccgacggcagagaggtgaacttctacaagatcatcgactacatcctgcacggcaaggaggagatcaaggtgatccccaccccccccgccgaccactggaccctgatcagcggcctgcccacctacgtggccgagaacggcttcatctgcaacatgatgaacgcccccgccgacgagtacttcaccttccagaagggccccgtggacgagaccggctgggtgatcaagaacgtgctgagcctgcccatcgtgaacaagaaggaggacatcgtgggcgtggccaccttctacaacagaaaggacggcaagcccttcgacgagcacgacgagtacatcaccgagaccctgacccagttcctgggctggagcctgctgaacaccgacacctacgacaagatgaacaagctggagaacagaaaggacatcgcccaggagatgctgatgaaccagaccaaggccacccccgaggagatcaagagcatcctgaagttccaggagaagctgaacgtggacgtgatcgacgactgcgaggagaagcagctggtggccatcctgaaggaggacctgcccgaccccagaagcgccgagctgtacgagttcagattcagcgacttccccctgaccgagcacggcctgatcaagtgcggcatcagactgttcttcgagatcaacgtggtggagaagttcaaggtgcccgtggaggtgctgaccagatggatgtacaccgtgagaaagggctacagagccgtgacctaccacaactggagacacggcttcaacgtgggccagaccatgttcaccctgctgatgaccggcagactgaagaagtactacaccgacctggaggccttcgccatgctggccgccgccttctgccacgacatcgaccacagaggcaccaacaacctgtaccagatgaagagcaccagccccctggccagactgcacggcagcagcatcctggagagacaccacctggagtacagcaagaccctgctgcaggacgagagcctgaacatcttccagaacctgaacaagagacagttcgagaccgtgatccacctgttcgaggtggccatcatcgccaccgacctggccctgtacttcaagaagagaaccatgttccagaagatcgtggacgcctgcgagcagatgcagaccgaggaggaggccatcaagtacgtgaccgtggaccccaccaagaaggagatcatcatggccatgatgatgaccgcctgcgacctgagcgccatcaccaagccctgggaggtgcagagccaggtggccctgatggtggccaacgagttctgggagcagggcgacctggagagaaccgtgctgcagcagcagcccatccccatgatggacagaaacaagagagacgagctgcccaagctgcaggtgggcttcatcgacttcgtgtgcaccttcgtgtacaaggagttcagcagattccacaaggagatcacccccatgctgagcggcctgcagaacaacagagtggagtggaagagcctggccgacgagtacgacgccaagatgaaggtgatcgaggaggaggccaagaagcaggagggcggcgccgagaaggccgccgaggacagcggcggcggcgacgacaagaagagcaagacctgcctgatgctgtag

SEQ ID NO: 93157 - DNA, 453 bp, Artificial Sequence
  Description of Artificial Sequence: Synthetic coding sequence
atgagcgccaaggacgagagagccagagagatcctgagaggcttcaagctgaactggatgaacctgagagacgccgagaccggcaagatcctgtggcagggcaccgaggacctgagcgtgcccggcgtggagcacgaggccagagtgcccaagaagatcctgaagtgcaaggccgtgagcagagagctgaacttcagcagcaccgagcagatggagaagttcagactggagcagaaggtgtacttcaagggccagtgcctggaggagtggttcttcgagttcggcttcgtgatccccaacagcaccaacacctggcagagcctgatcgaggccgcccccgagagccagatgatgcccgccagcgtgctgaccggcaacgtgatcatcgagaccaagttcttcgacgacgacctgctggtgagcaccagcagagtgagactgttctacgtgtag

SEQ ID NO: 93158 - DNA, 414 bp, Artificial Sequence
  Description of Artificial Sequence: Synthetic coding sequence
atgaagcagagagacaagggcagaggctggcaccccgccgagggcggccccgccctgaccgcccagccccccgagaccagacccgccctggacagaagcagaagagagagcagaagccagggctgcagaggcgtgagcgtgagcctgaccatgaacctggagccccccaaggccgagttcagaagcgccaccagagtggccggcggccccgtgacccccagaaagggcccccccaagttcaagcagagacagaccagacagttcaagagcaagccccccaagaagggcgtgcagggcttcggcgacgacatccccggcatggagggcctgggcaccgacatcaccgtgatctgcccctgggaggccttcaaccacctggagctgcacgagctggcccagtacggcatcatctag

SEQ ID NO: 93159 - DNA, 264 bp, Artificial Sequence
  Description of Artificial Sequence: Synthetic coding sequence
atgaacctggagccccccaaggccgagttcagaagcgccaccagagtggccggcggccccgtgacccccagaaagggcccccccaagttcaagcagagacagaccagacagttcaagagcaagccccccaagaagggcgtgcagggcttcggcgacgacatccccggcatggagggcctgggcaccgacatcaccgtgatctgcccctgggaggccttcaaccacctggagctgcacgagctggcccagtacggcatcatctag

SEQ ID NO: 93160 - DNA, 252 bp, Artificial Sequence
  Description of Artificial Sequence: Synthetic coding sequence
atgagcgacaacaccaccctgcccgcccccgccagcaaccagggccccaccacccccagaaagggcccccccaagttcaagcagagacagaccagacagttcaagagcaagccccccaagaagggcgtgaagggcttcggcgacgacatccccggcatggagggcctgggcaccgacatcaccgtgatctgcccctgggaggccttcagccacctggagctgcacgagctggcccagttcggcatcatctag

SEQ ID NO: 93161 - DNA, 1371 bp, Artificial Sequence
  Description of Artificial Sequence: Synthetic coding sequence
atgggcatcaccctgatctggtgcctggccctggtgctgatcaagtggatcaccagcaagagaagaggcgccatcagctacgacagcagcgaccagaccgccctgtacatcagaatgctgggcgacgtgagagtgagaagcagagccggcttcgagagcgagagaagaggcagccacccctacatcgacttcagaatcttccacagccagagcgagatcgaggtgagcgtgagcgccagaaacatcagaagactgctgagcttccagagatacctgagaagcagcagattcttcagaggcaccgccgtgagcaacagcctgaacatcctggacgacgactacaacggccaggccaagtgcatgctggagaaggtgggcaactggaacttcgacatcttcctgttcgacagactgaccaacggcaacagcctggtgagcctgaccttccacctgttcagcctgcacggcctgatcgagtacttccacctggacatgatgaagctgagaagattcctggtgatgatccaggaggactaccacagccagaacccctaccacaacgccgtgcacgccgccgacgtgacccaggccatgcactgctacctgaaggagcccaagctggccaacagcgtgaccccctgggacatcctgctgagcctgatcgccgccgccacccacgacctggaccaccccggcgtgaaccagcccttcctgatcaagaccaaccactacctggccaccctgtacaagaacaccagcgtgctggagaaccaccactggagaagcgccgtgggcctgctgagagagagcggcctgttcagccacctgcccctggagagcagacagcagatggagacccagatcggcgccctgatcctggccaccgacatcagcagacagaacgagtacctgagcctgttcagaagccacctggacagaggcgacctgtgcctggaggacaccagacacagacacctggtgctgcagatggccctgaagtgcgccgacatctgcaacccctgcagaacctgggagctgagcaagcagtggagcgagaaggtgaccgaggagttcttccaccagggcgacatcgagaagaagtaccacctgggcgtgagccccctgtgcgacagacacaccgagagcatcgccaacatccagatcggcttcatgacctacctggtggagcccctgttcaccgagtgggccagattcagcaacaccagactgagccagaccatgctgggccacgtgggcctgaacaaggccagctggaagggcctgcagagagagcagagcagcagcgaggacaccgacgccgccttcgagctgaacagccagctgctgccccaggagaacagactgagctag

SEQ ID NO: 93162 - DNA, 1275 bp, Artificial Sequence
  Description of Artificial Sequence: Synthetic coding sequence
atggaggtgtgctaccagctgcccgtgctgcccctggacagacccgtgccccagcacgtgctgagcagaagaggcgccatcagcttcagcagcagcagcgccctgttcggctgccccaaccccagacagctgagccagagaagaggcgccatcagctacgacagcagcgaccagaccgccctgtacatcagaatgctgggcgacgtgagagtgagaagcagagccggcttcgagagcgagagaagaggcagccacccctacatcgacttcagaatcttccacagccagagcgagatcgaggtgagcgtgagcgccagaaacatcagaagactgctgagcttccagagatacctgagaagcagcagattcttcagaggcaccgccgtgagcaacagcctgaacatcctggacgacgactacaacggccaggccaagtgcatgctggagaaggtgggcaactggaacttcgacatcttcctgttcgacagactgaccaacggcaacagcctggtgagcctgaccttccacctgttcagcctgcacggcctgatcgagtacttccacctggacatgatgaagctgagaagattcctggtgatgatccaggaggactaccacagccagaacccctaccacaacgccgtgcacgccgccgacgtgacccaggccatgcactgctacctgaaggagcccaagctggccaacagcgtgaccccctgggacatcctgctgagcctgatcgccgccgccacccacgacctggaccaccccggcgtgaaccagcccttcctgatcaagaccaaccactacctggccaccctgtacaagaacaccagcgtgctggagaaccaccactggagaagcgccgtgggcctgctgagagagagcggcctgttcagccacctgcccctggagagcagacagcagatggagacccagatcggcgccctgatcctggccaccgacatcagcagacagaacgagtacctgagcctgttcagaagccacctggacagaggcgacctgtgcctggaggacaccagacacagacacctggtgctgcagatggccctgaagtgcgccgacatctgcaacccctgcagaacctgggagctgagcaagcagtggagcgagaaggtgaccgaggagttcttccaccagggcgacatcgagaagaagtaccacctgggcgtgagccccctgtgcgacagacacaccgagagcatcgccaacatccagatcggcaactacacctacctggacatcgccggctag

SEQ ID NO: 93163 - DNA, 1449 bp, Artificial Sequence
  Description of Artificial Sequence: Synthetic coding sequence
atggaggtgtgctaccagctgcccgtgctgcccctggacagacccgtgccccagcacgtgctgagcagaagaggcgccatcagcttcagcagcagcagcgccctgttcggctgccccaaccccagacagctgagccagagaagaggcgccatcagctacgacagcagcgaccagaccgccctgtacatcagaatgctgggcgacgtgagagtgagaagcagagccggcttcgagagcgagagaagaggcagccacccctacatcgacttcagaatcttccacagccagagcgagatcgaggtgagcgtgagcgccagaaacatcagaagactgctgagcttccagagatacctgagaagcagcagattcttcagaggcaccgccgtgagcaacagcctgaacatcctggacgacgactacaacggccaggccaagtgcatgctggagaaggtgggcaactggaacttcgacatcttcctgttcgacagactgaccaacggcaacagcctggtgagcctgaccttccacctgttcagcctgcacggcctgatcgagtacttccacctggacatgatgaagctgagaagattcctggtgatgatccaggaggactaccacagccagaacccctaccacaacgccgtgcacgccgccgacgtgacccaggccatgcactgctacctgaaggagcccaagctggccaacagcgtgaccccctgggacatcctgctgagcctgatcgccgccgccacccacgacctggaccaccccggcgtgaaccagcccttcctgatcaagaccaaccactacctggccaccctgtacaagaacaccagcgtgctggagaaccaccactggagaagcgccgtgggcctgctgagagagagcggcctgttcagccacctgcccctggagagcagacagcagatggagacccagatcggcgccctgatcctggccaccgacatcagcagacagaacgagtacctgagcctgttcagaagccacctggacagaggcgacctgtgcctggaggacaccagacacagacacctggtgctgcagatggccctgaagtgcgccgacatctgcaacccctgcagaacctgggagctgagcaagcagtggagcgagaaggtgaccgaggagttcttccaccagggcgacatcgagaagaagtaccacctgggcgtgagccccctgtgcgacagacacaccgagagcatcgccaacatccagatcggcttcatgacctacctggtggagcccctgttcaccgagtgggccagattcagcaacaccagactgagccagaccatgctgggccacgtgggcctgaacaaggccagctggaagggcctgcagagagagcagagcagcagcgaggacaccgacgccgccttcgagctgaacagccagctgctgccccaggagaacagactgagctag

SEQ ID NO: 93164 - DNA, 2490 bp, Artificial Sequence
  Description of Artificial Sequence: Synthetic coding sequence
atgggctgcgcccccagcatccacatcagcgagagactggtggccgaggacgcccccagccccgccgccccccccctgagcagcggcggccccagactgccccagggccagaagaccgccgccctgcccagaaccagaggcgccggcctgctggagagcgagctgagagacggcagcggcaagaaggtggccgtggccgacgtgcagttcggccccatgagattccaccaggaccagctgcaggtgctgctggtgttcaccaaggaggacaaccagtgcaacggcttctgcagagcctgcgagaaggccggcttcaagtgcaccgtgaccaaggaggcccaggccgtgctggcctgcttcctggacaagcaccacgacatcatcatcatcgaccacagaaaccccagacagctggacgccgaggccctgtgcagaagcatcagaagcagcaagctgagcgagaacaccgtgatcgtgggcgtggtgagaagagtggacagagaggagctgagcgtgatgcccttcatcagcgccggcttcaccagaagatacgtggagaaccccaacatcatggcctgctacaacgagctgctgcagctggagttcggcgaggtgagaagccagctgaagctgagagcctgcaacagcgtgttcaccgccctggagaacagcgaggacgccatcgagatcaccagcgaggacagattcatccagtacgccaaccccgccttcgagaccaccatgggctaccagagcggcgagctgatcggcaaggagctgggcgaggtgcccatcaacgagaagaaggccgacctgctggacaccatcaacagctgcatcagaatcggcaaggagtggcagggcatctactacgccaagaagaagaacggcgacaacatccagcagaacgtgaagatcatccccgtgatcggccagggcggcaagatcagacactacgtgagcatcatcagagtgtgcaacggcaacaacaaggccgagaagatcagcgagtgcgtgcagagcgacacccacaccgacaaccagaccggcaagcacaaggacagaagaaagggcagcctggacgtgaaggccgtggccagcagagccaccgaggtgagcagccagagaagacacagcagcatggccagaatccacagcatgaccatcgaggcccccatcaccaaggtgatcaacatcatcaacgccgcccaggagagcagccccatgcccgtgaccgaggccctggacagagtgctggagatcctgagaaccaccgagctgtacagcccccagttcggcgccaaggacgacgacccccacgccaacgacctggtgggcggcctgatgagcgacggcctgagaagactgagcggcaacgagtacgtgctgagcaccaagaacacccagatggtgagcagcaacatcatcacccccatcagcctggacgacgtgccccccagaatcgccagagccatggagaacgaggagtactgggacttcgacatcttcgagctggaggccgccacccacaacagacccctgatctacctgggcctgaagatgttcgccagattcggcatctgcgagttcctgcactgcagcgagagcaccctgagaagctggctgcagatcatcgaggccaactaccacagcagcaacccctaccacaacagcacccacagcgccgacgtgctgcacgccaccgcctacttcctgagcaaggagagaatcaaggagaccctggaccccatcgacgaggtggccgccctgatcgccgccaccatccacgacgtggaccaccccggcagaaccaacagcttcctgtgcaacgccggcagcgagctggccatcctgtacaacgacaccgccgtgctggagagccaccacgccgccctggccttccagctgaccaccggcgacgacaagtgcaacatcttcaagaacatggagagaaacgactacagaaccctgagacagggcatcatcgacatggtgctggccaccgagatgaccaagcacttcgagcacgtgaacaagttcgtgaacagcatcaacaagcccctggccaccctggaggagaacggcgagaccgacaagaaccaggaggtgatcaacaccatgctgagaacccccgagaacagaaccctgatcaagagaatgctgatcaagtgcgccgacgtgagcaacccctgcagacccctgcagtactgcatcgagtgggccgccagaatcagcgaggagtacttcagccagaccgacgaggagaagcagcagggcctgcccgtggtgatgcccgtgttcgacagaaacacctgcagcatccccaagagccagatcagcttcatcgactacttcatcaccgacatgttcgacgcctgggacgccttcgtggacctgcccgacctgatgcagcacctggacaacaacttcaagtactggaagggcctggacgagatgaagctgagaaacctgagacccccccccgagtag

SEQ ID NO: 93165 - DNA, 2352 bp, Artificial Sequence
  Description of Artificial Sequence: Synthetic coding sequence
atgggctgcgcccccagcatccacatcagcgagagactggtggccgaggacgcccccagccccgccgccccccccctgagcagcggcggccccagactgccccagggccagaagaccgccgccctgcccagaaccagaggcgccggcctgctggagagcgagctgagagacggcagcggcaagaaggtggccgtggccgacgtgcagttcggccccatgagattccaccaggaccagctgcaggtgctgctggtgttcaccaaggaggacaaccagtgcaacggcttctgcagagcctgcgagaaggccggcttcaagtgcaccgtgaccaaggaggcccaggccgtgctggcctgcttcctggacaagcaccacgacatcatcatcatcgaccacagaaaccccagacagctggacgccgaggccctgtgcagaagcatcagaagcagcaagctgagcgagaacaccgtgatcgtgggcgtggtgagaagagtggacagagaggagctgagcgtgatgcccttcatcagcgccggcttcaccagaagatacgtggagaaccccaacatcatggcctgctacaacgagctgctgcagctggagttcggcgaggtgagaagccagctgaagctgagagcctgcaacagcgtgttcaccgccctggagaacagcgaggacgccatcgagatcaccagcgaggacagattcatccaggagtggcagggcatctactacgccaagaagaagaacggcgacaacatccagcagaacgtgaagatcatccccgtgatcggccagggcggcaagatcagacactacgtgagcatcatcagagtgtgcaacggcaacaacaaggccgagaagatcagcgagtgcgtgcagagcgacacccacaccgacaaccagaccggcaagcacaaggacagaagaaagggcagcctggacgtgaaggccgtggccagcagagccaccgaggtgagcagccagagaagacacagcagcatggccagaatccacagcatgaccatcgaggcccccatcaccaaggtgatcaacatcatcaacgccgcccaggagagcagccccatgcccgtgaccgaggccctggacagagtgctggagatcctgagaaccaccgagctgtacagcccccagttcggcgccaaggacgacgacccccacgccaacgacctggtgggcggcctgatgagcgacggcctgagaagactgagcggcaacgagtacgtgctgagcaccaagaacacccagatggtgagcagcaacatcatcacccccatcagcctggacgacgtgccccccagaatcgccagagccatggagaacgaggagtactgggacttcgacatcttcgagctggaggccgccacccacaacagacccctgatctacctgggcctgaagatgttcgccagattcggcatctgcgagttcctgcactgcagcgagagcaccctgagaagctggctgcagatcatcgaggccaactaccacagcagcaacccctaccacaacagcacccacagcgccgacgtgctgcacgccaccgcctacttcctgagcaaggagagaatcaaggagaccctggaccccatcgacgaggtggccgccctgatcgccgccaccatccacgacgtggaccaccccggcagaaccaacagcttcctgtgcaacgccggcagcgagctggccatcctgtacaacgacaccgccgtgctggagagccaccacgccgccctggccttccagctgaccaccggcgacgacaagtgcaacatcttcaagaacatggagagaaacgactacagaaccctgagacagggcatcatcgacatggtgctggccaccgagatgaccaagcacttcgagcacgtgaacaagttcgtgaacagcatcaacaagcccctggccaccctggaggagaacggcgagaccgacaagaaccaggaggtgatcaacaccatgctgagaacccccgagaacagaaccctgatcaagagaatgctgatcaagtgcgccgacgtgagcaacccctgcagacccctgcagtactgcatcgagtgggccgccagaatcagcgaggagtacttcagccagaccgacgaggagaagcagcagggcctgcccgtggtgatgcccgtgttcgacagaaacacctgcagcatccccaagagccagatcagcttcatcgactacttcatcaccgacatgttcgacgcctgggacgccttcgtggacctgcccgacctgatgcagcacctggacaacaacttcaagtactggaagggcctggacgagatgaagctgagaaacctgagacccccccccgagtag

SEQ ID NO: 93166 - DNA, 2490 bp, Artificial Sequence; identical to SEQ ID NO: 93164
  Description of Artificial Sequence: Synthetic coding sequence

SEQ ID NO: 93167 - DNA, 2274 bp, Artificial Sequence
  Description of Artificial Sequence: Synthetic coding sequence
atgagattccaccaggaccagctgcaggtgctgctggtgttcaccaaggaggacaaccagtgcaacggcttctgcagagcctgcgagaaggccggcttcaagtgcaccgtgaccaaggaggcccaggccgtgctggcctgcttcctggacaagcaccacgacatcatcatcatcgaccacagaaaccccagacagctggacgccgaggccctgtgcagaagcatcagaagcagcaagctgagcgagaacaccgtgatcgtgggcgtggtgagaagagtggacagagaggagctgagcgtgatgcccttcatcagcgccggcttcaccagaagatacgtggagaaccccaacatcatggcctgctacaacgagctgctgcagctggagttcggcgaggtgagaagccagctgaagctgagagcctgcaacagcgtgttcaccgccctggagaacagcgaggacgccatcgagatcaccagcgaggacagattcatccagtacgccaaccccgccttcgagaccaccatgggctaccagagcggcgagctgatcggcaaggagctgggcgaggtgcccatcaacgagaagaaggccgacctgctggacaccatcaacagctgcatcagaatcggcaaggagtggcagggcatctactacgccaagaagaagaacggcgacaacatccagcagaacgtgaagatcatccccgtgatcggccagggcggcaagatcagacactacgtgagcatcatcagagtgtgcaacggcaacaacaaggccgagaagatcagcgagtgcgtgcagagcgacacccacaccgacaaccagaccggcaagcacaaggacagaagaaagggcagcctggacgtgaaggccgtggccagcagagccaccgaggtgagcagccagagaagacacagcagcatggccagaatccacagcatgaccatcgaggcccccatcaccaaggtgatcaacatcatcaacgccgcccaggagagcagccccatgcccgtgaccgaggccctggacagagtgctggagatcctgagaaccaccgagctgtacagcccccagttcggcgccaaggacgacgacccccacgccaacgacctggtgggcggcctgatgagcgacggcctgagaagactgagcggcaacgagtacgtgctgagcaccaagaacacccagatggtgagcagcaacatcatcacccccatcagcctggacgacgtgccccccagaatcgccagagccatggagaacgaggagtactgggacttcgacatcttcgagctggaggccgccacccacaacagacccctgatctacctgggcctgaagatgttcgccagattcggcatctgcgagttcctgcactgcagcgagagcaccctgagaagctggctgcagatcatcgaggccaactaccacagcagcaacccctaccacaacagcacccacagcgccgacgtgctgcacgccaccgcctacttcctgagcaaggagagaatcaaggagaccctggaccccatcgacgaggtggccgccctgatcgccgccaccatccacgacgtggaccaccccggcagaaccaacagcttcctgtgcaacgccggcagcgagctggccatcctgtacaacgacaccgccgtgctggagagccaccacgccgccctggccttccagctgaccaccggcgacgacaagtgcaacatcttcaagaacatggagagaaacgactacagaaccctgagacagggcatcatcgacatggtgctggccaccgagatgaccaagcacttcgagcacgtgaacaagttcgtgaacagcatcaacaagcccctggccaccctggaggagaacggcgagaccgacaagaaccaggaggtgatcaacaccatgctgagaacccccgagaacagaaccctgatcaagagaatgctgatcaagtgcgccgacgtgagcaacccctgcagacccctgcagtactgcatcgagtgggccgccagaatcagcgaggagtacttcagccagaccgacgaggagaagcagcagggcctgcccgtggtgatgcccgtgttcgacagaaacacctgcagcatccccaagagccagatcagcttcatcgactacttcatcaccgacatgttcgacgcctgggacgccttcgtggacctgcccgacctgatgcagcacctggacaacaacttcaagtactggaagggcctggacgagatgaagctgagaaacctgagacccccccccgagtag

SEQ ID NO: 93168 - DNA, 2658 bp, Artificial Sequence
  Description of Artificial Sequence: Synthetic coding sequence
atgggctgcgcccccagcatccacgtgagccagagcggcgtgatctactgcagagacagcgacgagagcagcagccccagacagaccaccagcgtgagccagggccccgccgcccccctgcccggcctgttcgtgcagaccgacgccgccgacgccatcccccccagcagagccagcggcccccccagcgtggccagagtgagaagagccagaaccgagctgggcagcggcagcagcgccggcagcgccgcccccgccgccaccaccagcagaggcagaagaagacactgctgcagcagcgccgaggccgagacccagacctgctacaccagcgtgaagcaggtgagcagcgccgaggtgagaatcggccccatgagactgacccaggaccccatccaggtgctgctgatcttcgccaaggaggacagccagagcgacggcttctggtgggcctgcgacagagccggctacagatgcaacatcgccagaacccccgagagcgccctggagtgcttcctggacaagcaccacgagatcatcgtgatcgaccacagacagacccagaacttcgacgccgaggccgtgtgcagaagcatcagagccaccaaccccagcgagcacaccgtgatcctggccgtggtgagcagagtgagcgacgaccacgaggaggccagcgtgctgcccctgctgcacgccggcttcaacagaagattcatggagaacagcagcatcatcgcctgctacaacgagctgatccagatcgagcacggcgaggtgagaagccagttcaagctgagagcctgcaacagcgtgttcaccgccctggaccactgccacgaggccatcgagatcaccagcgacgaccacgtgatccagtacgtgaaccccgccttcgagagaatgatgggctaccacaagggcgagctgctgggcaaggagctggccgacctgcccaagagcgacaagaacagagccgacctgctggacaccatcaacacctgcatcaagaagggcaaggagtggcagggcgtgtactacgccagaagaaagagcggcgacagcatccagcagcacgtgaagatcacccccgtgatcggccagggcggcaagatcagacacttcgtgagcctgaagaagctgtgctgcaccaccgacaacaacaagcagatccacaagatccacagagacagcggcgacaacagccagaccgagccccacagcttcagatacaagaacagaagaaaggagagcatcgacgtgaagagcatcagcagcagaggcagcgacgcccccagcctgcagaacagaagataccccagcatggccagaatccacagcatgaccatcgaggcccccatcaccaaggtgatcaacatcatcaacgccgcccaggagaacagccccgtgaccgtggccgaggccctggacagagtgctggagatcctgagaaccaccgagctgtacagcccccagctgggcaccaaggacgaggacccccacaccagcgacctggtgggcggcctgatgaccgacggcctgagaagactgagcggcaacgagtacgtgttcaccaagaacgtgcaccagagccacagccacctggccatgcccatcaccatcaacgacgtgcccccctgcatcagccagctgctggacaacgaggagagctgggacttcaacatcttcgagctggaggccatcacccacaagagacccctggtgtacctgggcctgaaggtgttcagcagattcggcgtgtgcgagttcctgaactgcagcgagaccaccctgagagcctggttccaggtgatcgaggccaactaccacagcagcaacgcctaccacaacagcacccacgccgccgacgtgctgcacgccaccgccttcttcctgggcaaggagagagtgaagggcagcctggaccagctggacgaggtggccgccctgatcgccgccaccgtgcacgacgtggaccaccccggcagaaccaacagcttcctgtgcaacgccggcagcgagctggccgtgctgtacaacgacaccgccgtgctggagagccaccacaccgccctggccttccagctgaccgtgaaggacaccaagtgcaacatcttcaagaacatcgacagaaaccactacagaaccctgagacaggccatcatcgacatggtgctggccaccgagatgaccaagcacttcgagcacgtgaacaagttcgtgaacagcatcaacaagcccatggccgccgagatcgagggcagcgactgcgagtgcaaccccgccggcaagaacttccccgagaaccagatcctgatcaagagaatgatgatcaagtgcgccgacgtggccaacccctgcagacccctggacctgtgcatcgagtgggccggcagaatcagcgaggagtacttcgcccagaccgacgaggagaagagacagggcctgcccgtggtgatgcccgtgttcgacagaaacacctgcagcatccccaagagccagatcagcttcatcgactacttcatcaccgacatgttcgacgcctgggacgccttcgcccacctgcccgccctgatgcagcacctggccgacaactacaagcactggaagaccctggacgacctgaagtgcaagagcctgagactgcccagcgacagctag

SEQ ID NO: 93169 - DNA, 2493 bp, Artificial Sequence
  Description of Artificial Sequence: Synthetic coding sequence
atgggctgcgcccccagcatccacgtgagccagagcggcgtgatctactgcagagacagcgacgagagcagcagccccagacagaccaccagcgtgagccagggccccgccgcccccctgcccggcctgttcgtgcagaccgacgccgccgacgccatcccccccagcagagccagcggcccccccagcgtggccagagtgagaagagccagaaccgagctgggcagcggcagcagcgccggcagcgccgcccccgccgccaccaccagcagaggcagaagaagacactgctgcagcagcgccgaggccgagacccagacctgctacaccagcgtgaagcaggtgagcagcgccgaggtgagaatcggccccatgagactgacccaggaccccatccaggtgctgctgatcttcgccaaggaggacagccagagcgacggcttctggtgggcctgcgacagagccggctacagatgcaacatcgccagaacccccgagagcgccctggagtgcttcctggacaagcaccacgagatcatcgtgatcgaccacagacagacccagaacttcgacgccgaggccgtgtgcagaagcatcagagccaccaaccccagcgagcacaccgtgatcctggccgtggtgagcagagtgagcgacgaccacgaggaggccagcgtgctgcccctgctgcacgccggcttcaacagaagattcatggagaacagcagcatcatcgcctgctacaacgagctgatccagatcgagcacggcgaggtgagaagccagttcaagctgagagcctgcaacagcgtgttcaccgccctggaccactgccacgaggccatcgagatcaccagcgacgaccacgtgatccagtacgtgaaccccgccttcgagagaatgatgggctaccacaagggcgagctgctgggcaaggagctggccgacctgcccaagagcgacaagaacagagccgacctgctggacaccatcaacacctgcatcaagaagggcaaggagtggcagggcgtgtactacgccagaagaaagagcggcgacagcatccagcagcacgtgaagatcacccccgtgatcggccagggcggcaagatcagacacttcgtgagcctgaagaagctgtgctgcaccaccgacaacaacaagcagatccacaagatccacagagacagcggcgacaacagccagaccgagccccacagcttcagatacaagaacagaagaaaggagagcatcgacgtgaagagcatcagcagcagaggcagcgacgcccccagcctgcagaacagaagataccccagcatggccagaatccacagcatgaccatcgaggcccccatcaccaaggacggcctgagaagactgagcggcaacgagtacgtgttcaccaagaacgtgcaccagagccacagccacctggccatgcccatcaccatcaacgacgtgcccccctgcatcagccagctgctggacaacgaggagagctgggacttcaacatcttcgagctggaggccatcacccacaagagacccctggtgtacctgggcctgaaggtgttcagcagattcggcgtgtgcgagttcctgaactgcagcgagaccaccctgagagcctggttccaggtgatcgaggccaactaccacagcagcaacgcctaccacaacagcacccacgccgccgacgtgctgcacgccaccgccttcttcctgggcaaggagagagtgaagggcagcctggaccagctggacgaggtggccgccctgatcgccgccaccgtgcacgacgtggaccaccccggcagaaccaacagcttcctgtgcaacgccggcagcgagctggccgtgctgtacaacgacaccgccgtgctggagagccaccacaccgccctggccttccagctgaccgtgaaggacaccaagtgcaacatcttcaagaacatcgacagaaaccactacagaaccctgagacaggccatcatcgacatggtgctggccaccgagatgaccaagcacttcgagcacgtgaacaagttcgtgaacagcatcaacaagcccatggccgccgagatcgagggcagcgactgcgagtgcaaccccgccggcaagaacttccccgagaaccagatcctgatcaagagaatgatgatcaagtgcgccgacgtggccaacccctgcagacccctggacctgtgcatcgagtgggccggcagaatcagcgaggagtacttcgcccagaccgacgaggagaagagacagggcctgcccgtggtgatgcccgtgttcgacagaaacacctgcagcatccccaagagccagatcagcttcatcgactacttcatcaccgacatgttcgacgcctgggacgccttcgcccacctgcccgccctgatgcagcacctggccgacaactacaagcactggaagaccctggacgacctgaagtgcaagagcctgagactgcccagcgacagctag

SEQ ID NO: 93170 - DNA, 2517 bp, Artificial Sequence
  Description of Artificial Sequence: Synthetic coding sequence
atgggctgcgcccccagcatccacgtgagccagagcggcgtgatctactgcagagacagcgacgagagcagcagccccagacagaccaccagcgtgagccagggccccgccgcccccctgcccggcctgttcgtgcagaccgacgccgccgacgccatcccccccagcagagccagcggcccccccagcgtggccagagtgagaagagccagaaccgagctgggcagcggcagcagcgccggcagcgccgcccccgccgccaccaccagcagaggcagaagaagacactgctgcagcagcgccgaggccgagacccagacctgctacaccagcgtgaagcaggtgagcagcgccgaggtgagaatcggccccatgagactgacccaggaccccatccaggtgctgctgatcttcgccaaggaggacagccagagcgacggcttctggtgggcctgcgacagagccggctacagatgcaacatcgccagaacccccgagagcgccctggagtgcttcctggacaagcaccacgagatcatcgtgatcgaccacagacagacccagaacttcgacgccgaggccgtgtgcagaagcatcagagccaccaaccccagcgagcacaccgtgatcctggccgtggtgagcagagtgagcgacgaccacgaggaggccagcgtgctgcccctgctgcacgccggcttcaacagaagattcatggagaacagcagcatcatcgcctgctacaacgagctgatccagatcgagcacggcgaggtgagaagccagttcaagctgagagcctgcaacagcgtgttcaccgccctggaccactgccacgaggccatcgagatcaccagcgacgaccacgtgatccaggagtggcagggcgtgtactacgccagaagaaagagcggcgacagcatccagcagcacgtgaagatcacccccgtgatcggccagggcggcaagatcagacacttcgtgagcctgaagaagctgtgctgcaccaccgacaacaacaagcagatccacaagatccacagagacagcggcgacaacagccagaccgagccccacagcttcagatacaagaacagaagaaaggagagcatcgacgtgaagagcatcagcagcagaggcagcgacgcccccagcctgcagaacagaagataccccagcatggccagaatccacagcatgaccatcgaggcccccatcaccaaggtgatcaacatcatcaacgccgcccaggagaacagccccgtgaccgtggccgaggccctggacagagtgctggagatcctgagaaccaccgagctgtacagcccccagctgggcaccaaggacgaggacccccacaccagcgacctggtgggcggcctgatgaccgacggcctgagaagactgagcggcaacgagtacgtgttcaccaagaacgtgcaccagagccacagccacctggccatgcccatcaccatcaacgacgtgcccccctgcatcagccagctgctggacaacgaggagagctgggacttcaacatcttcgagctggaggccatcacccacaagagacccctggtgtacctgggcctgaaggtgttcagcagattcggcgtgtgcgagttcctgaactgcagcgagaccaccctgagagcctggttccaggtgatcgaggccaactaccacagcagcaacgcctaccacaacagcacccacgccgccgacgtgctgcacgccaccgccttcttcctgggcaaggagagagtgaagggcagcctggaccagctggacgaggtggccgccctgatcgccgccaccgtgcacgacgtggaccaccccggcagaaccaacagcttcctgtgcaacgccggcagcgagctggccgtgctgtacaacgacaccgccgtgctggagagccaccacaccgccctggccttccagctgaccgtgaaggacaccaagtgcaacatcttcaagaacatcgacagaaaccactacagaaccctgagacaggccatcatcgacatggtgctggccaccgagatgaccaagcacttcgagcacgtgaacaagttcgtgaacagcatcaacaagcccatggccgccgagatcgagggcagcgactgcgagtgcaaccccgccggcaagaacttccccgagaaccagatcctgatcaagagaatgatgatcaagtgcgccgacgtggccaacccctgcagacccctggacctgtgcatcgagtgggccggcagaatcagcgaggagtacttcgcccagaccgacgaggagaagagacagggcctgcccgtggtgatgcccgtgttcgacagaaacacctgcagcatccccaagagccagatcagcttcatcgactacttcatcaccgacatgttcgacgcctgggacgccttcgcccacctgcccgccctgatgcagcacctggccgacaactacaagcactggaagaccctggacgacctgaagtgcaagagcctgagactgcccagcgacagctag

SEQ ID NO: 93171 - DNA, 2598 bp, Artificial Sequence
  Description of Artificial Sequence: Synthetic coding sequence
atgggctgcgcccccagcatccacgtgagccagagcggcgtgatctactgcagagacagcgacgagagcagcagccccagacagaccaccagcgtgagccagggccccgccgcccccctgcccggcctgttcgtgcagaccgacgccgccgacgccatcccccccagcagagccagcggcccccccagcgtggccagagtgagaagagccagaaccgagctgggcagcggcagcagcgccggcagcgccgcccccgccgccaccaccagcagaggcagaagaagacactgctgcagcagcgccgaggccgagacccagacctgctacaccagcgtgaaggtgctgctgatcttcgccaaggaggacagccagagcgacggcttctggtgggcctgcgacagagccggctacagatgcaacatcgccagaacccccgagagcgccctggagtgcttcctggacaagcaccacgagatcatcgtgatcgaccacagacagacccagaacttcgacgccgaggccgtgtgcagaagcatcagagccaccaaccccagcgagcacaccgtgatcctggccgtggtgagcagagtgagcgacgaccacgaggaggccagcgtgctgcccctgctgcacgccggcttcaacagaagattcatggagaacagcagcatcatcgcctgctacaacgagctgatccagatcgagcacggcgaggtgagaagccagttcaagctgagagcctgcaacagcgtgttcaccgccctggaccactgccacgaggccatcgagatcaccagcgacgaccacgtgatccagtacgtgaaccccgccttcgagagaatgatgggctaccacaagggcgagctgctgggcaaggagctggccgacctgcccaagagcgacaagaacagagccgacctgctggacaccatcaacacctgcatcaagaagggcaaggagtggcagggcgtgtactacgccagaagaaagagcggcgacagcatccagcagcacgtgaagatcacccccgtgatcggccagggcggcaagatcagacacttcgtgagcctgaagaagctgtgctgcaccaccgacaacaacaagcagatccacaagatccacagagacagcggcgacaacagccagaccgagccccacagcttcagatacaagaacagaagaaaggagagcatcgacgtgaagagcatcagcagcagaggcagcgacgcccccagcctgcagaacagaagataccccagcatggccagaatccacagcatgaccatcgaggcccccatcaccaaggtgatcaacatcatcaacgccgcccaggagaacagccccgtgaccgtggccgaggccctggacagagtgctggagatcctgagaaccaccgagctgtacagcccccagctgggcaccaaggacgaggacccccacaccagcgacctggtgggcggcctgatgaccgacggcctgagaagactgagcggcaacgagtacgtgttcaccaagaacgtgcaccagagccacagccacctggccatgcccatcaccatcaacgacgtgcccccctgcatcagccagctgctggacaacgaggagagctgggacttcaacatcttcgagctggaggccatcacccacaagagacccctggtgtacctgggcctgaaggtgttcagcagattcggcgtgtgcgagttcctgaactgcagcgagaccaccctgagagcctggttccaggtgatcgaggccaactaccacagcagcaacgcctaccacaacagcacccacgccgccgacgtgctgcacgccaccgccttcttcctgggcaaggagagagtgaagggcagcctggaccagctggacgaggtggccgccctgatcgccgccaccgtgcacgacgtggaccaccccggcagaaccaacagcttcctgtgcaacgccggcagcgagctggccgtgctgtacaacgacaccgccgtgctggagagccaccacaccgccctggccttccagctgaccgtgaaggacaccaagtgcaacatcttcaagaacatcgacagaaaccactacagaaccctgagacaggccatcatcgacatggtgctggccaccgagatgaccaagcacttcgagcacgtgaacaagttcgtgaacagcatcaacaagcccatggccgccgagatcgagggcagcgactgcgagtgcaaccccgccggcaagaacttccccgagaaccagatcctgatcaagagaatgatgatcaagtgcgccgacgtggccaacccctgcagacccctggacctgtgcatcgagtgggccggcagaatcagcgaggagtacttcgcccagaccgacgaggagaagagacagggcctgcccgtggtgatgcccgtgttcgacagaaacacctgcagcatccccaagagccagatcagcttcatcgactacttcatcaccgacatgttcgacgcctgggacgccttcgcccacctgcccgccctgatgcagcacctggccgacaactacaagcactggaagaccctggacgacctgaagtgcaagagcctgagactgcccagcgacagctag

SEQ ID NO: 93172 - DNA, 2367 bp, Artificial Sequence
  Description of Artificial Sequence: Synthetic coding sequence
atgggctgcgcccccagcatccacgtgagccagagcggcgtgatctactgcagagacagcgacgagagcagcagccccagacagaccaccagcgtgagccagggccccgccgcccccctgcccggcctgttcgtgcagaccgacgccgccgacgccatcccccccagcagagccagcggcccccccagcgtggccagagtgagaagagccagaaccgagctgggcagcggcagcagcgccggcagcgccgcccccgccgccaccaccagcagaggcagaagaagacactgctgcagcagcgccgaggccgagacccagacctgctacaccagcgtgaagcaggtgagcagcgccgaggtgagaatcggccccatgagactgacccaggaccccatccaggtgctgctgatcttcgccaaggaggacagccagagcgacggcttctggtgggcctgcgacagagccggctacagatgcaacatcgccagaacccccgagagcgccctggagtgcttcctggacaagcaccacgagatcatcgtgatcgaccacagacagacccagaacttcgacgccgaggccgtgtgcagaagcatcagagccaccaaccccagcgagcacaccgtgatcctggccgtggtgagcagagtgagcgacgaccacgaggaggccagcgtgctgcccctgctgcacgccggcttcaacagaagattcatggagaacagcagcatcatcgcctgctacaacgagctgatccagatcgagcacggcgaggtgagaagccagttcaagctgagagcctgcaacagcgtgttcaccgccctggaccactgccacgaggccatcgagatcaccagcgacgaccacgtgatccagatccacaagatccacagagacagcggcgacaacagccagaccgagccccacagcttcagatacaagaacagaagaaaggagagcatcgacgtgaagagcatcagcagcagaggcagcgacgcccccagcctgcagaacagaagataccccagcatggccagaatccacagcatgaccatcgaggcccccatcaccaaggtgatcaacatcatcaacgccgcccaggagaacagccccgtgaccgtggccgaggccctggacagagtgctggagatcctgagaaccaccgagctgtacagcccccagctgggcaccaaggacgaggacccccacaccagcgacctggtgggcggcctgatgaccgacggcctgagaagactgagcggcaacgagtacgtgttcaccaagaacgtgcaccagagccacagccacctggccatgcccatcaccatcaacgacgtgcccccctgcatcagccagctgctggacaacgaggagagctgggacttcaacatcttcgagctggaggccatcacccacaagagacccctggtgtacctgggcctgaaggtgttcagcagattcggcgtgtgcgagttcctgaactgcagcgagaccaccctgagagcctggttccaggtgatcgaggccaactaccacagcagcaacgcctaccacaacagcacccacgccgccgacgtgctgcacgccaccgccttcttcctgggcaaggagagagtgaagggcagcctggaccagctggacgaggtggccgccctgatcgccgccaccgtgcacgacgtggaccaccccggcagaaccaacagcttcctgtgcaacgccggcagcgagctggccgtgctgtacaacgacaccgccgtgctggagagccaccacaccgccctggccttccagctgaccgtgaaggacaccaagtgcaacatcttcaagaacatcgacagaaaccactacagaaccctgagacaggccatcatcgacatggtgctggccaccgagatgaccaagcacttcgagcacgtgaacaagttcgtgaacagcatcaacaagcccatggccgccgagatcgagggcagcgactgcgagtgcaaccccgccggcaagaacttccccgagaaccagatcctgatcaagagaatgatgatcaagtgcgccgacgtggccaacccctgcagacccctggacctgtgcatcgagtgggccggcagaatcagcgaggagtacttcgcccagaccgacgaggagaagagacagggcctgcccgtggtgatgcccgtgttcgacagaaacacctgcagcatccccaagagccagatcagcttcatcgactacttcatcaccgacatgttcgacgcctgggacgccttcgcccacctgcccgccctgatgcagcacctggccgacaactacaagcactggaagaccctggacgacctgaagtgcaagagcctgagactgcccagcgacagctag

SEQ ID NO: 93173 - DNA, 1053 bp, Artificial Sequence
  Description of Artificial Sequence: Synthetic coding sequence
atgcccatcaccatcaacgacgtgcccccctgcatcagccagctgctggacaacgaggagagctgggacttcaacatcttcgagctggaggccatcacccacaagagacccctggtgtacctgggcctgaaggtgttcagcagattcggcgtgtgcgagttcctgaactgcagcgagaccaccctgagagcctggttccaggtgatcgaggccaactaccacagcagcaacgcctaccacaacagcacccacgccgccgacgtgctgcacgccaccgccttcttcctgggcaaggagagagtgaagggcagcctggaccagctggacgaggtggccgccctgatcgccgccaccgtgcacgacgtggaccaccccggcagaaccaacagcttcctgtgcaacgccggcagcgagctggccgtgctgtacaacgacaccgccgtgctggagagccaccacaccgccctggccttccagctgaccgtgaaggacaccaagtgcaacatcttcaagaacatcgacagaaaccactacagaaccctgagacaggccatcatcgacatggtgctggccaccgagatgaccaagcacttcgagcacgtgaacaagttcgtgaacagcatcaacaagcccatggccgccgagatcgagggcagcgactgcgagtgcaaccccgccggcaagaacttccccgagaaccagatcctgatcaagagaatgatgatcaagtgcgccgacgtggccaacccctgcagacccctggacctgtgcatcgagtgggccggcagaatcagcgaggagtacttcgcccagaccgacgaggagaagagacagggcctgcccgtggtgatgcccgtgttcgacagaaacacctgcagcatccccaagagccagatcagcttcatcgactacttcatcaccgacatgttcgacgcctgggacgccttcgcccacctgcccgccctgatgcagcacctggccgacaactacaagcactggaagaccctggacgacctgaagtgcaagagcctgagactgcccagcgacagctag

SEQ ID NO: 93174 - DNA, 1782 bp, Artificial Sequence
  Description of Artificial Sequence: Synthetic coding sequence
atgggcagcggcagcagcagctacagacccaaggccatctacctggacatcgacggcagaatccagaaggtgatcttcagcaagtactgcaacagcagcgacatcatggacctgttctgcatcgccaccggcctgcccagaaacaccaccatcagcctgctgaccaccgacgacgccatggtgagcatcgaccccaccatgcccgccaacagcgagagaaccccctacaaggtgagacccgtggccatcaagcagctgagcgccggcgtggaggacaagagaaccaccagcagaggccagagcgccgagagacccctgagagacagaagagtggtgggcctggagcagcccagaagagagggcgccttcgagagcggccaggtggagcccagacccagagagccccagggctgctaccaggagggccagagaatcccccccgagagagaggagctgatccagagcgtgctggcccaggtggccgagcagttcagcagagccttcaagatcaacgagctgaaggccgaggtggccaaccacctggccgtgctggagaagagagtggagctggagggcctgaaggtggtggagatcgagaagtgcaagagcgacatcaagaagatgagagaggagctggccgccagaagcagcagaaccaactgcccctgcaagtacagcttcctggacaaccacaagaagctgacccccagaagagacgtgcccacctaccccaagtacctgctgagccccgagaccatcgaggccctgagaaagcccaccttcgacgtgtggctgtgggagcccaacgagatgctgagctgcctggagcacatgtaccacgacctgggcctggtgagagacttcagcatcaaccccgtgaccctgagaagatggctgttctgcgtgcacgacaactacagaaacaaccccttccacaacttcagacactgcttctgcgtggcccagatgatgtacagcatggtgtggctgtgcagcctgcaggagaagttcagccagaccgacatcctgatcctgatgaccgccgccatctgccacgacctggaccaccccggctacaacaacacctaccagatcaacgccagaaccgagctggccgtgagatacaacgacatcagccccctggagaaccaccactgcgccgtggccttccagatcctggccgagcccgagtgcaacatcttcagcaacatcccccccgacggcttcaagcagatcagacagggcatgatcaccctgatcctggccaccgacatggccagacacgccgagatcatggacagcttcaaggagaagatggagaacttcgactacagcaacgaggagcacatgaccctgctgaagatgatcctgatcaagtgctgcgacatcagcaacgaggtgagacccatggaggtggccgagccctgggtggactgcctgctggaggagtacttcatgcagagcgacagagagaagagcgagggcctgcccgtggcccccttcatggacagagacaaggtgaccaaggccaccgcccagatcggcttcatcaagttcgtgctgatccccatgttcgagaccgtgaccaagctgttccccatggtggaggagatcatgctgcagcccctgtgggagagcagagacagatacgaggagctgaagagaatcgacgacgccatgaaggagctgcagaagaagaccgacagcctgaccagcggcgccaccgagaagagcagagagagaagcagagacgtgaagaacagcgagggcgactgcgcctag

SEQ ID NO: 93175 - DNA, 1704 bp, Artificial Sequence
  Description of Artificial Sequence: Synthetic coding sequence
atgggcagcggcagcagcagctacagacccaaggccatctacctggacatcgacggcagaatccagaaggtgatcttcagcaagtactgcaacagcagcgacatcatggacctgttctgcatcgccaccggcctgcccagaaccccctacaaggtgagacccgtggccatcaagcagctgagcgccggcgtggaggacaagagaaccaccagcagaggccagagcgccgagagacccctgagagacagaagagtggtgggcctggagcagcccagaagagagggcgccttcgagagcggccaggtggagcccagacccagagagccccagggctgctaccaggagggccagagaatcccccccgagagagaggagctgatccagagcgtgctggcccaggtggccgagcagttcagcagagccttcaagatcaacgagctgaaggccgaggtggccaaccacctggccgtgctggagaagagagtggagctggagggcctgaaggtggtggagatcgagaagtgcaagagcgacatcaagaagatgagagaggagctggccgccagaagcagcagaaccaactgcccctgcaagtacagcttcctggacaaccacaagaagctgacccccagaagagacgtgcccacctaccccaagtacctgctgagccccgagaccatcgaggccctgagaaagcccaccttcgacgtgtggctgtgggagcccaacgagatgctgagctgcctggagcacatgtaccacgacctgggcctggtgagagacttcagcatcaaccccgtgaccctgagaagatggctgttctgcgtgcacgacaactacagaaacaaccccttccacaacttcagacactgcttctgcgtggcccagatgatgtacagcatggtgtggctgtgcagcctgcaggagaagttcagccagaccgacatcctgatcctgatgaccgccgccatctgccacgacctggaccaccccggctacaacaacacctaccagatcaacgccagaaccgagctggccgtgagatacaacgacatcagccccctggagaaccaccactgcgccgtggccttccagatcctggccgagcccgagtgcaacatcttcagcaacatcccccccgacggcttcaagcagatcagacagggcatgatcaccctgatcctggccaccgacatggccagacacgccgagatcatggacagcttcaaggagaagatggagaacttcgactacagcaacgaggagcacatgaccctgctgaagatgatcctgatcaagtgctgcgacatcagcaacgaggtgagacccatggaggtggccgagccctgggtggactgcctgctggaggagtacttcatgcagagcgacagagagaagagcgagggcctgcccgtggcccccttcatggacagagacaaggtgaccaaggccaccgcccagatcggcttcatcaagttcgtgctgatccccatgttcgagaccgtgaccaagctgttccccatggtggaggagatcatgctgcagcccctgtgggagagcagagacagatacgaggagctgaagagaatcgacgacgccatgaaggagctgcagaagaagaccgacagcctgaccagcggcgccaccgagaagagcagagagagaagcagagacgtgaagaacagcgagggcgactgcgcctag

SEQ ID NO: 93176 - DNA, 1476 bp, Artificial Sequence
  Description of Artificial Sequence: Synthetic coding sequence
atgggcagcggcagcagcagctacagacccaaggccatctacctggacatcgacggcagaatccagaaggagcacgaccacctgcccgccgaccacagaagaagacacggcctgcacagaccccaccacgccagagagttcagaacccacagcgtgcagagcgagacctgcggccaccaggccaccctgagagccttcaagatcaacgagctgaaggccgaggtggccaaccacctggccgtgctggagaagagagtggagctggagggcctgaaggtggtggagatcgagaagtgcaagagcgacatcaagaagatgagagaggagctggccgccagaagcagcagaaccaactgcccctgcaagtacagcttcctggacaaccacaagaagctgacccccagaagagacgtgcccacctaccccaagtacctgctgagccccgagaccatcgaggccctgagaaagcccaccttcgacgtgtggctgtgggagcccaacgagatgctgagctgcctggagcacatgtaccacgacctgggcctggtgagagacttcagcatcaaccccgtgaccctgagaagatggctgttctgcgtgcacgacaactacagaaacaaccccttccacaacttcagacactgcttctgcgtggcccagatgatgtacagcatggtgtggctgtgcagcctgcaggagaagttcagccagaccgacatcctgatcctgatgaccgccgccatctgccacgacctggaccaccccggctacaacaacacctaccagatcaacgccagaaccgagctggccgtgagatacaacgacatcagccccctggagaaccaccactgcgccgtggccttccagatcctggccgagcccgagtgcaacatcttcagcaacatcccccccgacggcttcaagcagatcagacagggcatgatcaccctgatcctggccaccgacatggccagacacgccgagatcatggacagcttcaaggagaagatggagaacttcgactacagcaacgaggagcacatgaccctgctgaagatgatcctgatcaagtgctgcgacatcagcaacgaggtgagacccatggaggtggccgagccctgggtggactgcctgctggaggagtacttcatgcagagcgacagagagaagagcgagggcctgcccgtggcccccttcatggacagagacaaggtgaccaaggccaccgcccagatcggcttcatcaagttcgtgctgatccccatgttcgagaccgtgaccaagctgttccccatggtggaggagatcatgctgcagcccctgtgggagagcagagacagatacgaggagctgaagagaatcgacgacgccatgaaggagctgcagaagaagaccgacagcctgaccagcggcgccaccgagaagagcagagagagaagcagagacgtgaagaacagcgagggcgactgcgcctag

SEQ ID NO: 93177 - DNA, 1602 bp, Artificial Sequence
  Description of Artificial Sequence: Synthetic coding sequence
atgggcagcggcagcagcagctacagacccaaggccatctacctggacatcgacggcagaatccagaaggtgatcttcagcaagtactgcaacagcagcgacatcatggacctgttctgcatcgccaccggcctgcccagaaacaccaccatcagcctgctgaccaccgacgacgccatggtgagcatcgaccccaccatgcccgccaacagcgagagaaccccctacaaggtgagacccgtggccatcaagcagctgagcgagagagaggagctgatccagagcgtgctggcccaggtggccgagcagttcagcagagccttcaagatcaacgagctgaaggccgaggtggccaaccacctggccgtgctggagaagagagtggagctggagggcctgaaggtggtggagatcgagaagtgcaagagcgacatcaagaagatgagagaggagctggccgccagaagcagcagaaccaactgcccctgcaagtacagcttcctggacaaccacaagaagctgacccccagaagagacgtgcccacctaccccaagtacctgctgagccccgagaccatcgaggccctgagaaagcccaccttcgacgtgtggctgtgggagcccaacgagatgctgagctgcctggagcacatgtaccacgacctgggcctggtgagagacttcagcatcaaccccgtgaccctgagaagatggctgttctgcgtgcacgacaactacagaaacaaccccttccacaacttcagacactgcttctgcgtggcccagatgatgtacagcatggtgtggctgtgcagcctgcaggagaagttcagccagaccgacatcctgatcctgatgaccgccgccatctgccacgacctggaccaccccggctacaacaacacctaccagatcaacgccagaaccgagctggccgtgagatacaacgacatcagccccctggagaaccaccactgcgccgtggccttccagatcctggccgagcccgagtgcaacatcttcagcaacatcccccccgacggcttcaagcagatcagacagggcatgatcaccctgatcctggccaccgacatggccagacacgccgagatcatggacagcttcaaggagaagatggagaacttcgactacagcaacgaggagcacatgaccctgctgaagatgatcctgatcaagtgctgcgacatcagcaacgaggtgagacccatggaggtggccgagccctgggtggactgcctgctggaggagtacttcatgcagagcgacagagagaagagcgagggcctgcccgtggcccccttcatggacagagacaaggtgaccaaggccaccgcccagatcggcttcatcaagttcgtgctgatccccatgttcgagaccgtgaccaagctgttccccatggtggaggagatcatgctgcagcccctgtgggagagcagagacagatacgaggagctgaagagaatcgacgacgccatgaaggagctgcagaagaagaccgacagcctgaccagcggcgccaccgagaagagcagagagagaagcagagacgtgaagaacagcgagggcgactgcgcctag

SEQ ID NO: 93178 - DNA, 1398 bp, Artificial Sequence
  Description of Artificial Sequence: Synthetic coding sequence
atgggcagcggcagcagcagctacagacccaaggccatctacctggacatcgacggcagaatccagaagcacagcgtgcagagcgagacctgcggccaccaggccaccctgagagccttcaagatcaacgagctgaaggccgaggtggccaaccacctggccgtgctggagaagagagtggagctggagggcctgaaggtggtggagatcgagaagtgcaagagcgacatcaagaagatgagagaggagctggccgccagaagcagcagaaccaactgcccctgcaagtacagcttcctggacaaccacaagaagctgacccccagaagagacgtgcccacctaccccaagtacctgctgagccccgagaccatcgaggccctgagaaagcccaccttcgacgtgtggctgtgggagcccaacgagatgctgagctgcctggagcacatgtaccacgacctgggcctggtgagagacttcagcatcaaccccgtgaccctgagaagatggctgttctgcgtgcacgacaactacagaaacaaccccttccacaacttcagacactgcttctgcgtggcccagatgatgtacagcatggtgtggctgtgcagcctgcaggagaagttcagccagaccgacatcctgatcctgatgaccgccgccatctgccacgacctggaccaccccggctacaacaacacctaccagatcaacgccagaaccgagctggccgtgagatacaacgacatcagccccctggagaaccaccactgcgccgtggccttccagatcctggccgagcccgagtgcaacatcttcagcaacatcccccccgacggcttcaagcagatcagacagggcatgatcaccctgatcctggccaccgacatggccagacacgccgagatcatggacagcttcaaggagaagatggagaacttcgactacagcaacgaggagcacatgaccctgctgaagatgatcctgatcaagtgctgcgacatcagcaacgaggtgagacccatggaggtggccgagccctgggtggactgcctgctggaggagtacttcatgcagagcgacagagagaagagcgagggcctgcccgtggcccccttcatggacagagacaaggtgaccaaggccaccgcccagatcggcttcatcaagttcgtgctgatccccatgttcgagaccgtgaccaagctgttccccatggtggaggagatcatgctgcagcccctgtgggagagcagagacagatacgaggagctgaagagaatcgacgacgccatgaaggagctgcagaagaagaccgacagcctgaccagcggcgccaccgagaagagcagagagagaagcagagacgtgaagaacagcgagggcgactgcgcctag

SEQ ID NO: 93179 - DNA, 1623 bp, Artificial Sequence
  Description of Artificial Sequence: Synthetic coding sequence
atgggcagcggcagcagcagctacagacccaaggccatctacctggacatcgacggcagaatccagaaggtgatcttcagcaagtactgcaacagcagcgacatcatggacctgttctgcatcgccaccggcctgcccagaaacaccaccatcagcctgctgaccaccgacgacgccatggtgagcatcgaccccaccatgcccgccaacagcgagagaaacgagctgatcctgtacaccagcctgagaaacctgctgttcctgcccagcaaggagagctgggccagccaccagcacagcgtgcagagcgagacctgcggccaccaggccaccctgagagccttcaagatcaacgagctgaaggccgaggtggccaaccacctggccgtgctggagaagagagtggagctggagggcctgaaggtggtggagatcgagaagtgcaagagcgacatcaagaagatgagagaggagctggccgccagaagcagcagaaccaactgcccctgcaagtacagcttcctggacaaccacaagaagctgacccccagaagagacgtgcccacctaccccaagtacctgctgagccccgagaccatcgaggccctgagaaagcccaccttcgacgtgtggctgtgggagcccaacgagatgctgagctgcctggagcacatgtaccacgacctgggcctggtgagagacttcagcatcaaccccgtgaccctgagaagatggctgttctgcgtgcacgacaactacagaaacaaccccttccacaacttcagacactgcttctgcgtggcccagatgatgtacagcatggtgtggctgtgcagcctgcaggagaagttcagccagaccgacatcctgatcctgatgaccgccgccatctgccacgacctggaccaccccggctacaacaacacctaccagatcaacgccagaaccgagctggccgtgagatacaacgacatcagccccctggagaaccaccactgcgccgtggccttccagatcctggccgagcccgagtgcaacatcttcagcaacatcccccccgacggcttcaagcagatcagacagggcatgatcaccctgatcctggccaccgacatggccagacacgccgagatcatggacagcttcaaggagaagatggagaacttcgactacagcaacgaggagcacatgaccctgctgaagatgatcctgatcaagtgctgcgacatcagcaacgaggtgagacccatggaggtggccgagccctgggtggactgcctgctggaggagtacttcatgcagagcgacagagagaagagcgagggcctgcccgtggcccccttcatggacagagacaaggtgaccaaggccaccgcccagatcggcttcatcaagttcgtgctgatccccatgttcgagaccgtgaccaagctgttccccatggtggaggagatcatgctgcagcccctgtgggagagcagagacagatacgaggagctgaagagaatcgacgacgccatgaaggagctgcagaagaagaccgacagcctgaccagcggcgccaccgagaagagcagagagagaagcagagacgtgaagaacagcgagggcgactgcgcctag

SEQ ID NO: 93180 - DNA, 1401 bp, Artificial Sequence
  Description of Artificial Sequence: Synthetic coding sequence
atggacgccttcagaagcaccccctacaaggtgagacccgtggccatcaagcagctgagcgagagagaggagctgatccagagcgtgctggcccaggtggccgagcagttcagcagagccttcaagatcaacgagctgaaggccgaggtggccaaccacctggccgtgctggagaagagagtggagctggagggcctgaaggtggtggagatcgagaagtgcaagagcgacatcaagaagatgagagaggagctggccgccagaagcagcagaaccaactgcccctgcaagtacagcttcctggacaaccacaagaagctgacccccagaagagacgtgcccacctaccccaagtacctgctgagccccgagaccatcgaggccctgagaaagcccaccttcgacgtgtggctgtgggagcccaacgagatgctgagctgcctggagcacatgtaccacgacctgggcctggtgagagacttcagcatcaaccccgtgaccctgagaagatggctgttctgcgtgcacgacaactacagaaacaaccccttccacaacttcagacactgcttctgcgtggcccagatgatgtacagcatggtgtggctgtgcagcctgcaggagaagttcagccagaccgacatcctgatcctgatgaccgccgccatctgccacgacctggaccaccccggctacaacaacacctaccagatcaacgccagaaccgagctggccgtgagatacaacgacatcagccccctggagaaccaccactgcgccgtggccttccagatcctggccgagcccgagtgcaacatcttcagcaacatcccccccgacggcttcaagcagatcagacagggcatgatcaccctgatcctggccaccgacatggccagacacgccgagatcatggacagcttcaaggagaagatggagaacttcgactacagcaacgaggagcacatgaccctgctgaagatgatcctgatcaagtgctgcgacatcagcaacgaggtgagacccatggaggtggccgagccctgggtggactgcctgctggaggagtacttcatgcagagcgacagagagaagagcgagggcctgcccgtggcccccttcatggacagagacaaggtgaccaaggccaccgcccagatcggcttcatcaagttcgtgctgatccccatgttcgagaccgtgaccaagctgttccccatggtggaggagatcatgctgcagcccctgtgggagagcagagacagatacgaggagctgaagagaatcgacgacgccatgaaggagctgcagaagaagaccgacagcctgaccagcggcgccaccgagaagagcagagagagaagcagagacgtgaagaacagcgagggcgactgcgcctag

SEQ ID NO: 93181 - DNA, 1659 bp, Artificial Sequence
  Description of Artificial Sequence: Synthetic coding sequence
atggacgccttcagaagaaacaccaccatcagcctgctgaccaccgacgacgccatggtgagcatcgaccccaccatgcccgccaacagcgagagaaccccctacaaggtgagacccgtggccatcaagcagctgagcgccggcgtggaggacaagagaaccaccagcagaggccagagcgccgagagacccctgagagacagaagagtggtgggcctggagcagcccagaagagagggcgccttcgagagcggccaggtggagcccagacccagagagccccagggctgctaccaggagggccagagaatcccccccgagagagaggagctgatccagagcgtgctggcccaggtggccgagcagttcagcagagccttcaagatcaacgagctgaaggccgaggtggccaaccacctggccgtgctggagaagagagtggagctggagggcctgaaggtggtggagatcgagaagtgcaagagcgacatcaagaagatgagagaggagctggccgccagaagcagcagaaccaactgcccctgcaagtacagcttcctggacaaccacaagaagctgacccccagaagagacgtgcccacctaccccaagtacctgctgagccccgagaccatcgaggccctgagaaagcccaccttcgacgtgtggctgtgggagcccaacgagatgctgagctgcctggagcacatgtaccacgacctgggcctggtgagagacttcagcatcaaccccgtgaccctgagaagatggctgttctgcgtgcacgacaactacagaaacaaccccttccacaacttcagacactgcttctgcgtggcccagatgatgtacagcatggtgtggctgtgcagcctgcaggagaagttcagccagaccgacatcctgatcctgatgaccgccgccatctgccacgacctggaccaccccggctacaacaacacctaccagatcaacgccagaaccgagctggccgtgagatacaacgacatcagccccctggagaaccaccactgcgccgtggccttccagatcctggccgagcccgagtgcaacatcttcagcaacatcccccccgacggcttcaagcagatcagacagggcatgatcaccctgatcctggccaccgacatggccagacacgccgagatcatggacagcttcaaggagaagatggagaacttcgactacagcaacgaggagcacatgaccctgctgaagatgatcctgatcaagtgctgcgacatcagcaacgaggtgagacccatggaggtggccgagccctgggtggactgcctgctggaggagtacttcatgcagagcgacagagagaagagcgagggcctgcccgtggcccccttcatggacagagacaaggtgaccaaggccaccgcccagatcggcttcatcaagttcgtgctgatccccatgttcgagaccgtgaccaagctgttccccatggtggaggagatcatgctgcagcccctgtgggagagcagagacagatacgaggagctgaagagaatcgacgacgccatgaaggagctgcagaagaagaccgacagcctgaccagcggcgccaccgagaagagcagagagagaagcagagacgtgaagaacagcgagggcgactgcgcctag

SEQ ID NO: 93182 - DNA, 1302 bp, Artificial Sequence
  Description of Artificial Sequence: Synthetic coding sequence
atggacgccttcagaagagccttcaagatcaacgagctgaaggccgaggtggccaaccacctggccgtgctggagaagagagtggagctggagggcctgaaggtggtggagatcgagaagtgcaagagcgacatcaagaagatgagagaggagctggccgccagaagcagcagaaccaactgcccctgcaagtacagcttcctggacaaccacaagaagctgacccccagaagagacgtgcccacctaccccaagtacctgctgagccccgagaccatcgaggccctgagaaagcccaccttcgacgtgtggctgtgggagcccaacgagatgctgagctgcctggagcacatgtaccacgacctgggcctggtgagagacttcagcatcaaccccgtgaccctgagaagatggctgttctgcgtgcacgacaactacagaaacaaccccttccacaacttcagacactgcttctgcgtggcccagatgatgtacagcatggtgtggctgtgcagcctgcaggagaagttcagccagaccgacatcctgatcctgatgaccgccgccatctgccacgacctggaccaccccggctacaacaacacctaccagatcaacgccagaaccgagctggccgtgagatacaacgacatcagccccctggagaaccaccactgcgccgtggccttccagatcctggccgagcccgagtgcaacatcttcagcaacatcccccccgacggcttcaagcagatcagacagggcatgatcaccctgatcctggccaccgacatggccagacacgccgagatcatggacagcttcaaggagaagatggagaacttcgactacagcaacgaggagcacatgaccctgctgaagatgatcctgatcaagtgctgcgacatcagcaacgaggtgagacccatggaggtggccgagccctgggtggactgcctgctggaggagtacttcatgcagagcgacagagagaagagcgagggcctgcccgtggcccccttcatggacagagacaaggtgaccaaggccaccgcccagatcggcttcatcaagttcgtgctgatccccatgttcgagaccgtgaccaagctgttccccatggtggaggagatcatgctgcagcccctgtgggagagcagagacagatacgaggagctgaagagaatcgacgacgccatgaaggagctgcagaagaagaccgacagcctgaccagcggcgccaccgagaagagcagagagagaagcagagacgtgaagaacagcgagggcgactgcgcctag

SEQ ID NO: 93183 - DNA, 1380 bp, Artificial Sequence
  Description of Artificial Sequence: Synthetic coding sequence
atggacgccttcagaagaaacaccaccatcagcctgctgaccaccgacgacgccatggtgagcatcgaccccaccatgcccgccaacagcgagagagccttcaagatcaacgagctgaaggccgaggtggccaaccacctggccgtgctggagaagagagtggagctggagggcctgaaggtggtggagatcgagaagtgcaagagcgacatcaagaagatgagagaggagctggccgccagaagcagcagaaccaactgcccctgcaagtacagcttcctggacaaccacaagaagctgacccccagaagagacgtgcccacctaccccaagtacctgctgagccccgagaccatcgaggccctgagaaagcccaccttcgacgtgtggctgtgggagcccaacgagatgctgagctgcctggagcacatgtaccacgacctgggcctggtgagagacttcagcatcaaccccgtgaccctgagaagatggctgttctgcgtgcacgacaactacagaaacaaccccttccacaacttcagacactgcttctgcgtggcccagatgatgtacagcatggtgtggctgtgcagcctgcaggagaagttcagccagaccgacatcctgatcctgatgaccgccgccatctgccacgacctggaccaccccggctacaacaacacctaccagatcaacgccagaaccgagctggccgtgagatacaacgacatcagccccctggagaaccaccactgcgccgtggccttccagatcctggccgagcccgagtgcaacatcttcagcaacatcccccccgacggcttcaagcagatcagacagggcatgatcaccctgatcctggccaccgacatggccagacacgccgagatcatggacagcttcaaggagaagatggagaacttcgactacagcaacgaggagcacatgaccctgctgaagatgatcctgatcaagtgctgcgacatcagcaacgaggtgagacccatggaggtggccgagccctgggtggactgcctgctggaggagtacttcatgcagagcgacagagagaagagcgagggcctgcccgtggcccccttcatggacagagacaaggtgaccaaggccaccgcccagatcggcttcatcaagttcgtgctgatccccatgttcgagaccgtgaccaagctgttccccatggtggaggagatcatgctgcagcccctgtgggagagcagagacagatacgaggagctgaagagaatcgacgacgccatgaaggagctgcagaagaagaccgacagcctgaccagcggcgccaccgagaagagcagagagagaagcagagacgtgaagaacagcgagggcgactgcgcctag

SEQ ID NO: 93184 - DNA, 1581 bp, Artificial Sequence
  Description of Artificial Sequence: Synthetic coding sequence
atggacgccttcagaagcaccccctacaaggtgagacccgtggccatcaagcagctgagcgccggcgtggaggacaagagaaccaccagcagaggccagagcgccgagagacccctgagagacagaagagtggtgggcctggagcagcccagaagagagggcgccttcgagagcggccaggtggagcccagacccagagagccccagggctgctaccaggagggccagagaatcccccccgagagagaggagctgatccagagcgtgctggcccaggtggccgagcagttcagcagagccttcaagatcaacgagctgaaggccgaggtggccaaccacctggccgtgctggagaagagagtggagctggagggcctgaaggtggtggagatcgagaagtgcaagagcgacatcaagaagatgagagaggagctggccgccagaagcagcagaaccaactgcccctgcaagtacagcttcctggacaaccacaagaagctgacccccagaagagacgtgcccacctaccccaagtacctgctgagccccgagaccatcgaggccctgagaaagcccaccttcgacgtgtggctgtgggagcccaacgagatgctgagctgcctggagcacatgtaccacgacctgggcctggtgagagacttcagcatcaaccccgtgaccctgagaagatggctgttctgcgtgcacgacaactacagaaacaaccccttccacaacttcagacactgcttctgcgtggcccagatgatgtacagcatggtgtggctgtgcagcctgcaggagaagttcagccagaccgacatcctgatcctgatgaccgccgccatctgccacgacctggaccaccccggctacaacaacacctaccagatcaacgccagaaccgagctggccgtgagatacaacgacatcagccccctggagaaccaccactgcgccgtggccttccagatcctggccgagcccgagtgcaacatcttcagcaacatcccccccgacggcttcaagcagatcagacagggcatgatcaccctgatcctggccaccgacatggccagacacgccgagatcatggacagcttcaaggagaagatggagaacttcgactacagcaacgaggagcacatgaccctgctgaagatgatcctgatcaagtgctgcgacatcagcaacgaggtgagacccatggaggtggccgagccctgggtggactgcctgctggaggagtacttcatgcagagcgacagagagaagagcgagggcctgcccgtggcccccttcatggacagagacaaggtgaccaaggccaccgcccagatcggcttcatcaagttcgtgctgatccccatgttcgagaccgtgaccaagctgttccccatggtggaggagatcatgctgcagcccctgtgggagagcagagacagatacgaggagctgaagagaatcgacgacgccatgaaggagctgcagaagaagaccgacagcctgaccagcggcgccaccgagaagagcagagagagaagcagagacgtgaagaacagcgagggcgactgcgcctag

SEQ ID NO: 93185 - DNA, 1479 bp, Artificial Sequence
  Description of Artificial Sequence: Synthetic coding sequence
atggacgccttcagaagaaacaccaccatcagcctgctgaccaccgacgacgccatggtgagcatcgaccccaccatgcccgccaacagcgagagaaccccctacaaggtgagacccgtggccatcaagcagctgagcgagagagaggagctgatccagagcgtgctggcccaggtggccgagcagttcagcagagccttcaagatcaacgagctgaaggccgaggtggccaaccacctggccgtgctggagaagagagtggagctggagggcctgaaggtggtggagatcgagaagtgcaagagcgacatcaagaagatgagagaggagctggccgccagaagcagcagaaccaactgcccctgcaagtacagcttcctggacaaccacaagaagctgacccccagaagagacgtgcccacctaccccaagtacctgctgagccccgagaccatcgaggccctgagaaagcccaccttcgacgtgtggctgtgggagcccaacgagatgctgagctgcctggagcacatgtaccacgacctgggcctggtgagagacttcagcatcaaccccgtgaccctgagaagatggctgttctgcgtgcacgacaactacagaaacaaccccttccacaacttcagacactgcttctgcgtggcccagatgatgtacagcatggtgtggctgtgcagcctgcaggagaagttcagccagaccgacatcctgatcctgatgaccgccgccatctgccacgacctggaccaccccggctacaacaacacctaccagatcaacgccagaaccgagctggccgtgagatacaacgacatcagccccctggagaaccaccactgcgccgtggccttccagatcctggccgagcccgagtgcaacatcttcagcaacatcccccccgacggcttcaagcagatcagacagggcatgatcaccctgatcctggccaccgacatggccagacacgccgagatcatggacagcttcaaggagaagatggagaacttcgactacagcaacgaggagcacatgaccctgctgaagatgatcctgatcaagtgctgcgacatcagcaacgaggtgagacccatggaggtggccgagccctgggtggactgcctgctggaggagtacttcatgcagagcgacagagagaagagcgagggcctgcccgtggcccccttcatggacagagacaaggtgaccaaggccaccgcccagatcggcttcatcaagttcgtgctgatccccatgttcgagaccgtgaccaagctgttccccatggtggaggagatcatgctgcagcccctgtgggagagcagagacagatacgaggagctgaagagaatcgacgacgccatgaaggagctgcagaagaagaccgacagcctgaccagcggcgccaccgagaagagcagagagagaagcagagacgtgaagaacagcgagggcgactgcgcctag

SEQ ID NO: 93186 - DNA, 1524 bp, Artificial Sequence
  Description of Artificial Sequence: Synthetic coding sequence
atgggcagcggcagcagcagctacagacccaaggccatctacctggacatcgacggcagaatccagaaggtgatcttcagcaagtactgcaacagcagcgacatcatggacctgttctgcatcgccaccggcctgcccagaaccccctacaaggtgagacccgtggccatcaagcagctgagcgagagagaggagctgatccagagcgtgctggcccaggtggccgagcagttcagcagagccttcaagatcaacgagctgaaggccgaggtggccaaccacctggccgtgctggagaagagagtggagctggagggcctgaaggtggtggagatcgagaagtgcaagagcgacatcaagaagatgagagaggagctggccgccagaagcagcagaaccaactgcccctgcaagtacagcttcctggacaaccacaagaagctgacccccagaagagacgtgcccacctaccccaagtacctgctgagccccgagaccatcgaggccctgagaaagcccaccttcgacgtgtggctgtgggagcccaacgagatgctgagctgcctggagcacatgtaccacgacctgggcctggtgagagacttcagcatcaaccccgtgaccctgagaagatggctgttctgcgtgcacgacaactacagaaacaaccccttccacaacttcagacactgcttctgcgtggcccagatgatgtacagcatggtgtggctgtgcagcctgcaggagaagttcagccagaccgacatcctgatcctgatgaccgccgccatctgccacgacctggaccaccccggctacaacaacacctaccagatcaacgccagaaccgagctggccgtgagatacaacgacatcagccccctggagaaccaccactgcgccgtggccttccagatcctggccgagcccgagtgcaacatcttcagcaacatcccccccgacggcttcaagcagatcagacagggcatgatcaccctgatcctggccaccgacatggccagacacgccgagatcatggacagcttcaaggagaagatggagaacttcgactacagcaacgaggagcacatgaccctgctgaagatgatcctgatcaagtgctgcgacatcagcaacgaggtgagacccatggaggtggccgagccctgggtggactgcctgctggaggagtacttcatgcagagcgacagagagaagagcgagggcctgcccgtggcccccttcatggacagagacaaggtgaccaaggccaccgcccagatcggcttcatcaagttcgtgctgatccccatgttcgagaccgtgaccaagctgttccccatggtggaggagatcatgctgcagcccctgtgggagagcagagacagatacgaggagctgaagagaatcgacgacgccatgaaggagctgcagaagaagaccgacagcctgaccagcggcgccaccgagaagagcagagagagaagcagagacgtgaagaacagcgagggcgactgcgcctag

SEQ ID NO: 93187 - DNA, 1398 bp, Artificial Sequence
  Description of Artificial Sequence: Synthetic coding sequence
atggacctgttctgcatcgccaccggcctgcccagaaacaccaccatcagcctgctgaccaccgacgacgccatggtgagcatcgaccccaccatgcccgccaacagcgagagagccttcaagatcaacgagctgaaggccgaggtggccaaccacctggccgtgctggagaagagagtggagctggagggcctgaaggtggtggagatcgagaagtgcaagagcgacatcaagaagatgagagaggagctggccgccagaagcagcagaaccaactgcccctgcaagtacagcttcctggacaaccacaagaagctgacccccagaagagacgtgcccacctaccccaagtacctgctgagccccgagaccatcgaggccctgagaaagcccaccttcgacgtgtggctgtgggagcccaacgagatgctgagctgcctggagcacatgtaccacgacctgggcctggtgagagacttcagcatcaaccccgtgaccctgagaagatggctgttctgcgtgcacgacaactacagaaacaaccccttccacaacttcagacactgcttctgcgtggcccagatgatgtacagcatggtgtggctgtgcagcctgcaggagaagttcagccagaccgacatcctgatcctgatgaccgccgccatctgccacgacctggaccaccccggctacaacaacacctaccagatcaacgccagaaccgagctggccgtgagatacaacgacatcagccccctggagaaccaccactgcgccgtggccttccagatcctggccgagcccgagtgcaacatcttcagcaacatcccccccgacggcttcaagcagatcagacagggcatgatcaccctgatcctggccaccgacatggccagacacgccgagatcatggacagcttcaaggagaagatggagaacttcgactacagcaacgaggagcacatgaccctgctgaagatgatcctgatcaagtgctgcgacatcagcaacgaggtgagacccatggaggtggccgagccctgggtggactgcctgctggaggagtacttcatgcagagcgacagagagaagagcgagggcctgcccgtggcccccttcatggacagagacaaggtgaccaaggccaccgcccagatcggcttcatcaagttcgtgctgatccccatgttcgagaccgtgaccaagctgttccccatggtggaggagatcatgctgcagcccctgtgggagagcagagacagatacgaggagctgaagagaatcgacgacgccatgaaggagctgcagaagaagaccgacagcctgaccagcggcgccaccgagaagagcagagagagaagcagagacgtgaagaacagcgagggcgactgcgcctag

SEQ ID NO: 93188 - DNA, 1869 bp, Artificial Sequence
  Description of Artificial Sequence: Synthetic coding sequence
atgcccccccagctgcagaacggcctgaacctgagcgccaaggtggtgcagggcagcctggacagcctgccccaggccgtgagagagttcctggagaacaacgccgagctgtgccagcccgaccacatccacatctgcgacggcagcgaggaggagaacggcagactgctgggccagatggaggaggagggcatcctgagaagactgaagaagtacgacaactgctggctggccctgaccgaccccagagacgtggccagaatcgagagcaagaccgtgatcgtgacccaggagcagagagacaccgtgcccatccccaagaccggcctgagccagctgggcagatggatgagcgaggaggacttcgagaaggccttcaacgccagattccccggctgcatgaagggcagaaccatgtacgtgatccccttcagcatgggccccctgggcagccccctgagcaagatcggcatcgagctgaccgacagcccctacgtggtggccagcatgagaatcatgaccagaatgggcacccccgtgctggaggccgtgggcgacggcgagttcgtgaagtgcctgcacagcgtgggctgccccctgcccctgcagaagcccctggtgaacaactggccctgcaaccccgagctgaccctgatcgcccacctgcccgacagaagagagatcatcagcttcggcagcggctacggcggcaacagcctgctgggcaagaagtgcttcgccctgagaatggccagcagactggccaaggaggagggctggctggccgagcacatgctgatcctgggcatcaccaaccccgagggcgagaagaagtacctggccgccgccttccccagcgcctgcggcaagaccaacctggccatgatgaaccccagcctgcccggctggaaggtggagtgcgtgggcgacgacatcgcctggatgaagttcgacgcccagggccacctgagagccatcaaccccgagaacggcttcttcggcgtggcccccggcaccagcgtgaagaccaaccccaacgccatcaagaccatccagaagaacaccatcttcaccaacgtggccgagaccagcgacggcggcgtgtactgggagggcatcgacgagcccctggccagcggcgtgaccatcaccagctggaagaacaaggagtggagcagcgaggacggcgagccctgcgcccaccccaacagcagattctgcacccccgccagccagtgccccatcatcgacgccgcctgggagagccccgagggcgtgcccatcgagggcatcatcttcggcggcagaagacccgccggcgtgcccctggtgtacgaggccctgagctggcagcacggcgtgttcgtgggcgccgccatgagaagcgaggccaccgccgccgccgagcacaagggcaagatcatcatgcacgaccccttcgccatgagacccttcttcggctacaacttcggcaagtacctggcccactggctgagcatggcccagcaccccgccgccaagctgcccaagatcttccacgtgaactggttcagaaaggacaaggagggcaagttcctgtggcccggcttcggcgagaacagcagagtgctggagtggatgttcaacagaatcgacggcaaggccagcaccaagctgacccccatcggctacatccccaaggaggacgccctgaacctgaagggcctgggccacatcaacatgatggagctgttcagcatcagcaaggagttctgggagaaggaggtggaggacatcgagaagtacctggaggaccaggtgaacgccgacctgccctgcgagatcgagagagagatcctggccctgaagcagagaatcagccagatgtag

SEQ ID NO: 93189 - DNA, 942 bp, Artificial Sequence
  Description of Artificial Sequence: Synthetic coding sequence
atgaccaccggcagaaccatgtacgtgatccccttcagcatgggccccctgggcagccccctgagcaagatcggcatcgagctgaccgacagcccctacgtggtggccagcatgagaatcatgaccagaatgggcacccccgtgctggaggccgtgggcgacggcgagttcgtgaagtgcctgcacagcgtgggctgccccctgcccctgcagaagcccctggtgaacaactggccctgcaaccccgagctgaccctgatcgcccacctgcccgacagaagagagatcatcagcttcggcagcggctacggcggcaacagcctgctgggcaagaagtgcttcgccctgagaatggccagcagactggccaaggaggagggctggctggccgagcacatgctgatcctgggcatcaccaaccccgagggcgagaagaagtacctggccgccgccttccccagcgcctgcggcaagaccaacctggccatgatgaaccccagcctgcccggctggaaggtggagtgcgtgggcgacgacatcgcctggatgaagttcgacgcccagggccacctgagagccatcaaccccgagaacggcttcttcggcgtggcccccggcaccagcgtgaagaccaaccccaacgccatcaagaccatccagaagaacaccatcttcaccaacgtggccgagaccagcgacggcggcgtgtactgggagggcatcgacgagcccctggccagcggcgtgaccatcaccagctggaagaacaaggagtggagcagcgaggacggcgtgagcctgcccgaggccctggtgtgcagagccgccggcaccgcctgcctgagccaggccctgaccagcctgagcctgagctacagaggcaccctgtgccccccccagctggaggtgctgcacccctgccagcccgtgccccaccactag

SEQ ID NO: 93190 - DNA, 915 bp, Artificial Sequence
  Description of Artificial Sequence: Synthetic coding sequence
accaccggccacctgagagccatcaaccccgagaacggcttcttcggcgtggcccccggcaccagcgtgaagaccaaccccaacgccatcaagaccatccagaagaacaccatcttcaccaacgtggccgagaccagcgacggcggcgtgtactgggagggcatcgacgagcccctggccagcggcgtgaccatcaccagctggaagaacaaggagtggagcagcgaggacggcgagccctgcgcccaccccaacagcagattctgcacccccgccagccagtgccccatcatcgacgccgcctgggagagccccgagggcgtgcccatcgagggcatcatcttcggcggcagaagacccgccggcgtgcccctggtgtacgaggccctgagctggcagcacggcgtgttcgtgggcgccgccatgagaagcgaggccaccgccgccgccgagcacaagggcaagatcatcatgcacgaccccttcgccatgagacccttcttcggctacaacttcggcaagtacctggcccactggctgagcatggcccagcaccccgccgccaagctgcccaagatcttccacgtgaactggttcagaaaggacaaggagggcaagttcctgtggcccggcttcggcgagaacagcagagtgctggagtggatgttcaacagaatcgacggcaaggccagcaccaagctgacccccatcggctacatccccaaggaggacgccctgaacctgaagggcctgggccacatcaacatgatggagctgttcagcatcagcaaggagttctgggagaaggaggtggaggacatcgagaagtacctggaggaccaggtgaacgccgacctgccctgcgagatcgagagagagatcctggccctgaagcagagaatcagccagatgtag

SEQ ID NO: 93191 - DNA, 918 bp, Artificial Sequence
  Description of Artificial Sequence: Synthetic coding sequence
atgaccaccggccacctgagagccatcaaccccgagaacggcttcttcggcgtggcccccggcaccagcgtgaagaccaaccccaacgccatcaagaccatccagaagaacaccatcttcaccaacgtggccgagaccagcgacggcggcgtgtactgggagggcatcgacgagcccctggccagcggcgtgaccatcaccagctggaagaacaaggagtggagcagcgaggacggcgagccctgcgcccaccccaacagcagattctgcacccccgccagccagtgccccatcatcgacgccgcctgggagagccccgagggcgtgcccatcgagggcatcatcttcggcggcagaagacccgccggcgtgcccctggtgtacgaggccctgagctggcagcacggcgtgttcgtgggcgccgccatgagaagcgaggccaccgccgccgccgagcacaagggcaagatcatcatgcacgaccccttcgccatgagacccttcttcggctacaacttcggcaagtacctggcccactggctgagcatggcccagcaccccgccgccaagctgcccaagatcttccacgtgaactggttcagaaaggacaaggagggcaagttcctgtggcccggcttcggcgagaacagcagagtgctggagtggatgttcaacagaatcgacggcaaggccagcaccaagctgacccccatcggctacatccccaaggaggacgccctgaacctgaagggcctgggccacatcaacatgatggagctgttcagcatcagcaaggagttctgggagaaggaggtggaggacatcgagaagtacctggaggaccaggtgaacgccgacctgccctgcgagatcgagagagagatcctggccctgaagcagagaatcagccagatgtag

SEQ ID NO: 93192 - DNA, 1674 bp, Artificial Sequence; identical to SEQ ID NO: 77629
  Description of Artificial Sequence: Synthetic coding sequence

SEQ ID NO: 93193 - DNA, 1326 bp, Artificial Sequence
  Description of Artificial Sequence: Synthetic coding sequence
atggccgccctgtacagacccggcctgagactgaactggcacggcctgagccccctgggctggcccagctgcagaagcatccagaccctgagagtgctgagcggcgacctgggccagctgcccaccggcatcagagacttcgtggagcacagcgccagactgtgccagcccgagggcatccacatctgcgacggcaccgaggccgagaacaccgccaccctgaccctgctggagcagcagggcctgatcagaaagctgcccaagtacaacaactgctggctggccagaaccgaccccaaggacgtggccagagtggagagcaagaccgtgatcgtgacccccagccagagagacaccgtgcagctgccccccggcggcgccagaggccagctgggcaactggatgagccccgccgacttccagagagccgtggacgagagattccccggctgcatgcagggcagaaccatgtacgtgctgcccttcagcatgggccccgtgggcagccccctgagcagaatcggcgtgcagctgaccgacagcgcctacgtggtggccagcatgagaatcatgaccagactgggcacccccgtgctgcaggccctgggcgacggcgacttcgtgaagtgcctgcacagcgtgggccagcccctgaccggccagggcgagcccgtgagccagtggccctgcaaccccgagaagaccctgatcggccacgtgcccgaccagagagagatcatcagcttcggcagcggctacggcggcaacagcctgctgggcaagaagtgcttcgccctgagaatcgccagcagactggccagagacgagggctggctggccgagcacatgctgatcctgggcatcaccagccccgccggcaagaagagatacgtggccgccgccttccccagcgcctgcggcaagaccaacctggccatgatgagacccgccctgcccggctggaaggtggagtgcgtgggcgacgacatcgcctggatgagattcgacagcgagggcagactgagagccatcaaccccgagaacggcttcttcggcgtggcccccggcaccagcgccaccaccaaccccaacgccatggccaccatccagagcaacaccatcttcaccaacgtggccgagaccagcgacggcggcgtgtactgggagggcatcgaccagcccctgccccccggcgtgaccgtgaccagctggctgggcaagccctggaagcccggcatgtgcggcggcgagggcgtggcccagccccccggcctgagcaccctgatggtggagaagctgagcccccagccccccaccatcttctag

SEQ ID NO: 93194 - DNA, 1521 bp, Artificial Sequence
  Description of Artificial Sequence: Synthetic coding sequence
atgagccccgccgacttccagagagccgtggacgagagattccccggctgcatgcagggcagaaccatgtacgtgctgcccttcagcatgggccccgtgggcagccccctgagcagaatcggcgtgcagctgaccgacagcgcctacgtggtggccagcatgagaatcatgaccagactgggcacccccgtgctgcaggccctgggcgacggcgacttcgtgaagtgcctgcacagcgtgggccagcccctgaccggccagggcgagcccgtgagccagtggccctgcaaccccgagaagaccctgatcggccacgtgcccgaccagagagagatcatcagcttcggcagcggctacggcggcaacagcctgctgggcaagaagtgcttcgccctgagaatcgccagcagactggccagagacgagggctggctggccgagcacatgctgatcctgggcatcaccagccccgccggcaagaagagatacgtggccgccgccttccccagcgcctgcggcaagaccaacctggccatgatgagacccgccctgcccggctggaaggtggagtgcgtgggcgacgacatcgcctggatgagattcgacagcgagggcagactgagagccatcaaccccgagaacggcttcttcggcgtggcccccggcaccagcgccaccaccaaccccaacgccatggccaccatccagagcaacaccatcttcaccaacgtggccgagaccagcgacggcggcgtgtactgggagggcatcgaccagcccctgccccccggcgtgaccgtgaccagctggctgggcaagccctggaagcccggcgacaaggagccctgcgcccaccccaacagcagattctgcgcccccgccagacagtgccccatcatggaccccgcctgggaggcccccgagggcgtgcccatcgacgccatcatcttcggcggcagaagacccaagggcgtgcccctggtgtacgaggccttcaactggagacacggcgtgttcgtgggcagcgccatgagaagcgagagcaccgccgccgccgagcacaagggcaagatcatcatgcacgaccccttcgccatgagacccttcttcggctacaacttcggccactacctggagcactggctgagcatggagggcagaaagggcgcccagctgcccagaatcttccacgtgaactggttcagaagagacgaggccggccacttcctgtggcccggcttcggcgagaacgccagagtgctggactggatctgcagaagactggagggcgaggacagcgccagagagacccccatcggcctggtgcccaaggagggcgccctggacctgagcggcctgagagccatcgacaccacccagctgttcagcctgcccaaggacttctgggagcaggaggtgagagacatcagaagctacctgaccgagcaggtgaaccaggacctgcccaaggaggtgctggccgagctggaggccctggagagaagagtgcacaagatgtag

SEQ ID NO: 93195 - DNA, 1521 bp, Artificial Sequence; identical to SEQ ID NO: 93194
  Description of Artificial Sequence: Synthetic coding sequence

SEQ ID NO: 93196 - DNA, 2343 bp, Artificial Sequence
  Description of Artificial Sequence: Synthetic coding sequence
atggccgccgtggacctggagaagctgagagccagcggcgccggcaaggccatcggcgtgctgaccagcggcggcgacgcccagggcatgaacgccgccgtgagagccgtgaccagaatgggcatctacgtgggcgccaaggtgttcctgatctacgagggctacgagggcctggtggagggcggcgagaacatcaagcaggccaactggctgagcgtgagcaacatcatccagctgggcggcaccatcatcggcagcgccagatgcaaggccttcaccaccagagagggcagaagagccgccgcctacaacctggtgcagcacggcatcaccaacctgtgcgtgatcggcggcgacggcagcctgaccggcgccaacatcttcagaagcgagtggggcagcctgctggaggagctggtggccgagggcaagatcagcgagaccaccgccagaacctacagccacctgaacatcgccggcctggtgggcagcatcgacaacgacttctgcggcaccgacatgaccatcggcaccgacagcgccctgcacagaatcatggaggtgatcgacgccatcaccaccaccgcccagagccaccagagaaccttcgtgctggaggtgatgggcagacactgcggctacctggccctggtgagcgccctggccagcggcgccgactggctgttcatccccgaggccccccccgaggacggctgggagaacttcatgtgcgagagactgggcgagaccagaagcagaggcagcagactgaacatcatcatcatcgccgagggcgccatcgacagaaacggcaagcccatcagcagcagctacgtgaaggacctggtggtgcagagactgggcttcgacaccagagtgaccgtgctgggccacgtgcagagaggcggcacccccagcgccttcgacagaatcctgagcagcaagatgggcatggaggccgtgatggccctgctggaggccacccccgacacccccgcctgcgtggtgaccctgagcggcaaccagagcgtgagactgcccctgatggagtgcgtgcagatgaccaaggaggtgcagaaggccatggacgacaagagattcgacgaggccacccagctgagaggcggcagcttcgagaacaactggaacatctacaagctgctggcccaccagaagccccccaaggagaagagcaacttcagcctggccatcctgaacgtgggcgcccccgccgccggcatgaacgccgccgtgagaagcgccgtgagaaccggcatcagccacggccacaccgtgtacgtggtgcacgacggcttcgagggcctggccaagggccaggtgcaggaggtgggctggcacgacgtggccggctggctgggcagaggcggcagcatgctgggcaccaagagaaccctgcccaagggccagctggagagcatcgtggagaacatcagaatctacggcatccacgccctgctggtggtgggcggcttcgaggcctacgagggcgtgctgcagctggtggaggccagaggcagatacgaggagctgtgcatcgtgatgtgcgtgatccccgccaccatcagcaacaacgtgcccggcaccgacttcagcctgggcagcgacaccgccgtgaacgccgccatggagagctgcgacagaatcaagcagagcgccagcggcaccaagagaagagtgttcatcgtggagaccatgggcggctactgcggctacctggccaccgtgaccggcatcgccgtgggcgccgacgccgcctacgtgttcgaggaccccttcaacatccacgacctgaaggtgaacgtggagcacatgaccgagaagatgaagaccgacatccagagaggcctggtgctgagaaacgagaagtgccacgactactacaccaccgagttcctgtacaacctgtacagcagcgagggcaagggcgtgttcgactgcagaaccaacgtgctgggccacctgcagcagggcggcgcccccacccccttcgacagaaactacggcaccaagctgggcgtgaaggccatgctgtggctgagcgagaagctgagagaggtgtacagaaagggcagagtgttcgccaacgcccccgacagcgcctgcgtgatcggcctgaagaagaaggccgtggccttcagccccgtgaccgagctgaagaaggacaccgacttcgagcacagaatgcccagagagcagtggtggctgagcctgagactgatgctgaagatgctggcccagtacagaatcagcatggccgcctacgtgagcggcgagctggagcacgtgaccagaagaaccctgagcatggacaagggcttctag

SEQ ID NO: 93197 - DNA, 762 bp, Artificial Sequence
  Description of Artificial Sequence: Synthetic coding sequence
atgagaagcatgtgcaaccagggcagaggcagagagagcagcagaggcggcctgcacgtgcagggcagctgcagaggcctgagcagaagcccccagcaggagaccggcttcgccaaggcccccgccggcaccgactgcttcttccactgcagccccggcagcagaggccagggcgacagaaaggaggaggtgaccagcgagcccggcggcaccagcatcatgagcagactgggcggcatgaacgccgccgtgagagccgtgaccagaatgggcatctacgtgggcgccaaggtgttcctgatctacgagggctacgagggcctggtggagggcggcgagaacatcaagcaggccaactggctgagcgtgagcaacatcatccagctgggcggcaccatcatcggcagcgccagatgcaaggccttcaccaccagagagggcagaagagccgccgcctacaacctggtgcagcacggcatcaccaacctgtgcgtgatcggcggcgacggcagcctgaccggcgccaacatcttcagaagcgagtggggcagcctgctggaggagctggtggccgagggcaagatcagcgagaccaccgccagaacctacagccacctgaacatcgccggcctggtgggcagcatcgacaacgacttctgcggcaccgacatgaccatcggcaccgacagcgccctgcacagaatcatggaggtgatcgacgccatcaccaccagaggcagactgggcgagctgcacgtgtag

SEQ ID NO: 93198 - DNA, 2484 bp, Artificial Sequence
  Description of Artificial Sequence: Synthetic coding sequence
atgtgcaaccagggcagaggcagagagagcagcagaggcggcctgcacgtgcagggcagctgcagaggcctgagcagaagcccccagcaggagaccggcttcgccaaggcccccgccggcaccgactgcttcttccactgcagccccggcagcagaggccagggcgacagaaaggaggaggtgaccagcgagcccggcggcaccagcatcatgagcagactgggcggcatgaacgccgccgtgagagccgtgaccagaatgggcatctacgtgggcgccaaggtgttcctgatctacgagggctacgagggcctggtggagggcggcgagaacatcaagcaggccaactggctgagcgtgagcaacatcatccagctgggcggcaccatcatcggcagcgccagatgcaaggccttcaccaccagagagggcagaagagccgccgcctacaacctggtgcagcacggcatcaccaacctgtgcgtgatcggcggcgacggcagcctgaccggcgccaacatcttcagaagcgagtggggcagcctgctggaggagctggtggccgagggcaagatcagcgagaccaccgccagaacctacagccacctgaacatcgccggcctggtgggcagcatcgacaacgacttctgcggcaccgacatgaccatcggcaccgacagcgccctgcacagaatcatggaggtgatcgacgccatcaccaccaccgcccagagccaccagagaaccttcgtgctggaggtgatgggcagacactgcggctacctggccctggtgagcgccctggccagcggcgccgactggctgttcatccccgaggccccccccgaggacggctgggagaacttcatgtgcgagagactgggcgagaccagaagcagaggcagcagactgaacatcatcatcatcgccgagggcgccatcgacagaaacggcaagcccatcagcagcagctacgtgaaggacctggtggtgcagagactgggcttcgacaccagagtgaccgtgctgggccacgtgcagagaggcggcacccccagcgccttcgacagaatcctgagcagcaagatgggcatggaggccgtgatggccctgctggaggccacccccgacacccccgcctgcgtggtgaccctgagcggcaaccagagcgtgagactgcccctgatggagtgcgtgcagatgaccaaggaggtgcagaaggccatggacgacaagagattcgacgaggccacccagctgagaggcggcagcttcgagaacaactggaacatctacaagctgctggcccaccagaagccccccaaggagaagagcaacttcagcctggccatcctgaacgtgggcgcccccgccgccggcatgaacgccgccgtgagaagcgccgtgagaaccggcatcagccacggccacaccgtgtacgtggtgcacgacggcttcgagggcctggccaagggccaggtgcaggaggtgggctggcacgacgtggccggctggctgggcagaggcggcagcatgctgggcaccaagagaaccctgcccaagggccagctggagagcatcgtggagaacatcagaatctacggcatccacgccctgctggtggtgggcggcttcgaggcctacgagggcgtgctgcagctggtggaggccagaggcagatacgaggagctgtgcatcgtgatgtgcgtgatccccgccaccatcagcaacaacgtgcccggcaccgacttcagcctgggcagcgacaccgccgtgaacgccgccatggagagctgcgacagaatcaagcagagcgccagcggcaccaagagaagagtgttcatcgtggagaccatgggcggctactgcggctacctggccaccgtgaccggcatcgccgtgggcgccgacgccgcctacgtgttcgaggaccccttcaacatccacgacctgaaggtgaacgtggagcacatgaccgagaagatgaagaccgacatccagagaggcctggtgctgagaaacgagaagtgccacgactactacaccaccgagttcctgtacaacctgtacagcagcgagggcaagggcgtgttcgactgcagaaccaacgtgctgggccacctgcagcagggcggcgcccccacccccttcgacagaaactacggcaccaagctgggcgtgaaggccatgctgtggctgagcgagaagctgagagaggtgtacagaaagggcagagtgttcgccaacgcccccgacagcgcctgcgtgatcggcctgaagaagaaggccgtggccttcagccccgtgaccgagctgaagaaggacaccgacttcgagcacagaatgcccagagagcagtggtggctgagcctgagactgatgctgaagatgctggcccagtacagaatcagcatggccgcctacgtgagcggcgagctggagcacgtgaccagaagaaccctgagcatggacaagggcttctag

SEQ ID NO: 93199 - DNA, 1722 bp, Artificial Sequence
  Description of Artificial Sequence: Synthetic coding sequence
atgggcagacactgcggctacctggccctggtgagcgccctggccagcggcgccgactggctgttcatccccgaggccccccccgaggacggctgggagaacttcatgtgcgagagactgggcgagaccagaagcagaggcagcagactgaacatcatcatcatcgccgagggcgccatcgacagaaacggcaagcccatcagcagcagctacgtgaaggacctggtggtgcagagactgggcttcgacaccagagtgaccgtgctgggccacgtgcagagaggcggcacccccagcgccttcgacagaatcctgagcagcaagatgggcatggaggccgtgatggccctgctggaggccacccccgacacccccgcctgcgtggtgaccctgagcggcaaccagagcgtgagactgcccctgatggagtgcgtgcagatgaccaaggaggtgcagaaggccatggacgacaagagattcgacgaggccacccagctgagaggcggcagcttcgagaacaactggaacatctacaagctgctggcccaccagaagccccccaaggagaagagcaacttcagcctggccatcctgaacgtgggcgcccccgccgccggcatgaacgccgccgtgagaagcgccgtgagaaccggcatcagccacggccacaccgtgtacgtggtgcacgacggcttcgagggcctggccaagggccaggtgcaggaggtgggctggcacgacgtggccggctggctgggcagaggcggcagcatgctgggcaccaagagaaccctgcccaagggccagctggagagcatcgtggagaacatcagaatctacggcatccacgccctgctggtggtgggcggcttcgaggcctacgagggcgtgctgcagctggtggaggccagaggcagatacgaggagctgtgcatcgtgatgtgcgtgatccccgccaccatcagcaacaacgtgcccggcaccgacttcagcctgggcagcgacaccgccgtgaacgccgccatggagagctgcgacagaatcaagcagagcgccagcggcaccaagagaagagtgttcatcgtggagaccatgggcggctactgcggctacctggccaccgtgaccggcatcgccgtgggcgccgacgccgcctacgtgttcgaggaccccttcaacatccacgacctgaaggtgaacgtggagcacatgaccgagaagatgaagaccgacatccagagaggcctggtgctgagaaacgagaagtgccacgactactacaccaccgagttcctgtacaacctgtacagcagcgagggcaagggcgtgttcgactgcagaaccaacgtgctgggccacctgcagcagggcggcgcccccacccccttcgacagaaactacggcaccaagctgggcgtgaaggccatgctgtggctgagcgagaagctgagagaggtgtacagaaagggcagagtgttcgccaacgcccccgacagcgcctgcgtgatcggcctgaagaagaaggccgtggccttcagccccgtgaccgagctgaagaaggacaccgacttcgagcacagaatgcccagagagcagtggtggctgagcctgagactgatgctgaagatgctggcccagtacagaatcagcatggccgcctacgtgagcggcgagctggagcacgtgaccagaagaaccctgagcatggacaagggcttctag

SEQ ID NO: 93200 - DNA, 2343 bp, Artificial Sequence
  Description of Artificial Sequence: Synthetic coding sequence
atgacccacgaggagcaccacgccgccaagaccctgggcatcggcaaggccatcgccgtgctgaccagcggcggcgacgcccagggcatgaacgccgccgtgagagccgtggtgagagtgggcatcttcaccggcgccagagtgttcttcgtgcacgagggctaccagggcctggtggacggcggcgaccacatcaaggaggccacctgggagagcgtgagcatgatgctgcagctgggcggcaccgtgatcggcagcgccagatgcaaggacttcagagagagagagggcagactgagagccgcctacaacctggtgaagagaggcatcaccaacctgtgcgtgatcggcggcgacggcagcctgaccggcgccgacaccttcagaagcgagtggagcgacctgctgagcgacctgcagaaggccggcaagatcaccgacgaggaggccaccaagagcagctacctgaacatcgtgggcctggtgggcagcatcgacaacgacttctgcggcaccgacatgaccatcggcaccgacagcgccctgcacagaatcatggagatcgtggacgccatcaccaccaccgcccagagccaccagagaaccttcgtgctggaggtgatgggcagacactgcggctacctggccctggtgaccagcctgagctgcggcgccgactgggtgttcatccccgagtgcccccccgacgacgactgggaggagcacctgtgcagaagactgagcgagaccagaaccagaggcagcagactgaacatcatcatcgtggccgagggcgccatcgacaagaacggcaagcccatcaccagcgaggacatcaagaacctggtggtgaagagactgggctacgacaccagagtgaccgtgctgggccacgtgcagagaggcggcacccccagcgccttcgacagaatcctgggcagcagaatgggcgtggaggccgtgatggccctgctggagggcacccccgacacccccgcctgcgtggtgagcctgagcggcaaccaggccgtgagactgcccctgatggagtgcgtgcaggtgaccaaggacgtgaccaaggccatggacgagaagaagttcgacgaggccctgaagctgagaggcagaagcttcatgaacaactgggaggtgtacaagctgctggcccacgtgagaccccccgtgagcaagagcggcagccacaccgtggccgtgatgaacgtgggcgcccccgccgccggcatgaacgccgccgtgagaagcaccgtgagaatcggcctgatccagggcaacagagtgctggtggtgcacgacggcttcgagggcctggccaagggccagatcgaggaggccggctggagctacgtgggcggctggaccggccagggcggcagcaagctgggcaccaagagaaccctgcccaagaagagcttcgagcagatcagcgccaacatcaccaagttcaacatccagggcctggtgatcatcggcggcttcgaggcctacaccggcggcctggagctgatggagggcagaaagcagttcgacgagctgtgcatccccttcgtggtgatccccgccaccgtgagcaacaacgtgcccggcagcgacttcagcgtgggcgccgacaccgccctgaacaccatctgcaccacctgcgacagaatcaagcagagcgccgccggcaccaagagaagagtgttcatcatcgagaccatgggcggctactgcggctacctggccaccatggccggcctggccgccggcgccgacgccgcctacatcttcgaggagcccttcaccatcagagacctgcaggccaacgtggagcacctggtgcagaagatgaagaccaccgtgaagagaggcctggtgctgagaaacgagaagtgcaacgagaactacaccaccgacttcatcttcaacctgtacagcgaggagggcaagggcatcttcgacagcagaaagaacgtgctgggccacatgcagcagggcggcagccccacccccttcgacagaaacttcgccaccaagatgggcgccaaggccatgaactggatgagcggcaagatcaaggagagctacagaaacggcagaatcttcgccaacacccccgacagcggctgcgtgctgggcatgagaaagagagccctggtgttccagcccgtggccgagctgaaggaccagaccgacttcgagcacagaatccccaaggagcagtggtggctgaagctgagacccatcctgaagatcctggccaagtacgagatcgacctggacaccagcgaccacgcccacctggagcacatcaccagaaagagaagcggcgaggccgccgtgtag

SEQ ID NO: 93201 - DNA, 2556 bp, Artificial Sequence
  Description of Artificial Sequence: Synthetic coding sequence
atgcacaaggacgagttccacctgaagttcttcatgtgcgtgatccagagcagacagctggtgagaaccccccagagaaccgccggcgaggccagcaccagcagcatgctgatccccaagcccccccccaagaccgacatcctgaagagcctggacaccatggacgaccccgacaccgtgggcagcatccccgtgttcaagaccgagtggatcatgacccacgaggagcaccacgccgccaagaccctgggcatcggcaaggccatcgccgtgctgaccagcggcggcgacgcccagggcatgaacgccgccgtgagagccgtggtgagagtgggcatcttcaccggcgccagagtgttcttcgtgcacgagggctaccagggcctggtggacggcggcgaccacatcaaggaggccacctgggagagcgtgagcatgatgctgcagctgggcggcaccgtgatcggcagcgccagatgcaaggacttcagagagagagagggcagactgagagccgcctacaacctggtgaagagaggcatcaccaacctgtgcgtgatcggcggcgacggcagcctgaccggcgccgacaccttcagaagcgagtggagcgacctgctgagcgacctgcagaaggccggcaagatcaccgacgaggaggccaccaagagcagctacctgaacatcgtgggcctggtgggcagcatcgacaacgacttctgcggcaccgacatgaccatcggcaccgacagcgccctgcacagaatcatggagatcgtggacgccatcaccaccaccgcccagagccaccagagaaccttcgtgctggaggtgatgggcagacactgcggctacctggccctggtgaccagcctgagctgcggcgccgactgggtgttcatccccgagtgcccccccgacgacgactgggaggagcacctgtgcagaagactgagcgagaccagaaccagaggcagcagactgaacatcatcatcgtggccgagggcgccatcgacaagaacggcaagcccatcaccagcgaggacatcaagaacctggtggtgaagagactgggctacgacaccagagtgaccgtgctgggccacgtgcagagaggcggcacccccagcgccttcgacagaatcctgggcagcagaatgggcgtggaggccgtgatggccctgctggagggcacccccgacacccccgcctgcgtggtgagcctgagcggcaaccaggccgtgagactgcccctgatggagtgcgtgcaggtgaccaaggacgtgaccaaggccatggacgagaagaagttcgacgaggccctgaagctgagaggcagaagcttcatgaacaactgggaggtgtacaagctgctggcccacgtgagaccccccgtgagcaagagcggcagccacaccgtggccgtgatgaacgtgggcgcccccgccgccggcatgaacgccgccgtgagaagcaccgtgagaatcggcctgatccagggcaacagagtgctggtggtgcacgacggcttcgagggcctggccaagggccagatcgaggaggccggctggagctacgtgggcggctggaccggccagggcggcagcaagctgggcaccaagagaaccctgcccaagaagagcttcgagcagatcagcgccaacatcaccaagttcaacatccagggcctggtgatcatcggcggcttcgaggcctacaccggcggcctggagctgatggagggcagaaagcagttcgacgagctgtgcatccccttcgtggtgatccccgccaccgtgagcaacaacgtgcccggcagcgacttcagcgtgggcgccgacaccgccctgaacaccatctgcaccacctgcgacagaatcaagcagagcgccgccggcaccaagagaagagtgttcatcatcgagaccatgggcggctactgcggctacctggccaccatggccggcctggccgccggcgccgacgccgcctacatcttcgaggagcccttcaccatcagagacctgcaggccaacgtggagcacctggtgcagaagatgaagaccaccgtgaagagaggcctggtgctgagaaacgagaagtgcaacgagaactacaccaccgacttcatcttcaacctgtacagcgaggagggcaagggcatcttcgacagcagaaagaacgtgctgggccacatgcagcagggcggcagccccacccccttcgacagaaacttcgccaccaagatgggcgccaaggccatgaactggatgagcggcaagatcaaggagagctacagaaacggcagaatcttcgccaacacccccgacagcggctgcgtgctgggcatgagaaagagagccctggtgttccagcccgtggccgagctgaaggaccagaccgacttcgagcacagaatccccaaggagcagtggtggctgaagctgagacccatcctgaagatcctggccaagtacgagatcgacctggacaccagcgaccacgcccacctggagcacatcaccagaaagagaagcggcgaggccgccgtgtag

SEQ ID NO: 93202 - DNA, 2343 bp, Artificial Sequence; identical to SEQ ID NO: 93200
  Description of Artificial Sequence: Synthetic coding sequence

SEQ ID NO: 93203 - DNA, 2250 bp, Artificial Sequence
  Description of Artificial Sequence: Synthetic coding sequence
atgacccacgaggagcaccacgccgccaagaccctgggcatcggcaaggccatcgccgtgctgaccagcggcggcgacgcccagggcatgaacgccgccgtgagagccgtggtgagagtgggcatcttcaccggcgccagagtgttcttcgtgcacgagggctaccagggcctggtggacggcggcgaccacatcaaggaggccacctgggagagcgtgagcatgatgctgcagctgggcggcaccgtgatcggcagcgccagatgcaaggacttcagagagagagagggcagactgagagccgcctacaacctggtgaagagaggcatcaccaacctgtgcgtgatcggcggcgacggcagcctgaccggcgccgacaccttcagaagcgagtggagcgacctgctgagcgacctgcagaaggccggcaagatcaccgacgaggaggccaccaagagcagctacctgaacatcgtgggcctggtgggcagcatcgacaacgacttctgcggcaccgacatgaccatcggcaccgacagcgccctgcacagaatcatggagatcgtggacgccatcaccaccaccgcccagagccaccagagaaccttcgtgctggaggtgatgggcagacactgcggctacctggccctggtgaccagcctgagctgcggcgccgactgggtgttcatccccgagtgcccccccgacgacgactgggaggagcacctgtgcagaagactgagcgagaccagaaccagaggcagcagactgaacatcatcatcgtggccgagggcgccatcgacaagaacggcaagcccatcaccagcgaggacatcaagaacggcagcagaatgggcgtggaggccgtgatggccctgctggagggcacccccgacacccccgcctgcgtggtgagcctgagcggcaaccaggccgtgagactgcccctgatggagtgcgtgcaggtgaccaaggacgtgaccaaggccatggacgagaagaagttcgacgaggccctgaagctgagaggcagaagcttcatgaacaactgggaggtgtacaagctgctggcccacgtgagaccccccgtgagcaagagcggcagccacaccgtggccgtgatgaacgtgggcgcccccgccgccggcatgaacgccgccgtgagaagcaccgtgagaatcggcctgatccagggcaacagagtgctggtggtgcacgacggcttcgagggcctggccaagggccagatcgaggaggccggctggagctacgtgggcggctggaccggccagggcggcagcaagctgggcaccaagagaaccctgcccaagaagagcttcgagcagatcagcgccaacatcaccaagttcaacatccagggcctggtgatcatcggcggcttcgaggcctacaccggcggcctggagctgatggagggcagaaagcagttcgacgagctgtgcatccccttcgtggtgatccccgccaccgtgagcaacaacgtgcccggcagcgacttcagcgtgggcgccgacaccgccctgaacaccatctgcaccacctgcgacagaatcaagcagagcgccgccggcaccaagagaagagtgttcatcatcgagaccatgggcggctactgcggctacctggccaccatggccggcctggccgccggcgccgacgccgcctacatcttcgaggagcccttcaccatcagagacctgcaggccaacgtggagcacctggtgcagaagatgaagaccaccgtgaagagaggcctggtgctgagaaacgagaagtgcaacgagaactacaccaccgacttcatcttcaacctgtacagcgaggagggcaagggcatcttcgacagcagaaagaacgtgctgggccacatgcagcagggcggcagccccacccccttcgacagaaacttcgccaccaagatgggcgccaaggccatgaactggatgagcggcaagatcaaggagagctacagaaacggcagaatcttcgccaacacccccgacagcggctgcgtgctgggcatgagaaagagagccctggtgttccagcccgtggccgagctgaaggaccagaccgacttcgagcacagaatccccaaggagcagtggtggctgaagctgagacccatcctgaagatcctggccaagtacgagatcgacctggacaccagcgaccacgcccacctggagcacatcaccagaaagagaagcggcgaggccgccgtgtag

SEQ ID NO: 93204 - DNA, 534 bp, Artificial Sequence
  Description of Artificial Sequence: Synthetic coding sequence
atgacccacgaggagcaccacgccgccaagaccctgggcatcggcaaggccatcgccgtgctgaccagcggcggcgacgcccagggcatgaacgccgccgtgagaagcaccgtgagaatcggcctgatccagggcaacagagtgctggtggtgcacgacggcttcgagggcctggccaagggccagatcgaggaggccggctggagctacgtgggcggctggaccggccagggcggcagcaagctgggcaccaagagaaccctgcccaagaagagcttcgagcagatcagcgccaacatcaccaagttcaacatccagggcctggtgatcatcggcggcttcgaggcctacaccggcggcctggagctgatggagggcagaaagcagttcgacgagctgtgcatccccttcgtggtgatccccgccaccgtgagcaacaacgtgcccggcagcgacttcagcgtgggcgccgacaccgccctgaacaccatctgcaccacctgcgacagaatcaagcagagcgccgccggctag

SEQ ID NO: 93205 - DNA, 2343 bp, Artificial Sequence; identical to SEQ ID NO: 93200
  Description of Artificial Sequence: Synthetic coding sequence

SEQ ID NO: 93206 - DNA, 354 bp, Artificial Sequence
  Description of Artificial Sequence: Synthetic coding sequence
atgacccacgaggagcaccacgccgccaagaccctgggcatcggcaaggccatcgccgtgctgaccagcggcggcgacgcccagggcatgaacgccgccgtgagagccgtggtgagagtgggcatcttcaccggcgccagagtgttcttcgtgcacgagggctaccagggcctggtggacggcggcgaccacatcaaggaggccacctgggagagcgtgagcatgatgctgcagctgggcggcaccgtgatcggcagcgccagatgcaaggacttcagagagagagagggcagactgagagccgcctacaacctggtgaagagaggcatcaccaacctgtgcgtgatcggctag

SEQ ID NO: 93207 - DNA, 486 bp, Artificial Sequence
  Description of Artificial Sequence: Synthetic coding sequence
atgacccacgaggagcaccacgccgccaagaccctgggcatcggcaaggccatcgccgtgctgaccagcggcggcgacgcccagggcatgaacgccgccgtgagagccgtggtgagagtgggcatcttcaccggcgccagagtgttcttcgtgcacgagggctaccagggcctggtggacggcggcgaccacatcaaggaggccacctgggagagcgtgagcatgatgctgcagctgggcggcaccgtgatcggcagcgccagatgcaaggacttcagagagagagagggcagactgagagccgcctacaacctggtgaagagaggcatcaccaacctgtgcgtgatcggcggcgacggcagcctgaccggcgccgacaccttcagaagcgagtggagcgacctgctgagcgacctgcagaaggccggcaagatcaccgacgaggaggccaccaagagcagctacctgaacatcgtgggcctgtag

SEQ ID NO: 93208 - DNA, 474 bp, Artificial Sequence
  Description of Artificial Sequence: Synthetic coding sequence
atgacccacgaggagcaccacgccgccaagaccctgggcatcggcaaggccatcgccgtgctgaccagcggcggcgacgcccagggcatgaacgccgccgtgagagccgtggtgagagtgggcatcttcaccggcgccagagtgttcttcgtgcacgagggctaccagggcctggtggacggcggcgaccacatcaaggaggccacctgggagagcgtgagcatgatgctgcagctgggcggcaccgtgatcggcagcgccagatgcaaggacttcagagagagagagggcagactgagagccgcctacaacctggtgaagagaggcatcaccaacctgtgcgtgatcggcggcgacggcagcctgaccggcgccgacaccttcagaagcgagtggagcgacctgctgagcgacctgcagaaggccggcaagatcaccgacgaggaggccaccaagagcagctacctgaactag

SEQ ID NO: 93209 - DNA, 258 bp, Artificial Sequence
  Description of Artificial Sequence: Synthetic coding sequence
atgacccacgaggagcaccacgccgccaagaccctgggcatcggcaaggccatcgccgtgctgaccagcggcggcgacgcccagggcatgaacgccgccgtgagagccgtggtgagagtgggcatcttcaccggcgccagagtgttcttcgtgcacgagggctaccagggcctggtggacggcggcgaccacatcaaggaggccacctgggagagcgtgagcatgatgctgcagctgggcggcaccgtgatcggctag

SEQ ID NO: 93210 - DNA, 420 bp, Artificial Sequence
  Description of Artificial Sequence: Synthetic coding sequence
atgacccacgaggagcaccacgccgccaagaccctgggcatcggcaaggccatcgccgtgctgaccagcggcggcgacgcccagggcatgaacgccgccgtgagagccgtggtgagagtgggcatcttcaccggcgccagagtgttcttcgtgcacgagggctaccagggcctggtggacggcggcgaccacatcaaggaggccacctgggagagcgtgagcatgatgctgcagctgggcggcaccgtgatcggcagcgccagatgcaaggacttcagagagagagagggcagactgagagccgcctacaacctggtgaagagaggcatcaccaacctgtgcgtgatcggcggcgacggcagcctgaccggcgccgacaccttcagaagcgagtggagcgacctgctgagcgacctgtag

SEQ ID NO: 93211 - DNA, 2250 bp, Artificial Sequence; identical to SEQ ID NO: 93203
  Description of Artificial Sequence: Synthetic coding sequence

SEQ ID NO: 93212 - DNA, 609 bp, Artificial Sequence
  Description of Artificial Sequence: Synthetic coding sequence
atgggcggctactgcggctacctggccaacatgggcggcctggccgccggcgccgacgccgcctacatcttcgaggagcccttcgacatcagagacctgcagagcaacgtggagcacctgaccgagaagatgaagaccaccatccagagaggcctggtgctgagaaacgagagctgcagcgagaactacaccaccgacttcatctaccagctgtacagcgaggagggcaagggcgtgttcgactgcagaaagaacgtgctgggccacatgcagcagggcggcgcccccagccccttcgacagaaacttcggcaccaagatcagcgccagagccatggagtggatcaccgccaagctgaaggaggccagaggcagaggcaagaagttcaccaccgacgacagcatctgcgtgctgggcatcagcaagagaaacgtgatcttccagcccgtggccgagctgaagaagcagaccgacttcgagcacagaatccccaaggagcagtggtggctgaagctgagacccctgatgaagatcctggccaagtacaaggccagctacgacgtgagcgacagcggccagctggagcacgtgcagccctggagcgtgtag

SEQ ID NO: 93213 - DNA, 2331 bp, Artificial Sequence
  Description of Artificial Sequence: Synthetic coding sequence
atgtgcggctacgagagatgcagaccctgcagaggcgcccacggctacctgagaggcggccagggcgtgctgcacctgagaggcctgcccggccacggcggcagaagactgaagcacagaagaggcagactgggcgagtgcctgcagcaccccgccagcggcgccgtgagaggcgactggagagagaagcccggctgctggagccacagattcccctgccccggcagacacgccctggtgggcggcaccatcatcggcagcgccagatgccaggccttcagaaccagagagggcagactgaaggccgcctgcaacctgctgcagagaggcatcaccaacctgtgcgtgatcggcggcgacggcagcctgaccggcgccaacctgttcagaaaggagtggagcggcctgctggaggagctggccagaaacggccagatcgacaaggaggccgtgcagaagtacgcctacctgaacgtggtgggcatggtgggcagcatcgacaacgacttctgcggcaccgacatgaccatcggcaccgacagcgccctgcacagaatcatcgaggtggtggacgccatcatgaccaccgcccagagccaccagagaaccttcgtgctggaggtgatgggcagacactgcggctacctggccctggtgagcgccctggcctgcggcgccgactgggtgttcctgcccgagagcccccccgaggagggctgggaggagcagatgtgcgtgaagctgagcgagaacagagccagaaagaagagactgaacatcatcatcgtggccgagggcgccatcgacacccagaacaagcccatcaccagcgagaagatcaaggagctggtggtgacccagctgggctacgacaccagagtgaccatcctgggccacgtgcagagaggcggcacccccagcgccttcgacagaatcctggccagcagaatgggcgtggaggccgtgatcgccctgctggaggccacccccgacacccccgcctgcgtggtgagcctgaacggcaaccacgccgtgagactgcccctgatggagtgcgtgcagatgacccaggacgtgcagaaggccatggacgagagaagattccaggacgccgtgagactgagaggcagaagcttcgccggcaacctgaacacctacaagagactggccatcaagctgcccgacgaccagatccccaagaccaactgcaacgtggccgtgatcaacgtgggcgcccccgccgccggcatgaacgccgccgtgagaagcgccgtgagagtgggcatcgccgacggccacagaatgctggccatctacgacggcttcgacggcttcgccaagggccagatcaaggagatcggctggaccgacgtgggcggctggaccggccagggcggcagcatcctgggcaccaagagagtgctgcccggcaagtacctggaggagatcgccacccagatgagaacccacagcatcaacgccctgctgatcatcggcggcttcgaggcctacctgggcctgctggagctgagcgccgccagagagaagcacgaggagttctgcgtgcccatggtgatggtgcccgccaccgtgagcaacaacgtgcccggcagcgacttcagcatcggcgccgacaccgccctgaacaccatcaccgacacctgcgacagaatcaagcagagcgccagcggcaccaagagaagagtgttcatcatcgagaccatgggcggctactgcggctacctggccaacatgggcggcctggccgccggcgccgacgccgcctacatcttcgaggagcccttcgacatcagagacctgcagagcaacgtggagcacctgaccgagaagatgaagaccaccatccagagaggcctggtgctgagaaacgagagctgcagcgagaactacaccaccgacttcatctaccagctgtacagcgaggagggcaagggcgtgttcgactgcagaaagaacgtgctgggccacatgcagcagggcggcgcccccagccccttcgacagaaacttcggcaccaagatcagcgccagagccatggagtggatcaccgccaagctgaaggaggccagaggcagaggcaagaagttcaccaccgacgacagcatctgcgtgctgggcatcagcaagagaaacgtgatcttccagcccgtggccgagctgaagaagcagaccgacttcgagcacagaatccccaaggagcagtggtggctgaagctgagacccctgatgaagatcctggccaagtacaaggccagctacgacgtgagcgacagcggccagctggagcacgtgcagccctggagcgtgtag

SEQ ID NO: 93214 - DNA, 2355 bp, Artificial Sequence
  Description of Artificial Sequence: Synthetic coding sequence
atggacgccgacgacagcagagcccccaagggcagcctgagaaagttcctggagcacctgagcggcgccggcaaggccatcggcgtgctgaccagcggcggcgacgcccagggcatgaacgccgccgtgagagccgtggtgagaatgggcatctacgtgggcgccaaggtgtacttcatctacgagggctaccagggcatggtggacggcggcagcaacatcgccgaggccgactgggagagcgtgagcagcatcctgcaggtgggcggcaccatcatcggcagcgccagatgccaggccttcagaaccagagagggcagactgaaggccgcctgcaacctgctgcagagaggcatcaccaacctgtgcgtgatcggcggcgacggcagcctgaccggcgccaacctgttcagaaaggagtggagcggcctgctggaggagctggccagaaacggccagatcgacaaggaggccgtgcagaagtacgcctacctgaacgtggtgggcatggtgggcagcatcgacaacgacttctgcggcaccgacatgaccatcggcaccgacagcgccctgcacagaatcatcgaggtggtggacgccatcatgaccaccgcccagagccaccagagaaccttcgtgctggaggtgatgggcagacactgcggctacctggccctggtgagcgccctggcctgcggcgccgactgggtgttcctgcccgagagcccccccgaggagggctgggaggagcagatgtgcgtgaagctgagcgagaacagagccagaaagaagagactgaacatcatcatcgtggccgagggcgccatcgacacccagaacaagcccatcaccagcgagaagatcaaggagctggtggtgacccagctgggctacgacaccagagtgaccatcctgggccacgtgcagagaggcggcacccccagcgccttcgacagaatcctggccagcagaatgggcgtggaggccgtgatcgccctgctggaggccacccccgacacccccgcctgcgtggtgagcctgaacggcaaccacgccgtgagactgcccctgatggagtgcgtgcagatgacccaggacgtgcagaaggccatggacgagagaagattccaggacgccgtgagactgagaggcagaagcttcgccggcaacctgaacacctacaagagactggccatcaagctgcccgacgaccagatccccaagaccaactgcaacgtggccgtgatcaacgtgggcgcccccgccgccggcatgaacgccgccgtgagaagcgccgtgagagtgggcatcgccgacggccacagaatgctggccatctacgacggcttcgacggcttcgccaagggccagatcaaggagatcggctggaccgacgtgggcggctggaccggccagggcggcagcatcctgggcaccaagagagtgctgcccggcaagtacctggaggagatcgccacccagatgagaacccacagcatcaacgccctgctgatcatcggcggcttcgaggcctacctgggcctgctggagctgagcgccgccagagagaagcacgaggagttctgcgtgcccatggtgatggtgcccgccaccgtgagcaacaacgtgcccggcagcgacttcagcatcggcgccgacaccgccctgaacaccatcaccgacacctgcgacagaatcaagcagagcgccagcggcaccaagagaagagtgttcatcatcgagaccatgggcggctactgcggctacctggccaacatgggcggcctggccgccggcgccgacgccgcctacatcttcgaggagcccttcgacatcagagacctgcagagcaacgtggagcacctgaccgagaagatgaagaccaccatccagagaggcctggtgctgagaaacgagagctgcagcgagaactacaccaccgacttcatctaccagctgtacagcgaggagggcaagggcgtgttcgactgcagaaagaacgtgctgggccacatgcagcagggcggcgcccccagccccttcgacagaaacttcggcaccaagatcagcgccagagccatggagtggatcaccgccaagctgaaggaggccagaggcagaggcaagaagttcaccaccgacgacagcatctgcgtgctgggcatcagcaagagaaacgtgatcttccagcccgtggccgagctgaagaagcagaccgacttcgagcacagaatccccaaggagcagtggtggctgaagctgagacccctgatgaagatcctggccaagtacaaggccagctacgacgtgagcgacagcggccagctggagcacgtgcagccctggagcgtgtag

SEQ ID NO: 93215 - DNA, 2322 bp, Artificial Sequence
  Description of Artificial Sequence: Synthetic coding sequence
tacgagagatgcagaccctgcagaggcgcccacggctacctgagaggcggccagggcgtgctgcacctgagaggcctgcccggccacggcggcagaagactgaagcacagaagaggcagactgggcgagtgcctgcagcaccccgccagcggcgccgtgagaggcgactggagagagaagcccggctgctggagccacagattcccctgccccggcagacacgccctggtgggcggcaccatcatcggcagcgccagatgccaggccttcagaaccagagagggcagactgaaggccgcctgcaacctgctgcagagaggcatcaccaacctgtgcgtgatcggcggcgacggcagcctgaccggcgccaacctgttcagaaaggagtggagcggcctgctggaggagctggccagaaacggccagatcgacaaggaggccgtgcagaagtacgcctacctgaacgtggtgggcatggtgggcagcatcgacaacgacttctgcggcaccgacatgaccatcggcaccgacagcgccctgcacagaatcatcgaggtggtggacgccatcatgaccaccgcccagagccaccagagaaccttcgtgctggaggtgatgggcagacactgcggctacctggccctggtgagcgccctggcctgcggcgccgactgggtgttcctgcccgagagcccccccgaggagggctgggaggagcagatgtgcgtgaagctgagcgagaacagagccagaaagaagagactgaacatcatcatcgtggccgagggcgccatcgacacccagaacaagcccatcaccagcgagaagatcaaggagctggtggtgacccagctgggctacgacaccagagtgaccatcctgggccacgtgcagagaggcggcacccccagcgccttcgacagaatcctggccagcagaatgggcgtggaggccgtgatcgccctgctggaggccacccccgacacccccgcctgcgtggtgagcctgaacggcaaccacgccgtgagactgcccctgatggagtgcgtgcagatgacccaggacgtgcagaaggccatggacgagagaagattccaggacgccgtgagactgagaggcagaagcttcgccggcaacctgaacacctacaagagactggccatcaagctgcccgacgaccagatccccaagaccaactgcaacgtggccgtgatcaacgtgggcgcccccgccgccggcatgaacgccgccgtgagaagcgccgtgagagtgggcatcgccgacggccacagaatgctggccatctacgacggcttcgacggcttcgccaagggccagatcaaggagatcggctggaccgacgtgggcggctggaccggccagggcggcagcatcctgggcaccaagagagtgctgcccggcaagtacctggaggagatcgccacccagatgagaacccacagcatcaacgccctgctgatcatcggcggcttcgaggcctacctgggcctgctggagctgagcgccgccagagagaagcacgaggagttctgcgtgcccatggtgatggtgcccgccaccgtgagcaacaacgtgcccggcagcgacttcagcatcggcgccgacaccgccctgaacaccatcaccgacacctgcgacagaatcaagcagagcgccagcggcaccaagagaagagtgttcatcatcgagaccatgggcggctactgcggctacctggccaacatgggcggcctggccgccggcgccgacgccgcctacatcttcgaggagcccttcgacatcagagacctgcagagcaacgtggagcacctgaccgagaagatgaagaccaccatccagagaggcctggtgctgagaaacgagagctgcagcgagaactacaccaccgacttcatctaccagctgtacagcgaggagggcaagggcgtgttcgactgcagaaagaacgtgctgggccacatgcagcagggcggcgcccccagccccttcgacagaaacttcggcaccaagatcagcgccagagccatggagtggatcaccgccaagctgaaggaggccagaggcagaggcaagaagttcaccaccgacgacagcatctgcgtgctgggcatcagcaagagaaacgtgatcttccagcccgtggccgagctgaagaagcagaccgacttcgagcacagaatccccaaggagcagtggtggctgaagctgagacccctgatgaagatcctggccaagtacaaggccagctacgacgtgagcgacagcggccagctggagcacgtgcagccctggagcgtgtag

SEQ ID NO: 93216 - DNA, 633 bp, Artificial Sequence
  Description of Artificial Sequence: Synthetic coding sequence
atgaacgccgccgtgagagccgtggtgagaatgggcatctacgtgggcgccaaggtgtacttcatctacgagggctaccagggcatggtggacggcggcagcaacatcgccgaggccgactgggagagcgtgagcagcatcctgcaggtgggcggcaccatcatcggcagcgccagatgccaggccttcagaaccagagagggcagactgaaggccgcctgcaacctgctgcagagaggcatcaccaacctgtgcgtgatcggcggcgacggcagcctgaccggcgccaacctgttcagaaaggagtggagcggcctgctggaggagctggccagaaacggccagatcgacaaggaggccgtgcagaagtacgcctacctgaacgtggtgggcatggtgggcagcatcgacaacgacttctgcggcaccgacatgaccatcggcaccgacagcgccctgcacagaatcatcgaggtggtggacgccatcatgaccaccgcccagagccaccagagaaccttcgtgctggaggtgatgggcagacactgcggctacctggccctggtgagcgccctggcctgcggcgccgactgggtgttcctgcccgagagcccccccgaggagggctggtag

SEQ ID NO: 93217 - DNA, 501 bp, Artificial Sequence
  Description of Artificial Sequence: Synthetic coding sequence
tgagccgacggccacagaatgctggccatctacgacggcttcgacggcttcgccaagggccagatcaaggagatcggctggaccgacgtgggcggctggaccggccagggcggcagcatcctgggcaccaagagagtgctgcccggcaagtacctggaggagatcgccacccagatgagaacccacagcatcaacgccctgctgatcatcggcggcttcgaggcctacaagagcgcctgcgacatggccgaggccagaggcagacaccaggagctgtgcatccccctgtgcgtggtgcccgccaccatcagcaacaacgtgcccggcaccgagatcagcctgggcagcgacaccggcctgaacgccgtggtggagacctgcgacagaatcaagcagagcgccagcggcaccaagagaagagtgttcatcatcgagaccatgggcggctactgcggctacctggccaacatgggcggcctggccgccggcgccgacgcctag

SEQ ID NO: 93218 - DNA, 723 bp, Artificial Sequence
  Description of Artificial Sequence: Synthetic coding sequence
atgggcagacactgcggctacctggccctggtgagcgccctggcctgcggcgccgactgggtgttcctgcccgagagcccccccgaggagggctgggaggagcagatgtgcgtgaagctgagcgagaacagagccagaaagaagagactgaacatcatcatcgtggccgagggcgccatcgacacccagaacaagcccatcaccagcgagaagatcaaggagctggtggtgacccagctgggctacgacaccagagtgaccatcctgggccacgtgcagagaggcggcacccccagcgccttcgacagaatcctggccagcagaatgggcgtggaggccgtgatcgccctgctggaggccacccccgacacccccgcctgcgtggtgagcctgaacggcaaccacgccgtgagactgcccctgatggagtgcgtgcagatgacccaggacgtgcagaaggccatggacgagagaagattccaggacgccgtgagactgagaggcagaagcttcgccggcaacctgaacacctacaagagactggccatcaagctgcccgacgaccagatccccaagaccaactgcaacgtggccgtgatcaacgtgggcgcccccgccgccggcatgaacgccgccgtgagaagcgccgtgagagtgggcatcgccgacggccacagaatgctggccatctacgacggcttcgacggcttcgccaagggctag

SEQ ID NO: 93219 - DNA, 501 bp, Artificial Sequence
  Description of Artificial Sequence: Synthetic coding sequence
atgaacgccgccgtgagagccgtggtgagaatgggcatctacgtgggcgccaaggtgtacttcatctacgagggctaccagggcatggtggacggcggcagcaacatcgccgaggccgactgggagagcgtgagcagcatcctgcaggtgggcggcaccatcatcggcagcgccagatgccaggccttcagaaccagagagggcagactgaaggccgcctgcaacctgctgcagagaggcatcaccaacctgtgcgtgatcggcggcgacggcagcctgaccggcgccaacctgttcagaaaggagtggagcggcctgctggaggagctggccagaaacggccagatcgacaaggaggccgtgcagaagtacgcctacctgaacgtggtgggcatggtgggcagcatcgacaacgacttctgcggcaccgacatgaccatcggcaccgacagcgccctgcacagaatcatcgaggtggtggacgccatcatgaccacctag

SEQ ID NO: 93220 - DNA, 312 bp, Artificial Sequence
  Description of Artificial Sequence: Synthetic coding sequence
tgattcatctaccagctgtacagcgaggagggcaagggcgtgttcgactgcagaaagaacgtgctgggccacatgcagcagggcggcgcccccagccccttcgacagaaacttcggcaccaagatcagcgccagagccatggagtggatcaccgccaagctgaaggaggccagaggcagaggcaagaagttcaccaccgacgacagcatctgcgtgctgggcatcagcaagagaaacgtgatcttccagcccgtggccgagctgaagaagcagaccgacttcgagaccgtgagcatgcagccccccagatag

SEQ ID NO: 93221 - DNA, 1743 bp, Artificial Sequence
  Description of Artificial Sequence: Synthetic coding sequence
atgagcgacttcgaggagtggatcagcggcacctacagaaagatggaggagggccccctgcccctgctgaccttcgccaccgccccctaccacgaccagaagcccggcaccagcggcctgagaaagaagacctactacttcgaggagaagccctgctacctggagaacttcatccagagcatcttcttcagcatcgacctgaaggacagacagggcagcagcctggtggtgggcggcgacggcagatacttcaacaagagcgccatcgagaccatcgtgcagatggccgccgccaacggcatcggcagactggtgatcggccagaacggcatcctgagcacccccgccgtgagctgcatcatcagaaagatcaaggccatcggcggcatcatcctgaccgccagccacaaccccggcggccccaacggcgacttcggcatcaagttcaacatcagcaacggcggccccgcccccgaggccatcaccgacaagatcttccagatcagcaagaccatcgaggagtacgccgtgtgccccgacctgaaggtggacctgggcgtgctgggcaagcagcagttcgacctggagaacaagttcaagcccttcaccgtggagatcgtggacagcgtggaggcctacgccaccatgctgagaagcatcttcgacttcagcgccctgaaggagctgctgagcggccccaacagactgaagatcagaatcgacgccatgcacggcgtggtgggcccctacgtgaagaagatcctgtgcgaggagctgggcgcccccgccaacagcgccgtgaactgcgtgcccctggaggacttcggcggccaccaccccgaccccaacctgacctacgccgccgacctggtggagaccatgaagagcggcgagcacgacttcggcgccgccttcgacggcgacggcgacagaaacatgatcctgggcaagcacggcttcttcgtgaaccccagcgacagcgtggccgtgatcgccgccaacatcttcagcatcccctacttccagcagaccggcgtgagaggcttcgccagaagcatgcccaccagcggcgccctggacagagtggccagcgccaccaagatcgccctgtacgagacccccaccggctggaagttcttcggcaacctgatggacgccagcaagctgagcctgtgcggcgaggagagcttcggcaccggcagcgaccacatcagagagaaggacggcctgtgggccgtgctggcctggctgagcatcctggccaccagaaagcagagcgtggaggacatcctgaaggaccactggcagaagtacggcagaaacttcttcaccagatacgactacgaggaggtggaggccgagggcgccaacaagatgatgaaggacctggaggccctgatgttcgacagaagcttcgtgggcaagcagttcagcgccaacgacaaggtgtacaccgtggagaaggccgacaacttcgagtacagcgaccccgtggacggcagcatcagcagaaaccagggcctgagactgatcttcaccgacggcagcagaatcgtgttcagactgagcggcaccggcagcgccggcgccaccatcagactgtacatcgacagctacgagaaggacgtggccaagatcaaccaggacccccaggtgatgctggcccccctgatcagcatcgccctgaaggtgagccagctgcaggagagaaccggcagaaccgcccccaccgtgatcacctag

SEQ ID NO: 93222 - DNA, 1689 bp, Artificial Sequence
  Description of Artificial Sequence: Synthetic coding sequence
atggtgaagatcgtgaccgtgaagacccaggcctaccaggaccagaagcccggcaccagcggcctgagaaagagagtgaaggtgttccagagcagcgccaactacgccgagaacttcatccagagcatcatcagcaccgtggagcccgcccagagacaggaggccaccctggtggtgggcggcgacggcagattctacatgaaggaggccatccagctgatcgccagaatcgccgccgccaacggcatcggcagactggtgatcggccagaacggcatcctgagcacccccgccgtgagctgcatcatcagaaagatcaaggccatcggcggcatcatcctgaccgccagccacaaccccggcggccccaacggcgacttcggcatcaagttcaacatcagcaacggcggccccgcccccgaggccatcaccgacaagatcttccagatcagcaagaccatcgaggagtacgccgtgtgccccgacctgaaggtggacctgggcgtgctgggcaagcagcagttcgacctggagaacaagttcaagcccttcaccgtggagatcgtggacagcgtggaggcctacgccaccatgctgagaagcatcttcgacttcagcgccctgaaggagctgctgagcggccccaacagactgaagatcagaatcgacgccatgcacggcgtggtgggcccctacgtgaagaagatcctgtgcgaggagctgggcgcccccgccaacagcgccgtgaactgcgtgcccctggaggacttcggcggccaccaccccgaccccaacctgacctacgccgccgacctggtggagaccatgaagagcggcgagcacgacttcggcgccgccttcgacggcgacggcgacagaaacatgatcctgggcaagcacggcttcttcgtgaaccccagcgacagcgtggccgtgatcgccgccaacatcttcagcatcccctacttccagcagaccggcgtgagaggcttcgccagaagcatgcccaccagcggcgccctggacagagtggccagcgccaccaagatcgccctgtacgagacccccaccggctggaagttcttcggcaacctgatggacgccagcaagctgagcctgtgcggcgaggagagcttcggcaccggcagcgaccacatcagagagaaggacggcctgtgggccgtgctggcctggctgagcatcctggccaccagaaagcagagcgtggaggacatcctgaaggaccactggcagaagtacggcagaaacttcttcaccagatacgactacgaggaggtggaggccgagggcgccaacaagatgatgaaggacctggaggccctgatgttcgacagaagcttcgtgggcaagcagttcagcgccaacgacaaggtgtacaccgtggagaaggccgacaacttcgagtacagcgaccccgtggacggcagcatcagcagaaaccagggcctgagactgatcttcaccgacggcagcagaatcgtgttcagactgagcggcaccggcagcgccggcgccaccatcagactgtacatcgacagctacgagaaggacgtggccaagatcaaccaggacccccaggtgatgctggcccccctgatcagcatcgccctgaaggtgagccagctgcaggagagaaccggcagaaccgcccccaccgtgatcacctag

SEQ ID NO: 93223 - DNA, 1617 bp, Artificial Sequence
  Description of Artificial Sequence: Synthetic coding sequence
atggtgaaggtgttccagagcagcgccaactacgccgagaacttcatccagagcatcatcagcaccgtggagcccgcccagagacaggaggccaccctggtggtgggcggcgacggcagattctacatgaaggaggccatccagctgatcgccagaatcgccgccgccaacggcatcggcagactggtgatcggccagaacggcatcctgagcacccccgccgtgagctgcatcatcagaaagatcaaggccatcggcggcatcatcctgaccgccagccacaaccccggcggccccaacggcgacttcggcatcaagttcaacatcagcaacggcggccccgcccccgaggccatcaccgacaagatcttccagatcagcaagaccatcgaggagtacgccgtgtgccccgacctgaaggtggacctgggcgtgctgggcaagcagcagttcgacctggagaacaagttcaagcccttcaccgtggagatcgtggacagcgtggaggcctacgccaccatgctgagaagcatcttcgacttcagcgccctgaaggagctgctgagcggccccaacagactgaagatcagaatcgacgccatgcacggcgtggtgggcccctacgtgaagaagatcctgtgcgaggagctgggcgcccccgccaacagcgccgtgaactgcgtgcccctggaggacttcggcggccaccaccccgaccccaacctgacctacgccgccgacctggtggagaccatgaagagcggcgagcacgacttcggcgccgccttcgacggcgacggcgacagaaacatgatcctgggcaagcacggcttcttcgtgaaccccagcgacagcgtggccgtgatcgccgccaacatcttcagcatcccctacttccagcagaccggcgtgagaggcttcgccagaagcatgcccaccagcggcgccctggacagagtggccagcgccaccaagatcgccctgtacgagacccccaccggctggaagttcttcggcaacctgatggacgccagcaagctgagcctgtgcggcgaggagagcttcggcaccggcagcgaccacatcagagagaaggacggcctgtgggccgtgctggcctggctgagcatcctggccaccagaaagcagagcgtggaggacatcctgaaggaccactggcagaagtacggcagaaacttcttcaccagatacgactacgaggaggtggaggccgagggcgccaacaagatgatgaaggacctggaggccctgatgttcgacagaagcttcgtgggcaagcagttcagcgccaacgacaaggtgtacaccgtggagaaggccgacaacttcgagtacagcgaccccgtggacggcagcatcagcagaaaccagggcctgagactgatcttcaccgacggcagcagaatcgtgttcagactgagcggcaccggcagcgccggcgccaccatcagactgtacatcgacagctacgagaaggacgtggccaagatcaaccaggacccccaggtgatgctggcccccctgatcagcatcgccctgaaggtgagccagctgcaggagagaaccggcagaaccgcccccaccgtgatcacctag

SEQ ID NO: 93224 - DNA, 1098 bp, Artificial Sequence
  Description of Artificial Sequence: Synthetic coding sequence
atgctgagaagcatcttcgacttcagcgccctgaaggagctgctgagcggccccaacagactgaagatcagaatcgacgccatgcacggcgtggtgggcccctacgtgaagaagatcctgtgcgaggagctgggcgcccccgccaacagcgccgtgaactgcgtgcccctggaggacttcggcggccaccaccccgaccccaacctgacctacgccgccgacctggtggagaccatgaagagcggcgagcacgacttcggcgccgccttcgacggcgacggcgacagaaacatgatcctgggcaagcacggcttcttcgtgaaccccagcgacagcgtggccgtgatcgccgccaacatcttcagcatcccctacttccagcagaccggcgtgagaggcttcgccagaagcatgcccaccagcggcgccctggacagagtggccagcgccaccaagatcgccctgtacgagacccccaccggctggaagttcttcggcaacctgatggacgccagcaagctgagcctgtgcggcgaggagagcttcggcaccggcagcgaccacatcagagagaaggacggcctgtgggccgtgctggcctggctgagcatcctggccaccagaaagcagagcgtggaggacatcctgaaggaccactggcagaagtacggcagaaacttcttcaccagatacgactacgaggaggtggaggccgagggcgccaacaagatgatgaaggacctggaggccctgatgttcgacagaagcttcgtgggcaagcagttcagcgccaacgacaaggtgtacaccgtggagaaggccgacaacttcgagtacagcgaccccgtggacggcagcatcagcagaaaccagggcctgagactgatcttcaccgacggcagcagaatcgtgttcagactgagcggcaccggcagcgccggcgccaccatcagactgtacatcgacagctacgagaaggacgtggccaagatcaaccaggacccccaggtgatgctggcccccctgatcagcatcgccctgaaggtgagccagctgcaggagagaaccggcagaaccgcccccaccgtgatcacctag

SEQ ID NO: 93225 - DNA, 1839 bp, Artificial Sequence
  Description of Artificial Sequence: Synthetic coding sequence
atggccgcccccgagggcagcggcctgggcgaggacgccagactggaccaggagaccgcccagtggctgagatgggacaagaacagcctgaccctggaggccgtgaagagactgatcgccgagggcaacaaggaggagctgagaaagtgcttcggcgccagaatggagttcggcaccgccggcctgagagccgccatgggccccggcatcagcagaatgaacgacctgaccatcatccagaccacccagggcttctgcagatacctggagaagcagttcagcgacctgaagcagaagggcatcgtgatcagcttcgacgccagagcccaccccagcagcggcggcagcagcagaagattcgccagactggccgccaccaccttcatcagccagggcatccccgtgtacctgttcagcgacatcacccccacccccttcgtgcccttcaccgtgagccacctgaagctgtgcgccggcatcatgatcaccgccagccacaaccccaagcaggacaacggctacaaggtgtactgggacaacggcgcccagatcatcagcccccacgacaagggcatcagccaggccatcgaggagaacctggagccctggccccaggcctgggacgacagcctgatcgacagcagccccctgctgcacaaccccagcgccagcatcaacaacgactacttcgaggacctgaagaagtactgcttccacagaagcgtgaacagagagaccaaggtgaagttcgtgcacaccagcgtgcacggcgtgggccacagcttcgtgcagagcgccttcaaggccttcgacctggtgccccccgaggccgtgcccgagcagaaggaccccgaccccgagttccccaccgtgaagtaccccaaccccgaggagggcaagggcgtgctgaccctgagcttcgccctggccgacaagaccaaggccagaatcgtgctggccaacgaccccgacgccgacagactggccgtggccgagaagcaggacagcggcgagtggagagtgttcagcggcaacgagctgggcgccctgctgggctggtggctgttcaccagctggaaggagaagaaccaggacagaagcgccctgaaggacacctacatgctgagcagcaccgtgagcagcaagatcctgagagccatcgccctgaaggagggcttccacttcgaggagaccctgaccggcttcaagtggatgggcaacagagccaagcagctgatcgaccagggcaagaccgtgctgttcgccttcgaggaggccatcggctacatgtgctgccccttcgtgctggacaaggacggcgtgagcgccgccgtgatcagcgccgagctggccagcttcctggccaccaagaacctgagcctgagccagcagctgaaggccatctacgtggagtacggctaccacatcaccaaggccagctacttcatctgccacgaccaggagaccatcaagaagctgttcgagaacctgagaaactacgacggcaagaacaactaccccaaggcctgcggcaagttcgagatcagcgccatcagagacctgaccaccggctacgacgacagccagcccgacaagaaggccgtgctgcccaccagcaagagcagccagatgatcaccttcaccttcgccaacggcggcgtggccaccatgagaaccagcggcaccgagcccaagatcaagtactacgccgagctgtgcgccccccccggcaacagcgaccccgagcagctgaagaaggagctgaacgagctggtgagcgccatcgaggagcacttcttccagccccagaagtacaacctgcagcccaaggccgactag

SEQ ID NO: 93226 - DNA, 1359 bp, Artificial Sequence
  Description of Artificial Sequence: Synthetic coding sequence
atgatcaccgccagccacaaccccaagcaggacaacggctacaaggtgtactgggacaacggcgcccagatcatcagcccccacgacaagggcatcagccaggccatcgaggagaacctggagccctggccccaggcctgggacgacagcctgatcgacagcagccccctgctgcacaaccccagcgccagcatcaacaacgactacttcgaggacctgaagaagtactgcttccacagaagcgtgaacagagagaccaaggtgaagttcgtgcacaccagcgtgcacggcgtgggccacagcttcgtgcagagcgccttcaaggccttcgacctggtgccccccgaggccgtgcccgagcagaaggaccccgaccccgagttccccaccgtgaagtaccccaaccccgaggagggcaagggcgtgctgaccctgagcttcgccctggccgacaagaccaaggccagaatcgtgctggccaacgaccccgacgccgacagactggccgtggccgagaagcaggacagcggcgagtggagagtgttcagcggcaacgagctgggcgccctgctgggctggtggctgttcaccagctggaaggagaagaaccaggacagaagcgccctgaaggacacctacatgctgagcagcaccgtgagcagcaagatcctgagagccatcgccctgaaggagggcttccacttcgaggagaccctgaccggcttcaagtggatgggcaacagagccaagcagctgatcgaccagggcaagaccgtgctgttcgccttcgaggaggccatcggctacatgtgctgccccttcgtgctggacaaggacggcgtgagcgccgccgtgatcagcgccgagctggccagcttcctggccaccaagaacctgagcctgagccagcagctgaaggccatctacgtggagtacggctaccacatcaccaaggccagctacttcatctgccacgaccaggagaccatcaagaagctgttcgagaacctgagaaactacgacggcaagaacaactaccccaaggcctgcggcaagttcgagatcagcgccatcagagacctgaccaccggctacgacgacagccagcccgacaagaaggccgtgctgcccaccagcaagagcagccagatgatcaccttcaccttcgccaacggcggcgtggccaccatgagaaccagcggcaccgagcccaagatcaagtactacgccgagctgtgcgccccccccggcaacagcgaccccgagcagctgaagaaggagctgaacgagctggtgagcgccatcgaggagcacttcttccagccccagaagtacaacctgcagcccaaggccgactag

SEQ ID NO: 93227 - DNA, 876 bp, Artificial Sequence
  Description of Artificial Sequence: Synthetic coding sequence
atgagcagccagctgatcctgagacccttcaccgtgagccacctgaagctgtgcgccggcatcatgatcaccgccagccacaaccccaagcaggacaacggctacaaggtgtactgggacaacggcgcccagatcatcagcccccacgacaagggcatcagccaggccatcgaggagaacctggagccctggccccaggcctgggacgacagcctgatcgacagcagccccctgctgcacaaccccagcgccagcatcaacaacgactacttcgaggacctgaagaagtactgcttccacagaagcgtgaacagagagaccaaggtgaagttcgtgcacaccagcgtgcacggcgtgggccacagcttcgtgcagagcgccttcaaggccttcgacctggtgccccccgaggccgtgcccgagcagaaggaccccgaccccgagttccccaccgtgaagtaccccaaccccgaggagggcaagggcgtgctgaccctgagcttcgccctggccgacaagaccaaggccagaatcgtgctggccaacgaccccgacgccgacagactggccgtggccgagaagcaggacagcggcgagtggagagtgttcagcggcaacgagctgggcgccctgctgggctggtggctgttcaccagctggaaggagaagaaccaggacagaagcgccctgaaggacacctacatgctgagcagcaccgtgagcagcaagatcctgagagccatcgccctgaaggagggcttccacttcgaggagaccctgaccggcttcaagtggatgggcaacagagccaagcagctgatcgaccagggcaagaccgtgctgttcgccttcgaggaggccatcggcaagaagtag

SEQ ID NO: 93228 - DNA, 1869 bp, Artificial Sequence
  Description of Artificial Sequence: Synthetic coding sequence
atggccgagaacaccgagggcgacctgaacagcaacctgctgcacgccccctaccacaccggcgacccccagctggacaccgccatcggccagtggctgagatgggacaagaaccccaagaccaaggagcagatcgagaacctgctgagaaacggcatgaacaaggagctgagagacagactgtgctgcagaatgaccttcggcaccgccggcctgagaagcgccatgggcgccggcttctgctacatcaacgacctgaccgtgatccagagcacccagggcatgtacaagtacctggagagatgcttcagcgacttcaagcagagaggcttcgtggtgggctacgacaccagaggccaggtgaccagcagctgcagcagccagagactggccaagctgaccgccgccgtgctgctggccaaggacgtgcccgtgtacctgttcagcagatacgtgcccacccccttcgtgccctacgccgtgcagaagctgaaggccgtggccggcgtgatgatcaccgccagccacaacagaaaggaggacaacggctacaaggtgtactgggagaccggcgcccagatcaccagcccccacgacaaggagatcctgaagtgcatcgaggagtgcgtggagccctggaacggcagctggaacgacaacctggtggacaccagccccctgaagagagaccccctgcaggacatctgcagaagatacatggaggacctgaagaagatctgcttctacagagagctgaacagcaagaccaccctgaagttcgtgcacaccagcttccacggcgtgggccacgactacgtgcagctggccttcaaggtgttcggcttcaagccccccatccccgtgcccgagcagaaggaccccgaccccgacttcagcaccgtgaagtgccccaaccccgaggagggcgagagcgtgctggagctgagcctgagactggccgagaaggagaacgccagagtggtgctggccaccgaccccgacgccgacagactggccgccgccgagctgcaggagaacggctgctggaaggtgttcaccggcaacgagctggccgccctgttcggctggtggatgttcgactgctggaagaagaacaagagcagaaacgccgacgtgaagaacgtgtacatgctggccaccaccgtgagcagcaagatcctgaaggccatcgccctgaaggagggcttccacttcgaggagaccctgcccggcttcaagtggatcggcagcagaatcatcgacctgctggagaacggcaaggaggtgctgttcgccttcgaggagagcatcggcttcctgtgcggcaccagcgtgctggacaaggacggcgtgagcgccgccgtggtggtggccgagatggccagctacctggagaccatgaacatcaccctgaagcagcagctggtgaaggtgtacgagaagtacggctaccacatcagcaagaccagctacttcctgtgctacgagccccccaccatcaagagcatcttcgagagactgagaaacttcgacagccccaaggagtaccccaagttctgcggcaccttcgccatcctgcacgtgagagacgtgaccaccggctacgacagcagccagcccaacaagaagagcgtgctgcccgtgagcaagaacagccagatgatcaccttcaccttccagaacggctgcgtggccaccctgagaaccagcggcaccgagcccaagatcaagtactacgccgagatgtgcgccagccccgaccagagcgacaccgccctgctggaggaggagctgaagaagctgatcgacgccctgatcgagaacttcctgcagcccagcaagaacggcctgatctggagaagcgtgtag

SEQ ID NO: 93229 - DNA, 1713 bp, Artificial Sequence
  Description of Artificial Sequence: Synthetic coding sequence
atgggcggcgagtggggccagagcgccatctgccccgagagcgcccaggagtggacctaccaggtgggccagcacctggtggacatggacctgggcgccatcaccaagtacagcgccctgcacgccaagcccaacggcctgatcctgcagtacggcaccgccggcttcagaaccaaggccgagcacctggaccacgtgatgttcagaatgggcctgctggccgtgctgagaagcaagcagaccaagagcaccatcggcgtgatggtgaccgccagccacaaccccgaggaggacaacggcgtgaagctggtggaccccctgggcgagatgctggcccccagctgggaggagcacgccacctgcctggccaacgccgaggagcaggacatgcagagagtgctgatcgacatcagcgagaaggaggccgtgaacctgcagcaggacgccttcgtggtgatcggcagagacaccagacccagcagcgagaagctgagccagagcgtgatcgacggcgtgaccgtgctgggcggccagttccacgactacggcctgctgaccaccccccagctgcactacatggtgtactgcagaaacaccggcggcagatacggcaaggccaccatcgagggctactaccagaagctgagcaaggccttcgtggagctgaccaagcaggccagctgcagcggcgacgagtacagaagcctgaaggtggactgcgccaacggcatcggcgccctgaagctgagagagatggagcactacttcagccagggcctgagcgtgcagctgttcaacgacggcagcaagggcaagctgaaccacctgtgcggcgccgacttcgtgaagagccaccagaagcccccccagggcatggagatcaagagcaacgagagatgctgcagcttcgacggcgacgccgacagaatcgtgtactactaccacgacgccgacggccacttccacctgatcgacggcgacaagatcgccaccctgatcagcagcttcctgaaggagctgctggtggagatcggcgagagcctgaacatcggcgtggtgcagaccgcctacgccaacggcagcagcaccagatacctggaggaggtgatgaaggtgcccgtgtactgcaccaagaccggcgtgaagcacctgcaccacaaggcccaggagttcgacatcggcgtgtacttcgaggccaacggccacggcaccgccctgttcagcaccgccgtggagatgaagatcaagcagagcgccgagcagctggaggacaagaagagaaaggccgccaagatgctggagaacatcatcgacctgttcaaccaggccgccggcgacgccatcagcgacatgctggtgatcgaggccatcctggccctgaagggcctgaccgtgcagcagtgggacgccctgtacaccgacctgcccaacagacagctgaaggtgcaggtggccgacagaagagtgatcagcaccaccgacgccgagagacaggccgtgaccccccccggcctgcaggaggccatcaacgacctggtgaagaagtacaagctgagcagagccttcgtgagacccagcggcaccgaggacgtggtgagagtgtacgccgaggccgacagccaggagagcgccgaccacctggcccacgaggtgagcctggccgtgttccagctggccggcggcatcggcgagagaccccagcccggcttctag

SEQ ID NO: 93230 - DNA, 444 bp, Artificial Sequence
  Description of Artificial Sequence: Synthetic coding sequence
atggacctgggcgccatcaccaagtacagcgccctgcacgccaagcccaacggcctgatcctgcagtacggcaccgccggcttcagaaccaaggccgagcacctggaccacgtgatgttcagaatgggcctgctggccgtgctgagaagcaagcagaccaagagcaccatcggcgtgatggtgaccgccagccacaaccccgaggaggacaacggcgtgaagctggtggaccccctgggcgagatgctggcccccagctgggaggagcacgccacctgcctggccaacgccgaggagcaggacatgcagagagtgctgatcgacatcagcgagaaggaggccgtgaacctgcagcaggacgccttcgtggtgatcggcagagacaccagacccagcagcgagaagctgagccagagcgtgatcgacggcgtgaccgtgctgtag

SEQ ID NO: 93231 - DNA, 1629 bp, Artificial Sequence
  Description of Artificial Sequence: Synthetic coding sequence
atggacctgggcgccatcaccaagtacagcgccctgcacgccaagcccaacggcctgatcctgcagtacggcaccgccggcttcagaaccaaggccgagcacctggaccacgtgatgttcagaatgggcctgctggccgtgctgagaagcaagcagaccaagagcaccatcggcgtgatggtgaccgccagccacaaccccgaggaggacaacggcgtgaagctggtggaccccctgggcgagatgctggcccccagctgggaggagcacgccacctgcctggccaacgccgaggagcaggacatgcagagagtgctgatcgacatcagcgagaaggaggccgtgaacctgcagcaggacgccttcgtggtgatcggcagagacaccagacccagcagcgagaagctgagccagagcgtgatcgacggcgtgaccgtgctgggcggccagttccacgactacggcctgctgaccaccccccagctgcactacatggtgtactgcagaaacaccggcggcagatacggcaaggccaccatcgagggctactaccagaagctgagcaaggccttcgtggagctgaccaagcaggccagctgcagcggcgacgagtacagaagcctgaaggtggactgcgccaacggcatcggcgccctgaagctgagagagatggagcactacttcagccagggcctgagcgtgcagctgttcaacgacggcagcaagggcaagctgaaccacctgtgcggcgccgacttcgtgaagagccaccagaagcccccccagggcatggagatcaagagcaacgagagatgctgcagcttcgacggcgacgccgacagaatcgtgtactactaccacgacgccgacggccacttccacctgatcgacggcgacaagatcgccaccctgatcagcagcttcctgaaggagctgctggtggagatcggcgagagcctgaacatcggcgtggtgcagaccgcctacgccaacggcagcagcaccagatacctggaggaggtgatgaaggtgcccgtgtactgcaccaagaccggcgtgaagcacctgcaccacaaggcccaggagttcgacatcggcgtgtacttcgaggccaacggccacggcaccgccctgttcagcaccgccgtggagatgaagatcaagcagagcgccgagcagctggaggacaagaagagaaaggccgccaagatgctggagaacatcatcgacctgttcaaccaggccgccggcgacgccatcagcgacatgctggtgatcgaggccatcctggccctgaagggcctgaccgtgcagcagtgggacgccctgtacaccgacctgcccaacagacagctgaaggtgcaggtggccgacagaagagtgatcagcaccaccgacgccgagagacaggccgtgaccccccccggcctgcaggaggccatcaacgacctggtgaagaagtacaagctgagcagagccttcgtgagacccagcggcaccgaggacgtggtgagagtgtacgccgaggccgacagccaggagagcgccgaccacctggcccacgaggtgagcctggccgtgttccagctggccggcggcatcggcgagagaccccagcccggcttctag

SEQ ID NO: 93232 - DNA, 1701 bp, Artificial Sequence
  Description of Artificial Sequence: Synthetic coding sequence
atggacctgggcgccatcaccaagtacagcgccctgcacgccaagcccaacggcctgatcctgcagtacggcaccgccggcttcagaaccaaggccgagcacctggaccacgtgatgttcagaatgggcctgctggccgtgctgagaagcaagcagaccaagagcaccatcggcgtgatggtgaccgccagccacaaccccgaggaggacaacggcgtgaagctggtggaccccctgggcgagatgctggcccccagctgggaggagcacgccacctgcctggccaacgccgaggagcaggacatgcagagagtgctgatcgacatcagcgagaaggaggccgtgaacctgcagcaggacgccttcgtggtgatcggcagagacaccagacccagcagcgagaagctgagccagagcgtgatcgacggcgtgaccgtgctgggcggccagttccacgactacggcctgctgaccaccccccagctgcactacatggtgtactgcagaaacaccggcggcagatacggcaaggccaccatcgagggctactaccagaagctgagcaaggccttcgtggagctgaccaagcaggccagctgcagcggcgacgagtacagaagcctgaaggtggactgcgccaacggcatcggcgccctgaagctgagagagatggagcactacttcagccagggcctgagcgtgcagctgttcaacgacggcagcaagggcaagctgaaccacctgtgcggcgccgacttcgtgaagagccaccagaagcccccccagggcatggagatcaagagcaacgagagatgctgcagcttcgacggcgacgccgacagaatcgtgtactactaccacgacgccgacggccacttccacctgatcgacggcgacaagatcgccaccctgatcagcagcttcctgaaggagctgctggtggagatcggcgagagcctgaacatcggcgtggtgcagaccgcctacgccaacggcagcagcaccagatacctggaggaggtgatgaaggtgcccgtgtactgcaccaagaccggcgtgaagcacctgcaccacaaggcccaggagttcgacatcggcgtgtacttcgaggccaacggccacggcaccgccctgttcagcaccgccgtggagatgaagatcaagcagagcgccgagcagctggaggacaagaagagaaaggccgccaagatgctggagaacatcatcgacctgttcaaccaggccgccggcgacgccatcagcgacatgctggtgatcgaggccatcctggccctgaagggcctgaccgtgcagcagtgggacgccctgtacaccgacctgcccaacagacagctgaaggtgcaggtggccgacagaagagtgatcagcaccaccgacgccgagagacaggccgtgaccccccccggcctgcaggaggccatcaacgacctggtgaagaagtacaagctgagcagagccttcgtgagacccagcggcaccgaggacgtggtgagagtgtacgccgaggccgacagccaggagagcgccgaccacctggcccacgaggtgagcctggccgtgttccagctggccggcggcatcggcgagagaccccagcccggctacaaggccgccgagaccacccacaacatcaacaacgccttcggccccggcaccgccaacgagcacaccgtgccctag

SEQ ID NO: 93233 - DNA, 720 bp, Artificial Sequence
  Description of Artificial Sequence: Synthetic coding sequence
atggagggcagccccatccccgtgctgaccgtgcccaccgccccctacgaggaccagagacccgccggcggcggcggcctgagaagacccaccggcctgttcgagggccagagaaactacctgcccaacttcatccagagcgtgctgagcagcatcgacctgagagacagacagggctgcaccatggtggtgggcagcgacggcagatacttcagcagaaccgccatcgagatcgtggtgcagatggccgccgccaacggcatcggcagactgatcatcggccagaacggcatcctgagcacccccgccgtgagctgcatcatcagaaagatcaaggccgccggcggcatcatcctgaccgccagccactgccccggcggccccggcggcgagttcggcgtgaagttcaacgtggccaacggcgtggagatcgtggaccccgtggacatctacctgaacctgctgagaaccatcttcgacttccacgccatcaagggcctgctgaccggccccagccagctgaagatcagaatcgacgccatgcacggcgtgatgggcccctacgtgagaaaggtgctgtgcgacgagctgggcgcccccgccaacagcgccatcaactgcgtgcccctggaggacttcggcggccagcaccccgaccccaacctgacctacgccaccaccctgctggaggccatgaagggcggcgagtacggcttctag

SEQ ID NO: 93234 - DNA, 1704 bp, Artificial Sequence
  Description of Artificial Sequence: Synthetic coding sequence
atggagggcagccccatccccgtgctgaccgtgcccaccgccccctacgaggaccagagacccgccggcggcggcggcctgagaagacccaccggcctgttcgagggccagagaaactacctgcccaacttcatccagagcgtgctgagcagcatcgacctgagagacagacagggctgcaccatggtggtgggcagcgacggcagatacttcagcagaaccgccatcgagatcgtggtgcagatggccgccgccaacggcatcggcagactgatcatcggccagaacggcatcctgagcacccccgccgtgagctgcatcatcagaaagatcaaggccgccggcggcatcatcctgaccgccagccactgccccggcggccccggcggcgagttcggcgtgaagttcaacgtggccaacggcggccccgcccccgacgtggtgagcgacaagatctaccagatcagcaagaccatcgaggagtacgccatctgccccgacctgagaatcgacctgagcagactgggcagacaggagttcgacctggagaacaagttcaagcccttcagagtggagatcgtggaccccgtggacatctacctgaacctgctgagaaccatcttcgacttccacgccatcaagggcctgctgaccggccccagccagctgaagatcagaatcgacgccatgcacggcgtgatgggcccctacgtgagaaaggtgctgtgcgacgagctgggcgcccccgccaacagcgccatcaactgcgtgcccctggaggacttcggcggccagcaccccgaccccaacctgacctacgccaccaccctgctggaggccatgaagggcggcgagtacggcttcggcgccgccttcgacgccgacggcgacagatacatgatcctgggccagaacggcttcttcgtgagccccagcgacagcctggccatcatcgccgccaacctgagctgcatcccctacttcagacagatgggcgtgagaggcttcggcagaagcatgcccaccagcatggccctggacagagtggccaagagcatgaaggtgcccgtgtacgagacccccgccggctggagattcttcagcaacctgatggacagcggcagatgcaacctgtgcggcgaggagagcttcggcaccggcagcgaccacctgagagagaaggacggcctgtgggccgtgctggtgtggctgagcatcatcgccgccagaaagcagagcgtggaggagatcgtgagagaccactgggccaagttcggcagacactactactgcagattcgactacgagggcctggaccccaagaccacctactacatcatgagagacctggaggccctggtgaccgacaagagcttcatcggccagcagttcgccgtgggcagccacgtgtacagcgtggccaagaccgacagcttcgagtacgtggaccccgtggacggcaccgtgaccaagaagcagggcctgagaatcatcttcagcgacgccagcagactgatcttcagactgagcagcagcagcggcgtgagagccaccctgagactgtacgccgagagctacgagagagaccccagcggccacgaccaggagccccaggccgtgctgagccccctgatcgccatcgccctgaagatcagccagatccacgagagaaccggcagaagaggccccaccgtgatcacctag

SEQ ID NO: 93235 - DNA, 1452 bp, Artificial Sequence
  Description of Artificial Sequence: Synthetic coding sequence
atggcccaggccgacatcgccctgatcggcctggccgtgatgggccagaacctgatcctgaacatgaacgaccacggcttcgtggtgtgcgccttcaacagaaccgtgagcaaggtggacgacttcctggccaacgaggccaagggcaccaaggtggtgggcgcccagagcctgaaggagatggtgagcaagctgaagaagcccagaagaatcatcctgctggtgaaggccggccaggccgtggacgacttcatcgagaagctggtgcccctgctggacaccggcgacatcatcatcgacggcggcaacagcgagtacagagacaccaccagaagatgcagagacctgaaggccaagggcatcctgttcgtgggcagcggcgtgagcggcggcgaggagggcgccagatacggccccagcctgatgcccggcggcaacaaggaggcctggccccacatcaagaccatcttccagggcatcgccgccaaggtgggcaccggcgagccctgctgcgactgggtgggcgacgagggcgccggccacttcgtgaagatggtgcacaacggcatcgagtacggcgacatgcagctgatctgcgaggcctaccacctgatgaaggacgtgctgggcatggcccaggacgagatggcccaggccttcgaggactggaacaagaccgagctggacagcttcctgatcgagatcaccgccaacatcctgaagttccaggacaccgacggcaagcacctgctgcccaagatcagagacagcgccggccagaagggcaccggcaagtggaccgccatcagcgccctggagtacggcgtgcccgtgaccctgatcggcgaggccgtgttcgccagatgcctgagcagcctgaaggacgagagaatccaggccagcaagaagctgaagggcccccagaagttccagttcgacggcgacaagaagagcttcctggaggacatcagaaaggccctgtacgccagcaagatcatcagctacgcccagggcttcatgctgctgagacaggccgccaccgagttcggctggaccctgaactacggcggcatcgccctgatgtggagaggcggctgcatcatcagaagcgtgttcctgggcaagatcaaggacgccttcgacagaaaccccgagctgcagaacctgctgctggacgacttcttcaagagcgccgtggagaactgccaggacagctggagaagagccgtgagcaccggcgtgcaggccggcatccccatgccctgcttcaccaccgccctgagcttctacgacggctacagacacgagatgctgcccgccagcctgatccaggcccagagagactacttcggcgcccacacctacgagctgctggccaagcccggccagttcatccacaccaactggaccggccacggcggcaccgtgagcagcagcagctacaacgcctag

SEQ ID NO: 93236 - DNA, 1413 bp, Artificial Sequence
  Description of Artificial Sequence: Synthetic coding sequence
atgggccagaacctgatcctgaacatgaacgaccacggcttcgtggtgtgcgccttcaacagaaccgtgagcaaggtggacgacttcctggccaacgaggccaagggcaccaaggtggtgggcgcccagagcctgaaggagatggtgagcaagctgaagaagcccagaagaatcatcctgctggtgaaggccggccaggccgtggacgacttcatcgagaagctggtgcccctgctggacaccggcgacatcatcatcgacggcggcaacagcgagtacagagacaccaccagaagatgcagagacctgaaggccaagggcatcctgttcgtgggcagcggcgtgagcggcggcgaggagggcgccagatacggccccagcctgatgcccggcggcaacaaggaggcctggccccacatcaagaccatcttccagggcatcgccgccaaggtgggcaccggcgagccctgctgcgactgggtgggcgacgagggcgccggccacttcgtgaagatggtgcacaacggcatcgagtacggcgacatgcagctgatctgcgaggcctaccacctgatgaaggacgtgctgggcatggcccaggacgagatggcccaggccttcgaggactggaacaagaccgagctggacagcttcctgatcgagatcaccgccaacatcctgaagttccaggacaccgacggcaagcacctgctgcccaagatcagagacagcgccggccagaagggcaccggcaagtggaccgccatcagcgccctggagtacggcgtgcccgtgaccctgatcggcgaggccgtgttcgccagatgcctgagcagcctgaaggacgagagaatccaggccagcaagaagctgaagggcccccagaagttccagttcgacggcgacaagaagagcttcctggaggacatcagaaaggccctgtacgccagcaagatcatcagctacgcccagggcttcatgctgctgagacaggccgccaccgagttcggctggaccctgaactacggcggcatcgccctgatgtggagaggcggctgcatcatcagaagcgtgttcctgggcaagatcaaggacgccttcgacagaaaccccgagctgcagaacctgctgctggacgacttcttcaagagcgccgtggagaactgccaggacagctggagaagagccgtgagcaccggcgtgcaggccggcatccccatgccctgcttcaccaccgccctgagcttctacgacggctacagacacgagatgctgcccgccagcctgatccaggcccagagagactacttcggcgcccacacctacgagctgctggccaagcccggccagttcatccacaccaactggaccggccacggcggcaccgtgagcagcagcagctacaacgcctag

SEQ ID NO: 93237 - DNA, 1386 bp, Artificial Sequence
  Description of Artificial Sequence: Synthetic coding sequence
atggcccaggccgacatcgccctgatcggcctggccgtgatgggccagaacctgatcctgaacatgaacgaccacggcttcgtggtgtgcgccttcaacagaaccgtgagcaaggtggacgacttcctggccaacgaggccaagggcaccaaggtggtgggcgcccagagcctgaaggagatggtgagcaagctgaagaagcccagaagaatcatcctgctggtgaaggccggccaggccgtggacgacttcatcgagaagctgagaagatgcagagacctgaaggccaagggcatcctgttcgtgggcagcggcgtgagcggcggcgaggagggcgccagatacggccccagcctgatgcccggcggcaacaaggaggcctggccccacatcaagaccatcttccagggcatcgccgccaaggtgggcaccggcgagccctgctgcgactgggtgggcgacgagggcgccggccacttcgtgaagatggtgcacaacggcatcgagtacggcgacatgcagctgatctgcgaggcctaccacctgatgaaggacgtgctgggcatggcccaggacgagatggcccaggccttcgaggactggaacaagaccgagctggacagcttcctgatcgagatcaccgccaacatcctgaagttccaggacaccgacggcaagcacctgctgcccaagatcagagacagcgccggccagaagggcaccggcaagtggaccgccatcagcgccctggagtacggcgtgcccgtgaccctgatcggcgaggccgtgttcgccagatgcctgagcagcctgaaggacgagagaatccaggccagcaagaagctgaagggcccccagaagttccagttcgacggcgacaagaagagcttcctggaggacatcagaaaggccctgtacgccagcaagatcatcagctacgcccagggcttcatgctgctgagacaggccgccaccgagttcggctggaccctgaactacggcggcatcgccctgatgtggagaggcggctgcatcatcagaagcgtgttcctgggcaagatcaaggacgccttcgacagaaaccccgagctgcagaacctgctgctggacgacttcttcaagagcgccgtggagaactgccaggacagctggagaagagccgtgagcaccggcgtgcaggccggcatccccatgccctgcttcaccaccgccctgagcttctacgacggctacagacacgagatgctgcccgccagcctgatccaggcccagagagactacttcggcgcccacacctacgagctgctggccaagcccggccagttcatccacaccaactggaccggccacggcggcaccgtgagcagcagcagctacaacgcctag

SEQ ID NO: 93238 - DNA, 1290 bp, Artificial Sequence
  Description of Artificial Sequence: Synthetic coding sequence
atgaccaccgccctgtggagcgtgctgctgatcggcctgagccccaagctgatgatcagctggcccatgagacaggccgtggacgacttcatcgagaagctggtgcccctgctggacaccggcgacatcatcatcgacggcggcaacagcgagtacagagacaccaccagaagatgcagagacctgaaggccaagggcatcctgttcgtgggcagcggcgtgagcggcggcgaggagggcgccagatacggccccagcctgatgcccggcggcaacaaggaggcctggccccacatcaagaccatcttccagggcatcgccgccaaggtgggcaccggcgagccctgctgcgactgggtgggcgacgagggcgccggccacttcgtgaagatggtgcacaacggcatcgagtacggcgacatgcagctgatctgcgaggcctaccacctgatgaaggacgtgctgggcatggcccaggacgagatggcccaggccttcgaggactggaacaagaccgagctggacagcttcctgatcgagatcaccgccaacatcctgaagttccaggacaccgacggcaagcacctgctgcccaagatcagagacagcgccggccagaagggcaccggcaagtggaccgccatcagcgccctggagtacggcgtgcccgtgaccctgatcggcgaggccgtgttcgccagatgcctgagcagcctgaaggacgagagaatccaggccagcaagaagctgaagggcccccagaagttccagttcgacggcgacaagaagagcttcctggaggacatcagaaaggccctgtacgccagcaagatcatcagctacgcccagggcttcatgctgctgagacaggccgccaccgagttcggctggaccctgaactacggcggcatcgccctgatgtggagaggcggctgcatcatcagaagcgtgttcctgggcaagatcaaggacgccttcgacagaaaccccgagctgcagaacctgctgctggacgacttcttcaagagcgccgtggagaactgccaggacagctggagaagagccgtgagcaccggcgtgcaggccggcatccccatgccctgcttcaccaccgccctgagcttctacgacggctacagacacgagatgctgcccgccagcctgatccaggcccagagagactacttcggcgcccacacctacgagctgctggccaagcccggccagttcatccacaccaactggaccggccacggcggcaccgtgagcagcagcagctacaacgcctag

SEQ ID NO: 93239 - DNA, 1500 bp, Artificial Sequence
  Description of Artificial Sequence: Synthetic coding sequence
atgaccttctggacccagatgttcttcctgctgcaggactgcgagggcctgatcgtgagaagcgccaccaaggtgaccgccgacgtgatcaacgccgccgagaagctgcaggtggtgggcagagccggcaccggcgtggacaacgtggacctggaggccgccaccagaaagggcatcctggtgatgaacacccccaacggcaacagcctgagcgccgccgagctgacctgcggcatgatcatgtgcctggccagacagatcccccaggccaccgccagcatgaaggacggcaagtgggagagaaagaagttcatgggcaccgagctgaacggcaagaccctgggcatcctgggcctgggcagaatcggcagagaggtggccaccagaatgcagagcttcggcatgaagaccatcggctacgaccccatcatcagccccgaggtgagcgccagcttcggcgtgcagcagctgcccctggaggagatctggcccctgtgcgacttcatcaccgtgcacacccccctgctgcccagcaccaccggcctgctgaacgacaacaccttcgcccagtgcaagaagggcgtgagagtggtgaactgcgccagaggcggcatcgtggacgagggcgccctgctgagagccctgcagagcggccagtgcgccggcgccgccctggacgtgttcaccgaggagccccccagagacagagccctggtggaccacgagaacgtgatcagctgcccccacctgggcgccagcaccaaggaggcccagagcagatgcggcgaggagatcgccgtgcagttcgtggacatggtgaagggcaagagcctgaccggcgtggtgaacgcccaggccctgaccagcgccttcagcccccacaccaagccctggatcggcctggccgaggccctgggcaccctgatgagagcctgggccggcagccccaagggcaccatccaggtgatcacccagggcaccagcctgaagaacgccggcaactgcctgagccccgccgtgatcgtgggcctgctgaaggaggccagcaagcaggccgacgtgaacctggtgaacgccaagctgctggtgaaggaggccggcctgaacgtgaccaccagccacagccccgccgcccccggcgagcagggcttcggcgagtgcctgctggccgtggccctggccggcgccccctaccaggccgtgggcctggtgcagggcaccacccccgtgctgcagggcctgaacggcgccgtgttcagacccgaggtgcccctgagaagagacctgcccctgctgctgttcagaacccagaccagcgaccccgccatgctgcccaccatgatcggcctgctggccgaggccggcgtgagactgctgagctaccagaccagcctggtgagcgacggcgagacctggcacgtgatgggcatcagcagcctgctgcccagcctggaggcctggaagcagcacgtgaccgaggccttccagttccacttctag

SEQ ID NO: 93240 - DNA, 1602 bp, Artificial Sequence
  Description of Artificial Sequence: Synthetic coding sequence
atggccttcgccaacctgagaaaggtgctgatcagcgacagcctggacccctgctgcagaaagatcctgcaggacggcggcctgcaggtggtggagaagcagaacctgagcaaggaggagctgatcgccgagctgcaggactgcgagggcctgatcgtgagaagcgccaccaaggtgaccgccgacgtgatcaacgccgccgagaagctgcaggtggtgggcagagccggcaccggcgtggacaacgtggacctggaggccgccaccagaaagggcatcctggtgatgaacacccccaacggcaacagcctgagcgccgccgagctgacctgcggcatgatcatgtgcctggccagacagatcccccaggccaccgccagcatgaaggacggcaagtgggagagaaagaagttcatgggcaccgagctgaacggcaagaccctgggcatcctgggcctgggcagaatcggcagagaggtggccaccagaatgcagagcttcggcatgaagaccatcggctacgaccccatcatcagccccgaggtgagcgccagcttcggcgtgcagcagctgcccctggaggagatctggcccctgtgcgacttcatcaccgtgcacacccccctgctgcccagcaccaccggcctgctgaacgacaacaccttcgcccagtgcaagaagggcgtgagagtggtgaactgcgccagaggcggcatcgtggacgagggcgccctgctgagagccctgcagagcggccagtgcgccggcgccgccctggacgtgttcaccgaggagccccccagagacagagccctggtggaccacgagaacgtgatcagctgcccccacctgggcgccagcaccaaggaggcccagagcagatgcggcgaggagatcgccgtgcagttcgtggacatggtgaagggcaagagcctgaccggcgtggtgaacgcccaggccctgaccagcgccttcagcccccacaccaagccctggatcggcctggccgaggccctgggcaccctgatgagagcctgggccggcagccccaagggcaccatccaggtgatcacccagggcaccagcctgaagaacgccggcaactgcctgagccccgccgtgatcgtgggcctgctgaaggaggccagcaagcaggccgacgtgaacctggtgaacgccaagctgctggtgaaggaggccggcctgaacgtgaccaccagccacagccccgccgcccccggcgagcagggcttcggcgagtgcctgctggccgtggccctggccggcgccccctaccaggccgtgggcctggtgcagggcaccacccccgtgctgcagggcctgaacggcgccgtgttcagacccgaggtgcccctgagaagagacctgcccctgctgctgttcagaacccagaccagcgaccccgccatgctgcccaccatgatcggcctgctggccgaggccggcgtgagactgctgagctaccagaccagcctggtgagcgacggcgagacctggcacgtgatgggcatcagcagcctgctgcccagcctggaggcctggaagcagcacgtgaccgaggccttccagttccacttctag

SEQ ID NO: 93241 - DNA, 291 bp, Artificial Sequence
  Description of Artificial Sequence: Synthetic coding sequence
atgaagaccatcggctacgaccccatcatcagccccgaggtgagcgccagcttcggcgtgcagcagctgcccctggaggagatctggcccctgtgcgacttcatcaccgtgcacacccccctgctgcccagcaccaccggcctgctgaacgacaacaccttcgcccagtgcaagaagggcgtgagagtggtgaactgcgccagaggcggcatcgtggacgagggcgccctgctgagagccctgcagagcggccagtgcgccggcgccgccctggacgtgttcaccgagtag

SEQ ID NO: 93242 - DNA, 1221 bp, Artificial Sequence
  Description of Artificial Sequence: Synthetic coding sequence
atgaaggacggcaagtgggagagaaagaagttcatgggcaccgagctgaacggcaagaccctgggcatcctgggcctgggcagaatcggcagagaggtggccaccagaatgcagagcttcggcatgaagaccatcggctacgaccccatcatcagccccgaggtgagcgccagcttcggcgtgcagcagctgcccctggaggagatctggcccctgtgcgacttcatcaccgtgcacacccccctgctgcccagcaccaccggcctgctgaacgacaacaccttcgcccagtgcaagaagggcgtgagagtggtgaactgcgccagaggcggcatcgtggacgagggcgccctgctgagagccctgcagagcggccagtgcgccggcgccgccctggacgtgttcaccgaggagccccccagagacagagccctggtggaccacgagaacgtgatcagctgcccccacctgggcgccagcaccaaggaggcccagagcagatgcggcgaggagatcgccgtgcagttcgtggacatggtgaagggcaagagcctgaccggcgtggtgaacgcccaggccctgaccagcgccttcagcccccacaccaagccctggatcggcctggccgaggccctgggcaccctgatgagagcctgggccggcagccccaagggcaccatccaggtgatcacccagggcaccagcctgaagaacgccggcaactgcctgagccccgccgtgatcgtgggcctgctgaaggaggccagcaagcaggccgacgtgaacctggtgaacgccaagctgctggtgaaggaggccggcctgaacgtgaccaccagccacagccccgccgcccccggcgagcagggcttcggcgagtgcctgctggccgtggccctggccggcgccccctaccaggccgtgggcctggtgcagggcaccacccccgtgctgcagggcctgaacggcgccgtgttcagacccgaggtgcccctgagaagagacctgcccctgctgctgttcagaacccagaccagcgaccccgccatgctgcccaccatgatcggcctgctggccgaggccggcgtgagactgctgagctaccagaccagcctggtgagcgacggcgagacctggcacgtgatgggcatcagcagcctgctgcccagcctggaggcctggaagcagcacgtgaccgaggccttccagttccacttctag

SEQ ID NO: 93243 - DNA, 1254 bp, Artificial Sequence
  Description of Artificial Sequence: Synthetic coding sequence
atgagcctgagcaacaagctgaccctggacaagctggacgtgaagggcaagagagtggtgatgagagtggacttcaacgtgcccatgaagaacaaccagatcaccaacaaccagagaatcaaggccgccgtgcccagcatcaagttctgcctggacaacggcgccaagagcgtggtgctgatgagccacctgggcagacccgacggcgtgcccatgcccgacaagtacagcctggagcccgtggccgtggagctgaagagcctgctgggcaaggacgtgctgttcctgaaggactgcgtgggccccgaggtggagaaggcctgcgccaaccccgccgccggcagcgtgatcctgctggagaacctgagattccacgtggaggaggagggcaagggcaaggacgccagcggcaacaaggtgaaggccgagcccgccaagatcgaggccttcagagccagcctgagcaagctgggcgacgtgtacgtgaacgacgccttcggcaccgcccacagagcccacagcagcatggtgggcgtgaacctgccccagaaggccggcggcttcctgatgaagaaggagctgaactacttcgccaaggccctggagagccccgagagacccttcctggccatcctgggcggcgccaaggtggccgacaagatccagctgatcaacaacatgctggacaaggtgaacgagatgatcatcggcggcggcatggccttcaccttcctgaaggtgctgaacaacatggagatcggcaccagcctgttcgacgaggagggcgccaagatcgtgaaggacctgatgagcaaggccgagaagaacggcgtgaagatcaccctgcccgtggacttcgtgaccgccgacaagttcgacgagaacgccaagaccggccaggccaccgtggccagcggcatccccgccggctggatgggcctggactgcggccccgagagcagcaagaagtacgccgaggccgtgaccagagccaagcagatcgtgtggaacggccccgtgggcgtgttcgagtgggaggccttcgccagaggcaccaaggccctgatggacgaggtggtgaaggccaccagcagaggctgcatcaccatcatcggcggcggcgacaccgccacctgctgcgccaagtggaacaccgaggacaaggtgagccacgtgagcaccggcggcggcgccagcctggagctgctggagggcaaggtgctgcccggcgtggacgccctgagcaacatctag

SEQ ID NO: 93244 - DNA, 846 bp, Artificial Sequence
  Description of Artificial Sequence: Synthetic coding sequence
atgagcctgagcaacaagctgaccctggacaagctggacgtgaagggcaagagagtggtgatgagagtggacttcaacgtgcccatgaagaacaaccagatcaccaacaaccagagaatcaaggccgccgtgcccagcatcaagttctgcctggacaacggcgccaagagcgtggtgctgatgagccacctgggcagacccgacggcagacccttcctggccatcctgggcggcgccaaggtggccgacaagatccagctgatcaacaacatgctggacaaggtgaacgagatgatcatcggcggcggcatggccttcaccttcctgaaggtgctgaacaacatggagatcggcaccagcctgttcgacgaggagggcgccaagatcgtgaaggacctgatgagcaaggccgagaagaacggcgtgaagatcaccctgcccgtggacttcgtgaccgccgacaagttcgacgagaacgccaagaccggccaggccaccgtggccagcggcatccccgccggctggatgggcctggactgcggccccgagagcagcaagaagtacgccgaggccgtgaccagagccaagcagatcgtgtggaacggccccgtgggcgtgttcgagtgggaggccttcgccagaggcaccaaggccctgatggacgaggtggtgaaggccaccagcagaggctgcatcaccatcatcggcggcggcgacaccgccacctgctgcgccaagtggaacaccgaggacaaggtgagccacgtgagcaccggcggcggcgccagcctggagctgctggagggcaaggtgctgcccggcgtggacgccctgagcaacatctag

SEQ ID NO: 93245 - DNA, 729 bp, Artificial Sequence
  Description of Artificial Sequence: Synthetic coding sequence
atggtgggcgtgaacctgccccagaaggccggcggcttcctgatgaagaaggagctgaactacttcgccaaggccctggagagccccgagagacccttcctggccatcctgggcggcgccaaggtggccgacaagatccagctgatcaacaacatgctggacaaggtgaacgagatgatcatcggcggcggcatggccttcaccttcctgaaggtgctgaacaacatggagatcggcaccagcctgttcgacgaggagggcgccaagatcgtgaaggacctgatgagcaaggccgagaagaacggcgtgaagatcaccctgcccgtggacttcgtgaccgccgacaagttcgacgagaacgccaagaccggccaggccaccgtggccagcggcatccccgccggctggatgggcctggactgcggccccgagagcagcaagaagtacgccgaggccgtgaccagagccaagcagatcgtgtggaacggccccgtgggcgtgttcgagtgggaggccttcgccagaggcaccaaggccctgatggacgaggtggtgaaggccaccagcagaggctgcatcaccatcatcggcggcggcgacaccgccacctgctgcgccaagtggaacaccgaggacaaggtgagccacgtgagcaccggcggcggcgccagcctggagctgctggagggcaaggtgctgcccggcgtggacgccctgagcaacatctag

SEQ ID NO: 93246 - DNA, 1170 bp, Artificial Sequence
  Description of Artificial Sequence: Synthetic coding sequence
atgaagaacaaccagatcaccaacaaccagagaatcaaggccgccgtgcccagcatcaagttctgcctggacaacggcgccaagagcgtggtgctgatgagccacctgggcagacccgacggcgtgcccatgcccgacaagtacagcctggagcccgtggccgtggagctgaagagcctgctgggcaaggacgtgctgttcctgaaggactgcgtgggccccgaggtggagaaggcctgcgccaaccccgccgccggcagcgtgatcctgctggagaacctgagattccacgtggaggaggagggcaagggcaaggacgccagcggcaacaaggtgaaggccgagcccgccaagatcgaggccttcagagccagcctgagcaagctgggcgacgtgtacgtgaacgacgccttcggcaccgcccacagagcccacagcagcatggtgggcgtgaacctgccccagaaggccggcggcttcctgatgaagaaggagctgaactacttcgccaaggccctggagagccccgagagacccttcctggccatcctgggcggcgccaaggtggccgacaagatccagctgatcaacaacatgctggacaaggtgaacgagatgatcatcggcggcggcatggccttcaccttcctgaaggtgctgaacaacatggagatcggcaccagcctgttcgacgaggagggcgccaagatcgtgaaggacctgatgagcaaggccgagaagaacggcgtgaagatcaccctgcccgtggacttcgtgaccgccgacaagttcgacgagaacgccaagaccggccaggccaccgtggccagcggcatccccgccggctggatgggcctggactgcggccccgagagcagcaagaagtacgccgaggccgtgaccagagccaagcagatcgtgtggaacggccccgtgggcgtgttcgagtgggaggccttcgccagaggcaccaaggccctgatggacgaggtggtgaaggccaccagcagaggctgcatcaccatcatcggcggcggcgacaccgccacctgctgcgccaagtggaacaccgaggacaaggtgagccacgtgagcaccggcggcggcgccagcctggagctgctggagggcaaggtgctgcccggcgtggacgccctgagcaacatctag

SEQ ID NO: 93247 - DNA, 1254 bp, Artificial Sequence
  Description of Artificial Sequence: Synthetic coding sequence
atgagcctgagcaagaagctgaccctggacaagctggacgtgagaggcaagagagtgatcatgagagtggacttcaacgtgcccatgaagaagaaccagatcaccaacaaccagagaatcaaggccagcatccccagcatcaagtactgcctggacaacggcgccaaggccgtggtgctgatgagccacctgggcagacccgacggcgtgcccatgcccgacaagtacagcctggcccccgtggccgtggagctgaagagcctgctgggcaaggacgtgctgttcctgaaggactgcgtgggcgccgaggtggagaaggcctgcgccaaccccgcccccggcagcgtgatcctgctggagaacctgagattccacgtggaggaggagggcaagggccaggaccccagcggcaagaagatcaaggccgagcccgacaagatcgaggccttcagagccagcctgagcaagctgggcgacgtgtacgtgaacgacgccttcggcaccgcccacagagcccacagcagcatggtgggcgtgaacctgccccacaaggccagcggcttcctgatgaagaaggagctggactacttcgccaaggccctggagaaccccgtgagacccttcctggccatcctgggcggcgccaaggtggccgacaagatccagctgatcaagaacatgctggacaaggtgaacgagatgatcatcggcggcggcatggcctacaccttcctgaaggtgctgaacaacatggagatcggcgccagcctgttcgacgaggagggcgccaagatcgtgaaggacatcatggccaaggcccagaagaacggcgtgagaatcaccttccccgtggacttcgtgaccggcgacaagttcgacgagaacgcccaggtgggcaaggccaccgtggccagcggcatcagccccggctggatgggcctggactgcggccccgagagcaacaagaaccacgcccaggtggtggcccaggccagactgatcgtgtggaacggccccctgggcgtgttcgagtgggacgccttcgccaagggcaccaaggccctgatggacgagatcgtgaaggccaccagcaagggctgcatcaccgtgatcggcggcggcgacaccgccacctgctgcgccaagtggaacaccgaggacaaggtgagccacgtgagcaccggcggcggcgccagcctggagctgctggagggcaagatcctgcccggcgtggaggccctgagcaacatgtag

SEQ ID NO: 93248 - DNA, 765 bp, Artificial Sequence
  Description of Artificial Sequence: Synthetic coding sequence
atggccgcctacaagctggtgctgatcagacacggcgagagcgcctggaacctggagaacagattcagcggctggtacgacgccgacctgagccccgccggccacgaggaggccaagagaggcggccaggccctgagagacgccggctacgagttcgacatctgcttcaccagcgtgcagaagagagccatcagaaccctgtggaccgtgctggacgccatcgaccagatgtggctgcccgtggtgagaacctggagactgaacgagagacactacggcggcctgaccggcctgaacaaggccgagaccgccgccaagcacggcgaggcccaggtgaagatctggagaagaagctacgacgtgccccccccccccatggagcccgaccaccccttctacagcaacatcagcaaggacagaagatacgccgacctgaccgaggaccagctgcccagctgcgagagcctgaaggacaccatcgccagagccctgcccttctggaacgaggagatcgtgccccagatcaaggagggcaagagagtgctgatcgccgcccacggcaacagcctgagaggcatcgtgaagcacctggagggcctgagcgaggaggccatcatggagctgaacctgcccaccggcatccccatcgtgtacgagctggacaagaacctgaagcccatcaagcccatgcagttcctgggcgacgaggagaccgtgagaaaggccatggaggccgtggccgcccagggcaaggccaagaagtag

SEQ ID NO: 93249 - DNA, 435 bp, Artificial Sequence
  Description of Artificial Sequence: Synthetic coding sequence
atgcccctgatcagatgcggctgccacgacgtgccccccccccccatggagcccgaccaccccttctacagcaacatcagcaaggacagaagatacgccgacctgaccgaggaccagctgcccagctgcgagagcctgaaggacaccatcgccagagccctgcccttctggaacgaggagatcgtgccccagatcaaggagggcaagagagtgctgatcgccgcccacggcaacagcctgagaggcatcgtgaagcacctggagggcctgagcgaggaggccatcatggagctgaacctgcccaccggcatccccatcgtgtacgagctggacaagaacctgaagcccatcaagcccatgcagttcctgggcgacgaggagaccgtgagaaaggccatggaggccgtggccgcccagggcaaggccaagaagtag

SEQ ID NO: 93250 - DNA, 762 bp, Artificial Sequence
  Description of Artificial Sequence: Synthetic coding sequence
atggccacccacagactggtgatggtgagacacggcgagagcacctggaaccaggagaacagattctgcggctggttcgacgccgagctgagcgagaagggcaccgaggaggccaagagaggcgccaaggccatcaaggacgccaagatggagttcgacatctgctacaccagcgtgctgaagagagccatcagaaccctgtgggccatcctggacggcaccgaccagatgtggctgcccgtggtgagaacctggagactgaacgagagacactacggcggcctgaccggcctgaacaaggccgagaccgccgccaagcacggcgaggagcaggtgaagatctggagaagaagcttcgacatcccccccccccccatggacgagaagcacccctactacaacagcatcagcaaggagagaagatacgccggcctgaagcccggcgagctgcccacctgcgagagcctgaaggacaccatcgccagagccctgcccttctggaacgaggagatcgtgccccagatcaaggccggcaagagagtgctgatcgccgcccacggcaacagcctgagaggcatcgtgaagcacctggagggcatgagcgaccaggccatcatggagctgaacctgcccaccggcatccccatcgtgtacgagctgaacaaggagctgaagcccaccaagcccatgcagttcctgggcgacgaggagaccgtgagaaaggccatggaggccgtggccgcccagggcaaggccaagtag

SEQ ID NO: 93251 - DNA, 765 bp, Artificial Sequence
  Description of Artificial Sequence: Synthetic coding sequence
atggccgcctacaagctggtgctgatcagacacggcgagagcacctggaacctggagaacagattcagctgctggtacgacgccgacctgagccccgccggccacgaggaggccaagagaggcggccaggccctgagagacgccggctacgagttcgacatctgcctgaccagcgtgcagaagagagtgatcagaaccctgtggaccgtgctggacgccatcgaccagatgtggctgcccgtggtgagaacctggagactgaacgagagacactacggcggcctgaccggcctgaacaaggccgagaccgccgccaagcacggcgaggcccaggtgaagatctggagaagaagctacgacgtgccccccccccccatggagcccgaccaccccttctacagcaacatcagcaaggacagaagatacgccgacctgaccgaggaccagctgcccagctacgagagccccaaggacaccatcgccagagccctgcccttctggaacgaggagatcgtgccccagatcaaggagggcaagagagtgctgatcgccgcccacggcaacagcctgcagggcatcgccaagcacgtggagggcctgagcgaggaggccatcatggagctgaacctgcccaccggcatccccatcgtgtacgagctggacaagaacctgaagcccatcaagcccatgcagttcctgggcgacgaggagaccgtgtgcaaggccatcgaggccgtggccgcccagggcaaggccaagaagtag

SEQ ID NO: 93252 - DNA, 966 bp, Artificial Sequence
  Description of Artificial Sequence: Synthetic coding sequence
atggccgccgccgaggccggcggcgacgacgccagatgcgtgagactgagcgccgagagagcccaggccctgctggccgacgtggacaccctgctgttcgactgcgacggcgtgctgtggagaggcgagaccgccgtgcccggcgcccccgaggccctgagagccctgagagccagaggcaagagactgggcttcatcaccaacaacagcagcaagaccagagccgcctacgccgagaagctgagaagactgggcttcggcggccccgccggccccggcgccagcctggaggtgttcggcaccgcctactgcaccgccctgtacctgagacagagactggccggcgcccccgcccccaaggcctacgtgctgggcagccccgccctggccgccgagctggaggccgtgggcgtggccagcgtgggcgtgggccccgagcccctgcagggcgagggccccggcgactggctgcacgcccccctggagcccgacgtgagagccgtggtggtgggcttcgacccccacttcagctacatgaagctgaccaaggccctgagatacctgcagcagcccggctgcctgctggtgggcaccaacatggacaacagactgcccctggagaacggcagattcatcgccggcaccggctgcctggtgagagccgtggagatggccgcccagagacaggccgacatcatcggcaagcccagcagattcatcttcgactgcgtgagccaggagtacggcatcaaccccgagagaaccgtgatggtgggcgacagactggacaccgacatcctgctgggcgccacctgcggcctgaagaccatcctgaccctgaccggcgtgagcaccctgggcgacgtgaagaacaaccaggagagcgactgcgtgagcaagaagaagatggtgcccgacttctacgtggacagcatcgccgacctgctgcccgccctgcagggctag

SEQ ID NO: 93253 - DNA, 378 bp, Artificial Sequence
  Description of Artificial Sequence: Synthetic coding sequence
atggccgtggccgacctggccctgatccccgacgtggacatcgacagcgacggcgtgttcaagtacgtgctgatcagagtgcacagcgcccccagaagcggcgcccccgccgccgagagcaaggagatcgtgagaggctacaagtgggccgagtaccacgccgacatctacgacaaggtgagcggcgacatgcagaagcagggctgcgactgcgagtgcctgggcggcggcagaatcagccaccagagccaggacaagaagatccacgtgtacggctacagcatggcctacggccccgcccagcacgccatcagcaccgagaagatcaaggccaagtaccccgactacgaggtgacctgggccaacgacggctactag

SEQ ID NO: 93254 - DNA, 375 bp, Artificial Sequence
  Description of Artificial Sequence: Synthetic coding sequence
atggccgtggccgacctggccctgatccccgacgtggacatcgacagcgacggcgtgttcaagtacgtgctgatcagagtgcacagcgcccccagaagcggcgcccccgccgccgagagcaaggagatcgtgagaggctacaagtgggccgagtaccacgccgacatctacgacaaggtgagcggcgacatgcagaagcagggctgcgactgcgagtgcctgggcggcggcagaatcagccaccagagccaggacaagaagatccacgtgtacggctacagcatgatgagacccacctgcgtgcccctgggcgccagcggccccagaatccaccaccagggcctgtggagctgccccgccagacacttcaactag

SEQ ID NO: 93255 - DNA, 375 bp, Artificial Sequence; identical to SEQ ID NO: 93254
  Description of Artificial Sequence: Synthetic coding sequence

SEQ ID NO: 93256 - DNA, 1356 bp, Artificial Sequence
  Description of Artificial Sequence: Synthetic coding sequence
atggccaccgacgacaagaccagccccaccctggacagcgccaacgacctgcccagaagccccaccagccccagccacctgacccacttcaagcccctgacccccgaccaggacgagccccccttcaagagcgcctacagcagcttcgtgaacctgttcagattcaacaaggagagagccgagggcggccagggcgagcagcagcccctgagcggcagctggaccagcccccagctgcccagcagaacccagagcgtgagaagccccaccccctacaagaagcagctgaacgaggagctgcagagaagaagcagcgccctgggcgacctgagagcctgcacctactgcagaaagatcgccctgagctacgcccacagcaccgacagcaacagcatcggcgaggacctgaacgccctgagcgacagcgcctgcagcgtgagcgtgctggaccccagcgagcccagaacccccgtgggcagcagaaaggccagcagaaacatcttcctggaggacgacctggcctggcagagcctgatccaccccgacagcagcaacacccccctgagcaccagactggtgagcgtgcaggaggacgccggcaagagccccgccagaaacagaagcgccagcatcaccaacctgagcctggacagaagcggcagccccatggtgcccagctacgagaccagcgtgagcccccaggccaacagaacctacgtgagaaccgagaccaccgaggacgagagaaagatcctgctggacagcgtgcagctgaaggacctgtggaagaagatctgccaccacagcagcggcatggagttccaggaccacagatactggctgagaacccaccccaactgcatcgtgggcaaggagctggtgaactggctgatcagaaacggccacatcgccaccagagcccaggccatcgccatcggccaggccatggtggacggcagatggctggactgcgtgagccaccacgaccagctgttcagagacgagtacgccctgtacagacccctgcagagcaccgagttcagcgagacccccagccccgacagcgacagcgtgaacagcgtggagggccacagcgagcccagctggttcaaggacatcaagttcgacgacagcgacaccgagcagatcgccgaggagggcgacgacaacctggccaacagcgccagccccagcaagagaaccagcgtgagcagcttccagagcaccgtggacagcgacagcgccgccagcatcagcctgaacgtggagctggacaacgtgaacttccacatcaagaagcccagcaagtacccccacgtgcccccccaccccgccgaccagaagggcagaagatag

SEQ ID NO: 93257 - DNA, 1647 bp, Artificial Sequence
  Description of Artificial Sequence: Synthetic coding sequence
atggccaccgacgacaagaccagccccaccctggacagcgccaacgacctgcccagaagccccaccagccccagccacctgacccacttcaagcccctgacccccgaccaggacgagccccccttcaagagcgcctacagcagcttcgtgaacctgttcagattcaacaaggagagagccgagggcggccagggcgagcagcagcccctgagcggcagctggaccagcccccagctgcccagcagaacccagagcgtgagaagccccaccccctacaagaagcagctgaacgaggagctgcagagaagaagcagcgccctggacaccagaagaaaggccgagcccaccttcggcggccacgaccccagaaccgccgtgcagctgagaagcctgagcaccgtgctgaagagactgaaggagatcatggagggcaagagccaggacagcgacctgaagcagtactggatgcccgacagccagtgcaaggagtgctacgactgcagcgagaagttcaccaccttcagaagaagacaccactgcagactgtgcggccagatcttctgcagcagatgctgcaaccaggagatccccggcaagttcatgggctacaccggcgacctgagagcctgcacctactgcagaaagatcgccctgagctacgcccacagcaccgacagcaacagcatcggcgaggacctgaacgccctgagcgacagcgcctgcagcgtgagcgtgctggaccccagcgagcccagaacccccgtgggcagcagaaaggccagcagaaacatcttcctggaggacgacctggcctggcagagcctgatccaccccgacagcagcaacacccccctgagcaccagactggtgagcgtgcaggaggacgccggcaagagccccgccagaaacagaagcgccagcatcaccaacctgagcctggacagaagcggcagccccatggtgcccagctacgagaccagcgtgagcccccaggccaacagaacctacgtgagaaccgagaccaccgaggacgagagaaagatcctgctggacagcgtgcagctgaaggacctgtggaagaagatctgccaccacagcagcggcatggagttccaggaccacagatactggctgagaacccaccccaactgcatcgtgggcaaggagctggtgaactggctgatcagaaacggccacatcgccaccagagcccaggccatcgccatcggccaggccatggtggacggcagatggctggactgcgtgagccaccacgaccagctgttcagagacgagtacgccctgtacagacccctgcagagcaccgagttcagcgagacccccagccccgacagcgacagcgtgaacagcgtggagggccacagcgagcccagctggttcaaggacatcaagttcgacgacagcgacaccgagcagatcgccgaggagggcgacgacaacctggccaacagcgccagccccagcaagagaaccagcgtgagcagcttccagagcaccgtggacagcgacagcgccgccagcatcagcctgaacgtggagctggacaacgtgaacttccacatcaagaagcccagcaagtacccccacgtgcccccccaccccgccgaccagaagggcagaagatag

SEQ ID NO: 93258 - DNA, 6297 bp, Artificial Sequence
  Description of Artificial Sequence: Synthetic coding sequence
atggccaccgacgacaagaccagccccaccctggacagcgccaacgacctgcccagaagccccaccagccccagccacctgacccacttcaagcccctgacccccgaccaggacgagccccccttcaagagcgcctacagcagcttcgtgaacctgttcagattcaacaaggagagagccgagggcggccagggcgagcagcagcccctgagcggcagctggaccagcccccagctgcccagcagaacccagagcgtgagaagccccaccccctacaagaagcagctgaacgaggagctgcagagaagaagcagcgccctggacaccagaagaaaggccgagcccaccttcggcggccacgaccccagaaccgccgtgcagctgagaagcctgagcaccgtgctgaagagactgaaggagatcatggagggcaagagccaggacagcgacctgaagcagtactggatgcccgacagccagtgcaaggagtgctacgactgcagcgagaagttcaccaccttcagaagaagacaccactgcagactgtgcggccagatcttctgcagcagatgctgcaaccaggagatccccggcaagttcatgggctacaccggcgacctgagagcctgcacctactgcagaaagatcgccctgagctacgcccacagcaccgacagcaacagcatcggcgaggacctgaacgccctgagcgacagcgcctgcagcgtgagcgtgctggaccccagcgagcccagaacccccgtgggcagcagaaaggccagcagaaacatcttcctggaggacgacctggcctggcagagcctgatccaccccgacagcagcaacacccccctgagcaccagactggtgagcgtgcaggaggacgccggcaagagccccgccagaaacagaagcgccagcatcaccaacctgagcctggacagaagcggcagccccatggtgcccagctacgagaccagcgtgagcccccaggccaacagaacctacgtgagaaccgagaccaccgaggacgagagaaagatcctgctggacagcgtgcagctgaaggacctgtggaagaagatctgccaccacagcagcggcatggagttccaggaccacagatactggctgagaacccaccccaactgcatcgtgggcaaggagctggtgaactggctgatcagaaacggccacatcgccaccagagcccaggccatcgccatcggccaggccatggtggacggcagatggctggactgcgtgagccaccacgaccagctgttcagagacgagtacgccctgtacagacccctgcagagcaccgagttcagcgagacccccagccccgacagcgacagcgtgaacagcgtggagggccacagcgagcccagctggttcaaggacatcaagttcgacgacagcgacaccgagcagatcgccgaggagggcgacgacaacctggccaacagcgccagccccagcaagagaaccagcgtgagcagcttccagagcaccgtggacagcgacagcgccgccagcatcagcctgaacgtggagctggacaacgtgaacttccacatcaagaagcccagcaagtacccccacgtgcccccccaccccgccgaccagaaggagtacctgatcagcgacaccggcggccagcagctgagcatcagcgacgccttcatcaaggagagcctgttcaacagaagagtggaggagaagagcaaggagctgcccttcacccccctgggctggcaccacaacaacctggagctgctgagagaggagaacggcgagaagcaggccatggagagactgctgagcgccaaccacaaccacatgatggccctgctgcagcagctgctgcacagcgacagcctgagcagcagctggagagacatcatcgtgagcctggtgtgccaggtggtgcagaccgtgagacccgacgtgaagaaccaggacgacgacatggacatcagacagttcgtgcacatcaagaagatccccggcggcaagaagttcgacagcgtggtggtgaacggcttcgtgtgcaccaagaacatcgcccacaagaagatgagcagctgcatcaagaaccccaagatcctgctgctgaagtgcagcatcgagtacctgtacagagaggagaccaagttcacctgcatcgaccccatcgtgctgcaggagagagagttcctgaagaactacgtgcagagaatcgtggacgtgagacccaccctggtgctggtggagaagaccgtgagcagaatcgcccaggacatgctgctggagcacggcatcaccctggtgatcaacgtgaagagccaggtgctggagagaatcagcagaatgacccagggcgacctggtgatgagcatggaccagctgctgaccaagccccacctgggcacctgccacaagttctacatgcagatcttccagctgcccaacgagcagaccaagaccctgatgttcttcgagggctgcccccagcacctgggctgcaccatcaagctgagaggcggcagcgactacgagctggccagagtgaaggagatcctgatcttcatgatctgcgtggcctaccacagccagctggagatcagcttcctgatggacgagttcgccatgccccccaccctgatgcagaaccccagcttccacagcctgatcgagggcagaggccacgagggcgccgtgcaggagcagtacggcggcggcagcatcccctgggaccccgacatcccccccgagagcctgccctgcgacgacagcagcctgctggagctgagaatcgtgttcgagaagggcgagcaggagaacaagaacctgccccaggccgtggccagcgtgaagcaccaggagcacagcaccaccgcctgccccgccggcctgccctgcgccttcttcgcccccgtgcccgagagcctgctgcccctgcccgtggacgaccagcaggacgccctgggcagcgagcagcccgagaccctgcagcagaccgtggtgctgcaggaccccaagagccagatcagagccttcagagaccccctgcaggacgacaccggcctgtacgtgaccgaggaggtgaccagcagcgaggacaagagaaagacctacagcctggccttcaagcaggagctgaaggacgtgatcctgtgcatcagccccgtgatcaccttcagagagcccttcctgctgaccgagaagggcatgagatgcagcaccagagactacttcgccgagcaggtgtactggagccccctgctgaacaaggagttcaaggagatggagaacagaagaaagaagcagctgctgagagacctgagcggcctgcagggcatgaacggcagcatccaggccaagagcatccaggtgctgcccagccacgagctggtgagcaccagaatcgccgagcacctgggcgacagccagagcctgggcagaatgctggccgactacagagccagaggcggcagaatccagcccaagaacagcgaccccttcgcccacagcaaggacgccagcagcaccagcagcggccagagcggcagcaagaacgagggcgacgaggagagaggcctgatcctgagcgacgccgtgtggagcaccaaggtggactgcctgaaccccatcaaccaccagagactgtgcgtgctgttcagcagcagcagcgcccagagcagcaacgcccccagcgcctgcgtgagcccctggatcgtgaccatggagttctacggcaagaacgacctgaccctgggcatcttcctggagagatactgcttcagacccagctaccagtgccccagcatgttctgcgacacccccatggtgcaccacatcagaagattcgtgcacggccagggctgcgtgcagatcatcctgaaggagctggacagccccgtgcccggctaccagcacaccatcctgacctacagctggtgcagaatctgcaagcaggtgacccccgtggtggccctgagcaacgagagctggagcatgagcttcgccaagtacctggagctgagattctacggccaccagtacaccagaagagccaacgccgagccctgcggccacagcatccaccacgactaccaccagtacttcagctacaaccagatggtggccagcttcagctacagccccatcagactgctggaggtgtgcgtgcccctgcccaagatcttcatcaagagacaggcccccctgaaggtgagcctgctgcaggacctgaaggacttcttccagaaggtgagccaggtgtacgtggccatcgacgagagactggccagcctgaagaccgacaccttcagcaagaccagagaggagaagatggaggacatcttcgcccagaaggagatggaggagggcgagttcaagaactggatcgagaagatgcaggccagactgatgagcagcagcgtggacaccccccagcagctgcagagcgtgttcgagagcctgatcgccaagaagcagagcctgtgcgaggtgctgcaggcctggaacaacagactgcaggacctgttccagcaggagaagggcagaaagagacccagcgtgccccccagccccggcagactgagacagggcgaggagagcaagatcagcgccatggacgccagccccagaaacatcagccccggcctgcagaacggcgagaaggaggacagattcctgaccaccctgagcagccagagcagcaccagcagcacccacctgcagctgcccaccccccccgaggtgatgagcgagcagagcgtgggcggcccccccgagctggacaccgccagcagcagcgaggacgtgttcgacggccacctgctgggcagcaccgacagccaggtgaaggagaagagcaccatgaaggccatcttcgccaacctgctgcccggcaacagctacaaccccatccccttccccttcgaccccgacaagcactacctgatgtacgagcacgagagagtgcccatcgccgtgtgcgagaaggagcccagcagcatcatcgccttcgccctgagctgcaaggagtacagaaacgccctggaggagctgagcaaggccacccagtggaacagcgccgaggagggcctgcccaccaacagcaccagcgacagcagacccaagagcagcagccccatcagactgcccgagatgagcggcggccagaccaacagaaccaccgagaccgagccccagcccaccaagaaggccagcggcatgctgagcttcttcagaggcaccgccggcaagagccccgacctgagcagccagaagagagagaccctgagaggcgccgacagcgcctactaccaggtgggccagaccggcaaggagggcaccgagaaccagggcgtggagccccaggacgaggtggacggcggcgacacccagaagaagcagctgatcaacccccacgtggagctgcagttcagcgacgccaacgccaagttctactgcagactgtactacgccggcgagttccacaagatgagagaggtgatcctggacagcagcgaggaggacttcatcagaagcctgagccacagcagcccctggcaggccagaggcggcaagagcggcgccgccttctacgccaccgaggacgacagattcatcctgaagcagatgcccagactggaggtgcagagcttcctggacttcgccccccactacttcaactacatcaccaacgccgtgcagcagaagagacccaccgccctggccaagatcctgggcgtgtacagaatcggctacaagaacagccagaacaacaccgagaagaagctggacctgctggtgatggagaacctgttctacggcagaaagatggcccaggtgttcgacctgaagggcagcctgagaaacagaaacgtgaagaccgacaccggcaaggagagctgcgacgtggtgctgctggacgagaacctgctgaagatggtgagagacaaccccctgtacatcagaagccacagcaaggccgtgctgagaaccagcatccacagcgacagccacttcctgagcagccacctgatcatcgactacagcctgctggtgggcagagacgacaccagcaacgagctggtggtgggcatcatcgactacatcagaaccttcacctgggacaagaagctggagatggtggtgaagagcaccggcatcctgggcggccagggcaagatgcccaccgtggtgagccccgagctgtacagaaccagattctgcgaggccatggacaagtacttcctgatggtgcccgaccactggaccggcctgggcctgaactgctag

SEQ ID NO: 93259 - DNA, 3051 bp, Artificial Sequence
  Description of Artificial Sequence: Synthetic coding sequence
atggagttccaggaccacagatactggctgagaacccaccccaactgcatcgtgggcaaggagctggtgaactggctgatcagaaacggccacatcgccaccagagcccaggccatcgccatcggccaggccatggtggacggcagatggctggactgcgtgagccaccacgaccagctgttcagagacgagtacgccctgtacagacccctgcagagcaccgagttcagcgagacccccagccccgacagcgacagcgtgaacagcgtggagggccacagcgagcccagctggttcaaggacatcaagttcgacgacagcgacaccgagcagatcgccgaggagggcgacgacaacctggccaagtacctgatcagcgacaccggcggccagcagctgagcatcagcgacgccttcatcaaggagagcctgttcaacagaagagtggaggagaagagcaaggagctgcccttcacccccctgggctggcaccacaacaacctggagctgctgagagaggagaacggcgagaagcaggccatggagagactgctgagcgccaaccacaaccacatgatggccctgctgcagcagctgctgcacagcgacagcctgagcagcagctggagagacatcatcgtgagcctggtgtgccaggtggtgcagaccgtgagacccgacgtgaagaaccaggacgacgacatggacatcagacagttcgtgcacatcaagaagatccccggcggcaagaagttcgacagcgtggtggtgaacggcttcgtgtgcaccaagaacatcgcccacaagaagatgagcagctgcatcaagaaccccaagatcctgctgctgaagtgcagcatcgagtacctgtacagagaggagaccaagttcacctgcatcgaccccatcgtgctgcaggagagagagttcctgaagaactacgtgcagagaatcgtggacgtgagacccaccctggtgctggtggagaagaccgtgagcagaatcgcccaggacatgctgctggagcacggcatcaccctggtgatcaacgtgaagagccaggtgctggagagaatcagcagaatgacccagggcgacctggtgatgagcatggaccagctgctgaccaagccccacctgggcacctgccacaagttctacatgcagatcttccagctgcccaacgagcagaccaagaccctgatgttcttcgagggctgcccccagcacctgggctgcaccatcaagctgagaggcggcagcgactacgagctggccagagtgaaggagatcctgatcttcatgatctgcgtggcctaccacagccagctggagatcagcttcctgatggacgagttcgccatgccccccaccctgatgcagaaccccagcttccacagcctgatcgagggcagaggccacgagggcgccgtgcaggagcagtacggcggcggcagcatcccctgggaccccgacatcccccccgagagcctgccctgcgacgacagcagcctgctggagctgagaatcgtgttcgagaagggcgagcaggagaacaagaacctgccccaggccgtggccagcgtgaagcaccaggagcacagcaccaccgcctgccccgccggcctgccctgcgccttcttcgcccccgtgcccgagagcctgctgcccctgcccgtggacgaccagcaggacgccctgggcagcgagcagcccgagaccctgcagcagaccgtggtgctgcaggaccccaagagccagatcagagccttcagagaccccctgcaggacgacaccggcctgtacgtgaccgaggaggtgaccagcagcgaggacaagagaaagacctacagcctggccttcaagcaggagctgaaggacgtgatcctgtgcatcagccccgtgatcaccttcagagagcccttcctgctgaccgagaagggcatgagatgcagcaccagagactacttcgccgagcaggtgtactggagccccctgctgaacaaggagttcaaggagatggagaacagaagaaagaagcagctgctgagagacctgagcggcctgcagggcatgaacggcagcatccaggccaagagcatccaggtgctgcccagccacgagctggtgagcaccagaatcgccgagcacctgggcgacagccagagcctgggcagaatgctggccgactacagagccagaggcggcagaatccagcccaagaacagcgaccccttcgcccacagcaaggacgccagcagcaccagcagcggccagagcggcagcaagaacgagggcgacgaggagagaggcctgatcctgagcgacgccgtgtggagcaccaaggtggactgcctgaaccccatcaaccaccagagactgtgcgtgctgttcagcagcagcagcgcccagagcagcaacgcccccagcgcctgcgtgagcccctggatcgtgaccatggagttctacggcaagaacgacctgaccctgggcatcttcctggagagatactgcttcagacccagctaccagtgccccagcatgttctgcgacacccccatggtgcaccacatcagaagattcgtgcacggccagggctgcgtgcagatcatcctgaaggagctggacagccccgtgcccggctaccagcacaccatcctgacctacagctggtgcagaatctgcaagcaggtgacccccgtggtggccctgagcaacgagagctggagcatgagcttcgccaagtacctggagctgagattctacggccaccagtacaccagaagagccaacgccgagccctgcggccacagcatccaccacgactaccaccagtacttcagctacaaccagatggtggccagcttcagctacagccccatcagactgctggaggtgtgcgtgcccctgcccaagatcttcatcaagagacaggcccccctgaaggtgagcctgctgcaggacctgaaggacttcttccagaaggtgagccaggtgtacgtggccatcgacgagagactggccagcctgaagaccgacaccttcagctag

SEQ ID NO: 93260 - DNA, 522 bp, Artificial Sequence
  Description of Artificial Sequence: Synthetic coding sequence
atgagaccctggagcagccccgcccagctggtggccggcgcccagcccgccggcagaggcgaccccctgggccccagacccatccccccccccagattcagaagagccagcagccagagagagcccccctaccccagacccgccgagcccgccctggagctggccggcagcaagtgccagcccgacacccccgccgccagcctgtgccccgccgacagccccagccagcacagagtgatgccccccggccccgccagctgggccaacgtgggcagcagaccccacaccgtggccaacggccacgagctgttcgaggtgagcgaggagagagacgaggaggtggccgccttctgccacatgctggacatcctgagaagcggcagcgacatccaggactacttcctgaccggctacgtgtggagcgccgtgacccccagccccgagcacctgggcgacgaggtgaacctgaaggtgaccgtgctgtgcgacagactgcaggaggccctgaccttcacctgctag

SEQ ID NO: 93261 - DNA, 4905 bp, Artificial Sequence
  Description of Artificial Sequence: Synthetic coding sequence
atgagcagcacccagggcaacggcgagcactggaagagcctggagagcgtgggcatcagcagaaaggagctggccatggccgaggccctgcagatggagtacgacgccctgagcagactgagacacgacaaggaggagaacagagccaagcagaacgccgaccccagcctgatcagctgggacgagcccggcgtggacttctacagcaagcccgccggcagaagaaccgacctgaagctgctgagaggcctgagcggcagcgaccccaccctgaactacaacagcctgagcccccaggagggcccccccaaccacagcaccagccagggcccccagcccggcagcgacccctggcccaagggcagcctgagcggcgactacctgtacatcttcgacggcagcgacggcggcgtgagcagcagccccggccccggcgacatcgagggcagctgcaagaagctgagccccccccccctgccccccagagccagcatctgggacaccccccccctgccccccagaaagggcagccccagcagcagcaagatcagccagcccagcgacatcaacaccttcagcctggtggagcagctgcccggcaagctgctggagcacagaatcctggaggaggaggaggtgctgggcggcggcggccagggcagactgctgggcagcgtggactacgacggcatcaacgacgccatcaccagactgaacctgaagagcacctacgacgccgagatgctgagagacgccaccagaggctggaaggagggcagaggccccctggacttcagcaaggacaccagcggcaagcccgtggccagaagcaagaccatgcccccccaggtgccccccagaacctacgccagcagatacggcaacagaaagaacgccacccccggcaagaacagaagaatcagcgccgcccccgtgggcagcagaccccacaccgtggccaacggccacgagctgttcgaggtgagcgaggagagagacgaggaggtggccgccttctgccacatgctggacatcctgagaagcggcagcgacatccaggactacttcctgaccggctacgtgtggagcgccgtgacccccagccccgagcacctgggcgacgaggtgaacctgaaggtgaccgtgctgtgcgacagactgcaggaggccctgaccttcacctgcaactgcagcagcaccgtggacctgctgatctaccagaccctgtgctacacccacgacgacctgagaaacgtggacgtgggcgacttcgtgctgaagccctgcggcctggaggagttcctgcagaacaagcacgccctgggcagccacgagtacatccagtactgcagaaagttcgacatcgacatcagactgcagctgatggagcagaaggtggtgagaagcgacctggccagaaccgtgaacgacgaccagagccccagcaccctgaactacctggtgcacctgcaggagagacccgtgaagcagaccatcagcagacaggccctgagcctgctgttcgacacctaccacaacgaggtggacgccttcctgctggccgacggcgacttccccctgaaggccgacagagtggtgcagagcgtgaaggccatctgcaacgccctggccgccgtggagacccccgagatcaccagcgccctgaaccagctgcccccctgccccagcagaatgcagcccaagatccagaaggaccccagcgtgctggccgtgagagagaacagagagaaggtggtggaggccctgaccgccgccatcctggacctggtggagctgtactgcaacaccttcaacgccgacttccagaccgccgtgcccggcagcagaaagcacgacctggtgcaggaggcctgccacttcgccagaagcctggccttcaccgtgtacgccacccacagaatccccatcatctgggccaccagctacgaggacttctacctgagctgcagcctgagccacggcggcaaggagctgtgcagccccctgcagaccagaagagcccacttcagcaagtacctgttccacctgatcgtgtgggaccagcagatctgcttccccgtgcaggtgaacagactgcccagagagaccctgctgtgcgccaccctgtacgccctgcccatccccccccccggcagcagcagcgaggccaacaagcagagaagagtgcccgaggccctgggctgggtgaccacccccctgttcaacttcagacaggtgctgacctgcggcagaaagctgctgggcctgtggcccgccacccaggagaaccccagcgccagatggagcgcccccaacttccaccagcccgacagcgtgatcctgcagatcgacttccccaccagcgccttcgacatcaagttcaccagcccccccggcgacaagttcagccccagatacgagttcggcagcctgagagaggaggaccagagaaagctgaaggacatcatgcagaaggagagcctgtactggctgaccgacgccgacaagaagagactgtgggagaagagatactactgccacagcgaggtgagcagcctgcccctggtgctggccagcgcccccagctgggagtgggcctgcctgcccgacatctacgtgctgctgaagcagtggacccacatgaaccaccaggacgccctgggcctgctgcacgccaccttccccgaccaggaggtgagaagaatggccgtgcagtggatcggcagcctgagcgacgccgagctgctggactacctgccccagctggtgcaggccctgaagtacgagtgctacctggacagccccctggtgagattcctgctgaagagagccgtgagcgacctgagagtgacccactacttcttctggctgctgaaggacggcctgaaggacagccagttcagcatcagataccagtacctgctggccgccctgctgtgctgctgcggcaagggcctgagagaggagttcaacagacagtgctggctggtgaacgccctggccaagctggcccagcaggtgagagaggccgcccccagcgccagacagggcatcctgagaaccggcctggaggaggtgaagcagttcttcgccctgaacggcagctgcagactgcccctgagccccagcctgctggtgaagggcatcgtgcccagagactgcagctacttcaacagcaacgccgtgcccctgaagctgagcttccagaacgtggaccccctgggcgagaacatcagagtgatcttcaagtgcggcgacgacctgagacaggacatgctgaccctgcagatgatcagaatcatgagcaagatctgggtgcaggagggcctggacatgagaatggtgatcttcagatgcttcagcaccggcagaggcagaggcatggtggagatgatccccaacgccgagaccctgagaaagatccaggtggagcacggcgtgaccggcagcttcaaggacagacccctggccgactggctgcagaagcacaaccccggcgaggacgagtacgagaaggccgtggagaacttcatctacagctgcgccggctgctgcgtggccacctacgtgctgggcatctgcgacagacacaacgacaacatcatgctgaagaccaccggccacatgttccacatcgacttcggcagattcctgggccacgcccagatgttcggcaacatcaagagagacagagcccccttcgtgttcaccagcgacatggcctacgtgatcaacggcggcgacaagcccagcagcagattccacgacttcgtggacctgtgctgccaggcctacaacctgatcagaaagcacacccacctgttcctgaacctgctgggcctgatgctgagctgcggcatccccgagctgagcgacctggaggacctgaagtacgtgtacgacgccctgagaccccaggacaccgaggccaacgccaccacctacttcaccagactgatcgagagcagcctgggcagcgtggccaccaagctgaacttcttcatccacaacctggcccagatgaagttcaccggcagcgacgacagactgaccctgagcttcgccagcagaacccacaccctgaagagcagcggcagaatcagcgacgtgttcctgtgcagacacgagaagatcttccaccccaacaagggctacatctacgtggtgaaggtgatgagagagaacacccacgaggccacctacatccagagaaccttcgaggagttccaggagctgcacaacaagctgagactgctgttccccagcagccacctgcccagcttccccagcagattcgtgatcggcagaagcagaggcgaggccgtggccgagagaagaagagaggagctgaacggctacatctggcacctgatccacgccccccccgaggtggccgagtgcgacctggtgtacaccttcttccaccccctgcccagagacgagaaggccatgggcaccagccccgcccccaagagcagcgacggcacctgggccagacccgtgggcaaggtgggcggcgaggtgaagctgagcatcagctacaagaacaacaagctgttcatcatggtgatgcacatcagaggcctgcagctgctgcaggacggcaacgaccccgacccctacgtgaagatctacctgctgcccgacccccagaagaccaccaagagaaagaccaaggtggccagaaagacctgcaaccccacctacaacgagatgctggtgtacgacggcatccccaagggcgacctgcagcagagagagctgcagctgagcgtgctgagcgagcagggcttctgggagaacgtgctgctgggcgaggtgaacatcagactgagagagctggacctggcccaggagaagaccggctggttcgccctgggcagcagaagccacggcaccctgtag

SEQ ID NO: 93262 - DNA, 360 bp, Artificial Sequence
  Description of Artificial Sequence: Synthetic coding sequence
atgttcggcaacatcaagagagacagagcccccttcgtgttcaccagcgacatggcctacgtgatcaacggcggcgacaagcccagcagcagattccacgacttcgtggacctgtgctgccaggcctacaacctgatcagaaagcacacccacctgttcctgaacctgctgggcctgatgctgagctgcggcatccccgagctgagcgacctggaggacctgaagtacgtgtacgacgccctgagaccccaggacaccgaggccaacgccaccacctacttcaccagagtgatcctggccagcgtggtgggcggcagagagagcaagacctgcagcgccgtgagcagcagcggcgactag

SEQ ID NO: 93263 - DNA, 396 bp, Artificial Sequence
  Description of Artificial Sequence: Synthetic coding sequence
atgagcagcacccagggcaacggcgagcactggaagagcctggagagcgtgggcatcagcagaaaggagctggccatggccgaggccctgcagatggagtacgacgccctgagcagactgagacacgacaaggaggagaacagagccaagcagaacgccgaccccagcctgatcagctgggacgagcccggcgtggacttctacagcaagcccgccggcagaagaaccgacctgaagctgctgagaggcctgagcggcagcgaccccaccctgaactacaacagcctgagcccccaggagggcccccccaaccacagcaccagccagggcccccagcccggcagcgacccctggcccaagggcagcctgagcggcgactacctgtacatcttctag

SEQ ID NO: 93264 - DNA, 4821 bp, Artificial Sequence
  Description of Artificial Sequence: Synthetic coding sequence
atgagcagcacccagggcaacggcgagcactggaagagcctggagagcgtgggcatcagcagaaaggagctggccatggccgaggccctgcagatggagtacgacgccctgagcagactgagacacgacaaggaggagaacagagccaagcagaacgccgaccccagcctgatcagctgggacgagcccggcgtggacttctacagcaagcccgccggcagaagaaccgacctgaagctgctgagaggcctgagcggcagcgaccccaccctgaactacaacagcctgagcccccaggagggcccccccaaccacagcaccagccagggcccccagcccggcagcgacccctggcccaagggcagcctgagcggcgactacctgtacatcttcgacggcagcgacggcggcgtgagcagcagccccggccccggcgacatcgagggcagctgcaagaagctgagccccccccccctgccccccagagccagcatctgggacaccccccccctgccccccagaaagggcagccccagcagcagcaagatcagccagcccagcgacatcaacaccttcagcctggtggagcagctgcccggcaagctgctggagcacagaatcctggaggaggaggaggtgctgggcggcggcggccagggcagactgctgggcagcgtggactacgacggcatcaacgacgccatcaccagactgaacctgaagagcacctacgacgccgagatgctgagagacgccaccagaggctggaaggagggcagaggccccctggacttcagcaaggacaccagcggcaagcccgtggccagaagcaagaccatgcccccccaggtgccccccagaacctacgccagcagatacggcaacagaaagaacgccacccccggcaagaacagaagaatcagcgccgcccccgtgggcagcagaccccacaccgtggccaacggccacgagctgttcgaggtgagcgaggagagagacgaggaggtggccgccttctgccacatgctggacatcctgagaagcggcagcgacatccaggactacttcctgaccggctacgtgtggagcgccgtgacccccagccccgagcacctgggcgacgaggtgaacctgaaggtgaccgtgctgtgcgacagactgcaggaggccctgaccttcacctgcaactgcagcagcaccgtggacctgctgatctaccagaccctgtgctacacccacgacgacctgagaaacgtggacgtgggcgacttcgtgctgaagccctgcggcctggaggagttcctgcagaacaagcacgccctgggcagccacgagtacatccagtactgcagaaagttcgacatcgacatcagactgcagctgatggagcagaaggtggtgagaagcgacctggccagaaccgtgaacgacgaccagagccccagcaccctgaactacctggtgcacctgcaggagagacccgtgaagcagaccatcagcagacaggccctgagcctgctgttcgacacctaccacaacgaggtggacgccttcctgctggccgacggcgacttccccctgaaggccgacagagtggtgcagagcgtgaaggccatctgcaacgccctggccgccgtggagacccccgagatcaccagcgccctgaaccagctgcccccctgccccagcagaatgcagcccaagatccagaaggaccccagcgtgctggccgtgagagagaacagagagaaggtggtggaggccctgaccgccgccatcctggacctggtggagctgtactgcaacaccttcaacgccgacttccagaccgccgtgcccggcagcagaaagcacgacctggtgcaggaggcctgccacttcgccagaagcctggccttcaccgtgtacgccacccacagaatccccatcatctgggccaccagctacgaggacttctacctgagctgcagcctgagccacggcggcaaggagctgtgcagccccctgcagaccagaagagcccacttcagcaagtacctgttccacctgatcgtgtgggaccagcagatctgcttccccgtgcaggtgaacagactgcccagagagaccctgctgtgcgccaccctgtacgccctgcccatccccccccccggcagcagcagcgaggccaacaagcagagaagagtgcccgaggccctgggctgggtgaccacccccctgttcaacttcagacaggtgctgacctgcggcagaaagctgctgggcctgtggcccgccacccaggagaaccccagcgccagatggagcgcccccaacttccaccagcccgacagcgtgatcctgcagatcgacttccccaccagcgccttcgacatcaagttcaccagcccccccggcgacaagttcagccccagatacgagttcggcagcctgagagaggaggaccagagaaagctgaaggacatcatgcagaaggagagcctgtactggctgaccgacgccgacaagaagagactgtgggagaagagatactactgccacagcgagtggacccacatgaaccaccaggacgccctgggcctgctgcacgccaccttccccgaccaggaggtgagaagaatggccgtgcagtggatcggcagcctgagcgacgccgagctgctggactacctgccccagctggtgcaggccctgaagtacgagtgctacctggacagccccctggtgagattcctgctgaagagagccgtgagcgacctgagagtgacccactacttcttctggctgctgaaggacggcctgaaggacagccagttcagcatcagataccagtacctgctggccgccctgctgtgctgctgcggcaagggcctgagagaggagttcaacagacagtgctggctggtgaacgccctggccaagctggcccagcaggtgagagaggccgcccccagcgccagacagggcatcctgagaaccggcctggaggaggtgaagcagttcttcgccctgaacggcagctgcagactgcccctgagccccagcctgctggtgaagggcatcgtgcccagagactgcagctacttcaacagcaacgccgtgcccctgaagctgagcttccagaacgtggaccccctgggcgagaacatcagagtgatcttcaagtgcggcgacgacctgagacaggacatgctgaccctgcagatgatcagaatcatgagcaagatctgggtgcaggagggcctggacatgagaatggtgatcttcagatgcttcagcaccggcagaggcagaggcatggtggagatgatccccaacgccgagaccctgagaaagatccaggtggagcacggcgtgaccggcagcttcaaggacagacccctggccgactggctgcagaagcacaaccccggcgaggacgagtacgagaaggccgtggagaacttcatctacagctgcgccggctgctgcgtggccacctacgtgctgggcatctgcgacagacacaacgacaacatcatgctgaagaccaccggccacatgttccacatcgacttcggcagattcctgggccacgcccagatgttcggcaacatcaagagagacagagcccccttcgtgttcaccagcgacatggcctacgtgatcaacggcggcgacaagcccagcagcagattccacgacttcgtggacctgtgctgccaggcctacaacctgatcagaaagcacacccacctgttcctgaacctgctgggcctgatgctgagctgcggcatccccgagctgagcgacctggaggacctgaagtacgtgtacgacgccctgagaccccaggacaccgaggccaacgccaccacctacttcaccagactgatcgagagcagcctgggcagcgtggccaccaagctgaacttcttcatccacaacctggcccagatgaagttcaccggcagcgacgacagactgaccctgagcttcgccagcagaacccacaccctgaagagcagcggcagaatcagcgacgtgttcctgtgcagacacgagaagatcttccaccccaacaagggctacatctacgtggtgaaggtgatgagagagaacacccacgaggccacctacatccagagaaccttcgaggagttccaggagctgcacaacaagctgagactgctgttccccagcagccacctgcccagcttccccagcagattcgtgatcggcagaagcagaggcgaggccgtggccgagagaagaagagaggagctgaacggctacatctggcacctgatccacgccccccccgaggtggccgagtgcgacctggtgtacaccttcttccaccccctgcccagagacgagaaggccatgggcaccagccccgcccccaagagcagcgacggcacctgggccagacccgtgggcaaggtgggcggcgaggtgaagctgagcatcagctacaagaacaacaagctgttcatcatggtgatgcacatcagaggcctgcagctgctgcaggacggcaacgaccccgacccctacgtgaagatctacctgctgcccgacccccagaagaccaccaagagaaagaccaaggtggccagaaagacctgcaaccccacctacaacgagatgctggtgtacgacggcatccccaagggcgacctgcagcagagagagctgcagctgagcgtgctgagcgagcagggcttctgggagaacgtgctgctgggcgaggtgaacatcagactgagagagctggacctggcccaggagaagaccggctggttcgccctgggcagcagaagccacggcaccctgtag

SEQ ID NO: 93265 - DNA, 183 bp, Artificial Sequence
  Description of Artificial Sequence: Synthetic coding sequence
atgagcagcacccagggcaacggcgagcactggaagagcctggagagcgtgggcatcagcagaaaggagctggccatggccgaggccctgcagatggagtacgacgccctgagcagactgagacacgacaaggaggagaacagagccaagcagaacgccgaccccagcctgatcagctggtag

SEQ ID NO: 93266 - DNA, 522 bp, Artificial Sequence; identical to SEQ ID NO: 93260
  Description of Artificial Sequence: Synthetic coding sequence

SEQ ID NO: 93267 - DNA, 4338 bp, Artificial Sequence
  Description of Artificial Sequence: Synthetic coding sequence
atggcctacagctggcagaccgaccccaaccccaacgagagccacgagaagcagtacgagcaccaggagttcctgttcgtgaaccagccccacagcagcagccaggtgagcctgggcttcgaccagatcgtggacgagatcagcggcaagatcccccactacgagagcgagatcgacgagaacaccttcttcgtgcccaccgcccccaagtgggacagcaccggccacagcctgaacgaggcccaccagatcagcctgaacgagttcaccagcaagagcagagagctgagctggcaccaggtgagcaaggcccccgccatcggcttcagccccagcgtgctgcccaagccccagaacaccaacaaggagtgcagctggggcagccccatcggcaagcaccacggcgccgacgacagcagattcagcatcctggcccccagcttcaccagcctggacaagatcaacctggagaaggagctggagaacgagaaccacaactaccacatcggcttcgagagcagcatcccccccaccaacagcagcttcagcagcgacttcatgcccaaggaggagaacaagagaagcggccacgtgaacatcgtggagcccagcctgatgctgctgaagggcagcctgcagcccggcatgtgggagagcacctggcagaagaacatcgagagcatcggctgcagcatccagctggtggaggtgccccagagcagcaacaccagcctggccagcttctgcaacaaggtgaagaagatcagagagagataccacgccgccgacgtgaacttcaacagcggcaagatctggagcaccaccaccgccttcccctaccagctgttcagcaagaccaagttcaacatccacatcttcatcgacaacagcacccagcccctgcacttcatgccctgcgccaactacctggtgaaggacctgatcgccgagatcctgcacttctgcaccaacgaccagctgctgcccaaggaccacatcctgagcgtgtgcggcagcgaggagttcctgcagaacgaccactgcctgggcagccacaagatgttccagaaggacaagagcgtgatccagctgcacctgcagaagagcagagaggcccccggcaagctgagcagaaagcacgaggaggaccacagccagttctacctgaaccagctgctggagttcatgcacatctggaaggtgagcagacagtgcctgctgaccctgatcagaaagtacgacttccacctgaagtacctgctgaagacccaggagaacgtgtacaacatcatcgaggaggtgaagaagatctgcagcgtgctgggctgcgtggagaccaagcagatcaccgacgccgtgaacgagctgagcctgatcctgcagagaaagggcgagaacttctaccagagcagcgagaccagcgccaagggcctgatcgagaaggtgaccaccgagctgagcaccagcatctaccagctgatcaacgtgtactgcaacagcttctacgccgacttccagcccgtgaacgtgcccagatgcaccagctacctgaaccccggcctgcccagccacctgagcttcaccgtgtacgccgcccacaacatccccgagacctgggtgcacagaatcaacttccccctggagatcaagagcctgcccagagagagcatgctgaccgtgaagctgttcggcatcgcctgcgccaccaacaacgccaacctgctggcctggacctgcctgcccctgttccccaaggagaagagcatcctgggcagcatgctgttcagcatgaccctgcagagcgagccccccgtggagatgatcacccccggcgtgtgggacgtgagccagcccagccccgtgaccctgcagatcgacttccccgccaccggctgggagtacatgaagcccgacagcgaggagaacagaagcaacctggaggagcccctgaaggagtgcatcaagcacatcgccagactgagccagaagcagacccccctgctgctgagcgaggagaagaagagatacctgtggttctacagattctactgcaacaacgagaactgcagcctgcccctggtgctgggcagcgcccccggctgggacgagagaaccgtgagcgagatgcacaccatcctgagaagatggaccttcagccagcccctggaggccctgggcctgctgaccagcagcttccccgaccaggagatcagaaaggtggccgtgcagcagctggacaacctgctgaacgacgagctgctggagtacctgccccagctggtgcaggccgtgaagttcgagtggaacctggagagccccctggtgcagctgctgctgcacagaagcctgcagagcatccaggtggcccacagactgtactggctgctgaagaacgccgagaacgaggcctacttcaagagctggtaccagaagctgctggccgccctgcagttctgcgccggcaaggccctgaacgacgagttcagcaaggagcagaagctgatcaagatcctgggcgacatcggcgagagagtgaagagcgccagcgaccaccagagacaggaggtgctgaagaaggagatcggcagactggaggagttcttccaggacgtgaacacctgccacctgcccctgaaccccgccctgtgcatcaagggcatcgaccacgacgcctgcagctacttcaccagcaacgccctgcccctgaagatcaccttcatcaacgccaaccccatgggcaagaacatcagcatcatcttcaaggccggcgacgacctgagacaggacatgctggtgctgcagctgatccaggtgatggacaacatctggctgcaggagggcctggacatgcagatgatcatctacagatgcctgagcaccggcaaggaccagggcctggtgcagatggtgcccgacgccgtgaccctggccaagatccacagacacagcggcctgatcggccccctgaaggagaacaccatcaagaagtggttcagccagcacaaccacctgaaggccgactacgagaaggccctgagaaacttcttctacagctgcgccggctggtgcgtggtgaccttcatcctgggcgtgtgcgacagacacaacgacaacatcatgctgaccaagagcggccacatgttccacatcgacttcggcaagttcctgggccacgcccagaccttcggcggcatcaagagagacagagcccccttcatcttcaccagcgagatggagtacttcatcaccgagggcggcaagaacccccagcacttccaggacttcgtggagctgtgctgcagagcctacaacatcatcagaaagcacagccagctgctgctgaacctgctggagatgatgctgtacgccggcctgcccgagctgagcggcatccaggacctgaagtacgtgtacaacaacctgagaccccaggacaccgacctggaggccaccagccacttcaccaagaagatcaaggagagcctggagtgcttccccgtgaagctgaacaacctgatccacaccctggcccagatgagcgccatcagccccgccaagagcaccagccagaccttcccccaggagagctgcctgctgagcaccaccagaagcatcgagagagccaccatcctgggcttcagcaagaagagcagcaacctgtacctgatccaggtgacccacagcaacaacgagaccagcctgaccgagaagagcttcgagcagttcagcaagctgcacagccagctgcagaagcagttcgccagcctgaccctgcccgagttcccccactggtggcacctgcccttcaccaacagcgaccacagaagattcagagacctgaaccactacatggagcagatcctgaacgtgagccacgaggtgaccaacagcgactgcgtgctgagcttcttcctgagcgaggccgtgcagcagaccgtggaggagagcagccccgtgtacctgggcgagaagttccccgacaagaagcccaaggtgcagctggtgatcagctacgaggacgtgaagctgaccatcctggtgaagcacatgaagaacatccacctgcccgacggcagcgcccccagcgcccacgtggagttctacctgctgccctaccccagcgaggtgagaagaagaaagaccaagagcgtgcccaagtgcaccgaccccacctacaacgagatcgtggtgtacgacgaggtgaccgagctgcagggccacgtgctgatgctgatcgtgaagagcaagaccgtgttcgtgggcgccatcaacatcagactgtgcagcgtgcccctggacaaggagaagtggtaccccctgggcaacagcatcatctag

SEQ ID NO: 93268 - DNA, 4338 bp, Artificial Sequence; identical to SEQ ID NO: 93267
  Description of Artificial Sequence: Synthetic coding sequence

SEQ ID NO: 93269 - DNA, 4461 bp, Artificial Sequence
  Description of Artificial Sequence: Synthetic coding sequence
atggcctacagctggcagaccgaccccaaccccaacgagagccacgagaagcagtacgagcaccaggagttcctgttcgtgaaccagccccacagcagcagccaggtgagcctgggcttcgaccagatcgtggacgagatcagcggcaagatcccccactacgagagcgagatcgacgagaacaccttcttcgtgcccaccgcccccaagtgggacagcaccggccacagcctgaacgaggcccaccagatcagcctgaacgagttcaccagcaagagcagagagctgagctggcaccaggtgagcaaggcccccgccatcggcttcagccccagcgtgctgcccaagccccagaacaccaacaaggagtgcagctggggcagccccatcggcaagcaccacggcgccgacgacagcagattcagcatcctggcccccagcttcaccagcctggacaagatcaacctggagaaggagctggagaacgagaaccacaactaccacatcggcttcgagagcagcatcccccccaccaacagcagcttcagcagcgacttcatgcccaaggaggagaacaagagaagcggccacgtgaacatcgtggagcccagcctgatgctgctgaagggcagcctgcagcccggcatgtgggagagcacctggcagaagaacatcgagagcatcggctgcagcatccagctggtggaggtgccccagagcagcaacaccagcctggccagcttctgcaacaaggtgaagaagatcagagagagataccacgccgccgacgtgaacttcaacagcggcaagatctggagcaccaccaccgccttcccctaccagctgttcagcaagaccaagttcaacatccacatcttcatcgacaacagcacccagcccctgcacttcatgccctgcgccaactacctggtgaaggacctgatcgccgagatcctgcacttctgcaccaacgaccagctgctgcccaaggaccacatcctgagcgtgtgcggcagcgaggagttcctgcagaacgaccactgcctgggcagccacaagatgttccagaaggacaagagcgtgatccagctgcacctgcagaagagcagagaggcccccggcaagctgagcagaaagcacgaggaggaccacagccagttctacctgaaccagctgctggagttcatgcacatctggaaggtgagcagacagtgcctgctgaccctgatcagaaagtacgacttccacctgaagtacctgctgaagacccaggagaacgtgtacaacatcatcgaggaggtgaagaagatctgcagcgtgctgggctgcgtggagaccaagcagatcaccgacgccgtgaacgagctgagcctgatcctgcagagaaagggcgagaacttctaccagagcagcgagaccagcgccaagggcctgatcgagaaggtgaccaccgagctgagcaccagcatctaccagctgatcaacgtgtactgcaacagcttctacgccgacttccagcccgtgaacgtgcccagatgcaccagctacctgaaccccggcctgcccagccacctgagcttcaccgtgtacgccgcccacaacatccccgagacctgggtgcacagctacaaggccttcagcttcacctgctggctgacctacgccggcaagaagctgtgccaggtgagaaactacagaaacatccccgacaagaagctgttcttcttcctggtgaactggaacgagaccatcaacttccccctggagatcaagagcctgcccagagagagcatgctgaccgtgaagctgttcggcatcgcctgcgccaccaacaacgccaacctgctggcctggacctgcctgcccctgttccccaaggagaagagcatcctgggcagcatgctgttcagcatgaccctgcagagcgagccccccgtggagatgatcacccccggcgtgtgggacgtgagccagcccagccccgtgaccctgcagatcgacttccccgccaccggctgggagtacatgaagcccgacagcgaggagaacagaagcaacctggaggagcccctgaaggagtgcatcaagcacatcgccagactgagccagaagcagacccccctgctgctgagcgaggagaagaagagatacctgtggttctacagattctactgcaacaacgagaactgcagcctgcccctggtgctgggcagcgcccccggctgggacgagagaaccgtgagcgagatgcacaccatcctgagaagatggaccttcagccagcccctggaggccctgggcctgctgaccagcagcttccccgaccaggagatcagaaaggtggccgtgcagcagctggacaacctgctgaacgacgagctgctggagtacctgccccagctggtgcaggccgtgaagttcgagtggaacctggagagccccctggtgcagctgctgctgcacagaagcctgcagagcatccaggtggcccacagactgtactggctgctgaagaacgccgagaacgaggcctacttcaagagctggtaccagaagctgctggccgccctgcagttctgcgccggcaaggccctgaacgacgagttcagcaaggagcagaagctgatcaagatcctgggcgacatcggcgagagagtgaagagcgccagcgaccaccagagacaggaggtgctgaagaaggagatcggcagactggaggagttcttccaggacgtgaacacctgccacctgcccctgaaccccgccctgtgcatcaagggcatcgaccacgacgcctgcagctacttcaccagcaacgccctgcccctgaagatcaccttcatcaacgccaaccccatgggcaagaacatcagcatcatcttcaaggccggcgacgacctgagacaggacatgctggtgctgcagctgatccaggtgatggacaacatctggctgcaggagggcctggacatgcagatgatcatctacagatgcctgagcaccggcaaggaccagggcctggtgcagatggtgcccgacgccgtgaccctggccaagatccacagacacagcggcctgatcggccccctgaaggagaacaccatcaagaagtggttcagccagcacaaccacctgaaggccgactacgagaaggccctgagaaacttcttctacagctgcgccggctggtgcgtggtgaccttcatcctgggcgtgtgcgacagacacaacgacaacatcatgctgaccaagagcggccacatgttccacatcgacttcggcaagttcctgggccacgcccagaccttcggcggcatcaagagagacagagcccccttcatcttcaccagcgagatggagtacttcatcaccgagggcggcaagaacccccagcacttccaggacttcgtggagctgtgctgcagagcctacaacatcatcagaaagcacagccagctgctgctgaacctgctggagatgatgctgtacgccggcctgcccgagctgagcggcatccaggacctgaagtacgtgtacaacaacctgagaccccaggacaccgacctggaggccaccagccacttcaccaagaagatcaaggagagcctggagtgcttccccgtgaagctgaacaacctgatccacaccctggcccagatgagcgccatcagccccgccaagagcaccagccagaccttcccccaggagagctgcctgctgagcaccaccagaagcatcgagagagccaccatcctgggcttcagcaagaagagcagcaacctgtacctgatccaggtgacccacagcaacaacgagaccagcctgaccgagaagagcttcgagcagttcagcaagctgcacagccagctgcagaagcagttcgccagcctgaccctgcccgagttcccccactggtggcacctgcccttcaccaacagcgaccacagaagattcagagacctgaaccactacatggagcagatcctgaacgtgagccacgaggtgaccaacagcgactgcgtgctgagcttcttcctgagcgaggccgtgcagcagaccgtggaggagagcagccccgtgtacctgggcgagaagttccccgacaagaagcccaaggtgcagctggtgatcagctacgaggacgtgaagctgaccatcctggtgaagcacatgaagaacatccacctgcccgacggcagcgcccccagcgcccacgtggagttctacctgctgccctaccccagcgaggtgagaagaagaaagaccaagagcgtgcccaagtgcaccgaccccacctacaacgagatcgtggtgtacgacgaggtgaccgagctgcagggccacgtgctgatgctgatcgtgaagagcaagaccgtgttcgtgggcgccatcaacatcagactgtgcagcgtgcccctggacaaggagaagtggtaccccctgggcaacagcatcatctag

SEQ ID NO: 93270 - DNA, 414 bp, Artificial Sequence
  Description of Artificial Sequence: Synthetic coding sequence
atgaccatggagaccctgcccaaggtgctggaggtggacgagaagagccccgaggccaaggacctgctgcccagccagaccgccagcagcctgtgcatcagcagcagaagcgagagcgtgtggaccaccacccccagaagcaactgggagatctacagaaagcccatcgtgatcatgagcgtgggcggcgccatcctgctgttcggcgtggtgatcacctgcctggcctacaccctgaagctgagcgacaagagcctgagcatcctgaagatggtgggccccggcttcctgagcctgggcctgatgatgctggtgtgcggcctggtgtgggtgcccatcatcaagaagaagcagaagcacagacagaagagcaacttcctgagaagcctgaagagcttcttcctgaccagatag

SEQ ID NO: 93271 - DNA, 414 bp, Artificial Sequence; identical to SEQ ID NO: 93270
  Description of Artificial Sequence: Synthetic coding sequence

SEQ ID NO: 93272 - DNA, 159 bp, Artificial Sequence
  Description of Artificial Sequence: Synthetic coding sequence
atggagaaggtgcagtacctgaccagaagcgccatcagaagagccagcaccatcgagatgccccagcaggccagacagaagctgcagaacctgttcatcaacttctgcctgatcctgatctgcctgctgctgatctgcatcatcgtgatgctgctgtag

SEQ ID NO: 93273 - DNA, 1371 bp, Artificial Sequence
  Description of Artificial Sequence: Synthetic coding sequence
atgccccccggcccctgggagagctgcttctgggtgggcggcctgatcctgtggctgagcgtgggcagcagcggcgacgccccccccaccccccagcccaagtgcgccgacttccagagcgccaacctgttcgagggcaccgacctgaaggtgcagttcctgctgttcgtgcccagcaaccccagctgcggccagctggtggagggcagcagcgacctgcagaacagcggcttcaacgccaccctgggcaccaagctgatcatccacggcttcagagtgctgggcaccaagcccagctggatcgacaccttcatcagaaccctgctgagagccaccaacgccaacgtgatcgccgtggactggatctacggcagcaccggcgtgtacttcagcgccgtgaagaacgtgatcaagctgagcctggagatcagcctgttcctgaacaagctgctggtgctgggcgtgagcgagagcagcatccacatcatcggcgtgagcctgggcgcccacgtgggcggcatggtgggccagctgttcggcggccagctgggccagatcaccggcctggaccccgccggccccgagtacaccagagccagcgtggaggagagactggacgccggcgacgccctgttcgtggaggccatccacaccgacaccgacaacctgggcatcagaatccccgtgggccacgtggactacttcgtgaacggcggccaggaccagcccggctgccccaccttcttctacgccggctacagctacctgatctgcgaccacatgagagccgtgcacctgtacatcagcgccctggagaacagctgccccctgatggccttcccctgcgccagctacaaggccttcctggccggcagatgcctggactgcttcaaccccttcctgctgagctgccccagaatcggcctggtggagcagggcggcgtgaagatcgagcccctgcccaaggaggtgaaggtgtacctgctgaccaccagcagcgccccctactgcatgcaccacagcctggtggagttccacctgaaggagctgagaaacaaggacaccaacatcgaggtgaccttcctgagcagcaacatcaccagcagcagcaagatcaccatccccaagcagcagagatacggcaagggcatcatcgcccacgccaccccccagtgccagatcaaccaggtgaagttcaagttccagagcagcaacagagtgtggaagaaggacagaaccaccatcatcggcaagttctgcaccgccctgctgcccgtgaacgacagagagaagatggtgtgcctgcccgagcccgtgaacctgcaggccagcgtgaccgtgagctgcgacctgaagatcgcctgcgtgtag

SEQ ID NO: 93274 - DNA, 1323 bp, Artificial Sequence
  Description of Artificial Sequence: Synthetic coding sequence
atgccccccggcccctgggagagctgcttctgggtgggcggcctgatcctgtggctgagcgtgggcagcagcggcgacgccccccccaccccccagcccaagtgcgccgacttccagagcgccaacctgttcgagggcaccgacctgaaggtgcagttcctgctgttcgtgcccagcaaccccagctgcggccagctggtggagggcagcagcgacctgcagaacagcggcttcaacgccaccctgggcaccaagctgatcatccacggcttcagagtgctgggcaccaagcccagctggatcgacaccttcatcagaaccctgctgagagccaccaacgccaacgtgatcgccgtggactggatctacggcagcaccggcgtgtacttcagcgccgtgaagaacgtgctgggcgtgagcgagagcagcatccacatcatcggcgtgagcctgggcgcccacgtgggcggcatggtgggccagctgttcggcggccagctgggccagatcaccggcctggaccccgccggccccgagtacaccagagccagcgtggaggagagactggacgccggcgacgccctgttcgtggaggccatccacaccgacaccgacaacctgggcatcagaatccccgtgggccacgtggactacttcgtgaacggcggccaggaccagcccggctgccccaccttcttctacgccggctacagctacctgatctgcgaccacatgagagccgtgcacctgtacatcagcgccctggagaacagctgccccctgatggccttcccctgcgccagctacaaggccttcctggccggcagatgcctggactgcttcaaccccttcctgctgagctgccccagaatcggcctggtggagcagggcggcgtgaagatcgagcccctgcccaaggaggtgaaggtgtacctgctgaccaccagcagcgccccctactgcatgcaccacagcctggtggagttccacctgaaggagctgagaaacaaggacaccaacatcgaggtgaccttcctgagcagcaacatcaccagcagcagcaagatcaccatccccaagcagcagagatacggcaagggcatcatcgcccacgccaccccccagtgccagatcaaccaggtgaagttcaagttccagagcagcaacagagtgtggaagaaggacagaaccaccatcatcggcaagttctgcaccgccctgctgcccgtgaacgacagagagaagatggtgtgcctgcccgagcccgtgaacctgcaggccagcgtgaccgtgagctgcgacctgaagatcgcctgcgtgtag

SEQ ID NO: 93275 - DNA, 852 bp, Artificial Sequence
  Description of Artificial Sequence: Synthetic coding sequence
atggtgggccagctgttcggcggccagctgggccagatcaccggcctggaccccgccggccccgagtacaccagagccagcgtggaggagagactggacgccggcgacgccctgttcgtggaggccatccacaccgacaccgacaacctgggcatcagaatccccgtgggccacgtggactacttcgtgaacggcggccaggaccagcccggctgccccaccttcttctacgccggctacagctacctgatctgcgaccacatgagagccgtgcacctgtacatcagcgccctggagaacagctgccccctgatggccttcccctgcgccagctacaaggccttcctggccggcagatgcctggactgcttcaaccccttcctgctgagctgccccagaatcggcctggtggagcagggcggcgtgaagatcgagcccctgcccaaggaggtgaaggtgtacctgctgaccaccagcagcgccccctactgcatgcaccacagcctggtggagttccacctgaaggagctgagaaacaaggacaccaacatcgaggtgaccttcctgagcagcaacatcaccagcagcagcaagatcaccatccccaagcagcagagatacggcaagggcatcatcgcccacgccaccccccagtgccagatcaaccaggtgaagttcaagttccagagcagcaacagagtgtggaagaaggacagaaccaccatcatcggcaagttctgcaccgccctgctgcccgtgaacgacagagagaagatggtgtgcctgcccgagcccgtgaacctgcaggccagcgtgaccgtgagctgcgacctgaagatcgcctgcgtgtag

SEQ ID NO: 93276 - DNA, 1656 bp, Artificial Sequence
  Description of Artificial Sequence: Synthetic coding sequence
atgagaaccagacccagacccagactgagaagaaccgagaacttcctgaccgccgtgcaccacggcaagaaggaggagaaggccgccgtggagagaagaagactgcacgtgctgaaggccctgaagaagctgagaatcgaggccgacgaggcccccgtggtggccgtgctgggcagcggcggcggcctgagagcccacatcgcctgcctgggcgtgctgagcgagatgaaggagcagggcctgctggacgccgtgacctacctggccggcgtgagcggcagcacctgggccatcagcagcctgtacaccaacgacggcgacatggaggccctggaggccgacctgaagcacagattcaccagacaggagtgggacctggccaagagcctgcagaagaccatccaggccgccagaagcgagaactacagcctgaccgacttctgggcctacatggtgatcagcaagcagaccagagagctgcccgagagccacctgagcaacatgaagaagcccgtggaggagggcaccctgccctaccccatcttcgccgccatcgacaacgacctgcagcccagctggcaggaggccagagcccccgagacctggttcgagttcaccccccaccacgccggcttcagcgccctgggcgccttcgtgagcatcacccacttcggcagcaagttcaagaagggcagactggtgagaacccaccccgagagagacctgaccttcctgagaggcctgtggggcagcgccctgggcaacaccgaggtgatcagagagtacatcttcgaccagctgagaaacctgaccctgaagggcctgtggagaagagccgtggccaacgccaagagcatcggccacctgatcttcgccagactgctgagactgcaggagagcagccagggcgagcaccccccccccgaggacgagggcggcgagcccgagcacacctggctgaccgagatgctggagaactggaccagaaccagcctggagaagcaggagcagccccacgaggaccccgagagaaagggcagcctgagcaacctgatggacttcgtgaagaagaccggcatctgcgccagcaagtgggagtggggcaccacccacaacttcctgtacaagcacggcggcatcagagacaagatcatgagcagcagaaagcacctgcacctggtggacgccggcctggccatcaacacccccttccccctggtgctgccccccaccagagaggtgcacctgatcctgagcttcgacttcagcgccggcgaccccttcgagaccatcagagccaccaccgactactgcagaagacacaagatccccttcccccaggtggaggaggccgagctggacctgtggagcaaggcccccgccagctgctacatcctgaagggcgagaccggccccgtggtgatgcacttccccctgttcaacatcgacgcctgcggcggcgacatcgaggcctggagcgacacctacgacaccttcaagctggccgacacctacaccctggacgtggtggtgctgctgctggccctggccaagaagaacgtgagagagaacaagaagaagatcctgagagagctgatgaacgtggccggcctgtactaccccaaggacagcgccagaagctgctgcctggcctag

SEQ ID NO: 93277 - DNA, 4392 bp, Artificial Sequence
  Description of Artificial Sequence: Synthetic coding sequence
atgctgctgagccccagcctgctgctgctgctgctgctgggcgcccccagaggctgcgccgagggcgtggccgccgccctgacccccgagagactgctggagtggcaggacaagggcatcttcgtgatccagagcgagagcctgaagaagtgcatccaggccggcaagagcgtgctgaccctggagaactgcaagcaggccaacaagcacatgctgtggaagtgggtgagcaaccacggcctgttcaacatcggcggcagcggctgcctgggcctgaacttcagcgcccccgagcagcccctgagcctgtacgagtgcgacagcaccctggtgagcctgagatggagatgcaacagaaagatgatcaccggccccctgcagtacagcgtgcaggtggcccacgacaacaccgtggtggccagcagaaagtacatccacaagtggatcagctacggcagcggcggcggcgacatctgcgagtacctgcacaaggacctgcacaccatcaagggcaacacccacggcatgccctgcatgttccccttccagtacaaccaccagtggcaccacgagtgcaccagagagggcagagaggacgacctgctgtggtgcgccaccaccagcagatacgagagagacgagaagtggggcttctgccccgaccccaccagcgccgaggtgggctgcgacaccatctgggagaaggacctgaacagccacatctgctaccagttcaacctgctgagcagcctgagctggagcgaggcccacagcagctgccagatgcagggcggcaccctgctgagcatcaccgacgagaccgaggagaacttcatcagagagcacatgagcagcaagaccgtggaggtgtggatgggcctgaaccagctggacgagcacgccggctggcagtggagcgacggcacccccctgaactacctgaactggagccccgaggtgaacttcgagcccttcgtggaggaccactgcggcaccttcagcagcttcatgcccagcgcctggagaagcagagactgcgagagcaccctgccctacatctgcaagaagtacctgaaccacatcgaccacgagatcgtggagaaggacgcctggaagtactacgccacccactgcgagcccggctggaacccctacaacagaaactgctacaagctgcagaaggaggagaagacctggcacgaggccctgagaagctgccaggccgacaacagcgccctgatcgacatcaccagcctggccgaggtggagttcctggtgaccctgctgggcgacgagaacgccagcgagacctggatcggcctgagcagcaacaagatccccgtgagcttcgagtggagcaacgacagcagcgtgatcttcaccaactggcacaccctggagccccacatcttccccaacagaagccagctgtgcgtgagcgccgagcagagcgagggccactggaaggtgaagaactgcgaggagagactgttctacatctgcaagaaggccggccacgtgctgagcgacgccgagagcggctgccaggagggctgggagagacacggcggcttctgctacaagatcgacaccgtgctgagaagcttcgaccaggccagcagcggctactactgcccccccgccctggtgaccatcaccaacagattcgagcaggccttcatcaccagcctgatcagcagcgtggtgaagatgaaggacagctacttctggatcgccctgcaggaccagaacgacaccggcgagtacacctggaagcccgtgggccagaagcccgagcccgtgcagtacacccactggaacacccaccagcccagatacagcggcggctgcgtggccatgagaggcagacaccccctgggcagatgggaggtgaagcactgcagacacttcaaggccatgagcctgtgcaagcagcccgtggagaaccaggagaaggccgagtacgaggagagatggcccttccacccctgctacctggactgggagagcgagcccggcctggccagctgcttcaaggtgttccacagcgagaaggtgctgatgaagagaacctggagagaggccgaggccttctgcgaggagttcggcgcccacctggccagcttcgcccacatcgaggaggagaacttcgtgaacgagctgctgcacagcaagttcaactggaccgaggagagacagttctggatcggcttcaacaagagaaaccccctgaacgccggcagctgggagtggagcgacagaacccccgtggtgagcagcttcctggacaacacctacttcggcgaggacgccagaaactgcgccgtgtacaaggccaacaagaccctgctgcccctgcactgcggcagcaagagagagtggatctgcaagatccccagagacgtgaagcccaagatccccttctggtaccagtacgacgtgccctggctgttctaccaggacgccgagtacctgttccacaccttcgccagcgagtggctgaacttcgagttcgtgtgcagctggctgcacagcgacctgctgaccatccacagcgcccacgagcaggagttcatccacagcaagatcaaggccctgagcaagtacggcgccagctggtggatcggcctgcaggaggagagagccaacgacgagttcagatggagagacggcacccccgtgatctaccagaactgggacaccggcagagagagaaccgtgaacaaccagagccagagatgcggcttcatcagcagcatcaccggcctgtggggcagcgaggagtgcagcgtgagcatgcccagcatctgcaagagaaagaaggtgtggctgatcgagaagaagaaggacacccccaagcagcacggcacctgccccaagggctggctgtacttcaactacaagtgcctgctgctgaacatccccaaggaccccagcagctggaagaactggacccacgcccagcacttctgcgccgaggagggcggcaccctggtggccatcgagagcgaggtggagcaggccttcatcaccatgaacctgttcggccagaccaccagcgtgtggatcggcctgcagaacgacgactacgagacctggctgaacggcaagcccgtggtgtacagcaactggagccccttcgacatcatcaacatccccagccacaacaccaccgaggtgcagaagcacatccccctgtgcgccctgctgagcagcaaccccaacttccacttcaccggcaagtggtacttcgaggactgcggcaaggagggctacggcttcgtgtgcgagaagatgcaggacaccagcggccacggcgtgaacaccagcgacatgtaccccatgcccaacaccctggagtacggcaacagaacctacaagatcatcaacgccaacatgacctggtacgccgccatcaagacctgcctgatgcacaaggcccagctggtgagcatcaccgaccagtaccaccagagcttcctgaccgtggtgctgaacagactgggctacgcccactggatcggcctgttcaccaccgacaacggcctgaacttcgactggagcgacggcaccaagagcagcttcaccttctggaaggacgaggagagcagcctgctgggcgactgcgtgttcgccgacagcaacggcagatggcacagcaccgcctgcgagagcttcctgcagggcgccatctgccacgtgccccccgagaccagacagagcgagcaccccgagctgtgcagcgagaccagcatcccctggatcaagttcaagagcaactgctacagcttcagcaccgtgctggacagcatgagcttcgaggccgcccacgagttctgcaagaaggagggcagcaacctgctgaccatcaaggacgaggccgagaacgccttcctgctggaggagctgttcgccttcggcagcagcgtgcagatggtgtggctgaacgcccagttcgacggcaacaacgagaccatcaagtggttcgacggcacccccaccgaccagagcaactggggcatcagaaagcccgacaccgactacttcaagccccaccactgcgtggccctgagaatccccgagggcctgtggcagctgagcccctgccaggagaagaagggcttcatctgcaagatggaggccgacatccacaccgccgaggccctgcccgagaagggccccagccacagcatcatccccctggccgtggtgctgaccctgatcgtgatcgtggccatctgcaccctgagcttctgcatctacaagcacaacggcggcttcttcagaagactggccggcttcagaaacccctactaccccgccaccaacttcagcaccgtgtacctggaggagaacatcctgatcagcgacctggagaagagcgaccagtag

SEQ ID NO: 93278 - DNA, 3975 bp, Artificial Sequence
  Description of Artificial Sequence: Synthetic coding sequence
atgctgctgagccccagcctgctgctgctgctgctgctgggcgcccccagaggctgcgccgagggcgtggccgccgccctgacccccgagagactgctggagtggcaggacaagggcatcttcgtgatccagagcgagagcctgaagaagtgcatccaggccggcaagagcgtgctgaccctggagaactgcaagcaggccaacaagcacatgctgtggaagtgggtgagcaaccacggcctgttcaacatcggcggcagcggctgcctgggcctgaacttcagcgcccccgagcagcccctgagcctgtacgagtgcgacagcaccctggtgagcctgagatggagatgcaacagaaagatgatcaccggccccctgcagtacagcgtgcaggtggcccacgacaacaccgtggtggccagcagaaagtacatccacaagtggatcagctacggcagcggcggcggcgacatctgcgagtacctgcacaaggacctgcacaccatcaagggcaacacccacggcatgccctgcatgttccccttccagtacaaccaccagtggcaccacgagtgcaccagagagggcagagaggacgacctgctgtggtgcgccaccaccagcagatacgagagagacgagaagtggggcttctgccccgaccccaccagcgccgaggtgggctgcgacaccatctgggagaaggacctgaacagccacatctgctaccagttcaacctgctgagcagcctgagctggagcgaggcccacagcagctgccagatgcagggcggcaccctgctgagcatcaccgacgagaccgaggagaacttcatcagagagcacatgagcagcaagaccgtggaggtgtggatgggcctgaaccagctggacgagcacgccggctggcagtggagcgacggcacccccctgaactacctgaactggagccccgaggtgaacttcgagcccttcgtggaggaccactgcggcaccttcagcagcttcatgcccagcgcctggagaagcagagactgcgagagcaccctgccctacatctgcaagaagtacctgaaccacatcgaccacgagatcgtggagaaggacgcctggaagtactacgccacccactgcgagcccggctggaacccctacaacagaaactgctacaagctgcagaaggaggagaagacctggcacgaggccctgagaagctgccaggccgacaacagcgccctgatcgacatcaccagcctggccgaggtggagttcctggtgaccctgctgggcgacgagaacgccagcgagacctggatcggcctgagcagcaacaagatccccgtgagcttcgagtggagcaacgacagcagcgtgatcttcaccaactggcacaccctggagccccacatcttccccaacagaagccagctgtgcgtgagcgccgagcagagcgagggccactggaaggtgaagaactgcgaggagagactgttctacatctgcaagaaggccggccacgtgctgagcgacgccgagagcggctgccaggagggctgggagagacacggcggcttctgctacaagatcgacaccgtgctgagaagcttcgaccaggccagcagcggctactactgcccccccgccctggtgaccatcaccaacagattcgagcaggccttcatcaccagcctgatcagcagcgtggtgaagatgaaggacagctacttctggatcgccctgcaggaccagaacgacaccggcgagtacacctggaagcccgtgggccagaagcccgagcccgtgcagtacacccactggaacacccaccagcccagatacagcggcggctgcgtggccatgagaggcagacaccccctgggcagatgggaggtgaagcactgcagacacttcaaggccatgagcctgtgcaagcagcccgtggagaaccaggagaaggccgagtacgaggagagatggcccttccacccctgctacctggactgggagagcgagcccggcctggccagctgcttcaaggtgttccacagcgagaaggtgctgatgaagagaacctggagagaggccgaggccttctgcgaggagttcggcgcccacctggccagcttcgcccacatcgaggaggagaacttcgtgaacgagctgctgcacagcaagttcaactggaccgaggagagacagttctggatcggcttcaacaagagaaaccccctgaacgccggcagctgggagtggagcgacagaacccccgtggtgagcagcttcctggacaacacctacttcggcgaggacgccagaaactgcgccgtgtacaaggccaacaagaccctgctgcccctgcactgcggcagcaagagagagtggatctgcaagatccccagagacgtgaagcccaagatccccttctggtaccagtacgacgtgccctggctgttctaccaggacgccgagtacctgttccacaccttcgccagcgagtggctgaacttcgagttcgtgtgcagctggctgcacagcgacctgctgaccatccacagcgcccacgagcaggagttcatccacagcaagatcaaggccctgagcaagtacggcgccagctggtggatcggcctgcaggaggagagagccaacgacgagttcagatggagagacggcacccccgtgatctaccagaactgggacaccggcagagagagaaccgtgaacaaccagagccagagatgcggcttcatcagcagcatcaccggcctgtggggcagcgaggagtgcagcgtgagcatgcccagcatctgcaagagaaagaaggtgtggctgatcgagaagaagaaggacacccccaagcagcacggcacctgccccaagggctggctgtacttcaactacaagtgcctgctgctgaacatccccaaggaccccagcagctggaagaactggacccacgcccagcacttctgcgccgaggagggcggcaccctggtggccatcgagagcgaggtggagcaggccttcatcaccatgaacctgttcggccagaccaccagcgtgtggatcggcctgcagaacgacgactacgagacctggctgaacggcaagcccgtggtgtacagcaactggagccccttcgacatcatcaacatccccagccacaacaccaccgaggtgcagaagcacatccccctgtgcgccctgctgagcagcaaccccaacttccacttcaccggcaagtggtacttcgaggactgcggcaaggagggctacggcttcgtgtgcgagaagatgcaggacaccagcggccacggcgtgaacaccagcgacatgtaccccatgcccaacaccctggagtacggcaacagaacctacaagatcatcaacgccaacatgacctggtacgccgccatcaagacctgcctgatgcacaaggcccagctggtgagcatcaccgaccagtaccaccagagcttcctgaccgtggtgctgaacagactgggctacgcccactggatcggcctgttcaccaccgacaacggcctgaacttcgactggagcgacggcaccaagagcagcttcaccttctggaaggacgaggagagcagcctgctgggcgactgcgtgttcgccgacagcaacggcagatggcacagcaccgcctgcgagagcttcctgcagggcgccatctgccacgtgccccccgagaccagacagagcgagcaccccgagctgtgcagcgagaccagcatcccctggatcaagttcaagagcaactgctacagcttcagcaccgtgctggacagcatgagcttcgaggccgcccacgagttctgcaagaaggagggcagcaacctgctgaccatcaaggacgaggccgagaacgccttcctgctggaggagctgttcgccttcggcagcagcgtgcagatggtgtggctgaacgcccagttcgacggcaacagcaagtag

SEQ ID NO: 93279 - DNA, 1584 bp, Artificial Sequence
  Description of Artificial Sequence: Synthetic coding sequence
atgggcagcagcgaggtgagcatcatccccggcctgcagaaggaggagaaggccgccgtggagagaagaagactgcacgtgctgaaggccctgaagaagctgagaatcgaggccgacgaggcccccgtggtggccgtgctgggcagcggcggcggcctgagagcccacatcgcctgcctgggcgtgctgagcgagatgaaggagcagggcctgctggacgccgtgacctacctggccggcgtgagcggcagcacctgggccatcagcagcctgtacaccaacgacggcgacatggaggccctggaggccgacctgaagcacagattcaccagacaggagtgggacctggccaagagcctgcagaagaccatccaggccgccagaagcgagaactacagcctgaccgacttctgggcctacatggtgatcagcaagcagaccagagagctgcccgagagccacctgagcaacatgaagaagcccgtggaggagggcaccctgccctaccccatcttcgccgccatcgacaacgacctgcagcccagctggcaggaggccagagcccccgagacctggttcgagttcaccccccaccacgccggcttcagcgccctgggcgccttcgtgagcatcacccacttcggcagcaagttcaagaagggcagactggtgagaacccaccccgagagagacctgaccttcctgagaggcctgtggggcagcgccctgggcaacaccgaggtgatcagagagtacatcttcgaccagctgagaaacctgaccctgaagggcctgtggagaagagccgtggccaacgccaagagcatcggccacctgatcttcgccagactgctgagactgcaggagagcagccagggcgagcaccccccccccgaggacgagggcggcgagcccgagcacacctggctgaccgagatgctggagaactggaccagaaccagcctggagaagcaggagcagccccacgaggaccccgagagaaagggcagcctgagcaacctgatggacttcgtgaagaagaccggcatctgcgccagcaagtgggagtggggcaccacccacaacttcctgtacaagcacggcggcatcagagacaagatcatgagcagcagaaagcacctgcacctggtggacgccggcctggccatcaacacccccttccccctggtgctgccccccaccagagaggtgcacctgatcctgagcttcgacttcagcgccggcgaccccttcgagaccatcagagccaccaccgactactgcagaagacacaagatccccttcccccaggtggaggaggccgagctggacctgtggagcaaggcccccgccagctgctacatcctgaagggcgagaccggccccgtggtgatgcacttccccctgttcaacatcgacgcctgcggcggcgacatcgaggcctggagcgacacctacgacaccttcaagctggccgacacctacaccctggacgtggtggtgctgctgctggccctggccaagaagaacgtgagagagaacaagaagaagatcctgagagagctgatgaacgtggccggctag

SEQ ID NO: 93280 - DNA, 1626 bp, Artificial Sequence
  Description of Artificial Sequence: Synthetic coding sequence
atgggcagcagcgaggtgagcatcatccccggcctgcagaaggaggagaaggccgccgtggagagaagaagactgcacgtgctgaaggccctgaagaagctgagaatcgaggccgacgaggcccccgtggtggccgtgctgggcagcggcggcggcctgagagcccacatcgcctgcctgggcgtgctgagcgagatgaaggagcagggcctgctggacgccgtgacctacctggccggcgtgagcggcagcacctgggccatcagcagcctgtacaccaacgacggcgacatggaggccctggaggccgacctgaagcacagattcaccagacaggagtgggacctggccaagagcctgcagaagaccatccaggccgccagaagcgagaactacagcctgaccgacttctgggcctacatggtgatcagcaagcagaccagagagctgcccgagagccacctgagcaacatgaagaagcccgtggaggagggcaccctgccctaccccatcttcgccgccatcgacaacgacctgcagcccagctggcaggaggccagagcccccgagacctggttcgagttcaccccccaccacgccggcttcagcgccctgggcgccttcgtgagcatcacccacttcggcagcaagttcaagaagggcagactggtgagaacccaccccgagagagacctgaccttcctgagaggcctgtggggcagcgccctgggcaacaccgaggtgatcagagagtacatcttcgaccagctgagaaacctgaccctgaagggcctgtggagaagagccgtggccaacgccaagagcatcggccacctgatcttcgccagactgctgagactgcaggagagcagccagggcgagcaccccccccccgaggacgagggcggcgagcccgagcacacctggctgaccgagatgctggagaactggaccagaaccagcctggagaagcaggagcagccccacgaggaccccgagagaaagggcagcctgagcaacctgatggacttcgtgaagaagaccggcatctgcgccagcaagtgggagtggggcaccacccacaacttcctgtacaagcacggcggcatcagagacaagatcatgagcagcagaaagcacctgcacctggtggacgccggcctggccatcaacacccccttccccctggtgctgccccccaccagagaggtgcacctgatcctgagcttcgacttcagcgccggcgaccccttcgagaccatcagagccaccaccgactactgcagaagacacaagatccccttcccccaggtggaggaggccgagctggacctgtggagcaaggcccccgccagctgctacatcctgaagggcgagaccggccccgtggtgatgcacttccccctgttcaacatcgacgcctgcggcggcgacatcgaggcctggagcgacacctacgacaccttcaagctggccgacacctacaccctggacgtggtggtgctgctgctggccctggccaagaagaacgtgagagagaacaagaagaagatcctgagagagctgatgaacgtggccggcctgtactaccccaaggacagcgccagaagctgctgcctggcctag

SEQ ID NO: 93281 - DNA, 2457 bp, Artificial Sequence
  Description of Artificial Sequence: Synthetic coding sequence
atggagagcctgagccccggcggcccccccggccacccctaccagggcgaggccagcacctgctggcagctgaccgtgagagtgctggaggccagaaacctgagatgggccgacctgctgagcgaggccgacccctacgtgatcctgcagctgagcaccgcccccggcatgaagttcaagaccaagaccctgaccgacaccagccaccccgtgtggaacgaggccttcagattcctgatccagagccaggtgaagaacgtgctggagctgagcatctacgacgaggacagcgtgaccgaggacgacatctgcttcaaggtgctgtacgacatcagcgaggtgctgcccggcaagctgctgagaaagaccttcagccagagcccccagggcgaggaggagctggacgtggagttcctgatggaggagaccagcgacagacccgagaacctgatcaccaacaaggtgatcgtggccagagagctgagctgcctggacgtgcacctggacagcaccggcagcaccgccgtggtggccgaccaggacaagctggagctggagctggtgctgaagggcagctacgaggacacccagaccagcttcctgggcaccgccagcgccttcagattccactacatggccgccctggagaccgagctgagcggcagactgagaagcagcagaagcaacggctggaacggcgacaacagcgccggctacctgaccgtgcccctgagacccctgaccatcggcaaggaggtgaccatggacgtgcccgcccccaacgcccccggcgtgagactgcagctgaaggccgagggctgccccgaggagctggccgtgcacctgggcttcaacctgtgcgccgaggagcaggccttcctgagcagaagaaagcaggtggtggccaaggccctgaagcaggccctgcagctggacagagacctgcaggaggacgaggtgcccgtggtgggcatcatggccaccggcggcggcgccagagccatgaccagcctgtacggccacctgctggccctgcagaagctgggcctgctggactgcgtgacctacttcagcggcatcagcggcagcacctggaccatggcccacctgtacggcgaccccgagtggagccagagagacctggagggccccatcagatacgccagagagcacctggccaagagcaagctggaggtgttcagccccgagagactggccagctacagaagagagctggagctgagagccgagcagggccaccccaccaccttcgtggacctgtgggccctggtgctggagagcatgctgcacggccaggtgatggaccagaagctgagcggccagagagccgccctggagagaggccagaaccccctgcccctgtacctgagcctgaacgtgaaggagaacaacctggagaccctggacttcaaggagtgggtggagttcagcccctacgaggtgggcttcctgaagtacggcgccttcgtgccccccgagctgttcggcagcgagttcttcatgggcagactgatgagaagaatccccgagcccagaatctgcttcctggaggccatctggagcaacatcttcagcctgaacctgctggacgcctggtacgacctgaccagcagcggcgagagctggaagcagcacatcaaggacaagaccagaagcctggagaaggagcccctgaccaccagcggcaccagcagcagactggaggccagctggctgcagcccggcaccgccctggcccaggccttcaagggcttcctgaccggcagacccctgcaccagagaagccccaacttcctgcagggcctgcagctgcaccaggactactgcagccacaaggacttcagcacctgggccgactaccagctggacagcatgcccagccagctgacccccaaggagcccagactgtgcctggtggacgccgcctacttcatcaacaccagcagccccagcatgttcagacccggcagaagactggacctgatcctgagcttcgactacagcctgagcgcccccttcgaggccctgcagcagaccgagctgtactgcagagccagaggcctgcccttccccagagtggagcccagcccccaggaccagcaccagcccagagagtgccacctgttcagcgaccccgcctgccccgaggcccccatcctgctgcacttccccctggtgaacgccagcttcaaggaccacagcgcccccggcgtgcagagaagccccgccgagctgcagggcggccaggtggacctgaccggcgccacctgcccctacaccctgagcaacatgacctacaaggaggaggacttcgagagactgctgagactgagcgactacaacgtgcagaccagccagggcgccatcctgcaggccctgagaaccgccctgaagcacagaaccctggaggccagaccccccagagcccagacctag

SEQ ID NO: 93282 - DNA, 1326 bp, Artificial Sequence
  Description of Artificial Sequence: Synthetic coding sequence
atggtgccccccaagctgcacgtgctgttctgcctgtgcggctgcctggccgtggtgtaccccttcgactggcagtacatcaaccccgtggcccacatgaagagcagcgcctgggtgaacaagatccaggtgctgatggccgccgccagcttcggccagaccaagatccccagaggcaacggcccctacagcgtgggctgcaccgacctgatgttcgaccacaccaacaagggcaccttcctgagactgtactaccccagccaggacaacgacagactggacaccctgtggatccccaacaaggagtacttctggggcctgagcaagttcctgggcacccactggctgatgggcaacatcctgagactgctgttcggcagcatgaccacccccgccaactggaacagccccctgagacccggcgagaagtaccccctggtggtgttcagccacggcctgggcgccttcagaaccctgtacagcgccatcggcatcgacctggccagccacggcttcatcgtggccgccgtggagcacagagacagaagcgccagcgccacctactacttcaaggaccagagcgccgccgagatcggcgacaagagctggctgtacctgagaaccctgaagcaggaggaggagacccacatcagaaacgagcaggtgagacagagagccaaggagtgcagccaggccctgagcctgatcctggacatcgaccacggcaagcccgtgaagaacgccctggacctgaagttcgacatggagcagctgaaggacagcatcgacagagagaagatcgccgtgatcggccacagcttcggcggcgccaccgtgatccagaccctgagcgaggaccagagattcagatgcggcatcgccctggacgcctggatgttccccctgggcgacgaggtgtacagcagaatcccccagcccctgttcttcatcaacagcgagtacttccagtaccccgccaacatcatcaagatgaagaagtgctacagccccgacaaggagagaaagatgatcaccatcagaggcagcgtgcaccagaacttcgccgacttcaccttcgccaccggcaagatcatcggccacatgctgaagctgaagggcgacatcgacagcaacgtggccatcgacctgagcaacaaggccagcctggccttcctgcagaagcacctgggcctgcacaaggacttcgaccagtgggactgcctgatcgagggcgacgacgagaacctgatccccggcaccaacatcaacaccaccaaccagcacatcatgctgcagaacagcagcggcatcgagaagtacaactag

SEQ ID NO: 93283 - DNA, 1326 bp, Artificial Sequence; identical to SEQ ID NO: 93282
  Description of Artificial Sequence: Synthetic coding sequence

SEQ ID NO: 93284 - DNA, 660 bp, Artificial Sequence
  Description of Artificial Sequence: Synthetic coding sequence
atggccgccgccagcttcggccagaccaagatccccagaggcaacggcccctacagcgtgggctgcaccgacctgatgttcgaccacaccaacaagggcaccttcctgagactgtactaccccagccaggacaacgacagactggacaccctgtggatccccaacaaggagtacttctggggcctgagcaagttcctgggcacccactggctgatgggcaacatcctgagactgctgttcggcagcatgaccacccccgccaactggaacagccccctgagacccggcgagaagtaccccctggtggtgttcagccacggcctgggcgccttcagaaccctgtacagcgccatcggcatcgacctggccagccacggcttcatcgtggccgccgtggagcacagagacagaagcgccagcgccacctactacttcaaggaccagagcgccgccgagatcggcgacaagagctggctgtacctgagaaccctgaagcaggaggaggagacccacatcagaaacgagcaggtgagacagagagccaaggagtgcagccaggccctgagcctgatcctggacatcgaccacggcaagcccgtgaagaacgccctggacctgaagttcgacatggagcagctgaaggtgagctacaagaagtag

SEQ ID NO: 93285 - DNA, 414 bp, Artificial Sequence
  Description of Artificial Sequence: Synthetic coding sequence
atgaccacccccgccaactggaacagccccctgagacccggcgagaagtaccccctggtggtgttcagccacggcctgggcgccttcagaaccctgtacagcgccatcggcatcgacctggccagccacggcttcatcgtggccgccgtggagcacagagacagaagcgccagcgccacctactacttcaaggaccagagcgccgccgagatcggcgacaagagctggctgtacctgagaaccctgaagcaggaggaggagacccacatcagaaacgagcaggtgagacagagagccaaggagtgcagccaggccctgagcctgatcctggacatcgaccacggcaagcccgtgaagaacgccctggacctgaagttcgacatggagcagctgaaggtgagctacaagaagtag

SEQ ID NO: 93286 - DNA, 489 bp, Artificial Sequence
  Description of Artificial Sequence: Synthetic coding sequence
atgagagcccccatccccgagcccaagcccggcgacctgatcgagatcttcagacccttctacagacactgggccatctacgtgggcgacggctacgtggtgcacctggccccccccagcgaggtggccggcgccggcgccgccagcgtgatgagcgccctgaccgacaaggccatcgtgaagaaggagctgctgtacgacgtggccggcagcgacaagtaccaggtgaacaacaagcacgacgacaagtacagccccctgccctgcagcaagatcatccagagagccgaggagctggtgggccaggaggtgctgtacaagctgaccagcgagaactgcgagcacttcgtgaacgagctgagatacggcgtggccagaagcgaccaggtgagagacgtgatcatcgccgccagcgtggccggcatgggcctggccgccatgagcctgatcggcgtgatgttcagcagaaacaagagacagaagcagtag

SEQ ID NO: 93287 - DNA, 489 bp, Artificial Sequence; identical to SEQ ID NO: 93286
  Description of Artificial Sequence: Synthetic coding sequence

SEQ ID NO: 93288 - DNA, 4377 bp, Artificial Sequence
  Description of Artificial Sequence: Synthetic coding sequence
atgggcctgagacccggcatcttcctgctggagctgctgctgctgctgggccagggcaccccccagatccacaccagccccagaaagagcaccctggagggccagctgtggcccgagaccctgaagaacagccccttcccctgcaaccccaacaagctgggcgtgaacatgcccagcaagagcgtgcacagcctgaagcccagcgacatcaagttcgtggccgccatcggcaacctggagatcccccccgaccccggcaccggcgacctggagaagcaggactggaccgagagaccccagcaggtgtgcatgggcgtgatgaccgtgctgagcgacatcatcagatacttcagccccagcgtgcccatgcccgtgtgccacaccggcaagagagtgatcccccacgacggcgccgaggacctgtggatccaggcccaggagctggtgagaaacatgaaggagaacctgcagctggacttccagttcgactggaagctgatcaacgtgttcttcagcaacgccagccagtgctacctgtgccccagcgcccagcagaacggcctggccgccggcggcgtggacgagctgatgggcgtgctggactacctgcagcaggaggtgcccagagccttcgtgaacctggtggacctgagcgaggtggccgaggtgagcagacagtaccacggcacctggctgagccccgcccccgagccctgcaactgcagcgaggagaccaccagactggccaaggtggtgatgcagtggagctaccaggaggcctggaacagcctgctggccagcagcagatacagcgagcaggagagcttcaccgtggtgttccagcccttcttctacgagaccacccccagcctgcacagcgaggaccccagactgcaggacagcaccaccctggcctggcacctgtggaacagaatgatggagcccgccggcgagaaggacgagcccctgagcgtgaagcacggcagacccatgaagtgccccagccaggagagcccctacctgttcagctacagaaacagcaactacctgaccagactgcagaagccccaggacaagctggaggtgagagagggcgccgagatcagatgccccgacaaggaccccagcgacaccgtgcccaccagcgtgcacagactgaagcccgccgacatcaacgtgatcggcgccctgggcgacagcctgaccgccggcaacggcgccggcagcacccccggcaacgtgctggacgtgctgacccagtacagaggcctgagctggagcgtgggcggcgacgagaacatcggcaccgtgaccaccctggccaacatcctgagagagttcaaccccagcctgaagggcttcagcgtgggcaccggcaaggagaccagccccaacgccttcctgaaccaggccgtggccggcggcagagccgaggacctgcccgtgcaggccagaagactggtggacctgatgaagaacgacaccagaatccacttccaggaggactggaagatcatcaccctgttcatcggcggcaacgacctgtgcgacttctgcaacgacctggtgcactacagcccccagaacttcaccgacaacatcggcaaggccctggacatcctgcacgccgaggtgcccagagccttcgtgaacctggtgaccgtgctggagatcgtgaacctgagagagctgtaccaggagaagaaggtgtactgccccagaatgatcctgagaagcctgtgcccctgcgtgctgaagttcgacgacaacagcaccgagctggccaccctgatcgagttcaacaagaagttccaggagaagacccaccagctgatcgagagcggcagatacgacaccagagaggacttcaccgtggtggtgcagcccttcttcgagaacgtggacatgcccaagaccagcgagggcctgcccgacaacagcttcttcgcccccgactgcttccacttcagcagcaagagccacagcagagccgccagcgccctgtggaacaacatgctggagcccgtgggccagaagaccaccagacacaagttcgagaacaagatcaacatcacctgccccaaccaggtgcagcccttcctgagaacctacaagaacagcatgcagggccacggcacctggctgccctgcagagacagagcccccagcgccctgcaccccaccagcgtgcacgccctgagacccgccgacatccaggtggtggccgccctgggcgacagcctgaccgccggcaacggcatcggcagcaagcccgacgacctgcccgacgtgaccacccagtacagaggcctgagctacagcgccggcggcgacggcagcctggagaacgtgaccaccctgcccaacatcctgagagagttcaacagaaacctgaccggctacgccgtgggcaccggcgacgccaacgacaccaacgccttcctgaaccaggccgtgcccggcgccaaggccgaggacctgatgagccaggtgcagaccctgatgcagaagatgaaggacgaccacagagtgaacttccacgaggactggaaggtgatcaccgtgctgatcggcggcagcgacctgtgcgactactgcaccgacagcaacctgtacagcgccgccaacttcgtgcaccacctgagaaacgccctggacgtgctgcacagagaggtgcccagagtgctggtgaacctggtggacttcctgaaccccaccatcatgagacaggtgttcctgggcaaccccgacaagtgccccgtgcagcaggccagcgtgctgtgcaactgcgtgctgaccctgagagagaacagccaggagctggccagactggaggccttcagcagagcctacagaagcagcatgagagagctggtgggcagcggcagatacgacacccaggaggacttcagcgtggtgctgcagcccttcttccagaacatccagctgcccgtgctggccgacggcctgcccgacaccagcttcttcgcccccgactgcatccaccccaaccagaagttccacagccagctggccagagccctgtggaccaacatgctggagcccctgggcagcaagaccgagaccctggacctgagagccgagatgcccatcacctgccccacccagaacgagcccttcctgagaacccccagaaacagcaactacacctaccccatcaagcccgccatcgagaactggggcagcgacttcctgtgcaccgagtggaaggccagcaacagcgtgcccaccagcgtgcaccagctgagacccgccgacatcaaggtggtggccgccctgggcgacagcctgaccaccgccgtgggcgccagacccaacaacagcagcgacctgcccaccagctggagaggcctgagctggagcatcggcggcgacggcaacctggagacccacaccaccctgcccaacatcctgaagaagttcaacccctacctgctgggcttcagcaccagcacctgggagggcaccgccggcctgaacgtggccgccgagggcgccagagccagagacatgcccgcccaggcctgggacctggtggagagaatgaagaacagccccgacatcaacctggagaaggactggaagctggtgaccctgttcatcggcgtgaacgacctgtgccactactgcgagaaccccgaggcccacctggccaccgagtacgtgcagcacatccagcaggccctggacatcctgagcgaggagctgcccagagccttcgtgaacgtggtggaggtgatggagctggccagcctgtaccagggccagggcggcaagtgcgccatgctggccgcccagaacaactgcacctgcctgagacacagccagagcagcctggagaagcaggagctgaagaaggtgaactggaacctgcagcacggcatcagcagcttcagctactggcaccagtacacccagagagaggacttcgccgtggtggtgcagcccttcttccagaacaccctgacccccctgaacgagagaggcgacaccgacctgaccttcttcagcgaggactgcttccacttcagcgacagaggccacgccgagatggccatcgccctgtggaacaacatgctggagcccgtgggcagaaagaccaccagcaacaacttcacccacagcagagccaagctgaagtgccccagccccgagagcccctacctgtacaccctgagaaacagcagactgctgcccgaccaggccgaggaggcccccgaggtgctgtactgggccgtgcccgtggccgccggcgtgggcctggtggtgggcatcatcggcaccgtggtgtggagatgcagaagaggcggcagaagagaggacccccccatgagcctgagaaccgtggccctgtag

SEQ ID NO: 93289 - DNA, 1467 bp, Artificial Sequence
  Description of Artificial Sequence: Synthetic coding sequence
atggagcccgccggcgagaaggacgagcccctgagcgtgaagcacggcagacccatgaagtgccccagccaggagagcccctacctgttcagctacagaaacagcaactacctgaccagactgcagaagccccaggacaagctggaggtgagagagggcgccgagatcagatgccccgacaaggaccccagcgacaccgtgcccaccagcgtgcacagactgaagcccgccgacatcaacgtgatcggcgccctgggcgacagcctgaccgccggcaacggcgccggcagcacccccggcaacgtgctggacgtgctgacccagtacagaggcctgagctggagcgtgggcggcgacgagaacatcggcaccgtgaccaccctggccaacatcctgagagagttcaaccccagcctgaagggcttcagcgtgggcaccggcaaggagaccagccccaacgccttcctgaaccaggccgtggccggcggcagagccgaggacctgcccgtgcaggccagaagactggtggacctgatgaagaacgacaccagaatccacttccaggaggactggaagatcatcaccctgttcatcggcggcaacgacctgtgcgacttctgcaacgacctggtgcactacagcccccagaacttcaccgacaacatcggcaaggccctggacatcctgcacgccgaggtgcccagagccttcgtgaacctggtgaccgtgctggagatcgtgaacctgagagagctgtaccaggagaagaaggtgtactgccccagaatgatcctgagaagcctgtgcccctgcgtgctgaagttcgacgacaacagcaccgagctggccaccctgatcgagttcaacaagaagttccaggagaagacccaccagctgatcgagagcggcagatacgacaccagagaggacttcaccgtggtggtgcagcccttcttcgagaacgtggacatgcccaagaccagcgagggcctgcccgacaacagcttcttcgcccccgactgcttccacttcagcagcaagagccacagcagagccgccagcgccctgtggaacaacatgctggagcccgtgggccagaagaccaccagacacaagttcgagaacaagatcaacatcacctgccccaaccaggtgcagcccttcctgagaacctacaagaacagcatgcagggccacggcacctggctgccctgcagagacagagcccccagcgccctgcaccccaccagcgtgcacgccctgagacccgccgacatccaggtggtggccgccctgggcgacagcctgaccgccggcaacggcatcggcagcaagcccgacgacctgcccgacgtgaccacccagtacagaggcctgagctacagagagagcaagcccggcttcctgagcgacagctgggtgagcaagagcaacagaaagtgcaccagaaaggcccccaacccctag

SEQ ID NO: 93290 - DNA, 4344 bp, Artificial Sequence
  Description of Artificial Sequence: Synthetic coding sequence
atgggcctgagacccggcatcttcctgctggagctgctgctgctgctgggccagggcaccccccagatccacaccagccccagaaagagcaccctggagggccagctgtggcccgagaccctgaagaacagccccttcccctgcaaccccaacaagctgggcgtgaacatgcccagcaagagcgtgcacagcctgaagcccagcgacatcaagttcgtggccgccatcggcaacctggagatcccccccgaccccggcaccggcgacctggagaagcaggactggaccgagagaccccagcaggtgtgcatgggcgtgatgaccgtgctgagcgacatcatcagatacttcagccccagcgtgcccatgcccgtgtgccacaccggcaagagagtgatcccccacgacggcgccgaggacctgtggatccaggcccaggagctggtgagaaacatgaaggagaacctgcagctggacttccagttcgactggaagctgatcaacgtgttcttcagcaacgccagccagtgctacctgtgccccagcgcccagcaggcccccagcctgagcaccgtgctgctgagccagaacggcctggccgccggcggcgtggacgagctgatgggcgtgctggactacctgcagcaggaggtgcccagagccttcgtgaacctggtggacctgagcgaggtggccgaggtgagcagacagtaccacggcacctggctgagccccgcccccgagccctgcaactgcagcgaggagaccaccagactggccaaggtggtgatgcagtggagctaccaggaggcctggaacagcctgctggccagcagcagatacagcgagcaggagagcttcaccgtggtgttccagcccttcttctacgagaccacccccagcctgcacagcgaggaccccagactgcaggacagcaccaccctggcctggcacctgtggaacagaatgatggagcccgccggcgagaaggacgagcccctgagcgtgaagcacggcagacccatgaagtgccccagccaggagagcccctacctgttcagctacagaaacagcaactacctgaccagactgcagaagccccaggacaagctggaggtgagagagggcgccgagatcagatgccccgacaaggaccccagcgacaccgtgcccaccagcgtgcacagactgaagcccgccgacatcaacgtgatcggcgccctgggcgacagcctgaccgccggcaacggcgccggcagcacccccggcaacgtgctggacgtgctgacccagtacagaggcctgagctggagcgtgggcggcgacgagaacatcggcaccgtgaccaccctggccaacatcctgagagagttcaaccccagcctgaagggcttcagcgtgggcaccggcaaggagaccagccccaacgccttcctgaaccaggccgtggccggcggcagagccgaggacctgcccgtgcaggccagaagactggtggacctgatgaagaacgacaccagaatccacttccaggaggactggaagatcatcaccctgttcatcggcggcaacgacctgtgcgacttctgcaacgacctggtgcccagagccttcgtgaacctggtgaccgtgctggagatcgtgaacctgagagagctgtaccaggagaagaaggtgtactgccccagaatgatcctgagaagcctgtgcccctgcgtgctgaagttcgacgacaacagcaccgagctggccaccctgatcgagttcaacaagaagttccaggagaagacccaccagctgatcgagagcggcagatacgacaccagagaggacttcaccgtggtggtgcagcccttcttcgagaacgtggacatgcccaagaccagcgagggcctgcccgacaacagcttcttcgcccccgactgcttccacttcagcagcaagagccacagcagagccgccagcgccctgtggaacaacatgctggagcccgtgggccagaagaccaccagacacaagttcgagaacaagatcaacatcacctgccccaaccaggtgcagcccttcctgagaacctacaagaacagcatgcagggccacggcacctggctgccctgcagagacagagcccccagcgccctgcaccccaccagcgtgcacgccctgagacccgccgacatccaggtggtggccgccctgggcgacagcctgaccgccggcaacggcatcggcagcaagcccgacgacctgcccgacgtgaccacccagtacagaggcctgagctacagcgccggcggcgacggcagcctggagaacgtgaccaccctgcccaacatcctgagagagttcaacagaaacctgaccggctacgccgtgggcaccggcgacgccaacgacaccaacgccttcctgaaccaggccgtgcccggcgccaaggccgaggacctgatgagccaggtgcagaccctgatgcagaagatgaaggacgaccacagagtgaacttccacgaggactggaaggtgatcaccgtgctgatcggcggcagcgacctgtgcgactactgcaccgacagcaacctgtacagcgccgccaacttcgtgcaccacctgagaaacgccctggacgtgctgcacagagaggtgcccagagtgctggtgaacctggtggacttcctgaaccccaccatcatgagacaggtgttcctgggcaaccccgacaagtgccccgtgcagcaggccagcgtgctgtgcaactgcgtgctgaccctgagagagaacagccaggagctggccagactggaggccttcagcagagcctacagaagcagcatgagagagctggtgggcagcggcagatacgacacccaggaggacttcagcgtggtgctgcagcccttcttccagaacatccagctgcccgtgctggccgacggcctgcccgacaccagcttcttcgcccccgactgcatccaccccaaccagaagttccacagccagctggccagagccctgtggaccaacatgctggagcccctgggcagcaagaccgagaccctggacctgagagccgagatgcccatcacctgccccacccagaacgagcccttcctgagaacccccagaaacagcaactacacctaccccatcaagcccgccatcgagaactggggcagcgacttcctgtgcaccgagtggaaggccagcaacagcgtgcccaccagcgtgcaccagctgagacccgccgacatcaaggtggtggccgccctgggcgacagcctgaccaccgccgtgggcgccagacccaacaacagcagcgacctgcccaccagctggagaggcctgagctggagcatcggcggcgacggcaacctggagacccacaccaccctgcccaacatcctgaagaagttcaacccctacctgctgggcttcagcaccagcacctgggagggcaccgccggcctgaacgtggccgccgagggcgccagagccagagacatgcccgcccaggcctgggacctggtggagagaatgaagaacagccccgacatcaacctggagaaggactggaagctggtgaccctgttcatcggcgtgaacgacctgtgccactactgcgagaaccccgaggcccacctggccaccgagtacgtgcagcacatccagcaggccctggacatcctgagcgaggagctgcccagagccttcgtgaacgtggtggaggtgatggagctggccagcctgtaccagggccagggcggcaagtgcgccatgctggccgcccagaacaactgcacctgcctgagacacagccagagcagcctggagaagcaggagctgaagaaggtgaactggaacctgcagcacggcatcagcagcttcagctactggcaccagtacacccagagagaggacttcgccgtggtggtgcagcccttcttccagaacaccctgacccccctgaacgagagaggcgacaccgacctgaccttcttcagcgaggactgcttccacttcagcgacagaggccacgccgagatggccatcgccctgtggaacaacatgctggagcccgtgggcagaaagaccaccagcaacaacttcacccacagcagagccaagctgaagtgccccagccccgagagcccctacctgtacaccctgagaaacagcagactgctgcccgaccaggccgaggaggcccccgaggtgctgtactgggccgtgcccgtggccgccggcgtgggcctggtggtgggcatcatcggcaccgtggtgtggagatgcagaagaggcggcagaagagaggacccccccatgagcctgagaaccgtggccctgtag

SEQ ID NO: 93291 - DNA, 1272 bp, Artificial Sequence
  Description of Artificial Sequence: Synthetic coding sequence
atgcccatcacctgccccacccagaacgagcccttcctgagaacccccagaaacagcaactacacctaccccatcaagcccgccatcgagaactggggcagcgacttcctgtgcaccgagtggaaggccagcaacagcgtgcccaccagcgtgcaccagctgagacccgccgacatcaaggtggtggccgccctgggcgacagcctgaccaccgccgtgggcgccagacccaacaacagcagcgacctgcccaccagctggagaggcctgagctggagcatcggcggcgacggcaacctggagacccacaccaccctgcccaacatcctgaagaagttcaacccctacctgctgggcttcagcaccagcacctgggagggcaccgccggcctgaacgtggccgccgagggcgccagagccagagacatgcccgcccaggcctgggacctggtggagagaatgaagaacagccccgacatcaacctggagaaggactggaagctggtgaccctgttcatcggcgtgaacgacctgtgccactactgcgagaaccccgaggcccacctggccaccgagtacgtgcagcacatccagcaggccctggacatcctgagcgaggagctgcccagagccttcgtgaacgtggtggaggtgatggagctggccagcctgtaccagggccagggcggcaagtgcgccatgctggccgcccagaacaactgcacctgcctgagacacagccagagcagcctggagaagcaggagctgaagaaggtgaactggaacctgcagcacggcatcagcagcttcagctactggcaccagtacacccagagagaggacttcgccgtggtggtgcagcccttcttccagaacaccctgacccccctgaacgagagaggcgacaccgacctgaccttcttcagcgaggactgcttccacttcagcgacagaggccacgccgagatggccatcgccctgtggaacaacatgctggagcccgtgggcagaaagaccaccagcaacaacttcacccacagcagagccaagctgaagtgccccagccccgagagcccctacctgtacaccctgagaaacagcagactgctgcccgaccaggccgaggaggcccccgaggtgctgtactgggccgtgcccgtggccgccggcgtgggcctggtggtgggcatcatcggcaccgtggtgtggagatgcagaagaggcggcagaagagaggacccccccatgagcctgagaaccgtggccctgtag

SEQ ID NO: 93292 - DNA, 3504 bp, Artificial Sequence
  Description of Artificial Sequence: Synthetic coding sequence
atggccggcgcccagcccggcgtgcacgccctgcagctggagccccccaccgtggtggagaccctgagaagaggcagcaagttcatcaagtgggacgaggagaagctgatgaccgtggtgagcggccccgaccccgtgaacaccgtgttcctgaacttcatggccgtgcaggacgacaccgccaaggtgtggagcgaggagctgttcaagctggccatgaacatcctggcccagaacgccagcagaaacaccttcctgagaaaggcctacaccaagctgaagctgcaggtgaaccaggacggcagaatccccgtgaagaacatcctgaagatgttcagcgccgacaagaagagagtggagaccgccctggagagctgcggcctgaagttcaacagaagcgagagcatcagacccgacgagttcagcctggagatcttcgagagattcctgaacaagctgtgcctgagacccgacatcgacaagatcctgctggagatcggcgccaagggcaagccctacctgaccctggagcagctgatggacttcatcaaccagaagcagagagaccccagactgaacgaggtgctgtacccccccctgagacccagccaggccagactgctgatcgagaagtacgagcccaaccagcagttcctggagagagaccagatgagcatggagggcttcagcagatacctgggcggcgaggagaacggcatcctgcccctggaggccctggacctgagcaccgacatgacccagcccctgagcgcctacttcatcaacagcagccacaacacctacctgaccgccggccagctggccggcaccagcagcgtggagatgtacagacaggccctgctgtggggctgcagatgcgtggagctggacgtgtggaagggcagaccccccgaggaggagcccttcatcacccacggcttcaccatgaccaccgaggtgcccctgagagacgtgctggaggccatcgccgagaccgccttcaagaccagcccctaccccgtgatcctgagcttcgagaaccacgtggacagcgccaagcagcaggccaagatggccgagtactgcagaagcatcttcggcgacgccctgctgatcgagcccctggacaagtaccccctggcccccggcgtgcccctgcccagcccccaggacctgatgggcagaatcctggtgaagaacaagaagagacacagacccagcgccggcggccccgacagcgccggcagaaagagacccctggagcagagcaacagcgccctgagcgagagcagcgccgccaccgagcccagcagcccccagctgggcagccccagcagcgacagctgccccggcctgagcaacggcgaggaggtgggcctggagaagcccagcctggagccccagaagagcctgggcgacgagggcctgaacagaggcccctacgtgctgggccccgccgacagagaggacgaggaggaggacgaggaggaggaggagcagaccgaccccaagaagcccaccaccgacgagggcaccgccagcagcgaggtgaacgccaccgaggagatgagcaccctggtgaactacatcgagcccgtgaagttcaagagcttcgaggccgccagaaagagaaacaagtgcttcgagatgagcagcttcgtggagaccaaggccatggagcagctgaccaagagccccatggagttcgtggagtacaacaagcagcagctgagcagaatctaccccaagggcaccagagtggacagcagcaactacatgccccagctgttctggaacgtgggctgccagctggtggccctgaacttccagaccctggacgtggccatgcagctgaacgccggcgtgttcgagtacaacggcagaagcggctacctgctgaagcccgagttcatgagaagacccgacaagagcttcgaccccttcaccgaggtgatcgtggacggcatcgtggccaacgccctgagagtgaaggtgatcagcggccagttcctgagcgacagaaaggtgggcatctacgtggaggtggacatgttcggcctgcccgtggacaccagaagaaagtacagaaccagaaccagccagggcaacagcttcaaccccgtgtgggacgaggagcccttcgacttccccaaggtggtgctgcccaccctggccagcctgagaatcgccgccttcgaggagggcggcaagttcgtgggccacagaatcctgcccgtgagcgccatcagaagcggctaccactacgtgtgcctgagaaacgaggccaaccagcccctgtgcctgcccgccctgctgatctacaccgaggccagcgactacatccccgacgaccaccaggactacgccgaggccctgatcaaccccatcaagcacgtgagcctgatggaccagagagccagacagctggccgccctgatcggcgagagcgaggcccaggccggccaggagacctgccaggacacccagagccagcagctgggcagccagcccagcagcaaccccacccccagccccctggacgccagccccagaagaccccccggccccaccaccagccccgccagcaccagcctgagcagccccggccagagagacgacctgatcgccagcatcctgagcgaggtggcccccacccccctggacgagctgagaggccacaaggccctggtgaagctgagaagcagacaggagagagacctgagagagctgagaaagaagcaccagagaaaggccgtgaccctgaccagaagactgctggacggcctggcccaggcccaggccgagggcagatgcagactgagacccggcgccctgggcggcgccgccgacgtggaggacaccaaggagggcgaggacgaggccaagagataccaggagttccagaacagacaggtgcagagcctgctggagctgagagaggcccaggtggacgccgaggcccagagaagactggagcacctgagacaggccctgcagagactgagagaggtggtgctggacgccaacaccacccagttcaagagactgaaggagatgaacgagagagagaagaaggagctgcagaagatcctggacagaaagagacacaacagcatcagcgaggccaagatgagagacaagcacaagaaggaggccgagctgaccgagatcaacagaagacacatcaccgagagcgtgaacagcatcagaagactggaggaggcccagaagcagagacacgacagactggtggccggccagcagcaggtgctgcagcagctggccgaggaggagcccaagctgctggcccagctggcccaggagtgccaggagcagagagccagactgccccaggagatcagaagaagcctgctgggcgagatgcccgagggcctgggcgacggccccctggtggcctgcgccagcaacggccacgcccccggcagcagcggccacctgagcggcgccgacagcgagagccaggaggagaacacccagctgtag

SEQ ID NO: 93293 - DNA, 3651 bp, Artificial Sequence
  Description of Artificial Sequence: Synthetic coding sequence
atggccggcgcccagcccggcgtgcacgccctgcagctgaagcccgtgtgcgtgagcgacagcctgaagaagggcaccaagttcgtgaagtgggacgacgacagcaccatcgtgacccccatcatcctgagaaccgacccccagggcttcttcttctactggaccgaccagaacaaggagaccgagctgctggacctgagcctggtgaaggacgccagatgcggcagacacgccaaggcccccaaggaccccaagctgagagagctgctggacgtgggcaacatcggcagactggagcagagaatgatcaccgtggtgtacggccccgacctggtgaacatcagccacctgaacctggtggccttccaggaggaggtggccaaggagtggaccaacgaggtgttcagcctggccaccaacctgctggcccagaacatgagcagagacgccttcctggagaaggcctacaccaagctgaagctgcaggtgacccccgagggcagaatccccctgaagaacatctacagactgttcagcgccgacagaaagagagtggagaccgccctggaggcctgcagcctgcccagcagcagaaacgacagcatcccccaggaggacttcacccccgaggtgtacagagtgttcctgaacaacctgtgccccagacccgagatcgacaacatcttcagcgagttcggcgccaagagcaagccctacctgaccgtggaccagatgatggacttcatcaacctgaagcagagagaccccagactgaacgagatcctgtacccccccctgaagcaggagcaggtgcaggtgctgatcgagaagtacgagcccaacaacagcctggccagaaagggccagatcagcgtggacggcttcatgagatacctgagcggcgaggagaacggcgtggtgagccccgagaagctggacctgaacgaggacatgagccagcccctgagccactacttcatcaacagcagccacaacacctacctgaccgccggccagctggccggcaacagcagcgtggagatgtacagacaggtgctgctgagcggctgcagatgcgtggagctggactgctggaagggcagaaccgccgaggaggagcccgtgatcacccacggcttcaccatgaccaccgagatcagcttcaaggaggtgatcgaggccatcgccgagtgcgccttcaagaccagccccttccccatcctgctgagcttcgagaaccacgtggacagccccaagcagcaggccaagatggccgagtactgcagactgatcttcggcgacgccctgctgatggagcccctggagaagtaccccctggagagcggcgtgcccctgcccagccccatggacctgatgtacaagatcctggtgaagaacaagaagaagagccacaagagcagcgagggcagcggcaagaagaagctgagcgagcaggccagcaacacctacagcgacagcagcagcatgttcgagcccagcagccccggcgccggcgaggccgacaccgagagcgacgacgacgacgacgacgacgactgcaagaagagcagcatggacgagggcaccgccggcagcgaggccatggccaccgaggagatgagcaacctggtgaactacatccagcccgtgaagttcgagagcttcgagatcagcaagaagagaaacaagagcttcgagatgagcagcttcgtggagaccaagggcctggagcagctgaccaagagccccgtggagttcgtggagtacaacaagatgcagctgagcagaatctaccccaagggcaccagagtggacagcagcaactacatgccccagctgttctggaacgccggctgccagatggtggccctgaacttccagaccatggacctggccatgcagatcaacatgggcatgtacgagtacaacggcaagagcggctacagactgaagcccgagttcatgagaagacccgacaagcacttcgaccccttcaccgagggcatcgtggacggcatcgtggccaacaccctgagcgtgaagatcatcagcggccagttcctgagcgacaagaaggtgggcacctacgtggaggtggacatgttcggcctgcccgtggacaccagaagaaaggccttcaagaccaagaccagccagggcaacgccgtgaaccccgtgtgggaggaggagcccatcgtgttcaagaaggtggtgctgcccaccctggcctgcctgagaatcgccgtgtacgaggagggcggcaagttcatcggccacagaatcctgcccgtgcaggccatcagacccggctaccactacatctgcctgagaaacgagagaaaccagcccctgaccctgcccgccgtgttcgtgtacatcgaggtgaaggactacgtgcccgacacctacgccgacgtgatcgaggccctgagcaaccccatcagatacgtgaacctgatggagcagagagccaagcagctggccgccctgaccctggaggacgaggaggaggtgaagaaggaggccgaccccggcgagacccccagcgaggcccccagcgaggccagaaccacccccgccgagaacggcgtgaaccacaccaccaccctgacccccaagccccccagccaggccctgcacagccagcccgcccccggcagcgtgaaggcccccgccaagaccgaggacctgatccagagcgtgctgaccgaggtggaggcccagaccatcgaggagctgaagcagcagaagagcttcgtgaagctgcagaagaagcactacaaggagatgaaggacctggtgaagagacaccacaagaagaccaccgacctgatcaaggagcacaccaccaagtacaacgagatccagaacgactacctgagaagaagagccgccctggagaagagcgccaagaaggacagcaagaagaagagcgagcccagcagccccgaccacggcagcagcaccatcgagcaggacctggccgccctggacgccgagatgacccagaagctgatcgacctgaaggacaagcagcagcagcagctgctgaacctgagacaggagcagtactacagcgagaagtaccagaagagagagcacatcaagctgctgatccagaagctgaccgacgtggccgaggagtgccagaacaaccagctgaagaagctgaaggagatctgcgagaaggagaagaaggagctgaagaagaagatggacaagaagagacaggagaagatcaccgaggccaagagcaaggacaagagccagatggaggaggagaagaccgagatgatcagaagctacatccaggaggtggtgcagtacatcaagagactggaggaggcccagagcaagagacaggagaagctggtggagaagcacaaggagatcagacagcagatcctggacgagaagcccaagctgcaggtggagctggagcaggagtaccaggacaagttcaagagactgcccctggagatcctggagttcgtgcaggaggccatgaagggcaagatcagcgaggacagcaaccacggcagcgcccccctgagcctgagcagcgaccccggcaaggtgaaccacaagacccccagcagcgaggagctgggcggcgacatccccggcaaggagttcgacacccccctgtag

SEQ ID NO: 93294 - DNA, 672 bp, Artificial Sequence
  Description of Artificial Sequence: Synthetic coding sequence
atgagaagacccgacaagcacttcgaccccttcaccgagggcatcgtggacggcatcgtggccaacaccctgagcgtgaagatcatcagcggccagttcctgagcgacaagaaggtgggcacctacgtggaggtggacatgttcggcctgcccgtggacaccagaagaaaggccttcaagaccaagaccagccagggcaacgccgtgaaccccgtgtgggaggaggagcccatcgtgttcaagaaggtggtgctgcccaccctggcctgcctgagaatcgccgtgtacgaggagggcggcaagttcatcggccacagaatcctgcccgtgcaggccatcagacccggctaccactacatctgcctgagaaacgagagaaaccagcccctgaccctgcccgccgtgttcgtgtacatcgaggtgaaggactacgtgcccgacacctacgccgacgtgatcgaggccctgagcaaccccatcagatacgtgaacctgatggagcagagagccaagcagctggccgccctgaccctggaggacgaggaggaggtgaagaaggagggcggcttcctgcacgacgagatcatgagactgaccagaaacaccctggagaagctgatggccctgcccctgacccacgtggtgcccatccagagcaagatgctgagctag

SEQ ID NO: 93295 - DNA, 3522 bp, Artificial Sequence
  Description of Artificial Sequence: Synthetic coding sequence
atggccggcgcccagcccggcgtgcacgccctgcagctgaagcccgtgtgcgtgagcgacagcctgaagaagggcaccaagttcgtgaagtgggacgacgacagcaccatcgtgacccccatcatcctgagaaccgacccccagggcttcttcttctactggaccgaccagaacaaggagaccgagctgctggacctgagcctggtgaaggacgccagatgcggcagacacgccaaggcccccaaggaccccaagctgagagagctgctggacgtgggcaacatcggcagactggagcagagaatgatcaccgtggtgtacggccccgacctggtgaacatcagccacctgaacctggtggccttccaggaggaggtggccaaggagtggaccaacgaggtgttcagcctggccaccaacctgctggcccagaacatgagcagagacgccttcctggagaaggcctacaccaagctgaagctgcaggtgacccccgagggcagaatccccctgaagaacatctacagactgttcagcgccgacagaaagagagtggagaccgccctggaggcctgcagcctgcccagcagcagaaacgacagcatcccccaggaggacttcacccccgaggtgtacagagtgttcctgaacaacctgtgccccagacccgagatcgacaacatcttcagcgagttcggcgccaagagcaagccctacctgaccgtggaccagatgatggacttcatcaacctgaagcagagagaccccagactgaacgagatcctgtacccccccctgaagcaggagcaggtgcaggtgctgatcgagaagtacgagcccaacaacagcctggccagaaagggccagatcagcgtggacggcttcatgagatacctgagcggcgaggagaacggcgtggtgagccccgagaagctggacctgaacgaggacatgagccagcccctgagccactacttcatcaacagcagccacaacacctacctgaccgccggccagctggccggcaacagcagcgtggagatgtacagacaggtgctgctgagcggctgcagatgcgtggagctggactgctggaagggcagaaccgccgaggaggagcccgtgatcacccacggcttcaccatgaccaccgagatcagcttcaaggaggtgatcgaggccatcgccgagtgcgccttcaagaccagccccttccccatcctgctgagcttcgagaaccacgtggacagccccaagcagcaggccaagatggccgagtactgcagactgatcttcggcgacgccctgctgatggagcccctggagaagtaccccctggagagcggcgtgcccctgcccagccccatggacctgatgtacaagatcctggtgaagaacaagaagaagagccacaagagcagcgagggcagcggcaagaagaagctgagcgagcaggccagcaacacctacagcgacagcagcagcatgttcgagcccagcagccccggcgccggcgaggccgacaccgagagcgacgacgacgacgacgacgacgactgcaagaagagcagcatggacgagggcaccgccggcagcgaggccatggccaccgaggagatgagcaacctggtgaactacatccagcccgtgaagttcgagagcttcgagatcagcaagaagagaaacaagagcttcgagatgagcagcttcgtggagaccaagggcctggagcagctgaccaagagccccgtggagttcgtggagtacaacaagatgcagctgagcagaatctaccccaagggcaccagagtggacagcagcaactacatgccccagctgttctggaacgccggctgccagatggtggccctgaacttccagaccatggacctggccatgcagatcaacatgggcatgtacgagtacaacggcaagagcggctacagactgaagcccgagttcatgagaagacccgacaagcacttcgaccccttcaccgagggcatcgtggacggcatcgtggccaacaccctgagcgtgaagatcatcagcggccagttcctgagcgacaagaaggtgggcacctacgtggaggtggacatgttcggcctgcccgtggacaccagaagaaaggccttcaagaccaagaccagccagggcaacgccgtgaaccccgtgtgggaggaggagcccatcgtgttcaagaaggtggtgctgcccaccctggcctgcctgagaatcgccgtgtacgaggagggcggcaagttcatcggccacagaatcctgcccgtgcaggccatcagacccggctaccactacatctgcctgagaaacgagagaaaccagcccctgaccctgcccgccgtgttcgtgtacatcgaggtgaaggactacgtgcccgacacctacgccgacgtgatcgaggccctgagcaaccccatcagatacgtgaacctgatggagcagagagccaagcagctggccgccctgaccctggaggacgaggaggaggtgaagaaggaggccgaccccggcgagacccccagcgaggcccccagcgaggccagaaccacccccgccgagaacggcgtgaaccacaccaccaccctgacccccaagccccccagccaggccctgcacagccagcccgcccccggcagcgtgaaggcccccgccaagaccgaggacctgatccagagcgtgctgaccgaggtggaggcccagaccatcgaggagctgaagcagcagaagagcttcgtgaagctgcagaagaagcactacaaggagatgaaggacctggtgaagagacaccacaagaagaccaccgacctgatcaaggagcacaccaccaagtacaacgagatccagaacgactacctgagaagaagagccgccctggagaagagcgccaagaaggacagcaagaagaagagcgagcccagcagccccgaccacggcagcagcaccatcgagcaggacctggccgccctggacgccgagatgacccagaagctgatcgacctgaaggacaagcagcagcagcagctgctgaacctgagacaggagcagtactacagcgagaagtaccagaagagagagcacatcaagctgctgatccagaagctgaccgacgtggccgaggagtgccagaacaaccagctgaagaagctgaaggagatctgcgagaaggagaagaaggagctgaagaagaagatggacaagaagagacaggagaagatcaccgaggccaagagcaaggacaagagccagatggaggaggagaagaccgagatgatcagaagctacatccaggaggtggtgcagtacatcaagagactggaggaggcccagagcaagagacaggagaagctggtggagaagcacaaggagatcagacagcagatcctggacgagaagcccaagggcgagggcagcagcagcttcctgagcgagacctgccacgaggaccccagcgtgagccccaacttcaccccccccaacccccaggccctgaagtggtag

SEQ ID NO: 93296 - DNA, 3522 bp, Artificial Sequence; identical to SEQ ID NO: 93295
  Description of Artificial Sequence: Synthetic coding sequence

SEQ ID NO: 93297 - DNA, 699 bp, Artificial Sequence
  Description of Artificial Sequence: Synthetic coding sequence
gccggcgcccagcccggcgtgcacgccctgcagctgaagcccgtgtgcgtgagcgacagcctgaagaagggcaccaagttcgtgaagtgggacgacgacagcaccatcgtgacccccatcatcctgagaaccgacccccagggcttcttcttctactggaccgaccagaacaaggagaccgagctgctggacctgagcctggtgaaggacgccagatgcggcagacacgccaaggcccccaaggaccccaagctgagagagctgctggacgtgggcaacatcggcagactggagcagagaatgatcaccgtggtgtacggccccgacctggtgaacatcagccacctgaacctggtggccttccaggaggaggtggccaaggagtggaccaacgaggtgttcagcctggccaccaacctgctggcccagaacatgagcagagacgccttcctggagaaggcctacaccaagctgaagctgcaggtgacccccgagggcagaatccccctgaagaacatctacagactgttcagcgccgacagaaagagagtggagaccgccctggaggcctgcagcctgcccagcagcagagtggagaaggccaacgaggccgccaagagcgagcagagctgcggcaaggccccccccaagcacttccacctgcacttcatcaagcagaacaagatgctggagccctag

SEQ ID NO: 93298 - DNA, 93 bp, Artificial Sequence
  Description of Artificial Sequence: Synthetic coding sequence
gaggaggcccagagcaagagacaggagaagctggtggagaagcacaaggagatcagacagcagatcctggacgagaagcccaaggtgccctag

SEQ ID NO: 93299 - DNA, 591 bp, Artificial Sequence
  Description of Artificial Sequence: Synthetic coding sequence
atcatcagcggccagttcctgagcgacaagaaggtgggcacctacgtggaggtggacatgttcggcctgcccgtggacaccagaagaaaggccttcaagaccaagaccagccagggcaacgccgtgaaccccgtgtgggaggaggagcccatcgtgttcaagaaggtggtgctgcccaccctggcctgcctgagaatcgccgtgtacgaggagggcggcaagttcatcggccacagaatcctgcccgtgcaggccatcagacccggctaccactacatctgcctgagaaacgagagaaaccagcccctgaccctgcccgccgtgttcgtgtacatcgaggtgaaggactacgtgcccgacacctacgccgacgtgatcgaggccctgagcaaccccatcagatacgtgaacctgatggagcagagagccaagcagctggccgccctgaccctggaggacgaggaggaggtgaagaaggagggcggcttcctgcacgacgagatcatgagactgaccagaaacaccctggagaagctgatggccctgcccctgacccacgtggtgcccatccagagcaagatgctgagctag

SEQ ID NO: 93300 - DNA, 3411 bp, Artificial Sequence
  Description of Artificial Sequence: Synthetic coding sequence
acccaggaccccaagctgagagagctgctggacgtgggcaacatcggcagactggagcagagaatgatcaccgtggtgtacggccccgacctggtgaacatcagccacctgaacctggtggccttccaggaggaggtggccaaggagtggaccaacgaggtgttcagcctggccaccaacctgctggcccagaacatgagcagagacgccttcctggagaaggcctacaccaagctgaagctgcaggtgacccccgagggcagaatccccctgaagaacatctacagactgttcagcgccgacagaaagagagtggagaccgccctggaggcctgcagcctgcccagcagcagaaacgacagcatcccccaggaggacttcacccccgaggtgtacagagtgttcctgaacaacctgtgccccagacccgagatcgacaacatcttcagcgagttcggcgccaagagcaagccctacctgaccgtggaccagatgatggacttcatcaacctgaagcagagagaccccagactgaacgagatcctgtacccccccctgaagcaggagcaggtgcaggtgctgatcgagaagtacgagcccaacaacagcctggccagaaagggccagatcagcgtggacggcttcatgagatacctgagcggcgaggagaacggcgtggtgagccccgagaagctggacctgaacgaggacatgagccagcccctgagccactacttcatcaacagcagccacaacacctacctgaccgccggccagctggccggcaacagcagcgtggagatgtacagacaggtgctgctgagcggctgcagatgcgtggagctggactgctggaagggcagaaccgccgaggaggagcccgtgatcacccacggcttcaccatgaccaccgagatcagcttcaaggaggtgatcgaggccatcgccgagtgcgccttcaagaccagccccttccccatcctgctgagcttcgagaaccacgtggacagccccaagcagcaggccaagatggccgagtactgcagactgatcttcggcgacgccctgctgatggagcccctggagaagtaccccctggagagcggcgtgcccctgcccagccccatggacctgatgtacaagatcctggtgaagaacaagaagaagagccacaagagcagcgagggcagcggcaagaagaagctgagcgagcaggccagcaacacctacagcgacagcagcagcatgttcgagcccagcagccccggcgccggcgaggccgacaccgagagcgacgacgacgacgacgacgacgactgcaagaagagcagcatggacgagggcaccgccggcagcgaggccatggccaccgaggagatgagcaacctggtgaactacatccagcccgtgaagttcgagagcttcgagatcagcaagaagagaaacaagagcttcgagatgagcagcttcgtggagaccaagggcctggagcagctgaccaagagccccgtggagttcgtggagtacaacaagatgcagctgagcagaatctaccccaagggcaccagagtggacagcagcaactacatgccccagctgttctggaacgccggctgccagatggtggccctgaacttccagaccatggacctggccatgcagatcaacatgggcatgtacgagtacaacggcaagagcggctacagactgaagcccgagttcatgagaagacccgacaagcacttcgaccccttcaccgagggcatcgtggacggcatcgtggccaacaccctgagcgtgaagatcatcagcggccagttcctgagcgacaagaaggtgggcacctacgtggaggtggacatgttcggcctgcccgtggacaccagaagaaaggccttcaagaccaagaccagccagggcaacgccgtgaaccccgtgtgggaggaggagcccatcgtgttcaagaaggtggtgctgcccaccctggcctgcctgagaatcgccgtgtacgaggagggcggcaagttcatcggccacagaatcctgcccgtgcaggccatcagacccggctaccactacatctgcctgagaaacgagagaaaccagcccctgaccctgcccgccgtgttcgtgtacatcgaggtgaaggactacgtgcccgacacctacgccgacgtgatcgaggccctgagcaaccccatcagatacgtgaacctgatggagcagagagccaagcagctggccgccctgaccctggaggacgaggaggaggtgaagaaggaggccgaccccggcgagacccccagcgaggcccccagcgaggccagaaccacccccgccgagaacggcgtgaaccacaccaccaccctgacccccaagccccccagccaggccctgcacagccagcccgcccccggcagcgtgaaggcccccgccaagaccgaggacctgatccagagcgtgctgaccgaggtggaggcccagaccatcgaggagctgaagcagcagaagagcttcgtgaagctgcagaagaagcactacaaggagatgaaggacctggtgaagagacaccacaagaagaccaccgacctgatcaaggagcacaccaccaagtacaacgagatccagaacgactacctgagaagaagagccgccctggagaagagcgccaagaaggacagcaagaagaagagcgagcccagcagccccgaccacggcagcagcaccatcgagcaggacctggccgccctggacgccgagatgacccagaagctgatcgacctgaaggacaagcagcagcagcagctgctgaacctgagacaggagcagtactacagcgagaagtaccagaagagagagcacatcaagctgctgatccagaagctgaccgacgtggccgaggagtgccagaacaaccagctgaagaagctgaaggagatctgcgagaaggagaagaaggagctgaagaagaagatggacaagaagagacaggagaagatcaccgaggccaagagcaaggacaagagccagatggaggaggagaagaccgagatgatcagaagctacatccaggaggtggtgcagtacatcaagagactggaggaggcccagagcaagagacaggagaagctggtggagaagcacaaggagatcagacagcagatcctggacgagaagcccaagctgcaggtggagctggagcaggagtaccaggacaagttcaagagactgcccctggagatcctggagttcgtgcaggaggccatgaagggcaagatcagcgaggacagcaaccacggcagcgcccccctgagcctgagcagcgaccccggcaaggtgaaccacaagacccccagcagcgaggagctgggcggcgacatccccggcaaggagttcgacacccccctgtag

SEQ ID NO: 93301 - DNA, 3282 bp, Artificial Sequence
  Description of Artificial Sequence: Synthetic coding sequence
acccaggaccccaagctgagagagctgctggacgtgggcaacatcggcagactggagcagagaatgatcaccgtggtgtacggccccgacctggtgaacatcagccacctgaacctggtggccttccaggaggaggtggccaaggagtggaccaacgaggtgttcagcctggccaccaacctgctggcccagaacatgagcagagacgccttcctggagaaggcctacaccaagctgaagctgcaggtgacccccgagggcagaatccccctgaagaacatctacagactgttcagcgccgacagaaagagagtggagaccgccctggaggcctgcagcctgcccagcagcagaaacgacagcatcccccaggaggacttcacccccgaggtgtacagagtgttcctgaacaacctgtgccccagacccgagatcgacaacatcttcagcgagttcggcgccaagagcaagccctacctgaccgtggaccagatgatggacttcatcaacctgaagcagagagaccccagactgaacgagatcctgtacccccccctgaagcaggagcaggtgcaggtgctgatcgagaagtacgagcccaacaacagcctggccagaaagggccagatcagcgtggacggcttcatgagatacctgagcggcgaggagaacggcgtggtgagccccgagaagctggacctgaacgaggacatgagccagcccctgagccactacttcatcaacagcagccacaacacctacctgaccgccggccagctggccggcaacagcagcgtggagatgtacagacaggtgctgctgagcggctgcagatgcgtggagctggactgctggaagggcagaaccgccgaggaggagcccgtgatcacccacggcttcaccatgaccaccgagatcagcttcaaggaggtgatcgaggccatcgccgagtgcgccttcaagaccagccccttccccatcctgctgagcttcgagaaccacgtggacagccccaagcagcaggccaagatggccgagtactgcagactgatcttcggcgacgccctgctgatggagcccctggagaagtaccccctggagagcggcgtgcccctgcccagccccatggacctgatgtacaagatcctggtgaagaacaagaagaagagccacaagagcagcgagggcagcggcaagaagaagctgagcgagcaggccagcaacacctacagcgacagcagcagcatgttcgagcccagcagccccggcgccggcgaggccgacaccgagagcgacgacgacgacgacgacgacgactgcaagaagagcagcatggacgagggcaccgccggcagcgaggccatggccaccgaggagatgagcaacctggtgaactacatccagcccgtgaagttcgagagcttcgagatcagcaagaagagaaacaagagcttcgagatgagcagcttcgtggagaccaagggcctggagcagctgaccaagagccccgtggagttcgtggagtacaacaagatgcagctgagcagaatctaccccaagggcaccagagtggacagcagcaactacatgccccagctgttctggaacgccggctgccagatggtggccctgaacttccagaccatggacctggccatgcagatcaacatgggcatgtacgagtacaacggcaagagcggctacagactgaagcccgagttcatgagaagacccgacaagcacttcgaccccttcaccgagggcatcgtggacggcatcgtggccaacaccctgagcgtgaagatcatcagcggccagttcctgagcgacaagaaggtgggcacctacgtggaggtggacatgttcggcctgcccgtggacaccagaagaaaggccttcaagaccaagaccagccagggcaacgccgtgaaccccgtgtgggaggaggagcccatcgtgttcaagaaggtggtgctgcccaccctggcctgcctgagaatcgccgtgtacgaggagggcggcaagttcatcggccacagaatcctgcccgtgcaggccatcagacccggctaccactacatctgcctgagaaacgagagaaaccagcccctgaccctgcccgccgtgttcgtgtacatcgaggtgaaggactacgtgcccgacacctacgccgacgtgatcgaggccctgagcaaccccatcagatacgtgaacctgatggagcagagagccaagcagctggccgccctgaccctggaggacgaggaggaggtgaagaaggaggccgaccccggcgagacccccagcgaggcccccagcgaggccagaaccacccccgccgagaacggcgtgaaccacaccaccaccctgacccccaagccccccagccaggccctgcacagccagcccgcccccggcagcgtgaaggcccccgccaagaccgaggacctgatccagagcgtgctgaccgaggtggaggcccagaccatcgaggagctgaagcagcagaagagcttcgtgaagctgcagaagaagcactacaaggagatgaaggacctggtgaagagacaccacaagaagaccaccgacctgatcaaggagcacaccaccaagtacaacgagatccagaacgactacctgagaagaagagccgccctggagaagagcgccaagaaggacagcaagaagaagagcgagcccagcagccccgaccacggcagcagcaccatcgagcaggacctggccgccctggacgccgagatgacccagaagctgatcgacctgaaggacaagcagcagcagcagctgctgaacctgagacaggagcagtactacagcgagaagtaccagaagagagagcacatcaagctgctgatccagaagctgaccgacgtggccgaggagtgccagaacaaccagctgaagaagctgaaggagatctgcgagaaggagaagaaggagctgaagaagaagatggacaagaagagacaggagaagatcaccgaggccaagagcaaggacaagagccagatggaggaggagaagaccgagatgatcagaagctacatccaggaggtggtgcagtacatcaagagactggaggaggcccagagcaagagacaggagaagctggtggagaagcacaaggagatcagacagcagatcctggacgagaagcccaagggcgagggcagcagcagcttcctgagcgagacctgccacgaggaccccagcgtgagccccaacttcaccccccccaacccccaggccctgaagtggtag

SEQ ID NO: 93302 - DNA, 3558 bp, Artificial Sequence
  Description of Artificial Sequence: Synthetic coding sequence
atgagcctgctgaaccccgtgctgctgccccccaaggtgaaggcctacctgagccagggcgagagattcatcaagtgggacgacgagaccaccgtggccagccccgtgatcctgagagtggaccccaagggctactacctgtactggacctaccagagcaaggagatggagttcctggacatcaccagcatcagagacaccagattcggcaagttcgccaagatgcccaagagccagaagctgagagacgtgttcaacatggacttccccgacaacagcttcctgctgaagaccctgaccgtggtgagcggccccgacatggtggacctgaccttccacaacttcgtgagctacaaggagaacgtgggcaaggcctgggccgaggacgtgctggccctggtgaagcaccccctgaccgccaacgccagcagaagcaccttcctggacaagatcctggtgaagctgaagatgcagctgaacagcgagggcaagatccccgtgaagaacttcttccagatgttccccgccgacagaaagagagtggaggccgccctgagcgcctgccacctgcccaagggcaagaacgacgccatcaaccccgaggacttccccgagcccgtgtacaagagcttcctgatgagcctgtgccccagacccgagatcgacgagatcttcaccagctaccacgccaaggccaagccctacatgaccaaggagcacctgaccaagttcatcaaccagaagcagagagacagcagactgaacagcctgctgttcccccccgccagacccgaccaggtgcagggcctgatcgacaagtacgagcccagcggcatcaacgcccagagaggccagctgagccccgagggcatggtgtggttcctgtgcggccccgagaacagcgtgctggcccaggacaagctgctgctgcaccacgacatgacccagcccctgaaccactacttcatcaacagcagccacaacacctacctgaccgccggccagttcagcggcctgagcagcgccgagatgtacagacaggtgctgctgagcggctgcagatgcgtggagctggactgctggaagggcaagccccccgacgaggagcccatcatcacccacggcttcaccatgaccaccgacatcttcttcaaggaggccatcgaggccatcgccgagagcgccttcaagaccagcccctaccccatcatcctgagcttcgagaaccacgtggacagccccagacagcaggccaagatggccgagtactgcagaaccatcttcggcgacatgctgctgaccgagcccctggagaagttccccctgaagcccggcgtgcccctgcccagccccgaggacctgagaggcaagatcctgatcaagaacaagaagaaccagttcagcggccccaccagcagcagcaaggacaccggcggcgaggccgagggcagcagcccccccagcgcccccgccggcgagggcaccgtgtgggccggcgaggagggcaccgagctggaggaggaggaggtggaggaggaggaggaggaggagagcggcaacctggacgaggaggagatcaagaagatgcagagcgacgagggcaccgccggcctggaggtgaccgcctacgaggagatgagcagcctggtgaactacatccagcccaccaagttcgtgagcttcgagttcagcgcccagaagaacagaagctacgtgatcagcagcttcaccgagctgaaggcctacgacctgctgagcaaggccagcgtgcagttcgtggactacaacaagagacagatgagcagaatctaccccaagggcaccagaatggacagcagcaactacatgccccagatgttctggaacgccggctgccagatggtggccctgaacttccagaccatggacctgcccatgcagcagaacatggccgtgttcgagttcaacggccagagcggctacctgctgaagcacgagttcatgagaagacccgacaagcagttcaaccccttcagcgtggacagaatcgacgtggtggtggccaccaccctgagcatcaccgtgatcagcggccagttcctgagcgagagaagcgtgagaacctacgtggaggtggagctgttcggcctgcccggcgaccccaagagaagatacagaaccaagctgagccccagcaccaacagcatcaaccccgtgtggaaggaggagcccttcgtgttcgagaagatcctgatgcccgagctggccagcctgagagtggccgtgatggaggagggcaacaagttcctgggccacagaatcatccccatcaacgccctgaacagcggctaccaccacctgtgcctgcacagcgagagcaacatgcccctgaccatgcccgccctgttcatcttcctggagatgaaggactacatccccggcgcctgggccgacctgaccgtggccctggccaaccccatcaagttcttcagcgcccacgacaccaagagcgtgaagctgaaggaggccatgggcggcctgcccgagaagcccttccccctggccagccccgtggccagccaggtgaacggcgccctggcccccaccagcaacggcagccccgccgccagagccggcgccagagaggaggccatgaaggaggccgccgagcccagaaccgccagcctggaggagctgagagagctgaagggcgtggtgaagctgcagagaagacacgagaaggagctgagagagctggagagaagaggcgccagaagatgggaggagctgctgcagagaggcgccgcccagctggccgagctgggcccccccggcgtgggcggcgtgggcgcctgcaagctgggccccggcaagggcagcagaaagaagagaagcctgcccagagaggagagcgccggcgccgcccccggcgagggccccgagggcgtggacggcagagtgagagagctgaaggacagactggagctggagctgctgagacagggcgaggagcagtacgagtgcgtgctgaagagaaaggagcagcacgtggccgagcagatcagcaagatgatggagctggccagagagaagcaggccgccgagctgaaggccctgaaggagaccagcgagaacgacaccaaggagatgaagaagaagctggagaccaagagactggagagaatccagggcatgaccaaggtgaccaccgacaagatggcccaggagagactgaagagagagatcaacaacagccacatccaggaggtggtgcaggtgatcaagcagatgaccgagaacctggagagacaccaggagaagctggaggagaagcaggccgcctgcctggagcagatcagagagatggagaagcagttccagaaggaggccctggccgagtacgaggccagaatgaagggcctggaggccgaggtgaaggagagcgtgagagcctgcctgagaacctgcttccccagcgaggccaaggacaagcccgagagagcctgcgagtgcccccccgagctgtgcgagcaggaccccctgatcgccaaggccgacgcccaggagagcagactgtag

SEQ ID NO: 93303 - DNA, 3546 bp, Artificial Sequence
  Description of Artificial Sequence: Synthetic coding sequence
atgagcctgctgaaccccgtgctgctgccccccaaggtgaaggcctacctgagccagggcgagagattcatcaagtgggacgacgagaccaccgtggccagccccgtgatcctgagagtggaccccaagggctactacctgtactggacctaccagagcaaggagatggagttcctggacatcaccagcatcagagacaccagattcggcaagttcgccaagatgcccaagagccagaagctgagagacgtgttcaacatggacttccccgacaacagcttcctgctgaagaccctgaccgtggtgagcggccccgacatggtggacctgaccttccacaacttcgtgagctacaaggagaacgtgggcaaggcctgggccgaggacgtgctggccctggtgaagcaccccctgaccgccaacgccagcagaagcaccttcctggacaagatcctggtgaagctgaagatgcagctgaacagcgagggcaagatccccgtgaagaacttcttccagatgttccccgccgacagaaagagagtggaggccgccctgagcgcctgccacctgcccaagggcaagaacgacgccatcaaccccgaggacttccccgagcccgtgtacaagagcttcctgatgagcctgtgccccagacccgagatcgacgagatcttcaccagctaccacgccaaggccaagccctacatgaccaaggagcacctgaccaagttcatcaaccagaagcagagagacagcagactgaacagcctgctgttcccccccgccagacccgaccaggtgcagggcctgatcgacaagtacgagcccagcggcatcaacgcccagagaggccagctgagccccgagggcatggtgtggttcctgtgcggccccgagaacagcgtgctggcccaggacaagctgctgctgcaccacgacatgacccagcccctgaaccactacttcatcaacagcagccacaacacctacctgaccgccggccagttcagcggcctgagcagcgccgagatgtacagacaggtgctgctgagcggctgcagatgcgtggagctggactgctggaagggcaagccccccgacgaggagcccatcatcacccacggcttcaccatgaccaccgacatcttcttcaaggaggccatcgaggccatcgccgagagcgccttcaagaccagcccctaccccatcatcctgagcttcgagaaccacgtggacagccccagacagcaggccaagatggccgagtactgcagaaccatcttcggcgacatgctgctgaccgagcccctggagaagttccccctgaagcccggcgtgcccctgcccagccccgaggacctgagaggcaagatcctgatcaagaacaagaagaaccagttcagcggccccaccagcagcagcaaggacaccggcggcgaggccgagggcagcagcccccccagcgcccccgccgtgtgggccggcgaggagggcaccgagctggaggaggaggaggtggaggaggaggaggaggaggagagcggcaacctggacgaggaggagatcaagaagatgcagagcgacgagggcaccgccggcctggaggtgaccgcctacgaggagatgagcagcctggtgaactacatccagcccaccaagttcgtgagcttcgagttcagcgcccagaagaacagaagctacgtgatcagcagcttcaccgagctgaaggcctacgacctgctgagcaaggccagcgtgcagttcgtggactacaacaagagacagatgagcagaatctaccccaagggcaccagaatggacagcagcaactacatgccccagatgttctggaacgccggctgccagatggtggccctgaacttccagaccatggacctgcccatgcagcagaacatggccgtgttcgagttcaacggccagagcggctacctgctgaagcacgagttcatgagaagacccgacaagcagttcaaccccttcagcgtggacagaatcgacgtggtggtggccaccaccctgagcatcaccgtgatcagcggccagttcctgagcgagagaagcgtgagaacctacgtggaggtggagctgttcggcctgcccggcgaccccaagagaagatacagaaccaagctgagccccagcaccaacagcatcaaccccgtgtggaaggaggagcccttcgtgttcgagaagatcctgatgcccgagctggccagcctgagagtggccgtgatggaggagggcaacaagttcctgggccacagaatcatccccatcaacgccctgaacagcggctaccaccacctgtgcctgcacagcgagagcaacatgcccctgaccatgcccgccctgttcatcttcctggagatgaaggactacatccccggcgcctgggccgacctgaccgtggccctggccaaccccatcaagttcttcagcgcccacgacaccaagagcgtgaagctgaaggaggccatgggcggcctgcccgagaagcccttccccctggccagccccgtggccagccaggtgaacggcgccctggcccccaccagcaacggcagccccgccgccagagccggcgccagagaggaggccatgaaggaggccgccgagcccagaaccgccagcctggaggagctgagagagctgaagggcgtggtgaagctgcagagaagacacgagaaggagctgagagagctggagagaagaggcgccagaagatgggaggagctgctgcagagaggcgccgcccagctggccgagctgggcccccccggcgtgggcggcgtgggcgcctgcaagctgggccccggcaagggcagcagaaagaagagaagcctgcccagagaggagagcgccggcgccgcccccggcgagggccccgagggcgtggacggcagagtgagagagctgaaggacagactggagctggagctgctgagacagggcgaggagcagtacgagtgcgtgctgaagagaaaggagcagcacgtggccgagcagatcagcaagatgatggagctggccagagagaagcaggccgccgagctgaaggccctgaaggagaccagcgagaacgacaccaaggagatgaagaagaagctggagaccaagagactggagagaatccagggcatgaccaaggtgaccaccgacaagatggcccaggagagactgaagagagagatcaacaacagccacatccaggaggtggtgcaggtgatcaagcagatgaccgagaacctggagagacaccaggagaagctggaggagaagcaggccgcctgcctggagcagatcagagagatggagaagcagttccagaaggaggccctggccgagtacgaggccagaatgaagggcctggaggccgaggtgaaggagagcgtgagagcctgcctgagaacctgcttccccagcgaggccaaggacaagcccgagagagcctgcgagtgcccccccgagctgtgcgagcaggaccccctgatcgccaaggccgacgcccaggagagcagactgtag

SEQ ID NO: 93304 - DNA, 3705 bp, Artificial Sequence
  Description of Artificial Sequence: Synthetic coding sequence
atggccggcgcccagcccggcgtgcacgccctgcagctggagccccccaccgtggtggagaccctgagaagaggcagcaagttcatcaagtgggacgaggagaccagcagcagaaacctggtgaccctgagagtggaccccaacggcttcttcctgtactggaccggccccaacatggaggtggacaccctggacatcagcagcatcagagacaccagaaccggcagatacgccagactgcccaaggaccccaagatcagagaggtgctgggcttcggcggccccgacgccagactggaggagaagctgatgaccgtggtgagcggccccgaccccgtgaacaccgtgttcctgaacttcatggccgtgcaggacgacaccgccaaggtgtggagcgaggagctgttcaagctggccatgaacatcctggcccagaacgccagcagaaacaccttcctgagaaaggcctacaccaagctgaagctgcaggtgaaccaggacggcagaatccccgtgaagaacatcctgaagatgttcagcgccgacaagaagagagtggagaccgccctggagagctgcggcctgaagttcaacagaagcgagagcatcagacccgacgagttcagcctggagatcttcgagagattcctgaacaagctgtgcctgagacccgacatcgacaagatcctgctggagatcggcgccaagggcaagccctacctgaccctggagcagctgatggacttcatcaaccagaagcagagagaccccagactgaacgaggtgctgtacccccccctgagacccagccaggccagactgctgatcgagaagtacgagcccaaccagcagttcctggagagagaccagatgagcatggagggcttcagcagatacctgggcggcgaggagaacggcatcctgcccctggaggccctggacctgagcaccgacatgacccagcccctgagcgcctacttcatcaacagcagccacaacacctacctgaccgccggccagctggccggcaccagcagcgtggagatgtacagacaggccctgctgtggggctgcagatgcgtggagctggacgtgtggaagggcagaccccccgaggaggagcccttcatcacccacggcttcaccatgaccaccgaggtgcccctgagagacgtgctggaggccatcgccgagaccgccttcaagaccagcccctaccccgtgatcctgagcttcgagaaccacgtggacagcgccaagcagcaggccaagatggccgagtactgcagaagcatcttcggcgacgccctgctgatcgagcccctggacaagtaccccctggcccccggcgtgcccctgcccagcccccaggacctgatgggcagaatcctggtgaagaacaagaagagacacagacccagcgccggcggccccgacagcgccggcagaaagagacccctggagcagagcaacagcgccctgagcgagagcagcgccgccaccgagcccagcagcccccagctgggcagccccagcagcgacagctgccccggcctgagcaacggcgaggaggtgggcctggagaagcccagcctggagccccagaagagcctgggcgacgagggcctgaacagaggcccctacgtgctgggccccgccgacagagaggacgaggaggaggacgaggaggaggaggagcagaccgaccccaagaagcccaccaccgacgagggcaccgccagcagcgaggtgaacgccaccgaggagatgagcaccctggtgaactacatcgagcccgtgaagttcaagagcttcgaggccgccagaaagagaaacaagtgcttcgagatgagcagcttcgtggagaccaaggccatggagcagctgaccaagagccccatggagttcgtggagtacaacaagcagcagctgagcagaatctaccccaagggcaccagagtggacagcagcaactacatgccccagctgttctggaacgtgggctgccagctggtggccctgaacttccagaccctggacgtggccatgcagctgaacgccggcgtgttcgagtacaacggcagaagcggctacctgctgaagcccgagttcatgagaagacccgacaagagcttcgaccccttcaccgaggtgatcgtggacggcatcgtggccaacgccctgagagtgaaggtgatcagcggccagttcctgagcgacagaaaggtgggcatctacgtggaggtggacatgttcggcctgcccgtggacaccagaagaaagtacagaaccagaaccagccagggcaacagcttcaaccccgtgtgggacgaggagcccttcgacttccccaaggtggtgctgcccaccctggccagcctgagaatcgccgccttcgaggagggcggcaagttcgtgggccacagaatcctgcccgtgagcgccatcagaagcggctaccactacgtgtgcctgagaaacgaggccaaccagcccctgtgcctgcccgccctgctgatctacaccgaggccagcgactacatccccgacgaccaccaggactacgccgaggccctgatcaaccccatcaagcacgtgagcctgatggaccagagagccagacagctggccgccctgatcggcgagagcgaggcccaggccggccaggagacctgccaggacacccagagccagcagctgggcagccagcccagcagcaaccccacccccagccccctggacgccagccccagaagaccccccggccccaccaccagccccgccagcaccagcctgagcagccccggccagagagacgacctgatcgccagcatcctgagcgaggtggcccccacccccctggacgagctgagaggccacaaggccctggtgaagctgagaagcagacaggagagagacctgagagagctgagaaagaagcaccagagaaaggccgtgaccctgaccagaagactgctggacggcctggcccaggcccaggccgagggcagatgcagactgagacccggcgccctgggcggcgccgccgacgtggaggacaccaaggagggcgaggacgaggccaagagataccaggagttccagaacagacaggtgcagagcctgctggagctgagagaggcccaggtggacgccgaggcccagagaagactggagcacctgagacaggccctgcagagactgagagaggtggtgctggacgccaacaccacccagttcaagagactgaaggagatgaacgagagagagaagaaggagctgcagaagatcctggacagaaagagacacaacagcatcagcgaggccaagatgagagacaagcacaagaaggaggccgagctgaccgagatcaacagaagacacatcaccgagagcgtgaacagcatcagaagactggaggaggcccagaagcagagacacgacagactggtggccggccagcagcaggtgctgcagcagctggccgaggaggagcccaagctgctggcccagctggcccaggagtgccaggagcagagagccagactgccccaggagatcagaagaagcctgctgggcgagatgcccgagggcctgggcgacggccccctggtggcctgcgccagcaacggccacgcccccggcagcagcggccacctgagcggcgccgacagcgagagccaggaggagaacacccagctgtag

SEQ ID NO: 93305 - DNA, 3705 bp, Artificial Sequence; identical to SEQ ID NO: 93304
  Description of Artificial Sequence: Synthetic coding sequence

SEQ ID NO: 93306 - DNA, 3528 bp, Artificial Sequence
  Description of Artificial Sequence: Synthetic coding sequence
atggccaagccctacgagttcaactggcagaaggaggtgcccagcttcctgcaggagggcgccgtgttcgacagatacgaggaggagagcttcgtgttcgagcccaactgcctgttcaaggtggacgagttcggcttcttcctgacctggagaagcgagggcaaggagggccaggtgctggagtgcagcctgatcaacagcatcagaagcggcgccatccccaaggaccccaagatcctggccgccctggaggccgtgggcaagagcgagaacgacctggagggcagaatcgtgtgcgtgtgcagcggcaccgacctggtgaacatcagcttcacctacatggtggccgagaaccccgaggtgaccaagcagtgggtggagggcctgagaagcatcatccacaacttcagagccaacaacgtgagccccatgacctgcctgaagaagcactggatgaagctggccttcatgaccaacaccaacggcaagatccccgtgagaagcatcaccagaaccttcgccagcggcaagaccgagaaggtgatcttccaggccctgaaggagctgggcctgcccagcggcaagaacgacgagatcgagcccaccgccttcagctacgagaagttctacgagctgacccagaagatctgccccagaaccgacatcgaggacctgttcaagaagatcaacggcgacaagaccgactacctgaccgtggaccagctggtgagcttcctgaacgagcaccagagagaccccagactgaacgagatcctgttccccttctacgacgccaagagagccatgcagatcatcgagatgtacgagcccgacgaggacctgaagaagaagggcctgatcagcagcgacggcttctgcagatacctgatgagcgacgagaacgcccccgtgttcctggacagactggagctgtaccaggagatggaccaccccctggcccactacttcatcagcagcagccacaacacctacctgaccggcagacagttcggcggcaagagcagcgtggagatgtacagacaggtgctgctggccggctgcagatgcgtggagctggactgctgggacggcaagggcgaggaccaggagcccatcatcacccacggcaaggccatgtgcaccgacatcctgttcaaggacgtgatccaggccatcaaggagaccgccttcgtgaccagcgagtaccccgtgatcctgagcttcgagaaccactgcagcaagtaccagcagtacaagatgagcaagtactgcgaggacctgttcggcgacctgctgctgaagcaggccctggagagccaccccctggagcccggcagagccctgcccagccccaacgacctgaagagaaagatcctgatcaagaacaagagactgaagcccgaggtggagaagaagcagctggaggccctgagaagcatgatggaggccggcgagagcgccagccccgccaacatcctggaggacgacaacgaggaggagatcgagagcgccgaccaggaggaggaggcccaccccgagttcaagttcggcaacgagctgagcgccgacgacctgggccacaaggaggccgtggccaacagcgtgaagaagggcctggtgaccgtggaggacgagcaggcctggatggccagctacaagtacgtgggcgccaccaccaacatccacccctacctgagcaccatgatcaactacgcccagcccgtgaagttccagggcttccacgtggccgaggagagaaacatccactacaacatgagcagcttcaacgagagcgtgggcctgggctacctgaagacccacgccatcgagttcgtgaactacaacaagagacagatgagcagaatctaccccaagggcggcagagtggacagcagcaactacatgccccagatcttctggaacgccggctgccagatggtgagcctgaactaccagacccccgacctggccatgcagctgaaccagggcaagttcgagtacaacggcagctgcggctacctgctgaagcccgacttcatgagaagacccgacagaaccttcgaccccttcagcgagacccccgtggacggcgtgatcgccgccacctgcagcgtgcaggtgatcagcggccagttcctgagcgacaagaagatcggcacctacgtggaggtggacatgtacggcctgcccaccgacaccatcagaaaggagttcagaaccagaatggtgatgaacaacggcctgaaccccgtgtacaacgaggagagcttcgtgttcagaaaggtgatcctgcccgacctggccgtgctgagaatcgccgtgtacgacgacaacaacaagctgatcggccagagaatcctgcccctggacggcctgcaggccggctacagacacatcagcctgagaaacgagggcaacaagcccctgagcctgcccaccatcttctgcaacatcgtgctgaagacctacgtgcccgacggcttcggcgacatcgtggacgccctgagcgaccccaagaagttcctgagcatcaccgagaagagagccgaccagatgagagccatgggcatcgagaccagcgacatcgccgacgtgcccagcgacaccagcaagaacgacaagaagggcaaggccaacaccgccaaggccaacgtgaccccccagagcagcagcgagctgagacccaccaccaccgccgccctggccagcggcgtggaggccaagaagggcatcgagctgatcccccaggtgagaatcgaggacctgaagcagatgaaggcctacctgaagcacctgaagaagcagcagaaggagctgaacagcctgaagaagaagcacgccaaggagcacagcaccatgcagaagctgcactgcacccaggtggacaagatcgtggcccagtacgacaaggagaagagcacccacgagaagatcctggagaaggccatgaagaagaagggcggcagcaactgcctggagatgaagaaggagaccgagatcaagatccagaccctgaccagcgaccacaagagcaaggtgaaggagatcgtggcccagcacaccaaggagtggagcgagatgatcaacacccacagcgccgaggagcaggagatcagagacctgcacctgagccagcagtgcgagctgctgaagaagctgctgatcaacgcccacgagcagcagacccagcagctgaagctgagccacgacagagagagcaaggagatgagagcccaccaggccaagatcagcatggagaacagcaaggccatcagccaggacaagagcatcaagaacaaggccgagagagagagaagagtgagagagctgaacagcagcaacaccaagaagttcctggaggagagaaagagactggccatgaagcagagcaaggagatggaccagctgaagaaggtgcagctggagcacctggagttcctggagaagcagaacgagcaggccaaggagatgcagcagatggtgaagctggaggccgagatggacagaagacccgccaccgtggtgtag

SEQ ID NO: 93307 - DNA, 3585 bp, Artificial Sequence
  Description of Artificial Sequence: Synthetic coding sequence
atggccaagccctacgagttcaactggcagaaggaggtgcccagcttcctgcaggagggcgccgtgttcgacagatacgaggaggagagcttcgtgttcgagcccaactgcctgttcaaggtggacgagttcggcttcttcctgacctggagaagcgagggcaaggagggccaggtgctggagtgcagcctgatcaacagcatcagaagcggcgccatccccaaggaccccaagatcctggccgccctggaggccgtgggcaagagcgagaacgacctggagggcagaatcgtgtgcgtgtgcagcggcaccgacctggtgaacatcagcttcacctacatggtggccgagaaccccgaggtgaccaagcagtgggtggagggcctgagaagcatcatccacaacttcagagccaacaacgtgagccccatgacctgcctgaagaagcactggatgaagctggccttcatgaccaacaccaacggcaagatccccgtgagaagcatcaccagaaccttcgccagcggcaagaccgagaaggtgatcttccaggccctgaaggagctgggcctgcccagcggcaagaacgacgagatcgagcccaccgccttcagctacgagaagttctacgagctgacccagaagatctgccccagaaccgacatcgaggacctgttcaagaagatcaacggcgacaagaccgactacctgaccgtggaccagctggtgagcttcctgaacgagcaccagagagaccccagactgaacgagatcctgttccccttctacgacgccaagagagccatgcagatcatcgagatgtacgagcccgacgaggacctgaagaagaagggcctgatcagcagcgacggcttctgcagatacctgatgagcgacgagaacgcccccgtgttcctggacagactggagctgtaccaggagatggaccaccccctggcccactacttcatcagcagcagccacaacacctacctgaccggcagacagttcggcggcaagagcagcgtggagatgtacagacaggtgctgctggccggctgcagatgcgtggagctggactgctgggacggcaagggcgaggaccaggagcccatcatcacccacggcaaggccatgtgcaccgacatcctgttcaaggacgtgatccaggccatcaaggagaccgccttcgtgaccagcgagtaccccgtgatcctgagcttcgagaaccactgcagcaagtaccagcagtacaagatgagcaagtactgcgaggacctgttcggcgacctgctgctgaagcaggccctggagagccaccccctggagcccggcagagccctgcccagccccaacgacctgaagagaaagatcctgatcaagaacaagagactgaagcccgaggtggagaagaagcagctggaggccctgagaagcatgatggaggccggcgagagcgccagccccgccaacatcctggaggacgacaacgaggaggagatcgagagcgccgaccaggaggaggaggcccaccccgagttcaagttcggcaacgagctgagcgccgacgacctgggccacaaggaggccgtggccaacagcgtgaagaagggcctggtgaccgtggaggacgagcaggcctggatggccagctacaagtacgtgggcgccaccaccaacatccacccctacctgagcaccatgatcaactacgcccagcccgtgaagttccagggcttccacgtggccgaggagagaaacatccactacaacatgagcagcttcaacgagagcgtgggcctgggctacctgaagacccacgccatcgagttcgtgaactacaacaagagacagatgagcagaatctaccccaagggcggcagagtggacagcagcaactacatgccccagatcttctggaacgccggctgccagatggtgagcctgaactaccagacccccgacctggccatgcagctgaaccagggcaagttcgagtacaacggcagctgcggctacctgctgaagcccgacttcatgagaagacccgacagaaccttcgaccccttcagcgagacccccgtggacggcgtgatcgccgccacctgcagcgtgcaggtgatcagcggccagttcctgagcgacaagaagatcggcacctacgtggaggtggacatgtacggcctgcccaccgacaccatcagaaaggagttcagaaccagaatggtgatgaacaacggcctgaaccccgtgtacaacgaggagagcttcgtgttcagaaaggtgatcctgcccgacctggccgtgctgagaatcgccgtgtacgacgacaacaacaagctgatcggccagagaatcctgcccctggacggcctgcaggccggctacagacacatcagcctgagaaacgagggcaacaagcccctgagcctgcccaccatcttctgcaacatcgtgctgaagacctacgtgcccgacggcttcggcgacatcgtggacgccctgagcgaccccaagaagttcctgagcatcaccgagaagagagccgaccagatgagagccatgggcatcgagaccagcgacatcgccgacgtgcccagcgacaccagcaagaacgacaagaagggcaaggccaacaccgccaaggccaacgtgaccccccagagcagcagcgagctgagacccaccaccaccgccgccctggccagcggcgtggaggccaagaagggcatcgagctgatcccccaggtgagaatcgaggacctgaagcagatgaaggcctacctgaagcacctgaagaagcagcagaaggagctgaacagcctgaagaagaagcacgccaaggagcacagcaccatgcagaagctgcactgcacccaggtggacaagatcgtggcccagtacgacaaggagaagagcacccacgagaagatcctggagaaggccatgaagaagaagggcggcagcaactgcctggagatgaagaaggagaccgagatcaagatccagaccctgaccagcgaccacaagagcaaggtgaaggagatcgtggcccagcacaccaaggagtggagcgagatgatcaacacccacagcgccgaggagcaggagatcagagacctgcacctgagccagcagtgcgagctgctgaagaagctgctgatcaacgcccacgagcagcagacccagcagctgaagctgagccacgacagagagagcaaggagatgagagcccaccaggccaagatcagcatggagaacagcaaggccatcagccaggacaagagcatcaagaacaaggccgagagagagagaagagtgagagagctgaacagcagcaacaccaagaagttcctggaggagagaaagagactggccatgaagcagagcaaggagatggaccagctgaagaaggtgcagctggagcacctggagttcctggagaagcagaacgagcagctgctgaagagctgccacgccgtgagccagacccagggcgagggcgacgccgccgacggcgagatcggcagcagagacggcccccagaccagcaacagcagcatgaagctgcagaacgccaactag

SEQ ID NO: 93308 - DNA, 3564 bp, Artificial Sequence
  Description of Artificial Sequence: Synthetic coding sequence
atggccaagccctacgagttcaactggcagaaggaggtgcccagcttcctgcaggagggcgccgtgttcgacagatacgaggaggagagcttcgtgttcgagcccaactgcctgttcaaggtggacgagttcggcttcttcctgacctggagaagcgagggcaaggagggccaggtgctggagtgcagcctgatcaacagcatcagaagcggcgccatccccaaggaccccaagatcctggccgccctggaggccgtgggcaagagcgagaacgacctggagggcagaatcgtgtgcgtgtgcagcggcaccgacctggtgaacatcagcttcacctacatggtggccgagaaccccgaggtgaccaagcagtgggtggagggcctgagaagcatcatccacaacttcagagccaacaacgtgagccccatgacctgcctgaagaagcactggatgaagctggccttcatgaccaacaccaacggcaagatccccgtgagaagcatcaccagaaccttcgccagcggcaagaccgagaaggtgatcttccaggccctgaaggagctgggcctgcccagcggcaagaacgacgagatcgagcccaccgccttcagctacgagaagttctacgagctgacccagaagatctgccccagaaccgacatcgaggacctgttcaagaagatcaacggcgacaagaccgactacctgaccgtggaccagctggtgagcttcctgaacgagcaccagagagaccccagactgaacgagatcctgttccccttctacgacgccaagagagccatgcagatcatcgagatgtacgagcccgacgaggacctgaagaagaagggcctgatcagcagcgacggcttctgcagatacctgatgagcgacgagaacgcccccgtgttcctggacagactggagctgtaccaggagatggaccaccccctggcccactacttcatcagcagcagccacaacacctacctgaccggcagacagttcggcggcaagagcagcgtggagatgtacagacaggtgctgctggccggctgcagatgcgtggagctggactgctgggacggcaagggcgaggaccaggagcccatcatcacccacggcaaggccatgtgcaccgacatcctgttcaaggacgtgatccaggccatcaaggagaccgccttcgtgaccagcgagtaccccgtgatcctgagcttcgagaaccactgcagcaagtaccagcagtacaagatgagcaagtactgcgaggacctgttcggcgacctgctgctgaagcaggccctggagagccaccccctggagcccggcagagccctgcccagccccaacgacctgaagagaaagatcctgatcaagaacaagagactgaagcccgaggtggagaagaagcagctggaggccctgagaagcatgatggaggccggcgagagcgccagccccgccaacatcctggaggacgacaacgaggaggagatcgagagcgccgaccaggaggaggaggcccaccccgagttcaagttcggcaacgagctgagcgccgacgacctgggccacaaggaggccgtggccaacagcgtgaagaaggccagcgacgacctggagcacgagaacaacaagaagggcctggtgaccgtggaggacgagcaggcctggatggccagctacaagtacgtgggcgccaccaccaacatccacccctacctgagcaccatgatcaactacgcccagcccgtgaagttccagggcttccacgtggccgaggagagaaacatccactacaacatgagcagcttcaacgagagcgtgggcctgggctacctgaagacccacgccatcgagttcgtgaactacaacaagagacagatgagcagaatctaccccaagggcggcagagtggacagcagcaactacatgccccagatcttctggaacgccggctgccagatggtgagcctgaactaccagacccccgacctggccatgcagctgaaccagggcaagttcgagtacaacggcagctgcggctacctgctgaagcccgacttcatgagaagacccgacagaaccttcgaccccttcagcgagacccccgtggacggcgtgatcgccgccacctgcagcgtgcaggtgatcagcggccagttcctgagcgacaagaagatcggcacctacgtggaggtggacatgtacggcctgcccaccgacaccatcagaaaggagttcagaaccagaatggtgatgaacaacggcctgaaccccgtgtacaacgaggagagcttcgtgttcagaaaggtgatcctgcccgacctggccgtgctgagaatcgccgtgtacgacgacaacaacaagctgatcggccagagaatcctgcccctggacggcctgcaggccggctacagacacatcagcctgagaaacgagggcaacaagcccctgagcctgcccaccatcttctgcaacatcgtgctgaagacctacgtgcccgacggcttcggcgacatcgtggacgccctgagcgaccccaagaagttcctgagcatcaccgagaagagagccgaccagatgagagccatgggcatcgagaccagcgacatcgccgacgtgcccagcgacaccagcaagaacgacaagaagggcaaggccaacaccgccaaggccaacgtgaccccccagagcagcagcgagctgagacccaccaccaccgccgccctggccagcggcgtggaggccaagaagggcatcgagctgatcccccaggtgagaatcgaggacctgaagcagatgaaggcctacctgaagcacctgaagaagcagcagaaggagctgaacagcctgaagaagaagcacgccaaggagcacagcaccatgcagaagctgcactgcacccaggtggacaagatcgtggcccagtacgacaaggagaagagcacccacgagaagatcctggagaaggccatgaagaagaagggcggcagcaactgcctggagatgaagaaggagaccgagatcaagatccagaccctgaccagcgaccacaagagcaaggtgaaggagatcgtggcccagcacaccaaggagtggagcgagatgatcaacacccacagcgccgaggagcaggagatcagagacctgcacctgagccagcagtgcgagctgctgaagaagctgctgatcaacgcccacgagcagcagacccagcagctgaagctgagccacgacagagagagcaaggagatgagagcccaccaggccaagatcagcatggagaacagcaaggccatcagccaggacaagagcatcaagaacaaggccgagagagagagaagagtgagagagctgaacagcagcaacaccaagaagttcctggaggagagaaagagactggccatgaagcagagcaaggagatggaccagctgaagaaggtgcagctggagcacctggagttcctggagaagcagaacgagcaggccaaggagatgcagcagatggtgaagctggaggccgagatggacagaagacccgccaccgtggtgtag

SEQ ID NO: 93309 - DNA, 3528 bp, Artificial Sequence; identical to SEQ ID NO: 93306
  Description of Artificial Sequence: Synthetic coding sequence

SEQ ID NO: 93310 - DNA, 3585 bp, Artificial Sequence; identical to SEQ ID NO: 93307
  Description of Artificial Sequence: Synthetic coding sequence

SEQ ID NO: 93311 - DNA, 342 bp, Artificial Sequence
  Description of Artificial Sequence: Synthetic coding sequence
atggccaagccctacgagttcaactggcagaaggaggtgcccagcttcctgcaggagggcgccgtgttcgacagatacgaggaggagagcttcgtgttcgagcccaactgcctgttcaaggtggacgagttcggcttcttcctgacctggagaagcgagggcaaggagggccaggtgctggagtgcagcctgatcaacagcatcagaagcggcgccatccccaaggaccccaagatcctggccgccctggaggccgtgggcaagagcgagaacgacctggagggcagaatcgtgtgcgtgtgcagcggcaccgacctggtgaacatcagcttcacctactag

SEQ ID NO: 93312 - DNA, 3072 bp, Artificial Sequence
  Description of Artificial Sequence: Synthetic coding sequence
cccgtgagaagcatcaccagaaccttcgccagcggcaagaccgagaaggtgatcttccaggccctgaaggagctgggcctgcccagcggcaagaacgacgagatcgagcccaccgccttcagctacgagaagttctacgagctgacccagaagatctgccccagaaccgacatcgaggacctgttcaagaagatcaacggcgacaagaccgactacctgaccgtggaccagctggtgagcttcctgaacgagcaccagagagaccccagactgaacgagatcctgttccccttctacgacgccaagagagccatgcagatcatcgagatgtacgagcccgacgaggacctgaagaagaagggcctgatcagcagcgacggcttctgcagatacctgatgagcgacgagaacgcccccgtgttcctggacagactggagctgtaccaggagatggaccaccccctggcccactacttcatcagcagcagccacaacacctacctgaccggcagacagttcggcggcaagagcagcgtggagatgtacagacaggtgctgctggccggctgcagatgcgtggagctggactgctgggacggcaagggcgaggaccaggagcccatcatcacccacggcaaggccatgtgcaccgacatcctgttcaaggacgtgatccaggccatcaaggagaccgccttcgtgaccagcgagtaccccgtgatcctgagcttcgagaaccactgcagcaagtaccagcagtacaagatgagcaagtactgcgaggacctgttcggcgacctgctgctgaagcaggccctggagagccaccccctggagcccggcagagccctgcccagccccaacgacctgaagagaaagatcctgatcaagaacaagagactgaagcccgaggtggagaagaagcagctggaggccctgagaagcatgatggaggccggcgagagcgccagccccgccaacatcctggaggacgacaacgaggaggagatcgagagcgccgaccaggaggaggaggcccaccccgagttcaagttcggcaacgagctgagcgccgacgacctgggccacaaggaggccgtggccaacagcgtgaagaaggccagcgacgacctggagcacgagaacaacaagaagggcctggtgaccgtggaggacgagcaggcctggatggccagctacaagtacgtgggcgccaccaccaacatccacccctacctgagcaccatgatcaactacgcccagcccgtgaagttccagggcttccacgtggccgaggagagaaacatccactacaacatgagcagcttcaacgagagcgtgggcctgggctacctgaagacccacgccatcgagttcgtgaactacaacaagagacagatgagcagaatctaccccaagggcggcagagtggacagcagcaactacatgccccagatcttctggaacgccggctgccagatggtgagcctgaactaccagacccccgacctggccatgcagctgaaccagggcaagttcgagtacaacggcagctgcggctacctgctgaagcccgacttcatgagaagacccgacagaaccttcgaccccttcagcgagacccccgtggacggcgtgatcgccgccacctgcagcgtgcaggtgatcagcggccagttcctgagcgacaagaagatcggcacctacgtggaggtggacatgtacggcctgcccaccgacaccatcagaaaggagttcagaaccagaatggtgatgaacaacggcctgaaccccgtgtacaacgaggagagcttcgtgttcagaaaggtgatcctgcccgacctggccgtgctgagaatcgccgtgtacgacgacaacaacaagctgatcggccagagaatcctgcccctggacggcctgcaggccggctacagacacatcagcctgagaaacgagggcaacaagcccctgagcctgcccaccatcttctgcaacatcgtgctgaagacctacgtgcccgacggcttcggcgacatcgtggacgccctgagcgaccccaagaagttcctgagcatcaccgagaagagagccgaccagatgagagccatgggcatcgagaccagcgacatcgccgacgtgcccagcgacaccagcaagaacgacaagaagggcaaggccaacaccgccaaggccaacgtgaccccccagagcagcagcgagctgagacccaccaccaccgccgccctggccagcggcgtggaggccaagaagggcatcgagctgatcccccaggtgagaatcgaggacctgaagcagatgaaggcctacctgaagcacctgaagaagcagcagaaggagctgaacagcctgaagaagaagcacgccaaggagcacagcaccatgcagaagctgcactgcacccaggtggacaagatcgtggcccagtacgacaaggagaagagcacccacgagaagatcctggagaaggccatgaagaagaagggcggcagcaactgcctggagatgaagaaggagaccgagatcaagatccagaccctgaccagcgaccacaagagcaaggtgaaggagatcgtggcccagcacaccaaggagtggagcgagatgatcaacacccacagcgccgaggagcaggagatcagagacctgcacctgagccagcagtgcgagctgctgaagaagctgctgatcaacgcccacgagcagcagacccagcagctgaagctgagccacgacagagagagcaaggagatgagagcccaccaggccaagatcagcatggagaacagcaaggccatcagccaggacaagagcatcaagaacaaggccgagagagagagaagagtgagagagctgaacagcagcaacaccaagaagttcctggaggagagaaagagactggccatgaagcagagcaaggagatggaccagctgaagaaggtgcagctggagcacctggagttcctggagaagcagaacgagcaggccaaggagatgcagcagatggtgaagctggaggccgagatggacagaagacccgccaccgtggtgtag

SEQ ID NO: 93313 - DNA, 183 bp, Artificial Sequence
  Description of Artificial Sequence: Synthetic coding sequence
atggccaagccctacgagttcaactggcagaaggaggtgcccagcttcctgcaggagggcgccgtgttcgacagatacgaggaggagagcttcgtgttcgagcccaactgcctgttcaaggtggacgagttcggcttcttcctgacctggagaagcgagggcaaggagggccaggtgctgtag

SEQ ID NO: 93314 - DNA, 246 bp, Artificial Sequence
  Description of Artificial Sequence: Synthetic coding sequence
atggccaagccctacgagttcaactggcagaaggaggtgcccagcttcctgcaggagggcgccgtgttcgacagatacgaggaggagagcttcgtgttcgagcccaactgcctgttcaaggtggacgagttcggcttcttcctgacctggagaagcgagggcaaggagggccaggtgctggagtgcagcctgatcaacagcatcagaagcggcgccatccccaaggaccccaagatcctggcctag

SEQ ID NO: 93315 - DNA, 333 bp, Artificial Sequence
  Description of Artificial Sequence: Synthetic coding sequence
atggccaagccctacgagttcaactggcagaaggaggtgcccagcttcctgcaggagggcgccgtgttcgacagatacgaggaggagagcttcgtgttcgagcccaactgcctgttcaaggtggacgagttcggcttcttcctgacctggagaagcgagggcaaggagggccaggtgctggagtgcagcctgatcaacagcatcagaagcggcgccatccccaaggaccccaagatcctggccgccctggaggccgtgggcaagagcgagaacgacctggagggcagaatcgtgtgcgtgtgcagcggcaccgacctggtgaacatcagctag

SEQ ID NO: 93316 - DNA, 2271 bp, Artificial Sequence
  Description of Artificial Sequence: Synthetic coding sequence
atggacagcggcagagacttcctgaccctgcacggcctgcaggacgacgaggacctgcaggccctgctgaagggcagccagctgctgaaggtgaagagcagcagctggagaagagagagattctacaagctgcaggaggactgcaagaccatctggcaggagagcagaaaggtgatgagaacccccgagagccagctgttcagcatcgaggacatccaggaggtgagaatgggccacagaaccgagggcctggagaagttcgccagagacgtgcccgaggacagatgcttcagcatcgtgttcaaggaccagagaaacaccctggacctgatcgcccccagccccgccgacgcccagcactgggtgctgggcctgcacaagatcatccaccacagcggcagcatggaccagagacagaagctgcagcactggatccacagctgcctgagaaaggccgacaagaacaaggacaacaagatgagcttcaaggagctgcagaacttcctgaaggagctgaacatccaggtggacgacagctacgccagaaagatcttcagagagtgcgaccacagccagaccgacagcctggaggacgaggagatcgaggccttctacaagatgctgacccagagagtggagatcgacagaaccttcgccgaggccgccggcagcggcgagaccctgagcgtggaccagctggtgaccttcctgcagcaccagcagagagaggaggccgccggccccgccctggccctgagcctgatcgagagatacgagcccagcgagaccgccaaggcccagagacagatgaccaaggacggcttcctgatgtacctgctgagcgccgacggcagcgccttcagcctggcccacagaagagtgtaccaggacatgggccagcccctgagccactacctggtgagcagcagccacaacacctacctgctggaggaccagctggccggccccagcagcaccgaggcctacatcagagccctgtgcaagggctgcagatgcctggagctggactgctgggacggccccaaccaggagcccatcatctaccacggctacaccttcaccagcaagatcctgttctgcgacgtgctgagagccatcagagactacgccttcaaggccagcccctaccccgtgatcctgagcctggagaaccactgcaccctggagcagcagagagtgatggccagacacctgcacgccatcctgggccccatgctgctgaacagacccctggacggcgtgaccaacagcctgcccagccccgagcagctgaagggcaagatcctgctgaagggcaagaagctgggcggcctgctgccccccggcggcgagggcggccccgaggccaccgtggtgagcgacgaggacgaggccgccgagatggaggacgaggccgtgagaagcagagtgcagcacaagcccaaggaggacaagctgagactggcccaggagctgagcgacatggtgatctactgcaagagcgtgcacttcggcggcttcagcagccccggcacccccggccaggccttctacgagatggccagcttcagcgagaacagagccctgagactgctgcaggagagcggcaacggcttcgtgagacacaacgtgggccacctgagcagaatctaccccgccggctggagaaccgacagcagcaactacagccccgtggagatgtggaacggcggctgccagatcgtggccctgaacttccagacccccggccccgagatggacgtgtaccagggcagattccaggacaacggcgcctgcggctacgtgctgaagcccgccttcctgagagaccccaacggcaccttcaaccccagagccctggcccagggcccctggtgggccagaaagagactgaacatcagagtgatcagcggccagcagctgcccaaggtgaacaagaacaagaacagcatcgtggaccccaaggtgaccgtggagatccacggcgtgagcagagacgtggccagcagacagaccgccgtgatcaccaacaacggcttcaacccctggtgggacaccgagttcgccttcgaggtggtggtgcccgacctggccctgatcagattcctggtggaggactacgacgccagcagcaagaacgacttcatcggccagagcaccatccccctgaacagcctgaagcagggctacagacacgtgcacctgatgagcaagaacggcgaccagcaccccagcgccaccctgttcgtgaagatcagcctgcaggactag

SEQ ID NO: 93317 - DNA, 2334 bp, Artificial Sequence
  Description of Artificial Sequence: Synthetic coding sequence
atgcagtgcctgggcatcagaagcagaagcagaagcagagagctgtacctgcaggagagaagcctgaaggtggccgccctgaacggcagaagactgggcctgcaggacgacgaggacctgcaggccctgctgaagggcagccagctgctgaaggtgaagagcagcagctggagaagagagagattctacaagctgcaggaggactgcaagaccatctggcaggagagcagaaaggtgatgagaacccccgagagccagctgttcagcatcgaggacatccaggaggtgagaatgggccacagaaccgagggcctggagaagttcgccagagacgtgcccgaggacagatgcttcagcatcgtgttcaaggaccagagaaacaccctggacctgatcgcccccagccccgccgacgcccagcactgggtgctgggcctgcacaagatcatccaccacagcggcagcatggaccagagacagaagctgcagcactggatccacagctgcctgagaaaggccgacaagaacaaggacaacaagatgagcttcaaggagctgcagaacttcctgaaggagctgaacatccaggtggacgacagctacgccagaaagatcttcagagagtgcgaccacagccagaccgacagcctggaggacgaggagatcgaggccttctacaagatgctgacccagagagtggagatcgacagaaccttcgccgaggccgccggcagcggcgagaccctgagcgtggaccagctggtgaccttcctgcagcaccagcagagagaggaggccgccggccccgccctggccctgagcctgatcgagagatacgagcccagcgagaccgccaaggcccagagacagatgaccaaggacggcttcctgatgtacctgctgagcgccgacggcagcgccttcagcctggcccacagaagagtgtaccaggacatgggccagcccctgagccactacctggtgagcagcagccacaacacctacctgctggaggaccagctggccggccccagcagcaccgaggcctacatcagagccctgtgcaagggctgcagatgcctggagctggactgctgggacggccccaaccaggagcccatcatctaccacggctacaccttcaccagcaagatcctgttctgcgacgtgctgagagccatcagagactacgccttcaaggccagcccctaccccgtgatcctgagcctggagaaccactgcaccctggagcagcagagagtgatggccagacacctgcacgccatcctgggccccatgctgctgaacagacccctggacggcgtgaccaacagcctgcccagccccgagcagctgaagggcaagatcctgctgaagggcaagaagctgggcggcctgctgccccccggcggcgagggcggccccgaggccaccgtggtgagcgacgaggacgaggccgccgagatggaggacgaggccgtgagaagcagagtgcagcacaagcccaaggaggacaagctgagactggcccaggagctgagcgacatggtgatctactgcaagagcgtgcacttcggcggcttcagcagccccggcacccccggccaggccttctacgagatggccagcttcagcgagaacagagccctgagactgctgcaggagagcggcaacggcttcgtgagacacaacgtgggccacctgagcagaatctaccccgccggctggagaaccgacagcagcaactacagccccgtggagatgtggaacggcggctgccagatcgtggccctgaacttccagacccccggccccgagatggacgtgtaccagggcagattccaggacaacggcgcctgcggctacgtgctgaagcccgccttcctgagagaccccaacggcaccttcaaccccagagccctggcccagggcccctggtgggccagaaagagactgaacatcagagtgatcagcggccagcagctgcccaaggtgaacaagaacaagaacagcatcgtggaccccaaggtgaccgtggagatccacggcgtgagcagagacgtggccagcagacagaccgccgtgatcaccaacaacggcttcaacccctggtgggacaccgagttcgccttcgaggtggtggtgcccgacctggccctgatcagattcctggtggaggactacgacgccagcagcaagaacgacttcatcggccagagcaccatccccctgaacagcctgaagcagggctacagacacgtgcacctgatgagcaagaacggcgaccagcaccccagcgccaccctgttcgtgaagatcagcctgcaggactag

SEQ ID NO: 93318 - DNA, 6909 bp, Artificial Sequence
  Description of Artificial Sequence: Synthetic coding sequence
atgaccagcgaggagatgaccgccagcgtgctgatccccgtgacccagagaaaggtggtgagcgcccagagcgccgccgacgagagcagcgagaaggtgagcgacatcaacatcagcaaggcccacaccgtgagaagaagcggcgagaccagccacaccatcagccagctgaacaagctgaaggaggagcccagcggcagcaacctgcccaagatcctgagcatcgccagagagaagatcgtgagcgacgagaacagcaacgagaagtgctgggagaagatcatgcccgacagcgccaagaacctgaacatcaactgcaacaacatcctgagaaaccaccagcacggcctgccccagagacagttctacgagatgtacaacagcgtggccgaggaggacctgtgcctggagaccggcatccccagccccctggagagaaaggtgttccccggcatccagctggagctggacagacccagcatgggcatcagccccctgggcaaccagagcgtgatcatcgagaccggcagagcccaccccgacagcagaagagccgtgttccacttccactacgaggtggacagaagaatgagcgacaccttctgcaccctgagcgagaacctgatcctggacgactgcggcaactgcgtgcccctgcccggcggcgaggagaagcagaagaagaactacgtggcctacacctgcaagctgatggagctggccaagaactgcgacaacaagaacgagcagctgcagtgcgaccactgcgacaccctgaacgacaagtacttctgcttcgagggcagctgcgagaaggtggacatggtgtacagcggcgacagcttctgcagaaaggacttcaccgacagccaggccgccaagaccttcctgagccacttcgaggacttccccgacaactgcgacgacgtggaggaggacgccttcaagagcaagaaggagagaagcaccctgctggtgagaagattctgcaagaacgacagagaggtgaagaagagcgtgtacaccggcaccagagccatcgtgagaaccctgcccagcggccacatcggcctgaccgcctggagctacatcgaccagaagagaaacggccccctgctgccctgcggcagagtgatggagccccccagcaccgtggagatcagacaggacggcagccagagactgagcgaggcccagtggtaccccatctacaacgccgtgagaagagaggagaccgagaacaccgtgggcagcctgctgcacttcctgaccaagctgcccgccagcgagaccgcccacggcagaatcagcgtgggcccctgcctgaagcagtgcgtgagagacaccgtgtgcgagtacagagccaccctgcagagaaccagcatcagccagtacatcaccggcagcctgctggaggccaccaccagcctgggcgccagaagcggcctgctgagcaccttcggcggcagcaccggcagaatgatgctgaaggagagacagcccggccccagcgtggccaacagcaacgccctgcccagcagcagcgccggcatcagcaaggagctgatcgacctgcagcccctgatccagttccccgaggaggtggccagcatcctgatggagcaggagcagaccatctacagaagagtgctgcccgtggactacctgtgcttcctgaccagagacctgggcacccccgagtgccagagcagcctgccctgcctgaaggccagcatcagcgccagcatcctgaccacccagaacggcgagcacaacgccctggaggacctggtgatgagattcaacgaggtgagcagctgggtgacctggctgatcctgaccgccggcagcatggaggagaagagagaggtgttcagctacctggtgcacgtggccaagtgctgctggaacatgggcaactacaacgccgtgatggagttcctggccggcctgagaagcagaaaggtgctgaagatgtggcagttcatggaccagagcgacatcgagaccatgagaagcctgaaggacgccatggcccagcacgagagcagctgcgagtacagaaaggtggtgaccagagccctgcacatccccggctgcaaggtggtgcccttctgcggcgtgttcctgaaggagctgtgcgaggtgctggacggcgccagcggcctgatgaagctgtgccccagatacaacagccaggaggagaccctggagttcgtggccgactacagcggccaggacaacttcctgcagagagtgggccagaacggcctgaagaacagcgagaaggagagcaccgtgaacagcatcttccaggtgatcagaagctgcaacagaagcctggagaccgacgaggaggacagccccagcgagggcaacagcagcagaaagagcagcctgaaggacaagagcagatggcagttcatcatcggcgacctgctggacagcgacaacgacatcttcgagcagagcaaggagtacgacagccacggcagcgaggacagccagaaggccttcgaccacggcaccgagctgatcccctggtacgtgctgagcatccaggccgacgtgcaccagttcctgctgcagggcgccaccgtgatccactacgaccaggacacccacctgagcgccagatgcttcctgcagctgcagcccgacaacagcaccctgacctgggtgaagcccaccaccgccagccccgccagcagcaaggccaagctgggcgtgctgaacaacaccgccgagcccggcaagttccccctgctgggcaacgccggcctgagcagcctgaccgagggcgtgctggacctgttcgccgtgaaggccgtgtacatgggccaccccggcatcgacatccacaccgtgtgcgtgcagaacaagctgggcagcatgttcctgagcgagaccggcgtgaccctgctgtacggcctgcagaccaccgacaacagactgctgcacttcgtggcccccaagcacaccgccaagatgctgttcagcggcctgctggagctgaccagagccgtgagaaagatgagaaagttccccgaccagagacagcagtggctgagaaagcagtacgtgagcctgtaccaggaggacggcagatacgagggccccaccctggcccacgccgtggagctgttcggcggcagaagatggagcgccagaaaccccagccccggcaccagcgccaagaacgccgagaagcccaacatgcagagaaacaacaccctgggcatcagcaccaccaagaagaagaagaagatcctgatgagaggcgagagcggcgaggtgaccgacgacgagatggccaccagaaaggccaagatgcacaaggagtgcagaagcagaagcggcagcgacccccaggacatcaacgagcaggaggagagcgaggtgaacgccatcgccaacccccccaaccccctgcccagcagaagagcccacagcctgaccaccgccggcagccccaacctggccgccggcaccagcagccccatcagacccgtgagcagccccgtgctgagcagcagcaacaagagccccagcagcgcctggagcagcagcagctggcacggcagaatcaagggcggcatgaagggcttccagagcttcatggtgagcgacagcaacatgagcttcgtggagttcgtggagctgttcaagagcttcagcgtgagaagcagaaaggacctgaaggacctgttcgacgtgtacgccgtgccctgcaacagaagcggcagcgagagcgcccccctgtacaccaacctgaccatcgacgagaacaccagcgacctgcagcccgacctggacctgctgaccagaaacgtgagcgacctgggcctgttcatcaagagcaagcagcagctgagcgacaaccagagacagatcagcgacgccatcgccgccgccagcatcgtgaccaacggcaccggcatcgagagcaccagcctgggcatcttcggcgtgggcatcctgcagctgaacgacttcctggtgaactgccagggcgagcactgcacctacgacgagatcctgagcatcatccagaagttcgagcccagcatcagcatgtgccaccagggcctgatgagcttcgagggcttcgccagattcctgatggacaaggagaacttcgccagcaagaacgacgagagccaggagaacatcaaggagctgcagctgcccctgagctactactacatcgagagcagccacaacacctacctgaccggccaccagctgaagggcgagagcagcgtggagctgtacagccaggtgctgctgcagggctgcagaagcgtggagctggactgctgggacggcgacgacggcatgcccatcatctaccacggccacaccctgaccaccaagatccccttcaaggaggtggtggaggccatcgacagaagcgccttcatcaacagcgacctgcccatcatcatcagcatcgagaaccactgcagcctgccccagcagagaaagatggccgagatcttcaagaccgtgttcggcgagaagctggtgaccaagttcctgttcgagaccgacttcagcgacgaccccatgctgcccagccccgaccagctgagaaagaaggtgctgctgaagaacaagaagctgaaggcccaccagacccccgtggacatcctgaagcagaaggcccaccagctggccagcatgcaggtgcaggcctacaacggcggcaacgccaaccccagacccgccaacaacgaggaggaggaggacgaggaggacgagtacgactacgactacgagagcctgagcgacgacaacatcctggaggacagacccgagaacaagagctgcaacgacaagctgcagttcgagtacaacgaggagatccccaagagaatcaagaaggccgacaacagcgcctgcaacaagggcaaggtgtacgacatggagctgggcgaggagttctacctggaccagaacaagaaggagagcagacagatcgcccccgagctgagcgacctggtgatctactgccaggccgtgaagttccccggcctgagcaccctgaacgccagcggcagcagcagaggcaaggagagaaagagcagaaagagcatcttcggcaacaaccccggcagaatgagccccggcgagaccgccagcttcaacaagaccagcggcaagagcagctgcgagggcatcagacagacctgggaggagagcagcagccccctgaaccccaccaccagcctgagcgccatcatcagaacccccaagtgctaccacatcagcagcctgaacgagaacgccgccaagagactgtgcagaagatacagccagaagctgacccagcacaccgcctgccagctgctgagaacctaccccgccgccaccagaatcgacagcagcaaccccaaccccctgatgttctggctgcacggcatccagctggtggccctgaactaccagaccgacgacctgcccctgcacctgaacgccgccatgttcgaggccaacggcggctgcggctacgtgctgaagccccccgtgctgtgggacaagaactgccccatgtaccagaagttcagccccctggagagagacctggacagcatggaccccgccgtgtacagcctgaccatcgtgagcggccagaacgtgtgccccagcaacagcatgggcagcccctgcatcgaggtggacgtgctgggcatgcccctggacagctgccacttcagaaccaagcccatccacagaaacaccctgaaccccatgtggaacgagcagttcctgttccacgtgcacttcgaggacctggtgttcctgagattcgccgtggtggagaacaacagcagcgccgtgaccgcccagagaatcatccccctgaaggccctgaagagaggctacagacacctgcagctgagaaacctgcacaacgaggtgctggagatcagcagcctgttcatcaacagcagaagaatggaggagaacagcagcggcaacaccatgagcgccagcagcatgttcaacaccgaggagagaaagtgcctgcagacccacagagtgaccgtgcacggcgtgcccggccccgagcccttcaccgtgttcaccatcaacggcggcaccaaggccaagcagctgctgcagcagatcctgaccaacgagcaggacatcaagcccgtgaccaccgactacttcctgatggaggagaagtacttcatcagcaaggagaagaacgagtgcagaaagcagcccttccagagagccatcggccccgaggaggagatcatgcagatcctgagcagctggttccccgaggagggctacatgggcagaatcgtgctgaagacccagcaggagaacctggaggagaagaacatcgtgcaggacgacaaggaggtgatcctgagcagcgaggaggagagcttcttcgtgcaggtgcacgacgtgagccccgagcagcccagaaccgtgatcaaggcccccagagtgagcaccgcccaggacgtgatccagcagaccctgtgcaaggccaagtacagctacagcatcctgagcaaccccaaccccagcgactacgtgctgctggaggaggtggtgaaggacaccaccaacaagaagaccaccacccccaagagcagccagagagtgctgctggaccaggagtgcgtgttccaggcccagagcaagtggaagggcgccggcaagttcatcctgaagctgaaggagcaggtgcaggccagcagagaggacaagaagaagggcatcagcttcgccagcgagctgaagaagctgaccaagagcaccaagcagcccagaggcctgaccagccccagccagctgctgaccagcgagagcatccagaccaaggaggagaagcccgtgggcggcctgagcagcagcgacaccatggactacagacagtag

SEQ ID NO: 93319 - DNA, 5985 bp, Artificial Sequence
  Description of Artificial Sequence: Synthetic coding sequence
atggtgagcgagggcagcgccgccggcagagacttcgccggcatggaggaggtgagacagctgcacgtgagattctgcaagggcatcaagatctggcaccaggcctggttcctgtgcagcctgctgggcagagagccccaggagagagaggccggctgccagctgtggctgtgcaccctgagcgccgtgctgaaggtgggctggctgttccccctgagcgaggtgcccaacttcaccctgctgaaggacggctgcggctgctggagactgaaggaggaccagatctacaacgccgtgagaagagaggagaccgagaacaccgtgggcagcctgctgcacttcctgaccaagctgcccgccagcgagaccgcccacggcagaatcagcgtgggcccctgcctgaagcagtgcgtgagagacaccgtgtgcgagtacagagccaccctgcagagaaccagcatcagccagtacatcaccggcagcctgctggaggccaccaccagcctgggcgccagaagcggcctgctgagcaccttcggcggcagcaccggcagaatgatgctgaaggagagacagcccggccccagcgtggccaacagcaacgccctgcccagcagcagcgccggcatcagcaaggagctgatcgacctgcagcccctgatccagttccccgaggaggtggccagcatcctgatggagcaggagcagaccatctacagaagagtgctgcccgtggactacctgtgcttcctgaccagagacctgggcacccccgagtgccagagcagcctgccctgcctgaaggccagcatcagcgccagcatcctgaccacccagaacggcgagcacaacgccctggaggacctggtgatgagattcaacgaggtgagcagctgggtgacctggctgatcctgaccgccggcagcatggaggagaagagagaggtgttcagctacctggtgcacgtggccaagtgctgctggaacatgggcaactacaacgccgtgatggagttcctggccggcctgagaagcagaaaggtgctgaagatgtggcagttcatggaccagagcgacatcgagaccatgagaagcctgaaggacgccatggcccagcacgagagcagctgcgagtacagaaaggtggtgaccagagccctgcacatccccggctgcaaggtggtgcccttctgcggcgtgttcctgaaggagctgtgcgaggtgctggacggcgccagcggcctgatgaagctgtgccccagatacaacagccaggaggagaccctggagttcgtggccgactacagcggccaggacaacttcctgcagagagtgggccagaacggcctgaagaacagcgagaaggagagcaccgtgaacagcatcttccaggtgatcagaagctgcaacagaagcctggagaccgacgaggaggacagccccagcgagggcaacagcagcagaaagagcagcctgaaggacaagagcagatggcagttcatcatcggcgacctgctggacagcgacaacgacatcttcgagcagagcaaggagtacgacagccacggcagcgaggacagccagaaggccttcgaccacggcaccgagctgatcccctggtacgtgctgagcatccaggccgacgtgcaccagttcctgctgcagggcgccaccgtgatccactacgaccaggacacccacctgagcgccagatgcttcctgcagctgcagcccgacaacagcaccctgacctgggtgaagcccaccaccgccagccccgccagcagcaaggccaagctgggcgtgctgaacaacaccgccgagcccggcaagttccccctgctgggcaacgccggcctgagcagcctgaccgagggcgtgctggacctgttcgccgtgaaggccgtgtacatgggccaccccggcatcgacatccacaccgtgtgcgtgcagaacaagctgggcagcatgttcctgagcgagaccggcgtgaccctgctgtacggcctgcagaccaccgacaacagactgctgcacttcgtggcccccaagcacaccgccaagatgctgttcagcggcctgctggagctgaccagagccgtgagaaagatgagaaagttccccgaccagagacagcagtggctgagaaagcagtacgtgagcctgtaccaggaggacggcagatacgagggccccaccctggcccacgccgtggagctgttcggcggcagaagatggagcgccagaaaccccagccccggcaccagcgccaagaacgccgagaagcccaacatgcagagaaacaacaccctgggcatcagcaccaccaagaagaagaagaagatcctgatgagaggcgagagcggcgaggtgaccgacgacgagatggccaccagaaaggccaagatgcacaaggagtgcagaagcagaagcggcagcgacccccaggacatcaacgagcaggaggagagcgaggtgaacgccatcgccaacccccccaaccccctgcccagcagaagagcccacagcctgaccaccgccggcagccccaacctggccgccggcaccagcagccccatcagacccgtgagcagccccgtgctgagcagcagcaacaagagccccagcagcgcctggagcagcagcagctggcacggcagaatcaagggcggcatgaagggcttccagagcttcatggtgagcgacagcaacatgagcttcgtggagttcgtggagctgttcaagagcttcagcgtgagaagcagaaaggacctgaaggacctgttcgacgtgtacgccgtgccctgcaacagaagcggcagcgagagcgcccccctgtacaccaacctgaccatcgacgagaacaccagcgacctgcagcccgacctggacctgctgaccagaaacgtgagcgacctgggcctgttcatcaagagcaagcagcagctgagcgacaaccagagacagatcagcgacgccatcgccgccgccagcatcgtgaccaacggcaccggcatcgagagcaccagcctgggcatcttcggcgtgggcatcctgcagctgaacgacttcctggtgaactgccagggcgagcactgcacctacgacgagatcctgagcatcatccagaagttcgagcccagcatcagcatgtgccaccagggcctgatgagcttcgagggcttcgccagattcctgatggacaaggagaacttcgccagcaagaacgacgagagccaggagaacatcaaggagctgcagctgcccctgagctactactacatcgagagcagccacaacacctacctgaccggccaccagctgaagggcgagagcagcgtggagctgtacagccaggtgctgctgcagggctgcagaagcgtggagctggactgctgggacggcgacgacggcatgcccatcatctaccacggccacaccctgaccaccaagatccccttcaaggaggtggtggaggccatcgacagaagcgccttcatcaacagcgacctgcccatcatcatcagcatcgagaaccactgcagcctgccccagcagagaaagatggccgagatcttcaagaccgtgttcggcgagaagctggtgaccaagttcctgttcgagaccgacttcagcgacgaccccatgctgcccagccccgaccagctgagaaagaaggtgctgctgaagaacaagaagctgaaggcccaccagacccccgtggacatcctgaagcagaaggcccaccagctggccagcatgcaggtgcaggcctacaacggcggcaacgccaaccccagacccgccaacaacgaggaggaggaggacgaggaggacgagtacgactacgactacgagagcctgagcgacgacaacatcctggaggacagacccgagaacaagagctgcaacgacaagctgcagttcgagtacaacgaggagatccccaagagaatcaagaaggccgacaacagcgcctgcaacaagggcaaggtgtacgacatggagctgggcgaggagttctacctggaccagaacaagaaggagagcagacagatcgcccccgagctgagcgacctggtgatctactgccaggccgtgaagttccccggcctgagcaccctgaacgccagcggcagcagcagaggcaaggagagaaagagcagaaagagcatcttcggcaacaaccccggcagaatgagccccggcgagaccgccagcttcaacaagaccagcggcaagagcagctgcgagggcatcagacagacctgggaggagagcagcagccccctgaaccccaccaccagcctgagcgccatcatcagaacccccaagtgctaccacatcagcagcctgaacgagaacgccgccaagagactgtgcagaagatacagccagaagctgacccagcacaccgcctgccagctgctgagaacctaccccgccgccaccagaatcgacagcagcaaccccaaccccctgatgttctggctgcacggcatccagctggtggccctgaactaccagaccgacgacctgcccctgcacctgaacgccgccatgttcgaggccaacggcggctgcggctacgtgctgaagccccccgtgctgtgggacaagaactgccccatgtaccagaagttcagccccctggagagagacctggacagcatggaccccgccgtgtacagcctgaccatcgtgagcggccagaacgtgtgccccagcaacagcatgggcagcccctgcatcgaggtggacgtgctgggcatgcccctggacagctgccacttcagaaccaagcccatccacagaaacaccctgaaccccatgtggaacgagcagttcctgttccacgtgcacttcgaggacctggtgttcctgagattcgccgtggtggagaacaacagcagcgccgtgaccgcccagagaatcatccccctgaaggccctgaagagaggctacagacacctgcagctgagaaacctgcacaacgaggtgctggagatcagcagcctgttcatcaacagcagaagaatggaggagaacagcagcggcaacaccatgagcgccagcagcatgttcaacaccgaggagagaaagtgcctgcagacccacagagtgaccgtgcacggcgtgcccggccccgagcccttcaccgtgttcaccatcaacggcggcaccaaggccaagcagctgctgcagcagatcctgaccaacgagcaggacatcaagcccgtgaccaccgactacttcctgatggaggagaagtacttcatcagcaaggagaagaacgagtgcagaaagcagcccttccagagagccatcggccccgaggaggagatcatgcagatcctgagcagctggttccccgaggagggctacatgggcagaatcgtgctgaagacccagcaggagaacctggaggagaagaacatcgtgcaggacgacaaggaggtgatcctgagcagcgaggaggagagcttcttcgtgcaggtgcacgacgtgagccccgagcagcccagaaccgtgatcaaggcccccagagtgagcaccgcccaggacgtgatccagcagaccctgtgcaaggccaagtacagctacagcatcctgagcaaccccaaccccagcgactacgtgctgctggaggaggtggtgaaggacaccaccaacaagaagaccaccacccccaagagcagccagagagtgctgctggaccaggagtgcgtgttccaggcccagagcaagtggaagggcgccggcaagttcatcctgaagctgaaggagcaggtgcaggccagcagagaggacaagaagaagggcatcagcttcgccagcgagctgaagaagctgaccaagagcaccaagcagcccagaggcctgaccagccccagccagctgctgaccagcgagagcatccagaccaaggaggagaagcccgtgggcggcctgagcagcagcgacaccatggactacagacagtag

SEQ ID NO: 93320 - DNA, 6939 bp, Artificial Sequence
  Description of Artificial Sequence: Synthetic coding sequence
atgaccagcgaggagatgaccgccagcgtgctgatccccgtgacccagagaaaggtggtgagcgcccagagcgccgccgacgagagcagcgagaaggtgagcgacatcaacatcagcaaggcccacaccgtgagaagaagcggcgagaccagccacaccatcagccagctgaacaagctgaaggaggagcccagcggcagcaacctgcccaagatcctgagcatcgccagagagaagatcgtgagcgacgagaacagcaacgagaagtgctgggagaagatcatgcccgacagcgccaagaacctgaacatcaactgcaacaacatcctgagaaaccaccagcacggcctgccccagagacagttctacgagatgtacaacagcgtggccgaggaggacctgtgcctggagaccggcatccccagccccctggagagaaaggtgttccccggcatccagctggagctggacagacccagcatgggcatcagccccctgggcaaccagagcgtgatcatcgagaccggcagagcccaccccgacagcagaagagccgtgttccacttccactacgaggtggacagaagaatgagcgacaccttctgcaccctgagcgagaacctgatcctggacgactgcggcaactgcgtgcccctgcccggcggcgaggagaagcagaagaagaactacgtggcctacacctgcaagctgatggagctggccaagaactgcgacaacaagaacgagcagctgcagtgcgaccactgcgacaccctgaacgacaagtacttctgcttcgagggcagctgcgagaaggtggacatggtgtacagcggcgacagcttctgcagaaaggacttcaccgacagccaggccgccaagaccttcctgagccacttcgaggacttccccgacaactgcgacgacgtggaggaggacgccttcaagagcaagaaggagagaagcaccctgctggtgagaagattctgcaagaacgacagagaggtgaagaagagcgtgtacaccggcaccagagccatcgtgagaaccctgcccagcggccacatcggcctgaccgcctggagctacatcgaccagaagagaaacggccccctgctgccctgcggcagagtgatggagccccccagcaccgtggagatcagacaggacggcagccagagactgagcgaggcccagtggtaccccatctacaacgccgtgagaagagaggagaccgagaacaccgtgggcagcctgctgcacttcctgaccaagctgcccgccagcgagaccgcccacggcagaatcagcgtgggcccctgcctgaagcagtgcgtgagagacaccgtgtgcgagtacagagccaccctgcagagaaccagcatcagccagtacatcaccggcagcctgctggaggccaccaccagcctgggcgccagaagcggcctgctgagcaccttcggcggcagcaccggcagaatgatgctgaaggagagacagcccggccccagcgtggccaacagcaacgccctgcccagcagcagcgccggcatcagcaaggagctgatcgacctgcagcccctgatccagttccccgaggaggtggccagcatcctgatggagcaggagcagaccatctacagaagagtgctgcccgtggactacctgtgcttcctgaccagagacctgggcacccccgagtgccagagcagcctgccctgcctgaaggccagcatcagcgccagcatcctgaccacccagaacggcgagcacaacgccctggaggacctggtgatgagattcaacgaggtgagcagctgggtgacctggctgatcctgaccgccggcagcatggaggagaagagagaggtgttcagctacctggtgcacgtggccaagtgctgctggaacatgggcaactacaacgccgtgatggagttcctggccggcctgagaagcagaaaggtgctgaagatgtggcagttcatggaccagagcgacatcgagaccatgagaagcctgaaggacgccatggcccagcacgagagcagctgcgagtacagaaaggtggtgaccagagccctgcacatccccggctgcaaggtggtgcccttctgcggcgtgttcctgaaggagctgtgcgaggtgctggacggcgccagcggcctgatgaagctgtgccccagatacaacagccaggaggagaccctggagttcgtggccgactacagcggccaggacaacttcctgcagagagtgggccagaacggcctgaagaacagcgagaaggagagcaccgtgaacagcatcttccaggtgatcagaagctgcaacagaagcctggagaccgacgaggaggacagccccagcgagggcaacagcagcagaaagagcagcctgaaggacaagagcagatggcagttcatcatcggcgacctgctggacagcgacaacgacatcttcgagcagagcaaggagtacgacagccacggcagcgaggacagccagaaggccttcgaccacggcaccgagctgatcccctggtacgtgctgagcatccaggccgacgtgcaccagttcctgctgcagggcgccaccgtgatccactacgaccaggacacccacctgagcgccagatgcttcctgcagctgcagcccgacaacagcaccctgacctgggtgaagcccaccaccgccagccccgccagcagcaaggccaagctgggcgtgctgaacaacaccgccgagcccggcaagttccccctgctgggcaacgccggcctgagcagcctgaccgagggcgtgctggacctgttcgccgtgaaggccgtgtacatgggccaccccggcatcgacatccacaccgtgtgcgtgcagaacaagctgggcagcatgttcctgagcgagaccggcgtgaccctgctgtacggcctgcagaccaccgacaacagactgctgcacttcgtggcccccaagcacaccgccaagatgctgttcagcggcctgctggagctgaccagagccgtgagaaagatgagaaagttccccgaccagagacagcagtggctgagaaagcagtacgtgagcctgtaccaggaggacggcagatacgagggccccaccctggcccacgccgtggagctgttcggcggcagaagatggagcgccagaaaccccagccccggcaccagcgccaagaacgccgagaagcccaacatgcagagaaacaacaccctgggcatcagcaccaccaagaagaagaagaagatcctgatgagaggcgagagcggcgaggtgaccgacgacgagatggccaccagaaaggccaagatgcacaaggagtgcagaagcagaagcggcagcgacccccaggacatcaacgagcaggaggagagcgaggtgaacgccatcgccaacccccccaaccccctgcccagcagaagagcccacagcctgaccaccgccggcagccccaacctggccgccggcaccagcagccccatcagacccgtgagcagccccgtgctgagcagcagcaacaagagccccagcagcgcctggagcagcagcagctggcacggcagaatcaagggcggcatgaagggcttccagagcttcatggtgagcgacagcaacatgagcttcgtggagttcgtggagctgttcaagagcttcagcgtgagaagcagaaaggacctgaaggacctgttcgacgtgtacgccgtgccctgcaacagaagcggcagcgagagcgcccccctgtacaccaacctgaccatcgacgagaacaccagcgacctgcagcccgacctggacctgctgaccagaaacgtgagcgacctgggcctgttcatcaagagcaagcagcagctgagcgacaaccagagacagatcagcgacgccatcgccgccgccagcatcgtgaccaacggcaccggcatcgagagcaccagcctgggcatcttcggcgtgggcatcctgcagctgaacgacttcctggtgaactgccagggcgagcactgcacctacgacgagatcctgagcatcatccagaagttcgagcccagcatcagcatgtgccaccagggcctgatgagcttcgagggcttcgccagattcctgatggacaaggagaacttcgccagcaagaacgacgagagccaggagaacatcaaggagctgcagctgcccctgagctactactacatcgagagcagccacaacacctacctgaccggccaccagctgaagggcgagagcagcgtggagctgtacagccaggtgctgctgcagggctgcagaagcgtggagctggactgctgggacggcgacgacggcatgcccatcatctaccacggccacaccctgaccaccaagatccccttcaaggaggtggtggaggccatcgacagaagcgccttcatcaacagcgacctgcccatcatcatcagcatcgagaaccactgcagcctgccccagcagagaaagatggccgagatcttcaagaccgtgttcggcgagaagctggtgaccaagttcctgttcgagaccgacttcagcgacgaccccatgctgcccagccccgaccagctgagaaagaaggtgctgctgaagaacaagaagctgaaggcccaccagacccccgtggacatcctgaagcagaaggcccaccagctggccagcatgcaggtgcaggcctacaacggcggcaacgccaaccccagacccgccaacaacgaggaggaggaggacgaggaggacgagtacgactacgactacgagagcctgagcgacgacaacatcctggaggacagacccgagaacaagagctgcaacgacaagctgcagttcgagtacaacgaggagatccccaagagaatcaagaaggccgacaacagcgcctgcaacaagggcaaggtgtacgacatggagctgggcgaggagttctacctggaccagaacaagaaggagagcagacagatcgcccccgagctgagcgacctggtgatctactgccaggccgtgaagttccccggcctgagcaccctgaacgccagcggcagcagcagaggcaaggagagaaagagcagaaagagcatcttcggcaacaaccccggcagaatgagccccggcgagaccgccagcttcaacaagaccagcggcaagagcagctgcgagggcatcagacagacctgggaggagagcagcagccccctgaaccccaccaccagcctgagcgccatcatcagaacccccaagtgctaccacatcagcagcctgaacgagaacgccgccaagagactgtgcagaagatacagccagaagctgacccagcacaccgcctgccagctgctgagaacctaccccgccgccaccagaatcgacagcagcaaccccaaccccctgatgttctggctgcacggcatccagctggtggccctgaactaccagaccgacgacctgcccctgcacctgaacgccgccatgttcgaggccaacggcggctgcggctacgtgctgaagccccccgtgctgtgggacaagaactgccccatgtaccagaagttcagccccctggagagagacctggacagcatggaccccgccgtgtacagcctgaccatcgtgagcggccagaacgtgtgccccagcaacagcatgggcagcccctgcatcgaggtggacgtgctgggcatgcccctggacagctgccacttcagaaccaagcccatccacagaaacaccctgaaccccatgtggaacgagcagttcctgttccacgtgcacttcgaggacctggtgttcctgagattcgccgtggtggagaacaacagcagcgccgtgaccgcccagagaatcatccccctgaaggccctgaagagaggctacagacacctgcagctgagaaacctgcacaacgaggtgctggagatcagcagcctgttcatcaacagcagaagaatggaggagaacagcagcggcaacaccatgagcgccagcagcatgttcaacaccgaggagagaaagtgcctgcagacccacagagtgaccgtgcacggcgtgcccggccccgagcccttcaccgtgttcaccatcaacggcggcaccaaggccaagcagctgctgcagcagatcctgaccaacgagcaggacatcaagcccgtgaccaccgactacttcctgatggaggagaagtacttcatcagcaaggagaagaacgagtgcagaaagcagcccttccagagagccatcggccccgaggaggagatcatgcagatcctgagcagctggttccccgaggagggctacatgggcagaatcgtgctgaagacccagcaggagaacctggaggagaagaacatcgtgcaggacgacaaggaggtgatcctgagcagcgaggaggagagcttcttcgtgcaggtgcacgacgtgagccccgagcagcccagaaccgtgatcaaggcccccagagtgagcaccgcccaggacgtgatccagcagaccctgtgcaaggccaagtacagctacagcatcctgagcaaccccaaccccagcgactacgtgctgctggaggaggtggtgaaggacaccaccaacaagaagaccaccacccccaagagcagccagagagtgctgctggaccaggagtgcgtgttccaggcccagagcaagtggaagggcgccggcaagttcatcctgaagctgaaggagcaggtgcaggccagcagagaggacaagaagaagggcatcagcttcgccagcgagctgaagaagctgaccaagagcaccaagcagcccagaggcctgaccagccccagccagctgctgaccagcgagagcatccagaccaaggaggagaagcccgtgggcggcctgagcagcagcgacaccatggactacagacaggtgaagatcttcaagcaggaggtgaaggagtag

SEQ ID NO: 93321 - DNA, 5985 bp, Artificial Sequence; identical to SEQ ID NO: 93319
  Description of Artificial Sequence: Synthetic coding sequence

SEQ ID NO: 93322 - DNA, 4968 bp, Artificial Sequence
  Description of Artificial Sequence: Synthetic coding sequence
atgagcgtgatgcagagcggcacccagatgatcaagctgaagagaggcaccaagggcctggtgagactgttctacctggacgagcacagaaccagactgagatggagacccagcagaaagagcgagaaggccaagatcctgatcgacagcatctacaaggtgaccgagggcagacagagcgagatcttccacagacaggccgagggcaacttcgaccccagctgctgcttcaccatctaccacggcaaccacatggagagcctggacctgatcaccagcaaccccgaggaggccagaacctggatcaccggcctgaagtacctgatggccggcatcagcgacgaggacagcctggccaagagacagagaacccacgaccagtgggtgaagcagaccttcgaggaggccgacaagaacggcgacggcctgctgaacatcgaggagatccaccagctgatgcacaagctgaacgtgaacctgcccagaagaaaggtgagacagatgttccaggaggccgacaccgacgagaaccagggcaccctgaccttcgaggagttctgcgtgttctacaagatgatgagcctgagaagagacctgtacctgctgctgctgagctacagcgacaagaaggaccacctgaccgtggaggagctggcccagttcctgaaggtggagcagaagatgaacaacgtgaccaccgactactgcctggacatcatcaagaagttcgaggtgagcgaggagaacaaggtgaagaacgtgctgggcatcgagggcttcaccaacttcatgagaagccccgcctgcgacatcttcaaccccctgcaccacgaggtgtaccaggacatggaccagcccctgtgcaactactacatcgccagcagccacaacacctacctgaccggcgaccagctgctgagccagagcaaggtggacatgtacgccagagtgctgcaggagggctgcagatgcgtggaggtggactgctgggacggccccgacggcgagcccgtggtgcaccacggctacaccctgaccagcaagatcctgttcagagacgtggtggagaccatcaacaagcacgccttcgtgaagaacgagttccccgtgatcctgagcatcgagaaccactgcagcatccagcagcagagaaagatcgcccagtacctgaagggcatcttcggcgacaagctggacctgagcagcgtggacaccggcgagtgcaagcagctgcccagcccccagagcctgaagggcaagatcctggtgaagggcaagaagctgccctaccacctgggcgacgacgccgaggagggcgaggtgagcgacgaggacagcgccgacgagatcgaggacgagtgcaagttcaagctgcactacagcaacggcaccaccgagcaccaggtggagagcttcatcagaaagaagctggagagcctgctgaaggagagccagatcagagacaaggaggaccccgacagcttcaccgtgagagccctgctgaaggccacccacgagggcctgaacgcccacctgaagcagagccccgacgtgaaggagagcggcaagaagagccacggcagaagcctgatgaccaacttcggcaagcacaagaagaccaccaagagcagaagcaagagctacagcaccgacgacgaggaggacacccagcagagcaccggcaaggagggcggccagctgtacagactgggcagaagaagaaagaccatgaagctgtgcagagagctgagcgacctggtggtgtacaccaacagcgtggccgcccaggacatcgtggacgacggcaccaccggcaacgtgctgagcttcagcgagaccagagcccaccaggtggtgcagcagaagagcgagcagttcatgatctacaaccagaagcagctgaccagaatctaccccagcgcctacagaatcgacagcagcaacttcaaccccctgccctactggaacgccggctgccagctggtggccctgaactaccagagcgagggcagaatgatgcagctgaacagagccaagttcaaggccaacggcaactgcggctacgtgctgaagccccagcagatgtgcaagggcaccttcaaccccttcagcggcgaccccctgcccgccaaccccaagaagcagctgatcctgaaggtgatcagcggccagcagctgcccaagccccccgacagcatgttcggcgacagaggcgagatcatcgaccccttcgtggaggtggagatcatcggcctgcccgtggactgctgcaaggaccagaccagagtggtggacgacaacggcttcaaccccgtgtgggaggagaccctgaccttcaccgtgcacatgcccgagatcgccctggtgagattcctggtgtgggaccacgaccccatcggcagagacttcgtgggccagagaaccgtgaccttcagcagcctggtgcccggctacagacacgtgtacctggagggcctgaccgaggccagcatcttcgtgcacatcaccatcaacgagatctacggcaagaacagacagctgcagggcctgaagggcctgttcaacaagaaccccagacacagcagcagcgagaacaacagccactacgtgagaaagagaagcatcggcgacagaatcctgagaagaaccgccagcgcccccgccaagggcagaaagaagagcaagatgggcttccaggagatggtggagatcaaggacagcgtgagcgaggccaccagagaccaggacggcgtgctgagaagaaccaccagaagcctgcaggccagacccgtgagcatgcccgtggacagaaacctgctgggcgccctgagcctgcccgtgagcgagaccgccaaggacatcgagggcaaggagaacagcctggccgaggacaaggacggcagaagaaagggcaaggccagcatcaaggacccccacttcctgaacttcaacaagaagctgagcagcagcagcagcgccctgctgcacaaggacaccagccagggcgacaccatcgtgagcaccgcccacatgagcgtgaccggcgagcagctgggcatgagcagccccagaggcggcagaaccaccagcaacgccaccagcaactgccaggagaacccctgccccagcaagagcctgagccccaagcagcacctggcccccgaccccgtggtgaaccccacccaggacctgcacggcgtgaagatcaaggagaagggcaaccccgaggacttcgtggagggcaagagcatcctgagcggcagcgtgctgagccacagcaacctggagatcaagaacctggagggcaacagaggcaagggcagagccgccaccagcttcagcctgagcgacgtgagcatgctgtgcagcgacatccccgacctgcacagcaccgccatcctgcaggagagcgtgatcagccacctgatcgacaacgtgaccctgaccaacgagaacgagcccggcagcagcatcagcgccctgatcggccagttcgacgagaccaacaaccaggccctgaccgtggtgagccacctgcacaacaccagcgtgatgagcggccactgccccctgcccagcctgggcctgaagatgcccatcaagcacggcttctgcaagggcaagagcaagagcagcttcctgtgcagcagccccgagctgatcgccctgagcagcagcgagaccaccaagcacgccaccaacaccgtgtacgagaccacctgcacccccatcagcaagaccaagcccgacgacgacctgagcagcaaggccaagaccgccgccctggagagcaacctgcccggcagccccaacaccagcagaggctggctgcccaagagccccaccaagggcgaggactgggagaccctgaagagctgcagccccgccagcagccccgacctgaccctggaggacgtgatcgccgaccccaccctgtgcttcaacagcggcgagagcagcctggtggagatcgacggcgagagcgagaacctgagcctgaccacctgcgagtacagaagagagggcaccagccagctggccagccccctgaagctgaagtacaaccagggcgtggtggagcacttccagagaggcctgagaaacggctactgcaaggagaccctgagacccagcgtgcccgagatcttcaacaacatccaggacgtgaagacccagagcatcagctacctggcctaccagggcgccggcttcgtgcacaaccacttcagcgacagcgacgccaagatgttccagacctgcgtgccccagcagagcagcgcccaggacatgcacgtgcccgtgcccaagcagctggcccacctgcccctgcccgccctgaagctgcccagcccctgcaagagcaagagcctgggcgacctgaccagcgaggacatcgcctgcaacttcgagagcaagtaccagtgcatcagcaagagcttcgtgaccaccggcatcagagacaagaagggcgtgaccgtgaagaccaagagcctggagcccatcgacgccctgaccgagcagctgagaaagctggtgagcttcgaccaggaggacaactgccaggtgctgtacagcaagcaggacgccaaccagctgcccagagccctggtgagaaagctgagcagcagaagccagagcagagtgagaaacatcgccagcagagccaaggagaagcaggaggccaacaagcagaaggtgcccaaccccagcaacggcgccggcgtggtgctgagaaacaagcccagcgcccccacccccgccgtgaacagacacagcaccggcagctacatcgccggctacctgaagaacaccaagggcggcggcctggagggcagaggcatccccgagggcgcctgcaccgccctgcactacggccacgtggaccagttctgcagcgacaacagcgtgctgcagaccgagcccagcagcgacgacaagcccgagatctacttcctgctgagactgtag

SEQ ID NO: 93323 - DNA, 5082 bp, Artificial Sequence
  Description of Artificial Sequence: Synthetic coding sequence
atggccgacctggaggtgtacaagaacctgagccccgagaaggtggagagatgcatgagcgtgatgcagagcggcacccagatgatcaagctgaagagaggcaccaagggcctggtgagactgttctacctggacgagcacagaaccagactgagatggagacccagcagaaagagcgagaaggccaagatcctgatcgacagcatctacaaggtgaccgagggcagacagagcgagatcttccacagacaggccgagggcaacttcgaccccagctgctgcttcaccatctaccacggcaaccacatggagagcctggacctgatcaccagcaaccccgaggaggccagaacctggatcaccggcctgaagtacctgatggccggcatcagcgacgaggacagcctggccaagagacagagaacccacgaccagtgggtgaagcagaccttcgaggaggccgacaagaacggcgacggcctgctgaacatcgaggagatccaccagctgatgcacaagctgaacgtgaacctgcccagaagaaaggtgagacagatgttccaggaggccgacaccgacgagaaccagggcaccctgaccttcgaggagttctgcgtgttctacaagatgatgagcctgagaagagacctgtacctgctgctgctgagctacagcgacaagaaggaccacctgaccgtggaggagctggcccagttcctgaaggtggagcagaagatgaacaacgtgaccaccgactactgcctggacatcatcaagaagttcgaggtgagcgaggagaacaaggtgaagaacgtgctgggcatcgagggcttcaccaacttcatgagaagccccgcctgcgacatcttcaaccccctgcaccacgaggtgtaccaggacatggaccagcccctgtgcaactactacatcgccagcagccacaacacctacctgaccggcgaccagctgctgagccagagcaaggtggacatgtacgccagagtgctgcaggagggctgcagatgcgtggaggtggactgctgggacggccccgacggcgagcccgtggtgcaccacggctacaccctgaccagcaagatcctgttcagagacgtggtggagaccatcaacaagcacgccttcgtgaagaacgagttccccgtgatcctgagcatcgagaaccactgcagcatccagcagcagagaaagatcgcccagtacctgaagggcatcttcggcgacaagctggacctgagcagcgtggacaccggcgagtgcaagcagctgcccagcccccagagcctgaagggcaagatcctggtgaagggcaagaagctgccctaccacctgggcgacgacgccgaggagggcgaggtgagcgacgaggacagcgccgacgagatcgaggacgagtgcaagttcaagctgcactacagcaacggcaccaccgagcaccaggtggagagcttcatcagaaagaagctggagagcctgctgaaggagagccagatcagagacaaggaggaccccgacagcttcaccgtgagagccctgctgaaggccacccacgagggcctgaacgcccacctgaagcagagccccgacgtgaaggagagcggcaagaagagccacggcagaagcctgatgaccaacttcggcaagcacaagaagaccaccaagagcagaagcaagagctacagcaccgacgacgaggaggacacccagcagagcaccggcaaggagggcggccagctgtacagactgggcagaagaagaaagaccatgaagctgtgcagagagctgagcgacctggtggtgtacaccaacagcgtggccgcccaggacatcgtggacgacggcaccaccggcaacgtgctgagcttcagcgagaccagagcccaccaggtggtgcagcagaagagcgagcagttcatgatctacaaccagaagcagctgaccagaatctaccccagcgcctacagaatcgacagcagcaacttcaaccccctgccctactggaacgccggctgccagctggtggccctgaactaccagagcgagggcagaatgatgcagctgaacagagccaagttcaaggccaacggcaactgcggctacgtgctgaagccccagcagatgtgcaagggcaccttcaaccccttcagcggcgaccccctgcccgccaaccccaagaagcagctgatcctgaaggtgatcagcggccagcagctgcccaagccccccgacagcatgttcggcgacagaggcgagatcatcgaccccttcgtggaggtggagatcatcggcctgcccgtggactgctgcaaggaccagaccagagtggtggacgacaacggcttcaaccccgtgtgggaggagaccctgaccttcaccgtgcacatgcccgagatcgccctggtgagattcctggtgtgggaccacgaccccatcggcagagacttcgtgggccagagaaccgtgaccttcagcagcctggtgcccggctacagacacgtgtacctggagggcctgaccgaggccagcatcttcgtgcacatcaccatcaacgagatctacggcaagtggagccccctgatcctgaaccccagctacaccatcctgcacttcctgggcgccaccaagaacagacagctgcagggcctgaagggcctgttcaacaagaaccccagacacagcagcagcgagaacaacagccactacgtgagaaagagaagcatcggcgacagaatcctgagaagaaccgccagcgcccccgccaagggcagaaagaagagcaagatgggcttccaggagatggtggagatcaaggacagcgtgagcgaggccaccagagaccaggacggcgtgctgagaagaaccaccagaagcctgcaggccagacccgtgagcatgcccgtggacagaaacctgctgggcgccctgagcctgcccgtgagcgagaccgccaaggacatcgagggcaaggagaacagcctggccgaggacaaggacggcagaagaaagggcaaggccagcatcaaggacccccacttcctgaacttcaacaagaagctgagcagcagcagcagcgccctgctgcacaaggacaccagccagggcgacaccatcgtgagcaccgcccacatgagcgtgaccggcgagcagctgggcatgagcagccccagaggcggcagaaccaccagcaacgccaccagcaactgccaggagaacccctgccccagcaagagcctgagccccaagcagcacctggcccccgaccccgtggtgaaccccacccaggacctgcacggcgtgaagatcaaggagaagggcaaccccgaggacttcgtggagggcaagagcatcctgagcggcagcgtgctgagccacagcaacctggagatcaagaacctggagggcaacagaggcaagggcagagccgccaccagcttcagcctgagcgacgtgagcatgctgtgcagcgacatccccgacctgcacagcaccgccatcctgcaggagagcgtgatcagccacctgatcgacaacgtgaccctgaccaacgagaacgagcccggcagcagcatcagcgccctgatcggccagttcgacgagaccaacaaccaggccctgaccgtggtgagccacctgcacaacaccagcgtgatgagcggccactgccccctgcccagcctgggcctgaagatgcccatcaagcacggcttctgcaagggcaagagcaagagcagcttcctgtgcagcagccccgagctgatcgccctgagcagcagcgagaccaccaagcacgccaccaacaccgtgtacgagaccacctgcacccccatcagcaagaccaagcccgacgacgacctgagcagcaaggccaagaccgccgccctggagagcaacctgcccggcagccccaacaccagcagaggctggctgcccaagagccccaccaagggcgaggactgggagaccctgaagagctgcagccccgccagcagccccgacctgaccctggaggacgtgatcgccgaccccaccctgtgcttcaacagcggcgagagcagcctggtggagatcgacggcgagagcgagaacctgagcctgaccacctgcgagtacagaagagagggcaccagccagctggccagccccctgaagctgaagtacaaccagggcgtggtggagcacttccagagaggcctgagaaacggctactgcaaggagaccctgagacccagcgtgcccgagatcttcaacaacatccaggacgtgaagacccagagcatcagctacctggcctaccagggcgccggcttcgtgcacaaccacttcagcgacagcgacgccaagatgttccagacctgcgtgccccagcagagcagcgcccaggacatgcacgtgcccgtgcccaagcagctggcccacctgcccctgcccgccctgaagctgcccagcccctgcaagagcaagagcctgggcgacctgaccagcgaggacatcgcctgcaacttcgagagcaagtaccagtgcatcagcaagagcttcgtgaccaccggcatcagagacaagaagggcgtgaccgtgaagaccaagagcctggagcccatcgacgccctgaccgagcagctgagaaagctggtgagcttcgaccaggaggacaactgccaggtgctgtacagcaagcaggacgccaaccagctgcccagagccctggtgagaaagctgagcagcagaagccagagcagagtgagaaacatcgccagcagagccaaggagaagcaggaggccaacaagcagaaggtgcccaaccccagcaacggcgccggcgtggtgctgagaaacaagcccagcgcccccacccccgccgtgaacagacacagcaccggcagctacatcgccggctacctgaagaacaccaagggcggcggcctggagggcagaggcatccccgagggcgcctgcaccgccctgcactacggccacgtggaccagttctgcagcgacaacagcgtgctgcagaccgagcccagcagcgacgacaagcccgagatctacttcctgctgagactgtag

SEQ ID NO: 93324 - DNA, 4968 bp, Artificial Sequence; identical to SEQ ID NO: 93322
  Description of Artificial Sequence: Synthetic coding sequence

SEQ ID NO: 93325 - DNA, 3009 bp, Artificial Sequence
  Description of Artificial Sequence: Synthetic coding sequence
atggccgacctggaggtgtacaagaacctgagccccgagaaggtggagagatgcatgagcgtgatgcagagcggcacccagatgatcaagctgaagagaggcaccaagggcctggtgagactgttctacctggacgagcacagaaccagactgagatggagacccagcagaaagagcgagaaggccaagatcctgatcgacagcatctacaaggtgaccgagggcagacagagcgagatcttccacagacaggccgagggcaacttcgaccccagctgctgcttcaccatctaccacggcaaccacatggagagcctggacctgatcaccagcaaccccgaggaggccagaacctggatcaccggcctgaagtacctgatggccggcatcagcgacgaggacagcctggccaagagacagagaacccacgaccagtgggtgaagcagaccttcgaggaggccgacaagaacggcgacggcctgctgaacatcgaggagatccaccagctgatgcacaagctgaacgtgaacctgcccagaagaaaggtgagacagatgttccaggaggccgacaccgacgagaaccagggcaccctgaccttcgaggagttctgcgtgttctacaagatgatgagcctgagaagagacctgtacctgctgctgctgagctacagcgacaagaaggaccacctgaccgtggaggagctggcccagttcctgaaggtggagcagaagatgaacaacgtgaccaccgactactgcctggacatcatcaagaagttcgaggtgagcgaggagaacaaggtgaagaacgtgctgggcatcgagggcttcaccaacttcatgagaagccccgcctgcgacatcttcaaccccctgcaccacgaggtgtaccaggacatggaccagcccctgtgcaactactacatcgccagcagccacaacacctacctgaccggcgaccagctgctgagccagagcaaggtggacatgtacgccagagtgctgcaggagggctgcagatgcgtggaggtggactgctgggacggccccgacggcgagcccgtggtgcaccacggctacaccctgaccagcaagatcctgttcagagacgtggtggagaccatcaacaagcacgccttcgtgaagaacgagttccccgtgatcctgagcatcgagaaccactgcagcatccagcagcagagaaagatcgcccagtacctgaagggcatcttcggcgacaagctggacctgagcagcgtggacaccggcgagtgcaagcagctgcccagcccccagagcctgaagggcaagatcctggtgaagggcaagaagctgccctaccacctgggcgacgacgccgaggagggcgaggtgagcgacgaggacagcgccgacgagatcgaggacgagtgcaagttcaagctgcactacagcaacggcaccaccgagcaccaggtggagagcttcatcagaaagaagctggagagcctgctgaaggagagccagatcagagacaaggaggaccccgacagcttcaccgtgagagccctgctgaaggccacccacgagggcctgaacgcccacctgaagcagagccccgacgtgaaggagagcggcaagaagagccacggcagaagcctgatgaccaacttcggcaagcacaagaagaccaccaagagcagaagcaagagctacagcaccgacgacgaggaggacacccagcagagcaccggcaaggagggcggccagctgtacagactgggcagaagaagaaagaccatgaagctgtgcagagagctgagcgacctggtggtgtacaccaacagcgtggccgcccaggacatcgtggacgacggcaccaccggcaacgtgctgagcttcagcgagaccagagcccaccaggtggtgcagcagaagagcgagcagttcatgatctacaaccagaagcagctgaccagaatctaccccagcgcctacagaatcgacagcagcaacttcaaccccctgccctactggaacgccggctgccagctggtggccctgaactaccagagcgagggcagaatgatgcagctgaacagagccaagttcaaggccaacggcaactgcggctacgtgctgaagccccagcagatgtgcaagggcaccttcaaccccttcagcggcgaccccctgcccgccaaccccaagaagcagctgatcctgaaggtgatcagcggccagcagctgcccaagccccccgacagcatgttcggcgacagaggcgagatcatcgaccccttcgtggaggtggagatcatcggcctgcccgtggactgctgcaaggaccagaccagagtggtggacgacaacggcttcaaccccgtgtgggaggagaccctgaccttcaccgtgcacatgcccgagatcgccctggtgagattcctggtgtgggaccacgaccccatcggcagagacttcgtgggccagagaaccgtgaccttcagcagcctggtgcccggctacagacacgtgtacctggagggcctgaccgaggccagcatcttcgtgcacatcaccatcaacgagatctacggcaagtggagccccctgatcctgaaccccagctacaccatcctgcacttcctgggcgccaccaagaacagacagctgcagggcctgaagggcctgttcaacaagaaccccagacacagcagcagcgagaacaacagccactacgtgagaaagagaagcatcggcgacagaatcctgagaagaaccgccagcgcccccgccaagggcagaaagaagagcaagatgggcttccaggagatggtggagatcaaggacagcgtgagcgaggccaccagagaccaggacggcgtgctgagaagaaccaccagaagcctgcaggccagacccgtgagcatgcccgtggacagaaacctgctgggcgccctgagcctgcccgtgagcgagaccgccaaggacatcgagggcaaggagaacagcctggtgcagatctag

SEQ ID NO: 93326 - DNA, 4968 bp, Artificial Sequence; identical to SEQ ID NO: 93322
  Description of Artificial Sequence: Synthetic coding sequence

SEQ ID NO: 93327 - DNA, 3045 bp, Artificial Sequence
  Description of Artificial Sequence: Synthetic coding sequence
atggccgacctggaggtgtacaagaacctgagccccgagaaggtggagagatgcatgagcgtgatgcagagcggcacccagatgatcaagctgaagagaggcaccaagggcctggtgagactgttctacctggacgagcacagaaccagactgagatggagacccagcagaaagagcgagaaggccaagatcctgatcgacagcatctacaaggtgaccgagggcagacagagcgagatcttccacagacaggccgagggcaacttcgaccccagctgctgcttcaccatctaccacggcaaccacatggagagcctggacctgatcaccagcaaccccgaggaggccagaacctggatcaccggcctgaagtacctgatggccggcatcagcgacgaggacagcctggccaagagacagagaacccacgaccagtgggtgaagcagaccttcgaggaggccgacaagaacggcgacggcctgctgaacatcgaggagatccaccagctgatgcacaagctgaacgtgaacctgcccagaagaaaggtgagacagatgttccaggaggccgacaccgacgagaaccagggcaccctgaccttcgaggagttctgcgtgttctacaagatgatgagcctgagaagagacctgtacctgctgctgctgagctacagcgacaagaaggaccacctgaccgtggaggagctggcccagttcctgaaggtggagcagaagatgaacaacgtgaccaccgactactgcctggacatcatcaagaagttcgaggtgagcgaggagaacaaggtgaagaacgtgctgggcatcgagggcttcaccaacttcatgagaagccccgcctgcgacatcttcaaccccctgcaccacgaggtgtaccaggacatggaccagcccctgtgcaactactacatcgccagcagccacaacacctacctgaccggcgaccagctgctgagccagagcaaggtggacatgtacgccagagtgctgcaggagggctgcagatgcgtggaggtggactgctgggacggccccgacggcgagcccgtggtgcaccacggctacaccctgaccagcaagatcctgttcagagacgtggtggagaccatcaacaagcacgccttcgtgaagaacgagttccccgtgatcctgagcatcgagaaccactgcagcatccagcagcagagaaagatcgcccagtacctgaagggcatcttcggcgacaagctggacctgagcagcgtggacaccggcgagtgcaagcagctgcccagcccccagagcctgaagggcaagatcctggtgaagggcaagaagctgccctaccacctgggcgacgacgccgaggagggcgaggtgagcgacgaggacagcgccgacgagatcgaggacgagtgcaagttcaagctgcactacagcaacggcaccaccgagcaccaggtggagagcttcatcagaaagaagctggagagcctgctgaaggagagccagatcagagacaaggaggaccccgacagcttcaccgtgagagccctgctgaaggccacccacgagggcctgaacgcccacctgaagcagagccccgacgtgaaggagagcggcaagaagagccacggcagaagcctgatgaccaacttcggcaagcacaagaagaccaccaagagcagaagcaagagctacagcaccgacgacgaggaggacacccagcagagcaccggcaaggagggcggccagctgtacagactgggcagaagaagaaagaccatgaagctgtgcagagagctgagcgacctggtggtgtacaccaacagcgtggccgcccaggacatcgtggacgacggcaccaccggcaacgtgctgagcttcagcgagaccagagcccaccaggtggtgcagcagaagagcgagcagttcatgatctacaaccagaagcagctgaccagaatctaccccagcgcctacagaatcgacagcagcaacttcaaccccctgccctactggaacgccggctgccagctggtggccctgaactaccagagcgagggcagaatgatgcagctgaacagagccaagttcaaggccaacggcaactgcggctacgtgctgaagccccagcagatgtgcaagggcaccttcaaccccttcagcggcgaccccctgcccgccaaccccaagaagcagctgatcctgaaggtgatcagcggccagcagctgcccaagccccccgacagcatgttcggcgacagaggcgagatcatcgaccccttcgtggaggtggagatcatcggcctgcccgtggactgctgcaaggaccagaccagagtggtggacgacaacggcttcaaccccgtgtgggaggagaccctgaccttcaccgtgcacatgcccgagatcgccctggtgagattcctggtgtgggaccacgaccccatcggcagagacttcgtgggccagagaaccgtgaccttcagcagcctggtgcccggctacagacacgtgtacctggagggcctgaccgaggccagcatcttcgtgcacatcaccatcaacgagatctacggcaagaacagacagctgcagggcctgaagggcctgttcaacaagaaccccagacacagcagcagcgagaacaacagccactacgtgagaaagagaagcatcggcgacagaatcctgagaagaaccgccagcgcccccgccaagggcagaaagaagagcaagatgggcttccaggagatggtggagatcaaggacagcgtgagcgaggccaccagagaccaggacggcgtgctgagaagaaccaccagaagcctgcaggccagacccgtgagcatgcccgtggacagaaacctgctgggcgccctgagcctgcccgtgagcgagaccgccaaggacatcgagggcaaggagaacagcctggacagcagcttctgcagacccaccgagcaggccaaggccgagatgtgcaaggtgcccttccccagacagctggagtgcgtgatgaagatggagatcagcgagacctag

SEQ ID NO: 93328 - DNA, 3507 bp, Artificial Sequence
  Description of Artificial Sequence: Synthetic coding sequence
atgttcagagaggccgacaccgacgaccaccagggcaccctgggcttcgaggagttctgcgccttctacaagatgatgagcaccagaagagacctgtacctgctgatgctgacctacagcaaccacaaggaccacctggacgccgccagcctgcagagattcctgcaggtggagcagaagatggccggcgtgaccctggagagctgccaggacatcatcgagcagttcgagccctgccccgagaacaagagcaagggcctgctgggcatcgacggcttcaccaactacaccagaagccccgccggcgacatcttcaaccccgagcaccaccacgtgcaccaggacatgacccagcccctgagccactacttcatcaccagcagccacaacacctacctggtgggcgaccagctgatgagccagagcagagtggacatgtacgcctgggtgctgcaggccggctgcagatgcgtggaggtggactgctgggacggccccgacggcgagcccatcgtgcaccacggctacaccctgaccagcaagatcctgttcaaggacgtgatcgagaccatcaacaagtacgccttcatcaagaacgagtaccccgtgatcctgagcatcgagaaccactgcagcgtgatccagcagaagaagatggcccagtacctgaccgacatcctgggcgacaagctggacctgagcagcgtgagcagcgaggacgccaccaccctgcccagcccccagatgctgaagggcaagatcctggtgaagggcaagaagctgcccgccaacatcagcgaggacgccgaggagggcgaggtgagcgacgaggacagcgccgacgagatcgacgacgactgcaagctgctgaacggcgacgccagcaccaacagaaagagagtggagaacaccgccaagagaaagctggacagcctgatcaaggagagcaagatcagagactgcgaggaccccaacaacttcagcgtgagcaccctgagccccagcggcaagctgggcagaaagagcaaggccgaggaggacgtggagagcggcgaggacgccggcgccagcagaagaaacggcagactggtggtgggcagcttcagcagaagaaagaagaagggcagcaagctgaagaaggccgccagcgtggaggagggcgacgagggccaggacagccccggcggccagagcagaggcgccaccagacagaagaagaccatgaagctgagcagagccctgagcgacctggtgaagtacaccaagagcgtggccacccacgacatcgagatggaggccgccagcagctggcaggtgagcagcttcagcgagaccaaggcccaccagatcctgcagcagaagcccgcccagtacctgagattcaaccagcagcagctgagcagaatctaccccagcagctacagagtggacagcagcaactacaacccccagcccttctggaacgccggctgccagatgggcgtgttcaaccccaacagcgaggaccccctgcccggccagctgaagaagcagctggtgctgagaatcatcagcggccagcagctgcccaagcccagagacagcatgctgggcgacagaggcgagatcatcgaccccttcgtggaggtggagatcatcggcctgcccgtggactgcagcagagagcagaccagagtggtggacgacaacggcttcaaccccacctgggaggagaccctggtgttcatggtgcacatgcccgagatcgccctggtgagattcctggtgtgggaccacgaccccatcggcagagacttcatcggccagagaaccctggccttcagcagcatgatgcccggctacagacacgtgtacctggagggcatggaggaggccagcatcttcgtgcacgtggccgtgagcgacatcagcggcaaggtgaagcaggccctgggcctgaagggcctgttcctgagaggccccaagcccggcagcctggacagccacgccgccggcagaccccccgccagacccagcgtgagccagagaatcctgagaagaaccgccagcgcccccaccaagagccagaagcccggcagaagaggcttccccgagctggtgctgggcaccagagacaccggcagcaagggcgtggccgacgacgtggtgccccccggccccggccccgcccccgaggcccccgcccaggagggccccggcagcggcagccccagagacaccagacccctgagcacccagagacccctgccccccctgtgcagcctggagaccatcgccgaggagcccgcccccggccccggcccccccccccccgccgccgtgcccaccagcagcagccagggcagacccccctaccccaccggccccggcgccaacgtggccagccccctggaggacaccgaggagcccagagacagcagacccagaccctgcaacggcgagggcgccggcggcgcctacgagagagcccccggcagccagaccgacggcagaagccagcccagaaccctgggccacctgcccgtgatcagaagagtgaagagcgagggccaggtgcccaccgagcccctgggcggctggagacccctggccgcccccttccccgcccccgccgtgtacagcgacgccaccggcagcgaccccctgtggcagagactggagccctgcggccacagagacagcgtgagcagcagcagcagcatgagcagcagcgacaccgtgatcgacctgagcctgcccagcctgggcctgggcagaagcagagagaacctggccggcgcccacatgggcagactgccccccagaccccacagcgccagcgccgccagacccgacctgccccccgtgaccaagagcaagagcaaccccaacctgagagccaccggccagagaccccccatccccgacgagctgcagcccagaagcctggcccccagaatggccggcctgcccttcagacccccctggggctgcctgagcctggtgggcgtgcaggactgccccgtggccgccaagagcaagagcctgggcgacctgaccgccgacgacttcgcccccagcttcgagggcggcagcagaagactgagccacagcctgggcctgcccggcggcaccagaagagtgagcggccccggcgtgagaagagacaccctgaccgagcagctgagatggctgaccgtgttccagcaggccggcgacatcaccagccccaccagcctgggccccgccggcgagggcgtggccggcggccccggcttcgtgagaagaagcagcagcagaagccacagcagagtgagagccatcgccagcagagccagacaggcccaggagagacagcagagactgcagggcctgggcagacagggcccccccgaggaggagagaggcacccccgagggcgcctgcagcgtgggccacgagggcagcgtggacgcccccgcccccagcaagggcgccctgggccccgccagcgccgccgccgagaacctggtgctgctgagactgtag

SEQ ID NO: 93329 - DNA, 1500 bp, Artificial Sequence
  Description of Artificial Sequence: Synthetic coding sequence
atgggcgccatgcaggagggcatgcagatggtgaagctgagaggcggcagcaagggcctggtgagattctactacctggacgagcacagaagctgcatcagatggagacccagcagaaagaacgagaaggccaagatcagcatcgacagcatccaggaggtgagcgagggcagacagagcgaggtgttccagagataccccgacggcagcttcatcatcgaccccttcgtggaggtggagatcatcggcctgcccgtggactgcagcagagagcagaccagagtggtggacgacaacggcttcaaccccacctgggaggagaccctggtgttcatggtgcacatgcccgagatcgccctggtgagattcctggtgtgggaccacgaccccatcggcagagacttcatcggccagagaaccctggccttcagcagcatgatgcccggctacagacacgtgtacctggagggcatggaggaggccagcatcttcgtgcacgtggccgtgagcgacatcagcggcaaggtgaagcaggccctgggcctgaagggcctgttcctgagaggccccaagcccggcagcctggacagccacgccgccggcagaccccccgccagacccagcgtgagccagagaatcctgagaagaaccgccagcgcccccaccaagagccagaagcccggcagaagaggcttccccgagctggtgctgggcaccagagacaccggcagcaagggcgtggccgacgacgtggtgccccccggccccggccccgcccccgaggcccccgcccaggagggccccggcagcggcagccccagaggcaaggcccccgccgccgtggccgagaagagccccgtgagagtgagaccccccagagtgctggacggccccggccccgccggcatggccgccacctgcatgaagtgcgtggtgggcagctgcgccggcgtgaacaccggcggcctgcagagagagagaccccccagccccggccccgccagcagacaggccgccatcagacagcagcccagagccagagccgacagcctgggcgccccctgctgcggcctggacccccacgccatccccggcagaagcagagaggcccccaagggccccggcgcctggagacagggccccggcggcagcggcagcatgagcagcgacagcagcagccccgacagccccggcatccccgagagaagccccagatggcccgagggcgcctgcagacagcccggcgccctgcagggcgagatgagcgccctgttcgcccagaagctggaggagatcagaagcaagagccccatgttcagcgccggcaagcccctgctgccctgcgtggtgctgccccacgcccccggcatggccggccccggcagccccgccgccgccagcgcctggaccgtgagccccagagtgctggtgctggtggccctgtacccctggcactgcctgagaggcaccctgctgccctggctggcctgcggcccctag

SEQ ID NO: 93330 - DNA, 3177 bp, Artificial Sequence
  Description of Artificial Sequence: Synthetic coding sequence
atggccggcatcagcgacgaggacagcctggccagaagacagagaaccagagaccagtggctgaagcagaccttcgacgaggccgacaagaacggcgacggcagcctgagcatcggcgaggtgctgcagctgctgcacaagctgaacgtgaacctgcccagacagagagtgaagcagatgttcagagaggccgacaccgacgaccaccagggcaccctgggcttcgaggagttctgcgccttctacaagatgatgagcaccagaagagacctgtacctgctgatgctgacctacagcaaccacaaggaccacctggacgccgccagcctgcagagattcctgcaggtggagcagaagatggccggcgtgaccctggagagctgccaggacatcatcgagcagttcgagccctgccccgagaacaagagcaagggcctgctgggcatcgacggcttcaccaactacaccagaagccccgccggcgacatcttcaaccccgagcaccaccacgtgcaccaggacatgacccagcccctgagccactacttcatcaccagcagccacaacacctacctggtgggcgaccagctgatgagccagagcagagtggacatgtacgcctgggtgctgcaggccggctgcagatgcgtggaggtggactgctgggacggccccgacggcgagcccatcgtgcaccacggctacaccctgaccagcaagatcctgttcaaggacgtgatcgagaccatcaacaagtacgccttcatcaagaacgagtaccccgtgatcctgagcatcgagaaccactgcagcgtgatccagcagaagaagatggcccagtacctgaccgacatcctgggcgacaagctggacctgagcagcgtgagcagcgaggacgccaccaccctgcccagcccccagatgctgaagggcaagatcctggtgaagggcaagaagctgcccgccaacatcagcgaggacgccgaggagggcgaggtgagcgacgaggacagcgccgacgagatcgacgacgactgcaagctgctgaacggcgacgccagcaccaacagaaagagagtggagaacaccgccaagagaaagctggacagcctgatcaaggagagcaagatcagagactgcgaggaccccaacaacttcagcgtgagcaccctgagccccagcggcaagctgggcagaaagagcaaggccgaggaggacgtggagagcggcgaggacgccggcgccagcagaagaaacggcagactggtggtgggcagcttcagcagaagaaagaagaagggcagcaagctgaagaaggccgccagcgtggaggagggcgacgagggccaggacagccccggcggccagagcagaggcgccaccagacagaagaagaccatgaagctgagcagagccctgagcgacctggtgaagtacaccaagagcgtggccacccacgacatcgagatggaggccgccagcagctggcaggtgagcagcttcagcgagaccaaggcccaccagatcctgcagcagaagcccgcccagtacctgagattcaaccagcagcagctgagcagaatctaccccagcagctacagagtggacagcagcaactacaacccccagcccttctggaacgccggctgccagatggtggccctgaactaccagagcgagggcagaatgctgcagctgaacagagccaagttcagcgccaacggcggctgcggctacgtgctgaagcccggctgcatgtgccagggcgtgttcaaccccaacagcgaggaccccctgcccggccagctgaagaagcagctggtgctgagaatcatcagcggccagcagctgcccaagcccagagacagcatgctgggcgacagaggcgagatcatcgaccccttcgtggaggtggagatcatcggcctgcccgtggactgcagcagagagcagaccagagtggtggacgacaacggcttcaaccccacctgggaggagaccctggtgttcatggtgcacatgcccgagatcgccctggtgagattcctggtgtgggaccacgaccccatcggcagagacttcatcggccagagaaccctggccttcagcagcatgatgcccggctacagacacgtgtacctggagggcatggaggaggccagcatcttcgtgcacgtggccgtgagcgacatcagcggcaaggtgaagcaggccctgggcctgaagggcctgttcctgagaggccccaagcccggcagcctggacagccacgccgccggcagaccccccgccagacccagcgtgagccagagaatcctgagaagaaccgccagcgcccccaccaagagccagaagcccggcagaagaggcttccccgagctggtgctgggcaccagagacaccggcagcaagggcgtggccgacgacgtggtgccccccggccccggccccgcccccgaggcccccgcccaggagggccccggcagcggcagccccagaggcaaggcccccgccgccgtggccgagaagagccccgtgagagtgagaccccccagagtgctggacggccccggccccgccggcatggccgccacctgcatgaagtgcgtggtgggcagctgcgccggcgtgaacaccggcggcctgcagagagagagaccccccagccccggccccgccagcagacaggccgccatcagacagcagcccagagccagagccgacagcctgggcgccccctgctgcggcctggacccccacgccatccccggcagaagcagagaggcccccaagggccccggcgcctggagacagggccccggcggcagcggcagcatgagcagcgacagcagcagccccgacagccccggcatccccgagagaagccccagatggcccgagggcgcctgcagacagcccggcgccctgcagggcgagatgagcgccctgttcgcccagaagctggaggagatcagaagcaagagccccatgttcagcgccggcaagcccctgctgccctgcgtggtgctgccccacgcccccggcatggccggccccggcagccccgccgccgccagcgcctggaccgtgagccccagagtgctggtgctggtggccctgtacccctggcactgcctgagaggcaccctgctgccctggctggcctgcggcccctag

SEQ ID NO: 93331 - DNA, 1494 bp, Artificial Sequence
  Description of Artificial Sequence: Synthetic coding sequence
atgggcgccatgcaggagggcatgcagatggtgaagctgagaggcggcagcaagggcctggtgagattctactacctggacgagcacagaagctgcatcagatggagacccagcagaaagaacgagaaggccaagatcagcatcgacagcatccaggaggtgagcgagggcagacagagcgaggtgttccagagataccccgacggcagcttcgaccccttcgtggaggtggagatcatcggcctgcccgtggactgcagcagagagcagaccagagtggtggacgacaacggcttcaaccccacctgggaggagaccctggtgttcatggtgcacatgcccgagatcgccctggtgagattcctggtgtgggaccacgaccccatcggcagagacttcatcggccagagaaccctggccttcagcagcatgatgcccggctacagacacgtgtacctggagggcatggaggaggccagcatcttcgtgcacgtggccgtgagcgacatcagcggcaaggtgaagcaggccctgggcctgaagggcctgttcctgagaggccccaagcccggcagcctggacagccacgccgccggcagaccccccgccagacccagcgtgagccagagaatcctgagaagaaccgccagcgcccccaccaagagccagaagcccggcagaagaggcttccccgagctggtgctgggcaccagagacaccggcagcaagggcgtggccgacgacgtggtgccccccggccccggccccgcccccgaggcccccgcccaggagggccccggcagcggcagccccagaggcaaggcccccgccgccgtggccgagaagagccccgtgagagtgagaccccccagagtgctggacggccccggccccgccggcatggccgccacctgcatgaagtgcgtggtgggcagctgcgccggcgtgaacaccggcggcctgcagagagagagaccccccagccccggccccgccagcagacaggccgccatcagacagcagcccagagccagagccgacagcctgggcgccccctgctgcggcctggacccccacgccatccccggcagaagcagagaggcccccaagggccccggcgcctggagacagggccccggcggcagcggcagcatgagcagcgacagcagcagccccgacagccccggcatccccgagagaagccccagatggcccgagggcgcctgcagacagcccggcgccctgcagggcgagatgagcgccctgttcgcccagaagctggaggagatcagaagcaagagccccatgttcagcgccggcaagcccctgctgccctgcgtggtgctgccccacgcccccggcatggccggccccggcagccccgccgccgccagcgcctggaccgtgagccccagagtgctggtgctggtggccctgtacccctggcactgcctgagaggcaccctgctgccctggctggcctgcggcccctag

SEQ ID NO: 93332 - DNA, 4251 bp, Artificial Sequence
  Description of Artificial Sequence: Synthetic coding sequence
atgagcggcccctggcccagccccgacagcagaaccaagggcaccgtggcctggctggccgaggtgctgctgtgggtgggcggcagcgtggtgctgagcagcgagtggcagctgggccccctggtggagagatgcatgggcgccatgcaggagggcatgcagatggtgaagctgagaggcggcagcaagggcctggtgagattctactacctggacgagcacagaagctgcatcagatggagacccagcagaaagaacgagaaggccaagatcagcatcgacagcatccaggaggtgagcgagggcagacagagcgaggtgttccagagataccccgacggcagcttcgaccccaactgctgcttcagcatctaccacggcagccacagagagagcctggacctggtgagcaccagcagcgaggtggccagaacctgggtgaccggcctgagatacctgatggccggcatcagcgacgaggacagcctggccagaagacagagaaccagagaccagtggctgaagcagaccttcgacgaggccgacaagaacggcgacggcagcctgagcatcggcgaggtgctgcagctgctgcacaagctgaacgtgaacctgcccagacagagagtgaagcagatgttcagagaggccgacaccgacgaccaccagggcaccctgggcttcgaggagttctgcgccttctacaagatgatgagcaccagaagagacctgtacctgctgatgctgacctacagcaaccacaaggaccacctggacgccgccagcctgcagagattcctgcaggtggagcagaagatggccggcgtgaccctggagagctgccaggacatcatcgagcagttcgagccctgccccgagaacaagagcaagggcctgctgggcatcgacggcttcaccaactacaccagaagccccgccggcgacatcttcaaccccgagcaccaccacgtgcaccaggacatgacccagcccctgagccactacttcatcaccagcagccacaacacctacctggtgggcgaccagctgatgagccagagcagagtggacatgtacgcctgggtgctgcaggccggctgcagatgcgtggaggtggactgctgggacggccccgacggcgagcccatcgtgcaccacggctacaccctgaccagcaagatcctgttcaaggacgtgatcgagaccatcaacaagtacgccttcatcaagaacgagtaccccgtgatcctgagcatcgagaaccactgcagcgtgatccagcagaagaagatggcccagtacctgaccgacatcctgggcgacaagctggacctgagcagcgtgagcagcgaggacgccaccaccctgcccagcccccagatgctgaagggcaagatcctggtgaagggcaagaagctgcccgccaacatcagcgaggacgccgaggagggcgaggtgagcgacgaggacagcgccgacgagatcgacgacgactgcaagctgctgaacggcgacgccagcaccaacagaaagagagtggagaacaccgccaagagaaagctggacagcctgatcaaggagagcaagatcagagactgcgaggaccccaacaacttcagcgtgagcaccctgagccccagcggcaagctgggcagaaagagcaaggccgaggaggacgtggagagcggcgaggacgccggcgccagcagaagaaacggcagactggtggtgggcagcttcagcagaagaaagaagaagggcagcaagctgaagaaggccgccagcgtggaggagggcgacgagggccaggacagccccggcggccagagcagaggcgccaccagacagaagaagaccatgaagctgagcagagccctgagcgacctggtgaagtacaccaagagcgtggccacccacgacatcgagatggaggccgccagcagctggcaggtgagcagcttcagcgagaccaaggcccaccagatcctgcagcagaagcccgcccagtacctgagattcaaccagcagcagctgagcagaatctaccccagcagctacagagtggacagcagcaactacaacccccagcccttctggaacgccggctgccagatggtggccctgaactaccagagcgagggcagaatgctgcagctgaacagagccaagttcagcgccaacggcggctgcggctacgtgctgaagcccggctgcatgtgccagggcgtgttcaaccccaacagcgaggaccccctgcccggccagctgaagaagcagctggtgctgagaatcatcagcggccagcagctgcccaagcccagagacagcatgctgggcgacagaggcgagatcatcgaccccttcgtggaggtggagatcatcggcctgcccgtggactgcagcagagagcagaccagagtggtggacgacaacggcttcaaccccacctgggaggagaccctggtgttcatggtgcacatgcccgagatcgccctggtgagattcctggtgtgggaccacgaccccatcggcagagacttcatcggccagagaaccctggccttcagcagcatgatgcccggctacagacacgtgtacctggagggcatggaggaggccagcatcttcgtgcacgtggccgtgagcgacatcagcggcaaggtgaagcaggccctgggcctgaagggcctgttcctgagaggccccaagcccggcagcctggacagccacgccgccggcagaccccccgccagacccagcgtgagccagagaatcctgagaagaaccgccagcgcccccaccaagagccagaagcccggcagaagaggcttccccgagctggtgctgggcaccagagacaccggcagcaagggcgtggccgacgacgtggtgccccccggccccggccccgcccccgaggcccccgcccaggagggccccggcagcggcagccccagagacaccagacccctgagcacccagagacccctgccccccctgtgcagcctggagaccatcgccgaggagcccgcccccggccccggcccccccccccccgccgccgtgcccaccagcagcagccagggcagacccccctaccccaccggccccggcgccaacgtggccagccccctggaggacaccgaggagcccagagacagcagacccagaccctgcaacggcgagggcgccggcggcgcctacgagagagcccccggcagccagaccgacggcagaagccagcccagaaccctgggccacctgcccgtgatcagaagagtgaagagcgagggccaggtgcccaccgagcccctgggcggctggagacccctggccgcccccttccccgcccccgccgtgtacagcgacgccaccggcagcgaccccctgtggcagagactggagccctgcggccacagagacagcgtgagcagcagcagcagcatgagcagcagcgacaccgtgatcgacctgagcctgcccagcctgggcctgggcagaagcagagagaacctggccggcgcccacatgggcagactgccccccagaccccacagcgccagcgccgccagacccgacctgccccccgtgaccaagagcaagagcaaccccaacctgagagccaccggccagagaccccccatccccgacgagctgcagcccagaagcctggcccccagaatggccggcctgcccttcagacccccctggggctgcctgagcctggtgggcgtgcaggactgccccgtggccgccaagagcaagagcctgggcgacctgaccgccgacgacttcgcccccagcttcgagggcggcagcagaagactgagccacagcctgggcctgcccggcggcaccagaagagtgagcggccccggcgtgagaagagacaccctgaccgagcagctgagatggctgaccgtgttccagcaggccggcgacatcaccagccccaccagcctgggccccgccggcgagggcgtggccggcggccccggcttcgtgagaagaagcagcagcagaagccacagcagagtgagagccatcgccagcagagccagacaggcccaggagagacagcagagactgcagggcctgggcagacagggcccccccgaggaggagagaggcacccccgagggcgcctgcagcgtgggccacgagggcagcgtggacgcccccgcccccagcaagggcgccctgggccccgccagcgccgccgccgagaacctggtgctgctgagactgtag

SEQ ID NO: 93333 - DNA, 4143 bp, Artificial Sequence
  Description of Artificial Sequence: Synthetic coding sequence
atgagcggcccctggcccagccccgacagcagaaccaagggcaccgtggcctggctggccgaggtgctgctgtgggtgggcggcagcgtggtgctgagcagcgagtggcagctgggccccctggtggagagatgcatgggcgccatgcaggagggcatgcagatggtgaagctgagaggcggcagcaagggcctggtgagattctactacctggacgagcacagaagctgcatcagatggagacccagcagaaagaacgagaaggccaagatcagcatcgacagcatccaggaggtgagcgagggcagacagagcgaggtgttccagagataccccgacggcagcttcgaccccaactgctgcttcagcatctaccacggcagccacagagagagcctggacctggtgagcaccagcagcgaggtggccagaacctgggtgaccggcctgagatacctgatggccggcatcagcgacgaggacagcctggccagaagacagagaaccagagaccagtggctgaagcagaccttcgacgaggccgacaagaacggcgacggcagcctgagcatcggcgaggtgctgcagctgctgcacaagctgaacgtgaacctgcccagacagagagtgaagcagatgttcagagaggccgacaccgacgaccaccagggcaccctgggcttcgaggagttctgcgccttctacaagatgatgagcaccagaagagacctgtacctgctgatgctgacctacagcaaccacaaggaccacctggacgccgccagcctgcagagattcctgcaggtggagcagaagatggccggcgtgaccctggagagctgccaggacatcatcgagcagttcgagccctgccccgagaacaagagcaagggcctgctgggcatcgacggcttcaccaactacaccagaagccccgccggcgacatcttcaaccccgagcaccaccacgtgcaccaggacatgacccagcccctgagccactacttcatcaccagcagccacaacacctacctggtgggcgaccagctgatgagccagagcagagtggacatgtacgcctgggtgctgcaggccggctgcagatgcgtggaggtggactgctgggacggccccgacggcgagcccatcgtgcaccacggctacaccctgaccagcaagatcctgttcaaggacgtgatcgagaccatcaacaagtacgccttcatcaagaacgagtaccccgtgatcctgagcatcgagaaccactgcagcgtgatccagcagaagaagatggcccagtacctgaccgacatcctgggcgacaagctggacctgagcagcgtgagcagcgaggacgccaccaccctgcccagcccccagatgctgaagggcaagatcctggtgaagggcaagaagctgcccgccaacatcagcgaggacgccgaggagggcgaggtgagcgacgaggacagcgccgacgagatcgacgacgactgcaagctgctgaacggcgacgccagcaccaacagaaagagagtggagaacaccgccaagagaaagctggacagcctgatcaaggagagcaagatcagagactgcgaggaccccaacaacttcagcgtgagcaccctgagccccagcggcaagctgggcagaaagagcaaggccgaggaggacgtggagagcggcgaggacgccggcgccagcagaagaaacggcagactggtggtgggcagcttcagcagaagaaagaagaagggcagcaagctgaagaaggccgccagcgtggaggagggcgacgagggccaggacagccccggcggccagagcagaggcgccaccagacagaagaagaccatgaagctgagcagagccctgagcgacctggtgaagtacaccaagagcgtggccacccacgacatcgagatggaggccgccagcagctggcaggtgagcagcttcagcgagaccaaggcccaccagatcctgcagcagaagcccgcccagtacctgagattcaaccagcagcagctgagcagaatctaccccagcagctacagagtggacagcagcaactacaacccccagcccttctggaacgccggctgccagatgggcgtgttcaaccccaacagcgaggaccccctgcccggccagctgaagaagcagctggtgctgagaatcatcagcggccagcagctgcccaagcccagagacagcatgctgggcgacagaggcgagatcatcgaccccttcgtggaggtggagatcatcggcctgcccgtggactgcagcagagagcagaccagagtggtggacgacaacggcttcaaccccacctgggaggagaccctggtgttcatggtgcacatgcccgagatcgccctggtgagattcctggtgtgggaccacgaccccatcggcagagacttcatcggccagagaaccctggccttcagcagcatgatgcccggctacagacacgtgtacctggagggcatggaggaggccagcatcttcgtgcacgtggccgtgagcgacatcagcggcaaggtgaagcaggccctgggcctgaagggcctgttcctgagaggccccaagcccggcagcctggacagccacgccgccggcagaccccccgccagacccagcgtgagccagagaatcctgagaagaaccgccagcgcccccaccaagagccagaagcccggcagaagaggcttccccgagctggtgctgggcaccagagacaccggcagcaagggcgtggccgacgacgtggtgccccccggccccggccccgcccccgaggcccccgcccaggagggccccggcagcggcagccccagagacaccagacccctgagcacccagagacccctgccccccctgtgcagcctggagaccatcgccgaggagcccgcccccggccccggcccccccccccccgccgccgtgcccaccagcagcagccagggcagacccccctaccccaccggccccggcgccaacgtggccagccccctggaggacaccgaggagcccagagacagcagacccagaccctgcaacggcgagggcgccggcggcgcctacgagagagcccccggcagccagaccgacggcagaagccagcccagaaccctgggccacctgcccgtgatcagaagagtgaagagcgagggccaggtgcccaccgagcccctgggcggctggagacccctggccgcccccttccccgcccccgccgtgtacagcgacgccaccggcagcgaccccctgtggcagagactggagccctgcggccacagagacagcgtgagcagcagcagcagcatgagcagcagcgacaccgtgatcgacctgagcctgcccagcctgggcctgggcagaagcagagagaacctggccggcgcccacatgggcagactgccccccagaccccacagcgccagcgccgccagacccgacctgccccccgtgaccaagagcaagagcaaccccaacctgagagccaccggccagagaccccccatccccgacgagctgcagcccagaagcctggcccccagaatggccggcctgcccttcagacccccctggggctgcctgagcctggtgggcgtgcaggactgccccgtggccgccaagagcaagagcctgggcgacctgaccgccgacgacttcgcccccagcttcgagggcggcagcagaagactgagccacagcctgggcctgcccggcggcaccagaagagtgagcggccccggcgtgagaagagacaccctgaccgagcagctgagatggctgaccgtgttccagcaggccggcgacatcaccagccccaccagcctgggccccgccggcgagggcgtggccggcggccccggcttcgtgagaagaagcagcagcagaagccacagcagagtgagagccatcgccagcagagccagacaggcccaggagagacagcagagactgcagggcctgggcagacagggcccccccgaggaggagagaggcacccccgagggcgcctgcagcgtgggccacgagggcagcgtggacgcccccgcccccagcaagggcgccctgggccccgccagcgccgccgccgagaacctggtgctgctgagactgtag

SEQ ID NO: 93334 - DNA, 2136 bp, Artificial Sequence
  Description of Artificial Sequence: Synthetic coding sequence
tgagccctgaactaccagagcgagggcagaatgctgcagctgaacagagccaagttcagcgccaacggcggctgcggctacgtgctgaagcccggctgcatgtgccagggcgtgttcaaccccaacagcgaggaccccctgcccggccagctgaagaagcagctggtgctgagaatcatcagcggccagcagctgcccaagcccagagacagcatgctgggcgacagaggcgagatcatcgaccccttcgtggaggtggagatcatcggcctgcccgtggactgcagcagagagcagaccagagtggtggacgacaacggcttcaaccccacctgggaggagaccctggtgttcatggtgcacatgcccgagatcgccctggtgagattcctggtgtgggaccacgaccccatcggcagagacttcatcggccagagaaccctggccttcagcagcatgatgcccggctacagacacgtgtacctggagggcatggaggaggccagcatcttcgtgcacgtggccgtgagcgacatcagcggcaaggtgaagcaggccctgggcctgaagggcctgttcctgagaggccccaagcccggcagcctggacagccacgccgccggcagaccccccgccagacccagcgtgagccagagaatcctgagaagaaccgccagcgcccccaccaagagccagaagcccggcagaagaggcttccccgagctggtgctgggcaccagagacaccggcagcaagggcgtggccgacgacgtggtgccccccggccccggccccgcccccgaggcccccgcccaggagggccccggcagcggcagccccagagacaccagacccctgagcacccagagacccctgccccccctgtgcagcctggagaccatcgccgaggagcccgcccccggccccggcccccccccccccgccgccgtgcccaccagcagcagccagggcagacccccctaccccaccggccccggcgccaacgtggccagccccctggaggacaccgaggagcccagagacagcagacccagaccctgcaacggcgagggcgccggcggcgcctacgagagagcccccggcagccagaccgacggcagaagccagcccagaaccctgggccacctgcccgtgatcagaagagtgaagagcgagggccaggtgcccaccgagcccctgggcggctggagacccctggccgcccccttccccgcccccgccgtgtacagcgacgccaccggcagcgaccccctgtggcagagactggagccctgcggccacagagacagcgtgagcagcagcagcagcatgagcagcagcgacaccgtgatcgacctgagcctgcccagcctgggcctgggcagaagcagagagaacctggccggcgcccacatgggcagactgccccccagaccccacagcgccagcgccgccagacccgacctgccccccgtgaccaagagcaagagcaaccccaacctgagagccaccggccagagaccccccatccccgacgagctgcagcccagaagcctggcccccagaatggccggcctgcccttcagacccccctggggctgcctgagcctggtgggcgtgcaggactgccccgtggccgccaagagcaagagcctgggcgacctgaccgccgacgacttcgcccccagcttcgagggcggcagcagaagactgagccacagcctgggcctgcccggcggcaccagaagagtgagcggccccggcgtgagaagagacaccctgaccgagcagctgagatggctgaccgtgttccagcaggccggcgacatcaccagccccaccagcctgggccccgccggcgagggcgtggccggcggccccggcttcgtgagaagaagcagcagcagaagccacagcagagtgagagccatcgccagcagagccagacaggcccaggagagacagcagagactgcagggcctgggcagacagggcccccccgaggaggagagaggcacccccgagggcgcctgcagcgtgggccacgagggcagcgtggacgcccccgcccccagcaagggcgccctgggccccgccagcgccgccgccgagaacctggtgctgctgagactgtag

SEQ ID NO: 93335 - DNA, 3390 bp, Artificial Sequence
  Description of Artificial Sequence: Synthetic coding sequence
atggaggagcccggcccccccggcggcctgagccaggaccaggtggagagatgcatgggcgccatgcaggagggcatgcagatggtgaagctgagaggcggcagcaagggcctggtgagattctactacctggacgagcacagaagctgcatcagatggagacccagcagaaagaacgagaaggccaagatcagcatcgacagcatccaggaggtgagcgagggcagacagagcgaggtgttccagagataccccgacggcagcttcgaccccaactgctgcttcagcatctaccacggcagccacagagagagcctggacctggtgagcaccagcagcgaggtggccagaacctgggtgaccggcctgagatacctgatggccggcatcagcgacgaggacagcctggccagaagacagagaaccagagaccagtggctgaagcagaccttcgacgaggccgacaagaacggcgacggcagcctgagcatcggcgaggtgctgcagctgctgcacaagctgaacgtgaacctgcccagacagagagtgaagcagatgttcagagaggccgacaccgacgaccaccagggcaccctgggcttcgaggagttctgcgccttctacaagatgatgagcaccagaagagacctgtacctgctgatgctgacctacagcaaccacaaggaccacctggacgccgccagcctgcagagattcctgcaggtggagcagaagatggccggcgtgaccctggagagctgccaggacatcatcgagcagttcgagccctgccccgagaacaagagcaagggcctgctgggcatcgacggcttcaccaactacaccagaagccccgccggcgacatcttcaaccccgagcaccaccacgtgcaccaggacatgacccagcccctgagccactacttcatcaccagcagccacaacacctacctggtgggcgaccagctgatgagccagagcagagtggacatgtacgcctgggtgctgcaggccggctgcagatgcgtggaggtggactgctgggacggccccgacggcgagcccatcgtgcaccacggctacaccctgaccagcaagatcctgttcaaggacgtgatcgagaccatcaacaagtacgccttcatcaagaacgagtaccccgtgatcctgagcatcgagaaccactgcagcgtgatccagcagaagaagatggcccagtacctgaccgacatcctgggcgacaagctggacctgagcagcgtgagcagcgaggacgccaccaccctgcccagcccccagatgctgaagggcaagatcctggtgaagggcaagaagctgcccgccaacatcagcgaggacgccgaggagggcgaggtgagcgacgaggacagcgccgacgagatcgacgacgactgcaagctgctgaacggcgacgccagcaccaacagaaagagagtggagaacaccgccaagagaaagctggacagcctgatcaaggagagcaagatcagagactgcgaggaccccaacaacttcagcgtgagcaccctgagccccagcggcaagctgggcagaaagagcaaggccgaggaggacgtggagagcggcgaggacgccggcgccagcagaagaaacggcagactggtggtgggcagcttcagcagaagaaagaagaagggcagcaagctgaagaaggccgccagcgtggaggagggcgacgagggccaggacagccccggcggccagagcagaggcgccaccagacagaagaagaccatgaagctgagcagagccctgagcgacctggtgaagtacaccaagagcgtggccacccacgacatcgagatggaggccgccagcagctggcaggtgagcagcttcagcgagaccaaggcccaccagatcctgcagcagaagcccgcccagtacctgagattcaaccagcagcagctgagcagaatctaccccagcagctacagagtggacagcagcaactacaacccccagcccttctggaacgccggctgccagatggtggccctgaactaccagagcgagggcagaatgctgcagctgaacagagccaagttcagcgccaacggcggctgcggctacgtgctgaagcccggctgcatgtgccagggcgtgttcaaccccaacagcgaggaccccctgcccggccagctgaagaagcagctggtgctgagaatcatcagcggccagcagctgcccaagcccagagacagcatgctgggcgacagaggcgagatcatcgaccccttcgtggaggtggagatcatcggcctgcccgtggactgcagcagagagcagaccagagtggtggacgacaacggcttcaaccccacctgggaggagaccctggtgttcatggtgcacatgcccgagatcgccctggtgagattcctggtgtgggaccacgaccccatcggcagagacttcatcggccagagaaccctggccttcagcagcatgatgcccggctacagacacgtgtacctggagggcatggaggaggccagcatcttcgtgcacgtggccgtgagcgacatcagcggcaaggtgaagcaggccctgggcctgaagggcctgttcctgagaggccccaagcccggcagcctggacagccacgccgccggcagaccccccgccagacccagcgtgagccagagaatcctgagaagaaccgccagcgcccccaccaagagccagaagcccggcagaagaggcttccccgagctggtgctgggcaccagagacaccggcagcaagggcgtggccgacgacgtggtgccccccggccccggccccgcccccgaggcccccgcccaggagggccccggcagcggcagccccagaggcaaggcccccgccgccgtggccgagaagagccccgtgagagtgagaccccccagagtgctggacggccccggccccgccggcatggccgccacctgcatgaagtgcgtggtgggcagctgcgccggcgtgaacaccggcggcctgcagagagagagaccccccagccccggccccgccagcagacaggccgccatcagacagcagcccagagccagagccgacagcctgggcgccccctgctgcggcctggacccccacgccatccccggcagaagcagagaggcccccaagggccccggcgcctggagacagggccccggcggcagcggcagcatgagcagcgacagcagcagccccgacagccccggcatccccgagagaagccccagatggcccgagggcgcctgcagacagcccggcgccctgcagggcgagatgagcgccctgttcgcccagaagctggaggagatcagaagcaagagccccatgttcagcgccgtgagaaactag

SEQ ID NO: 93336 - DNA, 1827 bp, Artificial Sequence
  Description of Artificial Sequence: Synthetic coding sequence
atggagatgagatggttcctgagcaagatccaggacgacttcagaggcggcaagatcaacctggagaagacccagagactgctggagaagctggacatcagatgcagctacatccacgtgaagcagatcttcaaggacaacgacagactgaagcagggcagaatcaccatcgaggagttcagagccatctacagaatcatcacccacagagaggagatcatcgagatcttcaacacctacagcgagaacagaaagatcctgctggccagcaacctggcccagttcctgacccaggagcagtacgccgccgagatgagcaaggccatcgccttcgagatcatccagaagtacgagcccatcgaggaggtgagaaaggcccaccagatgagcctggagggcttcaccagatacatggacagcagagagtgcctgctgttcaagaacgagtgcagaaaggtgtaccaggacatgacccaccccctgaacgactacttcatcagcagcagccacaacacctacctggtgagcgaccagctgctgggccccagcgacctgtggggctacgtgagcgccctggtgaagggctgcagatgcctggagatcgactgctgggacggcgcccagaacgagcccgtggtgtaccacggctacaccctgaccagcaagctgctgttcaagaccgtgatccaggccatccacaagtacgccttcatgaccagcgactaccccgtggtgctgagcctggagaaccactgcagcaccgcccagcaggaggtgatggccgacaacctgcaggccaccttcggcgagagcctgctgagcgacatgctggacgacttccccgacaccctgcccagccccgaggccctgaagttcaagatcctggtgaagaacaagaagatcggcaccctgaaggagacccacgagagaaagggcagcgacaagagaggcgacaaccaggacaaggagaccggcgtgaagaagctgcccggcgtgatgctgttcaagaagaagaagaccagaaagctgaagatcgccctggccctgagcgacctggtgatctacaccaaggccgagaagttcaagagcttccagcacagcagactgtaccagcagttcaacgagaacaacagcatcggcgagacccaggccagaaagctgagcaagctgagagtgcacgagttcatcttccacaccagaaagttcatcaccagaatctaccccaaggccaccagagccgacagcagcaacttcaacccccaggagttctggaacatcggctgccagatggtggccctgaacttccagacccccggcctgcccatggacctgcagaacggcaagttcctggacaacggcggcagcggctacatcctgaagccccacttcctgagagagagcaagagctacttcaaccccagcaacatcaaggagggcatgcccatcaccctgaccatcagactgatcagcggcatccagctgcccctgacccacagcagcagcaacaagggcgacagcctggtgatcatcgaggtgttcggcgtgcccaacgaccagatgaagcagcagaccagagtgatcaagaagaacgccttcagccccagatggaacgagaccttcaccttcatcatccacgtgcccgagctggccctgatcagattcgtggtggagggccagggcctgatcgccggcaacgagttcctgggccagtacaccctgcccctgctgtgcatgaacaagggctacagaagaatccccctgttcagcagaatgggcgagagcctggagcccgccagcctgttcgtgtacgtgtggtacgtgagatag

SEQ ID NO: 93337 - DNA, 1242 bp, Artificial Sequence
  Description of Artificial Sequence: Synthetic coding sequence
atgagatggttcctgagcaagatccaggacgacttcagaggcggcaagatcaacctggagaagacccagagactgctggagaagctggacatcagatgcagctacatccacgtgaagcagatcttcaagaccagcgactaccccgtggtgctgagcctggagaaccactgcagcaccgcccagcaggaggtgatggccgacaacctgcaggccaccttcggcgagagcctgctgagcgacatgctggacgacttccccgacaccctgcccagccccgaggccctgaagttcaagatcctggtgaagaacaagaagatcggcaccctgaaggagacccacgagagaaagggcagcgacaagagaggcgacaaccaggacaaggagaccggcgtgaagaagctgcccggcgtgatgctgttcaagaagaagaagaccagaaagctgaagatcgccctggccctgagcgacctggtgatctacaccaaggccgagaagttcaagagcttccagcacagcagactgtaccagcagttcaacgagaacaacagcatcggcgagacccaggccagaaagctgagcaagctgagagtgcacgagttcatcttccacaccagaaagttcatcaccagaatctaccccaaggccaccagagccgacagcagcaacttcaacccccaggagttctggaacatcggctgccagatggtggccctgaacttccagacccccggcctgcccatggacctgcagaacggcaagttcctggacaacggcggcagcggctacatcctgaagccccacttcctgagagagagcaagagctacttcaaccccagcaacatcaaggagggcatgcccatcaccctgaccatcagactgatcagcggcatccagctgcccctgacccacagcagcagcaacaagggcgacagcctggtgatcatcgaggtgttcggcgtgcccaacgaccagatgaagcagcagaccagagtgatcaagaagaacgccttcagccccagatggaacgagaccttcaccttcatcatccacgtgcccgagctggccctgatcagattcgtggtggagggccagggcctgatcgccggcaacgagttcctgggccagtacaccctgcccctgctgtgcatgaacaagggctacagaagaatccccctgttcagcagaatgggcgagagcctggagcccgccagcctgttcgtgtacgtgtggtacgtgagatag

SEQ ID NO: 93338 - DNA, 1821 bp, Artificial Sequence
  Description of Artificial Sequence: Synthetic coding sequence
atgagatggttcctgagcaagatccaggacgacttcagaggcggcaagatcaacctggagaagacccagagactgctggagaagctggacatcagatgcagctacatccacgtgaagcagatcttcaaggacaacgacagactgaagcagggcagaatcaccatcgaggagttcagagccatctacagaatcatcacccacagagaggagatcatcgagatcttcaacacctacagcgagaacagaaagatcctgctggccagcaacctggcccagttcctgacccaggagcagtacgccgccgagatgagcaaggccatcgccttcgagatcatccagaagtacgagcccatcgaggaggtgagaaaggcccaccagatgagcctggagggcttcaccagatacatggacagcagagagtgcctgctgttcaagaacgagtgcagaaaggtgtaccaggacatgacccaccccctgaacgactacttcatcagcagcagccacaacacctacctggtgagcgaccagctgctgggccccagcgacctgtggggctacgtgagcgccctggtgaagggctgcagatgcctggagatcgactgctgggacggcgcccagaacgagcccgtggtgtaccacggctacaccctgaccagcaagctgctgttcaagaccgtgatccaggccatccacaagtacgccttcatgaccagcgactaccccgtggtgctgagcctggagaaccactgcagcaccgcccagcaggaggtgatggccgacaacctgcaggccaccttcggcgagagcctgctgagcgacatgctggacgacttccccgacaccctgcccagccccgaggccctgaagttcaagatcctggtgaagaacaagaagatcggcaccctgaaggagacccacgagagaaagggcagcgacaagagaggcgacaaccaggacaaggagaccggcgtgaagaagctgcccggcgtgatgctgttcaagaagaagaagaccagaaagctgaagatcgccctggccctgagcgacctggtgatctacaccaaggccgagaagttcaagagcttccagcacagcagactgtaccagcagttcaacgagaacaacagcatcggcgagacccaggccagaaagctgagcaagctgagagtgcacgagttcatcttccacaccagaaagttcatcaccagaatctaccccaaggccaccagagccgacagcagcaacttcaacccccaggagttctggaacatcggctgccagatggtggccctgaacttccagacccccggcctgcccatggacctgcagaacggcaagttcctggacaacggcggcagcggctacatcctgaagccccacttcctgagagagagcaagagctacttcaaccccagcaacatcaaggagggcatgcccatcaccctgaccatcagactgatcagcggcatccagctgcccctgacccacagcagcagcaacaagggcgacagcctggtgatcatcgaggtgttcggcgtgcccaacgaccagatgaagcagcagaccagagtgatcaagaagaacgccttcagccccagatggaacgagaccttcaccttcatcatccacgtgcccgagctggccctgatcagattcgtggtggagggccagggcctgatcgccggcaacgagttcctgggccagtacaccctgcccctgctgtgcatgaacaagggctacagaagaatccccctgttcagcagaatgggcgagagcctggagcccgccagcctgttcgtgtacgtgtggtacgtgagatag

SEQ ID NO: 93339 - DNA, 1248 bp, Artificial Sequence
  Description of Artificial Sequence: Synthetic coding sequence
atggagatgagatggttcctgagcaagatccaggacgacttcagaggcggcaagatcaacctggagaagacccagagactgctggagaagctggacatcagatgcagctacatccacgtgaagcagatcttcaagaccagcgactaccccgtggtgctgagcctggagaaccactgcagcaccgcccagcaggaggtgatggccgacaacctgcaggccaccttcggcgagagcctgctgagcgacatgctggacgacttccccgacaccctgcccagccccgaggccctgaagttcaagatcctggtgaagaacaagaagatcggcaccctgaaggagacccacgagagaaagggcagcgacaagagaggcgacaaccaggacaaggagaccggcgtgaagaagctgcccggcgtgatgctgttcaagaagaagaagaccagaaagctgaagatcgccctggccctgagcgacctggtgatctacaccaaggccgagaagttcaagagcttccagcacagcagactgtaccagcagttcaacgagaacaacagcatcggcgagacccaggccagaaagctgagcaagctgagagtgcacgagttcatcttccacaccagaaagttcatcaccagaatctaccccaaggccaccagagccgacagcagcaacttcaacccccaggagttctggaacatcggctgccagatggtggccctgaacttccagacccccggcctgcccatggacctgcagaacggcaagttcctggacaacggcggcagcggctacatcctgaagccccacttcctgagagagagcaagagctacttcaaccccagcaacatcaaggagggcatgcccatcaccctgaccatcagactgatcagcggcatccagctgcccctgacccacagcagcagcaacaagggcgacagcctggtgatcatcgaggtgttcggcgtgcccaacgaccagatgaagcagcagaccagagtgatcaagaagaacgccttcagccccagatggaacgagaccttcaccttcatcatccacgtgcccgagctggccctgatcagattcgtggtggagggccagggcctgatcgccggcaacgagttcctgggccagtacaccctgcccctgctgtgcatgaacaagggctacagaagaatccccctgttcagcagaatgggcgagagcctggagcccgccagcctgttcgtgtacgtgtggtacgtgagatag

SEQ ID NO: 93340 - DNA, 1212 bp, Artificial Sequence
  Description of Artificial Sequence: Synthetic coding sequence
atggacagcagagagtgcctgctgttcaagaacgagtgcagaaaggtgtaccaggacatgacccaccccctgaacgactacttcatcagcagcagccacaacacctacctggtgagcgaccagctgctgggccccagcgacctgtggggctacgtgagcgccctggtgaagggctgcagatgcctggagatcgactgctgggacggcgcccagaacgagcccgtggtgtaccacggctacaccctgaccagcaagctgctgttcaagaccgtgatccaggccatccacaagtacgccttcatgaccagcgactaccccgtggtgctgagcctggagaaccactgcagcaccgcccagcaggaggtgatggccgacaacctgcaggccaccttcggcgagagcctgctgagcgacatgctggacgacttccccgacaccctgcccagccccgaggccctgaagttcaagatcctggtgaagaacaagaagatcggcaccctgaaggagacccacgagagaaagggcagcgacaagagaggcgacaaccaggacaaggagaccggcgtgaagaagctgcccggcgtgatgctgttcaagaagaagaagaccagaaagctgaagatcgccctggccctgagcgacctggtgatctacaccaaggccgagaagttcaagagcttccagcacagcagactgtaccagcagttcaacgagaacaacagcatcggcgagacccaggccagaaagctgagcaagctgagagtgcacgagttcatcttccacaccagaaagttcatcaccagaatctaccccaaggccaccagagccgacagcagcaacttcaacccccaggagttctggaacatcggctgccagatggtggccctgaacttccagacccccggcctgcccatggacctgcagaacggcaagttcctggacaacggcggcagcggctacatcctgaagccccacttcctgagagagagcaagagctacttcaaccccagcaacatcaaggagggcatgcccatcaccctgaccatcagactgatcagcggcatccagctgcccctgacccacagcagcagcaacaagggcgacagcctggtgatcatcgaggtgttcggcgtgcccaacgaccagatgaagcagcagaccagagtgatcaagaagaacggccagggcaacatggtgatcatccccgcctag

SEQ ID NO: 93341 - DNA, 3387 bp, Artificial Sequence
  Description of Artificial Sequence: Synthetic coding sequence
atggccgactgcgtgagaggctgggccgccgtgggcggcgccctgcccaccagccccggccccagcctgggcgccaagggcgccctgaaggccggcgtgggcgaggacggcgtgggcggcggcagactggtgcacggcagagccagatacgacagcggcggcgtgagcaacggcgactgcagcctgggcgtgagcggcgacgaggccagagccagccccaccagaggccccagaggcgtggccctggcccccacccccagcgccgtggtgtgcaccctgcccagagagagcaagcccggcggcctgcccagaagaagcagcatcatcaaggacggcaccaagcagaagagagagagaaagaagaccgtgagcttcagcagcatgcccaccgagaagaagatcagcagcgccagcgactgcatcaacagcatggtggagggcagcgagctgaagaaggtgagaagcaacagcagaatctaccacagatacttcctgctggacgccgacatgcagagcctgagatgggagcccagcaagaaggacagcgagaaggccaagatcgacatcaagagcatcaaggaggtgagaaccggcaagaacaccgacatcttcagaagcaacggcatcagcgaccagatcagcgaggactgcgccttcagcgtgatctacggcgagaactacgagagcctggacctggtggccaacagcgccgacgtggccaacatctgggtgaccggcctgagatacctgatcagctacggcaagcacaccctggacatgctggagagcagccaggacaacatgagaaccagctgggtgagccagatgttcagcgagatcgacgtggacaacctgggccacatcaccctgtgcaacgccgtgcagtgcatcagaaacctgaaccccggcctgaagaccagcaagatcgagctgaagttcaaggagctgcacaagagcaaggacaaggccggcaccgaggtgaccaaggaggagttcatcgaggtgttccacgagctgtgcaccagacccgagatctacttcctgctggtgcagttcagcagcaacaaggagttcctggacaccaaggacctgatgatgttcctggaggccgagcagggcgtggcccacatcaacgaggagatcagcctggagatcatccacaagtacgagcccagcaaggagggccaggagaagggctggctgagcatcgacggcttcaccaactacctgatgagccccgactgctacatcttcgaccccgagcacaagaaggtgtgccaggacatgaagcagcccctgagccactacttcatcaacagcagccacaacacctacctgatcgaggaccagttcagaggccccagcgacatcaccggctacatcagagccctgaagatgggctgcagaagcgtggagctggacgtgtgggacggccccgacaacgagcccgtgatctacaccggccacaccatgaccagccagatcgtgttcagaagcgtgatcgacatcatcaacaagtacgccttcttcgccagcgagtaccccctgatcctgtgcctggagaaccactgcagcatcaagcagcagaaggtgatggtgcagcacatgaagaagctgctgggcgacaagctgtacaccaccagccccaacgtggaggagagctacctgcccagccccgacgtgctgaagggcaagatcctgatcaaggccaagaagctgagcagcaactgcagcggcgtggagggcgacgtgaccgacgaggacgagggcgccgagatgagccagagaatgggcaaggagaacatggagcagcccaacaacgtgcccgtgaagagattccagctgtgcaaggagctgagcgagctggtgagcatctgcaagagcgtgcagttcaaggagttccaggtgagcttccaggtgcagaagtactgggaggtgtgcagcttcaacgaggtgctggccagcaagtacgccaacgagaaccccggcgacttcgtgaactacaacaagagattcctggccagagtgttccccagccccatgagaatcgacagcagcaacatgaacccccaggacttctggaagtgcggctgccagatcgtggccatgaacttccagacccccggcctgatgatggacctgaacatcggctggttcagacagaacggcaactgcggctacgtgctgagacccgccatcatgagagaggaggtgagcttcttcagcgccaacaccaaggacagcgtgcccggcgtgagcccccagctgctgcacatcaagatcatcagcggccagaacttccccaagcccaagggcagcggcgccaagggcgacgtggtggacccctacgtgtacgtggagatccacggcatccccgccgactgcgccgagcagagaaccaagaccgtgcaccagaacggcgacgcccccatcttcgacgagagcttcgagttccagatcaacctgcccgagctggccatggtgagattcgtggtgctggacgacgactacatcggcgacgagttcatcggccagtacaccatccccttcgagtgcctgcagaccggctacagacacgtgcccctgcagagcctgaccggcgaggtgctggcccacgccagcctgttcgtgcacgtggccatcaccaacagaagaggcggcggcaagccccacaagagaggcctgagcgtgagaaagggcaagaagagcagagagtacgccagcctgagaaccctgtggatcaagaccgtggacgaggtgttcaagaacgcccagccccccatcagagacgccaccgacctgagagagaacatgcagaacgccgtggtgagcttcaaggagctgtgcggcctgagcagcgtggccaacctgatgcagtgcatgctggccgtgagccccagattcctgggccccgacaacacccccctggtggtgctgaacctgagcgagcagtaccccaccatggagctgcagggcatcgtgcccgaggtgctgaagaagatcgtgaccacctacgacatgatgatccagagcctgaaggccctgatcgagaacgccgacgccgtgtacgagaagatcgtgcactgccagaaggccgccatggagttccacgagcacctgcacagcatcggcaccaaggagggcctgaaggagagaaagctgcagaaggccgtggagagcttcacctggaacatcaccatcctgaagggccaggccgacctgctgaagtacgccaagaacgagaccctggagaacctgaagcagatccacttcgccgccgtgagctgcggcctgaacaagcccggcaccgagaacgccgacgtgcagaagcccagaagaagcctggaggtgatccccgagaaggccaacgacgagaccggcgagtag

SEQ ID NO: 93342 - DNA, 2883 bp, Artificial Sequence
  Description of Artificial Sequence: Synthetic coding sequence
atgcccaccgagaagaagatcagcagcgccagcgactgcatcaacagcatggtggagggcagcgagctgaagaaggtgagaagcaacagcagaatctaccacagatacttcctgctggacgccgacatgcagagcctgagatgggagcccagcaagaaggacagcgagaaggccaagatcgacatcaagagcatcaaggaggtgagaaccggcaagaacaccgacatcttcagaagcaacggcatcagcgaccagatcagcgaggactgcgccttcagcgtgatctacggcgagaactacgagagcctggacctggtggccaacagcgccgacgtggccaacatctgggtgaccggcctgagatacctgatcagctacggcaagcacaccctggacatgctggagagcagccaggacaacatgagaaccagctgggtgagccagatgttcagcgagatcgacgtggacaacctgggccacatcaccctgtgcaacgccgtgcagtgcatcagaaacctgaaccccggcctgaagaccagcaagatcgagctgaagttcaaggagctgcacaagagcaaggacaaggccggcaccgaggtgaccaaggaggagttcatcgaggtgttccacgagctgtgcaccagacccgagatctacttcctgctggtgcagttcagcagcaacaaggagttcctggacaccaaggacctgatgatgttcctggaggccgagcagggcgtggcccacatcaacgaggagatcagcctggagatcatccacaagtacgagcccagcaaggagggccaggagaagggctggctgagcatcgacggcttcaccaactacctgatgagccccgactgctacatcttcgaccccgagcacaagaaggtgtgccaggacatgaagcagcccctgagccactacttcatcaacagcagccacaacacctacctgatcgaggaccagttcagaggccccagcgacatcaccggctacatcagagccctgaagatgggctgcagaagcgtggagctggacgtgtgggacggccccgacaacgagcccgtgatctacaccggccacaccatgaccagccagatcgtgttcagaagcgtgatcgacatcatcaacaagtacgccttcttcgccagcgagtaccccctgatcctgtgcctggagaaccactgcagcatcaagcagcagaaggtgatggtgcagcacatgaagaagctgctgggcgacaagctgtacaccaccagccccaacgtggaggagagctacctgcccagccccgacgtgctgaagggcaagatcctgatcaaggccaagaagctgagcagcaactgcagcggcgtggagggcgacgtgaccgacgaggacgagggcgccgagatgagccagagaatgggcaaggagaacatggagcagcccaacaacgtgcccgtgaagagattccagctgtgcaaggagctgagcgagctggtgagcatctgcaagagcgtgcagttcaaggagttccaggtgagcttccaggtgcagaagtactgggaggtgtgcagcttcaacgaggtgctggccagcaagtacgccaacgagaaccccggcgacttcgtgaactacaacaagagattcctggccagagtgttccccagccccatgagaatcgacagcagcaacatgaacccccaggacttctggaagtgcggctgccagatcgtggccatgaacttccagacccccggcctgatgatggacctgaacatcggctggttcagacagaacggcaactgcggctacgtgctgagacccgccatcatgagagaggaggtgagcttcttcagcgccaacaccaaggacagcgtgcccggcgtgagcccccagctgctgcacatcaagatcatcagcggccagaacttccccaagcccaagggcagcggcgccaagggcgacgtggtggacccctacgtgtacgtggagatccacggcatccccgccgactgcgccgagcagagaaccaagaccgtgcaccagaacggcgacgcccccatcttcgacgagagcttcgagttccagatcaacctgcccgagctggccatggtgagattcgtggtgctggacgacgactacatcggcgacgagttcatcggccagtacaccatccccttcgagtgcctgcagaccggctacagacacgtgcccctgcagagcctgaccggcgaggtgctggcccacgccagcctgttcgtgcacgtggccatcaccaacagaagaggcggcggcaagccccacaagagaggcctgagcgtgagaaagggcaagaagagcagagagtacgccagcctgagaaccctgtggatcaagaccgtggacgaggtgttcaagaacgcccagccccccatcagagacgccaccgacctgagagagaacatgcagaacgccgtggtgagcttcaaggagctgtgcggcctgagcagcgtggccaacctgatgcagtgcatgctggccgtgagccccagattcctgggccccgacaacacccccctggtggtgctgaacctgagcgagcagtaccccaccatggagctgcagggcatcgtgcccgaggtgctgaagaagatcgtgaccacctacgacatgatgatccagagcctgaaggccctgatcgagaacgccgacgccgtgtacgagaagatcgtgcactgccagaaggccgccatggagttccacgagcacctgcacagcatcggcaccaaggagggcctgaaggagagaaagctgcagaaggccgtggagagcttcacctggaacatcaccatcctgaagatcagaaagaccggcagaagaagcatcttcgtgccccagacccccatcatggtgtag

SEQ ID NO: 93343 - DNA, 3006 bp, Artificial Sequence
  Description of Artificial Sequence: Synthetic coding sequence
atgcccaccgagaagaagatcagcagcgccagcgactgcatcaacagcatggtggagggcagcgagctgaagaaggtgagaagcaacagcagaatctaccacagatacttcctgctggacgccgacatgcagagcctgagatgggagcccagcaagaaggacagcgagaaggccaagatcgacatcaagagcatcaaggaggtgagaaccggcaagaacaccgacatcttcagaagcaacggcatcagcgaccagatcagcgaggactgcgccttcagcgtgatctacggcgagaactacgagagcctggacctggtggccaacagcgccgacgtggccaacatctgggtgaccggcctgagatacctgatcagctacggcaagcacaccctggacatgctggagagcagccaggacaacatgagaaccagctgggtgagccagatgttcagcgagatcgacgtggacaacctgggccacatcaccctgtgcaacgccgtgcagtgcatcagaaacctgaaccccggcctgaagaccagcaagatcgagctgaagttcaaggagctgcacaagagcaaggacaaggccggcaccgaggtgaccaaggaggagttcatcgaggtgttccacgagctgtgcaccagacccgagatctacttcctgctggtgcagttcagcagcaacaaggagttcctggacaccaaggacctgatgatgttcctggaggccgagcagggcgtggcccacatcaacgaggagatcagcctggagatcatccacaagtacgagcccagcaaggagggccaggagaagggctggctgagcatcgacggcttcaccaactacctgatgagccccgactgctacatcttcgaccccgagcacaagaaggtgtgccaggacatgaagcagcccctgagccactacttcatcaacagcagccacaacacctacctgatcgaggaccagttcagaggccccagcgacatcaccggctacatcagagccctgaagatgggctgcagaagcgtggagctggacgtgtgggacggccccgacaacgagcccgtgatctacaccggccacaccatgaccagccagatcgtgttcagaagcgtgatcgacatcatcaacaagtacgccttcttcgccagcgagtaccccctgatcctgtgcctggagaaccactgcagcatcaagcagcagaaggtgatggtgcagcacatgaagaagctgctgggcgacaagctgtacaccaccagccccaacgtggaggagagctacctgcccagccccgacgtgctgaagggcaagatcctgatcaaggccaagaagctgagcagcaactgcagcggcgtggagggcgacgtgaccgacgaggacgagggcgccgagatgagccagagaatgggcaaggagaacatggagcagcccaacaacgtgcccgtgaagagattccagctgtgcaaggagctgagcgagctggtgagcatctgcaagagcgtgcagttcaaggagttccaggtgagcttccaggtgcagaagtactgggaggtgtgcagcttcaacgaggtgctggccagcaagtacgccaacgagaaccccggcgacttcgtgaactacaacaagagattcctggccagagtgttccccagccccatgagaatcgacagcagcaacatgaacccccaggacttctggaagtgcggctgccagatcgtggccatgaacttccagacccccggcctgatgatggacctgaacatcggctggttcagacagaacggcaactgcggctacgtgctgagacccgccatcatgagagaggaggtgagcttcttcagcgccaacaccaaggacagcgtgcccggcgtgagcccccagctgctgcacatcaagatcatcagcggccagaacttccccaagcccaagggcagcggcgccaagggcgacgtggtggacccctacgtgtacgtggagatccacggcatccccgccgactgcgccgagcagagaaccaagaccgtgcaccagaacggcgacgcccccatcttcgacgagagcttcgagttccagatcaacctgcccgagctggccatggtgagattcgtggtgctggacgacgactacatcggcgacgagttcatcggccagtacaccatccccttcgagtgcctgcagaccggctacagacacgtgcccctgcagagcctgaccggcgaggtgctggcccacgccagcctgttcgtgcacgtggccatcaccaacagaagaggcggcggcaagccccacaagagaggcctgagcgtgagaaagggcaagaagagcagagagtacgccagcctgagaaccctgtggatcaagaccgtggacgaggtgttcaagaacgcccagccccccatcagagacgccaccgacctgagagagaacatgcagaacgccgtggtgagcttcaaggagctgtgcggcctgagcagcgtggccaacctgatgcagtgcatgctggccgtgagccccagattcctgggccccgacaacacccccctggtggtgctgaacctgagcgagcagtaccccaccatggagctgcagggcatcgtgcccgaggtgctgaagaagatcgtgaccacctacgacatgatgatccagagcctgaaggccctgatcgagaacgccgacgccgtgtacgagaagatcgtgcactgccagaaggccgccatggagttccacgagcacctgcacagcatcggcaccaaggagggcctgaaggagagaaagctgcagaaggccgtggagagcttcacctggaacatcaccatcctgaagggccaggccgacctgctgaagtacgccaagaacgagaccctggagaacctgaagcagatccacttcgccgccgtgagctgcggcctgaacaagcccggcaccgagaacgccgacgtgcagaagcccagaagaagcctggaggtgatccccgagaaggccaacgacgagaccggcgagtag

SEQ ID NO: 93344 - DNA, 3006 bp, Artificial Sequence; identical to SEQ ID NO: 93343
  Description of Artificial Sequence: Synthetic coding sequence

SEQ ID NO: 93345 - DNA, 2802 bp, Artificial Sequence
  Description of Artificial Sequence: Synthetic coding sequence
atgaccgccacccccgagagcctgttccccaccggcgacgagctggacagcagccagctgcagatggagagcgacgaggtggacaccctgaaggagggcgaggaccccgccgacagaatgcaccccttcctggccatctacgagctgcagagcctgaaggtgcaccccctggtgttcgcccccggcgtgcccgtgaccgcccaggtggtgggcaccgagagatacaccagcggcagcaaggtgggcacctgcaccctgtacagcgtgagactgacccacggcgacttcagctggaccaccaagaagaagtacagacacttccaggagctgcacagagacctgctgagacacaaggtgctgatgagcctgctgcccctggccagattcgccgtggcctacagccccgccagagacgccggcaacagagagatgcccagcctgcccagagccggccccgagggcagcaccagacacgccgccagcaagcagaagtacctggagaactacctgaacagactgctgaccatgagcttctacagaaactaccacgccatgaccgagttcctggaggtgagccagctgagcttcatccccgacctgggcagaaagggcctggagggcatgatcagaaagagaagcggcggccacagagtgcccggcctgacctgctgcggcagagaccaggtgtgctacagatggagcaagagatggctggtggtgaaggacagcttcctgctgtacatgtgcctggagaccggcgccatcagcttcgtgcagctgttcgaccccggcttcgaggtgcaggtgggcaagagaagcaccgaggccagacacggcgtgagaatcgacaccagccacagaagcctgatcctgaagtgcagcagctacagacaggccagatggtgggcccaggagatcaccgagctggcccagggccccggcagagacttcctgcagctgcacagacacgacagctacgccccccccagacccggcaccctggccagatggttcgtgaacggcgccggctacttcgccgccgtggccgacgccatcctgagagcccaggaggagatcttcatcaccgactggtggctgagccccgaggtgtacctgaagagacccgcccacagcgacgactggagactggacatcatgctgaagagaaaggccgaggagggcgtgagagtgagcatcctgctgttcaaggaggtggagctggccctgggcatcaacagcggctacagcaagagagccctgatgctgctgcaccccaacatcaaggtgatgagacaccccgaccaggtgaccctgtgggcccaccacgagaagctgctggtggtggaccaggtggtggccttcctgggcggcctggacctggcctacggcagatgggacgacctgcactacagactgaccgacctgggcgacagcagcgagagcgccgccagccagccccccacccccagacccgacagccccgccacccccgacctgagccacaaccagttcttctggctgggcaaggactacagcaacctgatcaccaaggactgggtgcagctggacagacccttcgaggacttcatcgacagagagaccacccccagaatgccctggagagacgtgggcgtggtggtgcacggcctgcccgccagagacctggccagacacttcatccagagatggaacttcaccaagaccaccaaggccaagtacaagacccccacctacccctacctgctgcccaagagcaccagcaccgccaaccagctgcccttcaccctgcccggcggccagtgcaccaccgtgcaggtgctgagaagcgtggacagatggagcgccggcaccctggagaacagcatcctgaacgcctacctgcacaccatcagagagagccagcacttcctgtacatcgagaaccagttcttcatcagctgcagcgacggcagaaccgtgctgaacaaggtgggcgacgagatcgtggacagaatcctgaaggcccacaagcagggctggtgctacagagtgtacgtgctgctgcccctgctgcccggcttcgagggcgacatcagcaccggcggcggcaacagcatccaggccatcctgcacttcacctacagaaccctgtgcagaggcgagtacagcatcctgcacagactgaaggccgccatgggcaccgcctggagagactacatcagcatctgcggcctgagaacccacggcgagctgggcggccaccccgtgagcgagctgatctacatccacagcaaggtgctgatcgccgacgacagaaccgtgatcatcggcagcgccaacatcaacgacagaagcctgctgggcaagagagacagcgagctggccgtgctgatcgaggacaccgagaccgagcccagcctgatgaacggcgccgagtaccaggccggcagattcgccctgagcctgagaaagcactgcttcggcgtgatcctgggcgccaacaccagacccgacctggacctgagagaccccatctgcgacgacttcttccagctgtggcaggacatggccgagagcaacgccaacatctacgagcagatcttcagatgcctgcccagcaacgccaccagaagcctgagaaccctgagagagtacgtggccgtggagcccctggccaccgtgagcccccccctggccagaagcgagctgacccaggtgcagggccacctggtgcacttccccctgaagttcctggaggacgagagcctgctgccccccctgggcagcaaggagggcatgatccccctggaggtgtggacctag

SEQ ID NO: 93346 - DNA, 2769 bp, Artificial Sequence
  Description of Artificial Sequence: Synthetic coding sequence
atgaccgccacccccgagagcctgttccccaccggcgacgagctggacagcagccagctgcagatggagagcgacgaggtggacaccctgaaggagggcgaggaccccgccgacagaatgcaccccttcctggccatctacgagctgcagagcctgaaggtgcaccccctggtgttcgcccccggcgtgcccgtgaccgcccaggtggtgggcaccgagagatacaccagcggcagcaaggtgggcacctgcaccctgtacagcgtgagactgacccacggcgacttcagctggaccaccaagaagaagtacagacacttccaggagctgcacagagacctgctgagacacaaggtgctgatgagcctgctgcccctggccagattcgccgtggcctacagccccgccagagacgccggcaacagagagatgcccagcctgcccagagccggccccgagggcagcaccagacacgccgccagcaagcagaagtacctggagaactacctgaacagactgctgaccatgagcttctacagaaactaccacgccatgaccgagttcctggaggtgagccagctgagcttcatccccgacctgggcagaaagggcctggagggcatgatcagaaagagaagcggcggccacagagtgcccggcctgacctgctgcggcagagaccaggtgtgctacagatggagcaagagatggctggtggtgaaggacagcttcctgctgtacatgtgcctggagaccggcgccatcagcttcgtgcagctgttcgaccccggcttcgaggtgcaggtgggcaagagaagcaccgaggccagacacggcgtgagaatcgacaccagccacagaagcctgatcctgaagtgcagcagctacagacaggccagatggtgggcccaggagatcaccgagctggcccagggccccggcagagacttcctgcagctgcacagacacgacagctacgccccccccagacccggcaccctggccagatggttcgtgaacggcgccggctacttcgccgccgtggccgacgccatcctgagagcccaggaggagatcttcatcaccgactggtggctgagccccgaggtgtacctgaagagacccgcccacagcgacgactggagactggacatcatgctgaagagaaaggccgaggagggcgtgagagtgagcatcctgctgttcaaggaggtggagctggccctgggcatcaacagcggctacagcaagagagccctgatgctgctgcaccccaacatcaaggtgatgagacaccccgaccaggtgaccctgtgggcccaccacgagaagctgctggtggtggaccaggtggtggccttcctgggcggcctggacctggcctacggcagatgggacgacctgcactacagactgaccgacctgggcgacagcagcgagagcgccgccagccagccccccacccccagacccgacagccccgccacccccgacctgagccacaaccagttcttctggctgggcaaggactacagcaacctgatcaccaaggactgggtgcagctggacagacccttcgaggacttcatcgacagagagaccacccccagaatgccctggagagacgtgggcgtggtggtgcacggcctgcccgccagagacctggccagacacttcatccagagatggaacttcaccaagaccaccaaggccaagtacaagacccccacctacccctacctgctgcccaagagcaccagcaccgccaaccagctgcccttcaccctgcccggcggccagtgcaccaccgtgcaggtgctgagaagcgtggacagatggagcgccggcaccctggagaacagcatcctgaacgcctacctgcacaccatcagagagagccagcacttcctgtacatcgagaaccagttcttcatcagctgcagcgacggcagaaccgtgctgaacaaggtgggcgacgagatcgtggacagaatcctgaaggcccacaagcagggctggtgctacagagtgtacgtgctgctgcccctgctgcccggcttcgagggcgacatcagcaccggcggcggcaacagcatccaggccatcctgcacttcacctacagaaccctgtgcagaggcgagtacagcatcctgcacagactgaaggccgccatgggcaccgcctggagagactacatcagcatctgcggcctgagaacccacggcgagctgggcggccaccccgtgagcgagctgatctacatccacagcaaggtgctgatcgccgacgacagaaccgtgatcatcggcagcgccaacatcaacgacagaagcctgctgggcaagagagacagcgagctggccgtgctgatcgaggacaccgagaccgagcccagcctgatgaacggcgccgagtaccaggccggcagcgtgatcctgggcgccaacaccagacccgacctggacctgagagaccccatctgcgacgacttcttccagctgtggcaggacatggccgagagcaacgccaacatctacgagcagatcttcagatgcctgcccagcaacgccaccagaagcctgagaaccctgagagagtacgtggccgtggagcccctggccaccgtgagcccccccctggccagaagcgagctgacccaggtgcagggccacctggtgcacttccccctgaagttcctggaggacgagagcctgctgccccccctgggcagcaaggagggcatgatccccctggaggtgtggacctag

SEQ ID NO: 93347 - DNA, 957 bp, Artificial Sequence
  Description of Artificial Sequence: Synthetic coding sequence
atggacaagcagaacagccagatgaacgccagccaccccgagaccaacctgcccgtgggctaccccccccagtacccccccaccgccttccagggcccccccggctacagcggctaccccggcccccaggtgagctacccccccccccccgccggccacagcggccccggccccgccggcttccccgtgcccaaccagcccgtgtacaaccagcccgtgtacaaccagcccgtgggcgccgccggcgtgccctggatgcccgccccccagccccccctgaactgcccccccggcctggagtacctgagccagatcgaccagatcctgatccaccagcagatcgagctgctggaggtgctgaccggcttcgagaccaacaacaagtacgagatcaagaacagcttcggccagagagtgtacttcgccgccgaggacaccgactgctgcaccagaaactgctgcggccccagcagacccttcaccctgagaatcatcgacaacatgggccaggaggtgatcaccctggagagacccctgagatgcagcagctgctgctgcccctgctgcctgcaggagatcgagatccaggccccccccggcgtgcccatcggctacgtgatccagacctggcacccctgcctgcccaagttcaccatccagaacgagaagagagaggacgtgctgaagatcagcggcccctgcgtggtgtgcagctgctgcggcgacgtggacttcgagatcaagagcctggacgagcagtgcgtggtgggcaagatcagcaagcactggaccggcatcctgagagaggccttcaccgacgccgacaacttcggcatccagttccccctggacctggacgtgaagatgaaggccgtgatgatcggcgcctgcttcctgatcgacttcatgttcttcgagagcaccggcagccaggagcagaagagcggcgtgtggtag

SEQ ID NO: 93348 - DNA, 93 bp, Artificial Sequence
  Description of Artificial Sequence: Synthetic coding sequence
atgaaggccgtgatgatcggcgcctgcttcctgatcgacttcatgttcttcgagagcaccggcagccaggagcagaagagcggcgtgtggtag

SEQ ID NO: 93349 - DNA, 750 bp, Artificial Sequence
  Description of Artificial Sequence: Synthetic coding sequence
atggacaagcagaacagccagatgaacgccagccaccccgagaccaacctgcccgtgggctaccccccccagtacccccccaccgccttccagggcccccccggctacagcggctaccccggcccccaggtgagctacccccccccccccgccggccacagcggccccggccccgccggcttccccgtgcccaaccagcccgtgtacaaccagcccgtgtacaaccagcccgtgggcgccgccggcgtgccctggatgcccgccccccagccccccctgaactgcccccccggcctggagtacctgagccagatcgaccagatcctgatccaccagcagatcgagctgctggaggtgctgaccggcttcgagaccaacaacaagtacgagatcaagaacagcttcggccagagagtgtacttcgccgccgaggacaccgactgctgcaccagaaactgctgcggccccagcagacccttcaccctgagaatcatcgacaacatgggccaggaggtgatcaccctggagagacccctgagatgcagcagctgctgctgcccctgctgcctgcaggagatcgagatccaggccccccccggcgtgcccatcggctacgtgatccagacctggcacccctgcctgcccaagttcaccatccagaacgagaagagagaggacgtgctgaagatcagcggcccctgcgtggtgtgcagctgctgcggcgacgtggacttcgagatcaagagctag

SEQ ID NO: 93350 - DNA, 675 bp, Artificial Sequence
  Description of Artificial Sequence: Synthetic coding sequence
atgcccgccccccccccccccctgaactgcccccccggcctggagtacctgagccagatcgacatgatcctgatccaccagcagatcgagctgctggaggtgctgttcagcttcgagagcagcaacatgtacgagatcaagaacagcttcggccagagaatctacttcgccgccgaggacaccaacttctgcatcagaaactgctgcggcagaagcagacccttcaccctgagaatcaccgacaacgtgggcagagaggtgatcaccctggagagacccctgagatgcaactgctgctgctgcccctgctgcctgcaggagatcgagatccaggccccccccggcgtgcccgtgggctacgtgacccagacctggcacccctgcctgaccaagttcaccatcaagaaccagaagagagaggacgtgctgaagatcagcggcccctgcatcgtgtgcagctgcatcgccggcgtggacttcgagatcaccagcctggacgagcagatcgtggtgggcagaatcagcaagcactggagcggcttcctgagagaggccttcaccgacgccgacaacttcggcatccagttccccagagacctggacgtgaagatgaaggccgtgatgatcggcgcctgcttcctgatcgactacatgttcttcgagagaaccagatag

SEQ ID NO: 93351 - DNA, 486 bp, Artificial Sequence
  Description of Artificial Sequence: Synthetic coding sequence
atgcccgccccccccccccccctgaactgcccccccggcctggagtacctgagccagatcgacatgatcctgatccaccagcagatcgagctgctggaggtgctgttcagcttcgagagcagcaacatgtacgagatcaagaacagcttcggccagagaatctacttcgccgccgaggacaccaacttctgcatcagaaactgctgcggcagaagcagacccttcaccctgagaatcaccgacaacgtgggcagagaggtgatcaccctggagagacccctgagatgcaactgctgctgctgcccctgctgcctgcaggagatcgagatccaggccccccccggcgtgcccgtgggctacgtgacccagacctggcacccctgcctgaccaagttcaccatcaagaaccagaagagagaggacgtgctgaagatcagcggcccctgcatcgtgtgcagctgcatcgccggcgtggacttcgagtag

SEQ ID NO: 93352 - DNA, 894 bp, Artificial Sequence
  Description of Artificial Sequence: Synthetic coding sequence
atgagaagctggaacagcctgttctgcctgaacagcagcagaccccccggccacatcgtgtaccccaagcaccaggccggccacaccggcaagcaggccgaccacctgggcagccaggccttctaccccggcagacagcacgactacctggtgccccccgccggcaccgccggcatccccgtgcagaaccagcccggcagacccgagggcgtgccctggatgcccgccccccccccccccctgaactgcccccccggcctggagtacctgagccagatcgacatgatcctgatccaccagcagatcgagctgctggaggtgctgttcagcttcgagagcagcaacatgtacgagatcaagaacagcttcggccagagaatctacttcgccgccgaggacaccaacttctgcatcagaaactgctgcggcagaagcagacccttcaccctgagaatcaccgacaacgtgggcagagaggtgatcaccctggagagacccctgagatgcaactgctgctgctgcccctgctgcctgcaggagatcgagatccaggccccccccggcgtgcccgtgggctacgtgacccagacctggcacccctgcctgaccaagttcaccatcaagaaccagaagagagaggacgtgctgaagatcagcggcccctgcatcgtgtgcagctgcatcgccggcgtggacttcgagatcaccagcctggacgagcagatcgtggtgggcagaatcagcaagcactggagcggcttcctgagagaggccttcaccgacgccgacaacttcggcatccagttccccagagacctggacgtgaagatgaaggccgtgatgatcggcgcctgcttcctgatcgactacatgttcttcgagagaaccagatag

SEQ ID NO: 93353 - DNA, 951 bp, Artificial Sequence
  Description of Artificial Sequence: Synthetic coding sequence
gtgagcgcccacctgagattcttcctggccatcatcctgagagacagcggcctgtgggccgagtggagaatgaagcccttccagatccacctgcccggcccccccggccacatcgtgtaccccaagcaccaggccggccacaccggcaagcaggccgaccacctgggcagccaggccttctaccccggcagacagcacgactacctggtgccccccgccggcaccgccggcatccccgtgcagaaccagcccggcagacccgagggcgtgccctggatgcccgccccccccccccccctgaactgcccccccggcctggagtacctgagccagatcgacatgatcctgatccaccagcagatcgagctgctggaggtgctgttcagcttcgagagcagcaacatgtacgagatcaagaacagcttcggccagagaatctacttcgccgccgaggacaccaacttctgcatcagaaactgctgcggcagaagcagacccttcaccctgagaatcaccgacaacgtgggcagagaggtgatcaccctggagagacccctgagatgcaactgctgctgctgcccctgctgcctgcaggagatcgagatccaggccccccccggcgtgcccgtgggctacgtgacccagacctggcacccctgcctgaccaagttcaccatcaagaaccagaagagagaggacgtgctgaagatcagcggcccctgcatcgtgtgcagctgcatcgccggcgtggacttcgagatcaccagcctggacgagcagatcgtggtgggcagaatcagcaagcactggagcggcttcctgagagaggccttcaccgacgccgacaacttcggcatccagttccccagagacctggacgtgaagatgaaggccgtgatgatcggcgcctgcttcctgatcgactacatgttcttcgagagaaccagatag

SEQ ID NO: 93354 - DNA, 888 bp, Artificial Sequence
  Description of Artificial Sequence: Synthetic coding sequence
atggccggctacctgccccccaagggctacgcccccagccccccccccccctaccccgtgacccccggctaccccgagcccgccctgcaccccggccccggccaggcccccgtgcccgcccaggtgcccgcccccgcccccggcttcgccctgttccccagccccggccccgtggccctgggcagcgccgcccccttcctgcccctgcccggcgtgcccagcggcctggagttcctggtgcagatcgaccagatcctgatccaccagaaggccgagagagtggagaccttcctgggctgggagacctgcaacagatacgagctgagaagcggcgccggccagcccctgggccaggccgccgaggagagcaactgctgcgccagactgtgctgcggcgccagaagacccctgagagtgagactggccgaccccggcgacagagaggtgctgagactgctgagacccctgcactgcggctgcagctgctgcccctgcggcctgcaggagatggaggtgcaggccccccccggcaccaccatcggccacgtgctgcagacctggcaccccttcctgcccaagttcagcatccaggacgccgacagacagaccgtgctgagagtggtgggcccctgctggacctgcggctgcggcaccgacaccaacttcgaggtgaagaccagagacgagagcagaagcgtgggcagaatcagcaagcagtggggcggcctggtgagagaggccctgaccgacgccgacgacttcggcctgcagttccccctggacctggacgtgagagtgaaggccgtgctgctgggcgccaccttcctgatcgactacatgttcttcgagaagagaggcggcgccggccccagcgccgtgaccagctag

SEQ ID NO: 93355 - DNA, 672 bp, Artificial Sequence
  Description of Artificial Sequence: Synthetic coding sequence
atggccggctacctgccccccaagggctacgcccccagccccccccccccctaccccgtgacccccggctaccccgagcccgccctgcaccccggccccggccaggcccccgtgcccgcccaggtgcccgcccccgcccccggcttcgccctgttccccagccccggccccgtggccctgggcagcgccgcccccttcctgcccctgcccggcgtgcccagcggcctggagttcctggtgcagatcgaccagatcctgatccaccagaaggccgagagagtggagaccttcctgggctggagacccgtgatcggcatgaactgcgccctgggccccggcagcccctgggtgagaagacccagaagagccaccgccgcccccgtgtgcgccgtggcccccgccggcagatgcgtgagcgcctggcccacccccggcaccgtgagatgctgcgtgtgcagcgccagatgcaccgtggccgccgccgccgcccccgtggccagcagaagatggaagtacagactgcaccaggccccccccctggccacctgctacagacccggcatccccagcagccccagcagccccagcagaatgcccatcgccagacagagctgcgagtggtggggccccgccggccccgtggccgtggcccagacccccaccctgagatag

SEQ ID NO: 93356 - DNA, 888 bp, Artificial Sequence; identical to SEQ ID NO: 93354
  Description of Artificial Sequence: Synthetic coding sequence

SEQ ID NO: 93357 - DNA, 888 bp, Artificial Sequence; identical to SEQ ID NO: 93354
  Description of Artificial Sequence: Synthetic coding sequence

SEQ ID NO: 93358 - DNA, 990 bp, Artificial Sequence
  Description of Artificial Sequence: Synthetic coding sequence
atgagcggcgtggtgcccaccgcccccgagcagcccgccggcgagatggagaaccagaccaagccccccgaccccagacccgacgccccccccgagtacaacagccacttcctgcccggcccccccggcaccgccgtgcccccccccaccggctaccccggcggcctgcccatgggctactacagcccccagcagcccagcaccttccccctgtaccagcccgtgggcggcatccaccccgtgagataccagcccggcaagtaccccatgcccaaccagagcgtgcccatcacctggatgcccggccccacccccatggccaactgcccccccggcctggagtacctggtgcagctggacaacatccacgtgctgcagcacttcgagcccctggagatgatgacctgcttcgagaccaacaacagatacgacatcaagaacaacagcgaccagatggtgtacatcgtgaccgaggacaccgacgacttcaccagaaacgcctacagaaccctgagacccttcgtgctgagagtgaccgactgcatgggcagagagatcatgaccatgcagagacccttcagatgcacctgctgctgcttctgctgccccagcgccagacaggagctggaggtgcagtgcccccccggcgtgaccatcggcttcgtggccgagcactggaacctgtgcagagccgtgtacagcatccagaacgagaagaaggagaacgtgatgagagtgagaggcccctgcagcacctacggctgcggcagcgacagcgtgttcgaggtgaagagcctggacggcatcagcaacatcggcagcatcatcagaaagtggaacggcctgctgagcgccatggccgacgccgaccacttcgacatccacttccccctggacctggacgtgaagatgaaggccatgatcttcggcgcctgcttcctgatcgacttcatgtacttcgagagaagccccccccagagaagcagatag

SEQ ID NO: 93359 - DNA, 720 bp, Artificial Sequence
  Description of Artificial Sequence: Synthetic coding sequence
atgagcggcgtggtgcccaccgcccccgagcagcccgccggcgagatggagaaccagaccaagccccccgaccccagacccgacgccccccccgagtacaacagccacttcctgcccggcccccccggcaccgccgtgcccccccccaccggctaccccggcggcctgcccatgggctactacagcccccagcagcccagcaccttccccctgtaccagcccgtgggcggcatccaccccgtgagataccagcccggcaagtaccccatgcccaaccagagcgtgcccatcacctggatgcccggccccacccccatggccaactgcccccccggcctggagtacctggtgcagctggaggtgcagtgcccccccggcgtgaccatcggcttcgtggccgagcactggaacctgtgcagagccgtgtacagcatccagaacgagaagaaggagaacgtgatgagagtgagaggcccctgcagcacctacggctgcggcagcgacagcgtgttcgaggtgaagagcctggacggcatcagcaacatcggcagcatcatcagaaagtggaacggcctgctgagcgccatggccgacgccgaccacttcgacatccacttccccctggacctggacgtgaagatgaaggccatgatcttcggcgcctgcttcctgatcgacttcatgtacttcgagagaagccccccccagagaagcagatag

SEQ ID NO: 93360 - DNA, 990 bp, Artificial Sequence; identical to SEQ ID NO: 93358
  Description of Artificial Sequence: Synthetic coding sequence

SEQ ID NO: 93361 - DNA, 789 bp, Artificial Sequence
  Description of Artificial Sequence: Synthetic coding sequence
atgagcggcgtggtgcccaccgcccccgagcagcccgccggcgagatggagaaccagaccaagccccccgaccccagacccgacgccccccccgagtacaacagccacttcctgcccggcccccccggcaccgccgtgcccccccccaccggctaccccggcggcctgcccatgggctactacagcccccagcagcccagcaccttccccctgtaccagcccgtgggcggcatccaccccgtgagataccagcccggcaagtaccccatgcccaaccagagcgtgcccatcacctggatgcccggccccacccccatggccaactgcccccccggcctggagtacctggtgcagctggacaacatccacgtgctgcagcacttcgagcccctggagatgatgacctgcttcgagaccaacaacagatacgacatcaagaacaacagcgaccagatggtgtacatcgtgaccgaggacaccgacgacttcaccagaaacgcctacagaaccctgagacccttcgtgctgagagtgaccgactgcatgggcagagagatcatgaccatgcagagacccttcagatgcacctgctgctgcttctgctgccccagcgccagacaggagctggaggtgcagtgcccccccggcgtgaccatcggcttcgtggccgagcactggaacctgtgcagagccgtgtacagcatccagaacgagaagaaggagaacgtgatgagagtgagaggcccctgcagcacctacggctgcggcagcgacagcgtgttcgagtag

SEQ ID NO: 93362 - DNA, 627 bp, Artificial Sequence
  Description of Artificial Sequence: Synthetic coding sequence
atgagcggcgtggtgcccaccgcccccgagcagcccgccggcgagatggagaaccagaccaagccccccgaccccagacccgacgccccccccgagtacaacagccacttcctgcccggcccccccggcaccgccgtgcccccccccaccggctaccccggcggcctgcccatgggctactacagcccccagcagcccagcaccttccccctgtaccagcccgtgggcggcatccaccccgtgagataccagcccggcaagtaccccatgcccaaccagagcgtgcccatcacctggatgcccggccccacccccatggccaactgcccccccggcctggagtacctggtgcagctggacaacatccacgtgctgcagcacttcgagcccctggagatgatgacctgcttcgagaccaacaacagatacgacatcaagaacaacagcgaccagatggtgtacatcgtgaccgaggacaccgacgacttcaccagaaacgcctacagaaccctgagacccttcgtgctgagagtgaccgactgcatgggcagagagatcatgaccatgcagagacccttcagatgcacctgctgctgcttctgctgccccagcgccagacaggagtag

SEQ ID NO: 93363 - DNA, 429 bp, Artificial Sequence
  Description of Artificial Sequence: Synthetic coding sequence
atgagcggcgtggtgcccaccgcccccgagcagcccgccggcgagatggagaaccagaccaagccccccgaccccagacccgacgccccccccgagtacaacagccacttcctgcccggcccccccggcaccgccgtgcccccccccaccggctaccccggcggcctgcccatgggctactacagcccccagcagcccagcaccttccccctgtaccagcccgtgggcggcatccaccccgtgagataccagcccggcaagtaccccatgcccaaccagagcgtgcccatcacctggatgcccggccccacccccatggccaactgcccccccggcctggagtacctggtgcagctggacaacatccacgtgctgcagcacttcgagcccctggagatgatgacctgcttcgagaccaacaacagatag

SEQ ID NO: 93364 - DNA, 990 bp, Artificial Sequence; identical to SEQ ID NO: 93358
  Description of Artificial Sequence: Synthetic coding sequence

SEQ ID NO: 93365 - DNA, 297 bp, Artificial Sequence
  Description of Artificial Sequence: Synthetic coding sequence
atgagcggcgtggtgcccaccgcccccgagcagcccgccggcgagatggagaaccagaccaagccccccgaccccagacccgacgccccccccgagtacaacagccacttcctgcccggcccccccggcaccgccgtgcccccccccaccggctaccccggcggcctgcccatgggctactacagcccccagcagcccagcaccttccccctgtaccagcccgtgggcggcatccaccccgtgagataccagcccggcaagtaccccatgcccaaccagagcgtgcccatcacctag

SEQ ID NO: 93366 - DNA, 675 bp, Artificial Sequence
  Description of Artificial Sequence: Synthetic coding sequence
atggagaaccagaccaagccccccgaccccagacccgacgccccccccgagtacaacagccacttcctgcccggcccccccggcaccgccgtgcccccccccaccggctaccccggcggcctgcccatgggctactacagcccccagcagcccagcaccttccccctgtaccagcccgtgggcggcatccaccccgtgagataccagcccggcaagtaccccatgcccaaccagagcgtgcccatcacctggatgcccggccccacccccatggccaactgcccccccggcctggagtacctggtgcagctggaggtgcagtgcccccccggcgtgaccatcggcttcgtggccgagcactggaacctgtgcagagccgtgtacagcatccagaacgagaagaaggagaacgtgatgagagtgagaggcccctgcagcacctacggctgcggcagcgacagcgtgttcgaggtgaagagcctggacggcatcagcaacatcggcagcatcatcagaaagtggaacggcctgctgagcgccatggccgacgccgaccacttcgacatccacttccccctggacctggacgtgaagatgaaggccatgatcttcggcgcctgcttcctgatcgacttcatgtacttcgagagaagccccccccagagaagcagatag

SEQ ID NO: 93367 - DNA, 1326 bp, Artificial Sequence
  Description of Artificial Sequence: Synthetic coding sequence
atggccctgttcggcgccctgttcctggccctgctggccggcgcccacgccgagttccccggctgcaagatcagagtgaccagcaaggccctggagctggtgaagcaggagggcctgagattcctggagcaggagctggagaccatcaccatccccgacctgagaggcaaggagggccacttctactacaacatcagcgaggtgaaggtgaccgagctgcagctgaccagcagcgagctggacttccagccccagcaggagctgatgctgcagatcaccaacgccagcctgggcctgagattcagaagacagctgctgtactggttcctgaaggtgtacgacttcctgagcaccttcatcaccagcggcatgagattcctgctgaaccagcagatctgccccgtgctgtaccacgccggcaccgtgctgctgaacagcctgctggacaccgtgcccgtgagaagcagcgtggacgagctggtgggcatcgactacagcctgatgaaggaccccgtggccagcaccagcaacctggacatggacttcagaggcgccttcttccccctgaccgagagaaactggagcctgcccaacagagccgtggagccccagctgcaggaggaggagagaatggtgtacgtggccttcagcgagttcttcttcgacagcgccatggagagctacttcagagccggcgccctgcagctgctgctggtgggcgacaaggtgccccacgacctggacatgctgctgagagccacctacttcggcagcatcgtgctgctgagccccgccgtgatcgacagccccctgaagctggagctgagagtgctggccccccccagatgcaccatcaagcccagcggcaccaccatcagcgtgaccgccagcgtgaccatcgccctggtgccccccgaccagcccgaggtgcagctgagcagcatgaccatggacgccagactgagcgccaagatggccctgagaggcaaggccctgagaacccagctggacctgagaagattcagaatctacagcaaccacagcgccctggagagcctggccctgatccccctgcaggcccccctgaagaccatgctgcagatcggcgtgatgcccatgctgaacgagagaacctggagaggcgtgcagatccccctgcccgagggcatcaacttcgtgcacgaggtggtgaccaaccacgccggcttcctgaccatcggcgccgacctgcacttcgccaagggcctgagagaggtgatcgagaagaacagacccgccgacgtgagagccagcaccgcccccacccccagcaccgccgccgtgtag

SEQ ID NO: 93368 - DNA, 1482 bp, Artificial Sequence
  Description of Artificial Sequence: Synthetic coding sequence
atggccctgttcggcgccctgttcctggccctgctggccggcgcccacgccgagttccccggctgcaagatcagagtgaccagcaaggccctggagctggtgaagcaggagggcctgagattcctggagcaggagctggagaccatcaccatccccgacctgagaggcaaggagggccacttctactacaacatcagcgaggtgaaggtgaccgagctgcagctgaccagcagcgagctggacttccagccccagcaggagctgatgctgcagatcaccaacgccagcctgggcctgagattcagaagacagctgctgtactggttcttctacgacggcggctacatcaacgccagcgccgagggcgtgagcatcagaaccggcctggagctgagcagagaccccgccggcagaatgaaggtgagcaacgtgagctgccaggccagcgtgagcagaatgcacgccgccttcggcggcaccttcaagaaggtgtacgacttcctgagcaccttcatcaccagcggcatgagattcctgctgaaccagcagatctgccccgtgctgtaccacgccggcaccgtgctgctgaacagcctgctggacaccgtgcccgtgagaagcagcgtggacgagctggtgggcatcgactacagcctgatgaaggaccccgtggccagcaccagcaacctggacatggacttcagaggcgccttcttccccctgaccgagagaaactggagcctgcccaacagagccgtggagccccagctgcaggaggaggagagaatggtgtacgtggccttcagcgagttcttcttcgacagcgccatggagagctacttcagagccggcgccctgcagctgctgctggtgggcgacaaggtgccccacgacctggacatgctgctgagagccacctacttcggcagcatcgtgctgctgagccccgccgtgatcgacagccccctgaagctggagctgagagtgctggccccccccagatgcaccatcaagcccagcggcaccaccatcagcgtgaccgccagcgtgaccatcgccctggtgccccccgaccagcccgaggtgcagctgagcagcatgaccatggacgccagactgagcgccaagatggccctgagaggcaaggccctgagaacccagctggacctgagaagattcagaatctacagcaaccacagcgccctggagagcctggccctgatccccctgcaggcccccctgaagaccatgctgcagatcggcgtgatgcccatgctgaacgagagaacctggagaggcgtgcagatccccctgcccgagggcatcaacttcgtgcacgaggtggtgaccaaccacgccggcttcctgaccatcggcgccgacctgcacttcgccaagggcctgagagaggtgatcgagaagaacagacccgccgacgtgagagccagcaccgcccccacccccagcaccgccgccgtgtag

SEQ ID NO: 93369 - DNA, 1482 bp, Artificial Sequence; identical to SEQ ID NO: 93368
  Description of Artificial Sequence: Synthetic coding sequence

SEQ ID NO: 93370 - DNA, 1542 bp, Artificial Sequence
  Description of Artificial Sequence: Synthetic coding sequence
atgggcctgagcggcagcgacaacagctgcgaccccacccccccccccggccccctggccatggccctgttcggcgccctgttcctggccctgctggccggcgcccacgccgagttccccggctgcaagatcagagtgaccagcaaggccctggagctggtgaagcaggagggcctgagattcctggagcaggagctggagaccatcaccatccccgacctgagaggcaaggagggccacttctactacaacatcagcgaggtgaaggtgaccgagctgcagctgaccagcagcgagctggacttccagccccagcaggagctgatgctgcagatcaccaacgccagcctgggcctgagattcagaagacagctgctgtactggttcttctacgacggcggctacatcaacgccagcgccgagggcgtgagcatcagaaccggcctggagctgagcagagaccccgccggcagaatgaaggtgagcaacgtgagctgccaggccagcgtgagcagaatgcacgccgccttcggcggcaccttcaagaaggtgtacgacttcctgagcaccttcatcaccagcggcatgagattcctgctgaaccagcagatctgccccgtgctgtaccacgccggcaccgtgctgctgaacagcctgctggacaccgtgcccgtgagaagcagcgtggacgagctggtgggcatcgactacagcctgatgaaggaccccgtggccagcaccagcaacctggacatggacttcagaggcgccttcttccccctgaccgagagaaactggagcctgcccaacagagccgtggagccccagctgcaggaggaggagagaatggtgtacgtggccttcagcgagttcttcttcgacagcgccatggagagctacttcagagccggcgccctgcagctgctgctggtgggcgacaaggtgccccacgacctggacatgctgctgagagccacctacttcggcagcatcgtgctgctgagccccgccgtgatcgacagccccctgaagctggagctgagagtgctggccccccccagatgcaccatcaagcccagcggcaccaccatcagcgtgaccgccagcgtgaccatcgccctggtgccccccgaccagcccgaggtgcagctgagcagcatgaccatggacgccagactgagcgccaagatggccctgagaggcaaggccctgagaacccagctggacctgagaagattcagaatctacagcaaccacagcgccctggagagcctggccctgatccccctgcaggcccccctgaagaccatgctgcagatcggcgtgatgcccatgctgaacgagagaacctggagaggcgtgcagatccccctgcccgagggcatcaacttcgtgcacgaggtggtgaccaaccacgccggcttcctgaccatcggcgccgacctgcacttcgccaagggcctgagagaggtgatcgagaagaacagacccgccgacgtgagagccagcaccgcccccacccccagcaccgccgccgtgtag

SEQ ID NO: 93371 - DNA, 1218 bp, Artificial Sequence
  Description of Artificial Sequence: Synthetic coding sequence
atgctgcagatcaccaacgccagcctgggcctgagattcagaagacagctgctgtactggttcttctacgacggcggctacatcaacgccagcgccgagggcgtgagcatcagaaccggcctggagctgagcagagaccccgccggcagaatgaaggtgagcaacgtgagctgccaggccagcgtgagcagaatgcacgccgccttcggcggcaccttcaagaaggtgtacgacttcctgagcaccttcatcaccagcggcatgagattcctgctgaaccagcagatctgccccgtgctgtaccacgccggcaccgtgctgctgaacagcctgctggacaccgtgcccgtgagaagcagcgtggacgagctggtgggcatcgactacagcctgatgaaggaccccgtggccagcaccagcaacctggacatggacttcagaggcgccttcttccccctgaccgagagaaactggagcctgcccaacagagccgtggagccccagctgcaggaggaggagagaatggtgtacgtggccttcagcgagttcttcttcgacagcgccatggagagctacttcagagccggcgccctgcagctgctgctggtgggcgacaaggtgccccacgacctggacatgctgctgagagccacctacttcggcagcatcgtgctgctgagccccgccgtgatcgacagccccctgaagctggagctgagagtgctggccccccccagatgcaccatcaagcccagcggcaccaccatcagcgtgaccgccagcgtgaccatcgccctggtgccccccgaccagcccgaggtgcagctgagcagcatgaccatggacgccagactgagcgccaagatggccctgagaggcaaggccctgagaacccagctggacctgagaagattcagaatctacagcaaccacagcgccctggagagcctggccctgatccccctgcaggcccccctgaagaccatgctgcagatcggcgtgatgcccatgctgaacgagagaacctggagaggcgtgcagatccccctgcccgagggcatcaacttcgtgcacgaggtggtgaccaaccacgccggcttcctgaccatcggcgccgacctgcacttcgccaagggcctgagagaggtgatcgagaagaacagacccgccgacgtgagagccagcaccgcccccacccccagcaccgccgccgtgtag

SEQ ID NO: 93372 - DNA, 1197 bp, Artificial Sequence
  Description of Artificial Sequence: Synthetic coding sequence
atggccctgttcggcgccctgttcctggccctgctggccggcgcccacgccgagttccccggctgcaagatcagagtgaccagcaaggccctggagctggtgaagcaggagggcctgagattcctggagcaggagctggagaccatcaccatccccgacctgagaggcaaggagggccacttctactacaacatcagcgagaaggtgtacgacttcctgagcaccttcatcaccagcggcatgagattcctgctgaaccagcagatctgccccgtgctgtaccacgccggcaccgtgctgctgaacagcctgctggacaccgtgcccgtgagaagcagcgtggacgagctggtgggcatcgactacagcctgatgaaggaccccgtggccagcaccagcaacctggacatggacttcagaggcgccttcttccccctgaccgagagaaactggagcctgcccaacagagccgtggagccccagctgcaggaggaggagagaatggtgtacgtggccttcagcgagttcttcttcgacagcgccatggagagctacttcagagccggcgccctgcagctgctgctggtgggcgacaaggtgccccacgacctggacatgctgctgagagccacctacttcggcagcatcgtgctgctgagccccgccgtgatcgacagccccctgaagctggagctgagagtgctggccccccccagatgcaccatcaagcccagcggcaccaccatcagcgtgaccgccagcgtgaccatcgccctggtgccccccgaccagcccgaggtgcagctgagcagcatgaccatggacgccagactgagcgccaagatggccctgagaggcaaggccctgagaacccagctggacctgagaagattcagaatctacagcaaccacagcgccctggagagcctggccctgatccccctgcaggcccccctgaagaccatgctgcagatcggcgtgatgcccatgctgaacgagagaacctggagaggcgtgcagatccccctgcccgagggcatcaacttcgtgcacgaggtggtgaccaaccacgccggcttcctgaccatcggcgccgacctgcacttcgccaagggcctgagagaggtgatcgagaagaacagacccgccgacgtgagagccagcaccgcccccacccccagcaccgccgccgtgtag

SEQ ID NO: 93373 - DNA, 2343 bp, Artificial Sequence
  Description of Artificial Sequence: Synthetic coding sequence
atggccccctacagcctgctggtgaccagactgcagaaggccctgggcgtgagacagtaccacgtggccagcgtgctgtgccagagagccaaggtggccatgagccacttcgagcccaacgagtacatccactacgacctgctggagaagaacatcaacatcgtgagaaagagactgaacagacccctgaccctgagcgagaagatcgtgtacggccacctggacgaccccgccagccaggagatcgagagaggcaagagctacctgagactgagacccgacagagtggccatgcaggacgccaccgcccagatggccatgctgcagttcatcagcagcggcctgagcaaggtggccgtgcccagcaccatccactgcgaccacctgatcgaggcccaggtgggcggcgagaaggacctgagaagagccaaggacatcaaccaggaggtgtacaacttcctggccaccgccggcgccaagtacggcgtgggcttctggaagcccggcagcggcatcatccaccagatcatcctggagaactacgcctaccccggcgtgctgctgatcggcaccgacagccacacccccaacggcggcggcctgggcggcatctgcatcggcgtgggcggcgccgacgccgtggacgtgatggccggcatcccctgggagctgaagtgccccaaggtgatcggcgtgaagctgaccggcagcctgagcggctggagcagccccaaggacgtgatcctgaaggtggccggcatcctgaccgtgaagggcggcaccggcgccatcgtggagtaccacggccccggcgtggacagcatcagctgcaccggcatggccaccatctgcaacatgggcgccgagatcggcgccaccaccagcgtgttcccctacaaccacagaatgaagaagtacctgagcaagaccggcagagaggacatcgccaacctggccgacgagttcaaggaccacctggtgcccgaccccggctgccactacgaccagctgatcgagatcaacctgagcgagctgaagccccacatcaacggccccttcacccccgacctggcccaccccgtggccgaggtgggcaaggtggccgagaaggagggctggcccctggacatcagagtgggcctgatcggcagctgcaccaacagcagctacgaggacatgggcagaagcgccgccgtggccaagcaggccctggcccacggcctgaagtgcaagagccagttcaccatcacccccggcagcgagcagatcagagccaccatcgagagagacggctacgcccagatcctgagagacctgggcggcatcgtgctggccaacgcctgcggcccctgcatcggccagtgggacagaaaggacatcaagaagggcgagaagaacaccatcgtgaccagctacaacagaaacttcaccggcagaaacgacgccaaccccgagacccacgccttcgtgaccagccccgagatcgtgaccgccctggccatcgccggcaccctgaagttcaaccccgagaccgactacctgaccggcaccgacggcaagaagttcagactggaggcccccgacgccgacgagctgcccaagggcgagttcgaccccggccaggacacctaccagcacccccccaaggacagcagcggccagcacgtggacgtgagccccaccagccagagactgcagctgctggagcccttcgacaagtgggacggcaaggacctggaggacctgcagatcctgatcaaggtgaagggcaagtgcaccaccgaccacatcagcgccgccggcccctggctgaagttcagaggccacctggacaacatcagcaacaacctgctgatcggcgccatcaacatcgagaacggcaaggccaacagcgtgagaaacgccgtgacccaggagttcggccccgtgcccgacaccgccagatactacaagaagcacggcatcagatgggtggtgatcggcgacgagaactacggcgagggcagcagcagagagcacgccgccctggagcccagacacctgggcggcagagccatcatcaccaagagcttcgccagaatccacgagaccaacctgaagaagcagggcctgctgcccctgaccttcgccgaccccgccgactacaacaagatccaccccgtggacaagctgaccatccagggcctgaaggacttcacccccggcaagcccctgaagtgcatcatcaagcaccccaacggcacccaggagaccatcctgctgaaccacaccttcaacgagacccagatcgagtggttcagagccggcagcgccctgaacagaatgaaggagctgcagcagtag

SEQ ID NO: 93374 - DNA, 741 bp, Artificial Sequence
  Description of Artificial Sequence: Synthetic coding sequence
atggccgcccccggccccgccctgtgcctgttcgacgtggacggcaccctgaccgcccccagacagaagatcaccaaggagatggacgacttcctgcagaagctgagacagaagatcaagatcggcgtggtgggcggcagcgacttcgagaaggtgcaggagcagctgggcaacgacgtggtggagaagtacgactacgtgttccccgagaacggcctggtggcctacaaggacggcaagctgctgtgcagacagaacatccagagccacctgggcgaggccctgatccaggacctgatcaactactgcctgagctacatcgccaagatcaagctgcccaagaagagaggcaccttcatcgagttcagaaacggcatgctgaacgtgagccccatcggcagaagctgcagccaggaggagagaatcgagttctacgagctggacaagaaggagaacatcagacagaagttcgtggccgacctgagaaaggagttcgccggcaagggcctgaccttcagcatcggcggccagatcagcttcgacgtgttccccgacggctgggacaagagatactgcctgagacacgtggagaacgacggctacaagaccatctacttcttcggcgacaagaccatgcccggcggcaacgaccacgagatcttcaccgaccccagaaccatgggctacagcgtgaccgcccccgaggacaccagaagaatctgcgagctgctgttcagctag

SEQ ID NO: 93375 - DNA, 366 bp, Artificial Sequence
  Description of Artificial Sequence: Synthetic coding sequence
atgctgaacgtgagccccatcggcagaagctgcagccaggaggagagaatcgagttctacgagctggacaagaaggagaacatcagacagaagttcgtggccgacctgagaaaggagttcgccggcaagggcctgaccttcagcatcggcggccagatcagcttcgacgtgttccccgacggctgggacaagagatactgcctgagacacgtggagaacgacggctacaagaccatctacttcttcggcgacaagaccatgcccggcggcaacgaccacgagatcttcaccgaccccagaaccatgggctacagcgtgaccgcccccgaggacaccagaagaatctgcgagctgctgttcagctag

SEQ ID NO: 93376 - DNA, 492 bp, Artificial Sequence
  Description of Artificial Sequence: Synthetic coding sequence
atgatgaacatccagagccacctgggcgaggccctgatccaggacctgatcaactactgcctgagctacatcgccaagatcaagctgcccaagaagagaggcaccttcatcgagttcagaaacggcatgctgaacgtgagccccatcggcagaagctgcagccaggaggagagaatcgagttctacgagctggacaagaaggagaacatcagacagaagttcgtggccgacctgagaaaggagttcgccggcaagggcctgaccttcagcatcggcggccagatcagcttcgacgtgttccccgacggctgggacaagagatactgcctgagacacgtggagaacgacggctacaagaccatctacttcttcggcgacaagaccatgcccggcggcaacgaccacgagatcttcaccgaccccagaaccatgggctacagcgtgaccgcccccgaggacaccagaagaatctgcgagctgctgttcagctag

SEQ ID NO: 93377 - DNA, 579 bp, Artificial Sequence
  Description of Artificial Sequence: Synthetic coding sequence
atggcccccctgggcggcgcccccagactggtgctgctgttcagcggcaagagaaagagcggcaaggacttcgtgaccgaggccctgcagagcagactgggcgccgacgtgtgcgccgtgctgagactgagcggccccctgaaggagcagtacgcccaggagcacggcctgaacttccagagactgctggacaccagcacctacaaggaggccttcagaaaggacatgatcagatggggcgaggagaagagacaggccgaccccggcttcttctgcagaaagatcgtggagggcatcagccagcccatctggctggtgagcgacaccagaagagtgagcgacatccagtggttcagagaggcctacggcgccgtgacccagaccgtgagagtggtggccctggagcagagcagacagcagagaggctgggtgttcacccccggcgtggacgacgccgagagcgagtgcggcctggacaacttcggcgacttcgactgggtgatcgagaaccacggcgtggagcagagactggaggagcagctggagaacctgatcgagttcatcagaagcagactgtag

SEQ ID NO: 93378 - DNA, 615 bp, Artificial Sequence
  Description of Artificial Sequence: Synthetic coding sequence
atggagcccaaggccagctgccccgccgccgcccccctgatggagagaaagttccacgtgctggtgggcgtgaccggcagcgtggccgccctgaagctgcccctgctggtgagcaagctgctggacatccccggcctggaggtggccgtggtgaccaccgagagagccaagcacttctacagcccccaggacatccccgtgaccctgtacagcgacgccgacgagtgggagatctggaagagcagaagcgaccccgtgctgcacatcgacctgagaagatgggccgacctgctgctggtggcccccctggacgccaacaccctgggcaaggtggccagcggcatctgcgacaacctgctgacctgcgtgatgagagcctgggacagaagcaagcccctgctgttctgccccgccatgaacaccgccatgtgggagcaccccatcaccgcccagcaggtggaccagctgaaggccttcggctacgtggagatcccctgcgtggccaagaagctggtgtgcggcgacgagggcctgggcgccatggccgaggtgggcaccatcgtggacaaggtgaaggaggtgctgttccagcacagcggcttccagcagagctag

SEQ ID NO: 93379 - DNA, 171 bp, Artificial Sequence
  Description of Artificial Sequence: Synthetic coding sequence
atggccgagatggaccccgtggccgagttcccccagccccccggcgccgccagatgggccgaggccctgctgagatgcttcacctggctgagactgtgccagatcagcatgttcctgagcctgaagtgcctgaacaccagaagcagccacctgggcgcccactgcagatag

SEQ ID NO: 93380 - DNA, 642 bp, Artificial Sequence
  Description of Artificial Sequence: Synthetic coding sequence
atggccgagatggaccccgtggccgagttcccccagccccccggcgccgccagatgggccgaggtgatggccagattcgccgccagactgggcgcccagggcagaagagtggtgctggtgaccagcggcggcaccaaggtgcccctggaggccagacccgtgagattcctggacaacttcagcagcggcagaagaggcgccaccagcgccgaggccttcctggccgccggctacggcgtgctgttcctgtacagagccagaagcgccttcccctacgcccacagattccccccccagacctggctgagcgccctgagacccagcggccccgccctgagcggcctgctgagcctggaggccgaggagaacgccctgcccggcttcgccgaggccctgagaagctaccaggaggccgccgccgccggcaccttcctggccgtggagttcaccaccctggccgactacctgcacctgctgcaggccgccgcccaggccctgaaccccctgggccccagcgccatgttctacctggccgccgccgtgagcgacttctacgtgcccgtgagcgagatgcccgagcacaagatccagagcagcggcggccccctgcaggtgatgggcgccagcctgcccgagatctag

SEQ ID NO: 93381 - DNA, 936 bp, Artificial Sequence
  Description of Artificial Sequence: Synthetic coding sequence
atggccgagatggaccccgtggccgagttcccccagccccccggcgccgccagatgggccgaggtgatggccagattcgccgccagactgggcgcccagggcagaagagtggtgctggtgaccagcggcggcaccaaggtgcccctggaggccagacccgtgagattcctggacaacttcagcagcggcagaagaggcgccaccagcgccgaggccttcctggccgccggctacggcgtgctgttcctgtacagagccagaagcgccttcccctacgcccacagattccccccccagacctggctgagcgccctgagacccagcggccccgccctgagcggcctgctgagcctggaggccgaggagaacgccctgcccggcttcgccgaggccctgagaagctaccaggaggccgccgccgccggcaccttcctggccgtggagttcaccaccctggccgactacctgcacctgctgcaggccgccgcccaggccctgaaccccctgggccccagcgccatgttctacctggccgccgccgtgagcgacttctacgtgcccgtgagcgagatgcccgagcacaagatccagagcagcggcggccccctgcagatcaccatgaagatggtgcccaagctgctgagccccctggtgaaggactgggcccccaaggccttcatcatcagcttcaagctggagaccgaccccgccatcgtgatcaacagagccagaaaggccctggagatctaccagcaccaggtggtggtggccaacatcctggagagcagacagagcttcgtgttcatcgtgaccaaggacagcgagaccaagctgctgctgagcgaggaggagatcgagaagggcgtggagatcgaggagaagatcgtggacaacctgcagagcagacacaccgccttcatcggcgacagaaactag

SEQ ID NO: 93382 - DNA, 417 bp, Artificial Sequence
  Description of Artificial Sequence: Synthetic coding sequence
atgttctacctggccgccgccgtgagcgacttctacgtgcccgtgagcgagatgcccgagcacaagatccagagcagcggcggccccctgcagatcaccatgaagatggtgcccaagctgctgagccccctggtgaaggactgggcccccaaggccttcatcatcagcttcaagctggagaccgaccccgccatcgtgatcaacagagccagaaaggccctggagatctaccagcaccaggtggtggtggccaacatcctggagagcagacagagcttcgtgttcatcgtgaccaaggacagcgagaccaagctgctgctgagcgaggaggagatcgagaagggcgtggagatcgaggagaagatcgtggacaacctgcagagcagacacaccgccttcatcggcgacagaaactag

SEQ ID NO: 93383 - DNA, 417 bp, Artificial Sequence; identical to SEQ ID NO: 93382
  Description of Artificial Sequence: Synthetic coding sequence

SEQ ID NO: 93384 - DNA, 393 bp, Artificial Sequence
  Description of Artificial Sequence: Synthetic coding sequence
atggccgagtacggcaccctgctgcaggacctgaccaacaacatcaccctggaggacctggagcagctgaagagcgcctgcaaggaggacatccccagcgagaagagcgaggagatcaccaccggcagcgcctggttcagcttcctggagagccacaacaagctggacaaggacaacctgagctacatcgagcacatcttcgagatcagcagaagacccgacctgctgaccatggtggtggactacagaaccagagtgctgaagatcagcgaggaggacgagctggacaccaagctgaccagaatccccagcgccaagaagtacaaggacatcatcagacagcccagcgaggaggagatcatcaagctggcccccccccccaagaaggcctag

SEQ ID NO: 93385 - DNA, 456 bp, Artificial Sequence
  Description of Artificial Sequence: Synthetic coding sequence
atggaggacgagggcaacaagctgtgccaggcccccccctggcccggccagaccagccccgtgatggccgagtacggcaccctgctgcaggacctgaccaacaacatcaccctggaggacctggagcagctgaagagcgcctgcaaggaggacatccccagcgagaagagcgaggagatcaccaccggcagcgcctggttcagcttcctggagagccacaacaagctggacaaggacaacctgagctacatcgagcacatcttcgagatcagcagaagacccgacctgctgaccatggtggtggactacagaaccagagtgctgaagatcagcgaggaggacgagctggacaccaagctgaccagaatccccagcgccaagaagtacaaggacatcatcagacagcccagcgaggaggagatcatcaagctggcccccccccccaagaaggcctag

SEQ ID NO: 93386 - DNA, 327 bp, Artificial Sequence
  Description of Artificial Sequence: Synthetic coding sequence
atggccgagtacggcaccctgctgcaggacctgaccaacaacatcaccctggaggacctggagcagctgaagagcgcctgcaaggaggacatccccagcgagaagaacaacctgagctacatcgagcacatcttcgagatcagcagaagacccgacctgctgaccatggtggtggactacagaaccagagtgctgaagatcagcgaggaggacgagctggacaccaagctgaccagaatccccagcgccaagaagtacaaggacatcatcagacagcccagcgaggaggagatcatcaagctggcccccccccccaagaaggcctag

SEQ ID NO: 93387 - DNA, 1554 bp, Artificial Sequence
  Description of Artificial Sequence: Synthetic coding sequence
atggagctggaggagctgggcatcagagaggagtgcggcgtgttcggctgcatcgccagcggcgagtggcccacccagctggacgtgccccacgtgatcaccctgggcctggtgggcctgcagcacagaggccaggagagcgccggcatcgtgaccagcgacggcagcagcgtgcccaccttcaagagccacaagggcatgggcctggtgaaccacgtgttcaccgaggacaacctgaagaagctgtacgtgagcaacctgggcatcggccacaccagatacgccaccaccggcaagtgcgagctggagaactgccagcccttcgtggtggagaccctgcacggcaagatcgccgtggcccacaacggcgagctggtgaacgccgccagactgagaaagaagctgctgagacacggcatcggcctgagcaccagcagcgacagcgagatgatcacccagctgctggcctacacccccccccaggagcaggacgacacccccgactgggtggccagaatcaagaacctgatgaaggaggcccccaccgcctacagcctgctgatcatgcacagagacgtgatctacgccgtgagagacccctacggcaacagacccctgtgcatcggcagactgatccccgtgagcgacatcaacgacaaggagaagaagaccagcgagaccgagggctgggtggtgagcagcgagagctgcagcttcctgagcatcggcgccagatactacagagaggtgctgcccggcgagatcgtggagatcagcagacacaacgtgcagaccctggacatcatcagcagaagcgagggcaaccccgtggccttctgcatcttcgagtacgtgtacttcgccagacccgacagcatgttcgaggaccagatggtgtacaccgtgagatacagatgcggccagcagctggccatcgaggcccccgtggacgccgacctggtgagcaccgtgcccgagagcgccacccccgccgccctggcctacgccggcaagtgcggcctgccctacgtggaggtgctgtgcaagaacagatacgtgggcagaaccttcatccagcccaacatgagactgagacagctgggcgtggccaagaagttcggcgtgctgagcgacaacttcaagggcaagagaatcgtgctggtggacgacagcatcgtgagaggcaacaccatcagccccatcatcaagctgctgaaggagagcggcgccaaggaggtgcacatcagagtggccagcccccccatcaagtacccctgcttcatgggcatcaacatccccaccaaggaggagctgatcgccaacaagcccgagttcgaccacctggccgagtacctgggcgccaacagcgtggtgtacctgagcgtggagggcctggtgagcagcgtgcaggagggcatcaagttcaagaagcagaaggagaagaagcacgacatcatgatccaggagaacggcaacggcctggagtgcttcgagaagagcggccactgcaccgcctgcctgaccggcaagtaccccgtggagctggagtggtag

SEQ ID NO: 93388 - DNA, 657 bp, Artificial Sequence
  Description of Artificial Sequence: Synthetic coding sequence
atggagctgctgatcatgatcaacgcctgcaagatcgccagcgccagcagagtgaccgccgtgatcccctgcttcccctacgccagacaggacaagaaggacaagggcttcttcgacatccccgtggacaacctgtacgccgagcccgccgtgctgaagtggatcagagagaacatcagcgagtggagaaactgcaccatcgtgagccccgacgccggcggcgccaagagagtgaccagcatcgccgacagactgaacgtggacttcgccctgatccacaaggagagaaagaaggccaacgaggtggacagaatggtgctggtgggcgacgtgaaggacagagtggccatcctggtggacgacatggccgacacctgcggcaccatctgccacgccgccgacaagctgctgagcgccggcgccaccagagtgtacgccatcctgacccacggcatcttcagcggccccgccatcagcagaatcaacaacgcctgcttcgaggccgtggtggtgaccaacaccatcccccaggaggacaagatgaagcactgcagcaagatccaggtgatcgacatcagcatgatcctggccgaggccatcagaagaacccacaacggcgagagcgtgagctacctgttcagccacgtgcccctgtag

SEQ ID NO: 93389 - DNA, 507 bp, Artificial Sequence
  Description of Artificial Sequence: Synthetic coding sequence
atgcccaacatcaagatcttcagcggcagcagccaccaggacctgagccagaagatcgccgacagactgggcctggagctgggcaaggtggtgaccaagaagttcagcaaccaggagacctgcgtggagatcggcgagagcgtgagaggcgaggacgtgtacatcgtgcagagcggctgcggcgagatcaacgacaacctgatggagctgctgatcatgatcaacgcctgcaagatcgccagcgccagcagagtgaccgccgtgatcccctgcttcccctacgccagacaggacaagaaggacaagagcagagcccccatcagcgccaagctggtggccaacatgctgagcgtggccggcgccgaccacatcatcaccatggacctgcacgccagccagatccaggtgagcgtggaggccaagtactggtgcctgaagggcggcagaaagggcctgatgatgctgaagaccgccgagaagcccaagatcatgcccaagtacatctag

SEQ ID NO: 93390 - DNA, 756 bp, Artificial Sequence
  Description of Artificial Sequence: Synthetic coding sequence
atggagctgctgatcatgatcaacgcctgcaagatcgccagcgccagcagagtgaccgccgtgatcccctgcttcccctacgccagacaggacaagaaggacaagagcagagcccccatcagcgccaagctggtggccaacatgctgagcgtggccggcgccgaccacatcatcaccatggacctgcacgccagccagatccagggcttcttcgacatccccgtggacaacctgtacgccgagcccgccgtgctgaagtggatcagagagaacatcagcgagtggagaaactgcaccatcgtgagccccgacgccggcggcgccaagagagtgaccagcatcgccgacagactgaacgtggacttcgccctgatccacaaggagagaaagaaggccaacgaggtggacagaatggtgctggtgggcgacgtgaaggacagagtggccatcctggtggacgacatggccgacacctgcggcaccatctgccacgccgccgacaagctgctgagcgccggcgccaccagagtgtacgccatcctgacccacggcatcttcagcggccccgccatcagcagaatcaacaacgcctgcttcgaggccgtggtggtgaccaacaccatcccccaggaggacaagatgaagcactgcagcaagatccaggtgatcgacatcagcatgatcctggccgaggccatcagaagaacccacaacggcgagagcgtgagctacctgttcagccacgtgcccctgtag

SEQ ID NO: 93391 - DNA, 957 bp, Artificial Sequence
  Description of Artificial Sequence: Synthetic coding sequence
atgcccaacatcaagatcttcagcggcagcagccaccaggacctgagccagaagatcgccgacagactgggcctggagctgggcaaggtggtgaccaagaagttcagcaaccaggagacctgcgtggagatcggcgagagcgtgagaggcgaggacgtgtacatcgtgcagagcggctgcggcgagatcaacgacaacctgatggagctgctgatcatgatcaacgcctgcaagatcgccagcgccagcagagtgaccgccgtgatcccctgcttcccctacgccagacaggacaagaaggacaagagcagagcccccatcagcgccaagctggtggccaacatgctgagcgtggccggcgccgaccacatcatcaccatggacctgcacgccagccagatccagggcttcttcgacatccccgtggacaacctgtacgccgagcccgccgtgctgaagtggatcagagagaacatcagcgagtggagaaactgcaccatcgtgagccccgacgccggcggcgccaagagagtgaccagcatcgccgacagactgaacgtggacttcgccctgatccacaaggagagaaagaaggccaacgaggtggacagaatggtgctggtgggcgacgtgaaggacagagtggccatcctggtggacgacatggccgacacctgcggcaccatctgccacgccgccgacaagctgctgagcgccggcgccaccagagtgtacgccatcctgacccacggcatcttcagcggccccgccatcagcagaatcaacaacgcctgcttcgaggccgtggtggtgaccaacaccatcccccaggaggacaagatgaagcactgcagcaagatccaggtgatcgacatcagcatgatcctggccgaggccatcagaagaacccacaacggcgagagcgtgagctacctgttcagccacgtgcccctgtag

SEQ ID NO: 93392 - DNA, 957 bp, Artificial Sequence; identical to SEQ ID NO: 93391
  Description of Artificial Sequence: Synthetic coding sequence

SEQ ID NO: 93393 - DNA, 957 bp, Artificial Sequence
  Description of Artificial Sequence: Synthetic coding sequence
acccccaacatcaagatcttcagcggcagcagccaccaggacctgagccagaagatcgccgacagactgggcctggagctgggcaaggtggtgaccaagaagttcagcaaccaggagacctgcgtggagatcgacgagagcgtgagaggcgaggacgtgtacatcgtgcagagcggctgcggcgagatcaacgacagcctgatggagctgctgatcatgatcaacgcctgcaagatcgccagcgccagcagagtgaccgccgtgatcccctgcttcccctacgccagacaggacaagaaggacaagagcagaagccccatcagcgccaagctggtggccaacatgctgagcatcgccggcgccgaccacatcatcaccatggacctgcacgccagccagatccagggcttcttcgacatccccgtggacaacctgtacgccgagcccaccgtgctgaagtggatcagagagaacatccccgagtggaagaactgcatcatcgtgagccccgacgccggcggcgccaagagagtgaccagcatcgccgaccagctgaacgtggacttcgccctgatccacaaggagagaaagaaggccaacgaggtggactgcatcgtgctggtgggcgacgtgaacgacagagtggccatcctggtggacgacatggccgacacctgcgtgaccatctgcctggccgccgacaagctgctgagcgccggcgccaccagagtgtacgccatcctgacccacggcatcttcagcggccccgccatcagcagaatcaacaccgcctgcttcgaggccgtggtggtgaccaacaccatcccccaggacgagaagatgaagcactgcagcaagatcagagtgatcgacatcagcatgatcctggccgaggccatcagaagaacccacaacggcgagagcgtgagctacctgttcagccacgtgcccctgtag

SEQ ID NO: 93394 - DNA, 957 bp, Artificial Sequence
  Description of Artificial Sequence: Synthetic coding sequence
atgcccaacatcgtgctgttcagcggcagcagccaccaggacctgagccagagagtggccgacagactgggcctggagctgggcaaggtggtgaccaagaagttcagcaaccaggagaccagcgtggagatcggcgagagcgtgagaggcgaggacgtgtacatcatccagagcggctgcggcgagatcaacgacaacctgatggagctgctgatcatgatcaacgcctgcaagatcgccagcagcagcagagtgaccgccgtgatcccctgcttcccctacgccagacaggacaagaaggacaagagcagagcccccatcagcgccaagctggtggccaacatgctgagcgtggccggcgccgaccacatcatcaccatggacctgcacgccagccagatccagggcttcttcgacatccccgtggacaacctgtacgccgagcccgccgtgctgcagtggatcagagagaacatcgccgagtggaagaactgcatcatcgtgagccccgacgccggcggcgccaagagagtgaccagcatcgccgacagactgaacgtggagttcgccctgatccacaaggagagaaagaaggccaacgaggtggacagaatggtgctggtgggcgacgtgaaggacagagtggccatcctggtggacgacatggccgacacctgcggcaccatctgccacgccgccgacaagctgctgagcgccggcgccaccaaggtgtacgccatcctgacccacggcatcttcagcggccccgccatcagcagaatcaacaacgccgccttcgaggccgtggtggtgaccaacaccatcccccaggaggacaagatgaagcactgcaccaagatccaggtgatcgacatcagcatgatcctggccgaggccatcagaagaacccacaacggcgagagcgtgagctacctgttcagccacgtgcccctgtag

SEQ ID NO: 93395 - DNA, 966 bp, Artificial Sequence
  Description of Artificial Sequence: Synthetic coding sequence
atgcccaacatcgtgctgttcagcggcagcagccaccaggacctgagccagagagtggccgacagactgggcctggagctgggcaaggtggtgaccaagaagttcagcaaccaggagaccagcgtggagatcggcgagagcgtgagaggcgaggacgtgtacatcatccagagcggctgcggcgagatcaacgacaacctgatggagctgctgatcatgatcaacgcctgcaagatcgccagcagcagcagagtgaccgccgtgatcccctgcttcccctacgccagacaggacaagaaggacaaggtgggcgagagcagagcccccatcagcgccaagctggtggccaacatgctgagcgtggccggcgccgaccacatcatcaccatggacctgcacgccagccagatccagggcttcttcgacatccccgtggacaacctgtacgccgagcccgccgtgctgcagtggatcagagagaacatcgccgagtggaagaactgcatcatcgtgagccccgacgccggcggcgccaagagagtgaccagcatcgccgacagactgaacgtggagttcgccctgatccacaaggagagaaagaaggccaacgaggtggacagaatggtgctggtgggcgacgtgaaggacagagtggccatcctggtggacgacatggccgacacctgcggcaccatctgccacgccgccgacaagctgctgagcgccggcgccaccaaggtgtacgccatcctgacccacggcatcttcagcggccccgccatcagcagaatcaacaacgccgccttcgaggccgtggtggtgaccaacaccatcccccaggaggacaagatgaagcactgcaccaagatccaggtgatcgacatcagcatgatcctggccgaggccatcagaagaacccacaacggcgagagcgtgagctacctgttcagccacgtgcccctgtag

SEQ ID NO: 93396 - DNA, 849 bp, Artificial Sequence
  Description of Artificial Sequence: Synthetic coding sequence
atggagctgctgatcatggcctacgccctgaagaccgcctgcgccagaaacatcatcggcgtgatcccctacttcccctacagcaagcagagcaagatgagaaagagaggcagcatcgtgtgcaagctgctggccagcatgctggccaaggccggcctgacccacatcatcaccatggacctgcaccagaaggagatccagggcttcttcagcttccccgtggacaacctgagagccagccccttcctgctgcagtacatccaggaggagatccccaactacagaaacgccgtgatcgtggccaagagccccgacgccgccaagagagcccagagctacgccgagagactgagactgggcctggccgtgatccacggcgaggcccagtgcaccgagctggacatggacgacggcagacacagcccccccatggtgaagaacgccaccgtgcaccccggcctggagctgcccctgatgatggccaaggagaagccccccatcaccgtggtgggcgacgtgggcggcagaatcgccatcatcgtggacgacatcatcgacgacgtggagagcttcgtggccgccgccgagatcctgaaggagagaggcgcctacaagatctacgtgatggccacccacggcatcctgagcgccgaggcccccagactgatcgaggagagcagcgtggacgaggtggtggtgaccaacaccgtgccccacgaggtgcagaagctgcagtgccccaagatcaagaccgtggacatcagcctgatcctgagcgaggccatcagaagaatccacaacggcgagagcatggcctacctgttcagaaacatcaccgtggacgactag

SEQ ID NO: 93397 - DNA, 1158 bp, Artificial Sequence
  Description of Artificial Sequence: Synthetic coding sequence
atgcccaagaagctgctgctgctgcccccccccagcgccagcagcgccttcagagtgcccagagccagacccgtgcccccccccgccatgaacgccgccagaaccggctacagagtgttcagcgccaacagcaccgccgcctgcaccgagctggccaagagaatcaccgagagactgggcgccgagctgggcaagagcgtggtgtaccaggagaccaacggcgagaccagagtggagatcaaggagagcgtgagaggccaggacatcttcatcatccagaccatccccagagacgtgaacaccgccgtgatggagctgctgatcatggcctacgccctgaagaccgcctgcgccagaaacatcatcggcgtgatcccctacttcccctacagcaagcagagcaagatgagaaagagaggcagcatcgtgtgcaagctgctggccagcatgctggccaaggccggcctgacccacatcatcaccatggacctgcaccagaaggagatccagggcttcttcagcttccccgtggacaacctgagagccagccccttcctgctgcagtacatccaggaggagatccccaactacagaaacgccgtgatcgtggccaagagccccgacgccgccaagagagcccagagctacgccgagagactgagactgggcctggccgtgatccacggcgaggcccagtgcaccgagctggacatggacgacggcagacacagcccccccatggtgaagaacgccaccgtgcaccccggcctggagctgcccctgatgatggccaaggagaagccccccatcaccgtggtgggcgacgtgggcggcagaatcgccatcatcgtggacgacatcatcgacgacgtggagagcttcgtggccgccgccgagatcctgaaggagagaggcgcctacaagatctacgtgatggccacccacggcatcctgagcgccgaggcccccagactgatcgaggagagcagcgtggacgaggtggtggtgaccaacaccgtgccccacgaggtgcagaagctgcagtgccccaagatcaagaccgtggacatcagcctgatcctgagcgaggccatcagaagaatccacaacggcgagagcatggcctacctgttcagaaacatcaccgtggacgactag

SEQ ID NO: 93398 - DNA, 1110 bp, Artificial Sequence
  Description of Artificial Sequence: Synthetic coding sequence
atgttctgcgtgaccccccccgagctggagaccaagatgaacatcaccaagggcggcctggtgctgttcagcgccaacagcaacagcagctgcatggagctgagcaagaagatcgccgagagactgggcgtggagatgggcaaggtgcaggtgtaccaggagcccaacagagagaccagagtgcagatccaggagagcgtgagaggcaaggacgtgttcatcatccagaccgtgagcaaggacgtgaacaccaccatcatggagctgctgatcatggtgtacgcctgcaagaccagctgcgccaagagcatcatcggcgtgatcccctacttcccctacagcaagcagtgcaagatgagaaagagaggcagcatcgtgagcaagctgctggccagcatgatgtgcaaggccggcctgacccacctgatcaccatggacctgcaccagaaggagatccagggcttcttcaacatccccgtggacaacctgagagccagccccttcctgctgcagtacatccaggaggagatccccgactacagaaacgccgtgatcgtggccaagagccccgccagcgccaagagagcccagagcttcgccgagagactgagactgggcatcgccgtgatccacggcgaggcccaggacgccgagagcgacctggtggacggcagacacagcccccccatggtgagaagcgtggccgccatccaccccagcctggagatccccatgctgatccccaaggagaagccccccatcaccgtggtgggcgacgtgggcggcagaatcgccatcatcgtggacgacatcatcgacgacgtggacagcttcctggccgccgccgagaccctgaaggagagaggcgcctacaagatcttcgtgatggccacccacggcctgctgagcagcgacgcccccagaagaatcgaggagagcgccatcgacgaggtggtggtgaccaacaccatcccccacgaggtgcagaagctgcagtgccccaagatcaagaccgtggacatcagcatgatcctgagcgaggccatcagaagaatccacaacggcgagagcatgagctacctgttcagaaacatcggcctggacgactag

SEQ ID NO: 93399 - DNA, 1110 bp, Artificial Sequence; identical to SEQ ID NO: 93398
  Description of Artificial Sequence: Synthetic coding sequence

SEQ ID NO: 93400 - DNA, 807 bp, Artificial Sequence
  Description of Artificial Sequence: Synthetic coding sequence
atgttctgcgtgaccccccccgagctggagaccaagatgaacatcaccaagggcggcctggtgctgttcagcgccaacagcaacagcagctgcatggagctgagcaagaagatcgccgagagactgggcgtggagatgggcaaggtgcaggtgtaccaggagcccaacagagagaccagagtgcagatccaggagagcgtgagaggcaaggacgtgttcatcatccagaccgtgagcaaggacgtgaacaccaccatcatggagctgctgatcatggtgtacgcctgcaagaccagctgcgccaagagcatcatcggcgtgatcccctacttcccctacagcaagcagtgcaagatgagaaagagaggcagcatcgtgagcaagctgctggccagcatgatgtgcaaggccggcctgacccacctgatcaccatggacctgcaccagaaggagatccagggcttcttcaacatccccgtggacaacctgagagccagccccttcctgctgcagtacatccaggaggagatccccgactacagaaacgccgtgatcgtggccaagagccccgccagcgccaagagagcccagagcttcgccgagagactgagactgggcatcgccgtgatccacggcgaggcccaggacgccgagagcgacctggtggacggcagacacagcccccccatggtgagaagcgtggccgccatccaccccagcctggagatccccatgctgatccccaaggagaagccccccatcaccgtggtgggcgacgtgggcggcagaatcgccatcatcgtgtag

SEQ ID NO: 93401 - DNA, 585 bp, Artificial Sequence
  Description of Artificial Sequence: Synthetic coding sequence
atgttctgcgtgaccccccccgagctggagaccaagatgaacatcaccaagggcggcctggtgctgttcagcgccaacagcaacagcagctgcatggagctgagcaagaagatcgccgagagactgggcgtggagatgggcaaggtgcaggtgtaccaggagcccaacagagagaccagagtgcagatccaggagagcgtgagaggcaaggacgtgttcatcatccagaccgtgagcaaggacgtgaacaccaccatcatggagctgctgatcatggtgtacgcctgcaagaccagctgcgccaagagcatcatcggcgtgatcccctacttcccctacagcaagcagtgcaagatgagaaagagaggcagcatcgtgagcaagctgctggccagcatgatgtgcaaggccggcctgacccacctgatcaccatggacctgcaccagaaggagatccagggcttcttcaacatccccgtggacaacctgagagccagccccttcctgctgcagtacatccaggaggagatccccgactacagaaacgccgtgatcgtggccaagagccccgccagcgccaagtag

SEQ ID NO: 93402 - DNA, 990 bp, Artificial Sequence
  Description of Artificial Sequence: Synthetic coding sequence
atgttctgcgtgaccccccccgagctggagaccaagatgaacatcaccaagggcggcctggtgctgttcagcgccaacagcaacagcagctgcatggagctgagcaagaagatcgccgaggacgtgaacaccaccatcatggagctgctgatcatggtgtacgcctgcaagaccagctgcgccaagagcatcatcggcgtgatcccctacttcccctacagcaagcagtgcaagatgagaaagagaggcagcatcgtgagcaagctgctggccagcatgatgtgcaaggccggcctgacccacctgatcaccatggacctgcaccagaaggagatccagggcttcttcaacatccccgtggacaacctgagagccagccccttcctgctgcagtacatccaggaggagatccccgactacagaaacgccgtgatcgtggccaagagccccgccagcgccaagagagcccagagcttcgccgagagactgagactgggcatcgccgtgatccacggcgaggcccaggacgccgagagcgacctggtggacggcagacacagcccccccatggtgagaagcgtggccgccatccaccccagcctggagatccccatgctgatccccaaggagaagccccccatcaccgtggtgggcgacgtgggcggcagaatcgccatcatcgtggacgacatcatcgacgacgtggacagcttcctggccgccgccgagaccctgaaggagagaggcgcctacaagatcttcgtgatggccacccacggcctgctgagcagcgacgcccccagaagaatcgaggagagcgccatcgacgaggtggtggtgaccaacaccatcccccacgaggtgcagaagctgcagtgccccaagatcaagaccgtggacatcagcatgatcctgagcgaggccatcagaagaatccacaacggcgagagcatgagctacctgttcagaaacatcggcctggacgactag

SEQ ID NO: 93403 - DNA, 531 bp, Artificial Sequence
  Description of Artificial Sequence: Synthetic coding sequence
atgttctgcgtgaccccccccgagctggagaccaagatgaacatcaccaagggcggcctggtgctgttcagcgccaacagcaacagcagctgcatggagctgagcaagaagatcgccgagagactgggcgtggagatgggcaaggtgcaggtgtaccaggagcccaacagagagaccagagtgcagatccaggagagcgtgagaggcaaggacgtgttcatcatccagaccgtgagcaaggacgtgaacaccaccatcatggagctgctgatcatggtgtacgcctgcaagaccagctgcgccaagagcatcatcggcgtgatcccctacttcccctacagcaagcagtgcaagatgagaaagagaggcagcatcgtgagcaagctgctggccagcatgatgtgcaaggccggcctgacccacctgatcaccatggacctgcaccagaaggagatccagggcttcttcaacatccccgtggacaacctgagagccagccccttcctgctgcagtacatccaggaggagtag

SEQ ID NO: 93404 - DNA, 735 bp, Artificial Sequence
  Description of Artificial Sequence: Synthetic coding sequence
atgttctgcgtgaccccccccgagctggagaccaagatgaacatcaccaagggcggcctggtgctgttcagcgccaacagcaacagcagctgcatggagctgagcaagaagatcgccgagagactgggcgtggagatgggcaaggtgcaggtgtaccaggagcccaacagagagaccagagtgcagatccaggagagcgtgagaggcaaggacgtgttcatcatccagaccgtgagcaaggacgtgaacaccaccatcatggagctgctgatcatggtgtacgcctgcaagaccagctgcgccaagagcatcatcggcgtgatcccctacttcccctacagcaagcagtgcaagatgagaaagagaggcagcatcgtgagcaagctgctggccagcatgatgtgcaaggccggcctgacccacctgatcaccatggacctgcaccagaaggagatccagggcttcttcaacatccccgtggacaacctgagagccagccccttcctgctgcagtacatccaggaggagatccccgactacagaaacgccgtgatcgtggccaagagccccgccagcgccaagagagcccagagcttcgccgagagactgagactgggcatcgccgtgatccacggcgaggcccaggacgccgagagcgacctggtggacggcagacacagcccccccatggtgagaagcgtggccgccatccaccccagcctggagatcccctag

SEQ ID NO: 93405 - DNA, 135 bp, Artificial Sequence
  Description of Artificial Sequence: Synthetic coding sequence
atgttctgcgtgaccccccccgagctggagaccaagatgaacatcaccaagggcggcctggtgctgttcagcgccaacagcaacagcagctgcatggagctgagcaagaagatcgccgagagactgggcgtgtag

SEQ ID NO: 93406 - DNA, 807 bp, Artificial Sequence; identical to SEQ ID NO: 93400
  Description of Artificial Sequence: Synthetic coding sequence

SEQ ID NO: 93407 - DNA, 423 bp, Artificial Sequence
  Description of Artificial Sequence: Synthetic coding sequence
atgttctgcgtgaccccccccgagctggagaccaagatgaacatcaccaagggcggcctggtgctgttcagcgccaacagcaacagcagctgcatggagctgagcaagaagatcgccgagagactgggcgtggagatgggcaaggtgcaggtgtaccaggagcccaacagagagaccagagtgcagatccaggagagcgtgagaggcaaggacgtgttcatcatccagaccgtgagcaaggacgtgaacaccaccatcatggagctgctgatcatggtgtacgcctgcaagaccagctgcgccaagagcatcatcggcgtgatcccctacttcccctacagcaagcagtgcaagatgagaaagagaggcagcatcgtgagcaagctgctggccagcatgatgtgcaaggccggcctgacctag

SEQ ID NO: 93408 - DNA, 807 bp, Artificial Sequence; identical to SEQ ID NO: 93400
  Description of Artificial Sequence: Synthetic coding sequence

SEQ ID NO: 93409 - DNA, 852 bp, Artificial Sequence
  Description of Artificial Sequence: Synthetic coding sequence
atggagctgctgatcatggtgtacgcctgcaagaccagctgcgccaagagcatcatcggcgtgatcccctacttcccctacagcaagcagtgcaagatgagaaagagaggcagcatcgtgagcaagctgctggccagcatgatgtgcaaggccggcctgacccacctgatcaccatggacctgcaccagaaggagatccagggcttcttcaacatccccgtggacaacctgagagccagccccttcctgctgcagtacatccaggaggagatccccgactacagaaacgccgtgatcgtggccaagagccccgccagcgccaagagagcccagagcttcgccgagagactgagactgggcatcgccgtgatccacggcgaggcccaggacgccgagagcgacctggtggacggcagacacagcccccccatggtgagaagcgtggccgccatccaccccagcctggagatccccatgctgatccccaaggagaagccccccatcaccgtggtgggcgacgtgggcggcagaatcgccatcatcgtggacgacatcatcgacgacgtggacagcttcctggccgccgccgagaccctgaaggagagaggcgcctacaagatcttcgtgatggccacccacggcctgctgagcagcgacgcccccagaagaatcgaggagagcgccatcgacgaggtggtggtgaccaacaccatcccccacgaggtgcagaagctgcagtgccccaagatcaagaccgtggacatcagcatgatcctgagcgaggccatcagaagaatccacaacggcgagagcatgagctacctgttcagaaacatcggcctggacgactag

SEQ ID NO: 93410 - DNA, 963 bp, Artificial Sequence
  Description of Artificial Sequence: Synthetic coding sequence
atgttctgcgtgaccccccccgagctggagaccaagatgaacatcaccaagggcggcctggtgctgttcagcgccaacagcaacagcagctgcatggagctgagcaagaagatcgccgagagactgggcgtggagatgggcaaggtgcaggtgtaccaggagcccaacagagagaccagagtgcagatccaggagagcgtgagaggcaaggacgtgttcatcatccagaccgtgagcaaggacgtgaacaccaccatcatggagctgctgatcatggtgtacgcctgcaagaccagctgcgccaagagcatcatcggcgtgatcccctacttcccctacagcaagcagtgcaagatgagaaagagaggcagcatcgtgagcaagctgctggccagcatgatgtgcaaggccggcctgacccacctgatcaccatggacctgcaccagaaggagatccagggcttcttcaacatccccgtggacaacctgagagccagccccttcctgctgcagtacatccaggaggagatccccgactacagaaacgccgtgatcgtggccaagagccccgccagcgccaagagagcccagagcttcgccgagagactgagactgggcatcgccgtgatccacggcgaggcccaggacgccgagagcgacctggtggacggcagacacagcccccccatggtgagaagcgtggccgccatccaccccagcctggagatccccatgctgatccccaaggagaagccccccatcaccgtggtgggcgacgtgggcggcagaatcgccatcatcgtggtggtggtgaccaacaccatcccccacgaggtgcagaagctgcagtgccccaagatcaagaccgtggacatcagcatgatcctgagcgaggccatcagaagaatccacaacggcgagagcatgagctacctgttcagaaacatcggcctggacgactag

SEQ ID NO: 93411 - DNA, 237 bp, Artificial Sequence
  Description of Artificial Sequence: Synthetic coding sequence
atgttctgcgtgaccccccccgagctggagaccaagatgaacatcaccaagggcggcctggtgctgttcagcgccaacagcaacagcagctgcatggagctgagcaagaagatcgccgagaacaagagcaccaacagcagagtgtgcgagggcaagagatgcttccaccaccccaactgcttcgagggcagagagcaccaccaccacggcgcccccgaccacggcgtgtgcatgtag

SEQ ID NO: 93412 - DNA, 678 bp, Artificial Sequence
  Description of Artificial Sequence: Synthetic coding sequence
atggccggcagcagcgaggaggcccccgactacggcagaggcgtggtgatcatggacgactggcccggctacgacctgaacctgttcacctacccccagcactactacggcgacctggagtacgtgctgatcccccacggcatcatcgtggacagaatcgagagactggccaaggacatcatgaaggacatcggctacagcgacatcatggtgctgtgcgtgctgaagggcggctacaagttctgcgccgacctggtggagcacctgaagaacatcagcagaaacagcgacagattcgtgagcatgaaggtggacttcatcagactgaagagctacagaaacgaccagagcatgggcgagatgcagatcatcggcggcgacgacctgagcaccctggccggcaagaacgtgctgatcgtggaggacgtggtgggcaccggcagaaccatgaaggccctgctgagcaacatcgagaagtacaagcccaacatgatcaaggtggccagcctgctggtgaagagaaccagcagaagcgacggcttcagacccgactacgccggcttcgagatccccaacctgttcgtggtgggctacgccctggactacaacgagtacttcagagacctgaaccacatctgcgtgatcaacgagcacggcaaggagaagtacagagtgtag

SEQ ID NO: 93413 - DNA, 573 bp, Artificial Sequence
  Description of Artificial Sequence: Synthetic coding sequence
atggccggcagcagcgaggaggcccccgactacggcagaggcgtggtgatcatggacgactggcccggctacgacctgaacctgttcacctacccccagcactactacggcgacctggagtacgtgctgatcccccacggcatcatcgtggacagaatcgagagactggccaaggacatcatgaaggacatcggctacagcgacatcatggtgctgtgcgtgctgaagggcggctacaagttctgcgccgacctggtggagcacctgaagaacatcagcagaaacagcgacagattcgtgagcatgaaggtggacttcatcagactgaagagctacagaaacgaccagagcatgggcgagatgcagatcatcggcggcgacgacctgagcaccctggccggcaagagcgtgctgttcgccaaggacgtggtgggcaccggcagaaccatgaaggccctgctgagcaacatcgagaagtacaagcccaacatgatcaaggtggccagcctgctggtgaagagaaccagcagaagcgacggcttcagacccgacagccacatgagacaccagtag

SEQ ID NO: 93414 - DNA, 522 bp, Artificial Sequence
  Description of Artificial Sequence: Synthetic coding sequence
atggccggcagcagcgaggaggcccccgactacggcagaggcgtggtgatcatggacgactggcccggctacgacctgaacctgttcacctacccccagcactactacggcgacctggagtacgtgctgatcccccacggcatcatcgtggacagaatcgagagactggccaaggacatcatgaaggacatcggctacagcgacatcatggtgctgtgcgtgctgaagggcggctacaagttctgcgccgacctggtggagcacctgaagaacatcagcagaaacagcgacagattcgtgagcatgaaggtggacttcatcagactgaagagctacagactgagagccagactgaagagaaccaccatctgcgacagaggcggcctggccttcagccagggctacatgagcagctgcgcccccctgcaggagagccccaacaccctgtggagaggctacctgcaggtgctgatcccctgcttccacatcagattccagctgcccagaagcgagcagaactag

SEQ ID NO: 93415 - DNA, 573 bp, Artificial Sequence
  Description of Artificial Sequence: Synthetic coding sequence
atggccggcagcagcgaggaggcccccgactacggcagaggcgtggtgatcatggacgactggcccggctacgacctgaacctgttcacctacccccagcactactacggcgacctggagtacgtgctgatcccccacggcatcatcgtggacagaatcgagagactggccaaggacatcatgaaggacatcggctacagcgacatcatggtgctgtgcgtgctgaagggcggctacaagttctgcgccgacctggtggagcacctgaagaacatcagcagaaacagcgacagattcgtgagcatgaaggtggacttcatcagactgaagagctacagaaacgaccagagcatgggcgagatgcagatcatcggcggcgacgacctgagcaccctggccggcaagaacgtgctgatcgtggaggacgtggtgggcaccggcagaaccatgaaggccctgctgagcaacatcgagaagtacaagcccaacatgatcaaggtggccagcctgctggtgaagagaaccagcagaagcgacggcttcagacccgacagccacatgagacaccagtag

SEQ ID NO: 93416 - DNA, 1299 bp, Artificial Sequence
  Description of Artificial Sequence: Synthetic coding sequence
atggccaccgccgaggtgctgaacatcggcaagaagctgtacgagggcaagaccaaggaggtgtacgagctgctggacagccccggcaaggtgctgctgcagagcaaggaccagatcaccgccggcaacgccgccagaaagaaccacctggagggcaaggccgccatcagcaacaagatcaccagctgcatcttccagctgctgcaggaggccgtgaccagctacaagagcaacagaatcaagaccgccttcaccagaaagtgcggcgagaccgccttcatcgccccccagtgcgagatgatccccatcgagtgggtgtgcagaagaatcgccaccggcagcttcctgaagagaaaccccggcgtgaaggagggctacaagttctacccccccaaggtggagctgttcttcaaggacgacgccaacaacgacccccagtggagcgaggagcagctgatcgccgccaagttctgcttcgccggcctgctgatcggccagaccgaggtggacatcatgagccacgccacccaggccatcttcgagatcctggagaagagctggctgccccagaactgcaccctggtggacatgaagatcgagttcggcgtggacgtgaccaccaaggagatcgtgctggccgacgtgatcgacaacgacagctggagactgtggcccagcggcgacagaagccagcagaaggacaagcagagctacagagacctgaaggaggtgacccccgagggcctgcagatggtgaagaagaacttcgagtgggtggccgagagagtggagctgctgctgaagagcgagagccagtgcagagtggtggtgctgatgggcagcaccagcgacctgggccactgcgagaagatcaagaaggcctgcggcaacttcggcatcccctgcgagctgagagtgaccagcgcccacaagggccccgacgagaccctgagaatcaaggccgagtacgagggcgacggcatccccaccgtgttcgtggccgtggccggcagaagcaacggcctgggccccgtgatgagcggcaacaccgcctaccccgtgatcagctgcccccccctgacccccgactggggcgtgcaggacgtgtggagcagcctgagactgcccagcggcctgggctgcagcaccgtgctgagccccgagggcagcgcccagttcgccgcccagatcttcggcctgagcaaccacctggtgtggagcaagctgagagccagcatcctgaacacctggatcagcctgaagcaggccgacaagaagatcagagagtgcaacctgtag

SEQ ID NO: 93417 - DNA, 1278 bp, Artificial Sequence
  Description of Artificial Sequence: Synthetic coding sequence
atggccaccgccgaggtgctgaacatcggcaagaagctgtacgagggcaagaccaaggaggtgtacgagctgctggacagccccggcaaggtgctgctgcagagcaaggaccagatcaccgccggcaacgccgccagaaagaaccacctggagggcaaggccgccatcagcaacaagatcaccagctgcatcttccagctgctgcaggaggccggcatcaagaccgccttcaccagaaagtgcggcgagaccgccttcatcgccccccagtgcgagatgatccccatcgagtgggtgtgcagaagaatcgccaccggcagcttcctgaagagaaaccccggcgtgaaggagggctacaagttctacccccccaaggtggagctgttcttcaaggacgacgccaacaacgacccccagtggagcgaggagcagctgatcgccgccaagttctgcttcgccggcctgctgatcggccagaccgaggtggacatcatgagccacgccacccaggccatcttcgagatcctggagaagagctggctgccccagaactgcaccctggtggacatgaagatcgagttcggcgtggacgtgaccaccaaggagatcgtgctggccgacgtgatcgacaacgacagctggagactgtggcccagcggcgacagaagccagcagaaggacaagcagagctacagagacctgaaggaggtgacccccgagggcctgcagatggtgaagaagaacttcgagtgggtggccgagagagtggagctgctgctgaagagcgagagccagtgcagagtggtggtgctgatgggcagcaccagcgacctgggccactgcgagaagatcaagaaggcctgcggcaacttcggcatcccctgcgagctgagagtgaccagcgcccacaagggccccgacgagaccctgagaatcaaggccgagtacgagggcgacggcatccccaccgtgttcgtggccgtggccggcagaagcaacggcctgggccccgtgatgagcggcaacaccgcctaccccgtgatcagctgcccccccctgacccccgactggggcgtgcaggacgtgtggagcagcctgagactgcccagcggcctgggctgcagcaccgtgctgagccccgagggcagcgcccagttcgccgcccagatcttcggcctgagcaaccacctggtgtggagcaagctgagagccagcatcctgaacacctggatcagcctgaagcaggccgacaagaagatcagagagtgcaacctgtag

SEQ ID NO: 93418 - DNA, 1278 bp, Artificial Sequence; identical to SEQ ID NO: 93417
  Description of Artificial Sequence: Synthetic coding sequence

SEQ ID NO: 93419 - DNA, 4017 bp, Artificial Sequence
  Description of Artificial Sequence: Synthetic coding sequence
atgagccccgtgctgcacttctacgtgagacccagcggccacgagggcgccgcccccggccacaccagaagaaagctgcagggcaagctgcccgagctgcagggcgtggagaccgagctgtgctacaacgtgaactggaccgccgaggccctgcccagcgccgaggagaccaagaagctgatgtggctgttcggctgccccctgctgctggacgacgtggccagagagagctggctgctgcccggcagcaacgacctgctgctggaggtgggccccagactgaacttcagcacccccaccagcaccaacatcgtgagcgtgtgcagagccaccggcctgggccccgtggacagagtggagaccaccagaagatacagactgagcttcgcccacccccccagcgccgaggtggaggccatcgccctggccaccctgcacgacagaatgaccgagcagcacttcccccaccccatccagagcttcagccccgagagcatgcccgagcccctgaacggccccatcaacatcctgggcgagggcagactggccctggagaaggccaaccaggagctgggcctggccctggacagctgggacctggacttctacaccaagagattccaggagctgcagagaaaccccagcaccgtggaggccttcgacctggcccagagcaacagcgagcacagcagacactggttcttcaagggccagctgcacgtggacggccagaagctggtgcacagcctgttcgagagcatcatgagcacccaggagagcagcaaccccaacaacgtgctgaagttctgcgacaacagcagcgccatccagggcaaggaggtgagattcctgagacccgaggaccccaccagacccagcagattccagcagcagcagggcctgagacacgtggtgttcaccgccgagacccacaacttccccaccggcgtgtgccccttcagcggcgccaccaccggcaccggcggcagaatcagagacgtgcagtgcaccggcagaggcgcccacgtggtggccggcaccgccggctactgcttcggcaacctgcacatccccggctacaacctgccctgggaggaccccagcttccagtaccccggcaacttcgccagacccctggaggtggccatcgaggccagcaacggcgccagcgactacggcaacaagttcggcgagcccgtgctggccggcttcgccagaagcctgggcctgcagctgcccgacggccagagaagagagtggatcaagcccatcatgttcagcggcggcatcggcagcatggaggccgaccacatcagcaaggaggcccccgagcccggcatggaggtggtgaaggtgggcggccccgtgtacagaatcggcgtgggcggcggcgccgccagcagcgtgcaggtgcagggcgacaacaccagcgacctggacttcggcgccgtgcagagaggcgaccccgagatggagcagaagatgaacagagtgatcagagcctgcgtggaggcccccaagggcaaccccatctgcagcctgcacgaccagggcgccggcggcaacggcaacgtgctgaaggagctgagcgaccccgccggcgccatcatctacaccagcagattccagctgggcgaccccaccctgaacgccctggagatctggggcgccgagtaccaggagagcaacgccctgctgctgagaagccccaacagagacttcctgacccacgtgagcgccagagagagatgccccgcctgcttcgtgggcaccatcaccggcgacagaagaatcgtgctggtggacgacagagagtgccccgtgagaagaaacggccagggcgacgccccccccacccccctgcccacccccgtggacctggagctggagtgggtgctgggcaagatgcccagaaaggagttcttcctgcagagaaagccccccatgctgcagcccctggccctgccccccggcctgagcgtgcaccaggccctggagagagtgctgagactgcccgccgtggccagcaagagatacctgaccaacaaggtggacagaagcgtgggcggcctggtggcccagcagcagtgcgtgggccccctgcagacccccctggccgacgtggccgtggtggccctgagccacgaggagctgatcggcgccgccaccgccctgggcgagcagcccgtgaagagcctgctggaccccaaggtggccgccagactggccgtggccgaggccctgaccaacctggtgttcgccctggtgaccgacctgagagacgtgaagtgcagcggcaactggatgtgggccgccaagctgcccggcgagggcgccgccctggccgacgcctgcgaggccatggtggccgtgatggccgccctgggcgtggccgtggacggcggcaaggacagcctgagcatggccgccagagtgggcaccgagaccgtgagagcccccggcagcctggtgatcagcgcctacgccgtgtgccccgacatcaccgccaccgtgacccccgacctgaagcaccccgagggcagaggccacctgctgtacgtggccctgagccccggccagcacagactgggcggcaccgccctggcccagtgcttcagccagctgggcgagcacccccccgacctggacctgcccgagaacctggtgagagccttcagcatcacccagggcctgctgaaggacagactgctgtgcagcggccacgacgtgagcgacggcggcctggtgacctgcctgctggagatggccttcgccggcaactgcggcctgcaggtggacgtgcccgtgcccagagtggacgtgctgagcgtgctgttcgccgaggagcccggcctggtgctggaggtgcaggagcccgacctggcccaggtgctgaagagatacagagacgccggcctgcactgcctggagctgggccacaccggcgaggccggcccccacgccatggtgagagtgagcgtgaacggcgccgtggtgctggaggagcccgtgggcgagctgagagccctgtgggaggagaccagcttccagctggacagactgcaggccgagcccagatgcgtggccgaggaggagagaggcctgagagagagaatgggccccagctactgcctgccccccaccttccccaaggccagcgtgcccagagagcccggcggccccagccccagagtggccatcctgagagaggagggcagcaacggcgacagagagatggccgacgccttccacctggccggcttcgaggtgtgggacgtgaccatgcaggacctgtgcagcggcgccatcggcctggacaccttcagaggcgtggccttcgtgggcggcttcagctacgccgacgtgctgggcagcgccaagggctgggccgccgccgtgaccttccaccccagagccggcgccgagctgagaagattcagaaagagacccgacaccttcagcctgggcgtgtgcaacggctgccagctgctggccctgctgggctgggtgggcggcgaccccaacgaggacgccgccgagatgggccccgacagccagcccgccagacccggcctgctgctgagacacaacctgagcggcagatacgagagcagatgggccagcgtgagagtgggccccggccccgccctgatgctgagaggcatggagggcgccgtgctgcccgtgtggagcgcccacggcgagggctacgtggccttcagcagccccgagctgcaggcccagatcgaggccagaggcctggcccccctgcactgggccgacgacgacggcaaccccaccgagcagtaccccctgaaccccaacggcagccccggcggcgtggccggcatctgcagctgcgacggcagacacctggccgtgatgccccaccccgagagagccgtgagaccctggcagtgggcctggagacccccccccttcgacaccctgaccaccagcccctggctgcagctgttcatcaacgccagaaactggaccctggagggcagctgctag

SEQ ID NO: 93420 - DNA, 2745 bp, Artificial Sequence
  Description of Artificial Sequence: Synthetic coding sequence
atgttcagcggcggcatcggcagcatggaggccgaccacatcagcaaggaggcccccgagcccggcatggaggtggtgaaggtgggcggccccgtgtacagaatcggcgtgggcggcggcgccgccagcagcgtgcaggtgcagggcgacaacaccagcgacctggacttcggcgccgtgcagagaggcgaccccgagatggagcagaagatgaacagagtgatcagagcctgcgtggaggcccccaagggcaaccccatctgcagcctgcacgaccagggcgccggcggcaacggcaacgtgctgaaggagctgagcgaccccgccggcgccatcatctacaccagcagattccagctgggcgaccccaccctgaacgccctggagatctggggcgccgagtaccaggagagcaacgccctgctgctgagaagccccaacagagacttcctgacccacgtgagcgccagagagagatgccccgcctgcttcgtgggcaccatcaccggcgacagaagaatcgtgctggtggacgacagagagtgccccgtgagaagaaacggccagggcgacgccccccccacccccctgcccacccccgtggacctggagctggagtgggtgctgggcaagatgcccagaaaggagttcttcctgcagagaaagccccccatgctgcagcccctggccctgccccccggcctgagcgtgcaccaggccctggagagagtgctgagactgcccgccgtggccagcaagagatacctgaccaacaaggtggacagaagcgtgggcggcctggtggcccagcagcagtgcgtgggccccctgcagacccccctggccgacgtggccgtggtggccctgagccacgaggagctgatcggcgccgccaccgccctgggcgagcagcccgtgaagagcctgctggaccccaaggtggccgccagactggccgtggccgaggccctgaccaacctggtgttcgccctggtgaccgacctgagagacgtgaagtgcagcggcaactggatgtgggccgccaagctgcccggcgagggcgccgccctggccgacgcctgcgaggccatggtggccgtgatggccgccctgggcgtggccgtggacggcggcaaggacagcctgagcatggccgccagagtgggcaccgagaccgtgagagcccccggcagcctggtgatcagcgcctacgccgtgtgccccgacatcaccgccaccgtgacccccgacctgaagcaccccgagggcagaggccacctgctgtacgtggccctgagccccggccagcacagactgggcggcaccgccctggcccagtgcttcagccagctgggcgagcacccccccgacctggacctgcccgagaacctggtgagagccttcagcatcacccagggcctgctgaaggacagactgctgtgcagcggccacgacgtgagcgacggcggcctggtgacctgcctgctggagatggccttcgccggcaactgcggcctgcaggtggacgtgcccgtgcccagagtggacgtgctgagcgtgctgttcgccgaggagcccggcctggtgctggaggtgcaggagcccgacctggcccaggtgctgaagagatacagagacgccggcctgcactgcctggagctgggccacaccggcgaggccggcccccacgccatggtgagagtgagcgtgaacggcgccgtggtgctggaggagcccgtgggcgagctgagagccctgtgggaggagaccagcttccagctggacagactgcaggccgagcccagatgcgtggccgaggaggagagaggcctgagagagagaatgggccccagctactgcctgccccccaccttccccaaggccagcgtgcccagagagcccggcggccccagccccagagtggccatcctgagagaggagggcagcaacggcgacagagagatggccgacgccttccacctggccggcttcgaggtgtgggacgtgaccatgcaggacctgtgcagcggcgccatcggcctggacaccttcagaggcgtggccttcgtgggcggcttcagctacgccgacgtgctgggcagcgccaagggctgggccgccgccgtgaccttccaccccagagccggcgccgagctgagaagattcagaaagagacccgacaccttcagcctgggcgtgtgcaacggctgccagctgctggccctgctgggctgggtgggcggcgaccccaacgaggacgccgccgagatgggccccgacagccagcccgccagacccggcctgctgctgagacacaacctgagcggcagatacgagagcagatgggccagcgtgagagtgggccccggccccgccctgatgctgagaggcatggagggcgccgtgctgcccgtgtggagcgcccacggcgagggctacgtggccttcagcagccccgagctgcaggcccagatcgaggccagaggcctggcccccctgcactgggccgacgacgacggcaaccccaccgagcagtaccccctgaaccccaacggcagccccggcggcgtggccggcatctgcagctgcgacggcagacacctggccgtgatgccccaccccgagagagccgtgagaccctggcagtgggcctggagacccccccccttcgacaccctgaccaccagcccctggctgcagctgttcatcaacgccagaaactggaccctggagggcagctgctag

SEQ ID NO: 93421 - DNA, 2244 bp, Artificial Sequence
  Description of Artificial Sequence: Synthetic coding sequence
gtgaagggcgagagaagaatcgtgctggtggacgacagagagtgccccgtgagaagaaacggccagggcgacgccccccccacccccctgcccacccccgtggacctggagctggagtgggtgctgggcaagatgcccagaaaggagttcttcctgcagagaaagccccccatgctgcagcccctggccctgccccccggcctgagcgtgcaccaggccctggagagagtgctgagactgcccgccgtggccagcaagagatacctgaccaacaaggtggacagaagcgtgggcggcctggtggcccagcagcagtgcgtgggccccctgcagacccccctggccgacgtggccgtggtggccctgagccacgaggagctgatcggcgccgccaccgccctgggcgagcagcccgtgaagagcctgctggaccccaaggtggccgccagactggccgtggccgaggccctgaccaacctggtgttcgccctggtgaccgacctgagagacgtgaagtgcagcggcaactggatgtgggccgccaagctgcccggcgagggcgccgccctggccgacgcctgcgaggccatggtggccgtgatggccgccctgggcgtggccgtggacggcggcaaggacagcctgagcatggccgccagagtgggcaccgagaccgtgagagcccccggcagcctggtgatcagcgcctacgccgtgtgccccgacatcaccgccaccgtgacccccgacctgaagcaccccgagggcagaggccacctgctgtacgtggccctgagccccggccagcacagactgggcggcaccgccctggcccagtgcttcagccagctgggcgagcacccccccgacctggacctgcccgagaacctggtgagagccttcagcatcacccagggcctgctgaaggacagactgctgtgcagcggccacgacgtgagcgacggcggcctggtgacctgcctgctggagatggccttcgccggcaactgcggcctgcaggtggacgtgcccgtgcccagagtggacgtgctgagcgtgctgttcgccgaggagcccggcctggtgctggaggtgcaggagcccgacctggcccaggtgctgaagagatacagagacgccggcctgcactgcctggagctgggccacaccggcgaggccggcccccacgccatggtgagagtgagcgtgaacggcgccgtggtgctggaggagcccgtgggcgagctgagagccctgtgggaggagaccagcttccagctggacagactgcaggccgagcccagatgcgtggccgaggaggagagaggcctgagagagagaatgggccccagctactgcctgccccccaccttccccaaggccagcgtgcccagagagcccggcggccccagccccagagtggccatcctgagagaggagggcagcaacggcgacagagagatggccgacgccttccacctggccggcttcgaggtgtgggacgtgaccatgcaggacctgtgcagcggcgccatcggcctggacaccttcagaggcgtggccttcgtgggcggcttcagctacgccgacgtgctgggcagcgccaagggctgggccgccgccgtgaccttccaccccagagccggcgccgagctgagaagattcagaaagagacccgacaccttcagcctgggcgtgtgcaacggctgccagctgctggccctgctgggctgggtgggcggcgaccccaacgaggacgccgccgagatgggccccgacagccagcccgccagacccggcctgctgctgagacacaacctgagcggcagatacgagagcagatgggccagcgtgagagtgggccccggccccgccctgatgctgagaggcatggagggcgccgtgctgcccgtgtggagcgcccacggcgagggctacgtggccttcagcagccccgagctgcaggcccagatcgaggccagaggcctggcccccctgcactgggccgacgacgacggcaaccccaccgagcagtaccccctgaaccccaacggcagccccggcggcgtggccggcatctgcagctgcgacggcagacacctggccgtgatgccccaccccgagagagccgtgagaccctggcagtgggcctggagacccccccccttcgacaccctgaccaccagcccctggctgcagctgttcatcaacgccagaaactggaccctggagggcagctgctag

SEQ ID NO: 93422 - DNA, 1302 bp, Artificial Sequence
  Description of Artificial Sequence: Synthetic coding sequence
atggccgccagagtgctgatcatcggcagcggcggcagagagcacaccctggcctggaagctggcccagagccaccacgtgaagcaggtgctggtggcccccggcaacgccggcaccgcctgcagcgagaagatcagcaacaccgccatcagcatcagcgaccacaccgccctggcccagttctgcaaggagaagaagatcgagttcgtggtggtgggccccgaggcccccctggccgccggcatcgtgggcaacctgagaagcgccggcgtgcagtgcttcggccccaccgccgaggccgcccagctggagagcagcaagagattcgccaaggagttcatggacagacacggcatccccaccgcccagtggaaggccttcaccaagcccgaggaggcctgcagcttcatcctgagcgccgacttccccgccctggtggtgaaggccagcggcctggccgccggcaagggcgtgatcgtggccaagagcaaggaggaggcctgcaaggccgtgcaggagatcatgcaggagaaggccttcggcgccgccggcgagaccatcgtgatcgaggagctgctggacggcgaggaggtgagctgcctgtgcttcaccgacggcaagaccgtggcccccatgccccccgcccaggaccacaagagactgctggagggcgacggcggccccaacaccggcggcatgggcgcctactgccccgccccccaggtgagcaacgacctgctgctgaagatcaaggacaccgtgctgcagagaaccgtggacggcatgcagcaggagggcaccccctacaccggcatcctgtacgccggcatcatgctgaccaagaacggccccaaggtgctggagttcaactgcagattcggcgaccccgagtgccaggtgatcctgcccctgctgaagagcgacctgtacgaggtgatccagagcaccctggacggcctgctgtgcaccagcctgcccgtgtggctggagaaccacaccgccctgaccgtggtgatggccagcaagggctaccccggcgactacaccaagggcgtggagatcaccggcttccccgaggcccaggccctgggcctggaggtgttccacgccggcaccgccctgaagaacggcaaggtggtgacccacggcggcagagtgctggccgtgaccgccatcagagagaacctgatcagcgccctggaggaggccaagaagggcctggccgccatcaagttcgagggcgccatctacagaaaggacgtgggcttcagagccatcgccttcctgcagcagcccagatag

SEQ ID NO: 93423 - DNA, 3033 bp, Artificial Sequence
  Description of Artificial Sequence: Synthetic coding sequence
atggccgccagagtgctgatcatcggcagcggcggcagagagcacaccctggcctggaagctggcccagagccaccacgtgaagcaggtgctggtggcccccggcaacgccggcaccgcctgcagcgagaagatcagcaacaccgccatcagcatcagcgaccacaccgccctggcccagttctgcaaggagaagaagatcgagttcgtggtggtgggccccgaggcccccctggccgccggcatcgtgggcaacctgagaagcgccggcgtgcagtgcttcggccccaccgccgaggccgcccagctggagagcagcaagagattcgccaaggagttcatggacagacacggcatccccaccgcccagtggaaggccttcaccaagcccgaggaggcctgcagcttcatcctgagcgccgacttccccgccctggtggtgaaggccagcggcctggccgccggcaagggcgtgatcgtggccaagagcaaggaggaggcctgcaaggccgtgcaggagatcatgcaggagaaggccttcggcgccgccggcgagaccatcgtgatcgaggagctgctggacggcgaggaggtgagctgcctgtgcttcaccgacggcaagaccgtggcccccatgccccccgcccaggaccacaagagactgctggagggcgacggcggccccaacaccggcggcatgggcgcctactgccccgccccccaggtgagcaacgacctgctgctgaagatcaaggacaccgtgctgcagagaaccgtggacggcatgcagcaggagggcaccccctacaccggcatcctgtacgccggcatcatgctgaccaagaacggccccaaggtgctggagttcaactgcagattcggcgaccccgagtgccaggtgatcctgcccctgctgaagagcgacctgtacgaggtgatccagagcaccctggacggcctgctgtgcaccagcctgcccgtgtggctggagaaccacaccgccctgaccgtggtgatggccagcaagggctaccccggcgactacaccaagggcgtggagatcaccggcttccccgaggcccaggccctgggcctggaggtgttccacgccggcaccgccctgaagaacggcaaggtggtgacccacggcggcagagtgctggccgtgaccgccatcagagagaacctgatcagcgccctggaggaggccaagaagggcctggccgccatcaagttcgagggcgccatctacagaaaggacgtgggcttcagagccatcgccttcctgcagcagcccagaagcctgacctacaaggagagcggcgtggacatcgccgccggcaacatgctggtgaagaagatccagcccctggccaaggccaccagcagaagcggctgcaaggtggacctgggcggcttcgccggcctgttcgacctgaaggccgccggcttcaaggaccccctgctggccagcggcaccgacggcgtgggcaccaagctgaagatcgcccagctgtgcaacaagcacgacaccatcggccaggacctggtggccatgtgcgtgaacgacatcctggcccagggcgccgagcccctgttcttcctggactacttcagctgcggcaagctggacctgagcgtgaccgaggccgtggtggccggcatcgccaaggcctgcggcaaggccggctgcgccctgctgggcggcgagaccgccgagatgcccgacatgtacccccccggcgagtacgacctggccggcttcgccgtgggcgccatggagagagaccagaagctgccccacctggagagaatcaccgagggcgacgtggtggtgggcatcgccagcagcggcctgcacagcaacggcttcagcctggtgagaaagatcgtggccaagagcagcctgcagtacagcagccccgcccccgacggctgcggcgaccagaccctgggcgacctgctgctgacccccaccagaatctacagccacagcctgctgcccgtgctgagaagcggccacgtgaaggccttcgcccacatcaccggcggcggcctgctggagaacatccccagagtgctgcccgagaagctgggcgtggacctggacgcccagacctggagaatccccagagtgttcagctggctgcagcaggagggccacctgagcgaggaggagatggccagaaccttcaactgcggcgtgggcgccgtgctggtggtgagcaaggagcagaccgagcagatcctgagagacatccagcagcacaaggaggaggcctgggtgatcggcagcgtggtggccagagccgagggcagccccagagtgaaggtgaagaacctgatcgagagcatgcagatcaacggcagcgtgctgaagaacggcagcctgaccaaccacttcagcttcgagaagaagaaggccagagtggccgtgctgatcagcggcaccggcagcaacctgcaggccctgatcgacagcaccagagagcccaacagcagcgcccagatcgacatcgtgatcagcaacaaggccgccgtggccggcctggacaaggccgagagagccggcatccccaccagagtgatcaaccacaagctgtacaagaacagagtggagttcgacagcgccatcgacctggtgctggaggagttcagcatcgacatcgtgtgcctggccggcttcatgagaatcctgagcggccccttcgtgcagaagtggaacggcaagatgctgaacatccaccccagcctgctgcccagcttcaagggcagcaacgcccacgagcaggccctggagaccggcgtgaccgtgaccggctgcaccgtgcacttcgtggccgaggacgtggacgccggccagatcatcctgcaggaggccgtgcccgtgaagagaggcgacaccgtggccaccctgagcgagagagtgaagctggccgagcacaagatcttccccgccgccctgcagctggtggccagcggcaccgtgcagctgggcgagaacggcaagatctgctgggtgaaggaggagtag

SEQ ID NO: 93424 - DNA, 3033 bp, Artificial Sequence; identical to SEQ ID NO: 93423
  Description of Artificial Sequence: Synthetic coding sequence

SEQ ID NO: 93425 - DNA, 3033 bp, Artificial Sequence; identical to SEQ ID NO: 93423
  Description of Artificial Sequence: Synthetic coding sequence

SEQ ID NO: 93426 - DNA, 699 bp, Artificial Sequence
  Description of Artificial Sequence: Synthetic coding sequence
atggccgccagagtgctgatcatcggcagcggcggcagagagcacaccctggcctggaagctggcccagagccaccacgtgaagcaggtgctggtggcccccggcaacgccggcaccgcctgcagcgagaagatcagcaacaccgccatcagcatcagcgaccacaccgccctggcccagttctgcaaggagaagaagatcgagttcgtggtggtgggccccgaggcccccctggccgccggcatcgtgggcaacctgagaagcgccggcgtgcagtgcttcggccccaccgccgaggccgcccagctggagagcagcaagagattcgccaaggagttcatggacagacacggcatccccaccgcccagtggaaggccttcaccaagcccgaggaggcctgcagcttcatcctgagcgccgacttccccgccctggtggtgaaggccagcggcctggccgccggcaagggcgtgatcgtggccaagagcaaggaggaggcctgcaaggccgtgcaggagatcatgcaggagaaggccttcggcgccgccggcgagaccatcgtgatcgaggagctgctggacggcgaggaggtgagctgcctgtgcttcaccgacggcaagaccgtggcccccatgccccccgcccaggaccacaagagactgctggagggcgacggcggccccaacaccggcggctag

SEQ ID NO: 93427 - DNA, 726 bp, Artificial Sequence
  Description of Artificial Sequence: Synthetic coding sequence
atggccgccagagtgctgatcatcggcagcggcggcagagagcacaccctggcctggaagctggcccagagccaccacgtgaagcaggtgctggtggcccccggcaacgccggcaccgcctgcagcgagaagatcagcaacaccgccatcagcatcagcgaccacaccgccctggcccagttctgcaaggagaagaagatcgagttcgtggtggtgggccccgaggcccccctggccgccggcatcgtgggcaacctgagaagcgccggcgtgcagtgcttcggccccaccgccgaggccgcccagctggagagcagcaagagattcgccaaggagttcatggacagacacggcatccccaccgcccagtggaaggccttcaccaagcccgaggaggcctgcagcttcatcctgagcgccgacttccccgccctggtggtgaaggccagcggcctggccgccggcaagggcgtgatcgtggccaagagcaaggaggaggcctgcaaggccgtgcaggagatcatgcaggagaaggccttcggcgccgccggcgagaccatcgtgatcgaggagctgctggacggcgaggaggtgagctgcctgtgcttcaccgacggcaagaccgtggcccccatgccccccgcccaggaccacaagagactgctggagggcgacggcggccccaacaccggcggcatgggcgcctactgccccgccccccagtag

SEQ ID NO: 93428 - DNA, 417 bp, Artificial Sequence
  Description of Artificial Sequence: Synthetic coding sequence
atggccgccagagtgctgatcatcggcagcggcggcagagagcacaccctggcctggaagctggcccagagccaccacgtgaagcaggtgctggtggcccccggcaacgccggcaccgcctgcagcgagaagatcagcaacaccgccatcagcatcagcgaccacaccgccctggcccagttctgcaaggagaagaagatcgagttcgtggtggtgggccccgaggcccccctggccgccggcatcgtgggcaacctgagaagcgccggcgtgcagtgcttcggccccaccgccgaggccgcccagctggagagcagcaagagattcgccaaggagttcatggacagacacggcatccccaccgcccagtggaaggccttcaccaagcccgaggaggcctgcagcttcatcctgtag

SEQ ID NO: 93429 - DNA, 411 bp, Artificial Sequence
  Description of Artificial Sequence: Synthetic coding sequence
atggccgccagagtgctgatcatcggcagcggcggcagagagcacaccctggcctggaagctggcccagagccaccacgtgaagcaggtgctggtggcccccggcaacgccggcaccgcctgcagcgagaagatcagcaacaccgccatcagcatcagcgaccacaccgccctggcccagttctgcaaggagaagaagatcgagttcgtggtggtgggccccgaggcccccctggccgccggcatcgtgggcaacctgagaagcgccggcgtgcagtgcttcggccccaccgccgaggccgcccagctggagagcagcaagagattcgccaaggagttcatggacagacacggcatccccaccgcccagtggaaggccttcaccaagcccgaggaggcctgcagcttctag

SEQ ID NO: 93430 - DNA, 1689 bp, Artificial Sequence
  Description of Artificial Sequence: Synthetic coding sequence
atgctggtgaagaagatccagcccctggccaaggccaccagcagaagcggctgcaaggtggacctgggcggcttcgccggcctgttcgacctgaaggccgccggcttcaaggaccccctgctggccagcggcaccgacggcgtgggcaccaagctgaagatcgcccagctgtgcaacaagcacgacaccatcggccaggacctggtggccatgtgcgtgaacgacatcctggcccagggcgccgagcccctgttcttcctggactacttcagctgcggcaagctggacctgagcgtgaccgaggccgtggtggccggcatcgccaaggcctgcggcaaggccggctgcgccctgctgggcggcgagaccgccgagatgcccgacatgtacccccccggcgagtacgacctggccggcttcgccgtgggcgccatggagagagaccagaagctgccccacctggagagaatcaccgagggcgacgtggtggtgggcatcgccagcagcggcctgcacagcaacggcttcagcctggtgagaaagatcgtggccaagagcagcctgcagtacagcagccccgcccccgacggctgcggcgaccagaccctgggcgacctgctgctgacccccaccagaatctacagccacagcctgctgcccgtgctgagaagcggccacgtgaaggccttcgcccacatcaccggcggcggcctgctggagaacatccccagagtgctgcccgagaagctgggcgtggacctggacgcccagacctggagaatccccagagtgttcagctggctgcagcaggagggccacctgagcgaggaggagatggccagaaccttcaactgcggcgtgggcgccgtgctggtggtgagcaaggagcagaccgagcagatcctgagagacatccagcagcacaaggaggaggcctgggtgatcggcagcgtggtggccagagccgagggcagccccagagtgaaggtgaagaacctgatcgagagcatgcagatcaacggcagcgtgctgaagaacggcagcctgaccaaccacttcagcttcgagaagaagaaggccagagtggccgtgctgatcagcggcaccggcagcaacctgcaggccctgatcgacagcaccagagagcccaacagcagcgcccagatcgacatcgtgatcagcaacaaggccgccgtggccggcctggacaaggccgagagagccggcatccccaccagagtgatcaaccacaagctgtacaagaacagagtggagttcgacagcgccatcgacctggtgctggaggagttcagcatcgacatcgtgtgcctggccggcttcatgagaatcctgagcggccccttcgtgcagaagtggaacggcaagatgctgaacatccaccccagcctgctgcccagcttcaagggcagcaacgcccacgagcaggccctggagaccggcgtgaccgtgaccggctgcaccgtgcacttcgtggccgaggacgtggacgccggccagatcatcctgcaggaggccgtgcccgtgaagagaggcgacaccgtggccaccctgagcgagagagtgaagctggccgagcacaagatcttccccgccgccctgcagctggtggccagcggcaccgtgcagctgggcgagaacggcaagatctgctgggtgaaggaggagtag

SEQ ID NO: 93431 - DNA, 2265 bp, Artificial Sequence
  Description of Artificial Sequence: Synthetic coding sequence
atgagcagacccctgagcgaccaggagaagagaaagcagatcagcgtgagaggcctggccggcgtggagaacgtgaccgagctgaagaagaacttcaacagacacctgcacttcaccctggtgaaggacagaaacgtggccacccccagagactactacttcgccctggcccacaccgtgagagaccacctggtgggcagatggatcagaacccagcagcactactacgagaaggaccccaagaagatcagcggcggctggcagatggaggaggccgacgactggctgagatacggcaacccctgggagaaggccagacccgagttcaccctgcccgtgcacttctacggccacgtggagcacaccagccagggcgccaagtgggtggacacccaggtggtgctggccatgccctacgacacccccgtgcccggctacagaaacaacgtggtgaacaccatgagactgtggagcgccaaggcccccaacgacttcaacctgaaggacttcaacgtgggcggctacatccaggccgtgctggacagaaacctggccgagaacatcagcagagtgctgtaccccaacgacaacttcttcgagggcaaggagctgagactgaagcaggagtacttcgtggtggccgccaccctgcaggacatcatcagaagattcaagagcagcaagttcggctgcagagaccccgtgagaaccaacttcgacgccttccccgacaaggtggccatccagctgaacgacacccaccccagcctggccatccccgagctgatgagaatcctggtggacctggagagaatggactgggacaaggcctgggacgtgaccgtgagaacctgcgcctacaccaaccacaccgtgctgcccgaggccctggagagatggcccgtgcacctgctggagaccctgctgcccagacacctgcagatcatctacgagatcaaccagagattcctgaacagagtggccgccgccttccccggcgacgtggacagactgagaagaatgagcctggtggaggagggcgccgtgaagagaatcaacatggcccacctgtgcatcgccggcagccacgccgtgaacggcgtggccagaatccacagcgagatcctgaagaagaccatcttcaaggacttctacgagctggagccccacaagttccagaacaagaccaacggcatcacccccagaagatggctggtgctgtgcaaccccggcctggccgaggtgatcgccgagagaatcggcgaggacttcatcagcgacctggaccagctgagaaagctgctgagcttcgtggacgacgaggccttcatcagagacgtggccaaggtgaagcaggagaacaagctgaagttcgccgcctacctggagagagagtacaaggtgcacatcaaccccaacagcctgttcgacatccaggtgaagagaatccacgagtacaagagacagctgctgaactgcctgcacgtgatcaccctgtacaacagaatcaagagagagcccaacaagttcttcgtgcccagaaccgtgatgatcggcggcaaggccgcccccggctaccacatggccaagatgatcatcagactggtgaccgccatcggcgacgtggtgaaccacgaccccgccgtgggcgacagactgagagtgatcttcctggagaactacagagtgagcctggccgagaaggtgatccccgccgccgacctgagcgagcagatcagcaccgccggcaccgaggccagcggcaccggcaacatgaagttcatgctgaacggcgccctgaccatcggcaccatggacggcgccaacgtggagatggccgaggaggccggcgaggagaacttcttcatcttcggcatgagagtggaggacgtggacaagctggaccagagaggctacaacgcccaggagtactacgacagaatccccgagctgagacaggtgatcgagcagctgagcagcggcttcttcagccccaagcagcccgacctgttcaaggacatcgtgaacatgctgatgcaccacgacagattcaaggtgttcgccgactacgaggactacatcaagtgccaggagaaggtgagcgccctgtacaagaaccccagagagtggaccagaatggtgatcagaaacatcgccaccagcggcaagttcagcagcgacagaaccatcgcccagtacgccagagagatctggggcgtggagcccagcagacagagactgcccgcccccgacgaggccatctag

SEQ ID NO: 93432 - DNA, 3633 bp, Artificial Sequence
  Description of Artificial Sequence: Synthetic coding sequence
atgagaagcagaagcaacagcggcgtgagactggacggctacgccagactggtgcagcagaccatcctgtgccaccagaaccccgtgaccggcctgctgcccgccagctacgaccagaaggacgcctgggtgagagacaacgtgtacagcatcctggccgtgtggggcctgggcctggcctacagaaagaacgccgacagagacgaggacaaggccaaggcctacgagctggagcagagcgtggtgaagctgatgagaggcctgctgcactgcatgatcagacaggtggacaaggtggagagcttcaagtacagccagagcaccaaggacagcctgcacgccaagtacaacaccaagacctgcgccaccgtggtgggcgacgaccagtggggccacctgcagctggacgccaccagcgtgtacctgctgttcctggcccagatgaccgccagcggcctgcacatcatccacagcctggacgaggtgaacttcatccagaacctggtgttctacatcgaggccgcctacaagaccgccgacttcggcatctgggagagaggcgacaagaccaaccagggcatcagcgagctgaacgccagcagcgtgggcatggccaaggccgccctggaggccctggacgagctggacctgttcggcgtgaagggcggcccccagagcgtgatccacgtgctggccgacgaggtgcagcactgccagagcatcctgaacagcctgctgcccagagccagcaccagcaaggaggtggacgccagcctgctgagcgtggtgagcttccccgccttcgccgtggaggacagccagctggtggagctgaccaagcaggagatcatcaccaagctgcagggcagatacggctgctgcagattcctgagagacggctacaagacccccaaggaggaccccaacagactgtactacgagcccgccgagctgaagctgttcgagaacatcgagtgcgagtggcccctgttctggacctacttcatcctggacggcgtgttcagcggcaacgccgagcaggtgcaggagtacaaggaggccctggaggccgtgctgatcaagggcaagaacggcgtgcccctgctgcccgagctgtacagcgtgccccccgacagagtggacgaggagtaccagaacccccacaccgtggacagagtgcccatgggcaagctgccccacatgtggggccagagcctgtacatcctgggcagcctgatggccgagggcttcctggcccccggcgagatcgaccccctgaacagaagattcagcaccgtgcccaagcccgacgtggtggtgcaggtgagcatcctggccgagaccgaggagatcaagaccatcctgaaggacaagggcatctacgtggagaccatcgccgaggtgtaccccatcagagtgcagcccgccagaatcctgagccacatctacagcagcctgggctgcaacaacagaatgaagctgagcggcagaccctacagacacatgggcgtgctgggcaccagcaagctgtacgacatcagaaagaccatcttcaccttcaccccccagttcatcgaccagcagcagttctacctggccctggacaacaagatgatcgtggagatgctgagaaccgacctgagctacctgtgcagcagatggagaatgaccggccagcccaccatcaccttccccatcagccacagcatgctggacgaggacggcaccagcctgaacagcagcatcctggccgccctgagaaagatgcaggacggctacttcggcggcgccagagtgcagaccggcaagctgagcgagttcctgaccaccagctgctgcacccacctgagcttcatggaccccggccccgagggcaagctgtacagcgaggactacgacgacaactacgactacctggagagcggcaactggatgaacgactacgacagcaccagccacgccagatgcggcgacgaggtggccagatacctggaccacctgctggcccacaccgccccccaccccaagctggcccccaccagccagaagggcggcctggacagattccaggccgccgtgcagaccacctgcgacctgatgagcctggtgaccaaggccaaggagctgcacgtgcagaacgtgcacatgtacctgcccaccaagctgttccaggccagcagacccagcttcaacctgctggacagcccccaccccagacaggagaaccaggtgcccagcgtgagagtggagatccacctgcccagagaccagagcggcgaggtggacttcaaggccctggtgctgcagctgaaggagaccagcagcctgcaggagcaggccgacatcctgtacatgctgtacaccatgaagggccccgactggaacaccgagctgtacaacgagagaagcgccaccgtgagagagctgctgaccgagctgtacggcaaggtgggcgagatcagacactggggcctgatcagatacatcagcggcatcctgagaaagaaggtggaggccctggacgaggcctgcaccgacctgctgagccaccagaagcacctgaccgtgggcctgccccccgagcccagagagaagaccatcagcgcccccctgccctacgaggccctgacccagctgatcgacgaggccagcgagggcgacatgagcatcagcatcctgacccaggagatcatggtgtacctggccatgtacatgagaacccagcccggcctgttcgccgagatgttcagactgagaatcggcctgatcatccaggtgatggccaccgagctggcccacagcctgagatgcagcgccgaggaggccaccgagggcctgatgaacctgagccccagcgccatgaagaacctgctgcaccacatcctgagcggcaaggagttcggcgtggagagaagcgtgagacccaccgacagcaacgtgagccccgccatcagcatccacgagatcggcgccgtgggcgccaccaagaccgagagaaccggcatcatgcagctgaagagcgagatcaagcagagccccggcaccagcatgacccccagcagcggcagcttccccagcgcctacgaccagcagagcagcaaggacagcagacagggccagtggcagagaagaagaagactggacggcgccctgaacagagtgcccgtgggcttctaccagaaggtgtggaaggtgctgcagaagtgccacggcctgagcgtggagggcttcgtgctgcccagcagcaccaccagagagatgacccccggcgagatcaagttcagcgtgcacgtggagagcgtgctgaacagagtgccccagcccgagtacagacagctgctggtggaggccatcctggtgctgaccatgctggccgacatcgagatccacagcatcggcagcatcatcgccgtggagaagatcgtgcacatcgccaacgacctgttcctgcaggagcagaagaccctgggcgccgacgacaccatgctggccaaggaccccgccagcggcatctgcaccctgctgtacgacagcgcccccagcggcagattcggcaccatgacctacctgagcaaggccgccgccacctacgtgcaggagttcctgccccacagcatctgcgccatgcagtag

SEQ ID NO: 93433 - DNA, 3723 bp, Artificial Sequence
  Description of Artificial Sequence: Synthetic coding sequence
atgagaagcagaagcaacagcggcgtgagactggacggctacgccagactggtgcagcagaccatcctgtgccaccagaaccccgtgaccggcctgctgcccgccagctacgaccagaaggacgcctgggtgagagacaacgtgtacagcatcctggccgtgtggggcctgggcctggcctacagaaagaacgccgacagagacgaggacaaggccaaggcctacgagctggagcagagcgtggtgaagctgatgagaggcctgctgcactgcatgatcagacaggtggacaaggtggagagcttcaagtacagccagagcaccaaggacagcctgcacgccaagtacaacaccaagacctgcgccaccgtggtgggcgacgaccagtggggccacctgcagctggacgccaccagcgtgtacctgctgttcctggcccagatgaccgccagcggcctgcacatcatccacagcctggacgaggtgaacttcatccagaacctggtgttctacatcgaggccgcctacaagaccgccgacttcggcatctgggagagaggcgacaagaccaaccagggcatcagcgagctgaacgccagcagcgtgggcatggccaaggccgccctggaggccctggacgagctggacctgttcggcgtgaagggcggcccccagagcgtgatccacgtgctggccgacgaggtgcagcactgccagagcatcctgaacagcctgctgcccagagccagcaccagcaaggaggtggacgccagcctgctgagcgtggtgagcttccccgccttcgccgtggaggacagccagctggtggagctgaccaagcaggagatcatcaccaagctgcagggcagatacggctgctgcagattcctgagagacggctacaagacccccaaggaggaccccaacagactgtactacgagcccgccgagctgaagctgttcgagaacatcgagtgcgagtggcccctgttctggacctacttcatcctggacggcgtgttcagcggcaacgccgagcaggtgcaggagtacaaggaggccctggaggccgtgctgatcaagggcaagaacggcgtgcccctgctgcccgagctgtacagcgtgccccccgacagagtggacgaggagtaccagaacccccacaccgtggacagagtgcccatgggcaagctgccccacatgtggggccagagcctgtacatcctgggcagcctgatggccgagggcttcctggcccccggcgagatcgaccccctgaacagaagattcagcaccgtgcccaagcccgacgtggtggtgcaggtgagcatcctggccgagaccgaggagatcaagaccatcctgaaggacaagggcatctacgtggagaccatcgccgaggtgtaccccatcagagtgcagcccgccagaatcctgagccacatctacagcagcctgggctgcaacaacagaatgaagctgagcggcagaccctacagacacatgggcgtgctgggcaccagcaagctgtacgacatcagaaagaccatcttcaccttcaccccccagttcatcgaccagcagcagttctacctggccctggacaacaagatgatcgtggagatgctgagaaccgacctgagctacctgtgcagcagatggagaatgaccggccagcccaccatcaccttccccatcagccacagcatgctggacgaggacggcaccagcctgaacagcagcatcctggccgccctgagaaagatgcaggacggctacttcggcggcgccagagtgcagaccggcaagctgagcgagttcctgaccaccagctgctgcacccacctgagcttcatggaccccggccccgagggcaagctgtacagcgaggactacgacgacaactacgactacctggagagcggcaactggatgaacgactacgacagcaccagccacgccagatgcggcgacgaggtggccagatacctggaccacctgctggcccacaccgccccccaccccaagctggcccccaccagccagaagggcggcctggacagattccaggccgccgtgcagaccacctgcgacctgatgagcctggtgaccaaggccaaggagctgcacgtgcagaacgtgcacatgtacctgcccaccaagctgttccaggccagcagacccagcttcaacctgctggacagcccccaccccagacaggagaaccaggtgcccagcgtgagagtggagatccacctgcccagagaccagagcggcgaggtggacttcaaggccctggtgctgcagctgaaggagaccagcagcctgcaggagcaggccgacatcctgtacatgctgtacaccatgaagggccccgactggaacaccgagctgtacaacgagagaagcgccaccgtgagagagctgctgaccgagctgtacggcaaggtgggcgagatcagacactggggcctgatcagatacatcagcggcatcctgagaaagaaggtggaggccctggacgaggcctgcaccgacctgctgagccaccagaagcacctgaccgtgggcctgccccccgagcccagagagaagaccatcagcgcccccctgccctacgaggccctgacccagctgatcgacgaggccagcgagggcgacatgagcatcagcatcctgacccaggagatcatggtgtacctggccatgtacatgagaacccagcccggcctgttcgccgagatgttcagactgagaatcggcctgatcatccaggtgatggccaccgagctggcccacagcctgagatgcagcgccgaggaggccaccgagggcctgatgaacctgagccccagcgccatgaagaacctgctgcaccacatcctgagcggcaaggagttcggcgtggagagaagcgtgagacccaccgacagcaacgtgagccccgccatcagcatccacgagatcggcgccgtgggcgccaccaagaccgagagaaccggcatcatgcagctgaagagcgagatcaagcaggtggagttcagaagactgagcatcagcgccgagagccagagcaacggcggccaccccctgggcatcgacctgatgagccccagcttcatgagccccggcaccagcatgacccccagcagcggcagcttccccagcgcctacgaccagcagagcagcaaggacagcagacagggccagtggcagagaagaagaagactggacggcgccctgaacagagtgcccgtgggcttctaccagaaggtgtggaaggtgctgcagaagtgccacggcctgagcgtggagggcttcgtgctgcccagcagcaccaccagagagatgacccccggcgagatcaagttcagcgtgcacgtggagagcgtgctgaacagagtgccccagcccgagtacagacagctgctggtggaggccatcctggtgctgaccatgctggccgacatcgagatccacagcatcggcagcatcatcgccgtggagaagatcgtgcacatcgccaacgacctgttcctgcaggagcagaagaccctgggcgccgacgacaccatgctggccaaggaccccgccagcggcatctgcaccctgctgtacgacagcgcccccagcggcagattcggcaccatgacctacctgagcaaggccgccgccacctacgtgcaggagttcctgccccacagcatctgcgccatgcagtag

SEQ ID NO: 93434 - DNA, 3672 bp, Artificial Sequence
  Description of Artificial Sequence: Synthetic coding sequence
atgagaagcagaagcaacagcggcgtgagactggacggctacgccagactggtgcagcagaccatcctgtgccaccagaaccccgtgaccggcctgctgcccgccagctacgaccagaaggacgcctgggtgagagacaacgtgtacagcatcctggccgtgtggggcctgggcctggcctacagaaagaacgccgacagagacgaggacaaggccaaggcctacgagctggagcagagcgtggtgaagctgatgagaggcctgctgcactgcatgatcagacaggtggacaaggtggagagcttcaagtacagccagagcaccaaggacagcctgcacgccaagtacaacaccaagacctgcgccaccgtggtgggcgacgaccagtggggccacctgcagctggacgccaccagcgtgtacctgctgttcctggcccagatgaccgccagcggcctgcacatcatccacagcctggacgaggtgaacttcatccagaacctggtgttctacatcgaggccgcctacaagaccgccgacttcggcatctgggagagaggcgacaagaccaaccagggcatcagcgagctgaacgccagcagcgtgggcatggccaaggccgccctggaggccctggacgagctggacctgttcggcgtgaagggcggcccccagagcgtgatccacgtgctggccgacgaggtgcagcactgccagagcatcctgaacagcctgctgcccagagccagcaccagcaaggaggtggacgccagcctgctgagcgtggtgagcttccccgccttcgccgtggaggacagccagctggtggagctgaccaagcaggagatcatcaccaagctgcagggcagatacggctgctgcagattcctgagagacggctacaagacccccaaggaggaccccaacagactgtactacgagcccgccgagctgaagctgttcgagaacatcgagtgcgagtggcccctgttctggacctacttcatcctggacggcgtgttcagcggcaacgccgagcaggtgcaggagtacaaggaggccctggaggccgtgctgatcaagggcaagaacggcgtgcccctgctgcccgagctgtacagcgtgccccccgacagagtggacgaggagtaccagaacccccacaccgtggacagagtgcccatgggcaagctgccccacatgtggggccagagcctgtacatcctgggcagcctgatggccgagggcttcctggcccccggcgagatcgaccccctgaacagaagattcagcaccgtgcccaagcccgacgtggtggtgcaggtgagcatcctggccgagaccgaggagatcaagaccatcctgaaggacaagggcatctacgtggagaccatcgccgaggtgtaccccatcagagtgcagcccgccagaatcctgagccacatctacagcagcctgggctgcaacaacagaatgaagctgagcggcagaccctacagacacatgggcgtgctgggcaccagcaagctgtacgacatcagaaagaccatcttcaccttcaccccccagttcatcgaccagcagcagttctacctggccctggacaacaagatgatcgtggagatgctgagaaccgacctgagctacctgtgcagcagatggagaatgaccggccagcccaccatcaccttccccatcagccacagcatgctggacgaggacggcaccagcctgaacagcagcatcctggccgccctgagaaagatgcaggacggctacttcggcggcgccagagtgcagaccggcaagctgagcgagttcctgaccaccagctgctgcacccacctgagcttcatggaccccggccccgagggcaagctgtacagcgaggactacgacgacaactacgactacctggagagcggcaactggatgaacgactacgacagcaccagccacgccagatgcggcgacgaggtggccagatacctggaccacctgctggcccacaccgccccccaccccaagctggcccccaccagccagaagggcggcctggacagattccaggccgccgtgcagaccacctgcgacctgatgagcctggtgaccaaggccaaggagctgcacgtgcagaacgtgcacatgtacctgcccaccaagctgttccaggccagcagacccagcttcaacctgctggacagcccccaccccagacaggagaaccaggtgcccagcgtgagagtggagatccacctgcccagagaccagagcggcgaggtggacttcaaggccctggtgctgcagctgaaggagaccagcagcctgcaggagcaggccgacatcctgtacatgctgtacaccatgaagggccccgactggaacaccgagctgtacaacgagagaagcgccaccgtgagagagctgctgaccgagctgtacggcaaggtgggcgagatcagacactggggcctgatcagatacatcagcggcatcctgagaaagaaggtggaggccctggacgaggcctgcaccgacctgctgagccaccagaagcacctgaccgtgggcctgccccccgagcccagagagaagaccatcagcgcccccctgccctacgaggccctgacccagctgatcgacgaggccagcgagggcgacatgagcatcagcatcctgacccaggagatcatggtgtacctggccatgtacatgagaacccagcccggcctgttcgccgagatgttcagactgagaatcggcctgatcatccaggtgatggccaccgagctggcccacagcctgagatgcagcgccgaggaggccaccgagggcctgatgaacctgagccccagcgccatgaagaacctgctgcaccacatcctgagcggcaaggagttcggcgtggagagaagcgtgagacccaccgacagcaacgtgagccccgccatcagcatccacgagatcggcgccgtgggcgccaccaagaccgagagaaccggcatcatgcagctgaagagcgagatcaagcaggtggagttcagaagactgagcatcagcgccgagagccagagccccggcaccagcatgacccccagcagcggcagcttccccagcgcctacgaccagcagagcagcaaggacagcagacagggccagtggcagagaagaagaagactggacggcgccctgaacagagtgcccgtgggcttctaccagaaggtgtggaaggtgctgcagaagtgccacggcctgagcgtggagggcttcgtgctgcccagcagcaccaccagagagatgacccccggcgagatcaagttcagcgtgcacgtggagagcgtgctgaacagagtgccccagcccgagtacagacagctgctggtggaggccatcctggtgctgaccatgctggccgacatcgagatccacagcatcggcagcatcatcgccgtggagaagatcgtgcacatcgccaacgacctgttcctgcaggagcagaagaccctgggcgccgacgacaccatgctggccaaggaccccgccagcggcatctgcaccctgctgtacgacagcgcccccagcggcagattcggcaccatgacctacctgagcaaggccgccgccacctacgtgcaggagttcctgccccacagcatctgcgccatgcagtag

SEQ ID NO: 93435 - DNA, 3546 bp, Artificial Sequence
  Description of Artificial Sequence: Synthetic coding sequence
atgagaagcagaagcaacagcggcgtgagactggacggctacgccagactggtgcagcagaccatcctgtgccaccagaaccccgtgaccggcctgctgcccgccagctacgaccagaaggacgcctgggtgagagacaacgtgtacagcatcctggccgtgtggggcctgggcctggcctacagaaagaacgccgacagagacgaggacaaggccaaggcctacgagctggagcagagcgtggtgaagctgatgagaggcctgctgcactgcatgatcagacaggtggacaaggtggagagcttcaagtacagccagagcaccaaggacagcctgcacgccaagtacaacaccaagacctgcgccaccgtggtgggcgacgaccagtggggccacctgcagctggacgccaccagcgtgtacctgctgttcctggcccagatgaccgccagcggcctgcacatcatccacagcctggacgaggtgaacttcatccagaacctggtgttctacatcgaggccgcctacaagaccgccgacttcggcatctgggagagaggcgacaagaccaaccagggcatcagcgagctgaacgccagcagcgtgggcatggccaaggccgccctggaggccctggacgagctggacctgttcggcgtgaagggcggcccccagagcgtgatccacgtgctggccgacgaggtgcagcactgccagagcatcctgaacagcctgctgcccagagccagcaccagcaaggaggtggacgccagcctgctgagcgtggtgagcttccccgccttcgccgtggaggacagccagctggtggagctgaccaagcaggagatcatcaccaagctgcagggcagatacggctgctgcagattcctgagagacggctacaagacccccaaggaggaccccaacagactgtactacgagcccgccgagctgaagctgttcgagaacatcgagtgcgagtggcccctgttctggacctacttcatcctggacggcgtgttcagcggcaacgccgagcaggtgcaggagtacaaggaggccctggaggccgtgctgatcaagggcaagaacggcgtgcccctgctgcccgagctgtacagcgtgccccccgacagagtggacgaggagtaccagaacccccacaccgtggacagagtgcccatgggcaagctgccccacatgtggggccagagcctgtacatcctgggcagcctgatggccgagggcttcctggcccccggcgagatcgaccccctgaacagaagattcagcaccgtgcccaagcccgacgtggtggtgcaggtgagcatcctggccgagaccgaggagatcaagaccatcctgaaggacaagggcatctacgtggagaccatcgccgaggtgtaccccatcagagtgcagcccgccagaatcctgagccacatctacagcagcctgggctgcaacaacagaatgaagctgagcggcagaccctacagacacatgggcgtgctgggcaccagcaagctgtacgacatcagaaagaccatcttcaccttcaccccccagttcatcgaccagcagcagttctacctggccctggacaacaagatgatcgtggagatgctgagaaccgacctgagctacctgtgcagcagatggagaatgaccggccagcccaccatcaccttccccatcagccacagcatgctggacgaggacggcaccagcctgaacagcagcatcctggccgccctgagaaagatgcaggacggctacttcggcggcgccagagtgcagaccggcaagctgagcgagttcctgaccaccagctgctgcacccacctgagcttcatggaccccggccccgagggcaagctgtacagcgaggactacgacgacaactacgactacctggagagcggcaactggatgaacgactacgacagcaccagccacgacgtgcacatgtacctgcccaccaagctgttccaggccagcagacccagcttcaacctgctggacagcccccaccccagacaggagaaccaggtgcccagcgtgagagtggagatccacctgcccagagaccagagcggcgaggtggacttcaaggccctggtgctgcagctgaaggagaccagcagcctgcaggagcaggccgacatcctgtacatgctgtacaccatgaagggccccgactggaacaccgagctgtacaacgagagaagcgccaccgtgagagagctgctgaccgagctgtacggcaaggtgggcgagatcagacactggggcctgatcagatacatcagcggcatcctgagaaagaaggtggaggccctggacgaggcctgcaccgacctgctgagccaccagaagcacctgaccgtgggcctgccccccgagcccagagagaagaccatcagcgcccccctgccctacgaggccctgacccagctgatcgacgaggccagcgagggcgacatgagcatcagcatcctgacccaggagatcatggtgtacctggccatgtacatgagaacccagcccggcctgttcgccgagatgttcagactgagaatcggcctgatcatccaggtgatggccaccgagctggcccacagcctgagatgcagcgccgaggaggccaccgagggcctgatgaacctgagccccagcgccatgaagaacctgctgcaccacatcctgagcggcaaggagttcggcgtggagagaagcgtgagacccaccgacagcaacgtgagccccgccatcagcatccacgagatcggcgccgtgggcgccaccaagaccgagagaaccggcatcatgcagctgaagagcgagatcaagcaggtggagttcagaagactgagcatcagcgccgagagccagagcaacggcggccaccccctgggcatcgacctgatgagccccagcttcatgagccccggcaccagcatgacccccagcagcggcagcttccccagcgcctacgaccagcagagcagcaaggacagcagacagggccagtggcagagaagaagaagactggacggcgccctgaacagagtgcccgtgggcttctaccagaaggtgtggaaggtgctgcagaagtgccacggcctgagcgtggagggcttcgtgctgcccagcagcaccaccagagagatgacccccggcgagatcaagttcagcgtgcacgtggagagcgtgctgaacagagtgccccagcccgagtacagacagctgctggtggaggccatcctggtgctgaccatgctggccgacatcgagatccacagcatcggcagcatcatcgccgtggagaagatcgtgcacatcgccaacgacctgttcctgcaggagcagaagaccctgggcgccgacgacaccatgctggccaaggaccccgccagcggcatctgcaccctgctgtacgacagcgcccccagcggcagattcggcaccatgacctacctgagcaaggccgccgccacctacgtgcaggagttcctgccccacagcatctgcgccatgcagtag

SEQ ID NO: 93436 - DNA, 3456 bp, Artificial Sequence
  Description of Artificial Sequence: Synthetic coding sequence
atgagaagcagaagcaacagcggcgtgagactggacggctacgccagactggtgcagcagaccatcctgtgccaccagaaccccgtgaccggcctgctgcccgccagctacgaccagaaggacgcctgggtgagagacaacgtgtacagcatcctggccgtgtggggcctgggcctggcctacagaaagaacgccgacagagacgaggacaaggccaaggcctacgagctggagcagagcgtggtgaagctgatgagaggcctgctgcactgcatgatcagacaggtggacaaggtggagagcttcaagtacagccagagcaccaaggacagcctgcacgccaagtacaacaccaagacctgcgccaccgtggtgggcgacgaccagtggggccacctgcagctggacgccaccagcgtgtacctgctgttcctggcccagatgaccgccagcggcctgcacatcatccacagcctggacgaggtgaacttcatccagaacctggtgttctacatcgaggccgcctacaagaccgccgacttcggcatctgggagagaggcgacaagaccaaccagggcatcagcgagctgaacgccagcagcgtgggcatggccaaggccgccctggaggccctggacgagctggacctgttcggcgtgaagggcggcccccagagcgtgatccacgtgctggccgacgaggtgcagcactgccagagcatcctgaacagcctgctgcccagagccagcaccagcaaggaggtggacgccagcctgctgagcgtggtgagcttccccgccttcgccgtggaggacagccagctggtggagctgaccaagcaggagatcatcaccaagctgcagggcagatacggctgctgcagattcctgagagacggctacaagacccccaaggaggaccccaacagactgtactacgagcccgccgagctgaagctgttcgagaacatcgagtgcgagtggcccctgttctggacctacttcatcctggacggcgtgttcagcggcaacgccgagcaggtgcaggagtacaaggaggccctggaggccgtgctgatcaagggcaagaacggcgtgcccctgctgcccgagctgtacagcgtgccccccgacagagtggacgaggagtaccagaacccccacaccgtggacagagtgcccatgggcaagctgccccacatgtggggccagagcctgtacatcctgggcagcctgatggccgagggcttcctggcccccggcgagatcgaccccctgaacagaagattcagcaccgtgcccaagcccgacgtggtggtgcaggtgagcatcctggccgagaccgaggagatcaagaccatcctgaaggacaagggcatctacgtggagaccatcgccgaggtgtaccccatcagagtgcagcccgccagaatcctgagccacatctacagcagcctgggctgcaacaacagaatgaagctgagcggcagaccctacagacacatgggcgtgctgggcaccagcaagctgtacgacatcagaaagaccatcttcaccttcaccccccagttcatcgaccagcagcagttctacctggccctggacaacaagatgatcgtggagatgctgagaaccgacctgagctacctgtgcagcagatggagaatgaccggccagcccaccatcaccttccccatcagccacagcatgctggacgaggacggcaccagcctgaacagcagcatcctggccgccctgagaaagatgcaggacggctacttcggcggcgccagagtgcagaccggcaagctgagcgagttcctgaccaccagctgctgcacccacctgagcttcatggaccccggccccgagggcaagctgtacagcgaggactacgacgacaactacgactacctggagagcggcaactggatgaacgactacgacagcaccagccacgacgtgcacatgtacctgcccaccaagctgttccaggccagcagacccagcttcaacctgctggacagcccccaccccagacaggagaaccaggtgcccagcgtgagagtggagatccacctgcccagagaccagagcggcgaggtggacttcaaggccctggtgctgcagctgaaggagaccagcagcctgcaggagcaggccgacatcctgtacatgctgtacaccatgaagggccccgactggaacaccgagctgtacaacgagagaagcgccaccgtgagagagctgctgaccgagctgtacggcaaggtgggcgagatcagacactggggcctgatcagatacatcagcggcatcctgagaaagaaggtggaggccctggacgaggcctgcaccgacctgctgagccaccagaagcacctgaccgtgggcctgccccccgagcccagagagaagaccatcagcgcccccctgccctacgaggccctgacccagctgatcgacgaggccagcgagggcgacatgagcatcagcatcctgacccaggagatcatggtgtacctggccatgtacatgagaacccagcccggcctgttcgccgagatgttcagactgagaatcggcctgatcatccaggtgatggccaccgagctggcccacagcctgagatgcagcgccgaggaggccaccgagggcctgatgaacctgagccccagcgccatgaagaacctgctgcaccacatcctgagcggcaaggagttcggcgtggagagaagcgtgagacccaccgacagcaacgtgagccccgccatcagcatccacgagatcggcgccgtgggcgccaccaagaccgagagaaccggcatcatgcagctgaagagcgagatcaagcagagccccggcaccagcatgacccccagcagcggcagcttccccagcgcctacgaccagcagagcagcaaggacagcagacagggccagtggcagagaagaagaagactggacggcgccctgaacagagtgcccgtgggcttctaccagaaggtgtggaaggtgctgcagaagtgccacggcctgagcgtggagggcttcgtgctgcccagcagcaccaccagagagatgacccccggcgagatcaagttcagcgtgcacgtggagagcgtgctgaacagagtgccccagcccgagtacagacagctgctggtggaggccatcctggtgctgaccatgctggccgacatcgagatccacagcatcggcagcatcatcgccgtggagaagatcgtgcacatcgccaacgacctgttcctgcaggagcagaagaccctgggcgccgacgacaccatgctggccaaggaccccgccagcggcatctgcaccctgctgtacgacagcgcccccagcggcagattcggcaccatgacctacctgagcaaggccgccgccacctacgtgcaggagttcctgccccacagcatctgcgccatgcagtag

SEQ ID NO: 93437 - DNA, 1164 bp, Artificial Sequence
  Description of Artificial Sequence: Synthetic coding sequence
atgaccagagacgaggccctgcccgacagccacagcgcccaggacttctacgagaactacgagcccaaggagatcctgggcagaggcgtgagcagcgtggtgagaagatgcatccacaagcccaccagccaggagtacgccgtgaaggtgatcgacgtgaccggcggcggcagcttcagccccgaggaggtgagagagctgagagaggccaccctgaaggaggtggacatcctgagaaaggtgagcggccaccccaacatcatccagctgaaggacacctacgagaccaacaccttcttcttcctggtgttcgacctgatgaagagaggcgagctgttcgactacctgaccgagaaggtgaccctgagcgagaaggagaccagaaagatcatgagagccctgctggaggtgatctgcaccctgcacaagctgaacatcgtgcacagagacctgaagcccgagaacatcctgctggacgacaacatgaacatcaagctgaccgacttcggcttcagctgccagctggagcccggcgagagactgagagaggtgtgcggcacccccagctacctggcccccgagatcatcgagtgcagcatgaacgaggaccaccccggctacggcaaggaggtggacatgtggagcaccggcgtgatcatgtacaccctgctggccggcagcccccccttctggcacagaaagcagatgctgatgctgagaatgatcatgagcggcaactaccagttcggcagccccgagtgggacgactacagcgacaccgtgaaggacctggtgagcagattcctggtggtgcagccccagaacagatacaccgccgaggaggccctggcccaccccttcttccagcagtacctggtggaggaggtgagacacttcagccccagaggcaagttcaaggtgatcgccctgaccgtgctggccagcgtgagaatctactaccagtacagaagagtgaagcccgtgaccagagagatcgtgatcagagacccctacgccctgagacccctgagaagactgatcgacgcctacgccttcagaatctacggccactgggtgaagaagggccagcagcagaacagagccgccctgttcgagaacacccccaaggccgtgctgctgagcctggccgaggaggactactag

SEQ ID NO: 93438 - DNA, 1260 bp, Artificial Sequence
  Description of Artificial Sequence: Synthetic coding sequence
atgaccagagacgaggccctgcccgacagccacagcgcccaggacttctacgagaactacgagcccaaggagatcctgggcagaggcgtgagcagcgtggtgagaagatgcatccacaagcccaccagccaggagtacgccgtgaaggtgatcgacgtgaccggcggcggcagcttcagccccgaggaggtgagagagctgagagaggccaccctgaaggaggtggacatcctgagaaaggtgagcggccaccccaacatcatccagctgaaggacacctacgagaccaacaccttcttcttcctggtgttcgacctgtgggaggacaccgacaccatggagatggagcagaagtggtgcctgggctgggacagccccaagagcaccaacttcagagcccagggcagagccagaatgaagagaggcgagctgttcgactacctgaccgagaaggtgaccctgagcgagaaggagaccagaaagatcatgagagccctgctggaggtgatctgcaccctgcacaagctgaacatcgtgcacagagacctgaagcccgagaacatcctgctggacgacaacatgaacatcaagctgaccgacttcggcttcagctgccagctggagcccggcgagagactgagagaggtgtgcggcacccccagctacctggcccccgagatcatcgagtgcagcatgaacgaggaccaccccggctacggcaaggaggtggacatgtggagcaccggcgtgatcatgtacaccctgctggccggcagcccccccttctggcacagaaagcagatgctgatgctgagaatgatcatgagcggcaactaccagttcggcagccccgagtgggacgactacagcgacaccgtgaaggacctggtgagcagattcctggtggtgcagccccagaacagatacaccgccgaggaggccctggcccaccccttcttccagcagtacctggtggaggaggtgagacacttcagccccagaggcaagttcaaggtgatcgccctgaccgtgctggccagcgtgagaatctactaccagtacagaagagtgaagcccgtgaccagagagatcgtgatcagagacccctacgccctgagacccctgagaagactgatcgacgcctacgccttcagaatctacggccactgggtgaagaagggccagcagcagaacagagccgccctgttcgagaacacccccaaggccgtgctgctgagcctggccgaggaggactactag

SEQ ID NO: 93439 - DNA, 1002 bp, Artificial Sequence
  Description of Artificial Sequence: Synthetic coding sequence
atgcacccccaggcccacgagcccggcgtgagaagagagggccacagaagacacagatggagacagctgcagcccggcggcggcgccggcgccgccagaagccacgccgagggcggcggccaccccgcccagggcctgagagccccccagcaccagatgaagagaggcgagctgttcgactacctgaccgagaaggtgaccctgagcgagaaggagaccagaaagatcatgagagccctgctggaggtgatctgcaccctgcacaagctgaacatcgtgcacagagacctgaagcccgagaacatcctgctggacgacaacatgaacatcaagctgaccgacttcggcttcagctgccagctggagcccggcgagagactgagagaggtgtgcggcacccccagctacctggcccccgagatcatcgagtgcagcatgaacgaggaccaccccggctacggcaaggaggtggacatgtggagcaccggcgtgatcatgtacaccctgctggccggcagcccccccttctggcacagaaagcagatgctgatgctgagaatgatcatgagcggcaactaccagttcggcagccccgagtgggacgactacagcgacaccgtgaaggacctggtgagcagattcctggtggtgcagccccagaacagatacaccgccgaggaggccctggcccaccccttcttccagcagtacctggtggaggaggtgagacacttcagccccagaggcaagttcaaggtgatcgccctgaccgtgctggccagcgtgagaatctactaccagtacagaagagtgaagcccgtgaccagagagatcgtgatcagagacccctacgccctgagacccctgagaagactgatcgacgcctacgccttcagaatctacggccactgggtgaagaagggccagcagcagaacagagccgccctgttcgagaacacccccaaggccgtgctgctgagcctggccgaggaggactactag

SEQ ID NO: 93440 - DNA, 2529 bp, Artificial Sequence
  Description of Artificial Sequence: Synthetic coding sequence
atgagcagacccctgagcgaccaggagaagagaaagcagatcagcgtgagaggcctggccggcgtggagaacgtgaccgagctgaagaagaacttcaacagacacctgcacttcaccctggtgaaggacagaaacgtggccacccccagagactactacttcgccctggcccacaccgtgagagaccacctggtgggcagatggatcagaacccagcagcactactacgagaaggaccccaagagaatctactacctgagcctggagttctacatgggcagaaccctgcagaacaccatggtgaacctggccctggagaacgcctgcgacgaggccacctaccagctgggcctggacatggaggagctggaggagatcgaggaggacgccggcctgggcaacggcggcctgggcagactggccgcctgcttcctggacagcatggccaccctgggcctggccgcctacggctacggcatcagatacgagttcggcatcttcaaccagaagatcagcggcggctggcagatggaggaggccgacgactggctgagatacggcaacccctgggagaaggccagacccgagttcaccctgcccgtgcacttctacggccacgtggagcacaccagccagggcgccaagtgggtggacacccaggtggtgctggccatgccctacgacacccccgtgcccggctacagaaacaacgtggtgaacaccatgagactgtggagcgccaaggcccccaacgacttcaacctgaaggacttcaacgtgggcggctacatccaggccgtgctggacagaaacctggccgagaacatcagcagagtgctgtaccccaacgacaacttcttcgagggcaaggagctgagactgaagcaggagtacttcgtggtggccgccaccctgcaggacatcatcagaagattcaagagcagcaagttcggctgcagagaccccgtgagaaccaacttcgacgccttccccgacaaggtggccatccagctgaacgacacccaccccagcctggccatccccgagctgatgagaatcctggtggacctggagagaatggactgggacaaggcctgggacgtgaccgtgagaacctgcgcctacaccaaccacaccgtgctgcccgaggccctggagagatggcccgtgcacctgctggagaccctgctgcccagacacctgcagatcatctacgagatcaaccagagattcctgaacagagtggccgccgccttccccggcgacgtggacagactgagaagaatgagcctggtggaggagggcgccgtgaagagaatcaacatggcccacctgtgcatcgccggcagccacgccgtgaacggcgtggccagaatccacagcgagatcctgaagaagaccatcttcaaggacttctacgagctggagccccacaagttccagaacaagaccaacggcatcacccccagaagatggctggtgctgtgcaaccccggcctggccgaggtgatcgccgagagaatcggcgaggacttcatcagcgacctggaccagctgagaaagctgctgagcttcgtggacgacgaggccttcatcagagacgtggccaaggtgaagcaggagaacaagctgaagttcgccgcctacctggagagagagtacaaggtgcacatcaaccccaacagcctgttcgacatccaggtgaagagaatccacgagtacaagagacagctgctgaactgcctgcacgtgatcaccctgtacaacagaatcaagagagagcccaacaagttcttcgtgcccagaaccgtgatgatcggcggcaaggccgcccccggctaccacatggccaagatgatcatcagactggtgaccgccatcggcgacgtggtgaaccacgaccccgccgtgggcgacagactgagagtgatcttcctggagaactacagagtgagcctggccgagaaggtgatccccgccgccgacctgagcgagcagatcagcaccgccggcaccgaggccagcggcaccggcaacatgaagttcatgctgaacggcgccctgaccatcggcaccatggacggcgccaacgtggagatggccgaggaggccggcgaggagaacttcttcatcttcggcatgagagtggaggacgtggacaagctggaccagagaggctacaacgcccaggagtactacgacagaatccccgagctgagacaggtgatcgagcagctgagcagcggcttcttcagccccaagcagcccgacctgttcaaggacatcgtgaacatgctgatgcaccacgacagattcaaggtgttcgccgactacgaggactacatcaagtgccaggagaaggtgagcgccctgtacaagaaccccagagagtggaccagaatggtgatcagaaacatcgccaccagcggcaagttcagcagcgacagaaccatcgcccagtacgccagagagatctggggcgtggagcccagcagacagagactgcccgcccccgacgaggccatctag

SEQ ID NO: 93441 - DNA, 2499 bp, Artificial Sequence
  Description of Artificial Sequence: Synthetic coding sequence
atgagcagacccctgagcgaccaggagaagagaaagcagatcagcgtgagaggcctggccggcgtggagaacgtgaccgagctgaagaagaacttcaacagacacctgcacttcaccctggtgaaggacagaaacgtggccacccccagagactactacttcgccctggcccacaccgtgagagaccacctggtgggcagatggatcagaacccagcagcactactacgagaaggaccccaagagaatctactacctgagcctggagttctacatgggcagaaccctgcagaacaccatggtgaacctggccctggagaacgcctgcgacgaggccacctaccaggtgggcctgggcagactggccgcctgcttcctggacagcatggccaccctgggcctggccgcctacggctacggcatcagatacgagttcggcatcttcaaccagaagatcagcggcggctggcagatggaggaggccgacgactggctgagatacggcaacccctgggagaaggccagacccgagttcaccctgcccgtgcacttctacggccacgtggagcacaccagccagggcgccaagtgggtggacacccaggtggtgctggccatgccctacgacacccccgtgcccggctacagaaacaacgtggtgaacaccatgagactgtggagcgccaaggcccccaacgacttcaacctgaaggacttcaacgtgggcggctacatccaggccgtgctggacagaaacctggccgagaacatcagcagagtgctgtaccccaacgacaacttcttcgagggcaaggagctgagactgaagcaggagtacttcgtggtggccgccaccctgcaggacatcatcagaagattcaagagcagcaagttcggctgcagagaccccgtgagaaccaacttcgacgccttccccgacaaggtggccatccagctgaacgacacccaccccagcctggccatccccgagctgatgagaatcctggtggacctggagagaatggactgggacaaggcctgggacgtgaccgtgagaacctgcgcctacaccaaccacaccgtgctgcccgaggccctggagagatggcccgtgcacctgctggagaccctgctgcccagacacctgcagatcatctacgagatcaaccagagattcctgaacagagtggccgccgccttccccggcgacgtggacagactgagaagaatgagcctggtggaggagggcgccgtgaagagaatcaacatggcccacctgtgcatcgccggcagccacgccgtgaacggcgtggccagaatccacagcgagatcctgaagaagaccatcttcaaggacttctacgagctggagccccacaagttccagaacaagaccaacggcatcacccccagaagatggctggtgctgtgcaaccccggcctggccgaggtgatcgccgagagaatcggcgaggacttcatcagcgacctggaccagctgagaaagctgctgagcttcgtggacgacgaggccttcatcagagacgtggccaaggtgaagcaggagaacaagctgaagttcgccgcctacctggagagagagtacaaggtgcacatcaaccccaacagcctgttcgacatccaggtgaagagaatccacgagtacaagagacagctgctgaactgcctgcacgtgatcaccctgtacaacagaatcaagagagagcccaacaagttcttcgtgcccagaaccgtgatgatcggcggcaaggccgcccccggctaccacatggccaagatgatcatcagactggtgaccgccatcggcgacgtggtgaaccacgaccccgccgtgggcgacagactgagagtgatcttcctggagaactacagagtgagcctggccgagaaggtgatccccgccgccgacctgagcgagcagatcagcaccgccggcaccgaggccagcggcaccggcaacatgaagttcatgctgaacggcgccctgaccatcggcaccatggacggcgccaacgtggagatggccgaggaggccggcgaggagaacttcttcatcttcggcatgagagtggaggacgtggacaagctggaccagagaggctacaacgcccaggagtactacgacagaatccccgagctgagacaggtgatcgagcagctgagcagcggcttcttcagccccaagcagcccgacctgttcaaggacatcgtgaacatgctgatgcaccacgacagattcaaggtgttcgccgactacgaggactacatcaagtgccaggagaaggtgagcgccctgtacaagaaccccagagagtggaccagaatggtgatcagaaacatcgccaccagcggcaagttcagcagcgacagaaccatcgcccagtacgccagagagatctggggcgtggagcccagcagacagagactgcccgcccccgccccccacgccgagggcggcgtgctggagctggacctgtag

SEQ ID NO: 93442 - DNA, 1425 bp, Artificial Sequence
  Description of Artificial Sequence: Synthetic coding sequence
atggccaccaactggggcagcctgctgcaggacaagcagcagctggaggagctggccagacaggccgtggacagagccctggccgagggcgtgctgctgagaaccagccaggagcccaccagcagcgaggtggtgagctacgcccccttcaccctgttccccagcctggtgcccagcgccctgctggagcaggcctacgccgtgcagatggacttcaacctgctggtggacgccgtgagccagaacgccgccttcctggagcagaccctgagcagcaccatcaagcaggacgacttcaccgccagactgttcgacatccacaagcaggtgctgaaggagggcatcgcccagaccgtgttcctgggcctgaacagaagcgactacatgttccagagaagcgccgacggcagccccgccctgaagcagatcgagatcaacaccatcagcgccagcttcggcggcctggccagcagaacccccgccgtgcacagacacgtgctgagcgtgctgagcaagaccaaggaggccggcaagatcctgagcaacaaccccagcaagggcctggccctgggcatcgccaaggcctgggagctgtacggcagccccaacgccctggtgctgctgatcgcccaggagaaggagagaaacatcttcgaccagagagccatcgagaacgagctgctggccagaaacatccacgtgatcagaagaaccttcgaggacatcagcgagaagggcagcctggaccaggacagaagactgttcgtggacggccaggagatcgccgtggtgtacttcagagacggctacatgcccagacagtacagcctgcagaactgggaggccagactgctgctggagagaagccacgccgccaagtgccccgacatcgccacccagctggccggcaccaagaaggtgcagcaggagctgagcagacccggcatgctggagatgctgctgcccggccagcccgaggccgtggccagactgagagccaccttcgccggcctgtacagcctggacgtgggcgaggagggcgaccaggccatcgccgaggccctggccgcccccagcagattcgtgctgaagccccagagagagggcggcggcaacaacctgtacggcgaggagatggtgcaggccctgaagcagctgaaggacagcgaggagagagccagctacatcctgatggagaagatcgagcccgagcccttcgagaactgcctgctgagacccggcagccccgccagagtggtgcagtgcatcagcgagctgggcatcttcggcgtgtacgtgagacaggagaagaccctggtgatgaacaagcacgtgggccacctgctgagaaccaaggccatcgagcacgccgacggcggcgtggccgccggcgtggccgtgctggacaacccctaccccgtgtag

SEQ ID NO: 93443 - DNA, 738 bp, Artificial Sequence
  Description of Artificial Sequence: Synthetic coding sequence
tgaaagcaccaccacaccgtgccccccagcgtgacccccaaggccctggacagaagccccccctgccccgagatgttcaccagagccgcccccggctaccacatggccaagctgatcatcaagctggtgaccagcatcggcgacgtggtgaaccacgaccccgtggtgggcgacagactgaaggtgatcttcctggagaactacagagtgagcctggccgagaaggtgatccccgccgccgacctgagccagcagatcagcaccgccggcaccgaggccagcggcaccggcaacatgaagttcatgctgaacggcgccctgaccatcggcaccatggacggcgccaacgtggagatggccgaggaggccggcgccgagaacctgttcatcttcggcctgagagtggaggacgtggaggccctggacagaaagggctacaacgccagagagtactacgaccacctgcccgagctgaagcaggccgtggaccagatcagcagcggcttcttcagccccaaggagcccgactgcttcaaggacatcgtgaacatgctgatgcaccacgacagattcaaggtgttcgccgactacgaggcctacatgcagtgccaggcccaggtggaccagctgtacagaaaccccaaggagtggaccaagaaggtgatcagaaacatcgcctgcagcggcaagttcagcagcgacagaaccatcaccgagtacgccagagagatctggtag

SEQ ID NO: 93444 - DNA, 975 bp, Artificial Sequence
  Description of Artificial Sequence: Synthetic coding sequence
atggacgcccccagacaggtggtgaacttcggccccggccccgccaagctgccccacagcgtgctgctggagatccagaaggagctgctggactacaagggcgtgggcatcagcgtgctggagatgagccacagaagcagcgacttcgccaagatcatcaacaacaccgagaacctggtgagagagctgctggccgtgcccgacaactacaaggtgatcttcctgcagggcggcggctgcggccagttcagcgccgtgcccctgaacctgatcggcctgaaggccggcagatgcgccgactacgtggtgaccggcgcctggagcgccaaggccgccgaggaggccaagaagttcggcaccatcaacatcgtgcaccccaagctgggcagctacaccaagatccccgaccccagcacctggaacctgaaccccgacgccagctacgtgtactactgcgccaacgagaccgtgcacggcgtggagttcgacttcatccccgacgtgaagggcgccgtgctggtgtgcgacatgagcagcaacttcctgagcaagcccgtggacgtgagcaagttcggcgtgatcttcgccggcgcccagaagaacgtgggcagcgccggcgtgaccgtggtgatcgtgagagacgacctgctgggcttcgccctgagagagtgccccagcgtgctggagtacaaggtgcaggccggcaacagcagcctgtacaacacccccccctgcttcagcatctacgtgatgggcctggtgctggagtggatcaagaacaacggcggcgccgccgccatggagaagctgagcagcatcaagagccagaccatctacgagatcatcgacaacagccagggcttctacgtgagcgtgggcggcatcagagccagcctgtacaacgccgtgaccatcgaggacgtgcagaagctggccgccttcatgaagaagttcctggagatgcaccagctgtag

SEQ ID NO: 93445 - DNA, 1113 bp, Artificial Sequence
  Description of Artificial Sequence: Synthetic coding sequence
atggacgcccccagacaggtggtgaacttcggccccggccccgccaagctgccccacagcgtgctgctggagatccagaaggagctgctggactacaagggcgtgggcatcagcgtgctggagatgagccacagaagcagcgacttcgccaagatcatcaacaacaccgagaacctggtgagagagctgctggccgtgcccgacaactacaaggtgatcttcctgcagggcggcggctgcggccagttcagcgccgtgcccctgaacctgatcggcctgaaggccggcagatgcgccgactacgtggtgaccggcgcctggagcgccaaggccgccgaggaggccaagaagttcggcaccatcaacatcgtgcaccccaagctgggcagctacaccaagatccccgaccccagcacctggaacctgaaccccgacgccagctacgtgtactactgcgccaacgagaccgtgcacggcgtggagttcgacttcatccccgacgtgaagggcgccgtgctggtgtgcgacatgagcagcaacttcctgagcaagcccgtggacgtgagcaagttcggcgtgatcttcgccggcgcccagaagaacgtgggcagcgccggcgtgaccgtggtgatcgtgagagacgacctgctgggcttcgccctgagagagtgccccagcgtgctggagtacaaggtgcaggccggcaacagcagcctgtacaacacccccccctgcttcagcatctacgtgatgggcctggtgctggagtggatcaagaacaacggcggcgccgccgccatggagaagctgagcagcatcaagagccagaccatctacgagatcatcgacaacagccagggcttctacgtgtgccccgtggagccccagaacagaagcaagatgaacatccccttcagaatcggcaacgccaagggcgacgacgccctggagaagagattcctggacaaggccctggagctgaacatgctgagcctgaagggccacagaagcgtgggcggcatcagagccagcctgtacaacgccgtgaccatcgaggacgtgcagaagctggccgccttcatgaagaagttcctggagatgcaccagctgtag

SEQ ID NO: 93446 - DNA, 585 bp, Artificial Sequence
  Description of Artificial Sequence: Synthetic coding sequence
atgagcagcaacttcctgagcaagcccgtggacgtgagcaagttcggcgtgatcttcgccggcgcccagaagaacgtgggcagcgccggcgtgaccgtggtgatcgtgagagacgacctgctgggcttcgccctgagagagtgccccagcgtgctggagtacaaggtgcaggccggcaacagcagcctgtacaacacccccccctgcttcagcatctacgtgatgggcctggtgctggagtggatcaagaacaacggcggcgccgccgccatggagaagctgagcagcatcaagagccagaccatctacgagatcatcgacaacagccagggcttctacgtgtgccccgtggagccccagaacagaagcaagatgaacatccccttcagaatcggcaacgccaagggcgacgacgccctggagaagagattcctggacaaggccctggagctgaacatgctgagcctgaagggccacagaagcgtgggcggcatcagagccagcctgtacaacgccgtgaccatcgaggacgtgcagaagctggccgccttcatgaagaagttcctggagatgcaccagctgtag

SEQ ID NO: 93447 - DNA, 1050 bp, Artificial Sequence
  Description of Artificial Sequence: Synthetic coding sequence
atgagcagcctgagcggcaaggtgcagaccgtgctgggcctggtggagcccagcaagctgggcagaaccctgacccacgagcacctggccatgaccttcgactgctgctactgccccccccccccctgccaggaggccatcagcaaggagcccatcgtgatgaagaacctgtactggatccagaagaacgcctacagccacaaggagaacctgcagctgaaccaggagaccgaggccatcaaggaggagctgctgtacttcaaggccaacggcggcggcgccctggtggagaacaccaccaccggcatcagcagagacacccagaccctgaagagactggccgaggagaccggcgtgcacatcatcagcggcgccggcttctacgtggacgccacccacagcagcgagaccagagccatgagcgtggagcagctgaccgacgtgctgatgaacgagatcctgcacggcgccgacggcaccagcatcaagtgcggcatcatcggcgagatcggctgcagctggcccctgaccgagagcgagagaaaggtgctgcaggccaccgcccacgcccaggcccagctgggctgccccgtgatcatccaccccggcagaagcagcagagcccccttccagatcatcagaatcctgcaggaggccggcgccgacatcagcaagaccgtgatgagccacctggacagaaccatcctggacaagaaggagctgctggagttcgcccagctgggctgctacctggagtacgacctgttcggcaccgagctgctgcactaccagctgggccccgacatcgacatgcccgacgacaacaagagaatcagaagagtgagactgctggtggaggagggctgcgaggacagaatcctggtggcccacgacatccacaccaagaccagactgatgaagtacggcggccacggctacagccacatcctgaccaacgtggtgcccaagatgctgctgagaggcatcaccgagaacgtgctggacaagatcctgatcgagaaccccaagcagtggctgaccttcaagtag

SEQ ID NO: 93448 - DNA, 1050 bp, Artificial Sequence; identical to SEQ ID NO: 93447
  Description of Artificial Sequence: Synthetic coding sequence

SEQ ID NO: 93449 - DNA, 1050 bp, Artificial Sequence; identical to SEQ ID NO: 93447
  Description of Artificial Sequence: Synthetic coding sequence

SEQ ID NO: 93450 - DNA, 909 bp, Artificial Sequence
  Description of Artificial Sequence: Synthetic coding sequence
atgagcagcctgagcggcaaggtgcagaccgtgctgggcctggtggagcccagcaagctgggcagaaccctgacccacgagcacctggccatgaccttcgactgctgctactgccccccccccccctgccaggaggccatcagcaaggagcccatcgtgatgaagaacctgtactggatccagaagaacgcctacagccacaaggagaacctgcagctgaaccaggagaccgaggccatcaaggaggagctgctgtacttcaaggccaacggcggcggcgccctggtggagaacaccaccaccggcatcagcagagacacccagaccctgaagagactggccgaggagaccggcgtgcacatcatcagcggcgccggcttctacgtggacgccacccacagcagcgagaccagagccatgagcgtggagcagctgaccgacgtgctgatgaacgagatcctgcacggcgccgacggcaccagcatcaagtgcggcatcatcggcgagatcggctgcagctggcccctgaccgagagcgagagaaaggtgctgcaggccaccgcccacgcccaggcccagctgggctgccccgtgatcatccaccccggcagaagcagcagagcccccttccagatcatcagaatcctgcaggaggccggcgccgacatcagcaagaccgtgatgagccacctggacagagtgagactgctggtggaggagggctgcgaggacagaatcctggtggcccacgacatccacaccaagaccagactgatgaagtacggcggccacggctacagccacatcctgaccaacgtggtgcccaagatgctgctgagaggcatcaccgagaacgtgctggacaagatcctgatcgagaaccccaagcagtggctgaccttcaagtag

SEQ ID NO: 93451 - DNA, 1050 bp, Artificial Sequence; identical to SEQ ID NO: 93447
  Description of Artificial Sequence: Synthetic coding sequence

SEQ ID NO: 93452 - DNA, 753 bp, Artificial Sequence
  Description of Artificial Sequence: Synthetic coding sequence
atgttcagcctgcccctgagcctgcccctgtgcgaggacaccgccttcctgcccagcaagtgctgcagcagccacaagaccatcaagcaggccagaaccctgatcatgatcttcctggccagcggcacccacttccagaccatgctgaagagcaagctgaacgtgctgaccctgaagaaggagcccctgcccgccgtgatcttccacgagcccgaggccatcgagctgtgcaccaccacccccctgatgaagaccagaacccacagcggctgcaaggtgacctacctgggcaaggtgagcaccaccggcatgcagttcctgagcggctgcaccgagaagcccgtgatcgagctgtggaagaagcacaccctggccagagaggacgtgttccccgccaacgccctgctggagatcagacccttccaggtgtggctgcaccacctggaccacaagggcgaggccaccgtgcacatggacaccttccaggtggccagaatcgcctactgcaccgccgaccacaacgtgagccccaacatcttcgcctgggtgtacagagagatcaacgacgacctgagctaccagatggactgccacgccgtggagtgcgagagcaagctggaggccaagaagctggcccacgccatgatggaggccttcagaaagaccttccacagcatgaagagcgacggcagaatccacagcaacagcagcagcgaggaggtgagccaggagctggagagcgacgacggctag

SEQ ID NO: 93453 - DNA, 747 bp, Artificial Sequence
  Description of Artificial Sequence: Synthetic coding sequence
atgcccagaatcgccggcaaccacctgatgctggaggagagcagaacctgcagcagccccgagctgctggacggcgtgtggccctgccagcccctgcacttcggcctgcccgccagcgagatgcacttccagaccatgctgaagagcaagctgaacgtgctgaccctgaagaaggagcccctgcccgccgtgatcttccacgagcccgaggccatcgagctgtgcaccaccacccccctgatgaagaccagaacccacagcggctgcaaggtgacctacctgggcaaggtgagcaccaccggcatgcagttcctgagcggctgcaccgagaagcccgtgatcgagctgtggaagaagcacaccctggccagagaggacgtgttccccgccaacgccctgctggagatcagacccttccaggtgtggctgcaccacctggaccacaagggcgaggccaccgtgcacatggacaccttccaggtggccagaatcgcctactgcaccgccgaccacaacgtgagccccaacatcttcgcctgggtgtacagagagatcaacgacgacctgagctaccagatggactgccacgccgtggagtgcgagagcaagctggaggccaagaagctggcccacgccatgatggaggccttcagaaagaccttccacagcatgaagagcgacggcagaatccacagcaacagcagcagcgaggaggtgagccaggagctggagagcgacgacggctag

SEQ ID NO: 93454 - DNA, 654 bp, Artificial Sequence
  Description of Artificial Sequence: Synthetic coding sequence
atgtggcagcccgccaccgagagactgcagcacttccagaccatgctgaagagcaagctgaacgtgctgaccctgaagaaggagcccctgcccgccgtgatcttccacgagcccgaggccatcgagctgtgcaccaccacccccctgatgaagaccagaacccacagcggctgcaaggtgacctacctgggcaaggtgagcaccaccggcatgcagttcctgagcggctgcaccgagaagcccgtgatcgagctgtggaagaagcacaccctggccagagaggacgtgttccccgccaacgccctgctggagatcagacccttccaggtgtggctgcaccacctggaccacaagggcgaggccaccgtgcacatggacaccttccaggtggccagaatcgcctactgcaccgccgaccacaacgtgagccccaacatcttcgcctgggtgtacagagagatcaacgacgacctgagctaccagatggactgccacgccgtggagtgcgagagcaagctggaggccaagaagctggcccacgccatgatggaggccttcagaaagaccttccacagcatgaagagcgacggcagaatccacagcaacagcagcagcgaggaggtgagccaggagctggagagcgacgacggctag

SEQ ID NO: 93455 - DNA, 507 bp, Artificial Sequence
  Description of Artificial Sequence: Synthetic coding sequence
atgtggcagcccgccaccgagagactgcaggtgacctacctgggcaaggtgagcaccaccggcatgcagttcctgagcggctgcaccgagaagcccgtgatcgagctgtggaagaagcacaccctggccagagaggacgtgttccccgccaacgccctgctggagatcagacccttccaggtgtggctgcaccacctggaccacaagggcgaggccaccgtgcacatggacaccttccaggtggccagaatcgcctactgcaccgccgaccacaacgtgagccccaacatcttcgcctgggtgtacagagagatcaacgacgacctgagctaccagatggactgccacgccgtggagtgcgagagcaagctggaggccaagaagctggcccacgccatgatggaggccttcagaaagaccttccacagcatgaagagcgacggcagaatccacagcaacagcagcagcgaggaggtgagccaggagctggagagcgacgacggctag

SEQ ID NO: 93456 - DNA, 753 bp, Artificial Sequence; identical to SEQ ID NO: 93452
  Description of Artificial Sequence: Synthetic coding sequence

SEQ ID NO: 93457 - DNA, 1017 bp, Artificial Sequence
  Description of Artificial Sequence: Synthetic coding sequence
atggagcagctgagagccgccgccagactgcagatcgtgctgggccacctgggcagacccagcgccggcgccgtggtggcccaccccaccagcggcaccatcagcagcgccagcttccacccccagcagttccagtacaccctggacaacaacgtgctgaccctggagcagagaaagttctacgaggagaacggcttcctggtgatcaagaacctggtgcccgacgccgacatccagagattcagaaacgagttcgagaagatctgcagaaaggaggtgaagcccctgggcctgaccgtgatgagagacgtgaccatcagcaagagcgagtacgcccccagcgagaagatgatcaccaaggtgcaggacttccaggaggacaaggagctgttcagatactgcaccctgcccgagatcctgaagtacgtggagtgcttcaccggccccaacatcatggccatgcacaccatgctgatcaacaagccccccgacagcggcaagaagaccagcagacaccccctgcaccaggacctgcactacttccccttcagacccagcgacctgatcgtgtgcgcctggaccgccatggagcacatcagcagaaacaacggctgcctggtggtgctgcccggcacccacaagggcagcctgaagccccacgactaccccaagtgggagggcggcgtgaacaagatgttccacggcatccaggactacgaggagaacaaggccagagtgcacctggtgatggagaagggcgacaccgtgttcttccaccccctgctgatccacggcagcggccagaacaagacccagggcttcagaaaggccatcagctgccacttcgccagcgccgactgccactacatcgacgtgaagggcaccagccaggagaacatcgagaaggaggtggtgggcatcgcccacaagttcttcggcgccgagaacagcgtgaacctgaaggacatctggatgttcagagccagactggtgaagggcgagagaaccaacctgtag

SEQ ID NO: 93458 - DNA, 717 bp, Artificial Sequence
  Description of Artificial Sequence: Synthetic coding sequence
atgagagacgtgaccatcagcaagagcgagtacgcccccagcgagaagatgatcaccaaggtgcaggacttccaggaggacaaggagctgttcagatactgcaccctgcccgagatcctgaagtacgtggagtgcttcaccggccccaacatcatggccatgcacaccatgctgatcaacaagccccccgacagcggcaagaagaccagcagacaccccctgcaccaggacctgcactacttccccttcagacccagcgacctgatcgtgtgcgcctggaccgccatggagcacatcagcagaaacaacggctgcctggtggtgctgcccggcacccacaagggcagcctgaagccccacgactaccccaagtgggagggcggcgtgaacaagatgttccacggcatccaggactacgaggagaacaaggccagagtgcacctggtgatggagaagggcgacaccgtgttcttccaccccctgctgatccacggcagcggccagaacaagacccagggcttcagaaaggccatcagctgccacttcgccagcgccgactgccactacatcgacgtgaagggcaccagccaggagaacatcgagaaggaggtggtgggcatcgcccacaagttcttcggcgccgagaacagcgtgaacctgaaggacatctggatgttcagagccagactggtgaagggcgagagaaccaacctgtag

SEQ ID NO: 93459 - DNA, 15429 bp, Artificial Sequence
  Description of Artificial Sequence: Synthetic coding sequence
atgggcaacgaggccagcctggagggcgagggcctgcccgagggcctggccgccgccgccgccgccggcggcggcgccagcggcgccggcagccccagccacaccgccatccccgccggcatggaggccgacctgagccagctgagcgaggaggagagaagacagatcgccgccgtgatgagcagagcccagggcctgcccaagggcagcgtgccccccgccgccgccgagagccccagcatgcacagaaagcaggagctggacagcagccacccccccaagcagagcggcagaccccccgaccccggcagacccgcccagcccggcctgagcaagagcagaaccaccgacaccttcagaagcgagcagaagctgcccggcagaagccccagcaccatcagcctgaaggagagcaagagcagaaccgacctgaaggaggagcacaagagcagcatgatgcccggcttcctgagcgaggtgaacgccctgagcgccgtgagcagcgtggtgaacaagttcaaccccttcgacctgatcagcgacagcgaggccagccaggaggagaccaccaagaagcagaaggtggtgcagaaggagcagggcaagcccgagggcatcatcaagccccccctgcagcagcagccccccaagcccatccccaagcagcagggccccggcagagaccccctgcagcaggacggcacccccaagagcatcagcagccagcagcccgagaagatcaagagccagccccccggcaccggcaagcccatccagggccccacccagaccccccagaccgaccacgccaagctgcccctgcagagagacgccagcagaccccagaccaagcaggccgacatcgtgagaggcgagagcgtgaagcccagcctgcccagccccagcaagccccccatccagcagcccacccccggcaagccccccgcccagcagcccggccacgagaagagccagcccggccccgccaagccccccgcccagcccagcggcctgaccaagcccctggcccagcagcccggcaccgtgaagccccccgtgcagccccccggcaccaccaagccccccgcccagcccctgggccccgccaagccccccgcccagcagaccggcagcgagaagcccagcagcgagcagcccggccccaaggccctggcccagccccccggcgtgggcaagacccccgcccagcagcccggccccgccaagccccccacccagcaggtgggcacccccaagcccctggcccagcagcccggcctgcagagccccgccaaggcccccggccccaccaagacccccgtgcagcagcccggccccggcaagatccccgcccagcaggccggccccggcaagaccagcgcccagcagaccggccccaccaagccccccagccagctgcccggccccgccaagccccccccccagcagcccggccccgccaagccccccccccagcagcccggcagcgccaagccccccagccagcagcccggcagcaccaagccccccccccagcagcccggccccgccaagcccagcccccagcagcccggcagcaccaagccccccagccagcagcccggcagcgccaagcccagcgcccagcagcccagccccgccaagcccagcgcccagcagagcaccaagcccgtgagccagaccggcagcggcaagcccctgcagccccccaccgtgagccccagcgccaagcagccccccagccagggcctgcccaagaccatctgccccctgtgcaacaccaccgagctgctgctgcacgtgcccgagaaggccaacttcaacacctgcaccgagtgccagaccaccgtgtgcagcctgtgcggcttcaaccccaacccccacctgaccgaggtgaaggagtggctgtgcctgaactgccagatgaagagagccctgggcggcgacctggcccccgtgcccagcagcccccagcccaagctgaagaccgcccccgtgaccaccaccagcgccgtgagcaagagcagcccccagccccagcagaccagccccaagaaggacgccgcccccaagcaggacctgagcaaggcccccgagcccaagaagcccccccccctggtgaagcagcccaccctgcacggcagccccagcgccaaggccaagcagccccccgaggccgacagcctgagcaagcccgccccccccaaggagcccagcgtgcccagcgagcaggacaaggcccccgtggccgacgacaagcccaagcagcccaagatggtgaagcccaccaccgacctggtgagcagcagcagcgccaccaccaagcccgacatccccagcagcaaggtgcagagccaggccgaggagaagaccaccccccccctgaagaccgacagcgccaagcccagccagagcttcccccccaccggcgagaaggtgagccccttcgacagcaaggccatccccagacccgccagcgacagcaagatcatcagccaccccggccccagcagcgagagcaagggccagaagcaggtggaccccgtgcagaagaaggaggagcccaagaaggcccagaccaagatgagccccaagcccgacgccaagcccatgcccaagggcagccccaccccccccggccccagacccaccgccggccagaccgtgcccaccccccagcagagccccaagccccaggagcagagcagaagattcagcctgaacctgggcagcatcaccgacgcccccaagagccagcccaccaccccccaggagaccgtgaccggcaagctgttcggcttcggcgccagcatcttcagccaggccagcaacctgatcagcaccgccggccagcccggcccccacagccagagcggccccggcgcccccatgaagcaggcccccgcccccagccagccccccaccagccagggcccccccaagagcaccggccaggccccccccgcccccgccaagagcatccccgtgaagaaggagaccaaggcccccgccgccgagaagctggagcccaaggccgagcaggcccccaccgtgaagagaaccgagaccgagaagaagcccccccccatcaaggacagcaagagcctgaccgccgagccccagaaggccgtgctgcccaccaagctggagaagagccccaagcccgagagcacctgccccctgtgcaagaccgagctgaacatcggcagcaaggacccccccaacttcaacacctgcaccgagtgcaagaaccaggtgtgcaacctgtgcggcttcaaccccaccccccacctgaccgagatccaggagtggctgtgcctgaactgccagacccagagagccatcagcggccagctgggcgacatcagaaagatgccccccgcccccagcggccccaaggccagccccatgcccgtgcccaccgagagcagcagccagaagaccgccgtgcccccccaggtgaagctggtgaagaagcaggagcaggaggtgaagaccgaggccgagaaggtgatcctggagaaggtgaaggagaccctgagcatggagaagatcccccccatggtgaccaccgaccagaagcaggaggagagcaagctggagaaggacaaggccagcgccctgcaggagaagaagcccctgcccgaggagaagaagctgatccccgaggaggagaagatcagaagcgaggagaagaagcccctgctggaggagaagaagcccacccccgaggacaagaagctgctgcccgaggccaagaccagcgcccccgaggagcagaagcacgacctgctgaagagccaggtgcagatcgccgaggagaagctggagggcagagtggcccccaagaccgtgcaggagggcaagcagccccagaccaagatggagggcctgcccagcggcaccccccagagcctgcccaaggaggacgacaagaccaccaagaccatcaaggagcagccccagcccccctgcaccgccaagcccgaccaggtggagcccggcaaggagaagaccgagaaggaggacgacaagagcgacaccagcagcagccagcagcccaagagcccccagggcctgagcgacaccggctacagcagcgacggcatcagcagcagcctgggcgagatccccagcctgatccccaccgacgagaaggacatcctgaagggcctgaagaaggacagcttcagccaggagagcagccccagcagccccagcgacctggccaagctggagagcaccgtgctgagcatcctggaggcccaggccagcaccctggccgacgagaagagcgagaagaagacccagccccacgaggtgagccccgagcagcccaaggaccaggagaagacccagagcctgagcgagaccctggagatcaccatcagcgaggaggagatcaaggagagccaggaggagagaaaggacaccttcaagaaggacagccagcaggacatccccagcagcaaggaccacaaggagaagagcgagttcgtggacgacatcaccaccagaagagagccctacgacagcgtggaggagagcagcgagagcgagaacagccccgtgccccagagaaagagaagaaccagcgtgggcagcagcagcagcgacgagtacaagcaggaggacagccagggcagcggcgaggaggaggacttcatcagaaagcagatcatcgagatgagcgccgacgaggacgccagcggcagcgaggacgacgagttcatcagaaaccagctgaaggagatcagcagcagcaccgagagccagaagaaggaggagaccaagggcaagggcaagatcaccgccggcaagcacagaagactgaccagaaagagcagcaccagcatcgacgaggacgccggcagaagacacagctggcacgacgaggacgacgaggccttcgacgagagccccgagctgaagtacagagagaccaagagccaggagagcgaggagctggtggtgaccggcggcggcggcctgagaagattcaagaccatcgagctgaacagcaccatcgccgacaagtacagcgccgagagcagccagaagaagaccagcctgtacttcgacgaggagcccgagctggagatggagagcctgaccgacagccccgaggacagaagcagaggcgagggcagcagcagcctgcacgccagcagcttcacccccggcaccagccccaccagcgtgagcagcctggacgaggacagcgacagcagccccagccacaagaagggcgagagcaagcagcagagaaaggccagacacagaccccacggccccctgctgcccaccatcgaggacagcagcgaggaggaggagctgagagaggaggaggagctgctgaaggagcaggagaagcagagagagatcgagcagcagcagagaaagagcagcagcaagaagagcaagaaggacaaggacgagctgagagcccagagaagaagagagagacccaagaccccccccagcaacctgagccccatcgaggacgccagccccaccgaggagctgagacaggccgccgagatggaggagctgcacagaagcagctgcagcgagtacagccccagcatcgagagcgaccccgagggcttcgagatcagccccgagaagatcatcgaggtgcagaaggtgtacaagctgcccaccgccgtgagcctgtacagccccaccgacgagcagagcatcatgcagaaggagggcagccagaaggccctgaagagcgccgaggagatgtacgaggagatgatgcacaagacccacaagtacaaggccttccccgccgccaacgagagagacgaggtgttcgagaaggagcccctgtacggcggcatgctgatcgaggactacatctacgagagcctggtggaggacacctacaacggcagcgtggacggcagcctgctgaccagacaggaggaggagaacggcttcatgcagcagaagggcagagagcagaagatcagactgagcgagcagatctacgaggaccccatgcagaagatcaccgacctgcagaaggagttctacgagctggagagcctgcacagcgtggtgccccaggaggacatcgtgagcagcagcttcatcatccccgagagccacgagatcgtggacctgggcaccatggtgaccagcaccgaggaggagagaaagctgctggacgccgacgccgcctacgaggagctgatgaagagacagcagatgcagctgacccccggcagcagccccacccaggcccccatcggcgaggacatgaccgagagcaccatggacttcgacagaatgcccgacgccagcctgaccagcagcgtgctgagcggcgccagcctgaccgacagcaccagcagcgccaccctgagcatccccgacgtgaagatcacccagcacttcagcaccgaggagatcgaggacgagtacgtgaccgactacaccagagagatccaggagatcatcgcccacgagagcctgatcctgacctacagcgagcccagcgagagcgccaccagcgtgccccccagcgacacccccagcctgaccagcagcgtgagcagcgtgtgcaccaccgacagcagcagccccatcaccaccctggacagcatcaccaccgtgtacaccgagcccgtggacatgatcaccaagttcgaggacagcgaggagatcagcagcagcacctacttccccggcagcatcatcgactaccccgaggagatcagcgtgagcctggacagaaccgccccccccgacggcagagccagcgccgaccacatcgtgatcagcctgagcgacatggccagcagcatcatcgagagcgtggtgcccaagcccgagggccccgtggccgacaccgtgagcaccgacctgctgatcagcgagaaggaccccgtgaagaaggccaagaaggagaccggcaacggcatcatcctggaggtgctggaggcctacagagacaagaaggagctggaggccgagagaaccaagagcagcctgagcgagaccgtgttcgaccacccccccagcagcgtgatcgccctgcccatgaaggagcagctgagcaccacctacttcaccagcggcgagaccttcggccaggagaagcccgccagccagctgcccagcggcagccccagcgtgagcagcctgcccgccaagcccagacccttcttcagaagcagcagcctggacatcagcgcccagccccccccccccccccccccccccccccccccccccccccccccccccccccccccccccccccccctgcccccccccaccagccccaagcccaccatcctgcccaagaagaagctgaccgtggccagccccgtgaccaccgccacccccctgttcgacgccgtgaccaccctggagaccaccgccgtgctgagaagcaacggcctgcccgtgaccagaatctgcaccaccgcccccccccccgtgccccccaagcccagcagcatccccagcggcctggtgttcacccacagacccgagcccagcaagccccccatcgcccccaagcccgtgatcccccagctgcccaccaccacccagaagcccaccgacatccaccccaagcccaccggcctgagcctgaccagcagcatgaccctgaacctggtgaccagcgccgactacaagctgcccagccccaccagccccctgagcccccacagcaacaagagcagccccagattcagcaagagcctgaccgagacctacgtggtgatcaccctgcccagcgagcccggcacccccaccgacagcagcgccagccaggccatcaccagctggcccctgggcagccccagcaaggacctggtgagcgtggagcccgtgttcagcgtggtgccccccgtgaccgccgtggagatccccatcagcagcgagcagaccttctacatcagcggcgccctgcagaccttcagcgccacccccgtgaccgcccccagcagcttccaggccgcccccaccagcgtgacccagttcctgaccaccgaggtgagcaagaccgaggtgagcgccaccagaagcaccgcccccagcgtgggcctgagcagcatcagcatcaccatcccccccgagcccctggccctggacaacatccacctggagaagccccagtacaaggaggacggcaagctgcagctggtgggcgacgtgatcgacctgagaaccgtgcccaaggtggaggtgaagaccaccgacaagtgcatcgacctgagcgccagcaccatggacgtgaagagacagatcaccgccaacgaggtgtacggcaagcagatcagcgccgtgcagcccagcatcatcaacctgagcgtgaccagcagcatcgtgacccccgtgagcctggccaccgagaccgtgaccttcgtgacctgcaccgccagcgccagctacaccaccggcaccgagagcctggtgggcgccgagcacgccatgaccacccccctgcagctgaccaccagcaagcacgccgagcccccctacagaatccccagcgaccaggtgttccccatcgccagagaggaggcccccatcaacctgagcctgggcacccccgcccacgccgtgaccctggccatcaccaagcccgtgaccgtgccccccgtgggcgtgaccaacggctggaccgacagcaccgtgagccagggcatcaccgacggcgaggtggtggacctgagcaccaccaagagccacagaaccgtggtgaccatggacgagagcaccagcagcgtgatgaccaagatcatcgaggacgagaagcccgtggacctgaccgccggcagaagagccgtgtgctgcgacgtggtgtacaagctgcccttcggcagaagctgcaccgcccagcagcccgccaccaccctgcccgaggacagattcggctacagagacgaccactaccagtacgacagaagcggcccctacggctacagaggcatcggcggcatgaagcccagcatgagcgacaccaacctggccgaggccggccacttcttctacaagagcaagaacgccttcgactacagcgagggcaccgacaccgccgtggacctgaccagcggcagagtgaccaccggcgaggtgatggactacagcagcaagaccaccggcccctaccccgagaccagacaggtgatcagcggcgccggcatcagcaccccccagtacagcaccgccagaatgacccccccccccggcccccagtactgcgtgggcagcgtgctgagaagcagcaacggcgtggtgtacagcagcgtggccacccccacccccagcaccttcgccatcaccacccagcccggcagcatcttcagcaccaccgtgagagacctgagcggcatccacaccgccgacgccgtgaccagcctgcccgccatgcaccacagccagcccatgcccagaagctacttcatcaccaccggcgccagcgagaccgacatcgccgtgaccggcatcgacatcagcgccagcctgcagaccatcaccatggagagcctgaccgccgagaccatcgacagcgtgcccaccctgaccaccgccagcgaggtgttccccgaggtggtgggcgacgagagcgccctgctgatcgtgcccgaggaggacaagcagcagcagcagctggacctggagagagagctgctggagctggagaagatcaagcagcagagattcgccgaggagctggagtgggagagacaggagatccagagattcagagagcaggagaagatcatggtgcagaagaagctggaggagctgcagagcatgaagcagcacctgctgttccagcaggaggaggagagacaggcccagttcatgatgagacaggagaccctggcccagcagcagctgcagctggagcagatccagcagctgcagcagcagctgcaccagcagctggaggagcagaagatcagacagatctaccagtacaactacgaccccagcggcaccgccagcccccagaccaccaccgagcaggccatcctggagggccagtacgccgccctggagggcagccagttctgggccaccgaggacgccaccaccaccgccagcgccgtggtggccatcgagatcccccagagccagggctggtacaccgtgcagagcgacggcgtgacccagtacatcgccccccccggcatcctgagcaccgtgagcgagatccccctgaccgacgtggtggtgaaggaggagaagcagcccaagaagagaagcagcggcgccaaggtgagaggccagtacgacgacatgggcgagaacatgaccgacgaccccagaagcttcaagaagatcgtggacagcggcgtgcagaccgacgacgaggacgccaccgacagaagctacgtgagcagaagaagaagaaccaagaagagcgtggacaccagcgtgcagaccgacgacgaggaccaggacgagtgggacatgcccaccagaagcagaagaaaggccagagtgggcaagtacggcgacagcatgaccgaggccgacaagaccaagcccctgagcaaggtgagcagcatcgccgtgcagaccgtggccgagatcagcgtgcagaccgagcccgtgggcaccatcagaacccccagcatcagagccagagtggacgccaaggtggagatcatcaagcacatcagcgcccccgagaagacctacaagggcggcagcctgggctgccagaccgaggccgacagcgacacccagagcccccagtacctgagcgccaccagcccccccaaggacaagaagagacccacccccctggagatcggctacagcagccacctgagagccgacagcaccgtgcagctggcccccagcccccccaagagccccaaggtgctgtacagccccatcagccccctgagccccggcaaggccctggagagcgccttcgtgccctacgagaagcccctgcccgacgacatcagcccccagaaggtgctgcaccccgacatggccaaggtgccccccgccagccccaagaccgccaagatgatgcagagaagcatgagcgaccccaagcccctgagccccaccgccgacgagagcagcagagcccccttccagtacaccgagggctacaccaccaagggcagccagaccatgaccagcagcggcgcccagaagaaggtgaagagaaccctgcccaaccccccccccgaggagatcagcaccggcacccagagcaccttcagcaccatgggcaccgtgagcagaagaagaatctgcagaaccaacaccatggccagagccaagatcctgcaggacatcgacagagagctggacctggtggagagagagagcgccaagctgagaaagaagcaggccgagctggacgaggaggagaaggagatcgacgccaagctgagatacctggagatgggcatcaacagaagaaaggaggccctgctgaaggagagagagaagagagagagagcctacctgcagggcgtggccgaggacagagactacatgagcgacagcgaggtgagcagcaccagacccaccagaatcgagagccagcacggcatcgagagacccagaaccgccccccagaccgagttcagccagttcatccccccccagacccagaccgagagccagctggtgccccccaccagcccctacacccagtaccagtacagcagccccgccctgcccacccaggcccccaccagctacacccagcagagccacttcgagcagcagaccctgtaccaccagcaggtgagcccctaccagacccagcccaccttccaggccgtggccaccatgagcttcaccccccaggtgcagcccacccccaccccccagcccagctaccagctgcccagccagatgatggtgatccagcagaagcccagacagaccaccctgtacctggagcccaagatcaccagcaactacgaggtgatcagaaaccagcccctgatgatcgcccccgtgagcaccgacaacaccttcgccgtgagccacctgggcagcaagtacaacagcctggacctgagaatcggcctggaggagagaagcagcatggccagcagccccatcagcagcatcagcgccgacagcttctacgccgacatcgaccaccacacccccagaaactacgtgctgatcgacgacatcggcgagatcaccaagggcaccgccgccctgagcaccgccttcagcctgcacgagaaggacctgagcaagaccgacagactgctgagaaccaccgagaccagaagaagccaggaggtgaccgacttcctggcccccctgcagagcagcagcagactgcacagctacgtgaaggccgaggaggaccccatggaggacccctacgagctgaagctgctgaagcaccagatcaagcaggagttcagaagaggcaccgagagcctggaccacctggccggcctgagccactactaccacgccgacaccagctacagacacttccccaagagcgagaagtacagcatcagcagactgaccctggagaagcaggccgccaagcagctgcccgccgccatcctgtaccagaagcagagcaagcacaagaagagcctgatcgaccccaagatgagcaagttcagccccatccaggagagcagagacctggagcccgactacagcagctacatgaccagcagcaccagcagcatcggcggcatcagcagcagagccagactgctgcaggacgacatcaccttcggcctgagaaagaacatcaccgaccagcagaagttcatgggcagcagcctgggcaccggcctgggcaccctgggcaacaccatcagaagcgccctgcaggacgaggccgacaagccctacagcagcggcagcagaagcagacccagcagcagacccagcagcgtgtacggcctggacctgagcatcaagagagacagcagcagcagcagcctgagactgaaggcccaggaggccgaggccctggacgtgagcttcagccacgccagcagcagcgccagaaccaagcccaccagcctgcccatcagccagagcagaggcagaatccccatcgtggcccagaacagcgaggaggagagccccctgagccccgtgggccagcccatgggcatggccagagccgccgccggccccctgccccccatcagcgccgacaccagagaccagttcggcagcagccacagcctgcccgaggtgcagcagcacatgagagaggagagcagaaccagaggctacgacagagacatcgccttcatcatggacgacttccagcacgccatgagcgacagcgaggcctaccacctgagaagagaggagaccgactggttcgacaagcccagagagagcagactggagaacggccacggcctggacagaaagctgcccgagagactggtgcacagcagacccctgagccagcaccaggagcagatcatccagatgaacggcaagaccatgcactacatcttcccccacgccagaatcaagatcaccagagacagcaaggaccacaccgtgagcggcaacggcctgggcatcagaatcgtgggcggcaaggagatccccggccacagcggcgagatcggcgcctacatcgccaagatcctgcccggcggcagcgccgagcagaccggcaagctgatggagggcatgcaggtgctggagtggaacggcatccccctgaccagcaagacctacgaggaggtgcagagcatcatcagccagcagagcggcgaggccgagatctgcgtgagactggacctgaacatgctgagcgacagcgagaacagccagcacctggagctgcacgagccccccaaggccgtggacaaggccaagagccccggcgtggaccccaagcagctggccgccgagctgcagaaggtgagcctgcagcagagccccctggtgctgagcagcgtggtggagaagggcagccacgtgcacagcggccccaccagcgccggcagcagcagcgtgcccagccccggccagcccggcagccccagcgtgagcaagaagaagcacggcagcagcaagcccaccgacggcaccaaggtggtgagccaccccatcaccggcgagatccagctgcagatcaactacgacctgggcaacctgatcatccacatcctgcaggccagaaacctggtgcccagagacaacaacggctacagcgaccccttcgtgaaggtgtacctgctgcccggcagaggccaggtgatggtggtgcagaacgccagcgccgagtacaagagaagaaccaagcacgtgcagaagagcctgaaccccgagtggaaccagaccgtgatctacaagagcatcagcatggagcagctgaagaagaagaccctggaggtgaccgtgtgggactacgacagattcagcagcaacgacttcctgggcgaggtgctgatcgacctgagcagcaccagccacctggacaacacccccagatggtaccccctgaaggagcagaccgagagcatcgaccacggcaagagccacagcagccagagcagccagcagagccccaagcccagcgtgatcaagagcagaagccacggcatcttccccgaccccagcaaggacatgcaggtgcccaccatcgagaagagccacagcagccccggcagcagcaagagcagcagcgagggccacctgagaagccacggccccagcagaagccagagcaagaccagcgtgacccagacccacctggaggacgccggcgccgccatcgccgccgccgaggccgccgtgcagcagctgagaatccagcccaccaagccccccaaccacagacccgccgagagcagcgtgagcaccggcagcagcggcagcagcttcggcagcggctacagcgtggacagcgagggcagcagcagcaccgccggcgagaccaacctgttccccatccccagaatcggcaagatgggccagaacggccaggagcccgtgaagcagcccggcgtgggcgtgggcctggccgacaccgaggccaagacccaggtgatgggcgagatcaagatcgccctgaagaaggagatgaagaccgacggcgagcagctgatcgtggagatcctgcagtgcagaaacatcacctacaagttcaagagccccgaccacctgcccgacctgtacgtgaagatctacgtgatgaacatcagcacccagaagaaggtgatcaagaagaagaccagagtgtgcagacacgacagagagcccagcttcaacgagaccttcagattcagcctgagccccgccggccacagcctgcagatcctgctgttcagcaacggcggcaagttcatgaagaagaccctgatcggcgaggcctgcatctggctggacaaggtggacctgagaaagagaatcgtgaactggcacaagctgctggtgagccccacccagacccactag

SEQ ID NO: 93460 - DNA, 1269 bp, Artificial Sequence
  Description of Artificial Sequence: Synthetic coding sequence
accaaggtgtggaacagcaacggcctgggcatcagaatcgtgggcggcaaggagatccccggccacagcggcgagatcggcgcctacatcgccaagatcctgcccggcggcagcgccgagcagaccggcaagctgatggagggcatgcaggtgctggagtggaacggcatccccctgaccagcaagacctacgaggaggtgcagagcatcatcagccagcagagcggcgaggccgagatctgcgtgagactggacctgaacatgctgagcgacagcgagaacagccagcacctggagctgcacgagccccccaaggccgtggacaaggccaagagccccggcgtggaccccaagcagctggccgccgagctgcagaaggtgagcctgcagcagagccccctggtgctgagcagcgtggtggagaagggcagccacgtgcacagcggccccaccagcgccggcagcagcagcgtgcccagccccggccagcccggcagccccagcgtgagcaagaagaagcacggcagcagcaagcccaccgacggcaccaaggtggtgagccaccccatcaccggcgagatccagctgcagatcaactacgacctgggcaacctgatcatccacatcctgcaggccagaaacctggtgcccagagacaacaacggctacagcgaccccttcgtgaaggtgtacctgctgcccggcagaggcgccgagtacaagagaagaaccaagcacgtgcagaagagcctgaaccccgagtggaaccagaccgtgatctacaagagcatcagcatggagcagctgaagaagaagaccctggaggtgaccgtgtgggactacgacagattcagcagcaacgacttcctgggcgaggtgctgatcgacctgagcagcaccagccacctggacaacacccccagatggtaccccctgaaggagcagaccgagagcatcgaccacggcaagagccacagcagccagagcagccagcagagccccaagcccagcgtgatcaagagcagaagccacggcatcttccccgaccccagcaaggacatgcaggtgcccaccatcgagaagagccacagcagccccggcagcagcaagagcagcagcgagggccacctgagaagccacggccccagcagaagccagagcaagaccagcgtgacccagacccacctggaggacgccggcgccgccatcgccgccgccgaggccgccgtgcagcagctgagaatccagcccagcaagagaagaaagtag

SEQ ID NO: 93461 - DNA, 14808 bp, Artificial Sequence
  Description of Artificial Sequence: Synthetic coding sequence
atgggcaacgaggccagcctggagggcgagggcctgcccgagggcctggccgccgccgccgccgccggcggcggcgccagcggcgccggcagccccagccacaccgccatccccgccggcatggaggccgacctgagccagctgagcgaggaggagagaagacagatcgccgccgtgatgagcagagcccagggcctgcccaagggcagcgtgccccccgccgccgccgagagccccagcatgcacagaaagcaggagctggacagcagccacccccccaagcagagcggcagaccccccgaccccggcagacccgcccagcccggcctgagcaagagcagaaccaccgacaccttcagaagcgagcagaagctgcccggcagaagccccagcaccatcagcctgaaggagagcaagagcagaaccgacctgaaggaggagcacaagagcagcatgatgcccggcttcctgagcgaggtgaacgccctgagcgccgtgagcagcgtggtgaacaagttcaaccccttcgacctgatcagcgacagcgaggccagccaggaggagaccaccaagaagcagaaggtggtgcagaaggagcagggcaagcccgagggcatcatcaagccccccctgcagcagcagccccccaagcccatccccaagcagcagggccccggcagagaccccctgcagcaggacggcacccccaagagcatcagcagccagcagcccgagaagatcaagagccagccccccggcaccggcaagcccatccagggccccacccagaccccccagaccgaccacgccaagctgcccctgcagagagacgccagcagaccccagaccaagcaggccgacatcgtgagaggcgagagcgtgaagcccagcctgcccagccccagcaagccccccatccagcagcccacccccggcaagccccccgcccagcagcccggccacgagaagagccagcccggccccgccaagccccccgcccagcccagcggcctgaccaagcccctggcccagcagcccggcaccgtgaagccccccgtgcagccccccggcaccaccaagccccccgcccagcccctgggccccgccaagccccccgcccagcagaccggcagcgagaagcccagcagcgagcagcccggccccaaggccctggcccagccccccggcgtgggcaagacccccgcccagcagcccggccccgccaagccccccacccagcaggtgggcacccccaagcccctggcccagcagcccggcctgcagagccccgccaaggcccccggccccaccaagacccccgtgcagcagcccggccccggcaagatccccgcccagcaggccggccccggcaagaccagcgcccagcagaccggccccaccaagccccccagccagctgcccggccccgccaagccccccccccagcagcccggccccgccaagccccccccccagcagcccggcagcgccaagccccccagccagcagcccggcagcaccaagccccccccccagcagcccggccccgccaagcccagcccccagcagcccggcagcaccaagccccccagccagcagcccggcagcgccaagcccagcgcccagcagcccagccccgccaagcccagcgcccagcagagcaccaagcccgtgagccagaccggcagcggcaagcccctgcagccccccaccgtgagccccagcgccaagcagccccccagccagggcctgcccaagaccatctgccccctgtgcaacaccaccgagctgctgctgcacgtgcccgagaaggccaacttcaacacctgcaccgagtgccagaccaccgtgtgcagcctgtgcggcttcaaccccaacccccacctgaccgaggtgaaggagtggctgtgcctgaactgccagatgaagagagccctgggcggcgacctggcccccgtgcccagcagcccccagcccaagctgaagaccgcccccgtgaccaccaccagcgccgtgagcaagagcagcccccagccccagcagaccagccccaagaaggacgccgcccccaagcaggacctgagcaaggcccccgagcccaagaagcccccccccctggtgaagcagcccaccctgcacggcagccccagcgccaaggccaagcagccccccgaggccgacagcctgagcaagcccgccccccccaaggagcccagcgtgcccagcgagcaggacaaggcccccgtggccgacgacaagcccaagcagcccaagatggtgaagcccaccaccgacctggtgagcagcagcagcgccaccaccaagcccgacatccccagcagcaaggtgcagagccaggccgaggagaagaccaccccccccctgaagaccgacagcgccaagcccagccagagcttcccccccaccggcgagaaggtgagccccttcgacagcaaggccatccccagacccgccagcgacagcaagatcatcagccaccccggccccagcagcgagagcaagggccagaagcaggtggaccccgtgcagaagaaggaggagcccaagaaggcccagaccaagatgagccccaagcccgacgccaagcccatgcccaagggcagccccaccccccccggccccagacccaccgccggccagaccgtgcccaccccccagcagagccccaagccccaggagcagagcagaagattcagcctgaacctgggcagcatcaccgacgcccccaagagccagcccaccaccccccaggagaccgtgaccggcaagctgttcggcttcggcgccagcatcttcagccaggccagcaacctgatcagcaccgccggccagcccggcccccacagccagagcggccccggcgcccccatgaagcaggcccccgcccccagccagccccccaccagccagggcccccccaagagcaccggccaggccccccccgcccccgccaagagcatccccgtgaagaaggagaccaaggcccccgccgccgagaagctggagcccaaggccgagcaggcccccaccgtgaagagaaccgagaccgagaagaagcccccccccatcaaggacagcaagagcctgaccgccgagccccagaaggccgtgctgcccaccaagctggagaagagccccaagcccgagagcacctgccccctgtgcaagaccgagctgaacatcggcagcaaggacccccccaacttcaacacctgcaccgagtgcaagaaccaggtgtgcaacctgtgcggcttcaaccccaccccccacctgaccgagatccaggagtggctgtgcctgaactgccagacccagagagccatcagcggccagctgggcgacatcagaaagatgccccccgcccccagcggccccaaggccagccccatgcccgtgcccaccgagagcagcagccagaagaccgccgtgcccccccaggtgaagctggtgaagaagcaggagcaggaggtgaagaccgaggccgagaaggtgatcctggagaaggtgaaggagaccctgagcatggagaagatcccccccatggtgaccaccgaccagaagcaggaggagagcaagctggagaaggacaaggccagcgccctgcaggagaagaagcccctgcccgaggagaagaagctgatccccgaggaggagaagatcagaagcgaggagaagaagcccctgctggaggagaagaagcccacccccgaggacaagaagctgctgcccgaggccaagaccagcgcccccgaggagcagaagcacgacctgctgaagagccaggtgcagatcgccgaggagaagctggagggcagagtggcccccaagaccgtgcaggagggcaagcagccccagaccaagatggagggcctgcccagcggcaccccccagagcctgcccaaggaggacgacaagaccaccaagaccatcaaggagcagccccagcccccctgcaccgccaagcccgaccaggtggagcccggcaaggagaagaccgagaaggaggacgacaagagcgacaccagcagcagccagcagcccaagagcccccagggcctgagcgacaccggctacagcagcgacggcatcagcagcagcctgggcgagatccccagcctgatccccaccgacgagaaggacatcctgaagggcctgaagaaggacagcttcagccaggagagcagccccagcagccccagcgacctggccaagctggagagcaccgtgctgagcatcctggaggcccaggccagcaccctggccgacgagaagagcgagaagaagacccagccccacgaggtgagccccgagcagcccaaggaccaggagaagacccagagcctgagcgagaccctggagatcaccatcagcgaggaggagatcaaggagagccaggaggagagaaaggacaccttcaagaaggacagccagcaggacatccccagcagcaaggaccacaaggagaagagcgagttcgtggacgacatcaccaccagaagagagccctacgacagcgtggaggagagcagcgagagcgagaacagccccgtgccccagagaaagagaagaaccagcgtgggcagcagcagcagcgacgagtacaagcaggaggacagccagggcagcggcgaggaggaggacttcatcagaaagcagatcatcgagatgagcgccgacgaggacgccagcggcagcgaggacgacgagttcatcagaaaccagctgaaggagatcagcagcagcaccgagagccagaagaaggaggagaccaagggcaagggcaagatcaccgccggcaagcacagaagactgaccagaaagagcagcaccagcatcgacgaggacgccggcagaagacacagctggcacgacgaggacgacgaggccttcgacgagagccccgagctgaagtacagagagaccaagagccaggagagcgaggagctggtggtgaccggcggcggcggcctgagaagattcaagaccatcgagctgaacagcaccatcgccgacaagtacagcgccgagagcagccagaagaagaccagcctgtacttcgacgaggagcccgagctggagatggagagcctgaccgacagccccgaggacagaagcagaggcgagggcagcagcagcctgcacgccagcagcttcacccccggcaccagccccaccagcgtgagcagcctggacgaggacagcgacagcagccccagccacaagaagggcgagagcaagcagcagagaaaggccagacacagaccccacggccccctgctgcccaccatcgaggacagcagcgaggaggaggagctgagagaggaggaggagctgctgaaggagcaggagaagcagagagagatcgagcagcagcagagaaagagcagcagcaagaagagcaagaaggacaaggacgagctgagagcccagagaagaagagagagacccaagaccccccccagcaacctgagccccatcgaggacgccagccccaccgaggagctgagacaggccgccgagatggaggagctgcacagaagcagctgcagcgagtacagccccagcatcgagagcgaccccgagggcttcgagatcagccccgagaagatcatcgaggtgcagaaggtgtacaagctgcccaccgccgtgagcctgtacagccccaccgacgagcagagcatcatgcagaaggagggcagccagaaggccctgaagagcgccgaggagatgtacgaggagatgatgcacaagacccacaagtacaaggccttccccgccgccaacgagagagacgaggtgttcgagaaggagcccctgtacggcggcatgctgatcgaggactacatctacgagagcctggtggaggacacctacaacggcagcgtggacggcagcctgctgaccagacaggaggaggagaacggcttcatgcagcagaagggcagagagcagaagatcagactgagcgagcagatctacgaggaccccatgcagaagatcaccgacctgcagaaggagttctacgagctggagagcctgcacagcgtggtgccccaggaggacatcgtgagcagcagcttcatcatccccgagagccacgagatcgtggacctgggcaccatggtgaccagcaccgaggaggagagaaagctgctggacgccgacgccgcctacgaggagctgatgaagagacagcagatgcagctgacccccggcagcagccccacccaggcccccatcggcgaggacatgaccgagagcaccatggacttcgacagaatgcccgacgccagcctgaccagcagcgtgctgagcggcgccagcctgaccgacagcaccagcagcgccaccctgagcatccccgacgtgaagatcacccagcacttcagcaccgaggagatcgaggacgagtacgtgaccgactacaccagagagatccaggagatcatcgcccacgagagcctgatcctgacctacagcgagcccagcgagagcgccaccagcgtgccccccagcgacacccccagcctgaccagcagcgtgagcagcgtgtgcaccaccgacagcagcagccccatcaccaccctggacagcatcaccaccgtgtacaccgagcccgtggacatgatcaccaagttcgaggacagcgaggagatcagcagcagcacctacttccccggcagcatcatcgactaccccgaggagatcagcgtgagcctggacagaaccgccccccccgacggcagagccagcgccgaccacatcgtgatcagcctgagcgacatggccagcagcatcatcgagagcgtggtgcccaagcccgagggccccgtggccgacaccgtgagcaccgacctgctgatcagcgagaaggaccccgtgaagaaggccaagaaggagaccggcaacggcatcatcctggaggtgctggaggcctacagagacaagaaggagctggaggccgagagaaccaagagcagcctgagcgagaccgtgttcgaccacccccccagcagcgtgatcgccctgcccatgaaggagcagctgagcaccacctacttcaccagcggcgagaccttcggccaggagaagcccgccagccagctgcccagcggcagccccagcgtgagcagcctgcccgccaagcccagacccttcttcagaagcagcagcctggacatcagcgcccagccccccccccccccccccccccccccccccccccccccccccccccccccccccccccccccccccctgcccccccccaccagccccaagcccaccatcctgcccaagaagaagctgaccgtggccagccccgtgaccaccgccacccccctgttcgacgccgtgaccaccctggagaccaccgccgtgctgagaagcaacggcctgcccgtgaccagaatctgcaccaccgcccccccccccgtgccccccaagcccagcagcatccccagcggcctggtgttcacccacagacccgagcccagcaagccccccatcgcccccaagcccgtgatcccccagctgcccaccaccacccagaagcccaccgacatccaccccaagcccaccggcctgagcctgaccagcagcatgaccctgaacctggtgaccagcgccgactacaagctgcccagccccaccagccccctgagcccccacagcaacaagagcagccccagattcagcaagagcctgaccgagacctacgtggtgatcaccctgcccagcgagcccggcacccccaccgacagcagcgccagccaggccatcaccagctggcccctgggcagccccagcaaggacctggtgagcgtggagcccgtgttcagcgtggtgccccccgtgaccgccgtggagatccccatcagcagcgagcagaccttctacatcagcggcgccctgcagaccttcagcgccacccccgtgaccgcccccagcagcttccaggccgcccccaccagcgtgacccagttcctgaccaccgaggtgagcaagaccgaggtgagcgccaccagaagcaccgcccccagcgtgggcctgagcagcatcagcatcaccatcccccccgagcccctggccctggacaacatccacctggagaagccccagtacaaggaggacggcaagctgcagctggtgggcgacgtgatcgacctgagaaccgtgcccaaggtggaggtgaagaccaccgacaagtgcatcgacctgagcgccagcaccatggacgtgaagagacagatcaccgccaacgaggtgtacggcaagcagatcagcgccgtgcagcccagcatcatcaacctgagcgtgaccagcagcatcgtgacccccgtgagcctggccaccgagaccgtgaccttcgtgacctgcaccgccagcgccagctacaccaccggcaccgagagcctggtgggcgccgagcacgccatgaccacccccctgcagctgaccaccagcaagcacgccgagcccccctacagaatccccagcgaccaggtgttccccatcgccagagaggaggcccccatcaacctgagcctgggcacccccgcccacgccgtgaccctggccatcaccaagcccgtgaccgtgccccccgtgggcgtgaccaacggctggaccgacagcaccgtgagccagggcatcaccgacggcgaggtggtggacctgagcaccaccaagagccacagaaccgtggtgaccatggacgagagcaccagcagcgtgatgaccaagatcatcgaggacgagaagcccgtggacctgaccgccggcagaagagccgtgtgctgcgacgtggtgtacaagctgcccttcggcagaagctgcaccgcccagcagcccgccaccaccctgcccgaggacagattcggctacagagacgaccactaccagtacgacagaagcggcccctacggctacagaggcatcggcggcatgaagcccagcatgagcgacaccaacctggccgaggccggccacttcttctacaagagcaagaacgccttcgactacagcgagggcaccgacaccgccgtggacctgaccagcggcagagtgaccaccggcgaggtgatggactacagcagcaagaccaccggcccctaccccgagaccagacaggtgatcagcggcgccggcatcagcaccccccagtacagcaccgccagaatgacccccccccccggcccccagtactgcgtgggcagcgtgctgagaagcagcaacggcgtggtgtacagcagcgtggccacccccacccccagcaccttcgccatcaccacccagcccggcagcatcttcagcaccaccgtgagagacctgagcggcatccacaccgccgacgccgtgaccagcctgcccgccatgcaccacagccagcccatgcccagaagctacttcatcaccaccggcgccagcgagaccgacatcgccgtgaccggcatcgacatcagcgccagcctgcagaccatcaccatggagagcctgaccgccgagaccatcgacagcgtgcccaccctgaccaccgccagcgaggtgttccccgaggtggtgggcgacgagagcgccctgctgatcgtgcccgaggaggacaagcagcagcagcagctggacctggagagagagctgctggagctggagaagatcaagcagcagagattcgccgaggagctggagtgggagagacaggagatccagagattcagagagcaggagaagatcatggtgcagaagaagctggaggagctgcagagcatgaagcagcacctgctgttccagcaggaggaggagagacaggcccagttcatgatgagacaggagaccctggcccagcagcagctgcagctggagcagatccagcagctgcagcagcagctgcaccagcagctggaggagcagaagatcagacagatctaccagtacaactacgaccccagcggcaccgccagcccccagaccaccaccgagcaggccatcctggagggccagtacgccgccctggagggcagccagttctgggccaccgaggacgccaccaccaccgccagcgccgtggtggccatcgagatcccccagagccagggctggtacaccgtgcagagcgacggcgtgacccagtacatcgccccccccggcatcctgagcaccgtgagcgagatccccctgaccgacgtggtggtgaaggaggagaagcagcccaagaagagaagcagcggcgccaaggtgagaggccagtacgacgacatgggcgagaacatgaccgacgaccccagaagcttcaagaagatcgtggacagcggcgtgcagaccgacgacgaggacgccaccgacagaagctacgtgagcagaagaagaagaaccaagaagagcgtggacaccagcgtgcagaccgacgacgaggaccaggacgagtgggacatgcccaccagaagcagaagaaaggccagagtgggcaagtacggcgacagcatgaccgaggccgacaagaccaagcccctgagcaaggtgagcagcatcgccgtgcagaccgtggccgagatcagcgtgcagaccgagcccgtgggcaccatcagaacccccagcatcagagccagagtggacgccaaggtggagatcatcaagcacatcagcgcccccgagaagacctacaagggcggcagcctgggctgccagaccgaggccgacagcgacacccagagcccccagtacctgagcgccaccagcccccccaaggacaagaagagacccacccccctggagatcggctacagcagccacctgagagccgacagcaccgtgcagctggcccccagcccccccaagagccccaaggtgctgtacagccccatcagccccctgagccccggcaaggccctggagagcgccttcgtgccctacgagaagcccctgcccgacgacatcagcccccagaaggtgctgcaccccgacatggccaaggtgccccccgccagccccaagaccgccaagatgatgcagagaagcatgagcgaccccaagcccctgagccccaccgccgacgagagcagcagagcccccttccagtacaccgagggctacaccaccaagggcagccagaccatgaccagcagcggcgcccagaagaaggtgaagagaaccctgcccaaccccccccccgaggagatcagcaccggcacccagagcaccttcagcaccatgggcaccgtgagcagaagaagaatctgcagaaccaacaccatggccagagccaagatcctgcaggacatcgacagagagctggacctggtggagagagagagcgccaagctgagaaagaagcaggccgagctggacgaggaggagaaggagatcgacgccaagctgagatacctggagatgggcatcaacagaagaaaggaggccctgctgaaggagagagagaagagagagagagcctacctgcagggcgtggccgaggacagagactacatgagcgacagcgaggtgagcagcaccagacccaccagaatcgagagccagcacggcatcgagagacccagaaccgccccccagaccgagttcagccagttcatccccccccagacccagaccgagagccagctggtgccccccaccagcccctacacccagtaccagtacagcagccccgccctgcccacccaggcccccaccagctacacccagcagagccacttcgagcagcagaccctgtaccaccagcaggtgagcccctaccagacccagcccaccttccaggccgtggccaccatgagcttcaccccccaggtgcagcccacccccaccccccagcccagctaccagctgcccagccagatgatggtgatccagcagaagcccagacagaccaccctgtacctggagcccaagatcaccagcaactacgaggtgatcagaaaccagcccctgatgatcgcccccgtgagcaccgacaacaccttcgccgtgagccacctgggcagcaagtacaacagcctggacctgagaatcggcctggaggagagaagcagcatggccagcagccccatcagcagcatcagcgccgacagcttctacgccgacatcgaccaccacacccccagaaactacgtgctgatcgacgacatcggcgagatcaccaagggcaccgccgccctgagcaccgccttcagcctgcacgagaaggacctgagcaagaccgacagactgctgagaaccaccgagaccagaagaagccaggaggtgaccgacttcctggcccccctgcagagcagcagcagactgcacagctacgtgaaggccgaggaggaccccatggaggacccctacgagctgaagctgctgaagcaccagatcaagcaggagttcagaagaggcaccgagagcctggaccacctggccggcctgagccactactaccacgccgacaccagctacagacacttccccaagagcgagaagtacagcatcagcagactgaccctggagaagcaggccgccaagcagctgcccgccgccatcctgtaccagaagcagagcaagcacaagaagagcctgatcgaccccaagatgagcaagttcagccccatccaggagagcagagacctggagcccgactacagcagctacatgaccagcagcaccagcagcatcggcggcatcagcagcagagccagactgctgcaggacgacatcaccttcggcctgagaaagaacatcaccgaccagcagaagttcatgggcagcagcctgggcaccggcctgggcaccctgggcaacaccatcagaagcgccctgcaggacgaggccgacaagccctacagcagcggcagcagaagcagacccagcagcagacccagcagcgtgtacggcctggacctgagcatcaagagagacagcagcagcagcagcctgagactgaaggcccaggaggccgaggccctggacgtgagcttcagccacgccagcagcagcgccagaaccaagcccaccagcctgcccatcagccagagcagaggcagaatccccatcgtggcccagaacagcgaggaggagagccccctgagccccgtgggccagcccatgggcatggccagagccgccgccggccccctgccccccatcagcgccgacaccagagaccagttcggcagcagccacagcctgcccgaggtgcagcagcacatgagagaggagagcagaaccagaggctacgacagagacatcgccttcatcatggacgacttccagcacgccatgagcgacagcgaggcctaccacctgagaagagaggagaccgactggttcgacaagcccagagagagcagactggagaacggccacggcctggacagaaagctgcccgagagactggtgcacagcagacccctgagccagcaccaggagcagatcatccagatgaacggcaagaccatgcactacatcttcccccacgccagaatcaagatcaccagagacagcaaggaccacaccgtgagcggcaacggcctgggcatcagaatcgtgggcggcaaggagatccccggccacagcggcgagatcggcgcctacatcgccaagatcctgcccggcggcagcgccgagcagaccggcaagctgatggagggcatgcaggtgctggagtggaacggcatccccctgaccagcaagacctacgaggaggtgcagagcatcatcagccagcagagcggcgaggccgagatctgcgtgagactggacctgaacatgctgagcgacagcgagaacagccagcacctggagctgcacgagccccccaaggccgtggacaaggccaagagccccggcgtggaccccaagcagctggccgccgagctgcagaaggtgagcctgcagcagagccccctggtgctgagcagcgtggtggagaagggcagccacgtgcacagcggccccaccagcgccggcagcagcagcgtgcccagccccggccagcccggcagccccagcgtgagcaagaagaagcacggcagcagcaagcccaccgacggcaccaaggtggtgagccaccccatcaccggcgagatccagctgcagatcaactacgacctgggcaacctgatcatccacatcctgcaggccagaaacctggtgcccagagacaacaacggctacagcgaccccttcgtgaaggtgtacctgctgcccggcagaggccaggtgatggtggtgcagaacgccagcgccgagtacaagagaagaaccaagcacgtgcagaagagcctgaaccccgagtggaaccagaccgtgatctacaagagcatcagcatggagcagctgaagaagaagaccctggaggtgaccgtgtgggactacgacagattcagcagcaacgacttcctgggcgaggtgctgatcgacctgagcagcaccagccacctggacaacacccccagatggtaccccctgaaggagcagaccgagagcatcgaccacggcaagagccacagcagccagagcagccagcagagccccaagcccagcgtgatcaagagcagaagccacggcatcttccccgaccccagcaaggacatgcaggtgcccaccatcgagaagagccacagcagccccggcagcagcaagagcagcagcgagggccacctgagaagccacggccccagcagaagccagagcaagaccagcgtgacccagacccacctggaggacgccggcgccgccatcgccgccgccgaggccgccgtgcagcagctgagaatccagcccagcaagagaagaaagtag

SEQ ID NO: 93462 - DNA, 10908 bp, Artificial Sequence
  Description of Artificial Sequence: Synthetic coding sequence
atgggcaacgaggccagcctggagggcgagggcctgcccgagggcctggccgccgccgccgccgccggcggcggcgccagcggcgccggcagccccagccacaccgccatccccgccggcatggaggccgacctgagccagctgagcgaggaggagagaagacagatcgccgccgtgatgagcagagcccagggcctgcccaagggcagcgtgccccccgccgccgccgagagccccagcatgcacagaaagcaggagctggacagcagccacccccccaagcagagcggcagaccccccgaccccggcagacccgcccagcccggcctgagcaagagcagaaccaccgacaccttcagaagcgagcagaagctgcccggcagaagccccagcaccatcagcctgaaggagagcaagagcagaaccgacctgaaggaggagcacaagagcagcatgatgcccggcttcctgagcgaggtgaacgccctgagcgccgtgagcagcgtggtgaacaagttcaaccccttcgacctgatcagcgacagcgaggccagccaggaggagaccaccaagaagcagaaggtggtgcagaaggagcagggcaagcccgagggcatcatcaagccccccctgcagcagcagccccccaagcccatccccaagcagcagggccccggcagagaccccctgcagcaggacggcacccccaagagcatcagcagccagcagcccgagaagatcaagagccagccccccggcaccggcaagcccatccagggccccacccagaccccccagaccgaccacgccaagctgcccctgcagagagacgccagcagaccccagaccaagcaggccgacatcgtgagaggcgagagcgtgaagcccagcctgcccagccccagcaagccccccatccagcagcccacccccggcaagccccccgcccagcagcccggccacgagaagagccagcccggccccgccaagccccccgcccagcccagcggcctgaccaagcccctggcccagcagcccggcaccgtgaagccccccgtgcagccccccggcaccaccaagccccccgcccagcccctgggccccgccaagccccccgcccagcagaccggcagcgagaagcccagcagcgagcagcccggccccaaggccctggcccagccccccggcgtgggcaagacccccgcccagcagcccggccccgccaagccccccacccagcaggtgggcacccccaagcccctggcccagcagcccggcctgcagagccccgccaaggcccccggccccaccaagacccccgtgcagcccaagccccccagccagcagcccggcagcaccaagccccccccccagcagcccggccccgccaagcccagcccccagcagcccggcagcaccaagccccccagccagcagcccggcagcgccaagcccagcgcccagcagcccagccccgccaagcccagcgcccagcagagcaccaagcccgtgagccagaccggcagcggcaagcccctgcagccccccaccgtgagccccagcgccaagcagccccccagccagggcctgcccaagaccatctgccccctgtgcaacaccaccgagctgctgctgcacgtgcccgagaaggccaacttcaacacctgcaccgagtgccagaccaccgtgtgcagcctgtgcggcttcaaccccaacccccacctgaccgaggtgaaggagtggctgtgcctgaactgccagatgaagagagccctgggcggcgacctggcccccgtgcccagcagcccccagcccaagctgaagaccgcccccgtgaccaccaccagcgccgtgagcaagagcagcccccagccccagcagaccagccccaagaaggacgccgcccccaagcaggacctgagcaaggcccccgagcccaagaagcccccccccctggtgaagcagcccaccctgcacggcagccccagcgccaaggccaagcagccccccgaggccgacagcctgagcaagcccgccccccccaaggagcccagcgtgcccagcgagcaggacaaggcccccgtggccgacgacaagcccaagcagcccaagatggtgaagcccaccaccgacctggtgagcagcagcagcgccaccaccaagcccgacatccccagcagcaaggtgcagagccaggccgaggagaagaccaccccccccctgaagaccgacagcgccaagcccagccagagcttcccccccaccggcgagaaggtgagccccttcgacagcaaggccatccccagacccgccagcgacagcaagatcatcagccaccccggccccagcagcgagagcaagggccagaagcaggtggaccccgtgcagaagaaggaggagcccaagaaggcccagaccaagatgagccccaagcccgacgccaagcccatgcccaagggcagccccaccccccccggccccagacccaccgccggccagaccgtgcccaccccccagcagagccccaagccccaggagcagagcagaagattcagcctgaacctgggcagcatcaccgacgcccccaagagccagcccaccaccccccaggagaccgtgaccggcaagctgttcggcttcggcgccagcatcttcagccaggccagcaacctgatcagcaccgccggccagcccggcccccacagccagagcggccccggcgcccccatgaagcaggcccccgcccccagccagccccccaccagccagggcccccccaagagcaccggccaggccccccccgcccccgccaagagcatccccgtgaagaaggagaccaaggcccccgccgccgagaagctggagcccaaggccgagcaggcccccaccgtgaagagaaccgagaccgagaagaagcccccccccatcaaggacagcaagagcctgaccgccgagccccagaaggccgtgctgcccaccaagctggagaagagccccaagcccgagagcacctgccccctgtgcaagaccgagctgaacatcggcagcaaggacccccccaacttcaacacctgcaccgagtgcaagaaccaggtgtgcaacctgtgcggcttcaaccccaccccccacctgaccgagaactgccagacccagagagccatcagcggccagctgggcgacatcagaaagatgccccccgcccccagcggccccaaggccagccccatgcccgtgcccaccgagagcagcagccagaagaccgccgtgcccccccaggtgaagctggtgaagaagcaggagcaggaggtgaagaccgaggccgagaaggtgatcctggagaaggtgaaggagaccctgagcatggagaagatcccccccatggtgaccaccgaccagaagcaggaggagagcaagctggagaaggacaaggccagcgccctgcaggagaagaagcccctgcccgaggagaagaagctgatccccgaggaggagaagatcagaagcgaggagaagaagcccctgctggaggagaagaagcccacccccgaggacaagaagctgctgcccgaggccaagaccagcgcccccgaggagcagaagcacgacctgctgaagagccaggtgcagatcgccgaggagaagctggagggcagagtggcccccaagaccgtgcaggagggcaagcagccccagaccaagatggagggcctgcccagcggcaccccccagagcctgcccaaggaggacgacaagaccaccaagaccatcaaggagcagccccagcccccctgcaccgccaagcccgaccaggagaaggaggacgacaagagcgacaccagcagcagccagcagcccaagagcccccagggcctgagcgacaccggctacagcagcgacggcatcagcagcagcctgggcgagatccccagcctgatccccaccgacgagaaggacatcctgaagggcctgaagaaggacagcttcagccaggagagcagccccagcagccccagcgacctggccaagctggagagcaccgtgctgagcatcctggaggcccaggccagcaccctggccgacgagaagagcgagaagaagacccagccccacgaggtgagccccgagcagcccaaggaccaggagaagacccagagcctgagcgagaccctggagatcaccatcagcgaggaggagatcaaggagagccaggaggagagaaaggacaccttcaagaaggacagccagcaggacatccccagcagcaaggaccacaaggagaagagcgagttcgtggacgacatcaccaccagaagagagccctacgacagcgtggaggagagcagcgagagcgagaacagccccgtgccccagagaaagagaagaaccagcgtgggcagcagcagcagcgacgagtacaagcaggaggacagccagggcagcggcgaggaggaggacttcatcagaaagcagatcatcgagatgagcgccgacgaggacgccagcggcagcgaggacgacgagttcatcagaaaccagctgaaggagatcagcagcagcaccgagagccagaagaaggaggagaccaagggcaagggcaagatcaccgccggcaagcacagaagactgaccagaaagagcagcaccagcatcgacgaggacgccggcagaagacacagctggcacgacgaggacgacgaggccttcgacgagagccccgagctgaagtacagagagaccaagagccaggagagcgaggagctggtggtgaccggcggcggcggcctgagaagattcaagaccatcgagctgaacagcaccatcgccgacaagtacagcgccgagagcagccagaagaagaccagcctgtacttcgacgaggagcccgagctggagatggagagcctgaccgacagccccgaggacagaagcagaggcgagggcagcagcagcctgcacgccagcagcttcacccccggcaccagccccaccagcgtgagcagcctggacgaggacagcgacagcagccccagccacaagaagggcgagagcaagcagcagagaaaggccagacacagaccccacggccccctgctgcccaccatcgaggacagcagcgaggaggaggagctgagagaggaggaggagctgctgaaggagcaggagaagcagagagagatcgagcagcagcagagaaagagcagcagcaagaagagcaagaaggacaaggacgagctgagagcccagagaagaagagagagacccaagaccccccccagcaacctgagccccatcgaggacgccagccccaccgaggagctgagacaggccgccgagatggaggagctgcacagaagcagctgcagcgagtacagccccagcatcgagagcgaccccgagggcttcgagatcagccccgagaagatcatcgaggtgcagaaggtgtacaagctgcccaccgccgtgagcctgtacagccccaccgacgagcagagcatcatgcagaaggagggcagccagaaggccctgaagagcgccgaggagatgtacgaggagatgatgcacaagacccacaagtacaaggccttccccgccgccaacgagagagacgaggtgttcgagaaggagcccctgtacggcggcatgctgatcgaggactacatctacgagagcctggtggaggacacctacaacggcagcgtggacggcagcctgctgaccagacaggaggaggagaacggcttcatgcagcagaagggcagagagcagaagatcagactgagcgagcagatctacgaggaccccatgcagaagatcaccgacctgcagaaggagttctacgagctggagagcctgcacagcgtggtgccccaggaggacatcgtgagcagcagcttcatcatccccgagagccacgagatcgtggacctgggcaccatggtgaccagcaccgaggaggagagaaagctgctggacgccgacgccgcctacgaggagctgatgaagagacagcagatgcagctgacccccggcagcagccccacccaggcccccatcggcgaggacatgaccgagagcaccatggacttcgacagaatgcccgacgccagcctgaccagcagcgtgctgagcggcgccagcctgaccgacagcaccagcagcgccaccctgagcatccccgacgtgaagatcacccagcacttcagcaccgaggagatcgaggacgagtacgtgaccgactacaccagagagatccaggagatcatcgcccacgagagcctgatcctgacctacagcgagcccagcgagagcgccaccagcgtgccccccagcgacacccccagcctgaccagcagcgtgagcagcgtgtgcaccaccgacagcagcagccccatcaccaccctggacagcatcaccaccgtgtacaccgagcccgtggacatgatcaccaagttcgaggacagcgaggagatcagcagcagcacctacttccccggcagcatcatcgactaccccgaggagatcagcgtgagcctggacagaaccgccccccccgacggcagagccagcgccgaccacatcgtgatcagcctgagcgacatggccagcagcatcatcgagagcgtggtgcccaagcccgagggccccgtggccgacaccgtgagcaccgacctgctgatcagcgagaaggaccccgtgaagaaggccaagaaggagaccggcaacggcatcatcctggaggtgctggaggcctacagagacaagaaggagctggaggccgagagaaccaagagcagcctgagcgagaccgtgttcgaccacccccccagcagcgtgatcgccctgcccatgaaggagcagctgagcaccacctacttcaccagcggcgagaccttcggccaggagaagcccgccagccagctgcccagcggcagccccagcgtgagcagcctgcccgccaagcccagacccttcttcagaagcagcagcctggacatcagcgcccagccccccccccccccccccccccccccccccccccccccccccccccccccccccccccccccccccctgcccccccccaccagccccaagcccaccatcctgcccaagaagaagctgaccgtggccagccccgtgaccaccgccacccccctgttcgacgccgtgaccaccctggagaccaccgccgtgctgagaagcaacggcctgcccgtgaccagaatctgcaccaccgcccccccccccgtgccccccaagcccagcagcatccccagcggcctggtgttcacccacagacccgagcccagcaagccccccatcgcccccaagcccgtgatcccccagctgcccaccaccacccagaagcccaccgacatccaccccaagcccaccggcctgagcctgaccagcagcatgaccctgaacctggtgaccagcgccgactacaagctgcccagccccaccagccccctgagcccccacagcaacaagagcagccccagattcagcaagagcctgaccgagacctacgtggtgatcaccctgcccagcgagcccggcacccccaccgacagcagcgccagccaggccatcaccagctggcccctgggcagccccagcaaggacctggtgagcgtggagcccgtgttcagcgtggtgccccccgtgaccgccgtggagatccccatcagcagcgagcagaccttctacatcagcggcgccctgcagaccttcagcgccacccccgtgaccgcccccagcagcttccaggccgcccccaccagcgtgacccagttcctgaccaccgaggtgagcaagaccgaggtgagcgccaccagaagcaccgcccccagcgtgggcctgagcagcatcagcatcaccatcccccccgagcccctggccctggacaacatccacctggagaagccccagtacaaggaggacggcaagctgcagctggtgggcgacgtgatcgacctgagaaccgtgcccaaggtggaggtgaagaccaccgacaagtgcatcgacctgagcgccagcaccatggacgtgaagagacagatcaccgccaacgaggtgtacggcaagcagatcagcgccgtgcagcccagcatcatcaacctgagcgtgaccagcagcatcgtgacccccgtgagcctggccaccgagaccgtgaccttcgtgacctgcaccgccagcgccagctacaccaccggcaccgagagcctggtgggcgccgagcacgccatgaccacccccctgcagctgaccaccagcaagcacgccgagcccccctacagaatccccagcgaccaggtgttccccatcgccagagaggaggcccccatcaacctgagcctgggcacccccgcccacgccgtgaccctggccatcaccaagcccgtgaccgtgccccccgtgggcgtgaccaacggctggaccgacagcaccgtgagccagggcatcaccgacggcgaggtggtggacctgagcaccaccaagagccacagaaccgtggtgaccatggacgagagcaccagcagcgtgatgaccaagatcatcgaggacgagaagcccgtggacctgaccgccggcagaagagccgtgtgctgcgacgtggtgtacaagctgcccttcggcagaagctgcaccgcccagcagcccgccaccaccctgcccgaggacagattcggctacagagacgaccactaccagtacgacagaagcggcccctacggctacagaggcatcggcggcatgaagcccagcatgagcgacaccaacctggccgaggccggccacttcttctacaagagcaagaacgccttcgactacagcgagggcaccgacaccgccgtggacctgaccagcggcagagtgaccaccggcgaggtgatggactacagcagcaagaccaccggcccctaccccgagaccagacaggtgatcagcggcgccggcatcagcaccccccagtacagcaccgccagaatgacccccccccccggcccccagtactgcgtgggcagcgtgctgagaagcagcaacggcgtggtgtacagcagcgtggccacccccacccccagcaccttcgccatcaccacccagcccggcagcatcttcagcaccaccgtgagagacctgagcggcatccacaccgccgacgccgtgaccagcctgcccgccatgcaccacagccagcccatgcccagaagctacttcatcaccaccggcgccagcgagaccgacatcgccgtgaccggcatcgacatcagcgccagcctgcagaccatcaccatggagagcctgaccgccgagaccatcgacagcgtgcccaccctgaccaccgccagcgaggtgttccccgaggtggtgggcgacgagagcgccctgctgatcgtgcccgaggaggacaagcagcagcagcagctggacctggagagagagctgctggagctggagaagatcaagcagcagagattcgccgaggagctggagtgggagagacaggagatccagagattcagagagcaggagaagatcatggtgcagaagaagctggaggagctgcagagcatgaagcagcacctgctgttccagcaggaggaggagagacaggcccagttcatgatgagacaggagaccctggcccagcagcagctgcagctggagcagatccagcagctgcagcagcagctgcaccagcagctggaggagcagaagatcagacagatctaccagtacaactacgaccccagcggcaccgccagcccccagaccaccaccgagcaggccatcctggagggccagtacgccgccctggagggcagccagttctgggccaccgaggacgccaccaccaccgccagcgccgtggtggccatcgagatcccccagagccagggctggtacaccgtgcagagcgacggcgtgacccagtacatcgccccccccggcatcctgagcaccgtgagcgagatccccctgaccgacgtggtggtgaaggaggagaagcagcccaagaagagaagcagcggcgccaaggtgagaggccagtacgacgacatgggcgagaacatgaccgacgaccccagaagcttcaagaagatcgtggacagcggcgtgcagaccgacgacgaggacgccaccgacagaagctacgtgagcagaagaagaagaaccaagaagagcgtggacaccagcgtgcagaccgacgacgaggaccaggacgagtgggacatgcccaccagaagcagaagaaaggccagagtgggcaagtacggcgacagcatgaccgaggccgacaagaccaagcccctgagcaaggtgagcagcatcgccgtgcagaccgtggccgagatcagcgtgcagaccgagcccgtgggcaccatcagaacccccagcatcagagccagagtggacgccaaggtggagatcatcaagcacatcagcgcccccgagaagacctacaagggcggcagcctgggctgccagaccgaggccgacagcgacacccagagcccccagtacctgagcgccaccagcccccccaaggacaagaagagacccacccccctggagatcggctacagcagccacctgagagccgacagcaccgtgcagctggcccccagcccccccaagagccccaaggtgctgtacagccccatcagccccctgagccccggcaaggccctggagagcgccttcgtgccctacgagaagcccctgcccgacgacatcagcccccagaaggtgctgcaccccgacatggccaaggtgccccccgccagccccaagaccgccaagatgatgcagagaagcatgagcgaccccaagcccctgagccccaccgccgacgagagcagcagagcccccttccagtacaccgagggctacacctag

SEQ ID NO: 93463 - DNA, 1635 bp, Artificial Sequence
  Description of Artificial Sequence: Synthetic coding sequence
atggagaagctgcaggagcacctgatcaaggccaaggccttcaccatcaagaagaccctggagatctacgtgcccatcaagcagttcttctacaacctgatccaccccgagtacagcgccgtgaccgacgtgtacgtgctgatgttcctggccgacaccgtggacttcatcatcatcgtgttcggcttctgggccttcggcaagcacagcgccgccgccgacatcaccagcagcctgagcgaggaccaggtgcccggccccttcctggtgatggtgctgatccagttcggcaccatggtggtggacagagccctgtacctgagaaagaccgtgctgggcaaggtgatcttccaggtgatcctggtgttcggcatccacttctggatgttcttcatcctgcccggcgtgaccgagagaaagttcagccagaacctggtggcccagctgtggtacttcgtgaagtgcgtgtacttcggcctgagcgcctaccagatcagatgcggctaccccaccagagtgctgggcaacttcctgaccaagagctacaactacgtgaacctgttcctgttccagggcttcagactggtgcccttcctgaccgagctgagagccgtgatggactgggtgtggaccgacaccaccctgagcctgagcagctggatctgcgtggaggacatctacgcccacatcttcatcctgaagtgctggagagagagcgagaagcccatcttcaccatgagcgcccagcagagccagctgaaggtgatggaccagcagagcttcaacaagttcatccaggccttcagcagagacaccggcgccatgcagttcctggagaactacgagaaggaggacatcaccgtggccgagctggagggcaacagcaacagcctgtggaccatcagcccccccagcaagcagaagatgatccacgagctgctggaccccaacagcagcttcagcgtggtgttcagctggagcatccagagaaacctgagcctgggcgccaagagcgagatcgccaccgacaagctgagcttccccctgaagaacatcaccagaaagaacatcgccaagatgatcgccggcaacagcaccgagagcagcaagacccccgtgaccatcgagaagatctacccctactacgtgaaggcccccagcgacagcaacagcaagcccatcaagcagctgctgagcgagaacaacttcatggacatcaccatcatcctgagcagagacaacaccaccaagtacaacagcgagtggtgggtgctgaacctgaccggcaacagaatctacaaccccaacagccaggccctggagctggtggtgttcaacgacaaggtgagcccccccagcctgggcttcctggccggctacggcatcatgggcctgtacgccagcgtggtgctggtgatcggcaagttcgtgagagagttcttcagcggcatcagccacagcatcatgttcgaggagctgcccaacgtggacagaatcctgaagctgtgcaccgacatcttcctggtgagagagaccggcgagctggagctggaggaggacctgtacgccaagctgatcttcctgtacagaagccccgagaccatgatcaagtggaccagagagaagaccaactag

SEQ ID NO: 93464 - DNA, 8259 bp, Artificial Sequence
  Description of Artificial Sequence: Synthetic coding sequence
atggccagcgaggtggtgtgcggcctgatcttcagactgctgctgcccatctgcctggccgtggcctgcgccttcagatacaacggcctgagcttcgtgtacctgatctacctgctgctgatccccctgttcagcgagcccaccaagaccaccatgcagggccacaccggcagactgctgaagagcctgtgcttcatcagcctgagcttcctgctgctgcacatcatcttccacatcaccctggtgagcctggaggcccagcacagaatcgcccccggctacaactgcagcacctgggagaagaccttcagacagatcggcttcgagagcctgaagggcgccgacgccggcaacggcatcagagtgttcgtgcccgacatcggcatgttcatcgccagcctgaccatctggctgctgtgcagaaacatcgtgcagaagcccgtgaccgacgaggccgcccagagcaaccccgagttcgagaacgaggagctggccgagggcgagaagatcgacagcgaggaggccctgatctacgaggaggacttcaacggcggcgacggcgtggagggcgagctggaggagagcaccaagctgaagatgttcagaagactggccagcgtggccagcaagctgaaggagttcatcggcaacatgatcaccaccgccggcaaggtggtggtgaccatcctgctgggcagcagcggcatgatgctgcccagcctgaccagcagcgtgtacttcttcgtgttcctgggcctgtgcacctggtggagctggtgcagaaccttcgaccccctgctgttcagctgcctgtgcgtgctgctggccatcttcaccgccggccacctgatcggcctgtacctgtaccagttccagttcttccaggaggccgtgccccccaacgactactacgccagactgttcggcatcaagagcgtgatccagaccgactgcagcagcacctggaagatcatcgtgaaccccgacctgagctggtaccaccacgccaaccccatcctgctgctggtgatgtactacaccctggccaccctgatcagaatctggctgcaggagcccctggtgcaggacgagggcaccaaggaggaggacaaggccctggcctgcagccccatccagatcaccgccggcagaagaagaagcctgtggtacgccacccactaccccaccgacgagagaaagctgctgagcatgacccaggacgactacaagcccagcgacggcctgctggtgaccgtgaacggcaaccccgtggactaccacaccatccaccccagcctgcccatggagaacggccccggcaaggccgacctgtacagcaccccccagtacagatgggagcccagcgacgagagcagcgagaagagagaggaggaggaggaggagaaggaggagttcgaggaggagagaagcagagaggagaagagaagcatcaaggtgcacgccatggtgagcgtgttccagttcatcatgaagcagagctacatctgcgccctgatcgccatgatggcctggagcatcacctaccacagctggctgaccttcgtgctgctgatctggagctgcaccctgtggatgatcagaaacagaagaaagtacgccatgatcagcagccccttcatggtggtgtacggcaacctgctgctgatcctgcagtacatctggagcttcgagctgcccgagatcaagaaggtgcccggcttcctggagaagaaggagcccggcgagctggccagcaagatcctgttcaccatcaccttctggctgctgctgagacagcacctgaccgagcagaaggccctgcaggagaaggaggccctgctgagcgaggtgaagatcggcagccaggagaacgaggagaaggacgaggagctgcaggacatccaggtggagggcgagcccaaggaggaggaggaggaggaggccaaggaggagaagcaggagagaaagaaggtggagcaggaggaggccgaggaggaggacgagcaggacatcatgaaggtgctgggcaacctggtggtggccatgttcatcaagtactggatctacgtgtgcggcggcatgttcttcttcgtgagcttcgagggcaagatcgtgatgtacaagatcatctacatggtgctgttcctgttctgcgtggccctgtaccaggtgcactacgagtggtggagaaagatcctgaagtacttctggatgagcgtggtgatctacaccatgctggtgctgatcttcatctacacctaccagttcgagaacttccccggcctgtggcagaacatgaccggcctgaagaaggagaagctggaggacctgggcctgaagcagttcaccgtggccgagctgttcaccagaatcttcatccccaccagcttcctgctggtgtgcatcctgcacctgcactacttccacgacagattcctggagctgaccgacctgaagagcatccccagcaaggaggacaacaccatctacagactggcccaccccgagggcagcctgcccgacctgaccatgatgcacctgaccgccagcctggagaagcccgaggtgagaaagctggccgagcccggcgaggagaagctggagggctacagcgagaaggcccagaagggcgacctgggcaaggacagcgaggagagcgaggaggacggcgaggaggaggaggagagcgaggaggaggaggagaccagcgacctgagaaacaagtggcacctggtgatcgacagactgaccgtgctgttcctgaagttcctggagtacttccacaagctgcaggtgttcatgtggtggatcctggagctgcacatcatcaagatcgtgagcagctacatcatctgggtgagcgtgaaggaggtgagcctgttcaactacgtgttcctgatcagctgggccttcgccctgccctacgccaagctgagaagactggccagcagcgtgtgcaccgtgtggacctgcgtgatcatcgtgtgcaagatgctgtaccagctgcagaccatcaagcccgagaacttcagcgtgaactgcagcctgcccaacgagaaccagaccaacatccccttcaacgagctgaacaagagcctgctgtacagcgcccccatcgaccccaccgagtgggtgggcctgagaaagagcagccccctgctggtgtacctgagaaacaacctgctgatgctggccatcctggccttcgaggtgaccatctacagacaccaggagtactacagaggcagaaacaacctgaccgcccccgtgagcagaaccatcttccacgacatcaccagactgcacctggacgacggcctgatcaactgcgccaagtacttcatcaactacttcttctacaagttcggcctggagacctgcttcctgatgagcgtgaacgtgatcggccagagaatggacttctacgccatgatccacgcctgctggctgatcgccgtgctgtacagaagaagaagaaaggccatcgccgagatctggcccaagtactgctgcttcctggcctgcatcatcaccttccagtacttcatctgcatcggcatcccccccgccccctgcagagactacccctggagattcaagggcgccagcttcaacgacaacatcatcaagtggctgtacttccccgacttcatcgtgagacccaaccccgtgttcctggtgtacgacttcatgctgctgctgtgcgccagcctgcagagacagatcttcgaggacgagaacaaggccgccgtgagaatcatggccggcgacaacgtggagatctgcatgaacctggacgccgccagcttcagccagcacaaccccgtgcccgacttcatccactgcagaagctacctggacatgagcaaggtgatcatcttcagctacctgttctggttcgtgctgaccatcatcttcatcaccggcaccaccagaatcagcatcttctgcatgggctacctggtggcctgcttctacttcctgctgttcggcggcgacctgctgctgaagcccatcaagagcatcctgagatactgggactggctgatcgcctacaacgtgttcgtgatcaccatgaagaacatcctgagcatcggcgcctgcggctacatcggcaccctggtgcacaacagctgctggctgatccaggccttcagcctggcctgcaccgtgaagggctaccagatgcccgccgccaacagcccctgcaccctgcccagcggcgaggccggcatcatctgggacagcatctgcttcgccttcctgctgctgcagagaagagtgttcatgagctactacttcctgcacgtggtggccgacatcaaggccagccagatcctggccagcagaggcgccgagctgttccaggccaccatcgtgaaggccgtgaaggccagaatcgaggaggagaagaagagcatggaccagctgaagagacagatggacagaatcaaggccagacagcagaagtacaagaagggcaaggagagaatgctgagcctgacccaggagcccggcgagggccaggacatgcagaagctgagcgaggaggacgacgagagagaggccgacaagcagaaggccaagggcaagaagaagcagtggtggagaccctgggtggaccacgccagcatggtgagaagcggcgactactacctgttcgagaccgacagcgaggaggaggaggaggaggagctgaagaaggaggacgaggagccccccagaagaagcgccttccagttcgtgtaccaggcctggatcaccgaccccaagaccgccctgagacagagacacaaggagaagaagagaagcgccagagaggagagaaagagaagaagaaagggcagcaaggagggccccgtggagtgggaggacagagaggacgagcccatcaagaagaagagcgacggccccgacaacatcatcaagagaatcttcaacatcctgaagttcacctgggtgctgttcctggccaccgtggacagcttcaccacctggctgaacagcatcagcagagagcacatcgacatcagcaccgtgctgagaatcgagagatgcatgctgaccagagagatcaagaagggcaacgtgcccaccagagagagcatccacatgtactaccagaaccacatcatgaacctgagcagagagagcggcctggacaccatcgacgagcaccccggcgccgccagcggcgcccagaccgcccacagaatggacagcctggacagccacgacagcatcagcagcgagcccacccagtgcaccatgctgtacagcagacagggcaccaccgagaccatcgaggaggtggaggccgagcaggaggaggaggccggcagcaccgcccccgagcccagagaggccaaggagtacgaggccaccggctacgacgtgggcgccatgggcgccgaggaggccagcctgacccccgaggaggagctgacccagttcagcaccctggacggcgacgtggaggccccccccagctacagcaaggccgtgagcttcgagcacctgagcttcggcagccaggacgacagcgccggcaagaacagaatggccgtgagccccgacgacagcagaaccgacaagctgggcagcagcatcctgccccccctgacccacgagctgaccgccagcgagctgctgctgaagaagatgttccacgacgacgagctggaggagagcgagaagttctacgtgggccagcccagattcctgctgctgttctacgccatgtacaacaccctggtggccagaagcgagatggtgtgctacttcgtgatcatcctgaaccacatggtgagcgccagcatgatcaccctgctgctgcccatcctgatcttcctgtgggccatgctgagcgtgcccagacccagcagaagattctggatgatggccatcgtgtacaccgaggtggccatcgtggtgaagtacttcttccagttcggcttcttcccctggaacaagaacgtggaggtgaacaaggacaagccctaccacccccccaacatcatcggcgtggagaagaaggagggctacgtgctgtacgacctgatccagctgctggccctgttcttccacagaagcatcctgaagtgccacggcctgtgggacgaggacgacatgaccgagagcggcatggccagagaggagagcgacgacgagctgagcctgggccacggcagaagagacagcagcgacagcctgaagagcatcaacctggccgccagcgtggagagcgtgcacgtgaccttccccgagcagcagaccgccgtgagaagaaagagaagcggcagcagcagcgagcccagccagagaagcagcttcagcagcaacagaagccagagaggcagcaccagcaccagaaacagcagccagaagggcagcagcgtgctgagcatcaagcagaagggcaagagagagctgtacatggagaagctgcaggagcacctgatcaaggccaaggccttcaccatcaagaagaccctggagatctacgtgcccatcaagcagttcttctacaacctgatccaccccgagtacagcgccgtgaccgacgtgtacgtgctgatgttcctggccgacaccgtggacttcatcatcatcgtgttcggcttctgggccttcggcaagcacagcgccgccgccgacatcaccagcagcctgagcgaggaccaggtgcccggccccttcctggtgatggtgctgatccagttcggcaccatggtggtggacagagccctgtacctgagaaagaccgtgctgggcaaggtgatcttccaggtgatcctggtgttcggcatccacttctggatgttcttcatcctgcccggcgtgaccgagagaaagttcagccagaacctggtggcccagctgtggtacttcgtgaagtgcgtgtacttcggcctgagcgcctaccagatcagatgcggctaccccaccagagtgctgggcaacttcctgaccaagagctacaactacgtgaacctgttcctgttccagggcttcagactggtgcccttcctgaccgagctgagagccgtgatggactgggtgtggaccgacaccaccctgagcctgagcagctggatctgcgtggaggacatctacgcccacatcttcatcctgaagtgctggagagagagcgagaagagatacccccagcccagaggccagaagaagaagaaggtggtgaagtacggcatgggcggcatgatcatcgtgctgctgatctgcatcgtgtggttccccctgctgttcatgagcctgatcaagagcgtggccggcgtgatcaaccagcccctggacgtgagcgtgaccatcaccctgggcggctaccagcccatcttcaccatgagcgcccagcagagccagctgaaggtgatggaccagcagagcttcaacaagttcatccaggccttcagcagagacaccggcgccatgcagttcctggagaactacgagaaggaggacatcaccgtggccgagctggagggcaacagcaacagcctgtggaccatcagcccccccagcaagcagaagatgatccacgagctgctggaccccaacagcagcttcagcgtggtgttcagctggagcatccagagaaacctgagcctgggcgccaagagcgagatcgccaccgacaagctgagcttccccctgaagaacatcaccagaaagaacatcgccaagatgatcgccggcaacagcaccgagagcagcaagacccccgtgaccatcgagaagatctacccctactacgtgaaggcccccagcgacagcaacagcaagcccatcaagcagctgctgagcgagaacaacttcatggacatcaccatcatcctgagcagagacaacaccaccaagtacaacagcgagtggtgggtgctgaacctgaccggcaacagaatctacaaccccaacagccaggccctggagctggtggtgttcaacgacaaggtgagcccccccagcctgggcttcctggccggctacggcatcatgggcctgtacgccagcgtggtgctggtgatcggcaagttcgtgagagagttcttcagcggcatcagccacagcatcatgttcgaggagctgcccaacgtggacagaatcctgaagctgtgcaccgacatcttcctggtgagagagaccggcgagctggagctggaggaggacctgtacgccaagctgatcttcctgtacagaagccccgagaccatgatcaagtggaccagagagaagaccaactag

SEQ ID NO: 93465 - DNA, 1692 bp, Artificial Sequence
  Description of Artificial Sequence: Synthetic coding sequence
atgagcgtggtgatctacaccatgctggtgctgatcttcatctacacctaccagttcgagaacttccccggcctgtggcagaacatgaccggcctgaagaaggagaagctggaggacctgggcctgaagcagttcaccgtggccgagctgttcaccagaatcttcatccccaccagcttcctgctggtgtgcatcctgcacctgcactacttccacgacagattcctggagctgaccgacctgaagagcatccccagcaaggaggacaacaccatctacagccacgccaaggtgaacggcagagtgtacctgatcatcaacagcatcaagaagaagctgcccatccaccagaacgagctggcccaccccgagggcagcctgcccgacctgaccatgatgcacctgaccgccagcctggagaagcccgaggtgagaaagctggccgagcccggcgaggagaagctggagggctacagcgagaaggcccagaagggcgacctgggcaaggacagcgaggagagcgaggaggacggcgaggaggaggaggagagcgaggaggaggaggagaccagcgacctgagaaacaagtggcacctggtgatcgacagactgaccgtgctgttcctgaagttcctggagtacttccacaagctgcaggtgttcatgtggtggatcctggagctgcacatcatcaagatcgtgagcagctacatcatctgggtgagcgtgaaggaggtgagcctgttcaactacgtgttcctgatcagctgggccttcgccctgccctacgccaagctgagaagactggccagcagcgtgtgcaccgtgtggacctgcgtgatcatcgtgtgcaagatgctgtaccagctgcagaccatcaagcccgagaacttcagcgtgaactgcagcctgcccaacgagaaccagaccaacatccccttcaacgagctgaacaagagcctgctgtacagcgcccccatcgaccccaccgagtgggtgggcctgagaaagagcagccccctgctggtgtacctgagaaacaacctgctgatgctggccatcctggccttcgaggtgaccatctacagacaccaggagtactacagaggcagaaacaacctgaccgcccccgtgagcagaaccatcttccacgacatcaccagactgcacctggacgacggcctgatcaactgcgccaagtacttcatcaactacttcttctacaagttcggcctggagacctgcttcctgatgagcgtgaacgtgatcggccagagaatggacttctacgccatgatccacgcctgctggctgatcgccgtgctgtacagaagaagaagaaaggccatcgccgagatctggcccaagtactgctgcttcctggcctgcatcatcaccttccagtacttcatctgcatcggcatcccccccgccccctgcagagactacccctggagattcaagggcgccagcttcaacgacaacatcatcaagtggctgtacttccccgacttcatcgtgagacccaaccccgtgttcctggtgtacgacttcatgctgctgctgtgcgccagcctgcagagacagatcttcgaggacgagaacaaggccgccgtgagaatcatggccggcgacaacgtggagatctgcatgaacctggacgccgccagcttcagccagcacaacccctag

SEQ ID NO: 93466 - DNA, 1941 bp, Artificial Sequence
  Description of Artificial Sequence: Synthetic coding sequence
atgaccgagagcggcatggccagagaggagagcgacgacgagctgagcctgggccacggcagaagagacagcagcgacagcctgaagagcatcaacctggccgccagcgtggagagcgtgcacgtgaccttccccgagcagcagaccgccgtgagaagaaagagaagcggcagcagcagcgagcccagccagagaagcagcttcagcagcaacagaagccagagaggcagcaccagcaccagaaacagcagccagaagggcagcagcgtgctgagcatcaagcagaagggcaagagagagctgtacatggagaagctgcaggagcacctgatcaaggccaaggccttcaccatcaagaagaccctggagatctacgtgcccatcaagcagttcttctacaacctgatccaccccgagtacagcgccgtgaccgacgtgtacgtgctgatgttcctggccgacaccgtggacttcatcatcatcgtgttcggcttctgggccttcggcaagcacagcgccgccgccgacatcaccagcagcctgagcgaggaccaggtgcccggccccttcctggtgatggtgctgatccagttcggcaccatggtggtggacagagccctgtacctgagaaagaccgtgctgggcaaggtgatcttccaggtgatcctggtgttcggcatccacttctggatgttcttcatcctgcccggcgtgaccgagagaaagttcagccagaacctggtggcccagctgtggtacttcgtgaagtgcgtgtacttcggcctgagcgcctaccagatcagatgcggctaccccaccagagtgctgggcaacttcctgaccaagagctacaactacgtgaacctgttcctgttccagggcttcagactggtgcccttcctgaccgagctgagagccgtgatggactgggtgtggaccgacaccaccctgagcctgagcagctggatctgcgtggaggacatctacgcccacatcttcatcctgaagtgctggagagagagcgagaagcccatcttcaccatgagcgcccagcagagccagctgaaggtgatggaccagcagagcttcaacaagttcatccaggccttcagcagagacaccggcgccatgcagttcctggagaactacgagaaggaggacatcaccgtggccgagctggagggcaacagcaacagcctgtggaccatcagcccccccagcaagcagaagatgatccacgagctgctggaccccaacagcagcttcagcgtggtgttcagctggagcatccagagaaacctgagcctgggcgccaagagcgagatcgccaccgacaagctgagcttccccctgaagaacatcaccagaaagaacatcgccaagatgatcgccggcaacagcaccgagagcagcaagacccccgtgaccatcgagaagatctacccctactacgtgaaggcccccagcgacagcaacagcaagcccatcaagcagctgctgagcgagaacaacttcatggacatcaccatcatcctgagcagagacaacaccaccaagtacaacagcgagtggtgggtgctgaacctgaccggcaacagaatctacaaccccaacagccaggccctggagctggtggtgttcaacgacaaggtgagcccccccagcctgggcttcctggccggctacggcatcatgggcctgtacgccagcgtggtgctggtgatcggcaagttcgtgagagagttcttcagcggcatcagccacagcatcatgttcgaggagctgcccaacgtggacagaatcctgaagctgtgcaccgacatcttcctggtgagagagaccggcgagctggagctggaggaggacctgtacgccaagctgatcttcctgtacagaagccccgagaccatgatcaagtggaccagagagaagaccaactag

SEQ ID NO: 93467 - DNA, 2130 bp, Artificial Sequence
  Description of Artificial Sequence: Synthetic coding sequence
atgaccgagagcggcatggccagagaggagagcgacgacgagctgagcctgggccacggcagaagagacagcagcgacagcctgaagagcatcaacctggccgccagcgtggagagcgtgcacgtgaccttccccgagcagcagaccgccgtgagaagaaagagaagcggcagcagcagcgagcccagccagagaagcagcttcagcagcaacagaagccagagaggcagcaccagcaccagaaacagcagccagaagggcagcagcgtgctgagcatcaagcagaagggcaagagagagctgtacatggagaagctgcaggagcacctgatcaaggccaaggccttcaccatcaagaagaccctggagatctacgtgcccatcaagcagttcttctacaacctgatccaccccgagtacagcgccgtgaccgacgtgtacgtgctgatgttcctggccgacaccgtggacttcatcatcatcgtgttcggcttctgggccttcggcaagcacagcgccgccgccgacatcaccagcagcctgagcgaggaccaggtgcccggccccttcctggtgatggtgctgatccagttcggcaccatggtggtggacagagccctgtacctgagaaagaccgtgctgggcaaggtgatcttccaggtgatcctggtgttcggcatccacttctggatgttcttcatcctgcccggcgtgaccgagagaaagttcagccagaacctggtggcccagctgtggtacttcgtgaagtgcgtgtacttcggcctgagcgcctaccagatcagatgcggctaccccaccagagtgctgggcaacttcctgaccaagagctacaactacgtgaacctgttcctgttccagggcttcagactggtgcccttcctgaccgagctgagagccgtgatggactgggtgtggaccgacaccaccctgagcctgagcagctggatctgcgtggaggacatctacgcccacatcttcatcctgaagtgctggagagagagcgagaagagatacccccagcccagaggccagaagaagaagaaggtggtgaagtacggcatgggcggcatgatcatcgtgctgctgatctgcatcgtgtggttccccctgctgttcatgagcctgatcaagagcgtggccggcgtgatcaaccagcccctggacgtgagcgtgaccatcaccctgggcggctaccagcccatcttcaccatgagcgcccagcagagccagctgaaggtgatggaccagcagagcttcaacaagttcatccaggccttcagcagagacaccggcgccatgcagttcctggagaactacgagaaggaggacatcaccgtggccgagctggagggcaacagcaacagcctgtggaccatcagcccccccagcaagcagaagatgatccacgagctgctggaccccaacagcagcttcagcgtggtgttcagctggagcatccagagaaacctgagcctgggcgccaagagcgagatcgccaccgacaagctgagcttccccctgaagaacatcaccagaaagaacatcgccaagatgatcgccggcaacagcaccgagagcagcaagacccccgtgaccatcgagaagatctacccctactacgtgaaggcccccagcgacagcaacagcaagcccatcaagcagctgctgagcgagaacaacttcatggacatcaccatcatcctgagcagagacaacaccaccaagtacaacagcgagtggtgggtgctgaacctgaccggcaacagaatctacaaccccaacagccaggccctggagctggtggtgttcaacgacaaggtgagcccccccagcctgggcttcctggccggctacggcatcatgggcctgtacgccagcgtggtgctggtgatcggcaagttcgtgagagagttcttcagcggcatcagccacagcatcatgttcgaggagctgcccaacgtggacagaatcctgaagctgtgcaccgacatcttcctggtgagagagaccggcgagctggagctggaggaggacctgtacgccaagctgatcttcctgtacagaagccccgagaccatgatcaagtggaccagagagaagaccaactag

SEQ ID NO: 93468 - DNA, 2565 bp, Artificial Sequence
  Description of Artificial Sequence: Synthetic coding sequence
atggccctgagactggtggccgacttcgacctgggcaaggacgtgctgccctggctgagagcccagagagccgtgagcgaggccagcggcgccggcagcggcggcgccgacgtgctggagaacgactacgagagcctgcacgtgctgaacgtggagagaaacggcaacatcatctacacctacaaggacgacaagggcaacgtggtgttcggcctgtacgactgccagaccagacagaacgagctgctgtacaccttcgagaaggacctgcaggtgttcagctgcagcgtgaacagcgagagaaccctgctggccgccagcctggtgcagagcaccaaggagggcaagagaaacgagctgcagcccggcagcaagtgcctgaccctgctggtggagatccaccccgtgaacaacgtgaaggtgctgaaggccgtggacagctacatctgggtgcagttcctgtacccccacatcgagagccaccccctgcccgagaaccacctgctgctgatcagcgaggagaagtacatcgagcagttcagaatccacgtggcccaggaggacggcaacagagtggtgatcaagaacagcggccacctgcccagagacagaatcgccgaggacttcgtgtgggcccagtgggacatgagcgagcagagactgtactacatcgacctgaagaagagcagaagcatcctgaagtgcatccagttctacgccgacgagagctacaacctgatgttcgaggtgcccctggacatcagcctgagcaacagcggcttcaagctggtgaacttcggctgcgactaccaccagtacagagacaagttcagcaagcacctgaccctgtgcgtgttcaccaaccacaccggcagcctgtgcgtgtgctacagccccaagtgcgccagctggggccagatcacctacagcgtgttctacatccacaagggccacagcaagaccttcaccaccagcctggagaacgtgggcagccacatgaccaagggcatcaccttcctgaacctggactactacgtggccgtgtacctgcccggccacttcttccacctgctgaacgtgcagcaccccgacctgatctgccacaacctgttcctgaccggcaacaacgagatgatcgacatgctgccccactgccccctgcagagcctgagcggcagcctggtgctggactgctgcagcggcaagctgtacagagccctgctgagccagagcagcctgctgcagctgctgcagaacacctgcctggactgcgagaagatggccgccctgcactgcgccctgtactgcggccagggcgcccagttcctggaggcccagatcatccagtggatcagcgagaacgtgagcgcctgccacagcttcgacctgatccaggagttcatcatcgccagcagctactggagcgtgtacagcgagaccagcaacatggacaagctgctgccccacagcagcgtgctgacctggaacaccgagatccccggcatcaccctggtgaccgaggacatcgccctgcccctgatgaaggtgctgagcttcaagggctactgggagaagctgaacagcaacctggagtacgtgaagtacgccaagccccacttccactacaacaacagcgtggtgagaagagagtggcacaacctgatcagcgaggagaagaccggcaagagaagaagcgccgcctacgtgagaaacatcctggacaacgccgtgaaggtgatcagcaacctggaggccagaaacctgggccccagactgacccccctgctgcaggaggaggacagccaccagagactgctgatgggcctgatggtgagcgagctgaaggaccacttcctgagacacctgcagggcgtggagaagaagaagatcgagcagatggtgctggactacatcagcaagctgctggacctgatctgccacatcgtggagaccaactggagaaagcacaacctgcacagctgggtgctgcacttcaacagcagaggcagcgccgccgagttcgccgtgttccacatcatgaccagaatcctggaggccaccaacagcctgttcctgcccctgccccccggcttccacaccctgcacaccatcctgggcgtgcagtgcctgcccctgcacaacctgctgcactgcatcgacagcggcgtgctgctgctgaccgagaccgccgtgatcagactgatgaaggacctggacaacaccgagaagaacgagaagctgaagttcagcatcatcgtgagactgccccccctgatcggccagaagatctgcagactgtgggaccaccccatgagcagcaacatcatcagcagaaaccacgtgaccagactgctgcagaactacaagaagcagcccagaaacagcatgatcaacaagagcagcttcagcgtggagttcctgcccctgaactacttcatcgagatcctgaccgacatcgagagcagcaaccaggccctgtaccccttcgagggccacgacaacgtggacgccgagttcgtggaggaggccgccctgaagcacaccgccatgctgctgggcctgtag

SEQ ID NO: 93469 - DNA, 528 bp, Artificial Sequence
  Description of Artificial Sequence: Synthetic coding sequence
atgaccagaatcctggaggccaccaacagcctgttcctgcccctgccccccggcttccacaccctgcacaccatcctgggcgtgcagtgcctgcccctgcacaacctgctgcactgcatcgacagcggcgtgctgctgctgaccgagaccgccgtgatcagactgatgaaggacctggacaacaccgagaagaacgagaagctgaagttcagcatcatcgtgagactgccccccctgatcggccagaagatctgcagactgtgggaccaccccatgagcagcaacatcatcagcagaaaccacgtgaccagactgctgcagaactacaagaagcagcccagaaacagcatgatcaacaagagcagcttcagcgtggagttcctgcccctgaactacttcatcgagatcctgaccgacatcgagagcagcaaccaggccctgtaccccttcgagggccacgacaacgtggacgccgagttcgtggaggaggccgccctgaagcacaccgccatgctgctgggcctgtag

SEQ ID NO: 93470 - DNA, 873 bp, Artificial Sequence
  Description of Artificial Sequence: Synthetic coding sequence
atggccaaccccaagctgctgggcatgggcctgagcgaggccgaggccatcggcgccgacagcgccagattcgaggagctgctgctgcaggccagcaaggagctgcagcaggcccagaccaccagacccgagagcacccagatccagccccagcccggcttctgcatcaagaccaacagcagcgagggcaaggtgttcatcaacatctgccacagccccagcatccccccccccgccgacgtgaccgaggaggagctgctgcagatgctggaggaggaccaggccggcttcagaatccccatgagcctgggcgagccccacgccgagctggacgccaagggccagggctgcaccgcctacgacgtggccgtgaacagcgacttctacagaagaatgcagaacagcgacttcctgagagagctggtgatcaccatcgccagagagggcctggaggacaagtacaacctgcagctgaaccccgagtggagaatgatgaagaacagacccttcatgggcagcatcagccagcagaacatcagaagcgagcagagacccagaatccaggagctgggcgacctgtacacccccgcccccggcagagccgagagcggccccgagaagccccacctgaacctgtggctggaggcccccgacctgctgctggccgaggtggacctgcccaagctggacggcgccctgggcctgagcctggagatcggcgagaacagactggtgatgggcggcccccagcagctgtaccacctggacgcctacatccccctgcagatcaacagccacgagagcaaggccgccttccacagaaagagaaagcagctgatggtggccatgcccctgctgcccgtgcccagctag

SEQ ID NO: 93471 - DNA, 942 bp, Artificial Sequence
  Description of Artificial Sequence: Synthetic coding sequence
atgctgctgagcaagatcaacagcctggcccacctgagagccgccccctgcaacgacctgcacgccaccaagctggcccccggcaaggagaaggagcccctggagagccagtaccaggtgggccccctgctgggcagcggcggcttcggcagcgtgtacagcggcatcagagtgagcgacaacctgcccgtggccatcaagcacgtggagaaggacagaatcagcgactggggcgagctgcccaacggcaccagagtgcccatggaggtggtgctgctgaagaaggtgagcagcggcttcagcggcgtgatcagactgctggactggttcgagagacccgacagcttcgtgctgatcctggagagacccgagcccgtgcaggacctgttcgacttcatcaccgagagaggcgccctgcaggaggagctggccagaagcttcttctggcaggtgctggaggccgtgagacactgccacaactgcggcgtgctgcacagagacatcaaggacgagaacatcctgatcgacctgaacagaggcgagctgaagctgatcgacttcggcagcggcgccctgctgaaggacaccgtgtacaccgacttcgacggcaccagagtgtacagcccccccgagtggatcagataccacagataccacggcagaagcgccgccgtgtggagcctgggcatcctgctgtacgacatggtgtgcggcgacatccccttcgagcacgacgaggagatcatcagaggccaggtgttcttcagacagagagtgagcagcgagtgccagcacctgatcagatggtgcctggccctgagacccagcgacagacccaccttcgaggagatccagaaccacccctggatgcaggacgtgctgctgccccaggagaccgccgagatccacctgcacagcctgagccccggccccagcaagtag

SEQ ID NO: 93472 - DNA, 936 bp, Artificial Sequence
  Description of Artificial Sequence: Synthetic coding sequence
atgctgaccaagcccctgcagggcccccccgccccccccggcacccccacccccccccccggcggcaaggacagagaggccttcgaggccgagtacagactgggccccctgctgggcaagggcggcttcggcaccgtgttcgccggccacagactgaccgacagactgcaggtggccatcaaggtgatccccagaaacagagtgctgggctggagccccctgagcgacagcgtgacctgccccctggaggtggccctgctgtggaaggtgggcgccggcggcggccaccccggcgtgatcagactgctggactggttcgagacccaggagggcttcatgctggtgctggagagacccctgcccgcccaggacctgttcgactacatcaccgagaagggccccctgggcgagggccccagcagatgcttcttcggccaggtggtggccgccatccagcactgccacagcagaggcgtggtgcacagagacatcaaggacgagaacatcctgatcgacctgagaagaggctgcgccaagctgatcgacttcggcagcggcgccctgctgcacgacgagccctacaccgacttcgacggcaccagagtgtacagcccccccgagtggatcagcagacaccagtaccacgccctgcccgccaccgtgtggagcctgggcatcctgctgtacgacatggtgtgcggcgacatccccttcgagagagaccaggagatcctggaggccgagctgcacttccccgcccacgtgagccccgactgctgcgccctgatcagaagatgcctggcccccaagcccagcagcagacccagcctggaggagatcctgctggacccctggatgcagacccccgccgaggacgtgcccctgaaccccagcaagggcggccccgcccccctggcctggagcctgctgccctag

SEQ ID NO: 93473 - DNA, 438 bp, Artificial Sequence
  Description of Artificial Sequence: Synthetic coding sequence
atgctggtgctggagagacccctgcccgcccaggacctgttcgactacatcaccgagaagggccccctgggcgagggccccagcagatgcttcttcggccaggtggtggccgccatccagcactgccacagcagaggcgtggtgcacagagacatcaaggacgagaacatcctgatcgacctgagaagaggctgcgccaagctgatcgacttcggcagcggcgccctgctgcacgacgagccctacaccgacttcgacggcaccagagtgtacagcccccccgagtggatcagcagacaccagtaccacgccctgcccgccaccgtgtggagcctgggcatcctgctgtacgacatggtgtgcggcgacatccccttcgagagagaccaggagatcctggaggccgagctgcacttccccgcccacgtgagcccctag

SEQ ID NO: 93474 - DNA, 2925 bp, Artificial Sequence
  Description of Artificial Sequence: Synthetic coding sequence
atggccaaggccggcagagccggcggccccccccccggcggcggcgccccctggcacctgagaaacgtgctgagcgacagcgtggagagcagcgacgacgagttcttcgacgccagagaggagatggccgagggcaagaacgccatcctgatcggcatgagccagtggaacagcaacgacctggtggagcagatcgagaccatgggcaagctggacgagcaccagggcgagggcaccgccccctgcaccagcagcatcctgcaggagaagcagagagagctgtacagagtgagcctgagaagacagagattccccgcccagggcagcatcgagatccacgaggacagcgaggagggctgcccccagagaagctgcaagacccacgtgctgctgctggtgctgcacggcggcaacatcctggacaccggcgccggcgaccccagctgcaaggccgccgacatccacaccttcagcagcgtgctggagaaggtgaccagagcccacttccccgccgccctgggccacatcctgatcaagttcgtgccctgccccgccatctgcagcgaggccttcagcctggtgagccacctgaacccctacagccacgacgagggctgcctgagcagcagccaggaccacgtgcccctggccgccctgcccctgctggccatcagcagcccccagtaccaggacgccgtggccaccgtgatcgagagagccaaccaggtgtacagagagttcctgaagagcagcgacggcatcggcttcagcggccaggtgtgcctgatcggcgactgcgtgggcggcctgctggccttcgacgccatctgctacagcgccggccccagcggcgacagccccgccagcagcagcagaaagggcagcatcagcagcacccaggacacccccgtggccgtggaggaggactgcagcctggccagcagcaagagactgagcaagagcaacatcgacatcagcagcggcctggaggacgaggagcccaagagacccctgcccagaaagcagagcgacagcagcacctacgactgcgaggccatcacccagcaccacgccttcctgagcagcatccacagcagcgtgctgaaggacgagagcgagacccccgccgccggcggcccccagctgcccgaggtgagcctgggcagattcgacttcgacgtgagcgacttcttcctgttcggcagccccctgggcctggtgctggccatgagaagaaccgtgctgcccggcctggacggcttccaggtgagacccgcctgcagccaggtgtacagcttcttccactgcgccgaccccagcgccagcagactggagcccctgctggagcccaagttccacctggtgccccccgtgagcgtgcccagataccagagattccccctgggcgacggccagagcctgctgctggccgacgccctgcacacccacagccccctgttcctggagggcagcagcagagacagcccccccctgctggacgcccccgccagccccccccaggccagcagattccagagacccggcagaagaatgagcgagggcagcagccacagcgagagcagcgagagcagcgacagcatggcccccgtgggcgccagcagaatcaccgccaagtggtggggcagcaagagaatcgactacgccctgtactgccccgacgtgctgaccgccttccccaccgtggccctgccccacctgttccacgccagctactgggagagcaccgacgtggtggccttcatcctgagacaggtgatgagatacgagagcgtgaacatcaaggagagcgccagactggaccccgccgccctgagccccgccaaccccagagagaagtggctgagaaagagaacccaggtgaagctgagaaacgtgaccgccaaccacagagccaacgacgtgatcgccgccgaggacggcccccaggtgctggtgggcagattcatgtacggccccctggacatggtggccctgaccggcgagaaggtggacatcctggtgatggccgagcccagcagcggcagatgggtgcacctggacaccgagatcaccaacagcagcggcagaatcacctacaacgtgcccagacccagaagactgggcgtgggcgtgtaccccgtgaagatggtggtgagaggcgaccagacctgcgccatgagctacctgaccgtgctgcccagaggcatggagtgcgtggtgttcagcatcgacggcagcttcgccgccagcgtgagcatcatgggcagcgaccccaaggtgagacccggcgccgtggacgtggtgagacactggcaggacctgggctacatgatcctgtacatcaccggcagacccgacatgcagaagcagagagtggtgagctggctgagccagcacaacttcccccagggcatgatcttcttcagcgacggcctggtgcacgaccccctgagacagaaggccatcttcctgagaaacctgatgcaggagtgcttcatcaagatcagcgccgcctacggcagcaccaaggacatcagcgtgtacagcgtgctgggcctgcccgccagccagatcttcatcgtgggcagacccaccaagaagtaccagacccagtgccagttcctgagcgagggctacgccgcccacctggccgccctggaggccagccacagaagcagacccaagaagaacaacagcagaatgatcctgagaaagggcagcttcggcctgcacgcccagcccgagttcctgagaaagagaaaccacctgagaagaaccatgagcgtgcagcagcccgacccccccgccgccaaccccaagcccgagagagcccagagccagcccgagagcgacaaggaccacgagagacccctgcccgccctgagctgggccagaggcccccccaagttcgagagcgtgccctag

SEQ ID NO: 93475 - DNA, 2817 bp, Artificial Sequence
  Description of Artificial Sequence: Synthetic coding sequence
atggccaaggccggcagagccggcggccccccccccggcggcggcgccccctggcacctgagaaacgtgctgagcgacagcgtggagagcagcgacgacgagttcttcgacgccagaggcgagggcaccgccccctgcaccagcagcatcctgcaggagaagcagagagagctgtacagagtgagcctgagaagacagagattccccgcccagggcagcatcgagatccacgaggacagcgaggagggctgcccccagagaagctgcaagacccacgtgctgctgctggtgctgcacggcggcaacatcctggacaccggcgccggcgaccccagctgcaaggccgccgacatccacaccttcagcagcgtgctggagaaggtgaccagagcccacttccccgccgccctgggccacatcctgatcaagttcgtgccctgccccgccatctgcagcgaggccttcagcctggtgagccacctgaacccctacagccacgacgagggctgcctgagcagcagccaggaccacgtgcccctggccgccctgcccctgctggccatcagcagcccccagtaccaggacgccgtggccaccgtgatcgagagagccaaccaggtgtacagagagttcctgaagagcagcgacggcatcggcttcagcggccaggtgtgcctgatcggcgactgcgtgggcggcctgctggccttcgacgccatctgctacagcgccggccccagcggcgacagccccgccagcagcagcagaaagggcagcatcagcagcacccaggacacccccgtggccgtggaggaggactgcagcctggccagcagcaagagactgagcaagagcaacatcgacatcagcagcggcctggaggacgaggagcccaagagacccctgcccagaaagcagagcgacagcagcacctacgactgcgaggccatcacccagcaccacgccttcctgagcagcatccacagcagcgtgctgaaggacgagagcgagacccccgccgccggcggcccccagctgcccgaggtgagcctgggcagattcgacttcgacgtgagcgacttcttcctgttcggcagccccctgggcctggtgctggccatgagaagaaccgtgctgcccggcctggacggcttccaggtgagacccgcctgcagccaggtgtacagcttcttccactgcgccgaccccagcgccagcagactggagcccctgctggagcccaagttccacctggtgccccccgtgagcgtgcccagataccagagattccccctgggcgacggccagagcctgctgctggccgacgccctgcacacccacagccccctgttcctggagggcagcagcagagacagcccccccctgctggacgcccccgccagccccccccaggccagcagattccagagacccggcagaagaatgagcgagggcagcagccacagcgagagcagcgagagcagcgacagcatggcccccgtgggcgccagcagaatcaccgccaagtggtggggcagcaagagaatcgactacgccctgtactgccccgacgtgctgaccgccttccccaccgtggccctgccccacctgttccacgccagctactgggagagcaccgacgtggtggccttcatcctgagacaggtgatgagatacgagagcgtgaacatcaaggagagcgccagactggaccccgccgccctgagccccgccaaccccagagagaagtggctgagaaagagaacccaggtgaagctgagaaacgtgaccgccaaccacagagccaacgacgtgatcgccgccgaggacggcccccaggtgctggtgggcagattcatgtacggccccctggacatggtggccctgaccggcgagaaggtggacatcctggtgatggccgagcccagcagcggcagatgggtgcacctggacaccgagatcaccaacagcagcggcagaatcacctacaacgtgcccagacccagaagactgggcgtgggcgtgtaccccgtgaagatggtggtgagaggcgaccagacctgcgccatgagctacctgaccgtgctgcccagaggcatggagtgcgtggtgttcagcatcgacggcagcttcgccgccagcgtgagcatcatgggcagcgaccccaaggtgagacccggcgccgtggacgtggtgagacactggcaggacctgggctacatgatcctgtacatcaccggcagacccgacatgcagaagcagagagtggtgagctggctgagccagcacaacttcccccagggcatgatcttcttcagcgacggcctggtgcacgaccccctgagacagaaggccatcttcctgagaaacctgatgcaggagtgcttcatcaagatcagcgccgcctacggcagcaccaaggacatcagcgtgtacagcgtgctgggcctgcccgccagccagatcttcatcgtgggcagacccaccaagaagtaccagacccagtgccagttcctgagcgagggctacgccgcccacctggccgccctggaggccagccacagaagcagacccaagaagaacaacagcagaatgatcctgagaaagggcagcttcggcctgcacgcccagcccgagttcctgagaaagagaaaccacctgagaagaaccatgagcgtgcagcagcccgacccccccgccgccaaccccaagcccgagagagcccagagccagcccgagagcgacaaggaccacgagagacccctgcccgccctgagctgggccagaggcccccccaagttcgagagcgtgccctag

SEQ ID NO: 93476 - DNA, 609 bp, Artificial Sequence
  Description of Artificial Sequence: Synthetic coding sequence
atggccaccctgatctacgtggacaaggagaacggcgagcccggcaccagagtggtggccaaggacggcctgaagctgggcagcggccccagcatcaaggccctggacggcagaagccaggtgagcacccccagattcggcaagaccttcgacgccccccccgccctgcccaaggccaccagaaaggccctgggcaccgtgaacagagccaccgagaagagcgtgaagaccaagggccccctgaagcagaagcagcccagcttcagcgccaagaagatgaccgagaagaccgtgaaggccaagagcagcgtgcccgccagcgacgacgcctaccccgagatcgagaagttcttccccttcaaccccctggacttcgagagcttcgacctgcccgaggagcaccagatcgcccacctgcccctgagcggcgtgcccctgatgatcctggacgaggagagagagctggagaagctgttccagctgggcccccccagccccgtgaagatgcccagccccccctgggagagcaacctgctgcagagccccagcagcatcctgagcaccctggacgtggagctgccccccgtgtgctgcgacatcgacatctag

SEQ ID NO: 93477 - DNA, 609 bp, Artificial Sequence; identical to SEQ ID NO: 93476
  Description of Artificial Sequence: Synthetic coding sequence

SEQ ID NO: 93478 - DNA, 609 bp, Artificial Sequence; identical to SEQ ID NO: 93476
  Description of Artificial Sequence: Synthetic coding sequence

SEQ ID NO: 93479 - DNA, 543 bp, Artificial Sequence
  Description of Artificial Sequence: Synthetic coding sequence
atggcccccggcgtggccagaggccccaccccctactggagactgagactgggcggcgccgccctgctgctgctgctgatccccgtggccgccgcccaggagccccccggcgccgcctgcagccagaacaccaacaagacctgcgaggagtgcctgaagaacgtgagctgcctgtggtgcaacaccaacaaggcctgcctggactaccccgtgaccagcgtgctgccccccgccagcctgtgcaagctgagcagcgccagatggggcgtgtgctgggtgaacttcgaggccctgatcatcaccatgagcgtggtgggcggcaccctgctgctgggcatcgccatctgctgctgctgctgctgcagaagaaagagaagcagaaagcccgacagaagcgaggagaaggccatgagagagagagaggagagaagaatcagacaggaggagagaagagccgagatgaagaccagacacgacgagatcagaaagaagtacggcctgttcaaggaggagaacccctacgccagattcgagaacaactag

SEQ ID NO: 93480 - DNA, 429 bp, Artificial Sequence
  Description of Artificial Sequence: Synthetic coding sequence
atggcccccggcgtggccagaggccccaccccctactggagactgagactgggcggcgccgccctgctgctgctgctgatccccgtggccgccgcccaggagccccccggcgccgcctgcagccagaacaccaacaagacctgcgaggagtgcctgaagaacgtgagcgcctgcctgaagaagaagaccagaatgctggacctgaagaccaccaaggccctgcagcacatcagccccgacgccagctgcgaggtgcacgccccccagcccagccccgccggcagacccagaggccactgcggcctgctgaccctggccagcgagcccgccagcctgcccggccaggccgccggcgagctgcccctgaaggacagccccctggtgctgcagaccggcgacctgctgttccccgtgcacctgtgcttctag

SEQ ID NO: 93481 - DNA, 576 bp, Artificial Sequence
  Description of Artificial Sequence: Synthetic coding sequence
atggccaccctgatctacgtggacaaggagatcggcgagcccggcaccagagtggccgccaaggacgtgctgaagctggagagcagacccagcatcaaggccctggacggcatcagccaggtgctgaccagaagattcggcaagacctacgacgcccccagcgccctgcccaaggccaccagaaaggccctgggcaccgtgaacagagccaccgagaagagcgtgaagaccaacggccccagaaagcagaagcagcccagcttcagcgccaagaagatgaccgagaagaccgtgaagaccaagagcagcgtgcccgccagcgacgacgcctaccccgagatcgagaagttcttccccttcaacctgctggacttcgagagcttcgacctgcccgaggagagacagatcgcccacctgcccctgagcggcgtgcccctgatgatcctggacgaggagggcgagctggagaagctgttccagctgggcccccccagccccgtgaagatgcccagccccccctgggagtgcaacctgttcgccgtgagcttcaagcacagcgtggaccccggctgctag

SEQ ID NO: 93482 - DNA, 2586 bp, Artificial Sequence
  Description of Artificial Sequence: Synthetic coding sequence
atgaccggcagagccagagccagagccagaggcagagccagaggccaggagaccgcccagctggtgggcagcaccgccagccagcagcccggctacatccagcccagaccccagcccccccccgccgagggcgagctgttcggcagaggcagacagagaggcaccgccggcggcaccgccaagagccagggcctgcagatcagcgccggcttccaggagctgagcctggccgagagaggcggcagaagaagagacttccacgacctgggcgtgaacaccagacagaacctggaccacgtgaaggagagcaagaccggcagcagcggcatcatcgtgagactgagcaccaaccacttcagactgaccagcagaccccagtgggccctgtaccagtaccacatcgactacaaccccctgatggaggccagaagactgagaagcgccctgctgttccagcacgaggacctgatcggcaagtgccacgccttcgacggcaccatcctgttcctgcccaagagactgcagcagaaggtgaccgaggtgttcagcaagaccagaaacggcgaggacgtgagaatcaccatcaccctgaccaacgagctgccccccaccagccccacctgcctgcagttctacaacatcatcttcagaagactgctgaagatcatgaacctgcagcagatcggcagaaactactacaaccccaacgaccccatcgacatccccagccacagactggtgatctggcccggcttcaccaccagcatcctgcagtacgagaacagcatcatgctgtgcaccgacgtgagccacaaggtgctgagaagcgagaccgtgctggacttcatgttcaacttctaccaccagaccgaggagcacaagttccaggagcaggtgagcaaggagctgatcggcctggtggtgctgaccaagtacaacaacaagacctacagagtggacgacatcgactgggaccagaaccccaagagcaccttcaagaaggccgacggcagcgaggtgagcttcctggagtactacagaaagcagtacaaccaggagatcaccgacctgaagcagcccgtgctggtgagccagcccaagagaagaagaggccccggcggcaccctgcccggccccgccatgctgatccccgagctgtgctacctgaccggcctgaccgacaagatgagaaacgacttcaacgtgatgaaggacctggccgtgcacaccagactgacccccgagcagagacagagagaggtgggcagactgatcgactacatccacaagaacgacaacgtgcagagagagctgagagactggggcctgagcttcgacagcaacctgctgagcttcagcggcagaatcctgcagaccgagaagatccaccagggcggcaagaccttcgactacaacccccagttcgccgactggagcaaggagaccagaggcgcccccctgatcagcgtgaagcccctggacaactggctgctgatctacaccagaagaaactacgaggccgccaacagcctgatccagaacctgttcaaggtgacccccgccatgggcatgcagatgagaaaggccatcatgatcgaggtggacgacagaaccgaggcctacctgagagtgctgcagcagaaggtgaccgccgacacccagatcgtggtgtgcctgctgagcagcaacagaaaggacaagtacgacgccatcaagaagtacctgtgcaccgactgccccacccccagccagtgcgtggtggccagaaccctgggcaagcagcagaccgtgatggccatcgccaccaagatcgccctgcagatgaactgcaagatgggcggcgagctgtggagagtggacatccccctgaagctggtgatgatcgtgggcatcgactgctaccacgacatgaccgccggcagaagaagcatcgccggcttcgtggccagcatcaacgagggcatgaccagatggttcagcagatgcatcttccaggacagaggccaggagctggtggacggcctgaaggtgtgcctgcaggccgccctgagagcctggaacagctgcaacgagtacatgcccagcagaatcatcgtgtacagagacggcgtgggcgacggccagctgaagaccctggtgaactacgaggtgccccagttcctggactgcctgaagagcatcggcagaggctacaaccccagactgaccgtgatcgtggtgaagaagagagtgaacaccagattcttcgcccagagcggcggcagactgcagaaccccctgcccggcaccgtgatcgacgtggaggtgaccagacccgagtggtacgacttcttcatcgtgagccaggccgtgagaagcggcagcgtgagccccacccactacaacgtgatctacgacaacagcggcctgaagcccgaccacatccagagactgacctacaagctgtgccacatctactacaactggcccggcgtgatcagagtgcccgccccctgccagtacgcccacaagctggccttcctggtgggccagagcatccacagagagcccaacctgagcctgagcaacagactgtactacctgtag

SEQ ID NO: 93483 - DNA, 369 bp, Artificial Sequence
  Description of Artificial Sequence: Synthetic coding sequence
atgaccggcagagccagagccagagccagaggcagagccagaggccaggagaccgcccagctggtgggcagcaccgccagccagcagcccggctacatccagcccagaccccagcccccccccgccgagggcgagctgttcggcagaggcagacagagaggcaccgccggcggcaccgccaagagccagggcctgcagatcagcgccggcttccaggagctgagcctggccgagagaggcggcagaagaagagacttccacgacctgggcgtgaacaccagacagaacctggaccacgtgaaggagagcaagaccggcagcagcggcatcatcgtgagactgagcaccaaccacttcagactgacctag

SEQ ID NO: 93484 - DNA, 453 bp, Artificial Sequence
  Description of Artificial Sequence: Synthetic coding sequence
atgaccggcagagccagagccagagccagaggcagagccagaggccaggagaccgcccagctggtgggcagcaccgccagccagcagcccggctacatccagcccagaccccagcccccccccgccgagggcgagctgttcggcagaggcagacagagaggcaccgccggcggcaccgccaagagccagggcctgcagatcagcgccggcttccaggagctgagcctggccgagagaggcggcagaagaagagacttccacgacctgggcgtgaacaccagacagaacctggaccacgtgaaggagagcaagaccggcagcagcggcatcatcgtgagactgagcaccaaccacttcagactgaccagcagaccccagtgggccctgtaccagtaccacatcgactacaaccccctgatggaggccagaagactgagaagcgccctgctgtag

SEQ ID NO: 93485 - DNA, 519 bp, Artificial Sequence
  Description of Artificial Sequence: Synthetic coding sequence
atgaccggcagagccagagccagagccagaggcagagccagaggccaggagaccgcccagctggtgggcagcaccgccagccagcagcccggctacatccagcccagaccccagcccccccccgccgagggcgagctgttcggcagaggcagacagagaggcaccgccggcggcaccgccaagagccagggcctgcagatcagcgccggcttccaggagctgagcctggccgagagaggcggcagaagaagagacttccacgacctgggcgtgaacaccagacagaacctggaccacgtgaaggagagcaagaccggcagcagcggcatcatcgtgagactgagcaccaaccacttcagactgaccagcagaccccagtgggccctgtaccagtaccacatcgactacaaccccctgatggaggccagaagactgagaagcgccctgctgttccagcacgaggacctgatcggcaagtgccacgccttcgacggcaccatcctgttcctgcccaagtag

SEQ ID NO: 93486 - DNA, 498 bp, Artificial Sequence
  Description of Artificial Sequence: Synthetic coding sequence
atgaccggcagagccagagccagagccagaggcagagccagaggccaggagaccgcccagctggtgggcagcaccgccagccagcagcccggctacatccagcccagaccccagcccccccccgccgagggcgagctgttcggcagaggcagacagagaggcaccgccggcggcaccgccaagagccagggcctgcagatcagcgccggcttccaggagctgagcctggccgagagaggcggcagaagaagagacttccacgacctgggcgtgaacaccagacagaacctggaccacgtgaaggagagcaagaccggcagcagcggcatcatcgtgagactgagcaccaaccacttcagactgaccagcagaccccagtgggccctgtaccagtaccacatcgactacaaccccctgatggaggccagaagactgagaagcgccctgctgttccagcacgaggacctgatcggcaagtgccacgccttcgacggctag

SEQ ID NO: 93487 - DNA, 2922 bp, Artificial Sequence
  Description of Artificial Sequence: Synthetic coding sequence
atggaccccttcagacccagcttcagaggccagagccccatccaccccagccagtgccaggccgtgagaatgcccggctgctggccccaggccagcaagcccctggaccccgccctgggcagaggcgcccccgccggcagaggccacgtgttcggcaagcccgaggagcccagcacccagagaggccccgcccagagagagagcgtgggcctggtgagcatgttcagaggcctgggcatcgagaccgtgagcaagacccccctgaagagagagatgctgcccagcggcagaggcatcctgggcagaggcctgagcgccaacctggtgagaaaggacagagaggagctgagccccaccttctgggaccccaaggtgctggccgccggcgacagcaagatggccgagaccagcgtgggctggagcagaaccctgggcagaggcagcagcgacgccagcctgctgcccctgggcagagccgccggcggcatcagcagagaggtggacaagcccccctgcaccttcagcacccccagcagaggccccccccagctgagcagcccccccgccctgccccagagccccctgcacagccccgacagacccctggtgctgaccgtggagcacaaggagaaggagctgatcgtgaagcagggcagcaagggcaccccccagagcctgggcctgaacctggtgaagatccagtgccacaacgaggccgtgtaccagtaccacgtgaccttcagccccaacgtggagtgcaagagcatgagattcggcatgctgaaggaccaccaggccgtgaccggcaacgtgaccgccttcgacggcagcatcctgtacctgcccgtgaagctgcagcaggtgctggagctgaagagccagagaaagaccgacagcgccgagatcagcatcaagatccagatgaccaagatcctggagccctgcagcgacctgtgcatccccttctacaacgtggtgttcagaagagtgatgaagctgctggacatgaagctggtgggcagaaacttctacgaccccaccagcgccatggtgctgcagcagcacagactgcagatctggcccggctacgccgccagcatcagaagaaccgacggcggcctgttcctgctggccgacgtgagccacaaggtgatcagaaacgactgcgtgctggacgtgatgcacgccatctaccagcagaacaaggagcacttccaggacgagtgcaccaagctgctggtgggcaacatcgtgatcaccagatacaacaacagaacctacagaatcgacgacgtggactggaacaagacccccaaggacagcttcaccatgagcgacggcaaggagatcaccttcctggagtactacagcaagaactacggcatcaccgtgaaggaggaggaccagcccctgctgatccacagacccagcgagagacaggacaaccacggcatgctgctgaagggcgagatcctgctgctgcccgagctgagcttcatgaccggcatccccgagaagatgaagaaggacttcagagccatgaaggacctggcccagcagatcaacctgagccccaagcagcaccacagcgccctggagtgcctgctgcagagaatcgccaagaacgaggccgccaccaacgagctgatgagatggggcctgagactgcagaaggacgtgcacaagatcgagggcagagtgctgcccatggagagaatcaacctgaagaacaccagcttcatcaccagccaggagctgaactgggtgaaggaggtgaccagagaccccagcatcctgaccatccccatgcacttctgggccctgttctaccccaagagagccatggaccaggccagagagctggtgaacatgctggagaagatcgccggccccatcggcatgagaatgagcccccccgcctgggtggagctgaaggacgacagaatcgagacctacgtgagaaccatccagagcaccctgggcgccgagggcaagatccagatggtggtgtgcatcatcatgggccccagagacgacctgtacggcgccatcaagaagctgtgctgcgtgcagagccccgtgcccagccaggtggtgaacgtgagaaccatcggccagcccaccagactgagaagcgtggcccagaagatcctgctgcagatcaactgcaagctgggcggcgagctgtggggcgtggacatccccctgaagcagctgatggtgatcggcatggacgtgtaccacgaccccagcagaggcatgagaagcgtggtgggcttcgtggccagcatcaacctgaccctgaccaagtggtacagcagagtggtgttccagatgccccaccaggagatcgtggacagcctgaagctgtgcctggtgggcagcctgaagaagttctacgaggtgaaccactgcctgcccgagaagatcgtggtgtacagagacggcgtgagcgacggccagctgaagaccgtggccaactacgagatcccccagctgcagaagtgcttcgaggccttcgagaactaccagcccaagatggtggtgttcgtggtgcagaagaagatcagcaccaacctgtacctggccgccccccagaacttcgtgacccccacccccggcaccgtggtggaccacaccatcaccagctgcgagtgggtggacttctacctgctggcccaccacgtgagacagggctgcggcatccccacccactacgtgtgcgtgctgaacaccgccaacctgagccccgaccacatgcagagactgaccttcaagctgtgccacatgtactggaactggcccggcaccatcagagtgcccgccccctgcaagtacgcccacaagctggccttcctgagcggccacatcctgcaccacgagcccgccatccagctgtgcgagaacctgttcttcctgtag

SEQ ID NO: 93488 - DNA, 2922 bp, Artificial Sequence; identical to SEQ ID NO: 93487
  Description of Artificial Sequence: Synthetic coding sequence

SEQ ID NO: 93489 - DNA, 639 bp, Artificial Sequence
  Description of Artificial Sequence: Synthetic coding sequence
atgaaggtgttcaagttcatcggcctgatgatcctgctgaccagcgccttcagcgccggcagcggccagagccccatgaccgtgctgtgcagcatcgactggttcatggtgaccgtgcaccccttcatgctgaacaacgacgtgtgcgtgcacttccacgagctgcacctgggcctgggctgcccccccaaccacgtgcagccccacgcctaccagttcacctacagagtgaccgagtgcggcatcagagccaaggccgtgagccaggacatggtgatctacagcaccgagatccactacagcagcaagggcacccccagcaagttcgtgatccccgtgagctgcgccgccccccagaagagcccctggctgaccaagccctgcagcatgagagtggccagcaagagcagagccaccgcccagaaggacgagaagtgctacgaggtgttcagcctgagccagagcagccagagacccaactgcgactgccccccctgcgtgttcagcgaggaggagcacacccaggtgccctgccaccaggccggcgcccaggaggcccagcccctgcagcccagccacttcctggacatcagcgaggactggagcctgcacaccgacgacatgatcggcagcatgtag

SEQ ID NO: 93490 - DNA, 294 bp, Artificial Sequence
  Description of Artificial Sequence: Synthetic coding sequence
atgagacccctgctgtgcgccctgaccggcctggccctgctgagagccgccggcagcctggccgccgccgagcccttcagcccccccagaggcgacagcgcccagagcaccgcctgcgacagacacatggccgtgcagagaagactggacgtgatggaggagatggtggagaagaccgtggaccacctgggcaccgaggtgaagggcctgctgggcctgctggaggagctggcctggaacctgccccccggccccttcagccccgcccccgacctgctgggcgacggcttctag

SEQ ID NO: 93491 - DNA, 264 bp, Artificial Sequence
  Description of Artificial Sequence: Synthetic coding sequence
atgagacccctgctgtgcgccctgaccggcctggccctgctgagagccgccggcagcctggccgccgccgagcccttcagcccccccagaggcgacagcgcccagagcaccgcctgcgacagacacatggccgtgcagagaagactggacgtgatggaggagatggccagcgagccctggagctggagccccgccgtgggcggcggcgcccccgccagacagagaccccagaaccagccctgccccctggacttcctgccctag

SEQ ID NO: 93492 - DNA, 168 bp, Artificial Sequence
  Description of Artificial Sequence: Synthetic coding sequence
atggccgtgcagagaagactggacgtgatggaggagatggtggagaagaccgtggaccacctgggcaccgaggtgaagggcctgctgggcctgctggaggagctggcctggaacctgccccccggccccttcagccccgcccccgacctgctgggcgacggcttctag

SEQ ID NO: 93493 - DNA, 2244 bp, Artificial Sequence
  Description of Artificial Sequence: Synthetic coding sequence
atgaaccacagccccctgaagaccgccctggcctacgagtgcttccaggaccaggacaacagcaccctggccctgcccagcgaccagaagatgaagaccggcaccagcggcagacagagagtgcaggagcaggtgatgatgaccgtgaagagacagaagagcaagagcagccagagcagcaccctgagccacagcaacagaggcagcatgtacgacggcctggccgacaactacaactacggcaccaccagcagaagcagctactacagcaagttccaggccggcaacggcagctggggctaccccatctacaacggcaccctgaagagagagcccgacaacagaagattcagcagctacagccagatggagaactggagcagacactaccccagaggcagctgcaacaccaccggcgccggcagcgacatctgcttcatgcagaagatcaaggccagcagaagcgagcccgacctgtactgcgaccccagaggcaccctgagaaagggcaccctgggcagcaagggccagaagaccacccagaacagatacagcttctacagcacctgcagcggccagaaggccatcaagaagtgccccgtgagaccccccagctgcgccagcaagcaggaccccgtgtacatcccccccatcagctgcaacaaggacctgagcttcggccacagcagagccagcagcaagatctgcagcgaggacatcgagtgcagcggcctgaccatccccaaggccgtgcagtacctgagcagccaggacgagaagtaccaggccatcggcgcctactacatccagcacacctgcttccaggacgagagcgccaagcagcaggtgtaccagctgggcggcatctgcaagctggtggacctgctgagaagccccaaccagaacgtgcagcaggccgccgccggcgccctgagaaacctggtgttcagaagcaccaccaacaagctggagaccagaagacagaacggcatcagagaggccgtgagcctgctgagaagaaccggcaacgccgagatccagaagcagctgaccggcctgctgtggaacctgagcagcaccgacgagctgaaggaggagctgatcgccgacgccctgcccgtgctggccgacagagtgatcatccccttcagcggctggtgcgacggcaacagcaacatgagcagagaggtggtggaccccgaggtgttcttcaacgccaccggctgcctgagaaagagactgggcatgagagagctgctggccctggtgccccagagagccaccagcagcagagtgaacctgagcagcgccgacgccggcagacagaccatgagaaactacagcggcctgatcgacagcctgatggcctacgtgcagaactgcgtggccgccagcagatgcgacgacaagagcgtggagaactgcatgtgcgtgctgcacaacctgagctacagactggacgccgaggtgcccaccagatacagacagctggagtacaacgccagaaacgcctacaccgagaagagcagcaccggctgcttcagcaacaagagcgacaagatgatgaacaacaactacgactgccccctgcccgaggaggagaccaaccccaagggcagcggctggctgtaccacagcgacgccatcagaacctacctgaacctgatgggcaagagcaagaaggacgccaccctggaggcctgcgccggcgccctgcagaacctgaccgccagcaagggcctgatgagcagcggcatgagccagctgatcggcctgaaggagaagggcctgccccagatcgccagactgctgcagagcggcaacagcgacgtggtgagaagcggcgccagcctgctgagcaacatgagcagacaccccctgctgcacagagtgatgggcaaccaggtgttccccgaggtgaccagactgctgaccagccacaccggcaacaccagcaacagcgaggacatcctgagcagcgcctgctacaccgtgagaaacctgatggccagccagccccagctggccaagcagtacttcagcagcagcatgctgaacaacatcatcaacctgtgcagaagcagcgccagccccaaggccgccgaggccgccagactgctgctgagcgacatgtggagcagcaaggagctgcagggcgtgctgagacagcagggcttcgacagaaacatgctgggcaccctggccggcgccaacagcctgagaaacttcaccagcagattctag

SEQ ID NO: 93494 - DNA, 2244 bp, Artificial Sequence; identical to SEQ ID NO: 93493
  Description of Artificial Sequence: Synthetic coding sequence

SEQ ID NO: 93495 - DNA, 2181 bp, Artificial Sequence
  Description of Artificial Sequence: Synthetic coding sequence
atgaaccacagccccctgaagaccgccctggcctacgagtgcttccaggaccaggacaacagcaccctggccctgcccagcgaccagaagatgaagaccggcaccagcggcagacagagagtgcaggagcaggtgatgatgaccgtgaagagacagaagagcaagagcagccagagcagcaccctgagccacagcaacagaggcagcatgtacgacggcctggccgacaactacaactacggcaccaccagcagaagcagctactacagcaagttccaggccggcaacggcagctggggctaccccatctacaacggcaccctgaagagagagcccgacaacagaagattcagcagctacagccagatggagaactggagcagacactaccccagaggcagctgcaacaccaccggcgccggcagcgacatctgcttcatgcagaagatcaaggccagcagaagcgagcccgacctgtactgcgaccccagaggcaccctgagaaagggcaccctgggcagcaagggccagaagaccacccagaacagatacagcttctacagcacctgcagcggccagaaggccatcaagaagtgccccgtgagaccccccagctgcgccagcaagcaggaccccgtgtacatcccccccatcagctgcaacaaggacctgagcttcggccacagcagagccagcagcaagatctgcagcgaggacatcgagtgcagcggcctgaccatccccaaggccgtgcagtacctgagcagccaggacgagaagtaccaggccatcggcgcctactacatccagcacacctgcttccaggacgagagcgccaagcagcaggtgtaccagctgggcggcatctgcaagctggtggacctgctgagaagccccaaccagaacgtgcagcaggccgccgccggcgccctgagaaacctggtgttcagaagcaccaccaacaagctggagaccagaagacagaacggcatcagagaggccgtgagcctgctgagaagaaccggcaacgccgagatccagaagcagctgaccggcctgctgtggaacctgagcagcaccgacgagctgaaggaggagctgatcgccgacgccctgcccgtgctggccgacagagtgatcatccccttcagcggctggtgcgacggcaacagcaacatgagcagagaggtggtggaccccgaggtgttcttcaacgccaccggctgcctgagaaacctgagcagcgccgacgccggcagacagaccatgagaaactacagcggcctgatcgacagcctgatggcctacgtgcagaactgcgtggccgccagcagatgcgacgacaagagcgtggagaactgcatgtgcgtgctgcacaacctgagctacagactggacgccgaggtgcccaccagatacagacagctggagtacaacgccagaaacgcctacaccgagaagagcagcaccggctgcttcagcaacaagagcgacaagatgatgaacaacaactacgactgccccctgcccgaggaggagaccaaccccaagggcagcggctggctgtaccacagcgacgccatcagaacctacctgaacctgatgggcaagagcaagaaggacgccaccctggaggcctgcgccggcgccctgcagaacctgaccgccagcaagggcctgatgagcagcggcatgagccagctgatcggcctgaaggagaagggcctgccccagatcgccagactgctgcagagcggcaacagcgacgtggtgagaagcggcgccagcctgctgagcaacatgagcagacaccccctgctgcacagagtgatgggcaaccaggtgttccccgaggtgaccagactgctgaccagccacaccggcaacaccagcaacagcgaggacatcctgagcagcgcctgctacaccgtgagaaacctgatggccagccagccccagctggccaagcagtacttcagcagcagcatgctgaacaacatcatcaacctgtgcagaagcagcgccagccccaaggccgccgaggccgccagactgctgctgagcgacatgtggagcagcaaggagctgcagggcgtgctgagacagcagggcttcgacagaaacatgctgggcaccctggccggcgccaacagcctgagaaacttcaccagcagattctag

SEQ ID NO: 93496 - DNA, 2646 bp, Artificial Sequence
  Description of Artificial Sequence: Synthetic coding sequence
atggccgcccccggcgcccccgccgagtacggctacatcagaaccgtgctgggccagcagatcctgggccagctggacagcagcagcctggccctgcccagcgaggccaagctgaagctggccggcagcagcggcagaggcggccagaccgtgaagagcctgagaatccaggagcaggtgcagcagaccctggccagaaagggcagaagcagcgtgggcaacggcaacctgcacagaaccagcagcgtgcccgagtacgtgtacaacctgcacctggtggagaacgacttcgtgggcggcagaagccccgtgcccaagacctacgacatgctgaaggccggcaccaccgccacctacgagggcagatggggcagaggcaccgcccagtacagcagccagaagagcgtggaggagagaagcctgagacaccccctgagaagactggagatcagccccgacagcagccccgagagagcccactacacccacagcgactaccagtacagccagagaagccaggccggccacaccctgcaccaccaggagagcagaagagccgccctgctggtgccccccagatacgccagaagcgagatcgtgggcgtgagcagagccggcaccaccagcagacagagacacttcgacacctaccacagacagtaccagcacggcagcgtgagcgacaccgtgttcgacagcatccccgccaaccccgccctgctgacctaccccagacccggcaccagcagaagcatgggcaacctgctggagaaggagaactacctgaccgccggcctgaccgtgggccaggtgagacccctggtgcccctgcagcccgtgacccagaacagagccagcagaagcagctggcaccagagcagcttccacagcaccagaaccctgagagaggccggccccagcgtggccgtggacagcagcggcagaagagcccacctgaccgtgggccaggccgccgccggcggcagcggcaacctgctgaccgagagaagcaccttcaccgacagccagctgggcaacgccgacatggagatgaccctggagagagccgtgagcatgctggaggccgaccacatgctgcccagcagaatcagcgccgccgccaccttcatccagcacgagtgcttccagaagagcgaggccagaaagagagtgaaccagctgagaggcatcctgaagctgctgcagctgctgaaggtgcagaacgaggacgtgcagagagccgtgtgcggcgccctgagaaacctggtgttcgaggacaacgacaacaagctggaggtggccgagctgaacggcgtgcccagactgctgcaggtgctgaagcagaccagagacctggagaccaagaagcagatcaccgaccacaccgtgaacctgagaagcagaaacggctggcccggcgccgtggcccacgcctgcaaccccagcaccctgggcggccagggcggcagaatcaccagaagcggcgtgagagaccagcccgaccagcacggcctgctgtggaacctgagcagcaacgacaagctgaagaacctgatgatcaccgaggccctgctgaccctgaccgagaacatcatcatccccttcagcggctggcccgagggcgactaccccaaggccaacggcctgctggacttcgacatcttctacaacgtgaccggctgcctgagaaacatgagcagcgccggcgccgacggcagaaaggccatgagaagatgcgacggcctgatcgacagcctggtgcactacgtgagaggcaccatcgccgactaccagcccgacgacaaggccaccgagaactgcgtgtgcatcctgcacaacctgagctaccagctggaggccgagctgcccgagaagtacagccagaacatctacatccagaacagaaacatccagaccgacaacaacaagagcatcggctgcttcggcagcagaagcagaaaggtgaaggagcagtaccaggacgtgcccatgcccgaggagaagagcaaccccaagggcgtggagtggctgtggcacagcatcgtgatcagaatgtacctgagcctgatcgccaagagcgtgagaaactacacccaggaggccagcctgggcgccctgcagaacctgaccgccggcagcggccccatgcccaccagcgtggcccagaccgtggtgcagaaggagagcggcctgcagcacaccagaaagatgctgcacgtgggcgaccccagcgtgaagaagaccgccatcagcctgctgagaaacctgagcagaaacctgagcctgcagaacgagatcgccaaggagaccctgcccgacctggtgagcatcatccccgacaccgtgcccagcaccgacctgctgatcgagaccaccgccagcgcctgctacaccctgaacaacatcatccagaacagctaccagaacgccagagacctgctgaacaccggcggcatccagaagatcatggccatcagcgccggcgacgcctacgccagcaacaaggccagcaaggccgccagcgtgctgctgtacagcctgtgggcccacaccgagctgcaccacgcctacaagaaggcccagttcaagaagaccgacttcgtgaacagcagaaccgccaaggcctaccacagcctgaaggactag

SEQ ID NO: 93497 - DNA, 2514 bp, Artificial Sequence
  Description of Artificial Sequence: Synthetic coding sequence
atggccgcccccggcgcccccgccgagtacggctacatcagaaccgtgctgggccagcagatcctgggccagctggacagcagcagcctggccctgcccagcgaggccaagctgaagctggccggcagcagcggcagaggcggccagaccgtgaagagcctgagaatccaggagcaggtgcagcagaccctggccagaaagggcagaagcagcgtgggcaacggcaacctgcacagaaccagcagcgtgcccgagtacgtgtacaacctgcacctggtggagaacgacttcgtgggcggcagaagccccgtgcccaagacctacgacatgctgaaggccggcaccaccgccacctacgagggcagatggggcagaggcaccgcccagtacagcagccagaagagcgtggaggagagaagcctgagacaccccctgagaagactggagatcagccccgacagcagccccgagagagcccactacacccacagcgactaccagtacagccagagaagccaggccggccacaccctgcaccaccaggagagcagaagagccgccctgctggtgccccccagatacgccagaagcgagatcgtgggcgtgagcagagccggcaccaccagcagacagagacacttcgacacctaccacagacagtaccagcacggcagcgtgagcgacaccgtgttcgacagcatccccgccaaccccgccctgctgacctaccccagacccggcaccagcagaagcatgggcaacctgctggagaaggagaactacctgaccgccggcctgaccgtgggccaggtgagacccctggtgcccctgcagcccgtgacccagaacagagccagcagaagcagctggcaccagagcagcttccacagcaccagaaccctgagagaggccggccccagcgtggccgtggacagcagcggcagaagagcccacctgaccgtgggccaggccgccgccggcggcagcggcaacctgctgaccgagagaagcaccttcaccgacagccagctgggcaacgccgacatggagatgaccctggagagagccgtgagcatgctggaggccgaccacatgctgcccagcagaatcagcgccgccgccaccttcatccagcacgagtgcttccagaagagcgaggccagaaagagagtgaaccagctgagaggcatcctgaagctgctgcagctgctgaaggtgcagaacgaggacgtgcagagagccgtgtgcggcgccctgagaaacctggtgttcgaggacaacgacaacaagctggaggtggccgagctgaacggcgtgcccagactgctgcaggtgctgaagcagaccagagacctggagaccaagaagcagatcaccggcctgctgtggaacctgagcagcaacgacaagctgaagaacctgatgatcaccgaggccctgctgaccctgaccgagaacatcatcatccccttcagcggctggcccgagggcgactaccccaaggccaacggcctgctggacttcgacatcttctacaacgtgaccggctgcctgagaaacatgagcagcgccggcgccgacggcagaaaggccatgagaagatgcgacggcctgatcgacagcctggtgcactacgtgagaggcaccatcgccgactaccagcccgacgacaaggccaccgagaactgcgtgtgcatcctgcacaacctgagctaccagctggaggccgagctgcccgagaagtacagccagaacatctacatccagaacagaaacatccagaccgacaacaacaagagcatcggctgcttcggcagcagaagcagaaaggtgaaggagcagtaccaggacgtgcccatgcccgaggagaagagcaaccccaagggcgtggagtggctgtggcacagcatcgtgatcagaatgtacctgagcctgatcgccaagagcgtgagaaactacacccaggaggccagcctgggcgccctgcagaacctgaccgccggcagcggccccatgcccaccagcgtggcccagaccgtggtgcagaaggagagcggcctgcagcacaccagaaagatgctgcacgtgggcgaccccagcgtgaagaagaccgccatcagcctgctgagaaacctgagcagaaacctgagcctgcagaacgagatcgccaaggagaccctgcccgacctggtgagcatcatccccgacaccgtgcccagcaccgacctgctgatcgagaccaccgccagcgcctgctacaccctgaacaacatcatccagaacagctaccagaacgccagagacctgctgaacaccggcggcatccagaagatcatggccatcagcgccggcgacgcctacgccagcaacaaggccagcaaggccgccagcgtgctgctgtacagcctgtgggcccacaccgagctgcaccacgcctacaagaaggcccagttcaagaagaccgacttcgtgaacagcagaaccgccaaggcctaccacagcctgaaggactag

SEQ ID NO: 93498 - DNA, 2475 bp, Artificial Sequence
  Description of Artificial Sequence: Synthetic coding sequence
atggccgcccccggcgcccccgccgagtacggctacatcagaaccgtgctgggccagcagatcctgggccagctggacagcagcagcctggccctgcccagcgaggccaagctgaagctggccggcagcagcggcagaggcggccagaccgtgaagagcctgagaatccaggagcaggtgcagcagaccctggccagaaagggcagaagcagcgtgggcaacggcaacctgcacagaaccagcagcgtgcccgagtacgtgtacaacctgcacctggtggagaacgacttcgtgggcggcagaagccccgtgcccaagacctacgacatgctgaaggccggcaccaccgccacctacgagggcagatggggcagaggcaccgcccagtacagcagccagaagagcgtggaggagagaagcctgagacaccccctgagaagactggagatcagccccgacagcagccccgagagagcccactacacccacagcgactaccagtacagccagagaagccaggccggccacaccctgcaccaccaggagagcagaagagccgccctgctggtgccccccagatacgccagaagcgagatcgtgggcgtgagcagagccggcaccaccagcagacagagacacttcgacacctaccacagacagtaccagcacggcagcgtgagcgacaccgtgttcgacagcatccccgccaaccccgccctgctgacctaccccagacccggcaccagcagaagcatgggcaacctgctggagaaggagaactacctgaccgccggcctgaccgtgggccaggtgagacccctggtgcccctgcagcccgtgacccagaacagagccagcagaagcagctggcaccagagcagcttccacagcaccagaaccctgagagaggccggccccagcgtggccgtggacagcagcggcagaagagcccacctgaccgtgggccaggccgccgccggcggcagcggcaacctgctgaccgagagaagcaccttcaccgacagccagctgggcaacgccgacatggagatgaccctggagagagccgtgagcatgctggaggccgaccacatgctgcccagcagaatcagcgccgccgccaccttcatccagcacgagtgcttccagaagagcgaggccagaaagagagtgaaccagctgagaggcatcctgaagctgctgcagctgctgaaggtgcagaacgaggacgtgcagagagccgtgtgcggcgccctgagaaacctggtgttcgaggacaacgacaacaagctggaggtggccgagctgaacggcgtgcccagactgctgcaggtgctgaagcagaccagagacctggagaccaagaagcagatcaccgaccacaccgtgaacctgagaagcagaaacggctggcccggcgccgtggcccacgcctgcaaccccagcaccctgggcggccagggcggcagaatcaccagaagcggcgtgagagaccagcccgaccagcacggcctgctgtggaacctgagcagcaacgacaagctgaagaacctgatgatcaccgaggccctgctgaccctgaccgagaacatcatcatccccttcagcggctggcccgagggcgactaccccaaggccaacggcctgctggacttcgacatcttctacaacgtgaccggctgcctgagaaacatgagcagcgccggcgccgacggcagaaaggccatgagaagatgcgacggcctgatcgacagcctggtgcactacgtgagaggcaccatcgccgactaccagcccgacgacaaggccaccgagaactgcgtgtgcatcctgcacaacctgagctaccagctggaggccgagctgcccgagaagtacagccagaacatctacatccagaacagaaacatccagaccgacaacaacaagagcatcggctgcttcggcagcagaagcagaaaggtgaaggagcagtaccaggacgtgcccatgcccgaggagaagagcaaccccaagggcgtggagtggctgtggcacagcatcgtgatcagaatgtacctgagcctgatcgccaagagcgtgagaaactacacccaggaggccagcctgggcgccctgcagaacctgaccgccggcagcggccccatgcccaccagcgtggcccagaccgtggtgcagaaggagagcggcctgcagcacaccagaaagatgctgcacgtgggcgaccccagcgtgaagaagaccgccatcagcctgctgagaaacctgagcagaaacctgagcctgcagaacgagatcgccaaggagaccctgcccgacctggtgagcatcatccccgacaccgtgcccagcaccgacctgctgatcgagaccaccgccagcgcctgctacaccctgaacaacatcatccagaacagctaccagaacgccagagacctgctgaacagaggccaccccgagaactacggccactag

SEQ ID NO: 93499 - DNA, 2394 bp, Artificial Sequence
  Description of Artificial Sequence: Synthetic coding sequence
atgcaggacggcaacttcctgctgagcgccctgcagcccgaggccggcgtgtgcagcctggccctgcccagcgacctgcagctggacagaagaggcgccgagggccccgaggccgagagactgagagccgccagagtgcaggagcaggtgagagccagactgctgcagctgggccagcagcccagacacaacggcgccgccgagcccgagcccgaggccgagaccgccagaggcaccagcagaggccagtaccacaccctgcaggccggcttcagcagcagaagccagggcctgagcggcgacaagaccagcggcttcagacccatcgccaagcccgcctacagccccgccagctggagcagcagaagcgccgtggacctgagctgcagcagaagactgagcagcgcccacaacggcggcagcgccttcggcgccgccggctacggcggcgcccagcccaccccccccatgcccaccagacccgtgagcttccacgagagaggcggcgtgggcagcagagccgactacgacaccctgagcctgagaagcctgagactgggccccggcggcctggacgacagatacagcctggtgagcgagcagctggagcccgccgccaccagcacctacagagccttcgcctacgagagacaggccagcagcagcagcagcagagccggcggcctggactggcccgaggccaccgaggtgagccccagcagaaccatcagagcccccgccgtgagaaccctgcagagattccagagcagccacagaagcagaggcgtgggcggcgccgtgcccggcgccgtgctggagcccgtggccagagcccccagcgtgagaagcctgagcctgagcctggccgacagcggccacctgcccgacgtgcacggcttcaacagctacggcagccacagaaccctgcagagactgagcagcggcttcgacgacatcgacctgcccagcgccgtgaagtacctgatggccagcgaccccaacctgcaggtgctgggcgccgcctacatccagcacaagtgctacagcgacgccgccgccaagaagcaggccagaagcctgcaggccgtgcccagactggtgaagctgttcaaccacgccaaccaggaggtgcagagacacgccaccggcgccatgagaaacctgatctacgacaacgccgacaacaagctggccctggtggaggagaacggcatcttcgagctgctgagaaccctgagagagcaggacgacgagctgagaaagaacgtgaccggcatcctgtggaacctgagcagcagcgaccacctgaaggacagactggccagagacaccctggagcagctgaccgacctggtgctgagccccctgagcggcgccggcggcccccccctgatccagcagaacgccagcgaggccgagatcttctacaacgccaccggcttcctgagaaacctgagcagcgccagccaggccaccagacagaagatgagagagtgccacggcctggtggacgccctggtgaccagcatcaaccacgccctggacgccggcaagtgcgaggacaagagcgtggagaacgccgtgtgcgtgctgagaaacctgagctacagactgtacgacgagatgccccccagcgccctgcagagactggagggcagaggcagaagagacctggccggcgccccccccggcgaggtggtgggctgcttcaccccccagagcagaagactgagagagctgcccctggccgccgacgccctgaccttcgccgaggtgagcaaggaccccaagggcctggagtggctgtggagcccccagatcgtgggcctgtacaacagactgctgcagagatgcgagctgaacagacacaccaccgaggccgccgccggcgccctgcagaacatcaccgccggcgacagaagatgggccggcgtgctgagcagactggccctggagcaggagagaatcctgaaccccctgctggacagagtgagaaccgccgaccaccaccagctgagaagcctgaccggcctgatcagaaacctgagcagaaacgccagaaacaaggacgagatgagcaccaaggtggtgagccacctgatcgagaagctgcccggcagcgtgggcgagaagagcccccccgccgaggtgctggtgaacatcatcgccgtgctgaacaacctggtggtggccagccccatcgccgccagagacctgctgtacttcgacggcctgagaaagctgatcttcatcaagaagaagagagacagccccgacagcgagaagagcagcagagccgccagcagcctgctggccaacctgtggcagtacaacaagctgcacagagacttcagagccaagggctacagaaaggaggacttcctgggcccctag

SEQ ID NO: 93500 - DNA, 276 bp, Artificial Sequence
  Description of Artificial Sequence: Synthetic coding sequence
accgccttcagaagaacccccggcgaggagttcgcctggagagaccccgagctgcccgaggtgatccacatgctgcagcaccagttccccagcgtgcaggccaacgccgccgcctacctgcagcacctgtgcttcggcgacaacaaggtgaagatggaggtgtgcagactgggcggcatcaagcacctggtggacctgctggaccacagagtgggcagcagcgaggagtgcctgtggtgccccagcaagcccagattctggcaggtgtacagatag

SEQ ID NO: 93501 - DNA, 3450 bp, Artificial Sequence
  Description of Artificial Sequence: Synthetic coding sequence
atgcccgcccccgagcaggccagcctggtggaggagggccagccccagaccagacaggaggccgccagcaccggccccggcatggagcccgagaccaccgccaccaccatcctggccagcgtgaaggagcaggagctgcagttccagagactgaccagagagctggaggtggagagacagatcgtggccagccagctggagagatgcagactgggcgccgagagccccagcatcgccagcaccagcagcaccgagaagagcttcccctggagaagcaccgacgtgcccaacaccggcgtgagcaagcccagagtgagcgacgccgtgcagcccaacaactacctgatcagaaccgagcccgagcagggcaccctgtacagccccgagcagaccagcctgcacgagagcgagggcagcctgggcaacagcagaagcagcacccagatgaacagctacagcgacagcggctaccaggaggccggcagcttccacaacagccagaacgtgagcaaggccgacaacagacagcagcacagcttcatcggcagcaccaacaaccacgtggtgagaaacagcagagccgagggccagaccctggtgcagcccagcgtggccaacagagccatgagaagagtgagcagcgtgcccagcagagcccagagccccagctacgtgatcagcaccggcgtgagccccagcagaggcagcctgagaaccagcctgggcagcggcttcggcagccccagcgtgaccgaccccagacccctgaaccccagcgcctacagcagcaccaccctgcccgccgccagagccgccagcccctacagccagagacccgccagccccaccgccatcagaagaatcggcagcgtgaccagcagacagaccagcaaccccaacggccccaccccccagtaccagaccaccgccagagtgggcagccccctgaccctgaccgacgcccagaccagagtggccagccccagccagggccaggtgggcagcagcagccccaagagaagcggcatgaccgccgtgccccagcacctgggccccagcctgcagagaaccgtgcacgacatggagcagttcggccagcagcagtacgacatctacgagagaatggtgccccccagacccgacagcctgaccggcctgagaagcagctacgccagccagcacagccagctgggccaggacctgagaagcgccgtgagccccgacctgcacatcacccccatctacgagggcagaacctactacagccccgtgtacagaagccccaaccacggcaccgtggagctgcagggcagccagaccgccctgtacagaaccggcagcgtgggcatcggcaacctgcagagaaccagcagccagagaagcaccctgacctaccagagaaacaactacgccctgaacaccaccgccacctacgccgagccctacagacccatccagtacagagtgcaggagtgcaactacaacagactgcagcacgccgtgcccgccgacgacggcaccaccagaagccccagcatcgacagcatccagaaggaccccagagagttcgcctggagagaccccgagctgcccgaggtgatccacatgctgcagcaccagttccccagcgtgcaggccaacgccgccgcctacctgcagcacctgtgcttcggcgacaacaaggtgaagatggaggtgtgcagactgggcggcatcaagcacctggtggacctgctggaccacagagtgctggaggtgcagaagaacgcctgcggcgccctgagaaacctggtgttcggcaagagcaccgacgagaacaagatcgccatgaagaacgtgggcggcatccccgccctgctgagactgctgagaaagagcatcgacgccgaggtgagagagctggtgaccggcgtgctgtggaacctgagcagctgcgacgccgtgaagatgaccatcatcagagacgccctgagcaccctgaccaacaccgtgatcgtgccccacagcggctggaacaacagcagcttcgacgacgaccacaagatcaagttccagaccagcctggtgctgagaaacaccaccggctgcctgagaaacctgagcagcgccggcgaggaggccagaaagcagatgagaagctgcgagggcctggtggacagcctgctgtacgtgatccacacctgcgtgaacaccagcgactacgacagcaagaccgtggagaactgcgtgtgcaccctgagaaacctgagctacagactggagctggaggtgccccaggccagactgctgggcctgaacgagctggacgacctgctgggcaaggagagccccagcaaggacagcgagcccagctgctggggcaagaagaagaagaagaagaagagaaccccccaggaggaccagtgggacggcgtgggccccatccccggcctgagcaagagccccaagggcgtggagatgctgtggcaccccagcgtggtgaagccctacctgaccctgctggccgagagcagcaaccccgccaccctggagggcagcgccggcagcctgcagaacctgagcgccggcaactggaagttcgccgcctacatcagagccgccgtgagaaaggagaagggcctgcccatcctggtggagctgctgagaatggacaacgacagagtggtgagcagcgtggccaccgccctgagaaacatggccctggacgtgagaaacaaggagctgatcggcaagtacgccatgagagacctggtgaacagactgcccggcggcaacggccccagcgtgctgagcgacgagaccatggccgccatctgctgcgccctgcacgaggtgaccagcaagaacatggagaacgccaaggccctggccgacagcggcggcatcgagaagctggtgaacatcaccaagggcagaggcgacagaagcagcctgaaggtggtgaaggccgccgcccaggtgctgaacaccctgtggcagtacagagacctgagaagcatctacaagaaggacggctggaaccagaaccacttcatcacccccgtgagcaccctggagagagacagattcaagagccaccccagcctgagcaccaccaaccagcagatgagccccatcatccagagcggcagcagcaagcccagccccatctacatcagcagctacagcagccccgccagagagcagaacagaagactgcagcaccagcagctgtactacagccaggacgacagcaacagaaagaacttcgacgcctacagactgtacctgcagagcccccacagctacgaggacccctacttcgacgacagagtgcacttccccgccagcaccgactacagcacccagtacggcctgaagagcaccaccaactacgtggacttctacagcaccaagagacccagctacagagccgagcagtaccccggcagccccgacagctgggtgtag

SEQ ID NO: 93502 - DNA, 3579 bp, Artificial Sequence
  Description of Artificial Sequence: Synthetic coding sequence
atgcccgcccccgagcaggccagcctggtggaggagggccagccccagaccagacaggaggccgccagcaccggccccggcatggagcccgagaccaccgccaccaccatcctggccagcgtgaaggagcaggagctgcagttccagagactgaccagagagctggaggtggagagacagatcgtggccagccagctggagagatgcagactgggcgccgagagccccagcatcgccagcaccagcagcaccgagaagagcttcccctggagaagcaccgacgtgcccaacaccggcgtgagcaagcccagagtgagcgacgccgtgcagcccaacaactacctgatcagaaccgagcccgagcagggcaccctgtacagccccgagcagaccagcctgcacgagagcgagggcagcctgggcaacagcagaagcagcacccagatgaacagctacagcgacagcggctaccaggaggccggcagcttccacaacagccagaacgtgagcaaggccgacaacagacagcagcacagcttcatcggcagcaccaacaaccacgtggtgagaaacagcagagccgagggccagaccctggtgcagcccagcgtggccaacagagccatgagaagagtgagcagcgtgcccagcagagcccagagccccagctacgtgatcagcaccggcgtgagccccagcagaggcagcctgagaaccagcctgggcagcggcttcggcagccccagcgtgaccgaccccagacccctgaaccccagcgcctacagcagcaccaccctgcccgccgccagagccgccagcccctacagccagagacccgccagccccaccgccatcagaagaatcggcagcgtgaccagcagacagaccagcaaccccaacggccccaccccccagtaccagaccaccgccagagtgggcagccccctgaccctgaccgacgcccagaccagagtggccagccccagccagggccaggtgggcagcagcagccccaagagaagcggcatgaccgccgtgccccagcacctgggccccagcctgcagagaaccgtgcacgacatggagcagttcggccagcagcagtacgacatctacgagagaatggtgccccccagacccgacagcctgaccggcctgagaagcagctacgccagccagcacagccagctgggccaggacctgagaagcgccgtgagccccgacctgcacatcacccccatctacgagggcagaacctactacagccccgtgtacagaagccccaaccacggcaccgtggagctgcagggcagccagaccgccctgtacagaaccggcagcgtgggcatcggcaacctgcagagaaccagcagccagagaagcaccctgacctaccagagaaacaactacgccctgaacaccaccgccacctacgccgagccctacagacccatccagtacagagtgcaggagtgcaactacaacagactgcagcacgccgtgcccgccgacgacggcaccaccagaagccccagcatcgacagcatccagaaggaccccagagagttcgcctggagagaccccgagctgcccgaggtgatccacatgctgcagcaccagttccccagcgtgcaggccaacgccgccgcctacctgcagcacctgtgcttcggcgacaacaaggtgaagatggaggtgtgcagactgggcggcatcaagcacctggtggacctgctggaccacagagtgctggaggtgcagaagaacgcctgcggcgccctgagaaacctggtgttcggcaagagcaccgacgagaacaagatcgccatgaagaacgtgggcggcatccccgccctgctgagactgctgagaaagagcatcgacgccgaggtgagagagctggtgaccggcgtgctgtggaacctgagcagctgcgacgccgtgaagatgaccatcatcagagacgccctgagcaccctgaccaacaccgtgatcgtgccccacagcggctggaacaacagcagcttcgacgacgaccacaagatcaagttccagaccagcctggtgctgagaaacaccaccggctgcctgagaaacctgagcagcgccggcgaggaggccagaaagcagatgagaagctgcgagggcctggtggacagcctgctgtacgtgatccacacctgcgtgaacaccagcgactacgacagcaagaccgtggagaactgcgtgtgcaccctgagaaacctgagctacagactggagctggaggtgccccaggccagactgctgggcctgaacgagctggacgacctgctgggcaaggagagccccagcaaggacagcgagcccagctgctggggcaagaagaagaagaagaagaagagaaccccccaggaggaccagtgggacggcgtgggccccatccccggcctgagcaagagccccaagggcgtggagatgctgtggcaccccagcgtggtgaagccctacctgaccctgctggccgagagcagcaaccccgccaccctggagggcagcgccggcagcctgcagaacctgagcgccggcaactggaagttcgccgcctacatcagagccgccgtgagaaaggagaagggcctgcccatcctggtggagctgctgagaatggacaacgacagagtggtgagcagcgtggccaccgccctgagaaacatggccctggacgtgagaaacaaggagctgatcggcaagtacgccatgagagacctggtgaacagactgcccggcggcaacggccccagcgtgctgagcgacgagaccatggccgccatctgctgcgccctgcacgaggtgaccagcaagaacatggagaacgccaaggccctggccgacagcggcggcatcgagaagctggtgaacatcaccaagggcagaggcgacagaagcagcctgaaggtggtgaaggccgccgcccaggtgctgaacaccctgtggcagtacagagacctgagaagcatctacaagaaggacggctggaaccagaaccacttcatcacccccgtgagcaccctggagagagacagattcaagagccaccccagcctgagcaccaccaaccagcagatgagccccatcatccagagcgtgggcagcaccagcagcagccccgccctgctgggcatcagagaccccagaagcgagtacgacagaacccagccccccatgcagtactacaacagccagggcgacgccacccacaagggcctgtaccccggcagcagcaagcccagccccatctacatcagcagctacagcagccccgccagagagcagaacagaagactgcagcaccagcagctgtactacagccaggacgacagcaacagaaagaacttcgacgcctacagactgtacctgcagagcccccacagctacgaggacccctacttcgacgacagagtgcacttccccgccagcaccgactacagcacccagtacggcctgaagagcaccaccaactacgtggacttctacagcaccaagagacccagctacagagccgagcagtaccccggcagccccgacagctgggtgtag

SEQ ID NO: 93503 - DNA, 1845 bp, Artificial Sequence
  Description of Artificial Sequence: Synthetic coding sequence
atgaacagctacagcgacagcggctaccaggaggccggcagcttccacaacagccagaacgtgagcaaggccgacaacagacagcagcacagcttcatcggcagcaccaacaaccacgtggtgagaaacagcagagccgagggccagaccctggtgcagcccagcgtggccaacagagccatgagaagagtgagcagcgtgcccagcagagcccagagccccagctacgtgatcagcaccggcgtgagccccagcagaggcagcctgagaaccagcctgggcagcggcttcggcagccccagcgtgaccgaccccagacccctgaaccccagcgcctacagcagcaccaccctgcccgccgccagagccgccagcccctacagccagagacccgccagccccaccgccatcagaagaatcggcagcgtgaccagcagacagaccagcaaccccaacggccccaccccccagtaccagaccaccgccagagtgggcagccccctgaccctgaccgacgcccagaccagagtggccagccccagccagggccaggtgggcagcagcagccccaagagaagcggcatgaccgccgtgccccagcacctgggccccagcctgcagagaaccgtgcacgacatggagcagttcggccagcagcagtacgacatctacgagagaatggtgccccccagacccgacagcctgaccgcctacggcgtgcccatgctggtgagcatcgtgagcctgggcaagaccttcgtgctgccctgccccgacctgcacatcacccccatctacgagggcagaacctactacagccccgtgtacagaagccccaaccacggcaccgtggagctgcagggcagccagaccgccctgtacagaaccggcagcgtgggcatcggcaacctgcagagaaccagcagccagagaagcaccctgacctaccagagaaacaactacgccctgaacaccaccgccacctacgccgagccctacagacccatccagtacagagtgcaggagtgcaactacaacagactgcagcacgccgtgcccgccgacgacggcaccaccagaagccccagcatcgacagcatccagaaggaccccagagagttcgcctggagagaccccgagctgcccgaggtgatccacatgctgcagcaccagttccccagcgtgcaggccaacgccgccgcctacctgcagcacctgtgcttcggcgacaacaaggtgaagatggaggtgtgcagactgggcggcatcaagcacctggtggacctgctggaccacagagtgctggaggtgcagaagaacgcctgcggcgccctgagaaacctggtgttcggcaagagcaccgacgagaacaagatcgccatgaagaacgtgggcggcatccccgccctgctgagactgctgagaaagagcatcgacgccgaggtgagagagctggtgaccggcgtgctgtggaacctgagcagctgcgacgccgtgaagatgaccatcatcagagacgccctgagcaccctgaccaacaccgtgatcgtgccccacagcggctggaacaacagcagcttcgacgacgaccacaagatcaagttccagaccagcctggtgctgagaaacaccaccggctgcctgagaaacctgagcagcgccggcgaggaggccagaaagcagatgagaagctgcgagggcctggtggacagcctgctgtacgtgatccacacctgcgtgaacaccagcgactacgacagcaagaccgtggagaactgcgtgtgcaccctgagaaacctgatcggctggagctggagatgccccagacccggctactgggactag

SEQ ID NO: 93504 - DNA, 1329 bp, Artificial Sequence
  Description of Artificial Sequence: Synthetic coding sequence
atgggcctggccatggagcacggcggcagctacgccagagccggcggcagcagcagaggctgctggtactacctgagatacttcttcctgttcgtgagcctgatccagttcctgatcatcctgggcctggtgctgttcatggtgtacggcaacgtgcacgtgagcaccgagagcaacctgcaggccaccgagagaagagccgagggcctgtacagccagctgctgggcctgaccgccagccagagcaacctgaccaaggagctgaacttcaccaccagagccaaggacgccatcatgcagatgtggctgaacgccagaagagacctggacagaatcaacgccagcttcagacagtgccagggcgacagagtgatctacaccaacaaccagagatacatggccgccatcatcctgagcgagaagcagtgcagagaccagttcaaggacatgaacaagagctgcgacgccctgctgttcatgctgaaccagaaggtgaagaccctggaggtggagatcgccaaggagaagaccatctgcaccaaggacaaggagagcgtgctgctgaacaagagagtggccgaggagcagctggtggagtgcgtgaagaccagagagctgcagcaccaggagagacagctggccaaggagcagctgcagaaggtgcaggccctgtgcctgcccctggacaaggacaagttcgagatggacctgagaaacctgtggagagacagcatcatccccagaagcctggacaacctgggctacaacctgtaccaccccctgggcagcgagctggccagcatcagaagagcctgcgaccacatgcccagcctgatgagcagcaaggtggaggagctggccagaagcctgagagccgacatcgagagagtggccagagagaacagcgacctgcagagacagaagctggaggcccagcagggcctgagagccagccaggaggccaagcagaaggtggagaaggaggcccaggccagagaggccaagctgcaggccgagtgcagcagacagacccagctggccctggaggagaaggccgtgctgagaaaggagagagacaacctggccaaggagctggaggagaagaagagagaggccgagcagctgagaatggagctggccatcagaaacagcgccctggacacctgcatcaagaccaagagccagcccatgatgcccgtgagcagacccatgggccccgtgcccaacccccagcccatcgaccccgccagcctggaggagttcaagagaaagatcctggagagccagagaccccccgccggcatccccgtggcccccagcagcggctag

SEQ ID NO: 93505 - DNA, 291 bp, Artificial Sequence
  Description of Artificial Sequence: Synthetic coding sequence
atggagcacaaggaggtggtgctgctgctgctgctgttcctgaagagcggccagggcgagcccctggacgactacgtgaacacccagggccccagcctgttcagcgtgaccaagaagcagctgggcgccggcagcagagaggagtgcgccgccaagtgcgaggaggacaaggagttcacctgcagagccttccagtaccacagcaaggagcagcagtgcgtgatcatggccgagaacagaaagagcagcatcatcatcagaatgagagacgccgtgctgttcgagaagtag

SEQ ID NO: 93506 - DNA, 291 bp, Artificial Sequence; identical to SEQ ID NO: 93505
  Description of Artificial Sequence: Synthetic coding sequence

SEQ ID NO: 93507 - DNA, 291 bp, Artificial Sequence; identical to SEQ ID NO: 93505
  Description of Artificial Sequence: Synthetic coding sequence

SEQ ID NO: 93508 - DNA, 492 bp, Artificial Sequence
  Description of Artificial Sequence: Synthetic coding sequence
atggacgccctggagggcgagagcttcgccctgagcttcagcagcgccagcgacgccgagttcgacgccgtggtgggctacctggaggacatcatcatggacgacgagttccagctgctgcagagaaacttcatggacaagtactacctggagttcgaggacaccgaggagaacaagctgatctacacccccatcttcaacgagtacatcagcctggtggagaagtacatcgaggagcagctgctgcagagaatccccgagttcaacatggccgccttcaccaccaccctgcagcaccacaaggacgaggtggccggcgacatcttcgacatgctgctgaccttcaccgacttcctggccttcaaggagatgttcctggactacagagccgagaaggagggcagaggcctggacctgagcagcggcctggtggtgaccagcctgtgcaagagcagcagcctgcccgccagccagaacaacctgagacactag

SEQ ID NO: 93509 - DNA, 1890 bp, Artificial Sequence
  Description of Artificial Sequence: Synthetic coding sequence
atggagaacagcaccaccaccatcagcagagaggagctggaggagctgcaggaggccttcaacaagatcgacatcgacaacagcggctacgtgagcgactacgagctgcaggacctgttcaaggaggccagcctgcccctgcccggctacaaggtgagagagatcgtggagaagatcctgagcgtggccgacagcaacaaggacggcaagatcagcttcgaggagttcgtgagcctgatgcaggagctgaagagcaaggacatcagcaagaccttcagaaagatcatcaacaagagagagggcatcaccgccatcggcggcaccagcaccatcagcagcgagggcacccagcacagctacagcgaggaggagaaggtggccttcgtgaactggatcaacaaggccctggagaacgaccccgactgcaagcacctgatccccatgaaccccaacgacgacagcctgttcaagagcctggccgacggcatcctgctgtgcaagatgatcaacctgagcgagcccgacaccatcgacgagagagccatcaacaagaagaagctgacccccttcaccatcagcgagaacctgaacctggccctgaacagcgccagcgccatcggctgcaccgtggtgaacatcggcgccagcgacctgaaggagggcaagccccacctggtgctgggcctgctgtggcagatcatcaaggtgggcctgttcgccgacatcgagatcagcagaaacgaggccctgatcgccctgctgaacgagggcgaggagctggaggagctgatgaagctgagccccgaggagctgctgctgagatgggtgaactaccacctgaccaacgccggctggcacaccatcagcaacttcagccaggacatcaaggacagcagagcctacttccacctgctgaaccagatcgcccccaagggcggcgaggacggccccgccatcgccatcgacctgagcggcatcaacgagaccaacgacctgaagagagccggcctgatgctgcaggaggccgacaagctgggctgcaagcagttcgtgacccccgccgacgtggtgagcggcaaccccaagctgaacctggccttcgtggccaacctgttcaacacctacccctgcctgcacaagcccaacaacaacgacatcgacatgaacctgctggagggcgagagcaaggaggagagaaccttcagaaactggatgaacagcctgggcgtgaacccctacatcaaccacctgtacagcgacctggccgacgccctggtgatcttccagctgtacgagatgatcagagtgcccgtgaactggagccacgtgaacaagcccccctaccccgccctgggcggcaacatgaagaagatcgagaactgcaactacgccgtggagctgggcaagaacaaggccaagttcagcctggtgggcatcgccggccaggacctgaacgagggcaacagcaccctgaccctggccctggtgtggcagctgatgagaagatacaccctgaacgtgctgagcgacctgggcgagggcgagaaggtgaacgacgagatcatcatcaagtgggtgaaccagaccctgaagagcgccaacaagaagaccagcatcagcagcttcaaggacaagagcatcagcaccagcctgcccgtgctggacctgatcgacgccatcgcccccaacgccgtgagacaggagatgatcagaagagagaacctgagcgacgaggacaagctgaacaacgccaagtacgccatcagcgtggccagaaagatcggcgccagaatctacgccctgcccgacgacctggtggaggtgaagcccaagatggtgatgaccgtgttcgcctgcctgatgggcaagggcctgaacagaatcaagtag

SEQ ID NO: 93510 - DNA, 1890 bp, Artificial Sequence; identical to SEQ ID NO: 93509
  Description of Artificial Sequence: Synthetic coding sequence

SEQ ID NO: 93511 - DNA, 165 bp, Artificial Sequence
  Description of Artificial Sequence: Synthetic coding sequence
atggagaacagcaccaccaccatcagcagagaggagctggaggagctgcaggaggccttcaacaagatcgacatcgacaacagcggctacgtgagcgactacgagctgcaggacctgttcaaggaggccagcctgcccctgcccggctacaaggtgagagagtag

SEQ ID NO: 93512 - DNA, 363 bp, Artificial Sequence
  Description of Artificial Sequence: Synthetic coding sequence
atggagaacagcaccaccaccatcagcagagaggagctggaggagctgcaggaggccttcaacaagatcgacatcgacaacagcggctacgtgagcgactacgagctgcaggacctgttcaaggaggccagcctgcccctgcccggctacaaggtgagagagatcgtggagaagatcctgagcgtggccgacagcaacaaggacggcaagatcagcttcgaggagttcgtgagcctgatgcaggagctgaagagcaaggacatcagcaagaccttcagaaagatcatcaacaagagagagggcatcaccgccatcggcggcaccagcaccatcagcagcgagggcacccagcacagctactag

SEQ ID NO: 93513 - DNA, 360 bp, Artificial Sequence
  Description of Artificial Sequence: Synthetic coding sequence
atggagaacagcaccaccaccatcagcagagaggagctggaggagctgcaggaggccttcaacaagatcgacatcgacaacagcggctacgtgagcgactacgagctgcaggacctgttcaaggaggccagcctgcccctgcccggctacaaggtgagagagatcgtggagaagatcctgagcgtggccgacagcaacaaggacggcaagatcagcttcgaggagttcgtgagcctgatgcaggagctgaagagcaaggacatcagcaagaccttcagaaagatcatcaacaagagagagggcatcaccgccatcggcggcaccagcaccatcagcagcgagggcacccagcacagctag

SEQ ID NO: 93514 - DNA, 102 bp, Artificial Sequence
  Description of Artificial Sequence: Synthetic coding sequence
atggagaacagcaccaccaccatcagcagagaggagctggaggagctgcaggaggccttcaacaagatcgacatcgacaacagcggctacgtgagcgactag

SEQ ID NO: 93515 - DNA, 177 bp, Artificial Sequence
  Description of Artificial Sequence: Synthetic coding sequence
atggagaacagcaccaccaccatcagcagagaggagctggaggagctgcaggaggccttcaacaagatcgacatcgacaacagcggctacgtgagcgactacgagctgcaggacctgttcaaggaggccagcctgcccctgcccggctacaaggtgagagagatcgtggagaagtag

SEQ ID NO: 93516 - DNA, 1890 bp, Artificial Sequence; identical to SEQ ID NO: 93509
  Description of Artificial Sequence: Synthetic coding sequence

SEQ ID NO: 93517 - DNA, 162 bp, Artificial Sequence
  Description of Artificial Sequence: Synthetic coding sequence
atggagaacagcaccaccaccatcagcagagaggagctggaggagctgcaggaggccttcaacaagatcgacatcgacaacagcggctacgtgagcgactacgagctgcaggacctgttcaaggaggccagcctgcccctgcccggctacaaggtgagatag

SEQ ID NO: 93518 - DNA, 1785 bp, Artificial Sequence
  Description of Artificial Sequence: Synthetic coding sequence
atgcccctgcccggctacaaggtgagagagatcatccagaagctgatgctggacggcgacagaaacaaggacggcaagatcagcttcgacgagttcgtgtacatcttccaggaggtgaagagcagcgacatcgccaagaccttcagaaaggccatcaacagaaaggagggcatctgcgccctgggcggcaccagcgagctgagcagcgagggcacccagcacagctacagcgaggaggagaagtacgccttcgtgaactggatcaacaaggccctggagaacgaccccgactgcagacacgtgatccccatgaaccccaacaccgacgacctgttcaaggccgtgggcgacggcatcgtgctgtgcaagatgatcaacctgagcgtgcccgacaccatcgacgagagagccatcaacaagaagaagctgacccccttcatcatccaggagaacctgaacctggccctgaacagcgccagcgccatcggctgccacgtggtgaacatcggcgccgaggacctgagagccggcaagccccacctggtgctgggcctgctgtggcagatcatcaagatcggcctgttcgccgacatcgagctgagcagaaacgaggccctggccgccctgctgagagacggcgagaccctggaggagctgatgaagctgagccccgaggagctgctgctgagatgggccaacttccacctggagaacagcggctggcagaagatcaacaacttcagcgccgacatcaagctgatcgacttcagcaacagcgtgaaggacagcaaggcctacttccacctgctgaaccagatcgcccccaagggccagaaggagggcgagcccagaatcgacatcaacatgagcggcttcaacgagaccgacgacctgaagagagccgagagcatgctgcagcaggccgacaagctgggctgcagacagttcgtgacccccgccgacgtggtgagcggcaaccccaagctgaacctggccttcgtggccaacctgttcaacaagtaccccgccctgaccaagcccgagaaccaggacatcgactggaccctgctggagggcgagaccagagaggagagaaccttcagaaactggatgaacagcctgggcgtgaacccccacgtgaaccacctgtacgccgacctgcaggacgccctggtgatcctgcagctgtacgagagaatcaaggtgcccgtggactggagcaaggtgaacaagcccccctaccccaagctgggcgccaacatgaagaagctggagaactgcaactacgccgtggagctgggcaagcaccccgccaagttcagcctggtgggcatcggcggccaggacctgaacgacggcaaccagaccctgaccctggccctggtgtggcagctgatgagaagatacaccctgaacgtgctggaggacctgggcgacggccagaaggccaacgacgacatcatcgtgaactgggtgaacagaaccctgagcgaggccggcaagagcaccagcatccagagcttcaaggacaagaccatcagcagcagcctggccgtggtggacctgatcgacgccatccagcccggctgcatcaactacgacctggtgaagagcggcaacctgaccgaggacgacaagcacaacaacgccaagtacgccgtgagcatggccagaagaatcggcgccagagtgtacgccctgcccgaggacctggtggaggtgaagcccaagatggtgatgaccgtgttcgcctgcctgatgggcagaggcatgaagagagtgtag

SEQ ID NO: 93519 - DNA, 1893 bp, Artificial Sequence
  Description of Artificial Sequence: Synthetic coding sequence
atggacgagatggccaccacccagatcagcaaggacgagctggacgagctgaaggaggccttcgccaaggtggacctgaacagcaacggcttcatctgcgactacgagctgcacgagctgttcaaggaggccaacatgcccctgcccggctacaaggtgagagagatcatccagaagctgatgctggacggcgacagaaacaaggacggcaagatcagcttcgacgagttcgtgtacatcttccaggaggtgaagagcagcgacatcgccaagaccttcagaaaggccatcaacagaaaggagggcatctgcgccctgggcggcaccagcgagctgagcagcgagggcacccagcacagctacagcgaggaggagaagtacgccttcgtgaactggatcaacaaggccctggagaacgaccccgactgcagacacgtgatccccatgaaccccaacaccgacgacctgttcaaggccgtgggcgacggcatcgtgctgtgcaagatgatcaacctgagcgtgcccgacaccatcgacgagagagccatcaacaagaagaagctgacccccttcatcatccaggagaacctgaacctggccctgaacagcgccagcgccatcggctgccacgtggtgaacatcggcgccgaggacctgagagccggcaagccccacctggtgctgggcctgctgtggcagatcatcaagatcggcctgttcgccgacatcgagctgagcagaaacgaggccctggccgccctgctgagagacggcgagaccctggaggagctgatgaagctgagccccgaggagctgctgctgagatgggccaacttccacctggagaacagcggctggcagaagatcaacaacttcagcgccgacatcaaggacagcaaggcctacttccacctgctgaaccagatcgcccccaagggccagaaggagggcgagcccagaatcgacatcaacatgagcggcttcaacgagaccgacgacctgaagagagccgagagcatgctgcagcaggccgacaagctgggctgcagacagttcgtgacccccgccgacgtggtgagcggcaaccccaagctgaacctggccttcgtggccaacctgttcaacaagtaccccgccctgaccaagcccgagaaccaggacatcgactggaccctgctggagggcgagaccagagaggagagaaccttcagaaactggatgaacagcctgggcgtgaacccccacgtgaaccacctgtacgccgacctgcaggacgccctggtgatcctgcagctgtacgagagaatcaaggtgcccgtggactggagcaaggtgaacaagcccccctaccccaagctgggcgccaacatgaagaagctggagaactgcaactacgccgtggagctgggcaagcaccccgccaagttcagcctggtgggcatcggcggccaggacctgaacgacggcaaccagaccctgaccctggccctggtgtggcagctgatgagaagatacaccctgaacgtgctggaggacctgggcgacggccagaaggccaacgacgacatcatcgtgaactgggtgaacagaaccctgagcgaggccggcaagagcaccagcatccagagcttcaaggacaagaccatcagcagcagcctggccgtggtggacctgatcgacgccatccagcccggctgcatcaactacgacctggtgaagagcggcaacctgaccgaggacgacaagcacaacaacgccaagtacgccgtgagcatggccagaagaatcggcgccagagtgtacgccctgcccgaggacctggtggaggtgaagcccaagatggtgatgaccgtgttcgcctgcctgatgggcagaggcatgaagagagtgtag

SEQ ID NO: 93520 - DNA, 1893 bp, Artificial Sequence; identical to SEQ ID NO: 93519
  Description of Artificial Sequence: Synthetic coding sequence

SEQ ID NO: 93521 - DNA, 1854 bp, Artificial Sequence
  Description of Artificial Sequence: Synthetic coding sequence
atggaggacctgaacagcaacggcttcatctgcgactacgagctgcacgagctgttcaaggaggccaacatgcccctgcccggctacaaggtgagagagatcatccagaagctgatgctggacggcgacagaaacaaggacggcaagatcagcttcgacgagttcgtgtacatcttccaggaggtgaagagcagcgacatcgccaagaccttcagaaaggccatcaacagaaaggagggcatctgcgccctgggcggcaccagcgagctgagcagcgagggcacccagcacagctacagcgaggaggagaagtacgccttcgtgaactggatcaacaaggccctggagaacgaccccgactgcagacacgtgatccccatgaaccccaacaccgacgacctgttcaaggccgtgggcgacggcatcgtgctgtgcaagatgatcaacctgagcgtgcccgacaccatcgacgagagagccatcaacaagaagaagctgacccccttcatcatccaggagaacctgaacctggccctgaacagcgccagcgccatcggctgccacgtggtgaacatcggcgccgaggacctgagagccggcaagccccacctggtgctgggcctgctgtggcagatcatcaagatcggcctgttcgccgacatcgagctgagcagaaacgaggccctggccgccctgctgagagacggcgagaccctggaggagctgatgaagctgagccccgaggagctgctgctgagatgggccaacttccacctggagaacagcggctggcagaagatcaacaacttcagcgccgacatcaagctgatcgacttcagcaacagcgtgaaggacagcaaggcctacttccacctgctgaaccagatcgcccccaagggccagaaggagggcgagcccagaatcgacatcaacatgagcggcttcaacgagaccgacgacctgaagagagccgagagcatgctgcagcaggccgacaagctgggctgcagacagttcgtgacccccgccgacgtggtgagcggcaaccccaagctgaacctggccttcgtggccaacctgttcaacaagtaccccgccctgaccaagcccgagaaccaggacatcgactggaccctgctggagggcgagaccagagaggagagaaccttcagaaactggatgaacagcctgggcgtgaacccccacgtgaaccacctgtacgccgacctgcaggacgccctggtgatcctgcagctgtacgagagaatcaaggtgcccgtggactggagcaaggtgaacaagcccccctaccccaagctgggcgccaacatgaagaagctggagaactgcaactacgccgtggagctgggcaagcaccccgccaagttcagcctggtgggcatcggcggccaggacctgaacgacggcaaccagaccctgaccctggccctggtgtggcagctgatgagaagatacaccctgaacgtgctggaggacctgggcgacggccagaaggccaacgacgacatcatcgtgaactgggtgaacagaaccctgagcgaggccggcaagagcaccagcatccagagcttcaaggacaagaccatcagcagcagcctggccgtggtggacctgatcgacgccatccagcccggctgcatcaactacgacctggtgaagagcggcaacctgaccgaggacgacaagcacaacaacgccaagtacgccgtgagcatggccagaagaatcggcgccagagtgtacgccctgcccgaggacctggtggaggtgaagcccaagatggtgatgaccgtgttcgcctgcctgatgggcagaggcatgaagagagtgtag

SEQ ID NO: 93522 - DNA, 1758 bp, Artificial Sequence
  Description of Artificial Sequence: Synthetic coding sequence
atgcccctgcccggctacaaggtgagagagatcatccagaagctgatgctggacggcgacagaaacaaggacggcaagatcagcttcgacgagttcgtgtacatcttccaggaggtgaagagcagcgacatcgccaagaccttcagaaaggccatcaacagaaaggagggcatctgcgccctgggcggcaccagcgagctgagcagcgagggcacccagcacagctacagcgaggaggagaagtacgccttcgtgaactggatcaacaaggccctggagaacgaccccgactgcagacacgtgatccccatgaaccccaacaccgacgacctgttcaaggccgtgggcgacggcatcgtgctgtgcaagatgatcaacctgagcgtgcccgacaccatcgacgagagagccatcaacaagaagaagctgacccccttcatcatccaggagaacctgaacctggccctgaacagcgccagcgccatcggctgccacgtggtgaacatcggcgccgaggacctgagagccggcaagccccacctggtgctgggcctgctgtggcagatcatcaagatcggcctgttcgccgacatcgagctgagcagaaacgaggccctggccgccctgctgagagacggcgagaccctggaggagctgatgaagctgagccccgaggagctgctgctgagatgggccaacttccacctggagaacagcggctggcagaagatcaacaacttcagcgccgacatcaaggacagcaaggcctacttccacctgctgaaccagatcgcccccaagggccagaaggagggcgagcccagaatcgacatcaacatgagcggcttcaacgagaccgacgacctgaagagagccgagagcatgctgcagcaggccgacaagctgggctgcagacagttcgtgacccccgccgacgtggtgagcggcaaccccaagctgaacctggccttcgtggccaacctgttcaacaagtaccccgccctgaccaagcccgagaaccaggacatcgactggaccctgctggagggcgagaccagagaggagagaaccttcagaaactggatgaacagcctgggcgtgaacccccacgtgaaccacctgtacgccgacctgcaggacgccctggtgatcctgcagctgtacgagagaatcaaggtgcccgtggactggagcaaggtgaacaagcccccctaccccaagctgggcgccaacatgaagaagctggagaactgcaactacgccgtggagctgggcaagcaccccgccaagttcagcctggtgggcatcggcggccaggacctgaacgacggcaaccagaccctgaccctggccctggtgtggcagctgatgagaagatacaccctgaacgtgctggaggacctgggcgacggccagaaggccaacgacgacatcatcgtgaactgggtgaacagaaccctgagcgaggccggcaagagcaccagcatccagagcttcaaggacaagaccatcagcagcagcctggccgtggtggacctgatcgacgccatccagcccggctgcatcaactacgacctggtgaagagcggcaacctgaccgaggacgacaagcacaacaacgccaagtacgccgtgagcatggccagaagaatcggcgccagagtgtacgccctgcccgaggacctggtggaggtgaagcccaagatggtgatgaccgtgttcgcctgcctgatgggcagaggcatgaagagagtgtag

SEQ ID NO: 93523 - DNA, 675 bp, Artificial Sequence
  Description of Artificial Sequence: Synthetic coding sequence
atgaacagcctgggcgtgaacccccacgtgaaccacctgtacgccgacctgcaggacgccctggtgatcctgcagctgtacgagagaatcaaggtgcccgtggactggagcaaggtgaacaagcccccctaccccaagctgggcgccaacatgaagaagctggagaactgcaactacgccgtggagctgggcaagcaccccgccaagttcagcctggtgggcatcggcggccaggacctgaacgacggcaaccagaccctgaccctggccctggtgtggcagctgatgagaagatacaccctgaacgtgctggaggacctgggcgacggccagaaggccaacgacgacatcatcgtgaactgggtgaacagaaccctgagcgaggccggcaagagcaccagcatccagagcttcaaggacaagaccatcagcagcagcctggccgtggtggacctgatcgacgccatccagcccggctgcatcaactacgacctggtgaagagcggcaacctgaccgaggacgacaagcacaacaacgccaagtacgccgtgagcatggccagaagaatcggcgccagagtgtacgccctgcccgaggacctggtggaggtgaagcccaagatggtgatgaccgtgttcgcctgcctgatgggcagaggcatgaagagagtgtag

SEQ ID NO: 93524 - DNA, 306 bp, Artificial Sequence
  Description of Artificial Sequence: Synthetic coding sequence
atgagcagcgccgccggcttctgcgccagcagacccggcctgctgttcctgggcctgctgctgctgcccctggtggtggccttcgccagcgccgaggccgaggaggacggcgacctgcagtgcctgtgcgtgaagaccaccagccaggtgagacccagacacatcaccagcctggaggtgatcaaggccggcccccactgccccaccgcccagctgatcgccaccctgaagaacggcagaaagatctgcctggacctgcaggcccccctgtacaagaagatcatcaagaagctgctggagagctag

SEQ ID NO: 93525 - DNA, 405 bp, Artificial Sequence
  Description of Artificial Sequence: Synthetic coding sequence
atgaagagcctgacctggatcctgggcctgtgggccctggccgcctgcttcacccccggcgagagccagagaggccccagaggcccctacccccccggccccctggccccccccccccccccctgcttccccttcggcaccggcttcgtgccccccccccacccccccccctacggccccggcagattccccccccccctgagccccccctacggccccggcagaatcccccccagccccccccccccctacggccccggcagaatccagagccacagcctgccccccccctacggccccggctacccccagccccccagccagcccagaccctacccccccggcccccccttcttccccgtgaacagccccaccgaccccgccctgcccacccccgccccctag

SEQ ID NO: 93526 - DNA, 399 bp, Artificial Sequence
  Description of Artificial Sequence: Synthetic coding sequence
atgagccagggcgacagcaaccccgccgccatcccccacgccgccgaggacatccagggcgacgacagatggatgagccagcacaacagattcgtgctggactgcaaggacaaggagcccgacgtgctgttcgtgggcgacagcatggtgcagctgatgcagcagtacgagatctggagagagctgttcagccccctgcacgccctgaacttcggcatcggcggcgacaccaccagacacgtgctgtggagactgaagaacggcgagctggagaacatcaagcccaaggtgatcgtggtgtgggtgggcaccaacaaccacgagaacaccgccgaggaggtggccggcggcatcgaggccatcgtgcagctgatcaacaccagacagccccaggcctag

SEQ ID NO: 93527 - DNA, 690 bp, Artificial Sequence
  Description of Artificial Sequence: Synthetic coding sequence
atgagccagggcgacagcaaccccgccgccatcccccacgccgccgaggacatccagggcgacgacagatggatgagccagcacaacagattcgtgctggactgcaaggacaaggagcccgacgtgctgttcgtgggcgacagcatggtgcagctgatgcagcagtacgagatctggagagagctgttcagccccctgcacgccctgaacttcggcatcggcggcgacaccaccagacacgtgctgtggagactgaagaacggcgagctggagaacatcaagcccaaggtgatcgtggtgtgggtgggcaccaacaaccacgagaacaccgccgaggaggtggccggcggcatcgaggccatcgtgcagctgatcaacaccagacagccccaggccaagatcatcgtgctgggcctgctgcccagaggcgagaagcccaaccccctgagacagaagaacgccaaggtgaaccagctgctgaaggtgagcctgcccaagctggccaacgtgcagctgctggacaccgacggcggcttcgtgcacagcgacggcgccatcagctgccacgacatgttcgacttcctgcacctgaccggcggcggctacgccaagatctgcaagcccctgcacgagctgatcatgcagctgctggaggagacccccgaggagaagcagaccaccatcgcctag

SEQ ID NO: 93528 - DNA, 468 bp, Artificial Sequence
  Description of Artificial Sequence: Synthetic coding sequence
atgagccagggcgacagcaaccccgccgccatcccccacgccgccgaggacatccagggcgacgacagatggatgagccagcacaacagattcgtgctggactgcaaggacaaggagcccgacgtgctgttcgtgggcgacagcatggtgcagctgatgcagcagtacgagatctggagagagctgttcagccccctgcacgccctgaacttcggcatcggcggcgacaccaccagacacgtgctgtggagactgaagaacggcgagctggagaacatcaagcccaaggtgatcgtggtgtgggtgggcaccaacaaccacgagaacaccgccgaggaggtggccggcggcatcgaggccatcgtgcagctgatcaacaccagacagccccaggccaagatcatcgtgctgatcatctactggcaggacgagcaggactaccacgagagaaaggtgcagatggactag

SEQ ID NO: 93529 - DNA, 609 bp, Artificial Sequence
  Description of Artificial Sequence: Synthetic coding sequence
atgagccagggcgacagcaaccccgccgccatcccccacgccgccgaggacatccagggcgacgacagatggatgagccagcacaacagattcgtgctggactgcaaggacaaggagcccgacgtgctgttcgtgggcgacagcatggtgcagctgatgcagcagtacgagatctggagagagctgttcagccccctgcacgccctgaacttcggcatcggcggcgacaccaccagacacgtgctgtggagactgaagaacggcgagctggagaacatcaagcccaaggtgatcgtggtgtgggtgggcaccaacaaccacgagaacaccgccgaggaggtggccggcggcatcgaggccatcgtgcagctgatcaacaccagacagccccaggccaagatcatcgtgctgggcaaggccgccgccagcaagtacagcatcagcgagatcgtgagactggagcagggcagcgtgaactggagcatcggcacctaccccgacgacacccccgccaccaccagacccgccatcctgcagctgttcaccggcaagatgagcagaatcaccatgaaggagaagagcagatggaccgaggagatcctgcactag

SEQ ID NO: 93530 - DNA, 696 bp, Artificial Sequence
  Description of Artificial Sequence: Synthetic coding sequence
atgagcggcgaggagaaccccgccagcaagcccacccccgtgcaggacgtgcagggcgacggcagatggatgagcctgcaccacagattcgtggccgacagcaaggacaaggagcccgaggtggtgttcatcggcgacagcctggtgcagctgatgcaccagtgcgagatctggagagagctgttcagccccctgcacgccctgaacttcggcatcggcggcgacggcacccagcacgtgctgtggagactggagaacggcgagctggagcacatcagacccaagatcgtggtggtgtgggtgggcaccaacaaccacggccacaccgccgagcaggtgaccggcggcatcaaggccatcgtgcagctggtgaacgagagacagccccaggccagagtggtggtgctgggcctgctgcccagaggccagcaccccaaccccctgagagagaagaacagacaggtgaacgagctggtgagagccgccctggccggccaccccagagcccacttcctggacgccgaccccggcttcgtgcacagcgacggcaccatcagccaccacgacatgtacgactacctgcacctgagcagactgggctacacccccgtgtgcagagccctgcacagcctgctgctgagactgctggcccaggaccagggccagggcgcccccctgctggagcccgccccctag

SEQ ID NO: 93531 - DNA, 696 bp, Artificial Sequence; identical to SEQ ID NO: 93530
  Description of Artificial Sequence: Synthetic coding sequence

SEQ ID NO: 93532 - DNA, 720 bp, Artificial Sequence
  Description of Artificial Sequence: Synthetic coding sequence
atgaccatcaagctgtgggacttccagggcttcgagtgcatcagaaccatgcacggccacgaccacaacgtgagcagcgtggccatcatgcccaacggcgaccacatcgtgagcgccagcagagacaagaccatcaagatgtgggaggtgcagaccggctactgcgtgaagaccttcaccggccacagagagtgggtgagaatggtgagacccaaccaggacggcaccctgatcgccagctgcagcaacgaccagaccgtgagagtgtgggtggtggccaccaaggagtgcaaggccgagctgagagagcacgagcacgtggtggagtgcatcagctgggcccccgagagcagctacagcagcatcagcgaggccaccggcagcgagaccaagaagagcggcaagcccggccccttcctgctgagcggcagcagagacaagaccatcaagatgtgggacgtgagcaccggcatgtgcctgatgaccctggtgggccacgacaactgggtgagaggcgtgctgttccacagcggcggcaagttcatcctgagctgcgccgacgacaagaccctgagagtgtgggactacaagaacaagagatgcatgaagaccctgaacgcccacgagcacttcgtgaccagcctggacttccacaagaccgccccctacgtggtgaccggcagcgtggaccagaccgtgaaggtgtgggagtgcagatag

SEQ ID NO: 93533 - DNA, 1233 bp, Artificial Sequence
  Description of Artificial Sequence: Synthetic coding sequence
atggtgctgagccagagacagagagacgagctgaacagagccatcgccgactacctgagaagcaacggctacgaggaggcctacagcgtgttcaagaaggaggccgagctggacgtgaacgaggagctggacaagaagtacgccggcctgctggagaagaagtggaccagcgtgatcagactgcagaagaaggtgatggagctggagagcaagctgaacgaggccaaggaggagttcaccagcggcggccccctgggccagaagagagaccccaaggagtggatccccagaccccccgagaagtacgccctgagcggccacagaagccccgtgaccagagtgatcttccaccccgtgttcagcgtgatggtgagcgccagcgaggacgccaccatcaaggtgtgggactacgagaccggcgacttcgagagaaccctgaagggccacaccgacagcgtgcaggacatcagcttcgaccacagcggcaagctgctggccagctgcagcgccgacatgaccatcaagctgtgggacttccagggcttcgagtgcatcagaaccatgcacggccacgaccacaacgtgagcagcgtggccatcatgcccaacggcgaccacatcgtgagcgccagcagagacaagaccatcaagatgtgggaggtgcagaccggctactgcgtgaagaccttcaccggccacagagagtgggtgagaatggtgagacccaaccaggacggcaccctgatcgccagctgcagcaacgaccagaccgtgagagtgtgggtggtggccaccaaggagtgcaaggccgagctgagagagcacgagcacgtggtggagtgcatcagctgggcccccgagagcagctacagcagcatcagcgaggccaccggcagcgagaccaagaagagcggcaagcccggccccttcctgctgagcggcagcagagacaagaccatcaagatgtgggacgtgagcaccggcatgtgcctgatgaccctggtgggccacgacaactgggtgagaggcgtgctgttccacagcggcggcaagttcatcctgagctgcgccgacgacaagaccctgagagtgtgggactacaagaacaagagatgcatgaagaccctgaacgcccacgagcacttcgtgaccagcctggacttccacaagaccgccccctacgtggtgaccggcagcgtggaccagaccgtgaaggtgtgggagtgcagatag

SEQ ID NO: 93534 - DNA, 618 bp, Artificial Sequence
  Description of Artificial Sequence: Synthetic coding sequence
atgaccatcaagctgtgggacttccagggcttcgagtgcatcagaaccatgcacggccacgaccacaacgtgagcagcgtggccatcatgcccaacggcgaccacatcgtgagcgccagcagagacaagaccatcaagatgtgggaggtgcagaccggctactgcgtgaagaccttcaccggccacagagagtgggtgagaatggtgagacccaaccaggacggcaccctgatcgccagctgcagcaacgaccagaccgtgagagtgtgggtggtggccaccaaggagtgcaaggccgagctgagagagcacgagcacgtggtggagtgcatcagctgggcccccgagagcagctacagcagcatcagcgaggccaccggcagcgaggtgggccacgacaactgggtgagaggcgtgctgttccacagcggcggcaagttcatcctgagctgcgccgacgacaagaccctgagagtgtgggactacaagaacaagagatgcatgaagaccctgaacgcccacgagcacttcgtgaccagcctggacttccacaagaccgccccctacgtggtgaccggcagcgtggaccagaccgtgaaggtgtgggagtgcagatag

SEQ ID NO: 93535 - DNA, 1029 bp, Artificial Sequence
  Description of Artificial Sequence: Synthetic coding sequence
atggagccccacgacagcagccacatggacagcgagttcagatacaccctgttccccatcgtgtacagcatcatcttcgtgctgggcgtgatcgccaacggctacgtgctgtgggtgttcgccagactgtacccctgcaagaagttcaacgagatcaagatcttcatggtgaacctgaccatggccgacatgctgttcctgatcaccctgcccctgtggatcgtgtactaccagaaccagggcaactggatcctgcccaagttcctgtgcaacgtggccggctgcctgttcttcatcaacacctactgcagcgtggccttcctgggcgtgatcacctacaacagattccaggccgtgaccagacccatcaagaccgcccaggccaacaccagaaagagaggcatcagcctgagcctggtgatctgggtggccatcgtgggcgccgccagctacttcctgatcctggacagcaccaacaccgtgcccgacagcgccggcagcggcaacgtgaccagatgcttcgagcactacgagaagggcagcgtgcccgtgctgatcatccacatcttcatcgtgttcagcttcttcctggtgttcctgatcatcctgttctgcaacctggtgatcatcagaaccctgctgatgcagcccgtgcagcagcagagaaacgccgaggtgaagagaagagccctgtggatggtgtgcaccgtgctggccgtgttcatcatctgcttcgtgccccaccacgtggtgcagctgccctggaccctggccgagctgggcttccaggacagcaagttccaccaggccatcaacgacgcccaccaggtgaccctgtgcctgctgagcaccaactgcgtgctggaccccgtgatctactgcttcctgaccaagaagttcagaaagcacctgaccgagaagttctacagcatgagaagcagcagaaagtgcagcagagccaccaccgacaccgtgaccgaggtggtggtgcccttcaaccagatccccggcaacagcctgaagaactag

SEQ ID NO: 93536 - DNA, 1029 bp, Artificial Sequence; identical to SEQ ID NO: 93535
  Description of Artificial Sequence: Synthetic coding sequence

SEQ ID NO: 93537 - DNA, 1029 bp, Artificial Sequence; identical to SEQ ID NO: 93535
  Description of Artificial Sequence: Synthetic coding sequence

SEQ ID NO: 93538 - DNA, 1128 bp, Artificial Sequence
  Description of Artificial Sequence: Synthetic coding sequence
atgaaggtgtggctgctgctgggcctgctgctggtgcacgaggccctggaggacgtgaccggccagcacctgcccaagaacaagagacccaaggagcccggcgagaacagaatcaagcccaccaacaagaaggtgaagcccaagatccccaagatgaaggacagagacagcgccaacagcgcccccaagacccagagcatcatgatgcaggtgctggacaagggcagattccagaagcccgccgccaccctgagcctgctggccggccagaccgtggagctgagatgcaagggcagcagaatcggctggagctaccccgcctacctggacaccttcaaggacagcagactgagcgtgaagcagaacgagagatacggccagctgaccctggtgaacagcaccagcgccgacaccggcgagttcagctgctgggtgcagctgtgcagcggctacatctgcagaaaggacgaggccaagaccggcagcacctacatcttcttcaccgagaagggcgagctgttcgtgcccagccccagctacttcgacgtggtgtacctgaaccccgacagacaggccgtggtgccctgcagagtgaccgtgctgagcgccaaggtgaccctgcacagagagttccccgccaaggagatccccgccaacggcaccgacatcgtgtacgacatgaagagaggcttcgtgtacctgcagccccacagcgagcaccagggcgtggtgtactgcagagccgaggccggcggcagaagccagatcagcgtgaagtaccagctgctgtacgtggccgtgcccagcggcccccccagcaccaccatcctggccagcagcaacaaggtgaagagcggcgacgacatcagcgtgctgtgcaccgtgctgggcgagcccgacgtggaggtggagttcacctggatcttccccggccagaaggacgagagacccgtgaccatccaggacacctggagactgatccacagaggcctgggccacaccaccagaatcagccagagcgtgatcaccgtggaggacttcgagaccatcgacgccggctactacatctgcaccgcccagaacctgcagggccagaccaccgtggccaccaccgtggagttcagctag

SEQ ID NO: 93539 - DNA, 1128 bp, Artificial Sequence; identical to SEQ ID NO: 93538
  Description of Artificial Sequence: Synthetic coding sequence

SEQ ID NO: 93540 - DNA, 1128 bp, Artificial Sequence; identical to SEQ ID NO: 93538
  Description of Artificial Sequence: Synthetic coding sequence

SEQ ID NO: 93541 - DNA, 3075 bp, Artificial Sequence
  Description of Artificial Sequence: Synthetic coding sequence
atggcccagggcgccatgagattctgcagcgagggcgactgcgccatcagcccccccagatgccccagaagatggctgcccgagggccccgtgccccagagcccccccgccagcatgtacggcagcaccggcagcctgctgagaagagtggccggccccggccccagaggcagagagctgggcagagtgaccgccccctgcacccccctgagaggcccccccagccccagagtggcccccagcccctgggcccccagcagccccaccggccagcccccccccggcgcccagagcagcgtggtgatcttcagattcgtggagaaggccagcgtgagacccctgaacggcctgcccgcccccggcggcctgagcagaagctgggacctgggcggcgtgagcccccccagacccacccccgccctgggccccggcagcaacagaaagctgagactggaggccagcaccagcgaccccctgcccgccagaggcggcagcgccctgcccggcagcagaaacctggtgcacggcccccccgcccccccccaggtgggcgccgacggcctgtacagcagcctgcccaacggcctgggcggcccccccgagagactggccaccctgttcggcggccccgccgacaccggcttcctgaaccagggcgacacctggagcagccccagagaggtgagcagccacgcccagagaatcgccagagccaagtgggagttcttctacggcagcctggacccccccagcagcggcgccaagccccccgagcaggccccccccagcccccccggcgtgggcagcagacagggcagcggcgtggccgtgggcagagccgccaagtacagcgagaccgacctggacaccgtgcccctgagatgctacagagagaccgacatcgacgaggtgctggccgagagagaggaggccgacagcgccatcgagagccagcccagcagcgagggcccccccggcaccgcctacccccccgcccccagacccggccccctgcccggcccccaccccagcctgggcagcggcaacgaggacgaggacgacgacgaggccggcggcgaggaggacgtggacgacgaggtgttcgaggccagcgagggcgccagacccggcagcagaatgcccctgaagagccccgtgcccttcctgcccggcaccagccccagcgccgacggccccgacagcttcagctgcgtgttcgaggccatcctggagagccacagagccaagggcaccagctacaccagcctggccagcctggaggccctggccagccccggccccacccagagccccttcttcaccttcgagctgcccccccagccccccgcccccagacccgacccccccgcccccgcccccctggcccccctggagcccgacagcggcaccagcagcgccgccgacggcccctggacccagagaggcgaggaggaggaggccgaggccagagccaagctggcccccggcagagagccccccagcccctgccacagcgaggacagcctgggcctgggcgccgcccccctgggcagcgagccccccctgagccagctggtgagcgacagcgacagcgagctggacagcaccgagagactggccctgggcagcaccgacaccctgagcaacggccagaaggccgacctggaggccgcccagagactggccaagagactgtacagactggacggcttcagaaaggccgacgtggccagacacctgggcaagaacaacgacttcagcaagctggtggccggcgagtacctgaagttcttcgtgttcaccggcatgaccctggaccaggccctgagagtgttcctgaaggagctggccctgatgggcgagacccaggagagagagagagtgctggcccacttcagccagagatacttccagtgcaaccccgaggccctgagcagcgaggacggcgcccacaccctgacctgcgccctgatgctgctgaacaccgacctgcacggccacaacatcggcaagagaatgacctgcggcgacttcatcggcaacctggagggcctgaacgacggcggcgacttccccagagagctgctgaaggccctgtacagcagcatcaagaacgagaagctgcagtgggccatcgacgaggaggagctgagaagaagcctgagcgagctggccgaccccaaccccaaggtgatcaagagaatcagcggcggcagcggcagcggcagcagccccttcctggacctgacccccgagcccggcgccgccgtgtacaagcacggcgccctggtgagaaaggtgcacgccgaccccgactgcagaaagacccccagaggcaagagaggctggaagagcttccacggcatcctgaagggcatgatcctgtacctgcagaaggaggagtacaagcccggcaaggccctgagcgagaccgagctgaagaacgccatcagcatccaccacgccctggccaccagagccagcgactacagcaagagaccccacgtgttctacctgagaaccgccgactggagagtgttcctgttccaggcccccagcctggagcagatgcagagctggatcaccagaatcaacgtggtggccgccatgttcagcgccccccccttccccgccgccgtgagcagccagaagaagttcagcagacccctgctgcccagcgccgccaccagactgagccaggaggagcaggtgagaacccacgaggccaagctgaaggccatggccagcgagctgagagagcacagagccgcccagctgggcaagaagggcagaggcaaggaggccgaggagcagagacagaaggaggcctacctggagttcgagaagagcagatacagcacctacgccgccctgctgagagtgaagctgaaggccggcagcgaggagctggacgccgtggaggccgccctggcccaggccggcagcaccgaggacggcctgccccccagccacagcagccccagcctgcagcccaagcccagcagccagcccagagcccagagacacagcagcgagcccagacccggcgccggcagcggcagaagaaagccctag

SEQ ID NO: 93542 - DNA, 3075 bp, Artificial Sequence; identical to SEQ ID NO: 93541
  Description of Artificial Sequence: Synthetic coding sequence

SEQ ID NO: 93543 - DNA, 2784 bp, Artificial Sequence
  Description of Artificial Sequence: Synthetic coding sequence
cagatctggagatgccccctgcagcaccacgccgagagcgccccccccctgcccgccctgagctgggcccagcccctgctgtgcctgagcagcgtgagcgccctgggcgagcagagacccacccccgccctgggccccggcagcaacagaaagctgagactggaggccagcaccagcgaccccctgcccgccagaggcggcagcgccctgcccggcagcagaaacctggtgcacggcccccccgcccccccccaggtgggcgccgacggcctgtacagcagcctgcccaacggcctgggcggcccccccgagagactggccaccctgttcggcggccccgccgacaccggcttcctgaaccagggcgacacctggagcagccccagagaggtgagcagccacgcccagagaatcgccagagccaagtgggagttcttctacggcagcctggacccccccagcagcggcgccaagccccccgagcaggccccccccagcccccccggcgtgggcagcagacagggcagcggcgtggccgtgggcagagccgccaagtacagcgagaccgacctggacaccgtgcccctgagatgctacagagagaccgacatcgacgaggtgctggccgagagagaggaggccgacagcgccatcgagagccagcccagcagcgagggcccccccggcaccgcctacccccccgcccccagacccggccccctgcccggcccccaccccagcctgggcagcggcaacgaggacgaggacgacgacgaggccggcggcgaggaggacgtggacgacgaggtgttcgaggccagcgagggcgccagacccggcagcagaatgcccctgaagagccccgtgcccttcctgcccggcaccagccccagcgccgacggccccgacagcttcagctgcgtgttcgaggccatcctggagagccacagagccaagggcaccagctacaccagcctggccagcctggaggccctggccagccccggccccacccagagccccttcttcaccttcgagctgcccccccagccccccgcccccagacccgacccccccgcccccgcccccctggcccccctggagcccgacagcggcaccagcagcgccgccgacggcccctggacccagagaggcgaggaggaggaggccgaggccagagccaagctggcccccggcagagagccccccagcccctgccacagcgaggacagcctgggcctgggcgccgcccccctgggcagcgagccccccctgagccagctggtgagcgacagcgacagcgagctggacagcaccgagagactggccctgggcagcaccgacaccctgagcaacggccagaaggccgacctggaggccgcccagagactggccaagagactgtacagactggacggcttcagaaaggccgacgtggccagacacctgggcaagaacaacgacttcagcaagctggtggccggcgagtacctgaagttcttcgtgttcaccggcatgaccctggaccaggccctgagagtgttcctgaaggagctggccctgatgggcgagacccaggagagagagagagtgctggcccacttcagccagagatacttccagtgcaaccccgaggccctgagcagcgaggacggcgcccacaccctgacctgcgccctgatgctgctgaacaccgacctgcacggccacaacatcggcaagagaatgacctgcggcgacttcatcggcaacctggagggcctgaacgacggcggcgacttccccagagagctgctgaaggccctgtacagcagcatcaagaacgagaagctgcagtgggccatcgacgaggaggagctgagaagaagcctgagcgagctggccgaccccaaccccaaggtgatcaagagaatcagcggcggcagcggcagcggcagcagccccttcctggacctgacccccgagcccggcgccgccgtgtacaagcacggcgccctggtgagaaaggtgcacgccgaccccgactgcagaaagacccccagaggcaagagaggctggaagagcttccacggcatcctgaagggcatgatcctgtacctgcagaaggaggagtacaagcccggcaaggccctgagcgagaccgagctgaagaacgccatcagcatccaccacgccctggccaccagagccagcgactacagcaagagaccccacgtgttctacctgagaaccgccgactggagagtgttcctgttccaggcccccagcctggagcagatgcagagctggatcaccagaatcaacgtggtggccgccatgttcagcgccccccccttccccgccgccgtgagcagccagaagaagttcagcagacccctgctgcccagcgccgccaccagactgagccaggaggagcaggtgagaacccacgaggccaagctgaaggccatggccagcgagctgagagagcacagagccgcccagctgggcaagaagggcagaggcaaggaggccgaggagcagagacagaaggaggcctacctggagttcgagaagagcagatacagcacctacgccgccctgctgagagtgaagctgaaggccggcagcgaggagctggacgccgtggaggccgccctggcccaggccggcagcaccgaggacggcctgccccccagccacagcagccccagcctgcagcccaagcccagcagccagcccagagcccagagacacagcagcgagcccagacccggcgccggcagcggcagaagaaagccctag

SEQ ID NO: 93544 - DNA, 1542 bp, Artificial Sequence
  Description of Artificial Sequence: Synthetic coding sequence
atgggcagcagctggtgcctgtacggctgctgcaacgccggcgtgaagaccaccagactggaggcccacagcgagatgggcagcaccgagatcctggagaaggagacccccgagaacctgagcaacggcaccagcagcaacgtggaggccgccaagagactggccaagagactgtaccagctggacagattcaagagaagcgacgtggccaagcacctgggcaagaacaacgagttcagcaagctggtggccgaggagtacctgaagttcttcgacttcaccggcatgaccctggaccagagcctgagatacttcttcaaggccttcagcctggtgggcgagacccaggagagagagagagtgctgatccacttcagcaacagatacttctactgcaaccccgacaccatcgccagccaggacggcgtgcactgcctgacctgcgccatcatgctgctgaacaccgacctgcacggccacaacatcggcaagaagatgacctgccaggagttcatcgccaacctgcagggcgtgaacgagggcgtggacttcagcaaggacctgctgaaggccctgtacaacagcatcaagaacgagaagctggagtgggccgtggacgacgaggagaagaagaagagccccagcgagagcaccgaggagaaggccaacggcacccaccccaagaccatcagcagaatcggcagcaccaccaaccccttcctggacatcccccacgaccccaacgccgccgtgtacaagagcggcttcctggccagaaagatccacgccgacatggacggcaagaagacccccagaggcaagagaggctggaagaccttctacgccgtgctgaagggcaccgtgctgtacctgcagaaggacgagtacaagcccgagaaggccctgagcgaggaggacctgaagaacgccgtgagcgtgcaccacgccctggccagcaaggccaccgactacgagaagaagcccaacgtgttcaagctgaagaccgccgactggagagtgctgctgttccagacccagagccccgaggagatgcagggctggatcaacaagatcaactgcgtggccgccgtgttcagcgccccccccttccccgccgccatcggcagccagaagaagttcagcagacccctgctgcccgccaccaccaccaagctgagccaggaggagcagctgaagagccacgagagcaagctgaagcagatcaccaccgagctggccgagcacagaagctacccccccgacaagaaggtgaaggccaaggacgtggacgagtacaagctgaaggaccactacctggagttcgagaagaccagatacgagatgtacgtgagcatcctgaaggagggcggcaaggagctgctgagcaacgacgagagcgaggccgccggcctgaagaagagccacagcagccccagcctgaaccccgacaccagccccatcaccgccaaggtgaagagaaacgtgagcgagagaaaggaccacagacccgagacccccagcatcaagcagaaggtgacctag

SEQ ID NO: 93545 - DNA, 3144 bp, Artificial Sequence
  Description of Artificial Sequence: Synthetic coding sequence
atggagggcagaagcgccgccgccgagaccttcgtgtgggtgaacaacgccagcgcccacagccagagcgtggccaaggccaagtacgagttcctgttcggcagaagcgagggcaaggcccccgacaccagcgaccacggcggcagcaccctgctgccccccaacgtgaccaacgagttccccgagtacggcaccatggaggagggcggcgagggcctgagagccagcctggagttcgacggcgaggccctgccctgccacccccaggagcagcagggcgtgcagcccctgaccggctgccacagcggcctggacagcgtgaccgagggccccaaggacgtgagagaggcccccagccagagccacctgaaggagcagagcctgcagcccatcgacagcctgatcagcgccctgaaggccaccgaggccagaatcatcagcggcaccctgcaggccaccaaggtgctggaccaggacgccgtgagcagcttcagcgtgcagcaggtggagaaggagctggacaccgccagcagaaagacccagagagtgaacaagaccctgcccgccggccagaagaacctgcccgagatccccctgagcgccgaggtgaccaccgaggagagcttctacctgagcatccagaaggacctgaccgccctgctgaccggcgacacccaggccgagatcagccagatcatgaacaacggcagaaagggcgccgtgtgcgtgcaggagcccagctgccccctggccagcctgggcagcagcgccgtgacctgccacagcgccggcagcgtgggcttcctgaaggagcagagaagcgccctgggcagagagcaccccggcggctgcgacagaagcagcagcatgggcagacccggcagagtgaagcacgtggagttccagggcgtggagatcctgtggaccggcggcgacaagagagagacccagcaccccatcgacttcgagaccagcctgcagagaaccgccagccccgacagcaaggagagcagcaaggtgcccagacacctgatcagcagcgccggcctgtgcaacagcagcagcctgaccgagaacgtgtgggacgagagctggaaggcccccagcgagagacccggcaccagcagcggcaccttcagccccgtgagactggacgagagcggcgaggacgaggtgttcctgcaggagaacaagcagcacctggagaagacccccaagcccgagagagacagagagagaatcagcgagcaggaggagcacgtgaagggcgaggacgaggacatcctgggccccggctacaccgaggacagcaccgacgtgtacagcagccagttcgagaccatcctggacaacaccagcctgtactacagcgccgagagcctggagaccctgtacagcgagcccgacagctacttcagcttcgagatgcccctgacccccatgatccagcagagaatcaaggagggcggccagttcctggagagaaccagcggcggcggccaccaggacatcctgagcgtgagcgccgacggcggcatcgtgatgggctacagcagcggcgtgaccaacggcctgaacgacgccagcgacagcatctacaccaagggcacccccgagatcgccttctggggcagcaacgccggcgtgaagaccaccagactggaggcccacagcgagatgggcagcaccgagatcctggagaaggagacccccgagaacctgagcaacggcaccagcagcaacgtggaggccgccaagagactggccaagagactgtaccagctggacagattcaagagaagcgacgtggccaagcacctgggcaagaacaacgagttcagcaagctggtggccgaggagtacctgaagttcttcgacttcaccggcatgaccctggaccagagcctgagatacttcttcaaggccttcagcctggtgggcgagacccaggagagagagagagtgctgatccacttcagcaacagatacttctactgcaaccccgacaccatcgccagccaggacggcgtgcactgcctgacctgcgccatcatgctgctgaacaccgacctgcacggccacaacatcggcaagaagatgacctgccaggagttcatcgccaacctgcagggcgtgaacgagggcgtggacttcagcaaggacctgctgaaggccctgtacaacagcatcaagaacgagaagctggagtgggccgtggacgacgaggagaagaagaagagccccagcgagagcaccgaggagaaggccaacggcacccaccccaagaccatcagcagaatcggcagcaccaccaaccccttcctggacatcccccacgaccccaacgccgccgtgtacaagagcggcttcctggccagaaagatccacgccgacatggacggcaagaagacccccagaggcaagagaggctggaagaccttctacgccgtgctgaagggcaccgtgctgtacctgcagaaggacgagtacaagcccgagaaggccctgagcgaggaggacctgaagaacgccgtgagcgtgcaccacgccctggccagcaaggccaccgactacgagaagaagcccaacgtgttcaagctgaagaccgccgactggagagtgctgctgttccagacccagagccccgaggagatgcagggctggatcaacaagatcaactgcgtggccgccgtgttcagcgccccccccttccccgccgccatcggcagccagaagaagttcagcagacccctgctgcccgccaccaccaccaagctgagccaggaggagcagctgaagagccacgagagcaagctgaagcagatcaccaccgagctggccgagcacagaagctacccccccgacaagaaggtgaaggccaaggacgtggacgagtacaagctgaaggaccactacctggagttcgagaagaccagatacgagatgtacgtgagcatcctgaaggagggcggcaaggagctgctgagcaacgacgagagcgaggccgccggcctgaagaagagccacagcagccccagcctgaaccccgacaccagccccatcaccgccaaggtgaagagaaacgtgagcgagagaaaggaccacagacccgagacccccagcatcaagcagaaggtgacctag

SEQ ID NO: 93546 - DNA, 810 bp, Artificial Sequence
  Description of Artificial Sequence: Synthetic coding sequence
atgatcggcgtgaacagcgtgcagagcgccagcaaggtgagagtgagaaccagcggcagcgtgaagtacagcagagaggacagcatcagaagacagagccacagaagcaagagcatgaagatcagcaacagcagcgagttcagcgccaaggagaacaaggccctgtacaacagcatcaagaacgagaagctggagtgggccgtggacgacgaggagaagaagaagagccccagcgagagcaccgaggagaaggccaacggcacccaccccaagaccatcagcagaatcggcagcaccaccaaccccttcctggacatcccccacgaccccaacgccgccgtgtacaagagcggcttcctggccagaaagatccacgccgacatggacggcaagaagacccccagaggcaagagaggctggaagaccttctacgccgtgctgaagggcaccgtgctgtacctgcagaagcacgagagcaagctgaagcagatcaccaccgagctggccgagcacagaagctacccccccgacaagaaggtgaaggccaaggacgtggacgagtacaagctgaaggaccactacctggagttcgagaagaccagatacgagatgtacgtgagcatcctgaaggagggcggcaaggagctgctgagcaacgacgagagcgaggccgccggcctgaagaagagccacagcagccccagcctgaaccccgacaccagccccatcaccgccaaggtgaagagaaacgtgagcgagagaaaggaccacagacccgagacccccagcatcaagcagaaggtgacctag

SEQ ID NO: 93547 - DNA, 3150 bp, Artificial Sequence
  Description of Artificial Sequence: Synthetic coding sequence
atggagggcagaagcgccgccgccgagaccttcgtgtgggtgaacaacgccagcgcccacagccagagcgtggccaaggccaagtacgagttcctgttcggcagaagcgagggcaaggcccccgacaccagcgaccacggcggcagcaccctgctgccccccaacgtgaccaacgagttccccgagtacggcaccatggaggagggcggcgagggcctgagagccagcctggagttcgacggcgaggccctgccctgccacccccaggagcagcagggcgtgcagcccctgaccggctgccacagcggcctggacagcgtgaccgagggccccaaggacgtgagagaggcccccagccagagccacctgaaggagcagagcctgcagcccatcgacagcctgatcagcgccctgaaggccaccgaggccagaatcatcagcggcaccctgcaggccaccaaggtgctggaccaggacgccgtgagcagcttcagcgtgcagcaggtggagaaggagctggacaccgccagcagaaagacccagagagtgaacaagaccctgcccgccggccagaagaacctgcccgagatccccctgagcgccgaggtgaccaccgaggagagcttctacctgagcatccagaaggacctgaccgccctgctgaccggcgacacccaggccgagatcagccagatcatgaacaacggcagaaagggcgccgtgtgcgtgcaggagcccagctgccccctggccagcctgggcagcagcgccgtgacctgccacagcgccggcagcgtgggcttcctgaaggagcagagaagcgccctgggcagagagcaccccggcggctgcgacagaagcagcagcatgggcagacccggcagagtgaagcacgtggagttccagggcgtggagatcctgtggaccggcggcgacaagagagagacccagcaccccatcgacttcgagaccagcctgcagagaaccgccagccccgacagcaaggagagcagcaaggtgcccagacacctgatcagcagcgccggcctgtgcaacagcagcagcctgaccgagaacgtgtgggacgagagctggaaggcccccagcgagagacccggcaccagcagcggcaccttcagccccgtgagactggacgagagcggcgaggacgaggtgttcctgcaggagaacaagcagcacctggagaagacccccaagcccgagagagacagagagagaatcagcgagcaggaggagcacgtgaagggcgaggacgaggacatcctgggccccggctacaccgaggacagcaccgacgtgtacagcagccagttcgagaccatcctggacaacaccagcctgtactacagcgccgagagcctggagaccctgtacagcgagcccgacagctacttcagcttcgagatgcccctgacccccatgatccagcagagaatcaaggagggcggccagttcctggagagaaccagcggcggcggccaccaggacatcctgagcgtgagcgccgacggcggcatcgtgatgggctacagcagcggcgtgaccaacggcctgaacgacgccagcgacagcatctacaccaagggcacccccgagatcgccttctggggcagcaacgccggcgtgaagaccaccagactggaggcccacagcgagatgggcagcaccgagatcctggagaaggagacccccgagaacctgagcaacggcaccagcagcaacgtggaggccgccaagagactggccaagagactgtaccagctggacagattcaagagaagcgacgtggccaagcacctgggcaagaacaacgagttcagcaagctggtggccgaggagtacctgaagttcttcgacttcaccggcatgaccctggaccagagcctgagatacttcttcaaggccttcagcctggtgggcgagacccaggagagagagagagtgctgatccacttcagcaacagatacttctactgcaaccccgacaccatcgccagccaggacggcgtgcactgcctgacctgcgccatcatgctgctgaacaccgacctgcacggccacgtgagcaacatcggcaagaagatgacctgccaggagttcatcgccaacctgcagggcgtgaacgagggcgtggacttcagcaaggacctgctgaaggccctgtacaacagcatcaagaacgagaagctggagtgggccgtggacgacgaggagaagaagaagagccccagcgagagcaccgaggagaaggccaacggcacccaccccaagaccatcagcagaatcggcagcaccaccaaccccttcctggacatcccccacgaccccaacgccgccgtgtacaagagcggcttcctggccagaaagatccacgccgacatggacggcaagaagacccccagaggcaagagaggctggaagaccttctacgccgtgctgaagggcaccgtgctgtacctgcagaaggacgagtacaagcccgagaaggccctgagcgaggaggacctgaagaacgccgtgagcgtgcaccacgccctggccagcaaggccaccgactacgagaagaagcccaacgtgttcaagctgaagaccgccgactggagagtgctgctgttccagacccagagccccgaggagatgcagggctggatcaacaagatcaactgcgtggccgccgtgttcagcgccccccccttccccgccgccatcggcagccagaagaagttcagcagacccctgctgcccgccaccaccaccaagctgagccaggaggagcagctgaagagccacgagagcaagctgaagcagatcaccaccgagctggccgagcacagaagctacccccccgacaagaaggtgaaggccaaggacgtggacgagtacaagctgaaggaccactacctggagttcgagaagaccagatacgagatgtacgtgagcatcctgaaggagggcggcaaggagctgctgagcaacgacgagagcgaggccgccggcctgaagaagagccacagcagccccagcctgaaccccgacaccagccccatcaccgccaaggtgaagagaaacgtgagcgagagaaaggaccacagacccgagacccccagcatcaagcagaaggtgacctag

SEQ ID NO: 93548 - DNA, 3171 bp, Artificial Sequence
  Description of Artificial Sequence: Synthetic coding sequence
atgatgggcgactacagactgcccgaccacccccagcccatggagatcctgaacctgtacctgggcgacagcctggagccccaccccggcgagtgccccagagagacctgcagccacgaggacccccccgagcccttcgaggagcagacctgggccaccgacccccccgagcccaccagacagaacgtgcccccctggggcagcggcgtggagctgacccacctgggcagctgggtgcaccaggacggcctggagccctgccaggagcagaccagagccaccgacccccccgagagcaccagacaggacgcccccccctggggcagcggcgtggagctgacccacctgggcagccccagcgcccagagagagcacagacagaacaccgccagccccggcagccccgtgaacagccacctgcccggcagccccaagcagaacagaagcaccagcacccaggtggtgttctgggccggcatcctgcaggcccagatgtgcgtgctggacctggaggaggagctggagaagaccgagggcctgaaggccggcctgaagtgctgcctgcccaccccccccgtggacctgcccggcgacaccggcctgcacagcagcccccccgagaacgaggacagcggcgaggacagcagcgagcccgagggcgagggccaggcctggctgagagagggcacccccgacagcagcccccagtggggcgccgaggaggagagcatgttcttcagcaaccccctgttcctggccagcccctgcagcgagaacagcgccagcggcgagtgcttcagctggggcgccagcgacagccacgccggcgtgagaaccggccccgagagccccgccaccctggagccccccctgcccgaggacaccgtgctgtgggagctggagagcgagcccgacctgggcgacggcgccgccatcagcggccactgcaccccccccttccccgtgcccatctacaagccccacagcatctgctgggccagcgtggccgccgccgagggcgcccccgccgccccccccggccacggcgagagcgagggcgacagactgggccccgcccccagcgccgccccctgcgtggacgaggccctgacctgggagagcggctgcgtgggcagcgacctgggccccgccgcccaccccgtgcagccctgggccagcctgagccccgagggctggcagagaggcggccccttctggccccaggtgaccctgaacagccaggacagagacgagagagagggcggccacccccaggagagcctgccctgcaccctggccccctgcccctggagaagccccgccagcagccccgagcccagcagccccgagagcgagagcagaggccccggccccagacccagccccgccagcagccaggagggcagcccccagctgcagcaccacagcagcggcatcctgcccaagtggaccctggacgccagccagagcagcctgctggagaccgacggcgagcagcccagcagcctgaagaagaaggaggccggcgaggcccccaagcccggcgaggaggtgaagagcgagggcaccgccagacccgccgagaccggcgacgtgcagcccgacatccacctgaccagcgccgagcacgagaacctgagaacccccatgaacagcagctggctgcccggcagccccatgccccaggcccagagccccgaggagggccagagaccccccgccggcgacaagctggccaacggcgtgagaaacaacaaggtggcctggaacctggccagcagactgtacagactggagggcttcagaaagagcgaggtggccgcctacctgcagaagaacaacgacttcagcagagccgtggccgaggagtacctgagcttcttccagttcggcggccagagcctggacagagccctgagaagcttcctgcaggccctggtgctgagcggcgagacccaggagagagagagaatcctgtaccagttcagcagaagattccaccactgcaaccccggcatcttccccagcgtggacagcgtgcacaccctgacctgcgccatcatgctgctgaacaccgacctgcacggccagaacatcggcaagagcatgagctgccaggagttcatcaccaacctgaacggcctgagagacggcggcaacttccccaaggagctgctgaaggccctgtactggagcatcagaagcgagaagctggagtgggccgtggacgaggaggacaccgccagacccgagaaggcccagcccagcctgcccgccggcaagatgagcaagcccttcctgcagctggcccaggaccccaccgtgcccacctacaagcagggcatcctggccagaaagatgcaccaggacgccgacggcaagaagaccccctggggcaagagaggctggaagatgttccacaccctgctgagaggcatggtgctgtacttcctgaagcagggcgaggaccactgcctggagggcgagagcctggtgggccagatggtggacgagcccgtgggcgtgcaccacagcctggccacccccgccacccactacaccaagaagccccacgtgttccagctgagaaccgccgactggagactgtacctgttccaggcccccaccgccaaggagatgagcagctggatcgccagaatcaacctggccgccgccacccacagcgccccccccttccccgccgccgtgggcagccagagaagattcgtgagacccatcctgcccgtgggccccgcccagagcagcctggaggagcagcacagaagccacgagaactgcctggacgccgccgccgacgacctgctggacctgcagagaaacctgcccgagagaagaggcagaggcagagagctggaggagcacagactgagaaaggagtacctggagtacgagaagaccagatacgagacctacgtgcagctgctggtggccagactgcactgccccagcgacgccctggacctgtgggaggagcagctgggcagagaggccggcggcaccagagagcccaagctgagcctgaagaagagccacagcagccccagcctgcaccaggacgaggcccccaccaccgccaaggtgaagagaaacatcagcgagagaagaacctacagaaagatcatccccaagagaaacagaaaccagctgtag

SEQ ID NO: 93549 - DNA, 1152 bp, Artificial Sequence
  Description of Artificial Sequence: Synthetic coding sequence
atgccctacgtggacagacagaacagaatctgcggcttcctggacatcgaggagaacgagaacagcggcaagttcctgagaagatacttcatcctggacaccagagaggacagcttcgtgtggtacatggacaacccccagaacctgcccagcggcagcagcagagtgggcgccatcaagctgacctacatcagcaaggtgagcgacgccaccaagctgagacccaaggccgagttctgcttcgtgatgaacgccggcatgagaaagtacttcctgcaggccaacgaccagcaggacctggtggagtgggtgaacgtgctgaacaaggccatcaagatcaccgtgcccaagcagagcgacagccagcccaacagcgacaacctgagcagacacggcgagtgcggcaagaagcaggtgagctacagaaccgacatcgtgggcggcgtgcccatcatcacccccacccagaaggaggaggtgaacgagtgcggcgagagcatcgacagaaacaacctgaagagaagccagagccacctgccctacttcacccccaagcccccccaggacagcgccgtgatcaaggccggctactgcgtgaagcagggcgccgtgatgaagaactggaagagaagatacttccagctggacgagaacaccatcggctacttcaagagcgagctggagaaggagcccctgagagtgatccccctgaaggaggtgcacaaggtgcaggagtgcaagcagagcgacatcatgatgagagacaacctgttcgagatcgtgaccaccagcagaaccttctacgtgcaggccgacagccccgaggagatgcacagctggatcaaggccgtgagcggcgccatcgtggcccagagaggccccggcagaagcgccagcagcatgagacaggccagaagactgagcaacccctgcatccagagaagcatcccccccgtgctgcagaaccccaacaccctgagcgtgctgcccacccagcccccccccccccacatcccccagcccctggccgccaccctgtggagccagcccctgccctggagaagcgaggacttcaccagcctgctgcccagaagcagccagggcaccagcagaagcagactgagcctgcaggagaaccagctgcccaagtag

SEQ ID NO: 93550 - DNA, 1152 bp, Artificial Sequence; identical to SEQ ID NO: 93549
  Description of Artificial Sequence: Synthetic coding sequence

SEQ ID NO: 93551 - DNA, 1215 bp, Artificial Sequence
  Description of Artificial Sequence: Synthetic coding sequence
atgccctacgtggacagacagaacagaatctgcggcttcctggacatcgaggagaacgagaacagcggcaagttcctgagaagatacttcatcctggacaccagagaggacagcttcgtgtggtacatggacaacccccagaacctgcccagcggcagcagcagagtgggcgccatcaagctgacctacatcagcaaggtgagcgacgccaccaagctgagacccaaggccgagttctgcttcgtgatgaacgccggcatgagaaagtacttcctgcaggccaacgaccagcaggacctggtggagtgggtgaacgtgctgaacaaggccatcaagatcaccgtgcccaagcagagcgacagccagcccaacagcgacaacctgagcagacacggcgagtgcggcaagaagcaggtgagctacagaaccgacatcgtgggcggcgtgcccatcatcacccccacccagaaggaggaggtgaacgagtgcggcgagagcatcgacagaaacaacctgaagagaagccagagccacctgccctacttcacccccaagcccccccaggacagcgccgtgatcaaggccggctactgcgtgaagcagggcgccgtgatgaagaactggaagagaagatacttccagctggacgagaacaccatcggctacttcaagagcgagctggagaaggagcccctgagagtgatccccctgaaggaggtgcacaaggtgcaggagtgcaagcagagcgacatcatgatgagagacaacctgttcgagatcgtgaccaccagcagaaccttctacgtgcaggccgacagccccgaggagatgcacagctggatcaaggccgtgagcggcgccatcgtggcccagagaggccccggcagaagcgccagcagcgagcacccccccggccccagcgagagcaagcacgccttcagacccaccaacgccgccaccgccaccagccacagcaccgccagcagaagcaacagcctggtgagcaccttcaccatggagaagagaggcttctacgagagcctggccaaggtgaagcccggcaacttcaaggtgcagaccgtgagccccagagagcccgccagcaaggtgaccgagcaggccctgctgagaccccagagcaagaacggcccccaggagaaggactgcgacctggtggacctggacgacgccagcctgcccgtgagcgacgtgtag

SEQ ID NO: 93552 - DNA, 345 bp, Artificial Sequence
  Description of Artificial Sequence: Synthetic coding sequence
atgccctacgtggacagacagaacagaatctgcggcttcctggacatcgaggagaacgagaacagcggcaagttcctgagaagatacttcatcctggacaccagagaggacagcttcgtgtggtacatggacaacccccagaacctgcccagcggcagcagcagagtgggcgccatcaagctgacctacatcagcaaggtgagcgacgccaccaagctgagacccaaggccgagttctgcttcgtgatgaacgccggcatgagaaagtacttcctgcaggccaacgaccagcaggacctggtggagtgggtgaacgtgctgaacaaggccatcaagatcacctag

SEQ ID NO: 93553 - DNA, 1215 bp, Artificial Sequence; identical to SEQ ID NO: 93551
  Description of Artificial Sequence: Synthetic coding sequence

SEQ ID NO: 93554 - DNA, 1215 bp, Artificial Sequence; identical to SEQ ID NO: 93551
  Description of Artificial Sequence: Synthetic coding sequence

SEQ ID NO: 93555 - DNA, 1005 bp, Artificial Sequence
  Description of Artificial Sequence: Synthetic coding sequence
atgccctacgtggacagacagaacagaatctgcggcttcctggacatcgaggagaacgagaacagcggcaagttcctgagaagatacttcatcctggacaccagagaggacagcttcgtgtggtacatggacaacccccagaacctgcccagcggcagcagcagagtgggcgccatcaagctgacctacatcagcaaggtgagcgacgccaccaagctgagacccaaggccgagttctgcttcgtgatgaacgccggcatgagaaagtacttcctgcaggccaacgaccagcaggacctggtggagtgggtgaacgtgctgaacaaggccatcaagatcaccgtgcccaagcagagcgacagccagcccaacagcgacaacctgagcagacacggcgagtgcggcaagaagcaggtgagctacagaaccgacatcgtgggcggcgtgcccatcatcacccccacccagaaggaggaggtgaacgagtgcggcgagagcatcgacagaaacaacctgaagagaagccagagccacctgccctacttcacccccaagcccccccaggacagcgccgtgatcaaggccggctactgcgtgaagcagggcgccgtgatgaagaactggaagagaagatacttccagctggacgagaacaccatcggctacttcaagagcgagctggagaaggagcccctgagagtgatccccctgaaggaggtgcacaaggtgcaggagtgcaagcagagcgacatcatgatgagagacaacctgttcgagatcgtgaccaccagcagaaccttctacgtgcaggccgacagccccgaggagatgcacagctggatcaaggccgtgagcggcgccatcgtggcccagagaggccccggcagaagcgccagcagcatgagacaggccagaagactgagcaacccctgcatccagagatacaccagcagagccggcgagtgcagcacctacgtgggcagccacgccaacgtgcccagctag

SEQ ID NO: 93556 - DNA, 1278 bp, Artificial Sequence
  Description of Artificial Sequence: Synthetic coding sequence
atgccctacgtggacagacagaacagaatctgcggcttcctggacatcgaggagcacgagaacagcggcaagttcctgagaagatacttcatcctggacacccaggccaactgcctgctgtggtacatggacaacccccagaacctggccatgggcgccggcgccgtgggcgccctgcagctgacctacatcagcaaggtgagcatcgccacccccaagcagaagcccaagacccccttctgcttcgtgatcaacgccctgagccagagatacttcctgcaggccaacgaccagaaggacatgaaggactgggtggaggccctgaaccaggccagcaagatcaccgtgcccaagggcggcggcctgcccatgaccaccgaggtgctgaagagcctggccgccccccccgccctggagaagaagccccaggtggcctacaagaccgagatcatcggcggcgtggtggtgcacacccccatcagccagaacggcggcgacggccaggagggcagcgagcccggcagccacaccatcctgagaagaagccagagctacatccccaccagcggctgcagagccagcaccggcccccccctgatcaagagcggctactgcgtgaagcagggcaacgtgagaaagagctggaagagaagattcttcgccctggacgacttcaccatctgctacttcaagtgcgagcaggacagagagcccctgagaaccatcttcctgaaggacgtgctgaagacccacgagtgcctggtgaagagcggcgacctgctgatgagagacaacctgttcgagatcatcaccagcagcagaaccttctacgtgcaggccgacagccccgaggacatgcacagctggatcaaggagatcggcgccgccgtgcaggccctgaagtgccaccccagagagaccagcttcagcagaagcatcagcctgaccagacccggcagcagcagcctgagcagcggccccaacagcatcctgtgcagaggcagaccccccctggaggagaagaaggccctgtgcaaggcccccagcgtggccagcagctggcagccctggacccccgtgccccaggccggcgagaagctgctgccccccggcgacaccagcgaggacagcctgttcacccccagacccggcgagggcagcgcccccggcgtgctgcccagcagcagaatcagacacagaagcgagccccagcaccccaaggagaagcccttcatgttcaacctggacgacgagaacatcagaaccagcgacgtgtag

SEQ ID NO: 93557 - DNA, 348 bp, Artificial Sequence
  Description of Artificial Sequence: Synthetic coding sequence
atgccctacgtggacagacagaacagaatctgcggcttcctggacatcgaggagcacgagaacagcggcaagttcctgagaagatacttcatcctggacacccaggccaactgcctgctgtggtacatggacaacccccagaacctggccatgggcgccggcgccgtgggcgccctgcagctgacctacatcagcaaggtgagcatcgccacccccaagcagaagcccaagacccccttctgcttcgtgatcaacgccctgagccagagatacttcctgcaggccaacgaccagaaggacatgaaggactgggtggaggccctgaaccaggccagcaagatcacctag

SEQ ID NO: 93558 - DNA, 1128 bp, Artificial Sequence
  Description of Artificial Sequence: Synthetic coding sequence
atgggcgccggcgccgtgggcgccctgcagctgacctacatcagcaaggtgagcatcgccacccccaagcagaagcccaagacccccttctgcttcgtgatcaacgccctgagccagagatacttcctgcaggccaacgaccagaaggacatgaaggactgggtggaggccctgaaccaggccagcaagatcaccgtgcccaagggcggcggcctgcccatgaccaccgaggtgctgaagagcctggccgccccccccgccctggagaagaagccccaggtggcctacaagaccgagatcatcggcggcgtggtggtgcacacccccatcagccagaacggcggcgacggccaggagggcagcgagcccggcagccacaccatcctgagaagaagccagagctacatccccaccagcggctgcagagccagcaccggcccccccctgatcaagagcggctactgcgtgaagcagggcaacgtgagaaagagctggaagagaagattcttcgccctggacgacttcaccatctgctacttcaagtgcgagcaggacagagagcccctgagaaccatcttcctgaaggacgtgctgaagacccacgagtgcctggtgaagagcggcgacctgctgatgagagacaacctgttcgagatcatcaccagcagcagaaccttctacgtgcaggccgacagccccgaggacatgcacagctggatcaaggagatcggcgccgccgtgcaggccctgaagtgccaccccagagagaccagcttcagcagaagcatcagcctgaccagacccggcagcagcagcctgagcagcggccccaacagcatcctgtgcagaggcagaccccccctggaggagaagaaggccctgtgcaaggcccccagcgtggccagcagctggcagccctggacccccgtgccccaggccggcgagaagctgctgccccccggcgacaccagcgaggacagcctgttcacccccagacccggcgagggcagcgcccccggcgtgctgcccagcagcagaatcagacacagaagcgagccccagcaccccaaggagaagcccttcatgttcaacctggacgacgagaacatcagaaccagcgacgtgtag

SEQ ID NO: 93559 - DNA, 4083 bp, Artificial Sequence
  Description of Artificial Sequence: Synthetic coding sequence
atgagcagacagagcaccctgtacagcttcttccccaagagccccgccctgagcgacgccaacaaggccagcgccagagccagcagagagggcggcagagccgccgccgcccccggcgccagccccagccccggcggcgacgccgcctggagcgaggccggccccggccccagacccctggccagaagcgccagcccccccaaggccaagaacctgaacggcggcctgagaagaagcgtggcccccgccgcccccaccagctgcgacttcagccccggcgacctggtgtgggccaagatggagggctacccctggtggccctgcctggtgtacaaccaccccttcgacggcaccttcatcagagagaagggcaagagcgtgagagtgcacgtgcagttcttcgacgacagccccaccagaggctgggtgagcaagagactgctgaagccctacaccggcagcaagagcaaggaggcccagaagggcggccacttctacagcgccaagcccgagatcctgagagccatgcagagagccgacgaggccctgaacaaggacaagatcaagagactggagctggccgtgtgcgacgagcccagcgagcccgaggaggaggaggagatggaggtgggcaccacctacgtgaccgacaagagcgaggaggacaacgagatcgagagcgaggaggaggtgcagcccaagacccagggcagcagaagaagcagcagacagatcaagaagagaagagtgatcagcgacagcgagagcgacatcggcggcagcgacgtggagttcaagcccgacaccaaggaggagggcagcagcgacgagatcagcagcggcgtgggcgacagcgagagcgagggcctgaacagccccgtgaaggtggccagaaagagaaagagaatggtgaccggcaacggcagcctgaagagaaagagcagcagaaaggagacccccagcgccaccaagcaggccaccagcatcagcagcgagaccaagaacaccctgagagccttcagcgccccccagaacagcgagagccaggcccacgtgagcggcggcggcgacgacagcagcagacccaccgtgtggtaccacgagaccctggagtggctgaaggaggagaagagaagagacgagcacagaagaagacccgaccaccccgacttcgacgccagcaccctgtacgtgcccgaggacttcctgaacagctgcacccccggcatgagaaagtggtggcagatcaagagccagaacttcgacctggtgatctgctacaaggtgggcaagttctacgagctgtaccacatggacgccctgatcggcgtgagcgagctgggcctggtgttcatgaagggcaactgggcccacagcggcttccccgagatcgccttcggcagatacagcgacagcctggtgcagaagggctacaaggtggccagagtggagcagaccgagacccccgagatgatggaggccagatgcagaaagatggcccacatcagcaagtacgacagagtggtgagaagagagatctgcagaatcatcaccaagggcacccagacctacagcgtgctggagggcgaccccagcgagaactacagcaagtacctgctgagcctgaaggagaaggaggaggacagcagcggccacaccagagcctacggcgtgtgcttcgtggacaccagcctgggcaagttcttcatcggccagttcagcgacgacagacactgcagcagattcagaaccctggtggcccactacccccccgtgcaggtgctgttcgagaagggcaacctgagcaaggagaccaagaccatcctgaagagcagcctgagctgcagcctgcaggagggcctgatccccggcagccagttctgggacgccagcaagaccctgagaaccctgctggaggaggagtacttcagagagaagctgagcgacggcatcggcgtgatgctgccccaggtgctgaagggcatgaccagcgagagcgacagcatcggcctgacccccggcgagaagagcgagctggccctgagcgccctgggcggctgcgtgttctacctgaagaagtgcctgatcgaccaggagctgctgagcatggccaacttcgaggagtacatccccctggacagcgacaccgtgagcaccaccagaagcggcgccatcttcaccaaggcctaccagagaatggtgctggacgccgtgaccctgaacaacctggagatcttcctgaacggcaccaacggcagcaccgagggcaccctgctggagagagtggacacctgccacacccccttcggcaagagactgctgaagcagtggctgtgcgcccccctgtgcaaccactacgccatcaacgacagactggacgccatcgaggacctgatggtggtgcccgacaagatcagcgaggtggtggagctgctgaagaagctgcccgacctggagagactgctgagcaagatccacaacgtgggcagccccctgaagagccagaaccaccccgacagcagagccatcatgtacgaggagaccacctacagcaagaagaagatcatcgacttcctgagcgccctggagggcttcaaggtgatgtgcaagatcatcggcatcatggaggaggtggccgacggcttcaagagcaagatcctgaagcaggtgatcagcctgcagaccaagaaccccgagggcagattccccgacctgaccgtggagctgaacagatgggacaccgccttcgaccacgagaaggccagaaagaccggcctgatcacccccaaggccggcttcgacagcgactacgaccaggccctggccgacatcagagagaacgagcagagcctgctggagtacctggagaagcagagaaacagaatcggctgcagaaccatcgtgtactggggcatcggcagaaacagataccagctggagatccccgagaacttcaccaccagaaacctgcccgaggagtacgagctgaagagcaccaagaagggctgcaagagatactggaccaagaccatcgagaagaagctggccaacctgatcaacgccgaggagagaagagacgtgagcctgaaggactgcatgagaagactgttctacaacttcgacaagaactacaaggactggcagagcgccgtggagtgcatcgccgtgctggacgtgctgctgtgcctggccaactacagcagaggcggcgacggccccatgtgcagacccgtgatcctgctgcccgaggacaccccccccttcctggagctgaagggcagcagacacccctgcatcaccaagaccttcttcggcgacgacttcatccccaacgacatcctgatcggctgcgaggaggaggagcaggagaacggcaaggcctactgcgtgctggtgaccggccccaacatgggcggcaagagcaccctgatgagacaggccggcctgctggccgtgatggcccagatgggctgctacgtgcccgccgaggtgtgcagactgacccccatcgacagagtgttcaccagactgggcgccagcgacagaatcatgagcggcgagagcaccttcttcgtggagctgagcgagaccgccagcatcctgatgcacgccaccgcccacagcctggtgctggtggacgagctgggcagaggcaccgccaccttcgacggcaccgccatcgccaacgccgtggtgaaggagctggccgagaccatcaagtgcagaaccctgttcagcacccactaccacagcctggtggaggactacagccagaacgtggccgtgagactgggccacatggcctgcatggtggagaacgagtgcgaggaccccagccaggagaccatcaccttcctgtacaagttcatcaagggcgcctgccccaagagctacggcttcaacgccgccagactggccaacctgcccgaggaggtgatccagaagggccacagaaaggccagagagttcgagaagatgaaccagagcctgagactgttcagagaggtgtgcctggccagcgagagaagcaccgtggacgccgaggccgtgcacaagctgctgaccctgatcaaggagctgtag

SEQ ID NO: 93560 - DNA, 2340 bp, Artificial Sequence
  Description of Artificial Sequence: Synthetic coding sequence
atggagggcagcagacccagaagcagcctgagcctggccagcagcgccagcaccatcagcagcctgagcagcctgagccccaagaagcccaccagagccgtgaacaagatccacgccttcggcaagagaggcaacgccctgagaagagaccccaacctgcccgtgcacatcagaggctggctgcacaagcaggacagcagcggcctgagactgtggaagagaagatggttcgtgctgagcggccactgcctgttctactacaaggacagcagagaggagagcgtgctgggcagcgtgctgctgcccagctacaacatcagacccgacggccccggcgcccccagaggcagaagattcaccttcaccgccgagcaccccggcatgagaacctacgtgctggccgccgacaccctggaggacctgagaggctggctgagagccctgggcagagccagcagagccgagggcgacgactacggccagcccagaagccccgccagaccccagcccggcgagggccccggcggccccggcggcccccccgaggtgagcagaggcgaggagggcagaatcagcgagagccccgaggtgaccagactgagcagaggcagaggcagacccagactgctgacccccagccccaccaccgacctgcacagcggcctgcagatgagaagagccagaagccccgacctgttcacccccctgagcagaccccccagccccctgagcctgcccagacccagaagcgcccccgccagaagaccccccgcccccagcggcgacaccgccccccccgccagaccccacacccccctgagcagaatcgacgtgagaccccccctggactggggcccccagagacagaccctgagcagaccccccacccccagaagaggcccccccagcgaggccggcggcggcaagccccccagaagcccccagcactggagccaggagcccagaacccaggcccacagcggcagccccacctacctgcagctgccccccagaccccccggcaccagagccagcatggtgctgctgcccggcccccccctggagagcaccttccaccagagcctggagaccgacaccctgctgaccaagctgtgcggccaggacagactgctgagaagactgcaggaggagatcgaccagaagcaggaggagaaggagcagctggaggccgccctggagctgaccagacagcagctgggccaggccaccagagaggccggcgcccccggcagagcctggggcagacagagactgctgcaggacagactggtgagcgtgagagccaccctgtgccacctgacccaggagagagagagagtgtgggacacctacagcggcctggagcaggagctgggcaccctgagagagaccctggagtacctgctgcacctgggcagcccccaggacagagtgagcgcccagcagcagctgtggatggtggaggacaccctggccggcctgggcggcccccagaagccccccccccacaccgagcccgacagccccagccccgtgctgcagggcgaggagagcagcgagagagagagcctgcccgagagcctggagctgagcagccccagaagccccgagaccgactggggcagaccccccggcggcgacaaggacctggccagcccccacctgggcctgggcagccccagagtgagcagagccagcagccccgagggcagacacctgcccagcccccagctgggcaccaaggcccccgtggccagacccagaatgagcgcccaggagcagctggagagaatgagaagaaaccaggagtgcggcagacccttccccagacccaccagccccagactgctgaccctgggcagaaccctgagccccgccagaagacagcccgacgtggagcagagacccgtggtgggccacagcggcgcccagaagtggctgagaagcagcggcagctggagcagccccagaaacaccaccccctacctgcccaccagcgagggccacagagagagagtgctgagcctgagccaggccctggccaccgaggccagccagtggcacagaatgatgaccggcggcaacctggacagccagggcgaccccctgcccggcgtgcccctgccccccagcgaccccaccagacaggagacccccccccccagaagcccccccgtggccaacagcggcagcaccggcttcagcagaagaggcagcggcagaggcggcggccccaccccctggggccccgcctgggacgccggcatcgccccccccgtgctgccccaggacgagggcgcctggcccctgagagtgaccctgctgcagagcagcttctag

SEQ ID NO: 93561 - DNA, 1752 bp, Artificial Sequence
  Description of Artificial Sequence: Synthetic coding sequence
atggagggcagcagacccagaagcagcctgagcctggccagcagcgccagcaccatcagcagcctgagcagcctgagccccaagaagcccaccagagccgtgaacaagatccacgccttcggcaagagaggcaacgccctgagaagagaccccaacctgcccgtgcacatcagaggctggctgcacaagcaggacagcagcggcctgagactgtggaagagaagatggttcgtgctgagcggccactgcctgttctactacaaggacagcagagaggagagcgtgctgggcagcgtgctgctgcccagctacaacatcagacccgacggccccggcgcccccagaggcagaagattcaccttcaccgccgagcaccccggcatgagaacctacgtgctggccgccgacaccctggaggacctgagaggctggctgagagccctgggcagagccagcagagccgagggcgacgactacggccagcccagaagccccgccagaccccagcccggcgagggccccggcggccccggcggcccccccgaggtgagcagaggcgaggagggcagaatcagcgagagccccgaggtgaccagactgagcagaggcagaggcagacccagactgctgacccccagccccaccaccgacctgcacagcggcctgcagatgagaagagccagaagccccgacctgttcacccccctgagcagaccccccagccccctgagcctgcccagacccagaagcgcccccgccagaagaccccccgcccccagcggcgacaccgccccccccgccagaccccacacccccctgagcagaatcgacgtgagaccccccctggactggggcccccagagacagaccctgagcagaccccccacccccagaagaggcccccccagcgaggccggcggcggcaagccccccagaagcccccagcactggagccaggagcccagaacccagcccggcccccccctggagagcaccttccaccagagcctggagaccgacaccctgctgaccaagctgtgcggccaggacagactgctgagaagactgcaggaggagatcgaccagaagcaggaggagaaggagcagctggaggccgccctggagctgaccagacagcagctgggccaggccaccagagaggccggcgcccccggcagagcctggggcagacagagactgctgcaggacagactggtgagcgtgagagccaccctgtgccacctgacccaggagagagagagagtgtgggacacctacagcggcctggagcaggagctgggcaccctgagagagaccctggagtacctgctgcacctgggcagcccccaggacagagtgagcgcccagcagcagctgtggatggtggaggacaccctggccggcctgggcggcccccagaagccccccccccacaccgagcccgacagccccagccccgtgctgcagggcgaggagagcagcgagagagagagcctgcccgagagcctggagctgagcagccccagaagccccgagaccgactggggcagaccccccggcggcgacaaggacctggccagcccccacctgggcctgggcagccccagagtgagcagagccagcagccccgagggcagacacctgcccagcccccagctgggcaccaagagcaaggagcaccaccccctgctggccgacttcagaagaagccccggcgccggcagccagcccctgcccagccccggctactag

SEQ ID NO: 93562 - DNA, 3366 bp, Artificial Sequence
  Description of Artificial Sequence: Synthetic coding sequence
atggccgccgccaccgtgggcagagacaccctgcccgagcactggagctacggcgtgtgcagagacggcagagtgttcttcatcaacgaccagctgagatgcaccacctggctgcaccccagaaccggcgagcccgtgaacagcggccacatgatcagaagcgacctgcccagaggctgggaggagggcttcaccgaggagggcgccagctacttcatcgaccacaaccagcagaccaccgccttcagacaccccgtgaccggccagttcagccccgagaacagcgagttcatcctgcaggaggagcccaacccccacatgagcaagcaggacagaaaccagagacccagcagcatggtgagcgagaccagcaccgccggcaccgccagcaccctggaggccaagcccggccccaagatcatcaagagcagcagcaaggtgcacagcttcggcaagagagaccaggccatcagaagaaaccccaacgtgcccgtggtggtgagaggctggctgcacaagcaggacagcagcggcatgagactgtggaagagaagatggttcgtgctggccgactactgcctgttctactacaaggacagcagagaggaggccgtgctgggcagcatccccctgcccagctacgtgatcagccccgtggcccccgaggacagaatcagcagaaagtacagcttcaaggccgtgcacaccggcatgagagccctgatctacaacagcagcaccgccggcagccaggccgagcagagcggcatgagaacctactacttcagcgccgacacccaggaggacatgaacgcctgggtgagagccatgaaccaggccgcccaggtgctgagcagaagcagcctgaagagagacatggagaaggtggagagacaggccgtgccccaggccaaccacaccgagagctgccacgagtgcggcagagtgggccccggccacaccagagactgcccccacagaggccacgacgacatcgtgaacttcgagagacaggagcaggagggcgagcagtacagaagccagagagaccccctggagggcaagagagacagaagcaaggccagaagcccctacagccccgccgaggaggacgccctgttcatggacctgcccaccggccccagaggccagcaggcccagccccagagagccgagaagaacggcatgctgcccgccagctacggccccggcgagcagaacggcaccggcggctaccagagagccttcccccccagaaccaaccccgagaagcacagccagagaaagagcaacctggcccaggtggagcactgggccagagcccagaagggcgacagcagaagcctgcccctggaccagaccctgcccagacagggccccggccagagcctgagcttccccgagaactaccagaccctgcccaagagcaccagacaccccagcggcggcagcagccccccccccagaaacctgcccagcgactacaagtacgcccaggacagagccagccacctgaagatgagcagcgaggagagaagagcccacagagacggcaccgtgtggcagctgtacgagtggcagcagagacagcagttcagacacggcagccccaccgcccccatctgcctgggcagccccgagttcaccgaccagggcagaagcagaagcatgctggaggtgcccagaagcatcagcgtgccccccagccccagcgacatccccccccccggcccccccagagtgttcccccccagaagaccccacacccccgccgagagagtgaccgtgaagccccccgaccagagaagaagcgtggacatcagcctgggcgacagccccagaagagccagaggccacgccgtgaagaacagcagccacgtggacagaagaagcatgcccagcatgggctacatgacccacaccgtgagcgcccccagcctgcacggcaagagcgccgacgacacctacctgcagctgaagaaggacctggagtacctggacctgaagatgaccggcagagacctgctgaaggacagaagcctgaagcccgtgaagatcgccgagagcgacaccgacgtgaagctgagcatcttctgcgagcaggacagagtgctgcaggacctggaggacaagatcagagccctgaaggagaacaaggaccagctggagagcgtgctggaggtgctgcacagacagatggagcagtacagagaccagccccagcacctggagaagatcgcctaccagcagaagctgctgcaggaggacctggtgcacatcagagccgagctgagcagagagagcaccgagatggagaacgcctggaacgagtacctgaagctggagaacgacgtggagcagctgaagcagaccctgcaggagcagcacagaagagccttcttcttccaggagaagagccagatccagaaggacctgtggagaatcgaggacgtgaccgccggcctgagcgccaacaaggagaacttcagaatcctggtggagagcgtgaagaaccccgagagaaagaccgtgcccctgttcccccacccccccgtgcccagcctgagcaccagcgagagcaagccccccccccagcccagcccccccaccagccccgtgagaacccccctggaggtgagactgttcccccagctgcagacctacgtgccctacagaccccaccccccccagctgagaaaggtgaccagccccctgcagagccccaccaaggccaagcccaaggtggaggacgaggccccccccagaccccccctgcccgagctgtacagccccgaggaccagccccccgccgtgccccccctgcccagagaggccaccatcatcagacacaccagcgtgagaggcctgaagagacagagcgacgagagaaagagagacagagagctgggccagtgcgtgaacggcgacagcagagtggagctgagaagctacgtgagcgagcccgagctggccaccctgagcggcgacatggcccagcccagcctgggcctggtgggccccgagagcagataccagaccctgcccggcagaggcctgagcggcagcaccagcagactgcagcagagcagcaccatcgccccctacgtgaccctgagaagaggcctgaacgccgagagcagcaaggccaccttccccagacccaagagcgccctggagagactgtacagcggcgaccaccagagaggcaagatgagcgccgaggagcagctggagagaatgaagagacaccagaaggccctggtgagagagagaaagagaaccctgggccagggcgagagaaccggcctgcccagcagcagatacctgagcagacccctgcccggcgacctgggcagcgtgtgctag

SEQ ID NO: 93563 - DNA, 3369 bp, Artificial Sequence
  Description of Artificial Sequence: Synthetic coding sequence
atggccgccgccaccgtgggcagagacaccctgcccgagcactggagctacggcgtgtgcagagacggcagagtgttcttcatcaacgaccagctgagatgcaccacctggctgcaccccagaaccggcgagcccgtgaacagcggccacatgatcagaagcgacctgcccagaggctgggaggagggcttcaccgaggagggcgccagctacttcatcgaccacaaccagcagaccaccgccttcagacaccccgtgaccggccagttcagccccgagaacagcgagttcatcctgcaggaggagcccaacccccacatgagcaagcaggacagaaaccagagacccagcagcatggtgagcgagaccagcaccgccggcaccgccagcaccctggaggccaagcccggccccaagatcatcaagagcagcagcaaggtgcacagcttcggcaagagagaccaggccatcagaagaaaccccaacgtgcccgtggtggtgagaggctggctgcacaagcaggacagcagcggcatgagactgtggaagagaagatggttcgtgctggccgactactgcctgttctactacaaggacagcagagaggaggccgtgctgggcagcatccccctgcccagctacgtgatcagccccgtggcccccgaggacagaatcagcagaaagtacagcttcaaggccgtgcacaccggcatgagagccctgatctacaacagcagcaccgccggcagccaggccgagcagagcggcatgagaacctactacttcagcgccgacacccaggaggacatgaacgcctgggtgagagccatgaaccaggccgcccaggtgctgagcagaagcagcctgaagagagacatggagaaggtggagagacaggccgtgccccaggccaaccacaccgagagctgccacgagtgcggcagagtgggccccggccacaccagagactgcccccacagaggccacgacgacatcgtgaacttcgagagacaggagcaggagggcgagcagtacagaagccagagagaccccctggagggcaagagagacagaagcaaggccagaagcccctacagccccgccgaggaggacgccctgttcatggacctgcccaccggccccagaggccagcaggcccagccccagagagccgagaagaacggcatgctgcccgccagctacggccccggcgagcagaacggcaccggcggctaccagagagccttcccccccagaaccaaccccgagaagcacagccagagaaagagcaacctggcccaggtggagcactgggccagagcccagaagggcgacagcagaagcctgcccctggaccagaccctgcccagacagggccccggccagagcctgagcttccccgagaactaccagaccctgcccaagagcaccagacaccccagcggcggcagcagccccccccccagaaacctgcccagcgactacaagtacgcccaggacagagccagccacctgaagatgagcagcgaggagagaagagcccacagagacggcaccgtgtggcagctgtacgagtggcagcagagacagcagttcagacacggcagccccaccgcccccatctgcctgggcagccccgagttcaccgaccagggcagaagcagaagcatgctggaggtgcccagaagcatcagcgtgccccccagccccagcgacatccccccccccggcccccccagagtgttcccccccagaagaccccacacccccgccgagagagtgaccgtgaagccccccgaccagagaagaagcgtggacatcagcctgggcgacagccccagaagagccagaggccacgccgtgaagaacagcagccacgtggacagaagaagcatgcccagcatgggctacatgacccacaccgtgagcgcccccagcctgcacggcaagagcgccgacgacacctacctgcagctgaagaaggacctggagtacctggacctgaagatgaccggcagagacctgctgaaggacagaagcctgaagcccgtgaagatcgccgagagcgacaccgacgtgaagctgagcatcttctgcgagcaggacagagtgctgcaggacctggaggacaagatcagagccctgaaggagaacaaggaccagctggagagcgtgctggaggtgctgcacagacagatggagcagtacagagaccagccccagcacctggagaagatcgcctaccagcagaagctgctgcaggaggacctggtgcacatcagagccgagctgagcagagagagcaccgagatggagaacgcctggaacgagtacctgaagctggagaacgacgtggagcagctgaagcagaccctgcaggagcagcacagaagagccttcttcttccaggagaagagccagatccagaaggacctgtggagaatcgaggacgtgaccgccggcctgagcgccaacaaggagaacttcagaatcctggtggagagcgtgaagaaccccgagagaaagaccgtgcccctgttcccccacccccccgtgcccagcctgagcaccagcgagagcaagccccccccccagcccagcccccccaccagccccgtgagaacccccctggaggtgagactgttcccccagctgcagacctacgtgccctacagaccccaccccccccagctgagaaaggtgaccagccccctgcagagccccaccaaggccaagcccaaggtgcaggaggacgaggccccccccagaccccccctgcccgagctgtacagccccgaggaccagccccccgccgtgccccccctgcccagagaggccaccatcatcagacacaccagcgtgagaggcctgaagagacagagcgacgagagaaagagagacagagagctgggccagtgcgtgaacggcgacagcagagtggagctgagaagctacgtgagcgagcccgagctggccaccctgagcggcgacatggcccagcccagcctgggcctggtgggccccgagagcagataccagaccctgcccggcagaggcctgagcggcagcaccagcagactgcagcagagcagcaccatcgccccctacgtgaccctgagaagaggcctgaacgccgagagcagcaaggccaccttccccagacccaagagcgccctggagagactgtacagcggcgaccaccagagaggcaagatgagcgccgaggagcagctggagagaatgaagagacaccagaaggccctggtgagagagagaaagagaaccctgggccagggcgagagaaccggcctgcccagcagcagatacctgagcagacccctgcccggcgacctgggcagcgtgtgctag

SEQ ID NO: 93564 - DNA, 2262 bp, Artificial Sequence
  Description of Artificial Sequence: Synthetic coding sequence
tgagacgccctgttcatggacctgcccaccggccccagaggccagcaggcccagccccagagagccgagaagaacggcatgctgcccgccagctacggccccggcgagcagaacggcaccggcggctaccagagagccttcccccccagaaccaaccccgagaagcacagccagagaaagagcaacctggcccaggtggagcactgggccagagcccagaagggcgacagcagaagcctgcccctggaccagaccctgcccagacagggccccggccagagcctgagcttccccgagaactaccagaccctgcccaagagcaccagacaccccagcggcggcagcagccccccccccagaaacctgcccagcgactacaagtacgcccaggacagagccagccacctgaagatgagcagcgaggagagaagagcccacagagacggcaccgtgtggcagctgtacgagtggcagcagagacagcagttcagacacggcagccccaccgcccccatctgcctgggcagccccgagttcaccgaccagggcagaagcagaagcatgctggaggtgcccagaagcatcagcgtgccccccagccccagcgacatccccccccccggcccccccagagtgttcccccccagaagaccccacacccccgccgagagagtgaccgtgaagccccccgaccagagaagaagcgtggacatcagcctgggcgacagccccagaagagccagaggccacgccgtgaagaacagcagccacgtggacagaagaagcatgcccagcatgggctacatgacccacaccgtgagcgcccccagcctgcacggcaagagcgccgacgacacctacctgcagctgaagaaggacctggagtacctggacctgaagatgaccggcagagacctgctgaaggacagaagcctgaagcccgtgaagatcgccgagagcgacaccgacgtgaagctgagcatcttctgcgagcaggacagagtgctgcaggacctggaggacaagatcagagccctgaaggagaacaaggaccagctggagagcgtgctggaggtgctgcacagacagatggagcagtacagagaccagccccagcacctggagaagatcgcctaccagcagaagctgctgcaggaggacctggtgcacatcagagccgagctgagcagagagagcaccgagatggagaacgcctggaacgagtacctgaagctggagaacgacgtggagcagctgaagcagaccctgcaggagcagcacagaagagccttcttcttccaggagaagagccagatccagaaggacctgtggagaatcgaggacgtgaccgccggcctgagcgccaacaaggagaacttcagaatcctggtggagagcgtgaagaaccccgagagaaagaccgtgcccctgttcccccacccccccgtgcccagcctgagcaccagcgagagcaagccccccccccagcccagcccccccaccagccccgtgagaacccccctggaggtgagactgttcccccagctgcagacctacgtgccctacagaccccaccccccccagctgagaaaggtgaccagccccctgcagagccccaccaaggccaagcccaaggtgcaggaggacgaggccccccccagaccccccctgcccgagctgtacagccccgaggaccagccccccgccgtgccccccctgcccagagaggccaccatcatcagacacaccagcgtgagaggcctgaagagacagagcgacgagagaaagagagacagagagctgggccagtgcgtgaacggcgacagcagagtggagctgagaagctacgtgagcgagcccgagctggccaccctgagcggcgacatggcccagcccagcctgggcctggtgggccccgagagcagataccagaccctgcccggcagaggcctgagcggcagcaccagcagactgcagcagagcagcaccatcgccccctacgtgaccctgagaagaggcctgaacgccgagagcagcaaggccaccttccccagacccaagagcgccctggagagactgtacagcggcgaccaccagagaggcaagatgagcgccgaggagcagctggagagaatgaagagacaccagaaggccctggtgagagagagaaagagaaccctgggccagggcgagagaaccggcctgcccagcagcagatacctgagcagacccctgcccggcgacctgggcagcgtgtgctag

SEQ ID NO: 93565 - DNA, 816 bp, Artificial Sequence
  Description of Artificial Sequence: Synthetic coding sequence
atgctgcaggcctgcaagatggagggcttccccctggtgcccccccagcccagcgaggacctggtgccctacgacaccgacctgtaccagagacagacccacgagtactacccctacctgagcagcgacggcgagagccacagcgaccactactgggacttccacccccaccacgtgcacagcgagttcgagagcttcgccgagaacaacttcaccgagctgcagagcgtgcagcccccccagctgcagcagctgtacagacacatggagctggagcagatgcacgtgctggacacccccatggtgcccccccaccccagcctgggccaccaggtgagctacctgcccagaatgtgcctgcagtaccccagcctgagccccgcccagcccagcagcgacgaggaggagggcgagagacagagcccccccctggaggtgagcgacggcgaggccgacggcctggagcccggccccggcctgctgcccggcgagaccggcagcaagaagaagatcagactgtaccagttcctgctggacctgctgagaagcggcgacatgaaggacagcatctggtgggtggacaaggacaagggcaccttccagttcagcagcaagcacaaggaggccctggcccacagatggggcatccagaagggcaacagaaagaagatgacctaccagaagatggccagagccctgagaaactacggcaagaccggcgaggtgaagaaggtgaagaagaagctgacctaccagttcagcggcgaggtgctgggcagaggcggcctggccgagagaagacaccccccccactag

SEQ ID NO: 93566 - DNA, 732 bp, Artificial Sequence
  Description of Artificial Sequence: Synthetic coding sequence
atgagccccgccgcccccgtgccccccgacagcgccctggagagccccttcgaggagatggccctggtgagaggcggctggctgtggagacagagcagcatcctgagaagatggaagagaaactggttcgccctgtggctggacggcaccctgggctactaccacgacgagaccgcccaggacgaggaggacagagtgctgatccacttcaacgtgagagacatcaagatcggccccgagtgccacgacgtgcagccccccgagggcagaagcagagacggcctgctgaccgtgaacctgagagagggcggcagactgcacctgtgcgccgagaccaaggacgacgccctggcctggaagaccgccctgctggaggccaacagcacccccgcccccgccggcgccaccgtgccccccagaagcagaagagtgtgcagcaaggtgagatgcgtgaccagaagctggagcccctgcaaggtggagagaagaatctgggtgagagtgtacagcccctaccaggactactacgaggtggtgccccccaacgcccacgaggccacctacgtgagaagctactacggccccccctacgccggccccggcgtgacccacgtgatcgtgagagaggacccctgctacagcgccggcgcccccctggccatgggcatgctggccggcgccgccaccggcgccgccctgggcagcctgatgtggagcccctgctggttctag

SEQ ID NO: 93567 - DNA, 627 bp, Artificial Sequence
  Description of Artificial Sequence: Synthetic coding sequence
atgagccccgccgcccccgtgccccccgacagcgccctggagagccccttcgaggagatggccctggtgagaggcggctggctgtggagacagagcagcatcctgagaagatggaagagaaactggttcgccctgtggctggacggcaccctgggctactaccacgacgagaccgcccaggacgaggaggacagagtgctgatccacttcaacgtgagagacatcaagatcggccccgagtgccacgacgtgcagccccccgagggcagaagcagagacggcctgctgaccgtgaacctgagagagggcggcagactgcacctgtgcgccgagaccaaggacgacgccctggcctggaagaccgccctgctggaggccaacagcacccccgtgagagtgtacagcccctaccaggactactacgaggtggtgccccccaacgcccacgaggccacctacgtgagaagctactacggccccccctacgccggccccggcgtgacccacgtgatcgtgagagaggacccctgctacagcgccggcgcccccctggccatgggcatgctggccggcgccgccaccggcgccgccctgggcagcctgatgtggagcccctgctggttctag

SEQ ID NO: 93568 - DNA, 675 bp, Artificial Sequence
  Description of Artificial Sequence: Synthetic coding sequence
atggccctggtgagaggcggctggctgtggagacagagcagcatcctgagaagatggaagagaaactggttcgccctgtggctggacggcaccctgggctactaccacgacgagaccgcccaggacgaggaggacagagtgctgatccacttcaacgtgagagacatcaagatcggccccgagtgccacgacgtgcagccccccgagggcagaagcagagacggcctgctgaccgtgaacctgagagagggcggcagactgcacctgtgcgccgagaccaaggacgacgccctggcctggaagaccgccctgctggaggccaacagcacccccgcccccgccggcgccaccgtgccccccagaagcagaagagtgtgcagcaaggtgagatgcgtgaccagaagctggagcccctgcaaggtggagagaagaatctgggtgagagtgtacagcccctaccaggactactacgaggtggtgccccccaacgcccacgaggccacctacgtgagaagctactacggccccccctacgccggccccggcgtgacccacgtgatcgtgagagaggacccctgctacagcgccggcgcccccctggccatgggcatgctggccggcgccgccaccggcgccgccctgggcagcctgatgtggagcccctgctggttctag

SEQ ID NO: 93569 - DNA, 570 bp, Artificial Sequence; identical to SEQ ID NO: 77789
  Description of Artificial Sequence: Synthetic coding sequence

SEQ ID NO: 93570 - DNA, 354 bp, Artificial Sequence
  Description of Artificial Sequence: Synthetic coding sequence
atggccctggtgagaggcggctggctgtggagacagagcagcatcctgagaagatggaagagaaactggttcgccctgtggctggacggcaccctgggctactaccacgacgagaccgcccaggacgaggaggacagagtgctgatccacttcaacgtgagagacatcaagatcggccccgagtgccacgacgtgcagccccccgagggcagaagcagagacggcctgctgaccgtgaacctgagagagggcggcagactgcacctgtgcgccgagaccaaggacgacgccctggcctggaagaccgccctgctggaggccaacagcacccccgtgagagtgtacagcccctag

SEQ ID NO: 93571 - DNA, 492 bp, Artificial Sequence
  Description of Artificial Sequence: Synthetic coding sequence
atggccctggtgagaggcggctggctgtggagacagagcagcatcctgagaagatggaagagaaactggttcgccctgtggctggacggcaccctgggctactaccacgacgagaccgcccaggacgaggaggacagagtgctgatccacttcaacgtgagagacatcaagatcggccccgagtgccacgacgtgcagccccccgagggcagaagcagagacggcctgctgaccgtgaacctgagagagggcggcagactgcacctgtgcgccgagaccaaggacgacgccctggcctggaagaccgccctgctggaggccaacagcacccccgtgagagtgtacagcccctaccaggactactacgaggtggtgccccccaacgcccacgaggccacctacgtgagaagctactacggccccccctacgccggccccggcgtgacccacgtgatcgtgagagaggacccctgctacagcgccggcgcctag

SEQ ID NO: 93572 - DNA, 480 bp, Artificial Sequence
  Description of Artificial Sequence: Synthetic coding sequence
atggccctggtgagaggcggctggctgtggagacagagcagcatcctgagaagatggaagagaaactggttcgccctgtggctggacggcaccctgggctactaccacgacgagaccgcccaggacgaggaggacagagtgctgatccacttcaacgtgagagacatcaagatcggccccgagtgccacgacgtgcagccccccgagggcagaagcagagacggcctgctgaccgtgaacctgagagagggcggcagactgcacctgtgcgccgagaccaaggacgacgccctggcctggaagaccgccctgctggaggccaacagcacccccatgatcagactgaagctgatccacccccacaacaagtacctgctgagctgctacagcgccggcgcccccctggccatgggcatgctggccggcgccgccaccggcgccgccctgggcagcctgatgtggagcccctgctggttctag

SEQ ID NO: 93573 - DNA, 483 bp, Artificial Sequence
  Description of Artificial Sequence: Synthetic coding sequence
atggccctggtgagaggcggctggctgtggagacagagcagcatcctgagaagatggaagagaaactggttcgccctgtggctggacggcaccctgggctactaccacgacgagaccgcccaggacgaggaggacagagtgctgatccacttcaacgtgagagacatcaagatcggccccgagtgccacgacgtgcagccccccgagggcagaagcagagacggcctgctgaccgtgaacctgagagagggcggcagactgcacctgtgcgccgagaccaaggacgacgccctggcctggaagaccgccctgctggaggccaacagcacccccgcccccgccggcgccaccgtgccccccagaagcagaagagtgtgcagcaaggtgagatgcgtgaccagaagctggagcccctgcaaggtggagagaagaatctgggtgagagtgtacagcccctaccaggactactacgaggtggtgtag

SEQ ID NO: 93574 - DNA, 465 bp, Artificial Sequence
  Description of Artificial Sequence: Synthetic coding sequence
atggccctggtgagaggcggctggctgtggagacagagcagcatcctgagaagatggaagagaaactggttcgccctgtggctggacggcaccctgggctactaccacgacgagaccgcccaggacgaggaggacagagtgctgatccacttcaacgtgagagacatcaagatcggccccgagtgccacgacgtgcagccccccgagggcagaagcagagacggcctgctgaccgtgaacctgagagagggcggcagactgcacctgtgcgccgagaccaaggacgacgccctggcctggaagaccgccctgctggaggccaacagcacccccgtgagagtgtacagcccctaccaggactactacgaggtggtgccccccaacgcccacgaggccacctacgtgagaagctactacggccccccctacgccggccccggcgtgacccacgtgatcgtgagatag

SEQ ID NO: 93575 - DNA, 258 bp, Artificial Sequence
  Description of Artificial Sequence: Synthetic coding sequence
atggccctggtgagaggcggctggctgtggagacagagcagcatcctgagaagatggaagagaaactggttcgccctgtggctggacggcaccctgggctactaccacgacgagaccgcccaggacgaggaggacagagtgctgatccacttcaacgtgagagacatcaagatcggccccgagtgccacgacgtgcagccccccgagggcagaagcagagacggcctgctgaccgtgaacctgagagagggcggctag

SEQ ID NO: 93576 - DNA, 3576 bp, Artificial Sequence
  Description of Artificial Sequence: Synthetic coding sequence
atggagagacccctggagaacggcgacgagagccccgacagccagggccacgccaccgactggagattcgccgtgtgcagcttcagagacgcctgggaggaggaggagcccgccagccagatgcacgtgaaggaccccggcccccccagaccccccgccggcgccacccaggacgaggagctgcagggcagccccctgagcagaaagttccagctgccccccgccgccgacgagagcggcgacgcccagagaggcaccgtggagagcagcagcgtgctgagcgagggccccggccccagcggcgtggagagcctgctgtgccccatgagcagccacctgagcctggcccagggcgagagcgacacccccggcgtgggcctggtgggcgaccccggccccagcagagccatgcccagcggcctgagccccggcgccctggacagcgaccccgtgggcctgggcgaccccctgagcgagatcagcaagctgctggaggccgcccccagcggcagcggcctgcccaagcccgccgactgcctgctggcccaggacctgtgctgggagctgctggccagcggcatggccaccctgcccggcaccagagacgtgcagggcagagccgtgctgctgctgtgcgcccacagccccgcctggctgcagagcgagtgcagcagccaggagctgatcagactgctgctgtacctgagaagcatccccagacccgaggtgcaggccctgggcctgaccgtgctggtggacgccagaatctgcgcccccagcagcagcctgttcagcggcctgagccagctgcaggaggccgcccccggcgccgtgtaccaggtgctgctggtgggcagcaccctgctgaaggaggtgcccagcggcctgcagctggagcagctgcccagccagagcctgctgacccacatccccaccgccggcctgcccaccagcctgggcggcggcctgccctactgccaccaggcctggctggacttcagaagaagactggaggccctgctgcagaactgccaggccgcctgcgccctgctgcagggcgccatcgagagcgtgaaggccgtgccccagcccatggagcccggcgaggtgggccagctgctgcagcagaccgaggtgctgatgcagcaggtgctggacagcccctggctggcctggctgcagtgccagggcggcagagagctgacctggctgaagcaggaggtgcccgaggtgaccctgagccccgactacagaaccgccatggacaaggccgacgagctgtacgacagagtggacggcctgctgcaccagctgaccctgcagagcaaccagagaatccaggccctggagctggtgcagaccctggaggccagagagagcggcctgcaccagatcgaggtgtggctgcagcaggtgggctggcccgccctggaggaggccggcgagcccagcctggacatgctgctgcaggcccagggcagcttccaggagctgtaccaggtggcccaggagcaggtgagacagggcgagaagttcctgcagcccctgaccggctgggaggccgccgagctggacccccccggcgccagattcctggccctgagagcccagctgaccgagttcagcagagccctggcccagagatgccagagactggccgacgccgagagactgttccagctgttcagagaggccctgacctgggccgaggagggccagagagtgctggccgagctggagcaggagagacccggcgtggtgctgcagcagctgcagctgcactggaccagacaccccgacctgccccccgcccacttcagaaagatgtgggccctggccaccggcctgggcagcgaggccatcagacaggagtgcagatgggcctgggccagatgccaggacacctggctggccctggaccagaagctggaggccagcctgaagctgccccccgtgggcagcaccgccagcctgtgcgtgagccaggtgcccgccgcccccgcccacccccccctgagaaaggcctacagcttcgacagaaacctgggccagagcctgagcgagcccgcctgccactgccaccacgccgccaccatcgccgcctgcagaagacccgaggccggcggcggcgccctgccccaggccagccccaccgtgcccccccccggcagcagcgaccccagaagcctgaacagactgcagctggtgctggccgagatggtggccaccgagagagagtacgtgagagccctggagtacaccatggagaactacttccccgagctggacagacccgacgtgccccagggcctgagaggccagagagcccacctgttcggcaacctggagaagctgagagacttccactgccacttcttcctgagagagctggaggcctgcaccagacacccccccagagtggcctacgccttcctgagacacagagtgcagttcggcatgtacgccctgtacagcaagaacaagcccagaagcgacgccctgatgagcagctacggccacaccttcttcaaggacaagcagcaggccctgggcgaccacctggacctggccagctacctgctgaagcccatccagagaatgggcaagtacgccctgctgctgcaggagctggccagagcctgcggcggccccacccaggagctgagcgccctgagagaggcccagagcctggtgcacttccagctgagacacggcaacgacctgctggccatggacgccatccagggctgcgacgtgaacctgaaggagcagggccagctggtgagacaggacgagttcgtggtgagaaccggcagacacaagagcgtgagaagaatcttcctgttcgaggagctgctgctgttcagcaagcccagacacggccccaccggcgtggacaccttcgcctacaagagaagcttcaagatggccgacctgggcctgaccgagtgctgcggcaacagcaacctgagattcgagatctggttcagaagaagaaaggccagagacaccttcgtgctgcaggccagcagcctggccatcaagcaggcctggaccgccgacatcagccacctgctgtggagacaggccgtgcacaacaaggaggtgagaatggccgagatggtgagcatgggcgtgggcaacaaggccttcagagacatcgcccccagcgaggaggccatcaacgacagaaccgtgaactacgtgctgaagtgcagagaggtgagaagcagagccagcatcgccgtggcccccttcgaccacgacagcctgtacctgggcgccagcaacagcctgcccggcgaccccgccagctgcagcgtgctgggcagcctgaacctgcacctgtacagagaccccgccctgctgggcctgagatgccccctgtaccccagcttccccgaggaggccgccctggaggccgaggccgagctgggcggccagcccagcctgaccgccgaggacagcgagatcagcagccagtgccccagcgccagcggcagcagcggcagcgacagcagctgcgtgagcggccaggccctgggcagaggcctggaggacctgccctgcgtgtag

SEQ ID NO: 93577 - DNA, 3576 bp, Artificial Sequence; identical to SEQ ID NO: 93576
  Description of Artificial Sequence: Synthetic coding sequence

SEQ ID NO: 93578 - DNA, 582 bp, Artificial Sequence
  Description of Artificial Sequence: Synthetic coding sequence
atggagagacccctggagaacggcgacgagagccccgacagccagggccacgccaccgactggagattcgccgtgtgcagcttcagagacgcctgggaggaggaggagcccgccagccagatgcacgtgaaggaccccggcccccccagaccccccgccggcgccacccaggacgaggagctgcagggcagccccctgagcagaaagttccagctgccccccgccgccgacgagagcggcgacgcccagagaggcaccgtggagagcagcagcgtgctgagcgagggccccggccccagcggcgtggagagcctgctgtgccccatgagcagccacctgagcctggcccagggcgagagcgacacccccggcgtgggcctggtgggcgaccccggccccagcagagccatgcccagcggcctgagccccggcgccctggacagcgaccccgtgggcctgggcgaccccctgagcgagatcagcaagctgctggaggccggcaaggagggctgggccagagaggtgtgggagggcaacggcgacgcctggagagacgagtgccaggacttcggcggcctgtag

SEQ ID NO: 93579 - DNA, 3576 bp, Artificial Sequence; identical to SEQ ID NO: 93576
  Description of Artificial Sequence: Synthetic coding sequence

SEQ ID NO: 93580 - DNA, 3333 bp, Artificial Sequence
  Description of Artificial Sequence: Synthetic coding sequence
atggagagacccctggagaacggcgacgagagccccgacagccagggccacgccaccgactggagattcgccgtgtgcagcttcagagacgcctgggaggaggaggagcccgccagccagatgcacgtgaaggaccccggcccccccagaccccccgccggcgccacccaggacgaggagctgcagggcagccccctgagcagaaagttccagctgccccccgccgccgacgagagcggcgacgcccagagaggcaccgtggagagcagcagcgtgctgagcgagggccccggccccagcggcgtggagagcctgctgtgccccatgagcagccacctgagcctggcccagggcaccagagacgtgcagggcagagccgtgctgctgctgtgcgcccacagccccgcctggctgcagagcgagtgcagcagccaggagctgatcagactgctgctgtacctgagaagcatccccagacccgaggtgcaggccctgggcctgaccgtgctggtggacgccagaatctgcgcccccagcagcagcctgttcagcggcctgagccagctgcaggaggccgcccccggcgccgtgtaccaggtgctgctggtgggcagcaccctgctgaaggaggtgcccagcggcctgcagctggagcagctgcccagccagagcctgctgacccacatccccaccgccggcctgcccaccagcctgggcggcggcctgccctactgccaccaggcctggctggacttcagaagaagactggaggccctgctgcagaactgccaggccgcctgcgccctgctgcagggcgccatcgagagcgtgaaggccgtgccccagcccatggagcccggcgaggtgggccagctgctgcagcagaccgaggtgctgatgcagcaggtgctggacagcccctggctggcctggctgcagtgccagggcggcagagagctgacctggctgaagcaggaggtgcccgaggtgaccctgagccccgactacagaaccgccatggacaaggccgacgagctgtacgacagagtggacggcctgctgcaccagctgaccctgcagagcaaccagagaatccaggccctggagctggtgcagaccctggaggccagagagagcggcctgcaccagatcgaggtgtggctgcagcaggtgggctggcccgccctggaggaggccggcgagcccagcctggacatgctgctgcaggcccagggcagcttccaggagctgtaccaggtggcccaggagcaggtgagacagggcgagaagttcctgcagcccctgaccggctgggaggccgccgagctggacccccccggcgccagattcctggccctgagagcccagctgaccgagttcagcagagccctggcccagagatgccagagactggccgacgccgagagactgttccagctgttcagagaggccctgacctgggccgaggagggccagagagtgctggccgagctggagcaggagagacccggcgtggtgctgcagcagctgcagctgcactggaccagacaccccgacctgccccccgcccacttcagaaagatgtgggccctggccaccggcctgggcagcgaggccatcagacaggagtgcagatgggcctgggccagatgccaggacacctggctggccctggaccagaagctggaggccagcctgaagctgccccccgtgggcagcaccgccagcctgtgcgtgagccaggtgcccgccgcccccgcccacccccccctgagaaaggcctacagcttcgacagaaacctgggccagagcctgagcgagcccgcctgccactgccaccacgccgccaccatcgccgcctgcagaagacccgaggccggcggcggcgccctgccccaggccagccccaccgtgcccccccccggcagcagcgaccccagaagcctgaacagactgcagctggtgctggccgagatggtggccaccgagagagagtacgtgagagccctggagtacaccatggagaactacttccccgagctggacagacccgacgtgccccagggcctgagaggccagagagcccacctgttcggcaacctggagaagctgagagacttccactgccacttcttcctgagagagctggaggcctgcaccagacacccccccagagtggcctacgccttcctgagacacagagtgcagttcggcatgtacgccctgtacagcaagaacaagcccagaagcgacgccctgatgagcagctacggccacaccttcttcaaggacaagcagcaggccctgggcgaccacctggacctggccagctacctgctgaagcccatccagagaatgggcaagtacgccctgctgctgcaggagctggccagagcctgcggcggccccacccaggagctgagcgccctgagagaggcccagagcctggtgcacttccagctgagacacggcaacgacctgctggccatggacgccatccagggctgcgacgtgaacctgaaggagcagggccagctggtgagacaggacgagttcgtggtgagaaccggcagacacaagagcgtgagaagaatcttcctgttcgaggagctgctgctgttcagcaagcccagacacggccccaccggcgtggacaccttcgcctacaagagaagcttcaagatggccgacctgggcctgaccgagtgctgcggcaacagcaacctgagattcgagatctggttcagaagaagaaaggccagagacaccttcgtgctgcaggccagcagcctggccatcaagcaggcctggaccgccgacatcagccacctgctgtggagacaggccgtgcacaacaaggaggtgagaatggccgagatggtgagcatgggcgtgggcaacaaggccttcagagacatcgcccccagcgaggaggccatcaacgacagaaccgtgaactacgtgctgaagtgcagagaggtgagaagcagagccagcatcgccgtggcccccttcgaccacgacagcctgtacctgggcgccagcaacagcctgcccggcgaccccgccagctgcagcgtgctgggcagcctgaacctgcacctgtacagagaccccgccctgctgggcctgagatgccccctgtaccccagcttccccgaggaggccgccctggaggccgaggccgagctgggcggccagcccagcctgaccgccgaggacagcgagatcagcagccagtgccccagcgccagcggcagcagcggcagcgacagcagctgcgtgagcggccaggccctgggcagaggcctggaggacctgccctgcgtgtag

SEQ ID NO: 93581 - DNA, 3021 bp, Artificial Sequence
  Description of Artificial Sequence: Synthetic coding sequence
atgcactacgacggccacgtgagattcgacctgcccccccagggcagcgtgctggccagaaacgtgagcaccagaagctgcccccccagaaccagccccgccgtggacctggaggaggaggaggaggagagcagcgtggacggcaagggcgacagaaagagcaccggcctgaagctgagcaagaagaaggccagaagaagacacaccgacgaccccagcaaggagtgcttcaccctgaagttcgacctgaacgtggacatcgagaccgagatcgtgcccgccatgaagaagaagagcctgggcgaggtgctgctgcccgtgttcgagagaaagggcatcgccctgggcaaggtggacatctacctggaccagagcaacacccccctgagcctgaccttcgaggcctacagattcggcggccactacctgagagtgaaggcccccgccaagcccggcgacgagggcaaggtggagcagggcatgaaggacagcaagagcctgagcctgcccatcctgagacccgccggcaccggcccccccgccctggagagagtggacgcccagagcagaagagagagcctggacatcctggcccccggcagaagaagaaagaacatgagcgagttcctgggcgaggccagcatccccggccaggagccccccacccccagcagctgcagcctgcccagcggcagcagcggcagcaccaacaccggcgacagctggaagaacagagccgccagcagattcagcggcttcttcagcagcggccccagcaccagcgccttcggcagagaggtggacaagatggagcagctggagggcaagctgcacacctacagcctgttcggcctgcccagactgcccagaggcctgagattcgaccacgacagctgggaggaggagtacgacgaggacgaggacgaggacaacgcctgcctgagactggaggacagctggagagagctgatcgacggccacgagaagctgaccagaagacagtgccaccagcaggaggccgtgtgggagctgctgcacaccgaggccagctacatcagaaagctgagagtgatcatcaacctgttcctgtgctgcctgctgaacctgcaggagagcggcctgctgtgcgaggtggaggccgagagactgttcagcaacatccccgagatcgcccagctgcacagaagactgtgggccagcgtgatggcccccgtgctggagaaggccagaagaaccagagccctgctgcagcccggcgacttcctgaagggcttcaagatgttcggcagcctgttcaagccctacatcagatactgcatggaggaggagggctgcatggagtacatgagaggcctgctgagagacaacgacctgttcagagcctacatcacctgggccgagaagcacccccagtgccagagactgaagctgagcgacatgctggccaagccccaccagagactgaccaagtaccccctgctgctgaagagcgtgctgagaaagaccgaggagcccagagccaaggaggccgtggtggccatgatcggcagcgtggagagattcatccaccacgtgaacgcctgcatgagacagagacaggagagacagagactggccgccgtggtgagcagaatcgacgcctacgaggtggtggagagcagcagcgacgaggtggacaagctgctgaaggagttcctgcacctggacctgaccgcccccatccccggcgccagccccgaggagaccagacagctgctgctggagggcagcctgagaatgaaggagggcaaggacagcaagatggacgtgtactgcttcctgttcaccgacctgctgctggtgaccaaggccgtgaagaaggccgagagaaccagagtgatcagaccccccctgctggtggacaagatcgtgtgcagagagctgagagaccccggcagcttcctgctgatctacctgaacgagttccacagcgccgtgggcgcctacaccttccaggccagcggccaggccctgtgcagaggctgggtggacaccatctacaacgcccagaaccagctgcagcagctgagagcccaggagccccccggcagccagcagcccctgcagagcctggaggaggaggaggacgagcaggaggaggaggaggaggaggaggaggaggaggaggagggcgaggacagcggcaccagcgccgccagcagccccaccatcatgagaaagagcagcggcagccccgacagccagcactgcgccagcgacggcagcaccgagaccctggccatggtggtggtggagcccggcgacaccctgagcagccccgagttcgacagcggccccttcagcagccagagcgacgagaccagcctgagcaccaccgccagcagcgccacccccaccagcgagctgctgcccctgggccccgtggacggcagaagctgcagcatggacagcgcctacggcaccctgagccccaccagcctgcaggacttcgtggcccccggccccatggccgagctggtgcccagagcccccgagagccccagagtgcccagccccccccccagccccagactgagaagaagaacccccgtgcagctgctgagctgccccccccacctgctgaagagcaagagcgaggccagcctgctgcagctgctggccggcgccggcacccacggcacccccagcgcccccagcagaagcctgagcgagctgtgcctggccgtgcccgcccccggcatcagaacccagggcagcccccaggaggccggccccagctgggactgcagaggcgcccccagccccggcagcggccccggcctggtgggctgcctggccggcgagcccgccggcagccacagaaagagatgcggcgacctgcccagcggcgccagccccagagtgcagcccgagcccccccccggcgtgagcgcccagcacagaaagctgaccctggcccagctgtacagaatcagaaccaccctgctgctgaacagcaccctgaccgccagcgaggtgtag

SEQ ID NO: 93582 - DNA, 2793 bp, Artificial Sequence
  Description of Artificial Sequence: Synthetic coding sequence
atgcactacgacggccacgtgagattcgacctgcccccccagggcagcgtgctggccagaaacgtgagcaccagaagctgcccccccagaaccagccccgccgtggacctggaggaggaggaggaggagagcagcgtggacggcaagggcgacagaaagagcaccggcctgaagctgagcaagaagaaggccagaagaagacacaccgacgaccccagcaaggagtgcttcaccctgaagttcgacctgaacgtggacatcgagaccgagatcgtgcccgccatgaagaagaagagcctgggcgaggtgctgctgcccgtgttcgagagaaagggcatcgccctgggcaaggtggacatctacctggaccagagcaacacccccctgagcctgaccttcgaggcctacagattcggcggccactacctgagagtgaaggcccccgccaagcccggcgacgagggcaaggtggagcagggcatgaaggacagcaagagcctgagcctgcccatcctgagacccgccggcaccggcccccccgccctggagagagtggacgcccagagcagaagagagagcctggacatcctggcccccggcagaagaagaaagaacatgagcgagttcctgggcgaggccagcatccccggccaggagccccccacccccagcagctgcagcctgcccagcggcagcagcggcagcaccaacaccggcgacagctggaagaacagagccgccagcagattcagcggcttcttcagcagcggccccagcaccagcgccttcggcagagaggtggacaagatggagcagctggagggcaagctgcacacctacagcctgttcggcctgcccagactgcccagaggcctgagattcgaccacgacagctgggaggaggagtacgacgaggacgaggacgaggacaacgcctgcctgagactggaggacagctggagagagctgatcgacggccacgagaagctgaccagaagacagtgccaccagcaggaggccgtgtgggagctgctgcacaccgaggccagctacatcagaaagctgagagtgatcatcaacctgttcctgtgctgcctgctgaacctgcaggagagcggcctgctgtgcgaggtggaggccgagagactgttcagcaacatccccgagatcgcccagctgcacagaagactgtgggccagcgtgatggcccccgtgctggagaaggccagaagaaccagagccctgctgcagcccggcgacttcctgaagggcttcaagatgttcggcagcctgttcaagccctacatcagatactgcatggaggaggagggctgcatggagtacatgagaggcctgctgagagacaacgacctgttcagagcctacatcacctgggccgagaagcacccccagtgccagagactgaagctgagcgacatgctggccaagccccaccagagactgaccaagtaccccctgctgctgaagagcgtgctgagaaagaccgaggagcccagagccaaggaggccgtggtggccatgatcggcagcgtggagagattcatccaccacgtgaacgcctgcatgagacagagacaggagagacagagactggccgccgtggtgagcagaatcgacgcctacgaggtggtggagagcagcagcgacgaggtggacaagctgctgaaggagttcctgcacctggacctgaccgcccccatccccggcgccagccccgaggagaccagacagctgctgctggagggcagcctgagaatgaaggagggcaaggacagcaagatggacgtgtactgcttcctgttcaccgacctgctgctggtgaccaaggccgtgaagaaggccgagagaaccagagtgatcagaccccccctgctggtggacaagatcgtgtgcagagagctgagagaccccggcagcttcctgctgatctacctgaacgagttccacagcgccgtgggcgcctacaccttccaggccagcggccaggccctgtgcagaggctgggtggacaccatctacaacgcccagaaccagctgcagcagctgagagcccaggagccccccggcagccagcagcccctgcagagcctggaggaggaggaggacgagcaggaggaggaggaggaggaggaggaggaggaggaggagggcgaggacagcggcaccagcgccgccagcagccccaccatcatgagaaagagcagcggcagccccgacagccagcactgcgccagcgacggcagcaccgagaccctggccatggtggtggtggagcccggcgacaccctgagcagccccgagttcgacagcggccccttcagcagccagagcgacgagaccagcctgagcaccaccgccagcagcgccacccccaccagcgagctgctgcccctgggccccgtggacggcagaagctgcagcatggacagcgcctacggcaccctgagccccaccagcctgcaggacttcgtggcccccggccccatggccgagctggtgcccagagcccccgagagccccagagtgcccagccccccccccagccccagactgagaagaagaacccccgtgcagctgctgagctgccccccccacctgctgaagagcaagagcgaggccagcctgctgcagctgctggccggcgccggcacccacggcacccccagcgcccccagcagaagcctgagcgagctgtgcctggccgtgcccgcccccgcccaggaggccgaccccggccccgccctgcccaaccaggaccaccccgccgcctag

SEQ ID NO: 93583 - DNA, 3021 bp, Artificial Sequence; identical to SEQ ID NO: 93581
  Description of Artificial Sequence: Synthetic coding sequence

SEQ ID NO: 93584 - DNA, 3132 bp, Artificial Sequence
  Description of Artificial Sequence: Synthetic coding sequence
atggacaagggcagagccgccaaggtgtgccaccacgccgactgccagcagctgcacagaagaggccccctgaacctgtgcgaggcctgcgacagcaagttccacagcaccatgcactacgacggccacgtgagattcgacctgcccccccagggcagcgtgctggccagaaacgtgagcaccagaagctgcccccccagaaccagccccgccgtggacctggaggaggaggaggaggagagcagcgtggacggcaagggcgacagaaagagcaccggcctgaagctgagcaagaagaaggccagaagaagacacaccgacgaccccagcaaggagtgcttcaccctgaagttcgacctgaacgtggacatcgagaccgagatcgtgcccgccatgaagaagaagagcctgggcgaggtgctgctgcccgtgttcgagagaaagggcatcgccctgggcaaggtggacatctacctggaccagagcaacacccccctgagcctgaccttcgaggcctacagattcggcggccactacctgagagtgaaggcccccgccaagcccggcgacgagggcaaggtggagcagggcatgaaggacagcaagagcctgagcctgcccatcctgagacccgccggcaccggcccccccgccctggagagagtggacgcccagagcagaagagagagcctggacatcctggcccccggcagaagaagaaagaacatgagcgagttcctgggcgaggccagcatccccggccaggagccccccacccccagcagctgcagcctgcccagcggcagcagcggcagcaccaacaccggcgacagctggaagaacagagccgccagcagattcagcggcttcttcagcagcggccccagcaccagcgccttcggcagagaggtggacaagatggagcagctggagggcaagctgcacacctacagcctgttcggcctgcccagactgcccagaggcctgagattcgaccacgacagctgggaggaggagtacgacgaggacgaggacgaggacaacgcctgcctgagactggaggacagctggagagagctgatcgacggccacgagaagctgaccagaagacagtgccaccagcaggaggccgtgtgggagctgctgcacaccgaggccagctacatcagaaagctgagagtgatcatcaacctgttcctgtgctgcctgctgaacctgcaggagagcggcctgctgtgcgaggtggaggccgagagactgttcagcaacatccccgagatcgcccagctgcacagaagactgtgggccagcgtgatggcccccgtgctggagaaggccagaagaaccagagccctgctgcagcccggcgacttcctgaagggcttcaagatgttcggcagcctgttcaagccctacatcagatactgcatggaggaggagggctgcatggagtacatgagaggcctgctgagagacaacgacctgttcagagcctacatcacctgggccgagaagcacccccagtgccagagactgaagctgagcgacatgctggccaagccccaccagagactgaccaagtaccccctgctgctgaagagcgtgctgagaaagaccgaggagcccagagccaaggaggccgtggtggccatgatcggcagcgtggagagattcatccaccacgtgaacgcctgcatgagacagagacaggagagacagagactggccgccgtggtgagcagaatcgacgcctacgaggtggtggagagcagcagcgacgaggtggacaagctgctgaaggagttcctgcacctggacctgaccgcccccatccccggcgccagccccgaggagaccagacagctgctgctggagggcagcctgagaatgaaggagggcaaggacagcaagatggacgtgtactgcttcctgttcaccgacctgctgctggtgaccaaggccgtgaagaaggccgagagaaccagagtgatcagaccccccctgctggtggacaagatcgtgtgcagagagctgagagaccccggcagcttcctgctgatctacctgaacgagttccacagcgccgtgggcgcctacaccttccaggccagcggccaggccctgtgcagaggctgggtggacaccatctacaacgcccagaaccagctgcagcagctgagagcccaggagccccccggcagccagcagcccctgcagagcctggaggaggaggaggacgagcaggaggaggaggaggaggaggaggaggaggaggaggagggcgaggacagcggcaccagcgccgccagcagccccaccatcatgagaaagagcagcggcagccccgacagccagcactgcgccagcgacggcagcaccgagaccctggccatggtggtggtggagcccggcgacaccctgagcagccccgagttcgacagcggccccttcagcagccagagcgacgagaccagcctgagcaccaccgccagcagcgccacccccaccagcgagctgctgcccctgggccccgtggacggcagaagctgcagcatggacagcgcctacggcaccctgagccccaccagcctgcaggacttcgtggcccccggccccatggccgagctggtgcccagagcccccgagagccccagagtgcccagccccccccccagccccagactgagaagaagaacccccgtgcagctgctgagctgccccccccacctgctgaagagcaagagcgaggccagcctgctgcagctgctggccggcgccggcacccacggcacccccagcgcccccagcagaagcctgagcgagctgtgcctggccgtgcccgcccccggcatcagaacccagggcagcccccaggaggccggccccagctgggactgcagaggcgcccccagccccggcagcggccccggcctggtgggctgcctggccggcgagcccgccggcagccacagaaagagatgcggcgacctgcccagcggcgccagccccagagtgcagcccgagcccccccccggcgtgagcgcccagcacagaaagctgaccctggcccagctgtacagaatcagaaccaccctgctgctgaacagcaccctgaccgccagcgaggtgtag

SEQ ID NO: 93585 - DNA, 3021 bp, Artificial Sequence; identical to SEQ ID NO: 93581
  Description of Artificial Sequence: Synthetic coding sequence

SEQ ID NO: 93586 - DNA, 2559 bp, Artificial Sequence
  Description of Artificial Sequence: Synthetic coding sequence
atgaacagcgtgctgaccaagcacggcagcccccccagaagctggctgagcctgtgcagcggcaccgacgaccagagccccgccgagaagaagggcctgagatgccagaaccccgcctgcatggacaagggcagagccgccaaggtgtgccaccacgccgactgccagcagctgcacagaagaggccccctgaacctgtgcgaggcctgcgacagcaagttccacagcaccatgcactacgacggccacgtgagattcgacctgcccccccagggcagcgtgctggccagaaacgtgagcaccagaagctgcccccccagaaccagccccgccgtggacctggaggaggaggaggaggagagcagcgtggacggcaagggcgacagaaagagcaccggcctgaagctgagcaagaagaaggccagaagaagacacaccgacgaccccagcaaggagtgcttcaccctgaagttcgacctgaacgtggacatcgagaccgagatcgtgcccgccatgaagaagaagagcctgggcgaggtgctgctgcccgtgttcgagagaaagggcatcgccctgggcaaggtggacatctacctggaccagagcaacacccccctgagcctgaccttcgaggcctacagattcggcggccactacctgagagtgaaggcccccgccaagcccggcgacgagggcaaggtggagcagggcatgaaggacagcaagagcctgagcctgcccatcctgagacccgccggcaccggcccccccgccctggagagagtggacgcccagagcagaagagagagcctggacatcctggcccccggcagaagaagaaagaacatgagcgagttcctgggcgaggccagcatccccggccaggagccccccacccccagcagctgcagcctgcccagcggcagcagcggcagcaccaacaccggcgacagctggaagaacagagccgccagcagattcagcggcttcttcagcagcggccccagcaccagcgccttcggcagagaggtggacaagatggagcagctggagggcaagctgcacacctacagcctgttcggcctgcccagactgcccagaggcctgagattcgaccacgacagctgggaggaggagtacgacgaggacgaggacgaggacaacgcctgcctgagactggaggacagctggagagagctgatcgacggccacgagaagctgaccagaagacagtgccaccagcaggaggccgtgtgggagctgctgcacaccgaggccagctacatcagaaagctgagagtgatcatcaacctgttcctgtgctgcctgctgaacctgcaggagagcggcctgctgtgcgaggtggaggccgagagactgttcagcaacatccccgagatcgcccagctgcacagaagactgtgggccagcgtgatggcccccgtgctggagaaggccagaagaaccagagccctgctgcagcccggcgacttcctgaagggcttcaagatgttcggcagcctgttcaagccctacatcagatactgcatggaggaggagggctgcatggagtacatgagaggcctgctgagagacaacgacctgttcagagcctacatcacctgggccgagaagcacccccagtgccagagactgaagctgagcgacatgctggccaagccccaccagagactgaccaagtaccccctgctgctgaagagcgtgctgagaaagaccgaggagcccagagccaaggaggccgtggtggccatgatcggcagcgtggagagattcatccaccacgtgaacgcctgcatgagacagagacaggagagacagagactggccgccgtggtgagcagaatcgacgcctacgaggtggtggagagcagcagcgacgaggtggacaagctgctgaaggagttcctgcacctggacctgaccgcccccatccccggcgccagccccgaggagaccagacagctgctgctggagggcagcctgagaatgaaggagggcaaggacagcaagatggacgtgtactgcttcctgttcaccgacctgctgctggtgaccaaggccgtgaagaaggccgagagaaccagagtgatcagaccccccctgctggtggacaagatcgtgtgcagagagctgagagaccccggcagcttcctgctgatctacctgaacgagttccacagcgccgtgggcgcctacaccttccaggccagcggccaggccctgtgcagaggctgggtggacaccatctacaacgcccagaaccagctgcagcagctgagagcccaggagccccccggcagccagcagcccctgcagagcctggaggaggaggaggacgagcaggaggaggaggaggaggaggaggaggaggaggaggagggcgaggacagcggcaccagcgccgccagcagccccaccatcatgagaaagagcagcggcagccccgacagccagcactggaagctgaccctggcccagctgtacagaatcagaaccaccctgctgctgaacagcaccctgaccgccagcgaggtgtag

SEQ ID NO: 93587 - DNA, 3252 bp, Artificial Sequence
  Description of Artificial Sequence: Synthetic coding sequence
atgaacagcgtgctgaccaagcacggcagcccccccagaagctggctgagcctgtgcagcggcaccgacgaccagagccccgccgagaagaagggcctgagatgccagaaccccgcctgcatggacaagggcagagccgccaaggtgtgccaccacgccgactgccagcagctgcacagaagaggccccctgaacctgtgcgaggcctgcgacagcaagttccacagcaccatgcactacgacggccacgtgagattcgacctgcccccccagggcagcgtgctggccagaaacgtgagcaccagaagctgcccccccagaaccagccccgccgtggacctggaggaggaggaggaggagagcagcgtggacggcaagggcgacagaaagagcaccggcctgaagctgagcaagaagaaggccagaagaagacacaccgacgaccccagcaaggagtgcttcaccctgaagttcgacctgaacgtggacatcgagaccgagatcgtgcccgccatgaagaagaagagcctgggcgaggtgctgctgcccgtgttcgagagaaagggcatcgccctgggcaaggtggacatctacctggaccagagcaacacccccctgagcctgaccttcgaggcctacagattcggcggccactacctgagagtgaaggcccccgccaagcccggcgacgagggcaaggtggagcagggcatgaaggacagcaagagcctgagcctgcccatcctgagacccgccggcaccggcccccccgccctggagagagtggacgcccagagcagaagagagagcctggacatcctggcccccggcagaagaagaaagaacatgagcgagttcctgggcgaggccagcatccccggccaggagccccccacccccagcagctgcagcctgcccagcggcagcagcggcagcaccaacaccggcgacagctggaagaacagagccgccagcagattcagcggcttcttcagcagcggccccagcaccagcgccttcggcagagaggtggacaagatggagcagctggagggcaagctgcacacctacagcctgttcggcctgcccagactgcccagaggcctgagattcgaccacgacagctgggaggaggagtacgacgaggacgaggacgaggacaacgcctgcctgagactggaggacagctggagagagctgatcgacggccacgagaagctgaccagaagacagtgccaccagcaggaggccgtgtgggagctgctgcacaccgaggccagctacatcagaaagctgagagtgatcatcaacctgttcctgtgctgcctgctgaacctgcaggagagcggcctgctgtgcgaggtggaggccgagagactgttcagcaacatccccgagatcgcccagctgcacagaagactgtgggccagcgtgatggcccccgtgctggagaaggccagaagaaccagagccctgctgcagcccggcgacttcctgaagggcttcaagatgttcggcagcctgttcaagccctacatcagatactgcatggaggaggagggctgcatggagtacatgagaggcctgctgagagacaacgacctgttcagagcctacatcacctgggccgagaagcacccccagtgccagagactgaagctgagcgacatgctggccaagccccaccagagactgaccaagtaccccctgctgctgaagagcgtgctgagaaagaccgaggagcccagagccaaggaggccgtggtggccatgatcggcagcgtggagagattcatccaccacgtgaacgcctgcatgagacagagacaggagagacagagactggccgccgtggtgagcagaatcgacgcctacgaggtggtggagagcagcagcgacgaggtggacaagctgctgaaggagttcctgcacctggacctgaccgcccccatccccggcgccagccccgaggagaccagacagctgctgctggagggcagcctgagaatgaaggagggcaaggacagcaagatggacgtgtactgcttcctgttcaccgacctgctgctggtgaccaaggccgtgaagaaggccgagagaaccagagtgatcagaccccccctgctggtggacaagatcgtgtgcagagagctgagagaccccggcagcttcctgctgatctacctgaacgagttccacagcgccgtgggcgcctacaccttccaggccagcggccaggccctgtgcagaggctgggtggacaccatctacaacgcccagaaccagctgcagcagctgagagcccaggagccccccggcagccagcagcccctgcagagcctggaggaggaggaggacgagcaggaggaggaggaggaggaggaggaggaggaggaggagggcgaggacagcggcaccagcgccgccagcagccccaccatcatgagaaagagcagcggcagccccgacagccagcactgcgccagcgacggcagcaccgagaccctggccatggtggtggtggagcccggcgacaccctgagcagccccgagttcgacagcggccccttcagcagccagagcgacgagaccagcctgagcaccaccgccagcagcgccacccccaccagcgagctgctgcccctgggccccgtggacggcagaagctgcagcatggacagcgcctacggcaccctgagccccaccagcctgcaggacttcgtggcccccggccccatggccgagctggtgcccagagcccccgagagccccagagtgcccagccccccccccagccccagactgagaagaagaacccccgtgcagctgctgagctgccccccccacctgctgaagagcaagagcgaggccagcctgctgcagctgctggccggcgccggcacccacggcacccccagcgcccccagcagaagcctgagcgagctgtgcctggccgtgcccgcccccggcatcagaacccagggcagcccccaggaggccggccccagctgggactgcagaggcgcccccagccccggcagcggccccggcctggtgggctgcctggccggcgagcccgccggcagccacagaaagagatgcggcgacctgcccagcggcgccagccccagagtgcagcccgagcccccccccggcgtgagcgcccagcacagaaagctgaccctggcccagctgtacagaatcagaaccaccctgctgctgaacagcaccctgaccgccagcgaggtgtag

SEQ ID NO: 93588 - DNA, 3021 bp, Artificial Sequence; identical to SEQ ID NO: 93581
  Description of Artificial Sequence: Synthetic coding sequence

SEQ ID NO: 93589 - DNA, 3189 bp, Artificial Sequence
  Description of Artificial Sequence: Synthetic coding sequence
atggacgaccagagccccgccgagaagaagggcctgagatgccagaaccccgcctgcatggacaagggcagagccgccaaggtgtgccaccacgccgactgccagcagctgcacagaagaggccccctgaacctgtgcgaggcctgcgacagcaagttccacagcaccatgcactacgacggccacgtgagattcgacctgcccccccagggcagcgtgctggccagaaacgtgagcaccagaagctgcccccccagaaccagccccgccgtggacctggaggaggaggaggaggagagcagcgtggacggcaagggcgacagaaagagcaccggcctgaagctgagcaagaagaaggccagaagaagacacaccgacgaccccagcaaggagtgcttcaccctgaagttcgacctgaacgtggacatcgagaccgagatcgtgcccgccatgaagaagaagagcctgggcgaggtgctgctgcccgtgttcgagagaaagggcatcgccctgggcaaggtggacatctacctggaccagagcaacacccccctgagcctgaccttcgaggcctacagattcggcggccactacctgagagtgaaggcccccgccaagcccggcgacgagggcaaggtggagcagggcatgaaggacagcaagagcctgagcctgcccatcctgagacccgccggcaccggcccccccgccctggagagagtggacgcccagagcagaagagagagcctggacatcctggcccccggcagaagaagaaagaacatgagcgagttcctgggcgaggccagcatccccggccaggagccccccacccccagcagctgcagcctgcccagcggcagcagcggcagcaccaacaccggcgacagctggaagaacagagccgccagcagattcagcggcttcttcagcagcggccccagcaccagcgccttcggcagagaggtggacaagatggagcagctggagggcaagctgcacacctacagcctgttcggcctgcccagactgcccagaggcctgagattcgaccacgacagctgggaggaggagtacgacgaggacgaggacgaggacaacgcctgcctgagactggaggacagctggagagagctgatcgacggccacgagaagctgaccagaagacagtgccaccagcaggaggccgtgtgggagctgctgcacaccgaggccagctacatcagaaagctgagagtgatcatcaacctgttcctgtgctgcctgctgaacctgcaggagagcggcctgctgtgcgaggtggaggccgagagactgttcagcaacatccccgagatcgcccagctgcacagaagactgtgggccagcgtgatggcccccgtgctggagaaggccagaagaaccagagccctgctgcagcccggcgacttcctgaagggcttcaagatgttcggcagcctgttcaagccctacatcagatactgcatggaggaggagggctgcatggagtacatgagaggcctgctgagagacaacgacctgttcagagcctacatcacctgggccgagaagcacccccagtgccagagactgaagctgagcgacatgctggccaagccccaccagagactgaccaagtaccccctgctgctgaagagcgtgctgagaaagaccgaggagcccagagccaaggaggccgtggtggccatgatcggcagcgtggagagattcatccaccacgtgaacgcctgcatgagacagagacaggagagacagagactggccgccgtggtgagcagaatcgacgcctacgaggtggtggagagcagcagcgacgaggtggacaagctgctgaaggagttcctgcacctggacctgaccgcccccatccccggcgccagccccgaggagaccagacagctgctgctggagggcagcctgagaatgaaggagggcaaggacagcaagatggacgtgtactgcttcctgttcaccgacctgctgctggtgaccaaggccgtgaagaaggccgagagaaccagagtgatcagaccccccctgctggtggacaagatcgtgtgcagagagctgagagaccccggcagcttcctgctgatctacctgaacgagttccacagcgccgtgggcgcctacaccttccaggccagcggccaggccctgtgcagaggctgggtggacaccatctacaacgcccagaaccagctgcagcagctgagagcccaggagccccccggcagccagcagcccctgcagagcctggaggaggaggaggacgagcaggaggaggaggaggaggaggaggaggaggaggaggagggcgaggacagcggcaccagcgccgccagcagccccaccatcatgagaaagagcagcggcagccccgacagccagcactgcgccagcgacggcagcaccgagaccctggccatggtggtggtggagcccggcgacaccctgagcagccccgagttcgacagcggccccttcagcagccagagcgacgagaccagcctgagcaccaccgccagcagcgccacccccaccagcgagctgctgcccctgggccccgtggacggcagaagctgcagcatggacagcgcctacggcaccctgagccccaccagcctgcaggacttcgtggcccccggccccatggccgagctggtgcccagagcccccgagagccccagagtgcccagccccccccccagccccagactgagaagaagaacccccgtgcagctgctgagctgccccccccacctgctgaagagcaagagcgaggccagcctgctgcagctgctggccggcgccggcacccacggcacccccagcgcccccagcagaagcctgagcgagctgtgcctggccgtgcccgcccccggcatcagaacccagggcagcccccaggaggccggccccagctgggactgcagaggcgcccccagccccggcagcggccccggcctggtgggctgcctggccggcgagcccgccggcagccacagaaagagatgcggcgacctgcccagcggcgccagccccagagtgcagcccgagcccccccccggcgtgagcgcccagcacagaaagctgaccctggcccagctgtacagaatcagaaccaccctgctgctgaacagcaccctgaccgccagcgaggtgtag

SEQ ID NO: 93590 - DNA, 3228 bp, Artificial Sequence
  Description of Artificial Sequence: Synthetic coding sequence
atgggcaccggccccggcgtgagcggcagactggccgccagcagacccggccccggcctgcccctgagagacagcgagcccagctgggccggcggcagagccagagacggcgacagccaggtgtgccaccacgccgactgccagcagctgcacagaagaggccccctgaacctgtgcgaggcctgcgacagcaagttccacagcaccatgcactacgacggccacgtgagattcgacctgcccccccagggcagcgtgctggccagaaacgtgagcaccagaagctgcccccccagaaccagccccgccgtggacctggaggaggaggaggaggagagcagcgtggacggcaagggcgacagaaagagcaccggcctgaagctgagcaagaagaaggccagaagaagacacaccgacgaccccagcaaggagtgcttcaccctgaagttcgacctgaacgtggacatcgagaccgagatcgtgcccgccatgaagaagaagagcctgggcgaggtgctgctgcccgtgttcgagagaaagggcatcgccctgggcaaggtggacatctacctggaccagagcaacacccccctgagcctgaccttcgaggcctacagattcggcggccactacctgagagtgaaggcccccgccaagcccggcgacgagggcaaggtggagcagggcatgaaggacagcaagagcctgagcctgcccatcctgagacccgccggcaccggcccccccgccctggagagagtggacgcccagagcagaagagagagcctggacatcctggcccccggcagaagaagaaagaacatgagcgagttcctgggcgaggccagcatccccggccaggagccccccacccccagcagctgcagcctgcccagcggcagcagcggcagcaccaacaccggcgacagctggaagaacagagccgccagcagattcagcggcttcttcagcagcggccccagcaccagcgccttcggcagagaggtggacaagatggagcagctggagggcaagctgcacacctacagcctgttcggcctgcccagactgcccagaggcctgagattcgaccacgacagctgggaggaggagtacgacgaggacgaggacgaggacaacgcctgcctgagactggaggacagctggagagagctgatcgacggccacgagaagctgaccagaagacagtgccaccagcaggaggccgtgtgggagctgctgcacaccgaggccagctacatcagaaagctgagagtgatcatcaacctgttcctgtgctgcctgctgaacctgcaggagagcggcctgctgtgcgaggtggaggccgagagactgttcagcaacatccccgagatcgcccagctgcacagaagactgtgggccagcgtgatggcccccgtgctggagaaggccagaagaaccagagccctgctgcagcccggcgacttcctgaagggcttcaagatgttcggcagcctgttcaagccctacatcagatactgcatggaggaggagggctgcatggagtacatgagaggcctgctgagagacaacgacctgttcagagcctacatcacctgggccgagaagcacccccagtgccagagactgaagctgagcgacatgctggccaagccccaccagagactgaccaagtaccccctgctgctgaagagcgtgctgagaaagaccgaggagcccagagccaaggaggccgtggtggccatgatcggcagcgtggagagattcatccaccacgtgaacgcctgcatgagacagagacaggagagacagagactggccgccgtggtgagcagaatcgacgcctacgaggtggtggagagcagcagcgacgaggtggacaagctgctgaaggagttcctgcacctggacctgaccgcccccatccccggcgccagccccgaggagaccagacagctgctgctggagggcagcctgagaatgaaggagggcaaggacagcaagatggacgtgtactgcttcctgttcaccgacctgctgctggtgaccaaggccgtgaagaaggccgagagaaccagagtgatcagaccccccctgctggtggacaagatcgtgtgcagagagctgagagaccccggcagcttcctgctgatctacctgaacgagttccacagcgccgtgggcgcctacaccttccaggccagcggccaggccctgtgcagaggctgggtggacaccatctacaacgcccagaaccagctgcagcagctgagagcccaggagccccccggcagccagcagcccctgcagagcctggaggaggaggaggacgagcaggaggaggaggaggaggaggaggaggaggaggaggagggcgaggacagcggcaccagcgccgccagcagccccaccatcatgagaaagagcagcggcagccccgacagccagcactgcgccagcgacggcagcaccgagaccctggccatggtggtggtggagcccggcgacaccctgagcagccccgagttcgacagcggccccttcagcagccagagcgacgagaccagcctgagcaccaccgccagcagcgccacccccaccagcgagctgctgcccctgggccccgtggacggcagaagctgcagcatggacagcgcctacggcaccctgagccccaccagcctgcaggacttcgtggcccccggccccatggccgagctggtgcccagagcccccgagagccccagagtgcccagccccccccccagccccagactgagaagaagaacccccgtgcagctgctgagctgccccccccacctgctgaagagcaagagcgaggccagcctgctgcagctgctggccggcgccggcacccacggcacccccagcgcccccagcagaagcctgagcgagctgtgcctggccgtgcccgcccccggcatcagaacccagggcagcccccaggaggccggccccagctgggactgcagaggcgcccccagccccggcagcggccccggcctggtgggctgcctggccggcgagcccgccggcagccacagaaagagatgcggcgacctgcccagcggcgccagccccagagtgcagcccgagcccccccccggcgtgagcgcccagcacagaaagctgaccctggcccagctgtacagaatcagaaccaccctgctgctgaacagcaccctgaccgccagcgaggtgtag

SEQ ID NO: 93591 - DNA, 2739 bp, Artificial Sequence
  Description of Artificial Sequence: Synthetic coding sequence
atgaagaagaagagcctgggcgaggtgctgctgcccgtgttcgagagaaagggcatcgccctgggcaaggtggacatctacctggaccagagcaacacccccctgagcctgaccttcgaggcctacagattcggcggccactacctgagagtgaaggcccccgccaagcccggcgacgagggcaaggtggagcagggcatgaaggacagcaagagcctgagcctgcccatcctgagacccgccggcaccggcccccccgccctggagagagtggacgcccagagcagaagagagagcctggacatcctggcccccggcagaagaagaaagaacatgagcgagttcctgggcgaggccagcatccccggccaggagccccccacccccagcagctgcagcctgcccagcggcagcagcggcagcaccaacaccggcgacagctggaagaacagagccgccagcagattcagcggcttcttcagcagcggccccagcaccagcgccttcggcagagaggtggacaagatggagcagctggagggcaagctgcacacctacagcctgttcggcctgcccagactgcccagaggcctgagattcgaccacgacagctgggaggaggagtacgacgaggacgaggacgaggacaacgcctgcctgagactggaggacagctggagagagctgatcgacggccacgagaagctgaccagaagacagtgccaccagcaggaggccgtgtgggagctgctgcacaccgaggccagctacatcagaaagctgagagtgatcatcaacctgttcctgtgctgcctgctgaacctgcaggagagcggcctgctgtgcgaggtggaggccgagagactgttcagcaacatccccgagatcgcccagctgcacagaagactgtgggccagcgtgatggcccccgtgctggagaaggccagaagaaccagagccctgctgcagcccggcgacttcctgaagggcttcaagatgttcggcagcctgttcaagccctacatcagatactgcatggaggaggagggctgcatggagtacatgagaggcctgctgagagacaacgacctgttcagagcctacatcacctgggccgagaagcacccccagtgccagagactgaagctgagcgacatgctggccaagccccaccagagactgaccaagtaccccctgctgctgaagagcgtgctgagaaagaccgaggagcccagagccaaggaggccgtggtggccatgatcggcagcgtggagagattcatccaccacgtgaacgcctgcatgagacagagacaggagagacagagactggccgccgtggtgagcagaatcgacgcctacgaggtggtggagagcagcagcgacgaggtggacaagctgctgaaggagttcctgcacctggacctgaccgcccccatccccggcgccagccccgaggagaccagacagctgctgctggagggcagcctgagaatgaaggagggcaaggacagcaagatggacgtgtactgcttcctgttcaccgacctgctgctggtgaccaaggccgtgaagaaggccgagagaaccagagtgatcagaccccccctgctggtggacaagatcgtgtgcagagagctgagagaccccggcagcttcctgctgatctacctgaacgagttccacagcgccgtgggcgcctacaccttccaggccagcggccaggccctgtgcagaggctgggtggacaccatctacaacgcccagaaccagctgcagcagctgagagcccaggagccccccggcagccagcagcccctgcagagcctggaggaggaggaggacgagcaggaggaggaggaggaggaggaggaggaggaggaggagggcgaggacagcggcaccagcgccgccagcagccccaccatcatgagaaagagcagcggcagccccgacagccagcactgcgccagcgacggcagcaccgagaccctggccatggtggtggtggagcccggcgacaccctgagcagccccgagttcgacagcggccccttcagcagccagagcgacgagaccagcctgagcaccaccgccagcagcgccacccccaccagcgagctgctgcccctgggccccgtggacggcagaagctgcagcatggacagcgcctacggcaccctgagccccaccagcctgcaggacttcgtggcccccggccccatggccgagctggtgcccagagcccccgagagccccagagtgcccagccccccccccagccccagactgagaagaagaacccccgtgcagctgctgagctgccccccccacctgctgaagagcaagagcgaggccagcctgctgcagctgctggccggcgccggcacccacggcacccccagcgcccccagcagaagcctgagcgagctgtgcctggccgtgcccgcccccggcatcagaacccagggcagcccccaggaggccggccccagctgggactgcagaggcgcccccagccccggcagcggccccggcctggtgggctgcctggccggcgagcccgccggcagccacagaaagagatgcggcgacctgcccagcggcgccagccccagagtgcagcccgagcccccccccggcgtgagcgcccagcacagaaagctgaccctggcccagctgtacagaatcagaaccaccctgctgctgaacagcaccctgaccgccagcgaggtgtag

SEQ ID NO: 93592 - DNA, 3258 bp, Artificial Sequence
  Description of Artificial Sequence: Synthetic coding sequence
atgagcctgggcgagagaggcagcccccagaccttcggcggcagcagcgtgagcaagggcagcgacgccggccacgaccagagccccgccgagaagaagggcctgagatgccagaaccccgcctgcatggacaagggcagagccgccaaggtgtgccaccacgccgactgccagcagctgcacagaagaggccccctgaacctgtgcgaggcctgcgacagcaagttccacagcaccatgcactacgacggccacgtgagattcgacctgcccccccagggcagcgtgctggccagaaacgtgagcaccagaagctgcccccccagaaccagccccgccgtggacctggaggaggaggaggaggagagcagcgtggacggcaagggcgacagaaagagcaccggcctgaagctgagcaagaagaaggccagaagaagacacaccgacgaccccagcaaggagtgcttcaccctgaagttcgacctgaacgtggacatcgagaccgagatcgtgcccgccatgaagaagaagagcctgggcgaggtgctgctgcccgtgttcgagagaaagggcatcgccctgggcaaggtggacatctacctggaccagagcaacacccccctgagcctgaccttcgaggcctacagattcggcggccactacctgagagtgaaggcccccgccaagcccggcgacgagggcaaggtggagcagggcatgaaggacagcaagagcctgagcctgcccatcctgagacccgccggcaccggcccccccgccctggagagagtggacgcccagagcagaagagagagcctggacatcctggcccccggcagaagaagaaagaacatgagcgagttcctgggcgaggccagcatccccggccaggagccccccacccccagcagctgcagcctgcccagcggcagcagcggcagcaccaacaccggcgacagctggaagaacagagccgccagcagattcagcggcttcttcagcagcggccccagcaccagcgccttcggcagagaggtggacaagatggagcagctggagggcaagctgcacacctacagcctgttcggcctgcccagactgcccagaggcctgagattcgaccacgacagctgggaggaggagtacgacgaggacgaggacgaggacaacgcctgcctgagactggaggacagctggagagagctgatcgacggccacgagaagctgaccagaagacagtgccaccagcaggaggccgtgtgggagctgctgcacaccgaggccagctacatcagaaagctgagagtgatcatcaacctgttcctgtgctgcctgctgaacctgcaggagagcggcctgctgtgcgaggtggaggccgagagactgttcagcaacatccccgagatcgcccagctgcacagaagactgtgggccagcgtgatggcccccgtgctggagaaggccagaagaaccagagccctgctgcagcccggcgacttcctgaagggcttcaagatgttcggcagcctgttcaagccctacatcagatactgcatggaggaggagggctgcatggagtacatgagaggcctgctgagagacaacgacctgttcagagcctacatcacctgggccgagaagcacccccagtgccagagactgaagctgagcgacatgctggccaagccccaccagagactgaccaagtaccccctgctgctgaagagcgtgctgagaaagaccgaggagcccagagccaaggaggccgtggtggccatgatcggcagcgtggagagattcatccaccacgtgaacgcctgcatgagacagagacaggagagacagagactggccgccgtggtgagcagaatcgacgcctacgaggtggtggagagcagcagcgacgaggtggacaagctgctgaaggagttcctgcacctggacctgaccgcccccatccccggcgccagccccgaggagaccagacagctgctgctggagggcagcctgagaatgaaggagggcaaggacagcaagatggacgtgtactgcttcctgttcaccgacctgctgctggtgaccaaggccgtgaagaaggccgagagaaccagagtgatcagaccccccctgctggtggacaagatcgtgtgcagagagctgagagaccccggcagcttcctgctgatctacctgaacgagttccacagcgccgtgggcgcctacaccttccaggccagcggccaggccctgtgcagaggctgggtggacaccatctacaacgcccagaaccagctgcagcagctgagagcccaggagccccccggcagccagcagcccctgcagagcctggaggaggaggaggacgagcaggaggaggaggaggaggaggaggaggaggaggaggagggcgaggacagcggcaccagcgccgccagcagccccaccatcatgagaaagagcagcggcagccccgacagccagcactgcgccagcgacggcagcaccgagaccctggccatggtggtggtggagcccggcgacaccctgagcagccccgagttcgacagcggccccttcagcagccagagcgacgagaccagcctgagcaccaccgccagcagcgccacccccaccagcgagctgctgcccctgggccccgtggacggcagaagctgcagcatggacagcgcctacggcaccctgagccccaccagcctgcaggacttcgtggcccccggccccatggccgagctggtgcccagagcccccgagagccccagagtgcccagccccccccccagccccagactgagaagaagaacccccgtgcagctgctgagctgccccccccacctgctgaagagcaagagcgaggccagcctgctgcagctgctggccggcgccggcacccacggcacccccagcgcccccagcagaagcctgagcgagctgtgcctggccgtgcccgcccccggcatcagaacccagggcagcccccaggaggccggccccagctgggactgcagaggcgcccccagccccggcagcggccccggcctggtgggctgcctggccggcgagcccgccggcagccacagaaagagatgcggcgacctgcccagcggcgccagccccagagtgcagcccgagcccccccccggcgtgagcgcccagcacagaaagctgaccctggcccagctgtacagaatcagaaccaccctgctgctgaacagcaccctgaccgccagcgaggtgtag

SEQ ID NO: 93593 - DNA, 2793 bp, Artificial Sequence; identical to SEQ ID NO: 93582
  Description of Artificial Sequence: Synthetic coding sequence

SEQ ID NO: 93594 - DNA, 2373 bp, Artificial Sequence
  Description of Artificial Sequence: Synthetic coding sequence
atgaaggccttcggccccccccacgagggccccctgcagggcctggtggccagcagaatcgagacctacggcggcagacacagagccagcgcccagagcaccgccggcagactgtaccccagaggctaccccgtgctggaccccagcagaagaagactgcagcagtacgtgcccttcgccagaggcagcggccaggccagaggcctgagccccatgagactgagagaccccgagcccgagaagagacacggcggccacgtgggcgccggcctgctgcacagccccaagctgaaggagctgaccaaggcccacgagctggaggtgagactgcacaccttcagcatgttcggcatgcccagactgccccccgaggacagaagacactgggagatcggcgagggcggcgacagcggcctgaccatcgagaagagctggagagagctggtgcccggccacaaggagatgagccaggagctgtgccaccagcaggaggccctgtgggagctgctgaccaccgagctgatctacgtgagaaagctgaagatcatgaccgacctgctggccgccggcctgctgaacctgcagagagtgggcctgctgatggaggtgagcgccgagaccctgttcggcaacgtgcccagcctgatcagaacccacagaagcttctgggacgaggtgctgggccccaccctggaggagaccagagccagcggccagcccctggaccccatcggcctgcagagcggcttcctgaccttcggccagagattccacccctacgtgcagtactgcctgagagtgaagcagaccatggcctacgccagagagcagcaggagaccaaccccctgttccacgccttcgtgcagtggtgcgagaagcacaagagaagcggcagacagatgctgtgcgacctgctgatcaagccccaccagagaatcaccaagtaccccctgctgctgcacgccgtgctgaagagaagccccgaggccagagcccaggaggccctgaacgccatgatcgaggccgtggagagcttcctgagacacatcaacggccaggtgagacagggcgaggagcaggagagcctggccgccgccgcccagagaatcggcccctacgaggtgctggagccccccagcgacgaggtggagaagaacctgagacccttcagcaccctggacctgaccagccccatgctgggcgtggccagcgagcacaccagacagctgctgctggagggccccgtgagagtgaaggagggcagagagggcaagctggacgtgtacctgttcctgttcagcgacgtgctgctggtgaccaagccccagagaaaggccgacaaggccaaggtgatcagaccccccctgatgctggagaagctggtgtgccagcccctgagagaccccaacagcttcctgctgatccacctgaccgagttccagtgcgtgagcagcgccctgctggtgcactgccccagccccaccgacagagcccagtggctggagaagacccagcaggcccaggccgccctgcagaagctgaaggccgaggagtacgtgcagcagaagagagagctgctgaccctgtacagagaccaggacagagagagccccagcaccagacccagcacccccagcctggagggcagccagagcagcgccgagggcagaacccccgagttcagcaccatcatcccccacctggtggtgaccgaggacaccgacgaggacgcccccctggtgcccgacgacaccagcgacagcggctacggcaccctgatccccggcacccccaccggcagcagaagccccctgagcagactgagacagagagccctgagaagagaccccagactgaccttcagcaccctggagctgagagacatccccctgagaccccacccccccgacccccaggccccccagagaagaagcgcccccgagctgcccgagggcatcctgaagggcggcagcctgccccaggaggacccccccacctggagcgaggaggaggacggcgccagcgagagaggcaacgtggtggtggagaccctgcacagagccagactgagaggccagctgcccagcagccccacccacgccgacagcgccggcgagagcccctgggagagcagcggcgaggaggaggaggagggccccctgttcctgaaggccggccacaccagcctgagacccatgagagccgaggacatgctgagagagatcagagaggagctggccagccagagaatcgagggcgccgaggagcccagagacagcagacccagaaagctgaccagagcccagctgcagagaatgagaggcccccacatcatccagctggacacccccctgagcgccagcgaggtgtag

SEQ ID NO: 93595 - DNA, 963 bp, Artificial Sequence
  Description of Artificial Sequence: Synthetic coding sequence
atgtgccccagagagggcggcagagccagcaccatccaccagaagaccgagaaggccttcggccagctgctgtgccagcccctgggcgagcccaagatccagcaccccctgaaggccgccctgcagaagctgaaggccgaggagtacgtgcagcagaagagagagctgctgaccctgtacagagaccaggacagagagagccccagcaccagacccagcacccccagcctggagggcagccagagcagcgccgagggcagaacccccgagttcagcaccatcatcccccacctggtggtgaccgaggacaccgacgaggacgcccccctggtgcccgacgacaccagcgacagcggctacggcaccctgatccccggcacccccaccggcagcagaagccccctgagcagactgagacagagagccctgagaagagaccccagactgaccttcagcaccctggagctgagagacatccccctgagaccccacccccccgacccccaggccccccagagaagaagcgcccccgagctgcccgagggcatcctgaagggcggcagcctgccccaggaggacccccccacctggagcgaggaggaggacggcgccagcgagagaggcaacgtggtggtggagaccctgcacagagccagactgagaggccagctgcccagcagccccacccacgccgacagcgccggcgagagcccctgggagagcagcggcgaggaggaggaggagggccccctgttcctgaaggccggccacaccagcctgagacccatgagagccgaggacatgctgagagagatcagagaggagctggccagccagagaatcgagggcgccgaggagcccagagacagcagacccagaaagctgaccagagcccagctgcagagaatgagaggcccccacatcatccagctggacacccccctgagcgccagcgaggtgtag

SEQ ID NO: 93596 - DNA, 2373 bp, Artificial Sequence; identical to SEQ ID NO: 93594
  Description of Artificial Sequence: Synthetic coding sequence

SEQ ID NO: 93597 - DNA, 2277 bp, Artificial Sequence
  Description of Artificial Sequence: Synthetic coding sequence
atgggctgcagactgcacgcccccggcgagaaggccgcccacgaccccagcagaagaagactgcagcagtacgtgcccttcgccagaggcagcggccaggccagaggcctgagccccatgagactgagagaccccgagcccgagaagagacacggcggccacgtgggcgccggcctgctgcacagccccaagctgaaggagctgaccaaggcccacgagctggaggtgagactgcacaccttcagcatgttcggcatgcccagactgccccccgaggacagaagacactgggagatcggcgagggcggcgacagcggcctgaccatcgagaagagctggagagagctggtgcccggccacaaggagatgagccaggagctgtgccaccagcaggaggccctgtgggagctgctgaccaccgagctgatctacgtgagaaagctgaagatcatgaccgacctgctggccgccggcctgctgaacctgcagagagtgggcctgctgatggaggtgagcgccgagaccctgttcggcaacgtgcccagcctgatcagaacccacagaagcttctgggacgaggtgctgggccccaccctggaggagaccagagccagcggccagcccctggaccccatcggcctgcagagcggcttcctgaccttcggccagagattccacccctacgtgcagtactgcctgagagtgaagcagaccatggcctacgccagagagcagcaggagaccaaccccctgttccacgccttcgtgcagtggtgcgagaagcacaagagaagcggcagacagatgctgtgcgacctgctgatcaagccccaccagagaatcaccaagtaccccctgctgctgcacgccgtgctgaagagaagccccgaggccagagcccaggaggccctgaacgccatgatcgaggccgtggagagcttcctgagacacatcaacggccaggtgagacagggcgaggagcaggagagcctggccgccgccgcccagagaatcggcccctacgaggtgctggagccccccagcgacgaggtggagaagaacctgagacccttcagcaccctggacctgaccagccccatgctgggcgtggccagcgagcacaccagacagctgctgctggagggccccgtgagagtgaaggagggcagagagggcaagctggacgtgtacctgttcctgttcagcgacgtgctgctggtgaccaagccccagagaaaggccgacaaggccaaggtgatcagaccccccctgatgctggagaagctggtgtgccagcccctgagagaccccaacagcttcctgctgatccacctgaccgagttccagtgcgtgagcagcgccctgctggtgcactgccccagccccaccgacagagcccagtggctggagaagacccagcaggcccaggccgccctgcagaagctgaaggccgaggagtacgtgcagcagaagagagagctgctgaccctgtacagagaccaggacagagagagccccagcaccagacccagcacccccagcctggagggcagccagagcagcgccgagggcagaacccccgagttcagcaccatcatcccccacctggtggtgaccgaggacaccgacgaggacgcccccctggtgcccgacgacaccagcgacagcggctacggcaccctgatccccggcacccccaccggcagcagaagccccctgagcagactgagacagagagccctgagaagagaccccagactgaccttcagcaccctggagctgagagacatccccctgagaccccacccccccgacccccaggccccccagagaagaagcgcccccgagctgcccgagggcatcctgaagggcggcagcctgccccaggaggacccccccacctggagcgaggaggaggacggcgccagcgagagaggcaacgtggtggtggagaccctgcacagagccagactgagaggccagctgcccagcagccccacccacgccgacagcgccggcgagagcccctgggagagcagcggcgaggaggaggaggagggccccctgttcctgaaggccggccacaccagcctgagacccatgagagccgaggacatgctgagagagatcagagaggagctggccagccagagaatcgagggcgccgaggagcccagagacagcagacccagaaagctgaccagagcccagctgcagagaatgagaggcccccacatcatccagctggacacccccctgagcgccagcgaggtgtag

SEQ ID NO: 93598 - DNA, 4482 bp, Artificial Sequence
  Description of Artificial Sequence: Synthetic coding sequence
atggccgagctgagcgagcccgagggccccgtggactggaaggagagatgcgtggccctggagagccagctgatgaagttcagagtgcaggccagcaagatcagagagctgctggccgagaagatgcagcagctggagagacaggtgatcgacgccgagagacaggccgagaaggccttccagcaggtgcaggtgatggaggacaagctgaaggccgccaacatccagaccagcgagagcgagaccagactgtacaacaagtgccaggacctggagagcctgatccaggagaaggacgacgtgatccagaacctggagctgcagctggaggagcagaagcagatcagaatccaggaggccaagatcatcgaggagaaggccgccaagatcaaggagtgggtgaccgtgaagctgaacgagctggagctggagaaccagaacctgagactgatcaaccagaaccagaccgaggagatcagaaccatgcagagcaagctgcaggaggtgcagggcaagaagagcagcaccgtgagcaccctgaagctgagcgagggccagagactgagcagcctgaccttcggctgcttcctgagcagagccagaagccccccccaggtggtgaagagcgaggagatgagcaagatcagcagcaaggagcccgagttcaccgagggcaaggacatggaggagatggagatccccgagaagagcgtggacaaccaggtgctggagaacaacagaggccagagaaccctgcaccagaccccctgcggcagcgagcagaacagaaagaccagaaccagcttcgccaccgacggcggcatcagccagaacagcggcgcccccgtgagcgactggagcagcgacgaggaggacggcagcaagggcagaagcaagagcagatgcaccagcaccctgagcagccacaccagcgaggagggcgtgcagtgcagcagaatgggcagcgagatgtacctgaccgccagcgacgacagcagcagcatcttcgaggaggagaccttcggcatcaagagacccgagcacaagaagctgtacagctggcagcaggaggcccagtggaaggccctgaacagccccctgggcaagggcaacagcgagctgagcaagaaggagcaggacagcagcagcgacgagctgaacaagaagttccagagccagagactggactacagcagcagcagcagcgaggccaacacccccagccccatcctgacccccgccctgatgcccaagcaccccaacagcctgagcggcaagggcacccagctggtgcccagcagccacctgcccccccccaagctgagaatccccaacgtgttcagcatcagcgtggccctggccaagagacacctgagccagccccagctgagcagcgacagaatgttcggcaccaacagaaacgccatcagcatgatcagacccctgagaccccaggagaccgacctggacctggtggacggcgacagcaccgaggtgctggagaacatggacaccagctgcgacgacggcctgttcagctacgacagcctggacagccccaacagcgacgaccaggagcactgcgacagcgccaagaaggtggcctacagcaagccccccaccccccccctgcacagattccccagctgggagagcagaatctacgccgtggccaagagcggcatcagaatgagcgaggccttcaacatggagagcgtgaacaagaacagcgccgccaccctgagctacaccaccagcggcctgtacaccagcctgatctacaagaacatgaccacccccgtgtacaccaccctgaagggcaaggccacccagatcagcagcagccccttcctggacgacagcagcggcagcgaggaggaggacagcagcagaagcagcagcagaaccagcgagagcgacagcagaagcagaagcggccccggcagccccagagccatgaagagaggcgtgagcctgagcagcgtggccagcgagagcgactacgccatcccccccgacgcctacagcaccgacaccgagtacagccagcccgagcagaagctgcccaagacctgcagcagcagcagcgacaacggcaagaacgagcccctggagaagagcggctacctgctgaagatgagcggcaaggtgaagagctggaagagaagatggttcgtgctgaagggcggcgagctgctgtactacaagagccccagcgacgtgatcagaaagccccagggccacatcgagctgagcgccagctgcagcatcctgagaggcgacaacaagcagaccgtgcagctgaccaccgagaagcacacctactacctgaccgccgacagccccaacatcctggaggagtggatcaaggtgctgcagaacgtgctgagagtgcaggccgccaaccccctgagcctgcagcccgagggcaagcccaccatgaagggcctgctgaccaaggtgaagcacggctacagcaagagagtgtggtgcaccctgatcggcaagaccctgtactacttcagaagccaggaggacaagttccccctgggccagatcaagctgtgggaggccaaggtggaggaggtggacagaagctgcgacagcgacgaggactacgaggccagcggcagaagcctgctgagcacccactacaccatcgtgatccaccccaaggaccagggccccacctacctgctgatcggcagcaagcacgagaaggacacctggctgtaccacctgaccgtggccgccggcagcaacaacgtgaacgtgggcagcgagttcgagcagctggtgtgcaagctgctgaacatcgacggcgagcccagcagccagatctggagacaccccaccctgtgccacagcaaggagggcatcatcagccccctgaccaccctgcccagcgaggccctgcagaccgaggccatcaagctgttcaagacctgccagctgttcatcaacgccgccgtggacagccccgccatcgactaccacatcagcctggcccagagcgccctgcagatctgcctgacccaccccgagctgcagaacgagatctgctgccagctgatcaagcagaccagaagaagacagccccagaaccagcccggccccctgcagggctggcagctgctggccctgtgcgtgggcctgttcctgccccaccaccccttcctgtggctgctgagactgcacctgaagagaaacgccgacagcagaaccgagttcggcaagtacgccatctactgccagagatgcgtggagagaacccagcagaacggcgacagagaggccagacccagcagaatggagatcctgagcaccctgctgagaaacccctaccaccacagcctgcccttcagcatccccgtgcacttcatgaacggcatctaccaggtggtgggcttcgacgccagcaccaccgtggaggagttcctgaacaccctgaaccaggacaccggcatgagaaagcccgcccagagcggcttcgccctgttcaccgacgaccccagcggcagagacctggagcactgcctgcagggcaacatcaagatctgcgacatcatcagcaagtgggagcaggccagcaaggagcagcagcccggcaagtgcgagggcaccagaaccgtgagactgacctacaagaacagactgtacttcagcgtgcaggccagaggcgagaccgacagagagaagctgctgctgatgtaccagaccaacgaccagatcatcaacggcctgttccccctgaacaaggacctggccctggagatggccgccctgctgagccaggtggagatcggcgacttcgagagacccttcagcacccccgccggccacgtgaccaaccagtgcaaggtgaaccagaccctgaagcaggtgatcgagaagttctaccccaagagatacagagacggctgcagcgaggagcagctgagacagctgtgccagagactgagcaccagatggatggccctgagaggccacagcgccgccgactgcgtgagaatctacctgaccgtggccagaaagtggcccttcttcggcgccaagctgttcctggccaagcccatcacccccagcagcctgggcagcaccttcctgtggctggccgtgcacgaggacggcctgagcctgctggagtacaacagcatgagactgatcgtgagctacgtgtacaagagcctgatgaccttcggcggctaccaggacgacttcatggtggtgatcaacaacacccacagcaaggacaagcccaccgagaagctgctgttcgccatggccaagcccaagatcctggagatcaccctgctgatcgccagctacatcaacaacttccaccagcagaaggccgccttccaccacctgagcgcccccgccctgctgagcgcccagaccagaggcccccaggccagaatgatgggcagccagcccctgctgagcagcagcagacccaccaagggccccaccctgctgtag

SEQ ID NO: 93599 - DNA, 2904 bp, Artificial Sequence
  Description of Artificial Sequence: Synthetic coding sequence
atggactggacccccagactgcccagcagacacatcatcagcgagctggagcacctgaccttcgtgaacaccgacgtgggcagatgcagagcctggctgagactggccctgaacgacggcctgatggagtgctacctgaagctgctgctgcaggagcaggccagactgcacgagtactaccagcccaccgccctgctgagagacgccgaggagggcgagttcctgctgagcttcctgcagggcctgaccagcctgagcttcgagctgagctacaagagcgccatcctgaacgagtggaccctgacccccctggccctgagcggcctgtgccccctgagcgagctggaccccctgagcaccagcggcgccgagctgcagagaaaggagagcctggacagcatcagccacagcagcggcagcgaggacatcgaggtgcaccacagcggccacaagatcagaagaaaccagaagctgaccgccagcagcctgagcctggacaccgccagcagcagccagctgagctgcagcctgaacagcgacagctgcctgctgcaggagaacggcagcaagagccccgaccactgcgaggagcccatgagctgcgacagcgacctgggcaccgccaacgccgaggacagcgacagaagcctgcaggaggtgctgctggagttcagcaaggcccaggtgaacagcgtgcccaccaacggcctgagccaggagaccgagatccccaccccccaggccagcctgagcctgcacggcctgaacaccagcacctacctgcactgcgaggcccccgccgagcccctgcccgcccaggccgccagcggcacccaggacggcgtgcacgtgcaggagcccagaccccaggcccccagccccctggacctgcagcagcccgtggagagcaccagcggccagcagcccagcagcaccgtgagcgagaccgccagagaggtgggccagggcaacggcctgcagaaggcccaggcccacgacggcgccggcctgaagctggtggtgagcagccccaccagccccaagaacaagagctggatcagcgaggacgacttctacagacccagcagagagcagcccctggagagcgccagcgaccaccccatcgccagctacagaggcacccccggcagcagacccggcctgcacagacacttcagccaggagcccagaaagaactgcagcctgggcgccctggaccaggcctgcgtgcccagccccggcagaagacaggcccaggccgcccccagccagggccacaagagcttcagagtggtgcacagaagacagatgggcctgagcaaccccttcagaggcctgatgaagctgggcaccgtggagagaagaggcgccatgggcatctggaaggagctgttctgcgagctgagccccctggagttcagactgtacctgagcaacgaggagcacacctgcgtggagaactgcagcctgctgagatgcgagagcgtgggccccgcccacagcgacggcagattcgagctggtgttcagcggcaagaagctggccctgagagccagcagccaggacgaggccgaggactggctggacagagtgagagaggccctgcagaaggtgagaccccagcaggaggacgagtgggtgaacgtgcagtaccccgaccagcccgaggagccccccgaggccccccagggctgcctgagccccagcgacctgctgagcgagcccgccgccctgcagggcacccagttcgactggagcagcgcccaggtgcccgagcccgacgccatcaaggagagcctgctgtacctgtacatggacagaacctggatgccctacatcttcagcctgagcctggaggccctgaagtgcttcagaatcagaaacaacgagaagatgctgagcgacagccacggcgtggagaccatcagagacatcctgcccgacaccagcctgggcggccccagcttcttcaagatcatcaccgccaaggccgtgctgaagctgcaggccggcaacgccgaggaggccgccctgtggagagacctggtgagaaaggtgctggccagctacctggagaccgccgaggaggccgtgaccctgggcggcagcctggacgagaactgccaggaggtgctgaagttcgccaccagagagaacggcttcctgctgcagtacctggtggccatccccatggagaagggcctggacagccagggctgcttctgcgccggctgcagcagacagatcggcttcagcttcgtgagacccaagctgtgcgccttcagcggcctgtactactgcgacatctgccaccaggacgacgccagcgtgatccccgccagaatcatccacaactgggacctgaccaagagacccatctgcagacaggccctgaagttcctgacccagatcagagcccagcccctgatcaacctgcagatggtgaacgccagcctgtacgagcacgtggagagaatgcacctgatcggcagaagaagagagcagctgaagctgctgggcgactacctgggcctgtgcagaagcggcgccctgaaggagctgagcaagagactgaaccacagaaactacctgctggagagcccccacagattcagcgtggccgacctgcagcagatcgccgacggcgtgtacgagggcttcctgaaggccctgatcgagttcgccagccagcacgtgtaccactgcgacctgtgcacccagagaggcttcatctgccagatctgccagcaccacgacatcatcttccccttcgagttcgacaccaccgtgagatgcgccgagtgcaagaccgtgttccaccagagctgccaggccgtggtgaagaagggctgccccagatgcgccagaagaagaaagtaccaggagcagaacatcttcgcctag

SEQ ID NO: 93600 - DNA, 3171 bp, Artificial Sequence
  Description of Artificial Sequence: Synthetic coding sequence
atgctgagcgtggtggagaacggcctggacccccaggccgccatccccgtgatcaagaagaagctggtgggcagcgtgaaggccctgcagaagcagtacgtgagcctggacaccgtggtgaccagcgaggacggcgacgccaacaccatgtgcagcgccctggaggccgtgttcatccacggcctgcacgccaagcacatcagagccgaggccggcggcaagagaaagaagagcgcccaccagaagcccctgccccagcccgtgttctggcccctgctgaaggccgtgacccacaagcacatcatcagcgagctggagcacctgaccttcgtgaacaccgacgtgggcagatgcagagcctggctgagactggccctgaacgacggcctgatggagtgctacctgaagctgctgctgcaggagcaggccagactgcacgagtactaccagcccaccgccctgctgagagacgccgaggagggcgagttcctgctgagcttcctgcagggcctgaccagcctgagcttcgagctgagctacaagagcgccatcctgaacgagtggaccctgacccccctggccctgagcggcctgtgccccctgagcgagctggaccccctgagcaccagcggcgccgagctgcagagaaaggagagcctggacagcatcagccacagcagcggcagcgaggacatcgaggtgcaccacagcggccacaagatcagaagaaaccagaagctgaccgccagcagcctgagcctggacaccgccagcagcagccagctgagctgcagcctgaacagcgacagctgcctgctgcaggagaacggcagcaagagccccgaccactgcgaggagcccatgagctgcgacagcgacctgggcaccgccaacgccgaggacagcgacagaagcctgcaggaggtgctgctggagttcagcaaggcccaggtgaacagcgtgcccaccaacggcctgagccaggagaccgagatccccaccccccaggccagcctgagcctgcacggcctgaacaccagcacctacctgcactgcgaggcccccgccgagcccctgcccgcccaggccgccagcggcacccaggacggcgtgcacgtgcaggagcccagaccccaggcccccagccccctggacctgcagcagcccgtggagagcaccagcggccagcagcccagcagcaccgtgagcgagaccgccagagaggtgggccagggcaacggcctgcagaaggcccaggcccacgacggcgccggcctgaagctggtggtgagcagccccaccagccccaagaacaagagctggatcagcgaggacgacttctacagacccagcagagagcagcccctggagagcgccagcgaccaccccatcgccagctacagaggcacccccggcagcagacccggcctgcacagacacttcagccaggagcccagaaagaactgcagcctgggcgccctggaccaggcctgcgtgcccagccccggcagaagacaggcccaggccgcccccagccagggccacaagagcttcagagtggtgcacagaagacagatgggcctgagcaaccccttcagaggcctgatgaagctgggcaccgtggagagaagaggcgccatgggcatctggaaggagctgttctgcgagctgagccccctggagttcagactgtacctgagcaacgaggagcacacctgcgtggagaactgcagcctgctgagatgcgagagcgtgggccccgcccacagcgacggcagattcgagctggtgttcagcggcaagaagctggccctgagagccagcagccaggacgaggccgaggactggctggacagagtgagagaggccctgcagaaggtgagaccccagcaggaggacgagtgggtgaacgtgcagtaccccgaccagcccgaggagccccccgaggccccccagggctgcctgagccccagcgacctgctgagcgagcccgccgccctgcagggcacccagttcgactggagcagcgcccaggtgcccgagcccgacgccatcaaggagagcctgctgtacctgtacatggacagaacctggatgccctacatcttcagcctgagcctggaggccctgaagtgcttcagaatcagaaacaacgagaagatgctgagcgacagccacggcgtggagaccatcagagacatcctgcccgacaccagcctgggcggccccagcttcttcaagatcatcaccgccaaggccgtgctgaagctgcaggccggcaacgccgaggaggccgccctgtggagagacctggtgagaaaggtgctggccagctacctggagaccgccgaggaggccgtgaccctgggcggcagcctggacgagaactgccaggaggtgctgaagttcgccaccagagagaacggcttcctgctgcagtacctggtggccatccccatggagaagggcctggacagccagggctgcttctgcgccggctgcagcagacagatcggcttcagcttcgtgagacccaagctgtgcgccttcagcggcctgtactactgcgacatctgccaccaggacgacgccagcgtgatccccgccagaatcatccacaactgggacctgaccaagagacccatctgcagacaggccctgaagttcctgacccagatcagagcccagcccctgatcaacctgcagatggtgaacgccagcctgtacgagcacgtggagagaatgcacctgatcggcagaagaagagagcagctgaagctgctgggcgactacctgggcctgtgcagaagcggcgccctgaaggagctgagcaagagactgaaccacagaaactacctgctggagagcccccacagattcagcgtggccgacctgcagcagatcgccgacggcgtgtacgagggcttcctgaaggccctgatcgagttcgccagccagcacgtgtaccactgcgacctgtgcacccagagaggcttcatctgccagatctgccagcaccacgacatcatcttccccttcgagttcgacaccaccgtgagatgcgccgagtgcaagaccgtgttccaccagagctgccaggccgtggtgaagaagggctgccccagatgcgccagaagaagaaagtaccaggagcagaacatcttcgcctag

SEQ ID NO: 93601 - DNA, 3003 bp, Artificial Sequence
  Description of Artificial Sequence: Synthetic coding sequence
atggtggagtgcttcgagagcggcggcaccagactgagcctgagcagcttcaacgtgagctgcgacagcctgagagagcagctgagagagtggagatgcttccagtggtggagaatggactggacccccagactgcccagcagacacatcatcagcgagctggagcacctgaccttcgtgaacaccgacgtgggcagatgcagagcctggctgagactggccctgaacgacggcctgatggagtgctacctgaagctgctgctgcaggagcaggccagactgcacgagtactaccagcccaccgccctgctgagagacgccgaggagggcgagttcctgctgagcttcctgcagggcctgaccagcctgagcttcgagctgagctacaagagcgccatcctgaacgagtggaccctgacccccctggccctgagcggcctgtgccccctgagcgagctggaccccctgagcaccagcggcgccgagctgcagagaaaggagagcctggacagcatcagccacagcagcggcagcgaggacatcgaggtgcaccacagcggccacaagatcagaagaaaccagaagctgaccgccagcagcctgagcctggacaccgccagcagcagccagctgagctgcagcctgaacagcgacagctgcctgctgcaggagaacggcagcaagagccccgaccactgcgaggagcccatgagctgcgacagcgacctgggcaccgccaacgccgaggacagcgacagaagcctgcaggaggtgctgctggagttcagcaaggcccaggtgaacagcgtgcccaccaacggcctgagccaggagaccgagatccccaccccccaggccagcctgagcctgcacggcctgaacaccagcacctacctgcactgcgaggcccccgccgagcccctgcccgcccaggccgccagcggcacccaggacggcgtgcacgtgcaggagcccagaccccaggcccccagccccctggacctgcagcagcccgtggagagcaccagcggccagcagcccagcagcaccgtgagcgagaccgccagagaggtgggccagggcaacggcctgcagaaggcccaggcccacgacggcgccggcctgaagctggtggtgagcagccccaccagccccaagaacaagagctggatcagcgaggacgacttctacagacccagcagagagcagcccctggagagcgccagcgaccaccccatcgccagctacagaggcacccccggcagcagacccggcctgcacagacacttcagccaggagcccagaaagaactgcagcctgggcgccctggaccaggcctgcgtgcccagccccggcagaagacaggcccaggccgcccccagccagggccacaagagcttcagagtggtgcacagaagacagatgggcctgagcaaccccttcagaggcctgatgaagctgggcaccgtggagagaagaggcgccatgggcatctggaaggagctgttctgcgagctgagccccctggagttcagactgtacctgagcaacgaggagcacacctgcgtggagaactgcagcctgctgagatgcgagagcgtgggccccgcccacagcgacggcagattcgagctggtgttcagcggcaagaagctggccctgagagccagcagccaggacgaggccgaggactggctggacagagtgagagaggccctgcagaaggtgagaccccagcaggaggacgagtgggtgaacgtgcagtaccccgaccagcccgaggagccccccgaggccccccagggctgcctgagccccagcgacctgctgagcgagcccgccgccctgcagggcacccagttcgactggagcagcgcccaggtgcccgagcccgacgccatcaaggagagcctgctgtacctgtacatggacagaacctggatgccctacatcttcagcctgagcctggaggccctgaagtgcttcagaatcagaaacaacgagaagatgctgagcgacagccacggcgtggagaccatcagagacatcctgcccgacaccagcctgggcggccccagcttcttcaagatcatcaccgccaaggccgtgctgaagctgcaggccggcaacgccgaggaggccgccctgtggagagacctggtgagaaaggtgctggccagctacctggagaccgccgaggaggccgtgaccctgggcggcagcctggacgagaactgccaggaggtgctgaagttcgccaccagagagaacggcttcctgctgcagtacctggtggccatccccatggagaagggcctggacagccagggctgcttctgcgccggctgcagcagacagatcggcttcagcttcgtgagacccaagctgtgcgccttcagcggcctgtactactgcgacatctgccaccaggacgacgccagcgtgatccccgccagaatcatccacaactgggacctgaccaagagacccatctgcagacaggccctgaagttcctgacccagatcagagcccagcccctgatcaacctgcagatggtgaacgccagcctgtacgagcacgtggagagaatgcacctgatcggcagaagaagagagcagctgaagctgctgggcgactacctgggcctgtgcagaagcggcgccctgaaggagctgagcaagagactgaaccacagaaactacctgctggagagcccccacagattcagcgtggccgacctgcagcagatcgccgacggcgtgtacgagggcttcagccccaaggtgcccagcgaggccgccggcctgagaccctggggcgccagaagccccgaggccgccagcgccttcagatgcatcgacagcagcagactgcccagcctgagaaaggtggtgcccaccctgttcctgaagtgctacttcatgcagtacaccgtgcccagcgagcagggcagcggccccgaggagagcctgcagtgcatcgagggcatcgccgccgtgtag

SEQ ID NO: 93602 - DNA, 5466 bp, Artificial Sequence
  Description of Artificial Sequence: Synthetic coding sequence
atgagctgcgagagaaagggcctgagcgagctgagaagcgagctgtacttcctgatcgccagattcctggaggacggcccctgccagcaggccgcccaggtgctgatcagagaggtggccgagaaggagctgctgcccagaagaaccgactggaccggcaaggagcaccccagaacctaccagaacctggtgaagtactacagacacctggcccccgaccacctgctgcagatctgccacagactgggccccctgctggagcaggagatcccccagagcgtgcccggcgtgcagaccctgctgggcgccggcagacagagcctgctgagaaccaacaagagctgcaagcacgtggtgtggaagggcagcgccctggccgccctgcactgcggcagaccccccgagagccccgtgaactacggcagcccccccagcatcgccgacaccctgttcagcagaaagctgaacggcaagtacagactggagagactggtgcccaccgccgtgtaccagcacatgaagatgcacaagagaatcctgggccacctgagcagcgtgtactgcgtgaccttcgacagaaccggcagaagaatcttcaccggcagcgacgactgcctggtgaagatctgggccaccgacgacggcagactgctggccaccctgagaggccacgccgccgagatcagcgacatggccgtgaactacgagaacaccatgatcgccgccggcagctgcgacaagatgatcagagtgtggtgcctgagaacctgcgcccccctggccgtgctgcagggccacagcgccagcatcaccagcctgcagttcagccccctgtgcagcggcagcaagagatacctgagcagcaccggcgccgacggcaccatctgcttctggctgtgggacgccggcaccctgaagatcaaccccagacccgccaagttcaccgagagacccagacccggcgtgcagatgatctgcagcagcttcagcgccggcggcatgttcctggccaccggcagcaccgaccacatcatcagagtgtacttcttcggcagcggccagcccgagaagatcagcgagctggagttccacaccgacaaggtggacagcatccagttcagcaacaccagcaacagattcgtgagcggcagcagagacggcaccgccagaatctggcagttcaagagaagagagtggaagagcatcctgctggacatggccaccagacccgccggccagaacctgcagggcatcgaggacaagatcaccaagatgaaggtgaccatggtggcctgggacagacacgacaacaccgtgatcaccgccgtgaacaacatgaccctgaaggtgtggaacagctacaccggccagctgatccacgtgctgatgggccacgaggacgaggtgttcgtgctggagccccaccccttcgaccccagagtgctgttcagcgccggccacgacggcaacgtgatcgtgtgggacctggccagaggcgtgaagatcagaagctacttcaacatgatcgagggccagggccacggcgccgtgttcgactgcaagtgcagccccgacggccagcacttcgcctgcaccgacagccacggccacctgctgatcttcggcttcggcagcagcagcaagtacgacaagatcgccgaccagatgttcttccacagcgactacagacccctgatcagagacgccaacaacttcgtgctggacgagcagacccagcaggccccccacctgatgcccccccccttcctggtggacgtggacggcaacccccaccccagcagataccagagactggtgcccggcagagagaactgcagagaggagcagctgatcccccagatgggcgtgaccagcagcggcctgaaccaggtgctgagccagcaggccaaccaggagatcagccccctggacagcatgatccagagactgcagcaggagcaggacctgagaagaagcggcgaggccgtgatcagcaacaccagcagactgagcagaggcagcatcagcagcaccagcgaggtgcacagcccccccaacgtgggcctgagaagaagcggccagatcgagggcgtgagacagatgcacagcaacgcccccagaagcgagatcgccaccgagagagacctggtggcctggagcagaagagtggtggtgcccgagctgagcgccggcgtggccagcagacaggaggagtggagaaccgccaagggcgaggaggagatcaagacctacagaagcgaggagaagagaaagcacctgaccgtgcccaaggagaacaagatccccaccgtgagcaagaaccacgcccacgagcacttcctggacctgggcgagagcaagaagcagcagaccaaccagcacaactacagaaccagaagcgccctggaggagacccccagacccagcgaggagatcgagaacggcagcagcagcagcgacgagggcgaggtggtggccgtgagcggcggcaccagcgaggaggaggagagagcctggcacagcgacggcagcagcagcgactacagcagcgactacagcgactggaccgccgacgccggcatcaacctgcagccccccaagaaggtgcccaagaacaagaccaagaaggccgagagcagcagcgacgaggaggaggagagcgagaagcagaagcagaagcagatcaagaaggagaagaagaaggtgaacgaggagaaggacggccccatcagccccaagaagaagaagcccaaggagagaaagcagaagagactggccgtgggcgagctgaccgagaacggcctgaccctggaggagtggctgcccagcacctggatcaccgacaccatccccagaagatgccccttcgtgccccagatgggcgacgaggtgtactacttcagacagggccacgaggcctacgtggagatggccagaaagaacaagatctacagcatcaaccccaagaagcagccctggcacaagatggagctgagagagcaggagctgatgaagatcgtgggcatcaagtacgaggtgggcctgcccaccctgtgctgcctgaagctggccttcctggaccccgacaccggcaagctgaccggcggcagcttcaccatgaagtaccacgacatgcccgacgtgatcgacttcctggtgctgagacagcagttcgacgacgccaagtacagaagatggaacatcggcgacagattcagaagcgtgatcgacgacgcctggtggttcggcaccatcgagagccaggagcccctgcagctggagtaccccgacagcctgttccagtgctacaacgtgtgctgggacaacggcgacaccgagaagatgagcccctgggacatggagctgatccccaacaacgccgtgttccccgaggagctgggcaccagcgtgcccctgaccgacggcgagtgcagaagcctgatctacaagcccctggacggcgagtggggcaccaaccccagagacgaggagtgcgagagaatcgtggccggcatcaaccagctgatgaccctggacatcgccagcgccttcgtggcccccgtggacctgcaggcctaccccatgtactgcaccgtggtggcctaccccaccgacctgagcaccatcaagcagagactggagaacagattctacagaagagtgagcagcctgatgtgggaggtgagatacatcgagcacaacaccagaaccttcaacgagcccggcagccccatcgtgaagagcgccaagttcgtgaccgacctgctgctgcacttcatcaaggaccagacctgctacaacatcatccccctgtacaacagcatgaagaagaaggtgctgagcgacagcgaggacgaggagaaggacgccgacgtgcccggcaccagcaccagaaagagaaaggaccaccagcccagaagaagactgagaaacagagcccagagctacgacatccaggcctggaagaagcagtgcgaggagctgctgaacctgatcttccagtgcgaggacagcgagcccttcagacagcccgtggacctgctggagtaccccgactacagagacatcatcgacacccccatggacttcgccaccgtgagagagaccctggaggccggcaactacgagagccccatggagctgtgcaaggacgtgagactgatcttcagcaacagcaaggcctacacccccagcaagagaagcagaatctacagcatgagcctgagactgagcgccttcttcgaggagcacatcagcagcgtgctgagcgactacaagagcgccctgagattccacaagagaaacaccatcaccaagagaagaaagaagagaaacagaagcagcagcgtgagcagcagcgccgccagcagccccgagagaaagaagagaatcctgaagccccagctgaagagcgagagcagcaccagcgccttcagcacccccaccagaagcatcccccccagacacaacgccgcccagatcaacggcaagaccgagagcagcagcgtggtgagaaccagaagcaacagagtggtggtggaccccgtggtgaccgagcagcccagcaccagcagcgccgccaagaccttcatcaccaaggccaacgccagcgccatccccggcaagaccatcctggagaacagcgtgaagcacagcaaggccctgaacaccctgagcagccccggccagagcagcttcagccacggcaccagaaacaacagcgccaaggagaacatggagaaggagaagcccgtgaagagaaagatgaagagcagcgtgctgcccaaggccagcaccctgagcaagagcagcgccgtgatcgagcagggcgactgcaagaacaacgccctggtgcccggcaccatccaggtgaacggccacggcggccagcccagcaagctggtgaagagaggccccggcagaaagcccaaggtggaggtgaacaccaacagcggcgagatcatccacaagaagagaggcagaaagcccaagaagctgcagtacgccaagcccgaggacctggagcagaacaacgtgcaccccatcagagacgaggtgctgcccagcagcacctgcaacttcctgagcgagaccaacaacgtgaaggaggacctgctgcagaagaagaacagaggcggcagaaagcccaagagaaagatgaagacccagaagctggacgccgacctgctggtgcccgccagcgtgaaggtgctgagaagaagcaacagaaagaagatcgacgaccccatcgacgaggaggaggagttcgaggagctgaagggcagcgagccccacatgagaaccagaaaccagggcagaagaaccgccttctacaacgaggacgacagcgaggaggagcagagacagctgctgttcgaggacaccagcctgaccttcggcaccagcagcagaggcagagtgagaaagctgaccgagaaggccaaggccaacctgatcggctggtag

SEQ ID NO: 93603 - DNA, 1197 bp, Artificial Sequence
  Description of Artificial Sequence: Synthetic coding sequence
atgaagaagaaggtgctgagcgacagcgaggacgaggagaaggacgccgacgtgcccggcaccagcaccagaaagagaaaggaccaccagcccagaagaagactgagaaacagagcccagagctacgacatccaggcctggaagaagcagtgcgaggagctgctgaacctgatcttccagtgcgaggacagcgagcccttcagacagcccgtggacctgctggagtaccccgactacagagacatcatcgacacccccatggacttcgccaccgtgagagagaccctggaggccggcaactacgagagccccatggagctgtgcaaggacgtgagactgatcttcagcaacagcaaggcctacacccccagcaagagaagcagaatctacagcatgagcctgagactgagcgccttcttcgaggagcacatcagcagcgtgctgagcgactacaagagcgccctgagattccacaagagaaacaccatcaccaagagaagaaagaagagaaacagaagcagcagcgtgagcagcagcgccgccagcagccccgagagaaagaagagaatcctgaagccccagctgaagagcgagagcagcaccagcgccttcagcacccccaccagaagcatcccccccagacacaacgccgcccagatcaacggcaagaccgagagcagcagcgtggtgagaaccagaagcaacagagtggtggtggaccccgtggtgaccgagcagcccagcaccagcagcgccgccaagaccttcatcaccaaggccaacgccagcgccatccccggcaagaccatcctggagaacagcgtgaagcacagcaaggccctgaacaccctgagcagccccggccagagcagcttcagccacggcaccagaaacaacagcgccaaggagaacatggagaaggagaagcccgtgaagagaaagatgaagagcagcgtgctgcccaaggccagcaccctgagcaagagcagcgccgtgatcgagcagggcgactgcaagaacaacgccctggtgcccggcaccatccaggtgaacggccacggcggccagcccagcaagctggtgaagagaggccccggcagaaagcccaaggtggaggtgaacatcgtggtgaagctgtacaccagaaagggcgtggagagccccaagagctacagcatgcagagccagaagatctag

SEQ ID NO: 93604 - DNA, 1206 bp, Artificial Sequence
  Description of Artificial Sequence: Synthetic coding sequence
atgagaagagcccccgccgccgagagactgctggagctgggcttcccccccagatgcggcagacaggagccccccttccccctgggcgtgaccagaggctggggcagatggcccatccagaagagaagagagggcgccagacccgtgcccttcagcgagagaagccaggaggacggcagaggccccgccgccagaagcagcggcaccctgtggagaatcagaaccagactgagcctgtgcagagaccccgagccccccccccccctgtgcctgctgagagtgagcctgctgtgcgccctgagagccggcggcagaggcagcagatggggcgaggacggcgccagactgctgctgctgccccccgccagagccgccggcaacggcgaggccgagcccagcggcggccccagctacgccggcagaatgctggagagcagcggctgcaaggccctgaaggagggcgtgctggagaagagaagcgacggcctgctgcagctgtggaagaagaagtgctgcatcctgaccgaggagggcctgctgctgatcccccccaagcagctgcagcaccagcagcagcagcagcagcagcagcagcagcagcagcagcagcagcccggccagggccccgccgagcccagccagcccagcggccccgccgtggccagcctggagccccccgtgaagctgaaggagctgcacttcagcaacatgaagaccgtggactgcgtggagagaaagggcaagtacatgtacttcaccgtggtgatggccgagggcaaggagatcgacttcagatgcccccaggaccagggctggaacgccgagatcaccctgcagatggtgcagtacaagaacagacaggccatcctggccgtgaagagcaccagacagaagcagcagcacctggtgcagcagcagccccccagccagccccagccccagccccagctgcagccccagccccagccccagccccagccccagccccagccccagagccagccccagccccagccccagcccaagccccagccccagcagctgcacccctacccccacccccacccccacccccacagccacccccacagccacccccacccccacccccacccccacccccaccagatcccccacccccacccccagccccacagccagccccacggccacagactgctgagaagcaccagcaacagcgcctag

SEQ ID NO: 93605 - DNA, 660 bp, Artificial Sequence
  Description of Artificial Sequence: Synthetic coding sequence
atgctggagagcagcggctgcaaggccctgaaggagggcgtgctggagaagagaagcgacggcctgctgcagctgtggaagaagaagtgctgcatcctgaccgaggagggcctgctgctgatcccccccaagcagctgcagcaccagcagcagcagcagcagcagcagcagcagcagcagcagcagcagcccggccagggccccgccgagcccagccagcccagcggccccgccgtggccagcctggagccccccgtgaagctgaaggagctgcacttcagcaacatgaagaccgtggactgcgtggagagaaagggcaagtacatgtacttcaccgtggtgatggccgagggcaaggagatcgacttcagatgcccccaggaccagggctggaacgccgagatcaccctgcagatggtgcagtacaagaacagacaggccatcctggccgtgaagagcaccagacagaagcagcagcacctggtgcagcagcagctgcacccctacccccacccccacccccacccccacagccacccccacagccacccccacccccacccccacccccacccccaccagatcccccacccccacccccagccccacagccagccccacggccacagactgctgagaagcaccagcaacagcgcctag

SEQ ID NO: 93606 - DNA, 459 bp, Artificial Sequence
  Description of Artificial Sequence: Synthetic coding sequence
atgaagagccccgacgaggtgctgagagagggcgagctggagaagagaagcgacagcctgttccagctgtggaagaagaagagaggcgtgctgaccagcgacagactgagcctgttccccgccagccccagagccagacccaaggagctgagattccacagcatcctgaaggtggactgcgtggagagaaccggcaagtacgtgtacttcaccatcgtgaccaccgaccacaaggagatcgacttcagatgcgccggcgagagctgctggaacgccgccatcgccctggccctgatcgacttccagaacagaagagccctgcaggacttcagaagcagacaggagagaaccgcccccgccgcccccgccgaggacgccgtggccgccgccgccgccgcccccagcgagcccagcgagcccagcagacccagcccccagcccaagcccagaaccccctag

SEQ ID NO: 93607 - DNA, 3960 bp, Artificial Sequence
  Description of Artificial Sequence: Synthetic coding sequence
atggacgccctgaacagaaaccagatcggccccggctgccagacccagaccatggtgcagaagggccccctggacctgatcgagaccggcaagggcctgaaggtgcagaccgacaagccccacctggtgagcctgggcagcggcagactgagcaccgccatcaccctgctgcccctggaggagggcagaaccgtgatcggcagcgccgccagagacatcagcctgcagggccccggcctggcccccgagcactgctacatcgagaacctgagaggcaccctgaccctgtacccctgcggcaacgcctgcaccatcgacggcctgcccgtgagacagcccaccagactgacccagggctgcatgctgtgcctgggccagagcaccttcctgagattcaaccaccccgccgaggccaagtggatgaagagcatgatccccgccggcggcagagcccccggccccccctacagccccgtgcccgccgagagcgagagcctggtgaacggcaaccacaccccccagaccgccaccagaggccccagcgcctgcgccagccacagcagcctggtgagcagcatcgagaaggacctgcaggagatcatggacagcctggtgctggaggagcccggcgccgccggcaagaagcccgccgccaccagccccctgagccccatggccaacggcggcagatacctgctgagcccccccaccagccccggcgccatgagcgtgggcagcagctacgagaacaccagccccgccttcagccccctgagcagccccgccagcagcggcagctgcgccagccacagccccagcggccaggagcccggccccagcgtgccccccctggtgcccgccagaagcagcagctaccacctggccctgcagcccccccagagcagacccagcggcgccagaagcgagagccccagactgagcagaaagggcggccacgagagaccccccagccccggcctgagaggcctgctgaccgacagccccgccgccaccgtgctggccgaggccagaagagccaccgagagccccagactgggcggccagctgcccgtggtggccatcagcctgagcgagtaccccgccagcggcgccctgagccagcccaccagcatccccggcagccccaagttccagccccccgtgcccgcccccagaaacaagatcggcaccctgcaggacagaccccccagccccttcagagagccccccggcagcgagagagtgctgaccaccagccccagcagacagctggtgggcagaaccttcagcgacggcctggccaccagaaccctgcagccccccgagagccccagactgggcagaagaggcctggacagcatgagagagctgccccccctgagccccagcctgagcagaagagccctgagccccctgcccaccagaaccacccccgaccccaagctgaacagagaggtggccgagagccccagacccagaagatgggccgcccacggcgccagccccgaggacttcagcctgaccctgggcgccagaggcagaagaaccagaagccccagccccaccctgggcgagagcctggccccccacaagggcagcttcagcggcagactgagccccgcctacagcctgggcagcctgaccggcgccagcccctgccagagcccctgcgtgcagagaaagctgagcagcggcgacctgagagtgcccgtgaccagagagagaaagaacagcatcaccgagatcagcgacaacgaggacgacctgctggagtaccacagaagacagagacaggagagactgagagagcaggagatggagagactggagagacagagactggagaccatcctgaacctgtgcgccgagtacagcagagccgacggcggccccgaggccggcgagctgcccagcatcggcgaggccaccgccgccctggccctggccggcagaagacccagcagaggcctggccggcgccagcggcagaagcagcgaggagcccggcgtggccacccagagactgtgggagagcatggagagaagcgacgaggagaacctgaaggaggagtgcagcagcaccgagagcacccagcaggagcacgaggacgcccccagcaccaagctgcagggcgaggtgctggccctggaggaggagagagcccaggtgctgggccacgtggagcagctgaaggtgagagtgaaggagctggagcagcagctgcaggagagcgccagagaggccgagatggagagagccctgctgcagggcgagagagaggccgagagagccctgctgcagaaggagcagaaggccgtggaccagctgcaggagaagctggtggccctggagaccggcatccagaaggagagagacaaggaggccgaggccctggagaccgagaccaagctgttcgaggacctggagttccagcagctggagagagagagcagagtggaggaggagagagagctggccggccagggcctgctgagaagcaaggccgagctgctgagaagcatcgccaagagaaaggagagactggccatcctggacagccaggccggccagatcagagcccaggccgtgcaggagagcgagagactggccagagacaagaacgccagcctgcagctgctgcagaaggagaaggagaagctgaccgtgctggagagaagataccacagcctgaccggcggcagacccttccccaagaccaccagcaccctgaaggaggtgtacagaagcaagatggacggcgaggccaccagccccctgcccagaaccagaagcggccccctgcccagcagcagcggcagcagcagcagcagcagccagctgagcgtggccaccctgggcagaagccccagccccaagagcgccctgctgacccagaacggcaccggcagcctgcccagaaacctggccgccaccctgcaggacatcgagaccaagagacagctggccctgcagcagaagggccagcaggtgatcgaggagcagagaagaagactggccgagctgaagcagaaggccgccgccgaggcccagtgccagtgggacgccctgcacggcgccgcccccttccccgccggccccagcggcttcccccccctgatgcaccacagcatcctgcaccacctgcccgccggcagagagagaggcgaggagggcgagcacgcctacgacaccctgagcctggagagcagcgacagcatggagaccagcatcagcaccggcggcaacagcgcctgcagccccgacaacatgagcagcgccagcggcctggacatgggcaagatcgaggagatggagaagatgctgaaggaggcccacgccgagaagaacagactgatggagagcagagagagagagatggagctgagaagacaggccctggaggaggagagaagaagaagagagcaggtggagagaagactgcagagcgagagcgccagaagacagcagctggtggagaaggaggtgaagatgagagagaagcagttcagccaggccagacccctgaccagatacctgcccatcagaaaggaggacttcgacctgaagacccacatcgagagcagcggccacggcgtggacacctgcctgcacgtggtgctgagcagcaaggtgtgcagaggctacctggtgaagatgggcggcaagatcaagagctggaagaagagatggttcgtgttcgacagactgaagagaaccctgagctactacgtggacaagcacgagaccaagctgaagggcgtgatctacttccaggccatcgaggaggtgtactacgaccacctgagaagcgccgccaagagccccaaccccgccctgaccttctgcgtgaagacccacgacagactgtactacatggtggcccccagcgccgaggccatgagaatctggatggacgtgatcgtgaccggcgccgagggctacacccagttcatgaactag

SEQ ID NO: 93608 - DNA, 2193 bp, Artificial Sequence
  Description of Artificial Sequence: Synthetic coding sequence
atggagagaagcgacgaggagaacctgaaggaggagtgcagcagcaccgagagcacccagcaggagcacgaggacgcccccagcaccaagctgcagggcgaggtgctggccctggaggaggagagagcccaggtgctgggccacgtggagcagctgaaggtgagagtgaaggagctggagcagcagctgcaggagagcgccagagaggccgagatggagagagccctgctgcagggcgagagagaggccgagagagccctgctgcagaaggagcagaaggccgtggaccagctgcaggagaagctggtggccctggagaccggcatccagaaggagagagacaaggagagagccgagctggccgccggcagaagacacctggccagacaggccctgtacgccgagctgcagacccagctggacaactgccccgagagcgtgagagagcagctgcaggagcagctgagaagagaggccgaggccctggagaccgagaccaagctgttcgaggacctggagttccagcagctggagagagagagcagagtggaggaggagagagagctggccggccagggcctgctgagaagcaaggccgagctgctgagaagcatcgccaagagaaaggagagactggccatcctggacagccaggccggccagatcagagcccaggccgtgcaggagagcgagagactggccagagacaagaacgccagcctgcagctgctgcagaaggagaaggagaagctgaccgtgctggagagaagataccacagcctgaccggcggcagacccttccccaagaccaccagcaccctgaaggagatggagaagctgctgctgcccgccgtggacctggagcagtggtaccaggagctgatggccggcctgggcaccggccccgccgccgccagcccccacagcagccccccccccctgcccgccaaggccagcagacagctgcaggtgtacagaagcaagatggacggcgaggccaccagccccctgcccagaaccagaagcggccccctgcccagcagcagcggcagcagcagcagcagcagccagctgagcgtggccaccctgggcagaagccccagccccaagagcgccctgctgacccagaacggcaccggcagcctgcccagaaacctggccgccaccctgcaggacatcgagaccaagagacagctggccctgcagcagaagggccagcaggtgatcgaggagcagagaagaagactggccgagctgaagcagaaggccgccgccgaggcccagtgccagtgggacgccctgcacggcgccgcccccttccccgccggccccagcggcttcccccccctgatgcaccacagcatcctgcaccacctgcccgccggcagagagagaggcgaggagggcgagcacgcctacgacaccctgagcctggagagcagcgacagcatggagaccagcatcagcaccggcggcaacagcgcctgcagccccgacaacatgagcagcgccagcggcctggacatgggcaagatcgaggagatggagaagatgctgaaggaggcccacgccgagaagaacagactgatggagagcagagagagagagatggagctgagaagacaggccctggaggaggagagaagaagaagagagcaggtggagagaagactgcagagcgagagcgccagaagacagcagctggtggagaaggaggtgaagatgagagagaagcagttcagccaggccagacccctgaccagatacctgcccatcagaaaggaggacttcgacctgaagacccacatcgagagcagcggccacggcgtggacacctgcctgcacgtggtgctgagcagcaaggtgtgcagaggctacctggtgaagatgggcggcaagatcaagagctggaagaagagatggttcgtgttcgacagactgaagagaaccctgagctactacgtggacaagcacgagaccaagctgaagggcgtgatctacttccaggccatcgaggaggtgtactacgaccacctgagaagcgccgccaagagccccaaccccgccctgaccttctgcgtgaagacccacgacagactgtactacatggtggcccccagcgccgaggccatgagaatctggatggacgtgatcgtgaccggcgccgagggctacacccagttcatgaactag

SEQ ID NO: 93609 - DNA, 4134 bp, Artificial Sequence
  Description of Artificial Sequence: Synthetic coding sequence
atggacgccctgaacagaaaccagatcggccccggctgccagacccagaccatggtgcagaagggccccctggacctgatcgagaccggcaagggcctgaaggtgcagaccgacaagccccacctggtgagcctgggcagcggcagactgagcaccgccatcaccctgctgcccctggaggagggcagaaccgtgatcggcagcgccgccagagacatcagcctgcagggccccggcctggcccccgagcactgctacatcgagaacctgagaggcaccctgaccctgtacccctgcggcaacgcctgcaccatcgacggcctgcccgtgagacagcccaccagactgacccagggctgcatgctgtgcctgggccagagcaccttcctgagattcaaccaccccgccgaggccaagtggatgaagagcatgatccccgccggcggcagagcccccggccccccctacagccccgtgcccgccgagagcgagagcctggtgaacggcaaccacaccccccagaccgccaccagaggccccagcgcctgcgccagccacagcagcctggtgagcagcatcgagaaggacctgcaggagatcatggacagcctggtgctggaggagcccggcgccgccggcaagaagcccgccgccaccagccccctgagccccatggccaacggcggcagatacctgctgagcccccccaccagccccggcgccatgagcgtgggcagcagctacgagaacaccagccccgccttcagccccctgagcagccccgccagcagcggcagctgcgccagccacagccccagcggccaggagcccggccccagcgtgccccccctggtgcccgccagaagcagcagctaccacctggccctgcagcccccccagagcagacccagcggcgccagaagcgagagccccagactgagcagaaagggcggccacgagagaccccccagccccggcctgagaggcctgctgaccgacagccccgccgccaccgtgctggccgaggccagaagagccaccgagagccccagactgggcggccagctgcccgtggtggccatcagcctgagcgagtaccccgccagcggcgccctgagccagcccaccagcatccccggcagccccaagttccagccccccgtgcccgcccccagaaacaagatcggcaccctgcaggacagaccccccagccccttcagagagccccccggcagcgagagagtgctgaccaccagccccagcagacagctggtgggcagaaccttcagcgacggcctggccaccagaaccctgcagccccccgagagccccagactgggcagaagaggcctggacagcatgagagagctgccccccctgagccccagcctgagcagaagagccctgagccccctgcccaccagaaccacccccgaccccaagctgaacagagaggtggccgagagccccagacccagaagatgggccgcccacggcgccagccccgaggacttcagcctgaccctgggcgccagaggcagaagaaccagaagccccagccccaccctgggcgagagcctggccccccacaagggcagcttcagcggcagactgagccccgcctacagcctgggcagcctgaccggcgccagcccctgccagagcccctgcgtgcagagaaagctgagcagcggcgacctgagagtgcccgtgaccagagagagaaagaacagcatcaccgagatcagcgacaacgaggacgacctgctggagtaccacagaagacagagacaggagagactgagagagcaggagatggagagactggagagacagagactggagaccatcctgaacctgtgcgccgagtacagcagagccgacggcggccccgaggccggcgagctgcccagcatcggcgaggccaccgccgccctggccctggccggcagaagacccagcagaggcctggccggcgccagcggcagaagcagcgaggagcccggcgtggccacccagagactgtgggagagcatggagagaagcgacgaggagaacctgaaggaggagtgcagcagcaccgagagcacccagcaggagcacgaggacgcccccagcaccaagctgcagggcgaggtgctggccctggaggaggagagagcccaggtgctgggccacgtggagcagctgaaggtgagagtgaaggagctggagcagcagctgcaggagagcgccagagaggccgagatggagagagccctgctgcagggcgagagagaggccgagagagccctgctgcagaaggagcagaaggccgtggaccagctgcaggagaagctggtggccctggagaccggcatccagaaggagagagacaaggaggccgaggccctggagaccgagaccaagctgttcgaggacctggagttccagcagctggagagagagagcagagtggaggaggagagagagctggccggccagggcctgctgagaagcaaggccgagctgctgagaagcatcgccaagagaaaggagagactggccatcctggacagccaggccggccagatcagagcccaggccgtgcaggagagcgagagactggccagagacaagaacgccagcctgcagctgctgcagaaggagaaggagaagctgaccgtgctggagagaagataccacagcctgaccggcggcagacccttccccaagaccaccagcaccctgaaggagatggagaagctgctgctgcccgccgtggacctggagcagtggtaccaggagctgatggccggcctgggcaccggccccgccgccgccagcccccacagcagccccccccccctgcccgccaaggccagcagacagctgcaggtgtacagaagcaagatggacggcgaggccaccagccccctgcccagaaccagaagcggccccctgcccagcagcagcggcagcagcagcagcagcagccagctgagcgtggccaccctgggcagaagccccagccccaagagcgccctgctgacccagaacggcaccggcagcctgcccagaaacctggccgccaccctgcaggacatcgagaccaagagacagctggccctgcagcagaagggccagcaggtgatcgaggagcagagaagaagactggccgagctgaagcagaaggccgccgccgaggcccagtgccagtgggacgccctgcacggcgccgcccccttccccgccggccccagcggcttcccccccctgatgcaccacagcatcctgcaccacctgcccgccggcagagagagaggcgaggagggcgagcacgcctacgacaccctgagcctggagagcagcgacagcatggagaccagcatcagcaccggcggcaacagcgcctgcagccccgacaacatgagcagcgccagcggcctggacatgggcaagatcgaggagatggagaagatgctgaaggaggcccacgccgagaagaacagactgatggagagcagagagagagagatggagctgagaagacaggccctggaggaggagagaagaagaagagagcaggtggagagaagactgcagagcgagagcgccagaagacagcagctggtggagaaggaggtgaagatgagagagaagcagttcagccaggccagacccctgaccagatacctgcccatcagaaaggaggacttcgacctgaagacccacatcgagagcagcggccacggcgtggacacctgcctgcacgtggtgctgagcagcaaggtgtgcagaggctacctggtgaagatgggcggcaagatcaagagctggaagaagagatggttcgtgttcgacagactgaagagaaccctgagctactacgtggacaagcacgagaccaagctgaagggcgtgatctacttccaggccatcgaggaggtgtactacgaccacctgagaagcgccgccaagaagagattcttcagattcaccatggtgaccgagagccccaaccccgccctgaccttctgcgtgaagacccacgacagactgtactacatggtggcccccagcgccgaggccatgagaatctggatggacgtgatcgtgaccggcgccgagggctacacccagttcatgaactag

SEQ ID NO: 93610 - DNA, 3423 bp, Artificial Sequence
  Description of Artificial Sequence: Synthetic coding sequence
atgagcgtgggcagcagctacgagaacaccagccccgccttcagccccctgagcagccccgccagcagcggcagctgcgccagccacagccccagcggccaggagcccggccccagcgtgccccccctggtgcccgccagaagcagcagctaccacctggccctgcagcccccccagagcagacccagcggcgccagaagcgagagccccagactgagcagaaagggcggccacgagagaccccccagccccggcctgagaggcctgctgaccgacagccccgccgccaccgtgctggccgaggccagaagagccaccgagagccccagactgggcggccagctgcccgtggtggccatcagcctgagcgagtaccccgccagcggcgccctgagccagcccaccagcatccccggcagccccaagttccagccccccgtgcccgcccccagaaacaagatcggcaccctgcaggacagaccccccagccccttcagagagccccccggcagcgagagagtgctgaccaccagccccagcagacagctggtgggcagaaccttcagcgacggcctggccaccagaaccctgcagccccccgagagccccagactgggcagaagaggcctggacagcatgagagagctgccccccctgagccccagcctgagcagaagagccctgagccccctgcccaccagaaccacccccgaccccaagctgaacagagaggtggccgagagccccagacccagaagatgggccgcccacggcgccagccccgaggacttcagcctgaccctgggcgccagaggcagaagaaccagaagccccagccccaccctgggcgagagcctggccccccacaagggcagcttcagcggcagactgagccccgcctacagcctgggcagcctgaccggcgccagcccctgccagagcccctgcgtgcagagaaagctgagcagcggcgacctgagagtgcccgtgaccagagagagaaagaacagcatcaccgagatcagcgacaacgaggacgacctgctggagtaccacagaagacagagacaggagagactgagagagcaggagatggagagactggagagacagagactggagaccatcctgaacctgtgcgccgagtacagcagagccgacggcggccccgaggccggcgagctgcccagcatcggcgaggccaccgccgccctggccctggccggcagaagacccagcagaggcctggccggcgccagcggcagaagcagcgaggagcccggcgtggccacccagagactgtgggagagcatggagagaagcgacgaggagaacctgaaggaggagtgcagcagcaccgagagcacccagcaggagcacgaggacgcccccagcaccaagctgcagggcgaggtgctggccctggaggaggagagagcccaggtgctgggccacgtggagcagctgaaggtgagagtgaaggagctggagcagcagctgcaggagagcgccagagaggccgagatggagagagccctgctgcagggcgagagagaggccgagagagccctgctgcagaaggagcagaaggccgtggaccagctgcaggagaagctggtggccctggagaccggcatccagaaggagagagacaaggaggccgaggccctggagaccgagaccaagctgttcgaggacctggagttccagcagctggagagagagagcagagtggaggaggagagagagctggccggccagggcctgctgagaagcaaggccgagctgctgagaagcatcgccaagagaaaggagagactggccatcctggacagccaggccggccagatcagagcccaggccgtgcaggagagcgagagactggccagagacaagaacgccagcctgcagctgctgcagaaggagaaggagaagctgaccgtgctggagagaagataccacagcctgaccggcggcagacccttccccaagaccaccagcaccctgaaggagatggagaagctgctgctgcccgccgtggacctggagcagtggtaccaggagctgatggccggcctgggcaccggccccgccgccgccagcccccacagcagccccccccccctgcccgccaaggccagcagacagctgcaggtgtacagaagcaagatggacggcgaggccaccagccccctgcccagaaccagaagcggccccctgcccagcagcagcggcagcagcagcagcagcagccagctgagcgtggccaccctgggcagaagccccagccccaagagcgccctgctgacccagaacggcaccggcagcctgcccagaaacctggccgccaccctgcaggacatcgagaccaagagacagctggccctgcagcagaaggtggagagcctgcccgccgagcccctgcccaccgacgaccccgccggccagcaggtgatcgaggagcagagaagaagactggccgagctgaagcagaaggccgccgccgaggcccagtgccagtgggacgccctgcacggcgccgcccccttccccgccggccccagcggcttcccccccctgatgcaccacagcatcctgcaccacctgcccgccggcagagagagaggcgaggagggcgagcacgcctacgacaccctgagcctggagagcagcgacagcatggagaccagcatcagcaccggcggcaacagcgcctgcagccccgacaacatgagcagcgccagcggcctggacatgggcaagatcgaggagatggagaagatgctgaaggaggcccacgccgagaagaacagactgatggagagcagagagagagagatggagctgagaagacaggccctggaggaggagagaagaagaagagagcaggtggagagaagactgcagagcgagagcgccagaagacagcagctggtggagaaggaggtgaagatgagagagaagcagttcagccaggccagacccctgaccagatacctgcccatcagaaaggaggacttcgacctgaagacccacatcgagagcagcggccacggcgtggacacctgcctgcacgtggtgctgagcagcaaggtgtgcagaggctacctggtgaagatgggcggcaagatcaagagctggaagaagagatggttcgtgttcgacagactgaagagaaccctgagctactacgtggacaagcacgagaccaagctgaagggcgtgatctacttccaggccatcgaggaggtgtactacgaccacctgagaagcgccgccaagagccccaaccccgccctgaccttctgcgtgaagacccacgacagactgtactacatggtggcccccagcgccgaggccatgagaatctggatggacgtgatcgtgaccggcgccgagggctacacccagttcatgaactag

SEQ ID NO: 93611 - DNA, 306 bp, Artificial Sequence
  Description of Artificial Sequence: Synthetic coding sequence
atgggcggcaagatcaagagctggaagaagagatggttcgtgttcgacagactgaagagaaccctgagctactacgtggacaagcacgagaccaagctgaagggcgtgatctacttccaggccatcgaggaggtgtactacgaccacctgagaagcgccgccaagagccccaaccccgccctgaccttctgcgtgaagacccacgacagactgtactacatggtggcccccagcgccgaggccatgagaatctggatggacgtgatcgtgaccggcgccgagggctacacccagttcatgaactag

SEQ ID NO: 93612 - DNA, 1119 bp, Artificial Sequence
  Description of Artificial Sequence: Synthetic coding sequence
atggacgccctgaacagaaaccagatcggccccggctgccagacccagaccatggtgcagaagggccccctggacctgatcgagaccggcaagggcctgaaggtgcagaccgacaagccccacctggtgagcctgggcagcggcagactgagcaccgccatcaccctgctgcccctggaggagggcagaaccgtgatcggcagcgccgccagagacatcagcctgcagggccccggcctggcccccgagcactgctacatcgagaacctgagaggcaccctgaccctgtacccctgcggcaacgcctgcaccatcgacggcctgcccgtgagacagcccaccagactgacccagggctgcatgctgtgcctgggccagagcaccttcctgagattcaaccaccccgccgaggccaagtggatgaagagcatgatccccgccggcggcagagcccccggccccccctacagccccgtgcccgagagcgagagcctggtgaacggcaaccacaccccccagaccgccaccagaggccccagcgcctgcgccagccacagcagcctggtgagcagcatcgagaaggacctgcaggagatcatggacagcctggtgctggaggagcccggcgccgccggcaagaagcccgccgccaccagccccctgagccccatggccaacggcggcagatacctgctgagcccccccaccagccccggcgccatgagcgtgggcagcagctacgagaacaccagccccgccttcagccccctgagcagccccgccagcagcggcagctgcgccagccacagccccagcggccaggagcccggccccagcgtgccccccctggtgcccgccagaagcagcagctaccacctggccctgcagcccccccagagcagacccagcggcgccagaagcgagagccccagactgagcagaaagggcggccacgagagaccccccagccccggcctgagaggcctgctgaccgacagccccgccgccaccgtgctggccgaggccagaagagccaccgagagccccagactgggcggccagctgcccgtggtggccatcagcctgagcgagtaccccgccgccagaagatgcacctag

SEQ ID NO: 93613 - DNA, 744 bp, Artificial Sequence
  Description of Artificial Sequence: Synthetic coding sequence
atggacgccctgaacagaaaccagatcggccccggctgccagacccagaccatggtgcagaagggccccctggacctgatcgagaccggcaagggcctgaaggtgcagaccgacaagccccacctggtgagcctgggcagcggcagactgagcaccgccatcaccctgctgcccctggaggagggcagaaccgtgatcggcagcgccgccagagacatcagcctgcagggccccggcctggcccccgagcactgctacatcgagaacctgagaggcaccctgaccctgtacccctgcggcaacgcctgcaccatcgacggcctgcccgtgagacagcccaccagactgacccagggctgcatgctgtgcctgggccagagcaccttcctgagattcaaccaccccgccgaggccaagtggatgaagagcatgatccccgccggcggcagagcccccggccccccctacagccccgtgcccgccgagagcgagagcctggtgaacggcaaccacaccccccagaccgccaccagaggccccagcgcctgcgccagccacagcagcctggtgagcagcatcgagaaggacctgcaggagatcatggacagcctggtgctggaggagcccggcgccgccggcaagaagcccgccgccaccagccccctgagccccatggccaacggcggcagatacctgctgagcccccccaccagccccggccacgtgtgcggcctgcagctgtag

SEQ ID NO: 93614 - DNA, 14055 bp, Artificial Sequence
  Description of Artificial Sequence: Synthetic coding sequence
atggtggccggcatgctgatgcccagagaccagctgagagccatctacgaggtgctgttcagagagggcgtgatggtggccaagaaggacagaagacccagaagcctgcacccccacgtgcccggcgtgaccaacctgcaggtgatgagagccatggccagcctgagagccagaggcctggtgagagagaccttcgcctggtgccacttctactggtacctgaccaacgagggcatcgcccacctgagacagtacctgcacctgccccccgagatcgtgcccgccagcctgcagagagtgagaagacccgtggccatggtgatgcccgccagaagaaccccccacgtgcaggccgtgcagggccccctgggcagcccccccaagagaggccccctgcccaccgaggagcagagagtgtacagaagaaaggagctggaggaggtgagccccgagacccccgtggtgcccgccaccacccagagaaccctggccagacccggccccgagcccgcccccgccaccgacgagagagacagagtgcagaagaagaccttcaccaagtgggtgaacaagcacctgatcaaggcccagagacacatcagcgacctgtacgaggacctgagagacggccacaacctgatcagcctgctggaggtgctgagcggcgacagcctgcccagagagaagggcagaatgagattccacaagctgcagaacgtgcagatcgccctggactacctgagacacagacaggtgaagctggtgaacatcagaaacgacgacatcgccgacggcaaccccaagctgaccctgggcctgatctggaccatcatcctgcacttccagatcagcgacatccaggtgagcggccagagcgaggacatgaccgccaaggagaagctgctgctgtggagccagagaatggtggagggctaccagggcctgagatgcgacaacttcaccagcagctggagagacggcagactgttcaacgccatcatccacagacacaagcccctgctgatcgacatgaacaaggtgtacagacagaccaacctggagaacctggaccaggccttcagcgtggccgagagagacctgggcgtgaccagactgctggaccccgaggacgtggacgtgccccagcccgacgagaagagcatcatcacctacgtgagcagcctgtacgacgccatgcccagagtgcccgacgtgcaggacggcgtgagagccaacgagctgcagctgagatggcaggagtacagagagctggtgctgctgctgctgcagtggatgagacaccacaccgccgccttcgaggagagaagattccccagcagcttcgaggagatcgagatcctgtggagccagttcctgaagttcaaggagatggagctgcccgccaaggaggccgacaagaacagaagcaagggcatctaccagagcctggagggcgccgtgcaggccggccagctgaaggtgccccccggctaccaccccctggacgtggagaaggagtggggcaagctgcacgtggccatcctggagagagagaagcagctgagaagcgagttcgagagactggagtgcctgcagagaatcgtgaccaagctgcagatggaggccggcctgtgcgaggagcagctgaaccaggccgacgccctgctgcagagcgacgtgagactgctggccgccggcaaggtgccccagagagccggcgaggtggagagagacctggacaaggccgacagcatgatcagactgctgttcaacgacgtgcagaccctgaaggacggcagacacccccagggcgagcagatgtacagaagagtgtacagactgcacgagagactggtggccatcagaaccgagtacaacctgagactgaaggccggcgtggccgcccccgccacccaggtggcccaggtgaccctgcagagcgtgcagagaagacccgagctggaggacagcaccctgagatacctgcaggacctgctggcctgggtggaggagaaccagcacagagtggacggcgccgagtggggcgtggacctgcccagcgtggaggcccagctgggcagccacagaggcctgcaccagagcatcgaggagttcagagccaagatcgagagagccagaagcgacgagggccagctgagccccgccaccagaggcgcctacagagactgcctgggcagactggacctgcagtacgccaagctgctgaacagcagcaaggccagactgagaagcctggagagcctgcacagcttcgtggccgccgccaccaaggagctgatgtggctgaacgagaaggaggaggaggaggtgggcttcgactggagcgacagaaacaccaacatgaccgccaagaaggagagctacagcgccctgatgagagagctggagctgaaggagaagaagatcaaggagctgcagaacgccggcgacagactgctgagagaggaccaccccgccagacccaccgtggagagcttccaggccgccctgcagacccagtggagctggatgctgcagctgtgctgctgcatcgaggcccacctgaaggagaacgccgcctacttccagttcttcagcgacgtgagagaggccgagggccagctgcagaagctgcaggaggccctgagaagaaagtacagctgcgacagaagcgccaccgtgaccagactggaggacctgctgcaggacgcccaggacgagaaggagcagctgaacgagtacaagggccacctgagcggcctggccaagagagccaaggccgtggtgcagctgaagcccagacaccccgcccaccccatgagaggcagactgcccctgctggccgtgtgcgactacaagcaggtggaggtgaccgtgcacaagggcgacgagtgccagctggtgggccccgcccagcccagccactggaaggtgctgagcagcagcggcagcgaggccgccgtgcccagcgtgtgcttcctggtgcccccccccaaccaggaggcccaggaggccgtgaccagactggaggcccagcaccaggccctggtgaccctgtggcaccagctgcacgtggacatgaagagcctgctggcctggcagagcctgagaagagacgtgcagctgatcagaagctggagcctggccaccttcagaaccctgaagcccgaggagcagagacaggccctgcacagcctggagctgcactaccaggccttcctgagagacagccaggacgccggcggcttcggccccgaggacagactgatggccgagagagagtacggcagctgcagccaccactaccagcagctgctgcagagcctggagcagggcgcccaggaggagagcagatgccagagatgcatcagcgagctgaaggacatcagactgcagctggaggcctgcgagaccagaaccgtgcacagactgagactgcccctggacaaggagcccgccagagagtgcgcccagagaatcgccgagcagcagaaggcccaggccgaggtggagggcctgggcaagggcgtggccagactgagcgccgaggccgagaaggtgctggccctgcccgagcccagccccgccgcccccaccctgagaagcgagctggagctgaccctgggcaagctggagcaggtgagaagcctgagcgccatctacctggagaagctgaagaccatcagcctggtgatcagaggcacccagggcgccgaggaggtgctgagagcccacgaggagcagctgaaggaggcccaggccgtgcccgccaccctgcccgagctggaggccaccaaggccagcctgaagaagctgagagcccaggccgaggcccagcagcccaccttcgacgccctgagagacgagctgagaggcgcccaggaggtgggcgagagactgcagcagagacacggcgagagagacgtggaggtggagagatggagagagagagtggcccagctgctggagagatggcaggccgtgctggcccagaccgacgtgagacagagagagctggagcagctgggcagacagctgagatactacagagagagcgccgaccccctgggcgcctggctgcaggacgccagaagaagacaggagcagatccaggccatgcccctggccgacagccaggccgtgagagagcagctgagacaggagcaggccctgctggaggagatcgagagacacggcgagaaggtggaggagtgccagagattcgccaagcagtacatcaacgccatcaaggactacgagctgcagctggtgacctacaaggcccagctggagcccgtggccagccccgccaagaagcccaaggtgcagagcggcagcgagagcgtgatccaggagtacgtggacctgagaacccactacagcgagctgaccaccctgaccagccagtacatcaagttcatcagcgagaccctgagaagaatggaggaggaggagagactggccgagcagcagagagccgaggagagagagagactggccgaggtggaggccgccctggagaagcagagacagctggccgaggcccacgcccaggccaaggcccaggccgagagagaggccaaggagctgcagcagagaatgcaggaggaggtggtgagaagagaggaggccgccgtggacgcccagcagcagaagagaagcatccaggaggagctgcagcagctgagacagagcagcgaggccgagatccaggccaaggccagacaggccgaggccgccgagagaagcagactgagaatcgaggaggagatcagagtggtgagactgcagctggaggccaccgagagacagagaggcggcgccgagggcgagctgcaggccctgagagccagagccgaggaggccgaggcccagaagagacaggcccaggaggaggccgagagactgagaagacaggtgcaggacgagagccagagaaagagacaggccgaggtggagctggccagcagagtgaaggccgaggccgaggccgccagagagaagcagagagccctgcaggccctggaggagctgagactgcaggccgaggaggccgagagaagactgagacaggccgaggtggagagagccagacaggtgcaggtggccctggagaccgcccagagaagcgccgaggccgagctgcagagcaagagagccagcttcgccgagaagaccgcccagctggagagaagcctgcaggaggagcacgtggccgtggcccagctgagagaggaggccgagagaagagcccagcagcaggccgaggccgagagagccagagaggaggccgagagagagctggagagatggcagctgaaggccaacgaggccctgagactgagactgcaggccgaggaggtggcccagcagaagagcctggcccaggccgaggccgagaagcagaaggaggaggccgagagagaggccagaagaagaggcaaggccgaggagcaggccgtgagacagagagagctggccgagcaggagctggagaagcagagacagctggccgagggcaccgcccagcagagactggccgccgagcaggagctgatcagactgagagccgagaccgagcagggcgagcagcagagacagctgctggaggaggagctggccagactgcagagagaggccgccgccgccacccagaagagacaggagctggaggccgagctggccaaggtgagagccgagatggaggtgctgctggccagcaaggccagagccgaggaggagagcagaagcaccagcgagaagagcaagcagagactggaggccgaggccggcagattcagagagctggccgaggaggccgccagactgagagccctggccgaggaggccaagagacagagacagctggccgaggaggacgccgccagacagagagccgaggccgagagagtgctggccgagaagctggccgccatcggcgaggccaccagactgaagaccgaggccgagatcgccctgaaggagaaggaggccgagaacgagagactgagaagactggccgaggacgaggccttccagagaagaagactggaggagcaggccgcccagcacaaggccgacatcgaggagagactggcccagctgagaaaggccagcgacagcgagctggagagacagaagggcctggtggaggacaccctgagacagagaagacaggtggaggaggagatcctggccctgaaggccagcttcgagaaggccgccgccggcaaggccgagctggagctggagctgggcagaatcagaagcaacgccgaggacaccctgagaagcaaggagcaggccgagctggaggccgccagacagagacagctggccgccgaggaggagagaagaagaagagaggccgaggagagagtgcagaagagcctggccgccgaggaggaggccgccagacagagaaaggccgccctggaggaggtggagagactgaaggccaaggtggaggaggccagaagactgagagagagagccgagcaggagagcgccagacagctgcagctggcccaggaggccgcccagaagagactgcaggccgaggagaaggcccacgccttcgccgtgcagcagaaggagcaggagctgcagcagaccctgcagcaggagcagagcgtgctggaccagctgagaggcgaggccgaggccgccagaagagccgccgaggaggccgaggaggccagagtgcaggccgagagagaggccgcccagagcagaagacaggtggaggaggccgagagactgaagcagagcgccgaggagcaggcccaggccagagcccaggcccaggccgccgccgagaagctgagaaaggaggccgagcaggaggccgccagaagagcccaggccgagcaggccgccctgagacagaagcaggccgccgacgccgagatggagaagcacaagaagttcgccgagcagaccctgagacagaaggcccaggtggagcaggagctgaccaccctgagactgcagctggaggagaccgaccaccagaagaacctgctggacgaggagctgcagagactgaaggccgaggccaccgaggccgccagacagagaagccaggtggaggaggagctgttcagcgtgagagtgcagatggaggagctgagcaagctgaaggccagaatcgaggccgagaacagagccctgatcctgagagacaaggacaacacccagagattcctgcaggaggaggccgagaagatgaagcaggtggccgaggaggccgccagactgagcgtggccgcccaggaggccgccagactgagacagctggccgaggaggacctggcccagcagagagccctggccgagaagatgctgaaggagaagatgcaggccgtgcaggaggccaccagactgaaggccgaggccgagctgctgcagcagcagaaggagctggcccaggagcaggccagaagactgcaggaggacaaggagcagatggcccagcagctggccgaggagacccagggcttccagagaaccctggaggccgagagacagagacagctggagatgagcgccgaggccgagagactgaagctgagagtggccgagatgagcagagcccaggccagagccgaggaggacgcccagagattcagaaagcaggccgaggagatcggcgagaagctgcacagaaccgagctggccacccaggagaaggtgaccctggtgcagaccctggagatccagagacagcagagcgaccacgacgccgagagactgagagaggccatcgccgagctggagagagagaaggagaagctgcagcaggaggccaagctgctgcagctgaagagcgaggagatgcagaccgtgcagcaggagcagctgctgcaggagacccaggccctgcagcagagcttcctgagcgagaaggacagcctgctgcagagagagagattcatcgagcaggagaaggccaagctggagcagctgttccaggacgaggtggccaaggcccagcagctgagagaggagcagcagagacagcagcagcagatggagcaggagagacagagactggtggccagcatggaggaggccagaagaagacagcacgaggccgaggagggcgtgagaagaaagcaggaggagctgcagcagctggagcagcagagaagacagcaggaggagctgctggccgaggagaaccagagactgagagagcagctgcagctgctggaggagcagcacagagccgccctggcccacagcgaggaggtgaccgccagccaggtggccgccaccaagaccctgcccaacggcagagacgccctggacggccccgccgccgaggccgagcccgagcacagcttcgacggcctgagaagaaaggtgagcgcccagagactgcaggaggccggcatcctgagcgccgaggagctgcagagactggcccagggccacaccaccgtggacgagctggccagaagagaggacgtgagacactacctgcagggcagaagcagcatcgccggcctgctgctgaaggccaccaacgagaagctgagcgtgtacgccgccctgcagagacagctgctgagccccggcaccgccctgatcctgctggaggcccaggccgccagcggcttcctgctggaccccgtgagaaacagaagactgaccgtgaacgaggccgtgaaggagggcgtggtgggccccgagctgcaccacaagctgctgagcgccgagagagccgtgaccggctacaaggacccctacaccggccagcagatcagcctgttccaggccatgcagaagggcctgatcgtgagagagcacggcatcagactgctggaggcccagatcgccaccggcggcgtgatcgaccccgtgcacagccacagagtgcccgtggacgtggcctacagaagaggctacttcgacgaggagatgaacagagtgctggccgaccccagcgacgacaccaagggcttcttcgaccccaacacccacgagaacctgacctacctgcagctgctggagagatgcgtggaggaccccgagaccggcctgtgcctgctgcccctgaccgacaaggccgccaagggcggcgagctggtgtacaccgacagcgaggccagagacgtgttcgagaaggccaccgtgagcgcccccttcggcaagttccagggcaagaccgtgaccatctgggagatcatcaacagcgagtacttcaccgccgagcagagaagagacctgctgagacagttcagaaccggcagaatcaccgtggagaagatcatcaagatcatcatcaccgtggtggaggagcaggagcagaagggcagactgtgcttcgagggcctgagaagcctggtgcccgccgccgagctgctggagagcagagtgatcgacagagagctgtaccagcagctgcagagaggcgagagaagcgtgagagacgtggccgaggtggacaccgtgagaagagccctgagaggcgccaacgtgatcgccggcgtgtggctggaggaggccggccagaagctgagcatctacaacgccctgaagaaggacctgctgcccagcgacatggccgtggccctgctggaggcccaggccggcaccggccacatcatcgaccccgccaccagcgccagactgaccgtggacgaggccgtgagagccggcctggtgggccccgagttccacgagaagctgctgagcgccgagaaggccgtgaccggctacagagacccctacaccggccagagcgtgagcctgttccaggccctgaagaagggcctgatccccagagagcagggcctgagactgctggacgcccagctgagcaccggcggcatcgtggaccccagcaagagccacagagtgcccctggacgtggcctgcgccagaggctgcctggacgaggagaccagcagagccctgagcgcccccagagccgacgccaaggcctacagcgaccccagcaccggcgagcccgccacctacggcgagctgcagcagagatgcagacccgaccagctgaccggcctgagcctgctgcccctgagcgagaaggccgccagagccagacaggaggagctgtacagcgagctgcaggccagagagaccttcgagaagacccccgtggaggtgcccgtgggcggcttcaagggcagaaccgtgaccgtgtgggagctgatcagcagcgagtacttcaccgccgagcagagacaggagctgctgagacagttcagaaccggcaaggtgaccgtggagaaggtgatcaagatcctgatcaccatcgtggaggaggtggagaccctgagacaggagagactgagcttcagcggcctgagagcccccgtgcccgccagcgagctgctggccagcggcgtgctgagcagagcccagttcgagcagctgaaggacggcaagaccaccgtgaaggacctgagcgagctgggcagcgtgagaaccctgctgcagggcagcggctgcctggccggcatctacctggaggacaccaaggagaaggtgagcatctacgaggccatgagaagaggcctgctgagagccaccaccgccgccctgctgctggaggcccaggccgccaccggcttcctggtggaccccgtgagaaaccagagactgtacgtgcacgaggccgtgaaggccggcgtggtgggccccgagctgcacgagcagctgctgagcgccgagaaggccgtgaccggctacagagacccctacagcggcagcaccatcagcctgttccaggccatgcagaagggcctggtgctgagacagcacggcatcagactgctggaggcccagatcgccaccggcggcatcatcgaccccgtgcacagccacagagtgcccgtggacgtggcctaccagagaggctacttcagcgaggagatgaacagagtgctggccgaccccagcgacgacaccaagggcttcttcgaccccaacacccacgagaacctgacctacagacagctgctggagagatgcgtggaggaccccgagaccggcctgagactgctgcccctgaagggcgccgagaaggccgaggtggtggagaccacccaggtgtacaccgaggaggagaccagaagagccttcgaggagacccagatcgacatccccggcggcggcagccacggcggcagcaccatgagcctgtgggaggtgatgcagagcgacctgatccccgaggagcagagagcccagctgatggccgacttccaggccggcagagtgaccaaggagagaatgatcatcatcatcatcgagatcatcgagaagaccgagatcatcagacagcagggcctggccagctacgactacgtgagaagaagactgaccgccgaggacctgttcgaggccagaatcatcagcctggagacctacaacctgctgagagagggcaccagaagcctgagagaggccctggaggccgagagcgcctggtgctacctgtacggcaccggcagcgtggccggcgtgtacctgcccggcagcagacagaccctgagcatctaccaggccctgaagaagggcctgctgagcgccgaggtggccagactgctgctggaggcccaggccgccaccggcttcctgctggaccccgtgaagggcgagagactgaccgtggacgaggccgtgagaaagggcctggtgggccccgagctgcacgacagactgctgagcgccgagagagccgtgaccggctacagagacccctacaccgagcagaccatcagcctgttccaggccatgaagaaggagctgatccccaccgaggaggccctgagactgctggacgcccagctggccaccggcggcatcgtggaccccagactgggcttccacctgcccctggaggtggcctaccagagaggctacctgaacaaggacacccacgaccagctgagcgagcccagcgaggtgagaagctacgtggaccccagcaccgacgagagactgagctacacccagctgctgagaagatgcagaagagacgacggcaccggccagctgctgctgcccctgagcgacgccagaaagctgaccttcagaggcctgagaaagcagatcaccatggaggagctggtgagaagccaggtgatggacgaggccaccgccctgcagctgagagagggcctgaccagcatcgaggaggtgaccaagaacctgcagaagttcctggagggcaccagctgcatcgccggcgtgttcgtggacgccaccaaggagagactgagcgtgtaccaggccatgaagaagggcatcatcagacccggcaccgccttcgagctgctggaggcccaggccgccaccggctacgtgatcgaccccatcaagggcctgaagctgaccgtggaggaggccgtgagaatgggcatcgtgggccccgagttcaaggacaagctgctgagcgccgagagagccgtgaccggctacaaggacccctacagcggcaagctgatcagcctgttccaggccatgaagaagggcctgatcctgaaggaccacggcatcagactgctggaggcccagatcgccaccggcggcatcatcgaccccgaggagagccacagactgcccgtggaggtggcctacaagagaggcctgttcgacgaggagatgaacgagatcctgaccgaccccagcgacgacaccaagggcttcttcgaccccaacaccgaggagaacctgacctacctgcagctgatggagagatgcatcaccgacccccagaccggcctgtgcctgctgcccctgaaggagaagaagagagagagaaagaccagcagcaagagcagcgtgagaaagagaagagtggtgatcgtggaccccgagaccggcaaggagatgagcgtgtacgaggcctacagaaagggcctgatcgaccaccagacctacctggagctgagcgagcaggagtgcgagtgggaggagatcaccatcagcagcagcgacggcgtggtgaagagcatgatcatcgacagaagaagcggcagacagtacgacatcgacgacgccatcgccaagaacctgatcgacagaagcgccctggaccagtacagagccggcaccctgagcatcaccgagttcgccgacatgctgagcggcaacgccggcggcttcagaagcagaagcagcagcgtgggcagcagcagcagctaccccatcagccccgccgtgagcagaacccagctggccagctggagcgaccccaccgaggagaccggccccgtggccggcatcctggacaccgagaccctggagaaggtgagcatcaccgaggccatgcacagaaacctggtggacaacatcaccggccagagactgctggaggcccaggcctgcaccggcggcatcatcgaccccagcaccggcgagagattccccgtgaccgacgccgtgaacaagggcctggtggacaagatcatggtggacagaatcaacctggcccagaaggccttctgcggcttcgaggaccccagaaccaagaccaagatgagcgccgcccaggccctgaagaagggctggctgtactacgaggccggccagagattcctggaggtgcagtacctgaccggcggcctgatcgagcccgacacccccggcagagtgcccctggacgaggccctgcagagaggcaccgtggacgccagaaccgcccagaagctgagagacgtgggcgcctacagcaagtacctgacctgccccaagaccaagctgaagatcagctacaaggacgccctggacagaagcatggtggaggagggcaccggcctgagactgctggaggccgccgcccagagcaccaagggctactacagcccctacagcgtgagcggcagcggcagcaccgccggcagcagaaccggcagcagaaccggcagcagagccggcagcagaagaggcagcttcgacgccaccggcagcggcttcagcatgaccttcagcagcagcagctacagcagcagcggctacggcagaagatacgccagcggcagcagcgccagcctgggcggccccgagagcgccgtggcctag

SEQ ID NO: 93615 - DNA, 13644 bp, Artificial Sequence
  Description of Artificial Sequence: Synthetic coding sequence
atgagccagcaccagctgagagtgccccagcccgagggcctgggcagaaagagaaccagcagcgaggacaacctgtacctggccgtgctgagagccagcgagggcaagaaggacgagagagacagagtgcagaagaagaccttcaccaagtgggtgaacaagcacctgatcaaggcccagagacacatcagcgacctgtacgaggacctgagagacggccacaacctgatcagcctgctggaggtgctgagcggcgacagcctgcccagagagaagggcagaatgagattccacaagctgcagaacgtgcagatcgccctggactacctgagacacagacaggtgaagctggtgaacatcagaaacgacgacatcgccgacggcaaccccaagctgaccctgggcctgatctggaccatcatcctgcacttccagatcagcgacatccaggtgagcggccagagcgaggacatgaccgccaaggagaagctgctgctgtggagccagagaatggtggagggctaccagggcctgagatgcgacaacttcaccagcagctggagagacggcagactgttcaacgccatcatccacagacacaagcccctgctgatcgacatgaacaaggtgtacagacagaccaacctggagaacctggaccaggccttcagcgtggccgagagagacctgggcgtgaccagactgctggaccccgaggacgtggacgtgccccagcccgacgagaagagcatcatcacctacgtgagcagcctgtacgacgccatgcccagagtgcccgacgtgcaggacggcgtgagagccaacgagctgcagctgagatggcaggagtacagagagctggtgctgctgctgctgcagtggatgagacaccacaccgccgccttcgaggagagaagattccccagcagcttcgaggagatcgagatcctgtggagccagttcctgaagttcaaggagatggagctgcccgccaaggaggccgacaagaacagaagcaagggcatctaccagagcctggagggcgccgtgcaggccggccagctgaaggtgccccccggctaccaccccctggacgtggagaaggagtggggcaagctgcacgtggccatcctggagagagagaagcagctgagaagcgagttcgagagactggagtgcctgcagagaatcgtgaccaagctgcagatggaggccggcctgtgcgaggagcagctgaaccaggccgacgccctgctgcagagcgacgtgagactgctggccgccggcaaggtgccccagagagccggcgaggtggagagagacctggacaaggccgacagcatgatcagactgctgttcaacgacgtgcagaccctgaaggacggcagacacccccagggcgagcagatgtacagaagagtgtacagactgcacgagagactggtggccatcagaaccgagtacaacctgagactgaaggccggcgtggccgcccccgccacccaggtggcccaggtgaccctgcagagcgtgcagagaagacccgagctggaggacagcaccctgagatacctgcaggacctgctggcctgggtggaggagaaccagcacagagtggacggcgccgagtggggcgtggacctgcccagcgtggaggcccagctgggcagccacagaggcctgcaccagagcatcgaggagttcagagccaagatcgagagagccagaagcgacgagggccagctgagccccgccaccagaggcgcctacagagactgcctgggcagactggacctgcagtacgccaagctgctgaacagcagcaaggccagactgagaagcctggagagcctgcacagcttcgtggccgccgccaccaaggagctgatgtggctgaacgagaaggaggaggaggaggtgggcttcgactggagcgacagaaacaccaacatgaccgccaagaaggagagctacagcgccctgatgagagagctggagctgaaggagaagaagatcaaggagctgcagaacgccggcgacagactgctgagagaggaccaccccgccagacccaccgtggagagcttccaggccgccctgcagacccagtggagctggatgctgcagctgtgctgctgcatcgaggcccacctgaaggagaacgccgcctacttccagttcttcagcgacgtgagagaggccgagggccagctgcagaagctgcaggaggccctgagaagaaagtacagctgcgacagaagcgccaccgtgaccagactggaggacctgctgcaggacgcccaggacgagaaggagcagctgaacgagtacaagggccacctgagcggcctggccaagagagccaaggccgtggtgcagctgaagcccagacaccccgcccaccccatgagaggcagactgcccctgctggccgtgtgcgactacaagcaggtggaggtgaccgtgcacaagggcgacgagtgccagctggtgggccccgcccagcccagccactggaaggtgctgagcagcagcggcagcgaggccgccgtgcccagcgtgtgcttcctggtgcccccccccaaccaggaggcccaggaggccgtgaccagactggaggcccagcaccaggccctggtgaccctgtggcaccagctgcacgtggacatgaagagcctgctggcctggcagagcctgagaagagacgtgcagctgatcagaagctggagcctggccaccttcagaaccctgaagcccgaggagcagagacaggccctgcacagcctggagctgcactaccaggccttcctgagagacagccaggacgccggcggcttcggccccgaggacagactgatggccgagagagagtacggcagctgcagccaccactaccagcagctgctgcagagcctggagcagggcgcccaggaggagagcagatgccagagatgcatcagcgagctgaaggacatcagactgcagctggaggcctgcgagaccagaaccgtgcacagactgagactgcccctggacaaggagcccgccagagagtgcgcccagagaatcgccgagcagcagaaggcccaggccgaggtggagggcctgggcaagggcgtggccagactgagcgccgaggccgagaaggtgctggccctgcccgagcccagccccgccgcccccaccctgagaagcgagctggagctgaccctgggcaagctggagcaggtgagaagcctgagcgccatctacctggagaagctgaagaccatcagcctggtgatcagaggcacccagggcgccgaggaggtgctgagagcccacgaggagcagctgaaggaggcccaggccgtgcccgccaccctgcccgagctggaggccaccaaggccagcctgaagaagctgagagcccaggccgaggcccagcagcccaccttcgacgccctgagagacgagctgagaggcgcccaggaggtgggcgagagactgcagcagagacacggcgagagagacgtggaggtggagagatggagagagagagtggcccagctgctggagagatggcaggccgtgctggcccagaccgacgtgagacagagagagctggagcagctgggcagacagctgagatactacagagagagcgccgaccccctgggcgcctggctgcaggacgccagaagaagacaggagcagatccaggccatgcccctggccgacagccaggccgtgagagagcagctgagacaggagcaggccctgctggaggagatcgagagacacggcgagaaggtggaggagtgccagagattcgccaagcagtacatcaacgccatcaaggactacgagctgcagctggtgacctacaaggcccagctggagcccgtggccagccccgccaagaagcccaaggtgcagagcggcagcgagagcgtgatccaggagtacgtggacctgagaacccactacagcgagctgaccaccctgaccagccagtacatcaagttcatcagcgagaccctgagaagaatggaggaggaggagagactggccgagcagcagagagccgaggagagagagagactggccgaggtggaggccgccctggagaagcagagacagctggccgaggcccacgcccaggccaaggcccaggccgagagagaggccaaggagctgcagcagagaatgcaggaggaggtggtgagaagagaggaggccgccgtggacgcccagcagcagaagagaagcatccaggaggagctgcagcagctgagacagagcagcgaggccgagatccaggccaaggccagacaggccgaggccgccgagagaagcagactgagaatcgaggaggagatcagagtggtgagactgcagctggaggccaccgagagacagagaggcggcgccgagggcgagctgcaggccctgagagccagagccgaggaggccgaggcccagaagagacaggcccaggaggaggccgagagactgagaagacaggtgcaggacgagagccagagaaagagacaggccgaggtggagctggccagcagagtgaaggccgaggccgaggccgccagagagaagcagagagccctgcaggccctggaggagctgagactgcaggccgaggaggccgagagaagactgagacaggccgaggtggagagagccagacaggtgcaggtggccctggagaccgcccagagaagcgccgaggccgagctgcagagcaagagagccagcttcgccgagaagaccgcccagctggagagaagcctgcaggaggagcacgtggccgtggcccagctgagagaggaggccgagagaagagcccagcagcaggccgaggccgagagagccagagaggaggccgagagagagctggagagatggcagctgaaggccaacgaggccctgagactgagactgcaggccgaggaggtggcccagcagaagagcctggcccaggccgaggccgagaagcagaaggaggaggccgagagagaggccagaagaagaggcaaggccgaggagcaggccgtgagacagagagagctggccgagcaggagctggagaagcagagacagctggccgagggcaccgcccagcagagactggccgccgagcaggagctgatcagactgagagccgagaccgagcagggcgagcagcagagacagctgctggaggaggagctggccagactgcagagagaggccgccgccgccacccagaagagacaggagctggaggccgagctggccaaggtgagagccgagatggaggtgctgctggccagcaaggccagagccgaggaggagagcagaagcaccagcgagaagagcaagcagagactggaggccgaggccggcagattcagagagctggccgaggaggccgccagactgagagccctggccgaggaggccaagagacagagacagctggccgaggaggacgccgccagacagagagccgaggccgagagagtgctggccgagaagctggccgccatcggcgaggccaccagactgaagaccgaggccgagatcgccctgaaggagaaggaggccgagaacgagagactgagaagactggccgaggacgaggccttccagagaagaagactggaggagcaggccgcccagcacaaggccgacatcgaggagagactggcccagctgagaaaggccagcgacagcgagctggagagacagaagggcctggtggaggacaccctgagacagagaagacaggtggaggaggagatcctggccctgaaggccagcttcgagaaggccgccgccggcaaggccgagctggagctggagctgggcagaatcagaagcaacgccgaggacaccctgagaagcaaggagcaggccgagctggaggccgccagacagagacagctggccgccgaggaggagagaagaagaagagaggccgaggagagagtgcagaagagcctggccgccgaggaggaggccgccagacagagaaaggccgccctggaggaggtggagagactgaaggccaaggtggaggaggccagaagactgagagagagagccgagcaggagagcgccagacagctgcagctggcccaggaggccgcccagaagagactgcaggccgaggagaaggcccacgccttcgccgtgcagcagaaggagcaggagctgcagcagaccctgcagcaggagcagagcgtgctggaccagctgagaggcgaggccgaggccgccagaagagccgccgaggaggccgaggaggccagagtgcaggccgagagagaggccgcccagagcagaagacaggtggaggaggccgagagactgaagcagagcgccgaggagcaggcccaggccagagcccaggcccaggccgccgccgagaagctgagaaaggaggccgagcaggaggccgccagaagagcccaggccgagcaggccgccctgagacagaagcaggccgccgacgccgagatggagaagcacaagaagttcgccgagcagaccctgagacagaaggcccaggtggagcaggagctgaccaccctgagactgcagctggaggagaccgaccaccagaagaacctgctggacgaggagctgcagagactgaaggccgaggccaccgaggccgccagacagagaagccaggtggaggaggagctgttcagcgtgagagtgcagatggaggagctgagcaagctgaaggccagaatcgaggccgagaacagagccctgatcctgagagacaaggacaacacccagagattcctgcaggaggaggccgagaagatgaagcaggtggccgaggaggccgccagactgagcgtggccgcccaggaggccgccagactgagacagctggccgaggaggacctggcccagcagagagccctggccgagaagatgctgaaggagaagatgcaggccgtgcaggaggccaccagactgaaggccgaggccgagctgctgcagcagcagaaggagctggcccaggagcaggccagaagactgcaggaggacaaggagcagatggcccagcagctggccgaggagacccagggcttccagagaaccctggaggccgagagacagagacagctggagatgagcgccgaggccgagagactgaagctgagagtggccgagatgagcagagcccaggccagagccgaggaggacgcccagagattcagaaagcaggccgaggagatcggcgagaagctgcacagaaccgagctggccacccaggagaaggtgaccctggtgcagaccctggagatccagagacagcagagcgaccacgacgccgagagactgagagaggccatcgccgagctggagagagagaaggagaagctgcagcaggaggccaagctgctgcagctgaagagcgaggagatgcagaccgtgcagcaggagcagctgctgcaggagacccaggccctgcagcagagcttcctgagcgagaaggacagcctgctgcagagagagagattcatcgagcaggagaaggccaagctggagcagctgttccaggacgaggtggccaaggcccagcagctgagagaggagcagcagagacagcagcagcagatggagcaggagagacagagactggtggccagcatggaggaggccagaagaagacagcacgaggccgaggagggcgtgagaagaaagcaggaggagctgcagcagctggagcagcagagaagacagcaggaggagctgctggccgaggagaaccagagactgagagagcagctgcagctgctggaggagcagcacagagccgccctggcccacagcgaggaggtgaccgccagccaggtggccgccaccaagaccctgcccaacggcagagacgccctggacggccccgccgccgaggccgagcccgagcacagcttcgacggcctgagaagaaaggtgagcgcccagagactgcaggaggccggcatcctgagcgccgaggagctgcagagactggcccagggccacaccaccgtggacgagctggccagaagagaggacgtgagacactacctgcagggcagaagcagcatcgccggcctgctgctgaaggccaccaacgagaagctgagcgtgtacgccgccctgcagagacagctgctgagccccggcaccgccctgatcctgctggaggcccaggccgccagcggcttcctgctggaccccgtgagaaacagaagactgaccgtgaacgaggccgtgaaggagggcgtggtgggccccgagctgcaccacaagctgctgagcgccgagagagccgtgaccggctacaaggacccctacaccggccagcagatcagcctgttccaggccatgcagaagggcctgatcgtgagagagcacggcatcagactgctggaggcccagatcgccaccggcggcgtgatcgaccccgtgcacagccacagagtgcccgtggacgtggcctacagaagaggctacttcgacgaggagatgaacagagtgctggccgaccccagcgacgacaccaagggcttcttcgaccccaacacccacgagaacctgacctacctgcagctgctggagagatgcgtggaggaccccgagaccggcctgtgcctgctgcccctgaccgacaaggccgccaagggcggcgagctggtgtacaccgacagcgaggccagagacgtgttcgagaaggccaccgtgagcgcccccttcggcaagttccagggcaagaccgtgaccatctgggagatcatcaacagcgagtacttcaccgccgagcagagaagagacctgctgagacagttcagaaccggcagaatcaccgtggagaagatcatcaagatcatcatcaccgtggtggaggagcaggagcagaagggcagactgtgcttcgagggcctgagaagcctggtgcccgccgccgagctgctggagagcagagtgatcgacagagagctgtaccagcagctgcagagaggcgagagaagcgtgagagacgtggccgaggtggacaccgtgagaagagccctgagaggcgccaacgtgatcgccggcgtgtggctggaggaggccggccagaagctgagcatctacaacgccctgaagaaggacctgctgcccagcgacatggccgtggccctgctggaggcccaggccggcaccggccacatcatcgaccccgccaccagcgccagactgaccgtggacgaggccgtgagagccggcctggtgggccccgagttccacgagaagctgctgagcgccgagaaggccgtgaccggctacagagacccctacaccggccagagcgtgagcctgttccaggccctgaagaagggcctgatccccagagagcagggcctgagactgctggacgcccagctgagcaccggcggcatcgtggaccccagcaagagccacagagtgcccctggacgtggcctgcgccagaggctgcctggacgaggagaccagcagagccctgagcgcccccagagccgacgccaaggcctacagcgaccccagcaccggcgagcccgccacctacggcgagctgcagcagagatgcagacccgaccagctgaccggcctgagcctgctgcccctgagcgagaaggccgccagagccagacaggaggagctgtacagcgagctgcaggccagagagaccttcgagaagacccccgtggaggtgcccgtgggcggcttcaagggcagaaccgtgaccgtgtgggagctgatcagcagcgagtacttcaccgccgagcagagacaggagctgctgagacagttcagaaccggcaaggtgaccgtggagaaggtgatcaagatcctgatcaccatcgtggaggaggtggagaccctgagacaggagagactgagcttcagcggcctgagagcccccgtgcccgccagcgagctgctggccagcggcgtgctgagcagagcccagttcgagcagctgaaggacggcaagaccaccgtgaaggacctgagcgagctgggcagcgtgagaaccctgctgcagggcagcggctgcctggccggcatctacctggaggacaccaaggagaaggtgagcatctacgaggccatgagaagaggcctgctgagagccaccaccgccgccctgctgctggaggcccaggccgccaccggcttcctggtggaccccgtgagaaaccagagactgtacgtgcacgaggccgtgaaggccggcgtggtgggccccgagctgcacgagcagctgctgagcgccgagaaggccgtgaccggctacagagacccctacagcggcagcaccatcagcctgttccaggccatgcagaagggcctggtgctgagacagcacggcatcagactgctggaggcccagatcgccaccggcggcatcatcgaccccgtgcacagccacagagtgcccgtggacgtggcctaccagagaggctacttcagcgaggagatgaacagagtgctggccgaccccagcgacgacaccaagggcttcttcgaccccaacacccacgagaacctgacctacagacagctgctggagagatgcgtggaggaccccgagaccggcctgagactgctgcccctgaagggcgccgagaaggccgaggtggtggagaccacccaggtgtacaccgaggaggagaccagaagagccttcgaggagacccagatcgacatccccggcggcggcagccacggcggcagcaccatgagcctgtgggaggtgatgcagagcgacctgatccccgaggagcagagagcccagctgatggccgacttccaggccggcagagtgaccaaggagagaatgatcatcatcatcatcgagatcatcgagaagaccgagatcatcagacagcagggcctggccagctacgactacgtgagaagaagactgaccgccgaggacctgttcgaggccagaatcatcagcctggagacctacaacctgctgagagagggcaccagaagcctgagagaggccctggaggccgagagcgcctggtgctacctgtacggcaccggcagcgtggccggcgtgtacctgcccggcagcagacagaccctgagcatctaccaggccctgaagaagggcctgctgagcgccgaggtggccagactgctgctggaggcccaggccgccaccggcttcctgctggaccccgtgaagggcgagagactgaccgtggacgaggccgtgagaaagggcctggtgggccccgagctgcacgacagactgctgagcgccgagagagccgtgaccggctacagagacccctacaccgagcagaccatcagcctgttccaggccatgaagaaggagctgatccccaccgaggaggccctgagactgctggacgcccagctggccaccggcggcatcgtggaccccagactgggcttccacctgcccctggaggtggcctaccagagaggctacctgaacaaggacacccacgaccagctgagcgagcccagcgaggtgagaagctacgtggaccccagcaccgacgagagactgagctacacccagctgctgagaagatgcagaagagacgacggcaccggccagctgctgctgcccctgagcgacgccagaaagctgaccttcagaggcctgagaaagcagatcaccatggaggagctggtgagaagccaggtgatggacgaggccaccgccctgcagctgagagagggcctgaccagcatcgaggaggtgaccaagaacctgcagaagttcctggagggcaccagctgcatcgccggcgtgttcgtggacgccaccaaggagagactgagcgtgtaccaggccatgaagaagggcatcatcagacccggcaccgccttcgagctgctggaggcccaggccgccaccggctacgtgatcgaccccatcaagggcctgaagctgaccgtggaggaggccgtgagaatgggcatcgtgggccccgagttcaaggacaagctgctgagcgccgagagagccgtgaccggctacaaggacccctacagcggcaagctgatcagcctgttccaggccatgaagaagggcctgatcctgaaggaccacggcatcagactgctggaggcccagatcgccaccggcggcatcatcgaccccgaggagagccacagactgcccgtggaggtggcctacaagagaggcctgttcgacgaggagatgaacgagatcctgaccgaccccagcgacgacaccaagggcttcttcgaccccaacaccgaggagaacctgacctacctgcagctgatggagagatgcatcaccgacccccagaccggcctgtgcctgctgcccctgaaggagaagaagagagagagaaagaccagcagcaagagcagcgtgagaaagagaagagtggtgatcgtggaccccgagaccggcaaggagatgagcgtgtacgaggcctacagaaagggcctgatcgaccaccagacctacctggagctgagcgagcaggagtgcgagtgggaggagatcaccatcagcagcagcgacggcgtggtgaagagcatgatcatcgacagaagaagcggcagacagtacgacatcgacgacgccatcgccaagaacctgatcgacagaagcgccctggaccagtacagagccggcaccctgagcatcaccgagttcgccgacatgctgagcggcaacgccggcggcttcagaagcagaagcagcagcgtgggcagcagcagcagctaccccatcagccccgccgtgagcagaacccagctggccagctggagcgaccccaccgaggagaccggccccgtggccggcatcctggacaccgagaccctggagaaggtgagcatcaccgaggccatgcacagaaacctggtggacaacatcaccggccagagactgctggaggcccaggcctgcaccggcggcatcatcgaccccagcaccggcgagagattccccgtgaccgacgccgtgaacaagggcctggtggacaagatcatggtggacagaatcaacctggcccagaaggccttctgcggcttcgaggaccccagaaccaagaccaagatgagcgccgcccaggccctgaagaagggctggctgtactacgaggccggccagagattcctggaggtgcagtacctgaccggcggcctgatcgagcccgacacccccggcagagtgcccctggacgaggccctgcagagaggcaccgtggacgccagaaccgcccagaagctgagagacgtgggcgcctacagcaagtacctgacctgccccaagaccaagctgaagatcagctacaaggacgccctggacagaagcatggtggaggagggcaccggcctgagactgctggaggccgccgcccagagcaccaagggctactacagcccctacagcgtgagcggcagcggcagcaccgccggcagcagaaccggcagcagaaccggcagcagagccggcagcagaagaggcagcttcgacgccaccggcagcggcttcagcatgaccttcagcagcagcagctacagcagcagcggctacggcagaagatacgccagcggcagcagcgccagcctgggcggccccgagagcgccgtggcctag

SEQ ID NO: 93616 - DNA, 13644 bp, Artificial Sequence
  Description of Artificial Sequence: Synthetic coding sequence
atggagcccagcggcagcctgttccccagcctggtggtggtgggccacgtggtgaccctggccgccgtgtggcactggagaagaggcagaagatgggcccaggacgagcaggacgagagagacagagtgcagaagaagaccttcaccaagtgggtgaacaagcacctgatcaaggcccagagacacatcagcgacctgtacgaggacctgagagacggccacaacctgatcagcctgctggaggtgctgagcggcgacagcctgcccagagagaagggcagaatgagattccacaagctgcagaacgtgcagatcgccctggactacctgagacacagacaggtgaagctggtgaacatcagaaacgacgacatcgccgacggcaaccccaagctgaccctgggcctgatctggaccatcatcctgcacttccagatcagcgacatccaggtgagcggccagagcgaggacatgaccgccaaggagaagctgctgctgtggagccagagaatggtggagggctaccagggcctgagatgcgacaacttcaccagcagctggagagacggcagactgttcaacgccatcatccacagacacaagcccctgctgatcgacatgaacaaggtgtacagacagaccaacctggagaacctggaccaggccttcagcgtggccgagagagacctgggcgtgaccagactgctggaccccgaggacgtggacgtgccccagcccgacgagaagagcatcatcacctacgtgagcagcctgtacgacgccatgcccagagtgcccgacgtgcaggacggcgtgagagccaacgagctgcagctgagatggcaggagtacagagagctggtgctgctgctgctgcagtggatgagacaccacaccgccgccttcgaggagagaagattccccagcagcttcgaggagatcgagatcctgtggagccagttcctgaagttcaaggagatggagctgcccgccaaggaggccgacaagaacagaagcaagggcatctaccagagcctggagggcgccgtgcaggccggccagctgaaggtgccccccggctaccaccccctggacgtggagaaggagtggggcaagctgcacgtggccatcctggagagagagaagcagctgagaagcgagttcgagagactggagtgcctgcagagaatcgtgaccaagctgcagatggaggccggcctgtgcgaggagcagctgaaccaggccgacgccctgctgcagagcgacgtgagactgctggccgccggcaaggtgccccagagagccggcgaggtggagagagacctggacaaggccgacagcatgatcagactgctgttcaacgacgtgcagaccctgaaggacggcagacacccccagggcgagcagatgtacagaagagtgtacagactgcacgagagactggtggccatcagaaccgagtacaacctgagactgaaggccggcgtggccgcccccgccacccaggtggcccaggtgaccctgcagagcgtgcagagaagacccgagctggaggacagcaccctgagatacctgcaggacctgctggcctgggtggaggagaaccagcacagagtggacggcgccgagtggggcgtggacctgcccagcgtggaggcccagctgggcagccacagaggcctgcaccagagcatcgaggagttcagagccaagatcgagagagccagaagcgacgagggccagctgagccccgccaccagaggcgcctacagagactgcctgggcagactggacctgcagtacgccaagctgctgaacagcagcaaggccagactgagaagcctggagagcctgcacagcttcgtggccgccgccaccaaggagctgatgtggctgaacgagaaggaggaggaggaggtgggcttcgactggagcgacagaaacaccaacatgaccgccaagaaggagagctacagcgccctgatgagagagctggagctgaaggagaagaagatcaaggagctgcagaacgccggcgacagactgctgagagaggaccaccccgccagacccaccgtggagagcttccaggccgccctgcagacccagtggagctggatgctgcagctgtgctgctgcatcgaggcccacctgaaggagaacgccgcctacttccagttcttcagcgacgtgagagaggccgagggccagctgcagaagctgcaggaggccctgagaagaaagtacagctgcgacagaagcgccaccgtgaccagactggaggacctgctgcaggacgcccaggacgagaaggagcagctgaacgagtacaagggccacctgagcggcctggccaagagagccaaggccgtggtgcagctgaagcccagacaccccgcccaccccatgagaggcagactgcccctgctggccgtgtgcgactacaagcaggtggaggtgaccgtgcacaagggcgacgagtgccagctggtgggccccgcccagcccagccactggaaggtgctgagcagcagcggcagcgaggccgccgtgcccagcgtgtgcttcctggtgcccccccccaaccaggaggcccaggaggccgtgaccagactggaggcccagcaccaggccctggtgaccctgtggcaccagctgcacgtggacatgaagagcctgctggcctggcagagcctgagaagagacgtgcagctgatcagaagctggagcctggccaccttcagaaccctgaagcccgaggagcagagacaggccctgcacagcctggagctgcactaccaggccttcctgagagacagccaggacgccggcggcttcggccccgaggacagactgatggccgagagagagtacggcagctgcagccaccactaccagcagctgctgcagagcctggagcagggcgcccaggaggagagcagatgccagagatgcatcagcgagctgaaggacatcagactgcagctggaggcctgcgagaccagaaccgtgcacagactgagactgcccctggacaaggagcccgccagagagtgcgcccagagaatcgccgagcagcagaaggcccaggccgaggtggagggcctgggcaagggcgtggccagactgagcgccgaggccgagaaggtgctggccctgcccgagcccagccccgccgcccccaccctgagaagcgagctggagctgaccctgggcaagctggagcaggtgagaagcctgagcgccatctacctggagaagctgaagaccatcagcctggtgatcagaggcacccagggcgccgaggaggtgctgagagcccacgaggagcagctgaaggaggcccaggccgtgcccgccaccctgcccgagctggaggccaccaaggccagcctgaagaagctgagagcccaggccgaggcccagcagcccaccttcgacgccctgagagacgagctgagaggcgcccaggaggtgggcgagagactgcagcagagacacggcgagagagacgtggaggtggagagatggagagagagagtggcccagctgctggagagatggcaggccgtgctggcccagaccgacgtgagacagagagagctggagcagctgggcagacagctgagatactacagagagagcgccgaccccctgggcgcctggctgcaggacgccagaagaagacaggagcagatccaggccatgcccctggccgacagccaggccgtgagagagcagctgagacaggagcaggccctgctggaggagatcgagagacacggcgagaaggtggaggagtgccagagattcgccaagcagtacatcaacgccatcaaggactacgagctgcagctggtgacctacaaggcccagctggagcccgtggccagccccgccaagaagcccaaggtgcagagcggcagcgagagcgtgatccaggagtacgtggacctgagaacccactacagcgagctgaccaccctgaccagccagtacatcaagttcatcagcgagaccctgagaagaatggaggaggaggagagactggccgagcagcagagagccgaggagagagagagactggccgaggtggaggccgccctggagaagcagagacagctggccgaggcccacgcccaggccaaggcccaggccgagagagaggccaaggagctgcagcagagaatgcaggaggaggtggtgagaagagaggaggccgccgtggacgcccagcagcagaagagaagcatccaggaggagctgcagcagctgagacagagcagcgaggccgagatccaggccaaggccagacaggccgaggccgccgagagaagcagactgagaatcgaggaggagatcagagtggtgagactgcagctggaggccaccgagagacagagaggcggcgccgagggcgagctgcaggccctgagagccagagccgaggaggccgaggcccagaagagacaggcccaggaggaggccgagagactgagaagacaggtgcaggacgagagccagagaaagagacaggccgaggtggagctggccagcagagtgaaggccgaggccgaggccgccagagagaagcagagagccctgcaggccctggaggagctgagactgcaggccgaggaggccgagagaagactgagacaggccgaggtggagagagccagacaggtgcaggtggccctggagaccgcccagagaagcgccgaggccgagctgcagagcaagagagccagcttcgccgagaagaccgcccagctggagagaagcctgcaggaggagcacgtggccgtggcccagctgagagaggaggccgagagaagagcccagcagcaggccgaggccgagagagccagagaggaggccgagagagagctggagagatggcagctgaaggccaacgaggccctgagactgagactgcaggccgaggaggtggcccagcagaagagcctggcccaggccgaggccgagaagcagaaggaggaggccgagagagaggccagaagaagaggcaaggccgaggagcaggccgtgagacagagagagctggccgagcaggagctggagaagcagagacagctggccgagggcaccgcccagcagagactggccgccgagcaggagctgatcagactgagagccgagaccgagcagggcgagcagcagagacagctgctggaggaggagctggccagactgcagagagaggccgccgccgccacccagaagagacaggagctggaggccgagctggccaaggtgagagccgagatggaggtgctgctggccagcaaggccagagccgaggaggagagcagaagcaccagcgagaagagcaagcagagactggaggccgaggccggcagattcagagagctggccgaggaggccgccagactgagagccctggccgaggaggccaagagacagagacagctggccgaggaggacgccgccagacagagagccgaggccgagagagtgctggccgagaagctggccgccatcggcgaggccaccagactgaagaccgaggccgagatcgccctgaaggagaaggaggccgagaacgagagactgagaagactggccgaggacgaggccttccagagaagaagactggaggagcaggccgcccagcacaaggccgacatcgaggagagactggcccagctgagaaaggccagcgacagcgagctggagagacagaagggcctggtggaggacaccctgagacagagaagacaggtggaggaggagatcctggccctgaaggccagcttcgagaaggccgccgccggcaaggccgagctggagctggagctgggcagaatcagaagcaacgccgaggacaccctgagaagcaaggagcaggccgagctggaggccgccagacagagacagctggccgccgaggaggagagaagaagaagagaggccgaggagagagtgcagaagagcctggccgccgaggaggaggccgccagacagagaaaggccgccctggaggaggtggagagactgaaggccaaggtggaggaggccagaagactgagagagagagccgagcaggagagcgccagacagctgcagctggcccaggaggccgcccagaagagactgcaggccgaggagaaggcccacgccttcgccgtgcagcagaaggagcaggagctgcagcagaccctgcagcaggagcagagcgtgctggaccagctgagaggcgaggccgaggccgccagaagagccgccgaggaggccgaggaggccagagtgcaggccgagagagaggccgcccagagcagaagacaggtggaggaggccgagagactgaagcagagcgccgaggagcaggcccaggccagagcccaggcccaggccgccgccgagaagctgagaaaggaggccgagcaggaggccgccagaagagcccaggccgagcaggccgccctgagacagaagcaggccgccgacgccgagatggagaagcacaagaagttcgccgagcagaccctgagacagaaggcccaggtggagcaggagctgaccaccctgagactgcagctggaggagaccgaccaccagaagaacctgctggacgaggagctgcagagactgaaggccgaggccaccgaggccgccagacagagaagccaggtggaggaggagctgttcagcgtgagagtgcagatggaggagctgagcaagctgaaggccagaatcgaggccgagaacagagccctgatcctgagagacaaggacaacacccagagattcctgcaggaggaggccgagaagatgaagcaggtggccgaggaggccgccagactgagcgtggccgcccaggaggccgccagactgagacagctggccgaggaggacctggcccagcagagagccctggccgagaagatgctgaaggagaagatgcaggccgtgcaggaggccaccagactgaaggccgaggccgagctgctgcagcagcagaaggagctggcccaggagcaggccagaagactgcaggaggacaaggagcagatggcccagcagctggccgaggagacccagggcttccagagaaccctggaggccgagagacagagacagctggagatgagcgccgaggccgagagactgaagctgagagtggccgagatgagcagagcccaggccagagccgaggaggacgcccagagattcagaaagcaggccgaggagatcggcgagaagctgcacagaaccgagctggccacccaggagaaggtgaccctggtgcagaccctggagatccagagacagcagagcgaccacgacgccgagagactgagagaggccatcgccgagctggagagagagaaggagaagctgcagcaggaggccaagctgctgcagctgaagagcgaggagatgcagaccgtgcagcaggagcagctgctgcaggagacccaggccctgcagcagagcttcctgagcgagaaggacagcctgctgcagagagagagattcatcgagcaggagaaggccaagctggagcagctgttccaggacgaggtggccaaggcccagcagctgagagaggagcagcagagacagcagcagcagatggagcaggagagacagagactggtggccagcatggaggaggccagaagaagacagcacgaggccgaggagggcgtgagaagaaagcaggaggagctgcagcagctggagcagcagagaagacagcaggaggagctgctggccgaggagaaccagagactgagagagcagctgcagctgctggaggagcagcacagagccgccctggcccacagcgaggaggtgaccgccagccaggtggccgccaccaagaccctgcccaacggcagagacgccctggacggccccgccgccgaggccgagcccgagcacagcttcgacggcctgagaagaaaggtgagcgcccagagactgcaggaggccggcatcctgagcgccgaggagctgcagagactggcccagggccacaccaccgtggacgagctggccagaagagaggacgtgagacactacctgcagggcagaagcagcatcgccggcctgctgctgaaggccaccaacgagaagctgagcgtgtacgccgccctgcagagacagctgctgagccccggcaccgccctgatcctgctggaggcccaggccgccagcggcttcctgctggaccccgtgagaaacagaagactgaccgtgaacgaggccgtgaaggagggcgtggtgggccccgagctgcaccacaagctgctgagcgccgagagagccgtgaccggctacaaggacccctacaccggccagcagatcagcctgttccaggccatgcagaagggcctgatcgtgagagagcacggcatcagactgctggaggcccagatcgccaccggcggcgtgatcgaccccgtgcacagccacagagtgcccgtggacgtggcctacagaagaggctacttcgacgaggagatgaacagagtgctggccgaccccagcgacgacaccaagggcttcttcgaccccaacacccacgagaacctgacctacctgcagctgctggagagatgcgtggaggaccccgagaccggcctgtgcctgctgcccctgaccgacaaggccgccaagggcggcgagctggtgtacaccgacagcgaggccagagacgtgttcgagaaggccaccgtgagcgcccccttcggcaagttccagggcaagaccgtgaccatctgggagatcatcaacagcgagtacttcaccgccgagcagagaagagacctgctgagacagttcagaaccggcagaatcaccgtggagaagatcatcaagatcatcatcaccgtggtggaggagcaggagcagaagggcagactgtgcttcgagggcctgagaagcctggtgcccgccgccgagctgctggagagcagagtgatcgacagagagctgtaccagcagctgcagagaggcgagagaagcgtgagagacgtggccgaggtggacaccgtgagaagagccctgagaggcgccaacgtgatcgccggcgtgtggctggaggaggccggccagaagctgagcatctacaacgccctgaagaaggacctgctgcccagcgacatggccgtggccctgctggaggcccaggccggcaccggccacatcatcgaccccgccaccagcgccagactgaccgtggacgaggccgtgagagccggcctggtgggccccgagttccacgagaagctgctgagcgccgagaaggccgtgaccggctacagagacccctacaccggccagagcgtgagcctgttccaggccctgaagaagggcctgatccccagagagcagggcctgagactgctggacgcccagctgagcaccggcggcatcgtggaccccagcaagagccacagagtgcccctggacgtggcctgcgccagaggctgcctggacgaggagaccagcagagccctgagcgcccccagagccgacgccaaggcctacagcgaccccagcaccggcgagcccgccacctacggcgagctgcagcagagatgcagacccgaccagctgaccggcctgagcctgctgcccctgagcgagaaggccgccagagccagacaggaggagctgtacagcgagctgcaggccagagagaccttcgagaagacccccgtggaggtgcccgtgggcggcttcaagggcagaaccgtgaccgtgtgggagctgatcagcagcgagtacttcaccgccgagcagagacaggagctgctgagacagttcagaaccggcaaggtgaccgtggagaaggtgatcaagatcctgatcaccatcgtggaggaggtggagaccctgagacaggagagactgagcttcagcggcctgagagcccccgtgcccgccagcgagctgctggccagcggcgtgctgagcagagcccagttcgagcagctgaaggacggcaagaccaccgtgaaggacctgagcgagctgggcagcgtgagaaccctgctgcagggcagcggctgcctggccggcatctacctggaggacaccaaggagaaggtgagcatctacgaggccatgagaagaggcctgctgagagccaccaccgccgccctgctgctggaggcccaggccgccaccggcttcctggtggaccccgtgagaaaccagagactgtacgtgcacgaggccgtgaaggccggcgtggtgggccccgagctgcacgagcagctgctgagcgccgagaaggccgtgaccggctacagagacccctacagcggcagcaccatcagcctgttccaggccatgcagaagggcctggtgctgagacagcacggcatcagactgctggaggcccagatcgccaccggcggcatcatcgaccccgtgcacagccacagagtgcccgtggacgtggcctaccagagaggctacttcagcgaggagatgaacagagtgctggccgaccccagcgacgacaccaagggcttcttcgaccccaacacccacgagaacctgacctacagacagctgctggagagatgcgtggaggaccccgagaccggcctgagactgctgcccctgaagggcgccgagaaggccgaggtggtggagaccacccaggtgtacaccgaggaggagaccagaagagccttcgaggagacccagatcgacatccccggcggcggcagccacggcggcagcaccatgagcctgtgggaggtgatgcagagcgacctgatccccgaggagcagagagcccagctgatggccgacttccaggccggcagagtgaccaaggagagaatgatcatcatcatcatcgagatcatcgagaagaccgagatcatcagacagcagggcctggccagctacgactacgtgagaagaagactgaccgccgaggacctgttcgaggccagaatcatcagcctggagacctacaacctgctgagagagggcaccagaagcctgagagaggccctggaggccgagagcgcctggtgctacctgtacggcaccggcagcgtggccggcgtgtacctgcccggcagcagacagaccctgagcatctaccaggccctgaagaagggcctgctgagcgccgaggtggccagactgctgctggaggcccaggccgccaccggcttcctgctggaccccgtgaagggcgagagactgaccgtggacgaggccgtgagaaagggcctggtgggccccgagctgcacgacagactgctgagcgccgagagagccgtgaccggctacagagacccctacaccgagcagaccatcagcctgttccaggccatgaagaaggagctgatccccaccgaggaggccctgagactgctggacgcccagctggccaccggcggcatcgtggaccccagactgggcttccacctgcccctggaggtggcctaccagagaggctacctgaacaaggacacccacgaccagctgagcgagcccagcgaggtgagaagctacgtggaccccagcaccgacgagagactgagctacacccagctgctgagaagatgcagaagagacgacggcaccggccagctgctgctgcccctgagcgacgccagaaagctgaccttcagaggcctgagaaagcagatcaccatggaggagctggtgagaagccaggtgatggacgaggccaccgccctgcagctgagagagggcctgaccagcatcgaggaggtgaccaagaacctgcagaagttcctggagggcaccagctgcatcgccggcgtgttcgtggacgccaccaaggagagactgagcgtgtaccaggccatgaagaagggcatcatcagacccggcaccgccttcgagctgctggaggcccaggccgccaccggctacgtgatcgaccccatcaagggcctgaagctgaccgtggaggaggccgtgagaatgggcatcgtgggccccgagttcaaggacaagctgctgagcgccgagagagccgtgaccggctacaaggacccctacagcggcaagctgatcagcctgttccaggccatgaagaagggcctgatcctgaaggaccacggcatcagactgctggaggcccagatcgccaccggcggcatcatcgaccccgaggagagccacagactgcccgtggaggtggcctacaagagaggcctgttcgacgaggagatgaacgagatcctgaccgaccccagcgacgacaccaagggcttcttcgaccccaacaccgaggagaacctgacctacctgcagctgatggagagatgcatcaccgacccccagaccggcctgtgcctgctgcccctgaaggagaagaagagagagagaaagaccagcagcaagagcagcgtgagaaagagaagagtggtgatcgtggaccccgagaccggcaaggagatgagcgtgtacgaggcctacagaaagggcctgatcgaccaccagacctacctggagctgagcgagcaggagtgcgagtgggaggagatcaccatcagcagcagcgacggcgtggtgaagagcatgatcatcgacagaagaagcggcagacagtacgacatcgacgacgccatcgccaagaacctgatcgacagaagcgccctggaccagtacagagccggcaccctgagcatcaccgagttcgccgacatgctgagcggcaacgccggcggcttcagaagcagaagcagcagcgtgggcagcagcagcagctaccccatcagccccgccgtgagcagaacccagctggccagctggagcgaccccaccgaggagaccggccccgtggccggcatcctggacaccgagaccctggagaaggtgagcatcaccgaggccatgcacagaaacctggtggacaacatcaccggccagagactgctggaggcccaggcctgcaccggcggcatcatcgaccccagcaccggcgagagattccccgtgaccgacgccgtgaacaagggcctggtggacaagatcatggtggacagaatcaacctggcccagaaggccttctgcggcttcgaggaccccagaaccaagaccaagatgagcgccgcccaggccctgaagaagggctggctgtactacgaggccggccagagattcctggaggtgcagtacctgaccggcggcctgatcgagcccgacacccccggcagagtgcccctggacgaggccctgcagagaggcaccgtggacgccagaaccgcccagaagctgagagacgtgggcgcctacagcaagtacctgacctgccccaagaccaagctgaagatcagctacaaggacgccctggacagaagcatggtggaggagggcaccggcctgagactgctggaggccgccgcccagagcaccaagggctactacagcccctacagcgtgagcggcagcggcagcaccgccggcagcagaaccggcagcagaaccggcagcagagccggcagcagaagaggcagcttcgacgccaccggcagcggcttcagcatgaccttcagcagcagcagctacagcagcagcggctacggcagaagatacgccagcggcagcagcgccagcctgggcggccccgagagcgccgtggcctag

SEQ ID NO: 93617 - DNA, 13578 bp, Artificial Sequence
  Description of Artificial Sequence: Synthetic coding sequence
atggaccccagcagagccatccagaacgagatcagcagcctgaaggacgagagagacagagtgcagaagaagaccttcaccaagtgggtgaacaagcacctgatcaaggcccagagacacatcagcgacctgtacgaggacctgagagacggccacaacctgatcagcctgctggaggtgctgagcggcgacagcctgcccagagagaagggcagaatgagattccacaagctgcagaacgtgcagatcgccctggactacctgagacacagacaggtgaagctggtgaacatcagaaacgacgacatcgccgacggcaaccccaagctgaccctgggcctgatctggaccatcatcctgcacttccagatcagcgacatccaggtgagcggccagagcgaggacatgaccgccaaggagaagctgctgctgtggagccagagaatggtggagggctaccagggcctgagatgcgacaacttcaccagcagctggagagacggcagactgttcaacgccatcatccacagacacaagcccctgctgatcgacatgaacaaggtgtacagacagaccaacctggagaacctggaccaggccttcagcgtggccgagagagacctgggcgtgaccagactgctggaccccgaggacgtggacgtgccccagcccgacgagaagagcatcatcacctacgtgagcagcctgtacgacgccatgcccagagtgcccgacgtgcaggacggcgtgagagccaacgagctgcagctgagatggcaggagtacagagagctggtgctgctgctgctgcagtggatgagacaccacaccgccgccttcgaggagagaagattccccagcagcttcgaggagatcgagatcctgtggagccagttcctgaagttcaaggagatggagctgcccgccaaggaggccgacaagaacagaagcaagggcatctaccagagcctggagggcgccgtgcaggccggccagctgaaggtgccccccggctaccaccccctggacgtggagaaggagtggggcaagctgcacgtggccatcctggagagagagaagcagctgagaagcgagttcgagagactggagtgcctgcagagaatcgtgaccaagctgcagatggaggccggcctgtgcgaggagcagctgaaccaggccgacgccctgctgcagagcgacgtgagactgctggccgccggcaaggtgccccagagagccggcgaggtggagagagacctggacaaggccgacagcatgatcagactgctgttcaacgacgtgcagaccctgaaggacggcagacacccccagggcgagcagatgtacagaagagtgtacagactgcacgagagactggtggccatcagaaccgagtacaacctgagactgaaggccggcgtggccgcccccgccacccaggtggcccaggtgaccctgcagagcgtgcagagaagacccgagctggaggacagcaccctgagatacctgcaggacctgctggcctgggtggaggagaaccagcacagagtggacggcgccgagtggggcgtggacctgcccagcgtggaggcccagctgggcagccacagaggcctgcaccagagcatcgaggagttcagagccaagatcgagagagccagaagcgacgagggccagctgagccccgccaccagaggcgcctacagagactgcctgggcagactggacctgcagtacgccaagctgctgaacagcagcaaggccagactgagaagcctggagagcctgcacagcttcgtggccgccgccaccaaggagctgatgtggctgaacgagaaggaggaggaggaggtgggcttcgactggagcgacagaaacaccaacatgaccgccaagaaggagagctacagcgccctgatgagagagctggagctgaaggagaagaagatcaaggagctgcagaacgccggcgacagactgctgagagaggaccaccccgccagacccaccgtggagagcttccaggccgccctgcagacccagtggagctggatgctgcagctgtgctgctgcatcgaggcccacctgaaggagaacgccgcctacttccagttcttcagcgacgtgagagaggccgagggccagctgcagaagctgcaggaggccctgagaagaaagtacagctgcgacagaagcgccaccgtgaccagactggaggacctgctgcaggacgcccaggacgagaaggagcagctgaacgagtacaagggccacctgagcggcctggccaagagagccaaggccgtggtgcagctgaagcccagacaccccgcccaccccatgagaggcagactgcccctgctggccgtgtgcgactacaagcaggtggaggtgaccgtgcacaagggcgacgagtgccagctggtgggccccgcccagcccagccactggaaggtgctgagcagcagcggcagcgaggccgccgtgcccagcgtgtgcttcctggtgcccccccccaaccaggaggcccaggaggccgtgaccagactggaggcccagcaccaggccctggtgaccctgtggcaccagctgcacgtggacatgaagagcctgctggcctggcagagcctgagaagagacgtgcagctgatcagaagctggagcctggccaccttcagaaccctgaagcccgaggagcagagacaggccctgcacagcctggagctgcactaccaggccttcctgagagacagccaggacgccggcggcttcggccccgaggacagactgatggccgagagagagtacggcagctgcagccaccactaccagcagctgctgcagagcctggagcagggcgcccaggaggagagcagatgccagagatgcatcagcgagctgaaggacatcagactgcagctggaggcctgcgagaccagaaccgtgcacagactgagactgcccctggacaaggagcccgccagagagtgcgcccagagaatcgccgagcagcagaaggcccaggccgaggtggagggcctgggcaagggcgtggccagactgagcgccgaggccgagaaggtgctggccctgcccgagcccagccccgccgcccccaccctgagaagcgagctggagctgaccctgggcaagctggagcaggtgagaagcctgagcgccatctacctggagaagctgaagaccatcagcctggtgatcagaggcacccagggcgccgaggaggtgctgagagcccacgaggagcagctgaaggaggcccaggccgtgcccgccaccctgcccgagctggaggccaccaaggccagcctgaagaagctgagagcccaggccgaggcccagcagcccaccttcgacgccctgagagacgagctgagaggcgcccaggaggtgggcgagagactgcagcagagacacggcgagagagacgtggaggtggagagatggagagagagagtggcccagctgctggagagatggcaggccgtgctggcccagaccgacgtgagacagagagagctggagcagctgggcagacagctgagatactacagagagagcgccgaccccctgggcgcctggctgcaggacgccagaagaagacaggagcagatccaggccatgcccctggccgacagccaggccgtgagagagcagctgagacaggagcaggccctgctggaggagatcgagagacacggcgagaaggtggaggagtgccagagattcgccaagcagtacatcaacgccatcaaggactacgagctgcagctggtgacctacaaggcccagctggagcccgtggccagccccgccaagaagcccaaggtgcagagcggcagcgagagcgtgatccaggagtacgtggacctgagaacccactacagcgagctgaccaccctgaccagccagtacatcaagttcatcagcgagaccctgagaagaatggaggaggaggagagactggccgagcagcagagagccgaggagagagagagactggccgaggtggaggccgccctggagaagcagagacagctggccgaggcccacgcccaggccaaggcccaggccgagagagaggccaaggagctgcagcagagaatgcaggaggaggtggtgagaagagaggaggccgccgtggacgcccagcagcagaagagaagcatccaggaggagctgcagcagctgagacagagcagcgaggccgagatccaggccaaggccagacaggccgaggccgccgagagaagcagactgagaatcgaggaggagatcagagtggtgagactgcagctggaggccaccgagagacagagaggcggcgccgagggcgagctgcaggccctgagagccagagccgaggaggccgaggcccagaagagacaggcccaggaggaggccgagagactgagaagacaggtgcaggacgagagccagagaaagagacaggccgaggtggagctggccagcagagtgaaggccgaggccgaggccgccagagagaagcagagagccctgcaggccctggaggagctgagactgcaggccgaggaggccgagagaagactgagacaggccgaggtggagagagccagacaggtgcaggtggccctggagaccgcccagagaagcgccgaggccgagctgcagagcaagagagccagcttcgccgagaagaccgcccagctggagagaagcctgcaggaggagcacgtggccgtggcccagctgagagaggaggccgagagaagagcccagcagcaggccgaggccgagagagccagagaggaggccgagagagagctggagagatggcagctgaaggccaacgaggccctgagactgagactgcaggccgaggaggtggcccagcagaagagcctggcccaggccgaggccgagaagcagaaggaggaggccgagagagaggccagaagaagaggcaaggccgaggagcaggccgtgagacagagagagctggccgagcaggagctggagaagcagagacagctggccgagggcaccgcccagcagagactggccgccgagcaggagctgatcagactgagagccgagaccgagcagggcgagcagcagagacagctgctggaggaggagctggccagactgcagagagaggccgccgccgccacccagaagagacaggagctggaggccgagctggccaaggtgagagccgagatggaggtgctgctggccagcaaggccagagccgaggaggagagcagaagcaccagcgagaagagcaagcagagactggaggccgaggccggcagattcagagagctggccgaggaggccgccagactgagagccctggccgaggaggccaagagacagagacagctggccgaggaggacgccgccagacagagagccgaggccgagagagtgctggccgagaagctggccgccatcggcgaggccaccagactgaagaccgaggccgagatcgccctgaaggagaaggaggccgagaacgagagactgagaagactggccgaggacgaggccttccagagaagaagactggaggagcaggccgcccagcacaaggccgacatcgaggagagactggcccagctgagaaaggccagcgacagcgagctggagagacagaagggcctggtggaggacaccctgagacagagaagacaggtggaggaggagatcctggccctgaaggccagcttcgagaaggccgccgccggcaaggccgagctggagctggagctgggcagaatcagaagcaacgccgaggacaccctgagaagcaaggagcaggccgagctggaggccgccagacagagacagctggccgccgaggaggagagaagaagaagagaggccgaggagagagtgcagaagagcctggccgccgaggaggaggccgccagacagagaaaggccgccctggaggaggtggagagactgaaggccaaggtggaggaggccagaagactgagagagagagccgagcaggagagcgccagacagctgcagctggcccaggaggccgcccagaagagactgcaggccgaggagaaggcccacgccttcgccgtgcagcagaaggagcaggagctgcagcagaccctgcagcaggagcagagcgtgctggaccagctgagaggcgaggccgaggccgccagaagagccgccgaggaggccgaggaggccagagtgcaggccgagagagaggccgcccagagcagaagacaggtggaggaggccgagagactgaagcagagcgccgaggagcaggcccaggccagagcccaggcccaggccgccgccgagaagctgagaaaggaggccgagcaggaggccgccagaagagcccaggccgagcaggccgccctgagacagaagcaggccgccgacgccgagatggagaagcacaagaagttcgccgagcagaccctgagacagaaggcccaggtggagcaggagctgaccaccctgagactgcagctggaggagaccgaccaccagaagaacctgctggacgaggagctgcagagactgaaggccgaggccaccgaggccgccagacagagaagccaggtggaggaggagctgttcagcgtgagagtgcagatggaggagctgagcaagctgaaggccagaatcgaggccgagaacagagccctgatcctgagagacaaggacaacacccagagattcctgcaggaggaggccgagaagatgaagcaggtggccgaggaggccgccagactgagcgtggccgcccaggaggccgccagactgagacagctggccgaggaggacctggcccagcagagagccctggccgagaagatgctgaaggagaagatgcaggccgtgcaggaggccaccagactgaaggccgaggccgagctgctgcagcagcagaaggagctggcccaggagcaggccagaagactgcaggaggacaaggagcagatggcccagcagctggccgaggagacccagggcttccagagaaccctggaggccgagagacagagacagctggagatgagcgccgaggccgagagactgaagctgagagtggccgagatgagcagagcccaggccagagccgaggaggacgcccagagattcagaaagcaggccgaggagatcggcgagaagctgcacagaaccgagctggccacccaggagaaggtgaccctggtgcagaccctggagatccagagacagcagagcgaccacgacgccgagagactgagagaggccatcgccgagctggagagagagaaggagaagctgcagcaggaggccaagctgctgcagctgaagagcgaggagatgcagaccgtgcagcaggagcagctgctgcaggagacccaggccctgcagcagagcttcctgagcgagaaggacagcctgctgcagagagagagattcatcgagcaggagaaggccaagctggagcagctgttccaggacgaggtggccaaggcccagcagctgagagaggagcagcagagacagcagcagcagatggagcaggagagacagagactggtggccagcatggaggaggccagaagaagacagcacgaggccgaggagggcgtgagaagaaagcaggaggagctgcagcagctggagcagcagagaagacagcaggaggagctgctggccgaggagaaccagagactgagagagcagctgcagctgctggaggagcagcacagagccgccctggcccacagcgaggaggtgaccgccagccaggtggccgccaccaagaccctgcccaacggcagagacgccctggacggccccgccgccgaggccgagcccgagcacagcttcgacggcctgagaagaaaggtgagcgcccagagactgcaggaggccggcatcctgagcgccgaggagctgcagagactggcccagggccacaccaccgtggacgagctggccagaagagaggacgtgagacactacctgcagggcagaagcagcatcgccggcctgctgctgaaggccaccaacgagaagctgagcgtgtacgccgccctgcagagacagctgctgagccccggcaccgccctgatcctgctggaggcccaggccgccagcggcttcctgctggaccccgtgagaaacagaagactgaccgtgaacgaggccgtgaaggagggcgtggtgggccccgagctgcaccacaagctgctgagcgccgagagagccgtgaccggctacaaggacccctacaccggccagcagatcagcctgttccaggccatgcagaagggcctgatcgtgagagagcacggcatcagactgctggaggcccagatcgccaccggcggcgtgatcgaccccgtgcacagccacagagtgcccgtggacgtggcctacagaagaggctacttcgacgaggagatgaacagagtgctggccgaccccagcgacgacaccaagggcttcttcgaccccaacacccacgagaacctgacctacctgcagctgctggagagatgcgtggaggaccccgagaccggcctgtgcctgctgcccctgaccgacaaggccgccaagggcggcgagctggtgtacaccgacagcgaggccagagacgtgttcgagaaggccaccgtgagcgcccccttcggcaagttccagggcaagaccgtgaccatctgggagatcatcaacagcgagtacttcaccgccgagcagagaagagacctgctgagacagttcagaaccggcagaatcaccgtggagaagatcatcaagatcatcatcaccgtggtggaggagcaggagcagaagggcagactgtgcttcgagggcctgagaagcctggtgcccgccgccgagctgctggagagcagagtgatcgacagagagctgtaccagcagctgcagagaggcgagagaagcgtgagagacgtggccgaggtggacaccgtgagaagagccctgagaggcgccaacgtgatcgccggcgtgtggctggaggaggccggccagaagctgagcatctacaacgccctgaagaaggacctgctgcccagcgacatggccgtggccctgctggaggcccaggccggcaccggccacatcatcgaccccgccaccagcgccagactgaccgtggacgaggccgtgagagccggcctggtgggccccgagttccacgagaagctgctgagcgccgagaaggccgtgaccggctacagagacccctacaccggccagagcgtgagcctgttccaggccctgaagaagggcctgatccccagagagcagggcctgagactgctggacgcccagctgagcaccggcggcatcgtggaccccagcaagagccacagagtgcccctggacgtggcctgcgccagaggctgcctggacgaggagaccagcagagccctgagcgcccccagagccgacgccaaggcctacagcgaccccagcaccggcgagcccgccacctacggcgagctgcagcagagatgcagacccgaccagctgaccggcctgagcctgctgcccctgagcgagaaggccgccagagccagacaggaggagctgtacagcgagctgcaggccagagagaccttcgagaagacccccgtggaggtgcccgtgggcggcttcaagggcagaaccgtgaccgtgtgggagctgatcagcagcgagtacttcaccgccgagcagagacaggagctgctgagacagttcagaaccggcaaggtgaccgtggagaaggtgatcaagatcctgatcaccatcgtggaggaggtggagaccctgagacaggagagactgagcttcagcggcctgagagcccccgtgcccgccagcgagctgctggccagcggcgtgctgagcagagcccagttcgagcagctgaaggacggcaagaccaccgtgaaggacctgagcgagctgggcagcgtgagaaccctgctgcagggcagcggctgcctggccggcatctacctggaggacaccaaggagaaggtgagcatctacgaggccatgagaagaggcctgctgagagccaccaccgccgccctgctgctggaggcccaggccgccaccggcttcctggtggaccccgtgagaaaccagagactgtacgtgcacgaggccgtgaaggccggcgtggtgggccccgagctgcacgagcagctgctgagcgccgagaaggccgtgaccggctacagagacccctacagcggcagcaccatcagcctgttccaggccatgcagaagggcctggtgctgagacagcacggcatcagactgctggaggcccagatcgccaccggcggcatcatcgaccccgtgcacagccacagagtgcccgtggacgtggcctaccagagaggctacttcagcgaggagatgaacagagtgctggccgaccccagcgacgacaccaagggcttcttcgaccccaacacccacgagaacctgacctacagacagctgctggagagatgcgtggaggaccccgagaccggcctgagactgctgcccctgaagggcgccgagaaggccgaggtggtggagaccacccaggtgtacaccgaggaggagaccagaagagccttcgaggagacccagatcgacatccccggcggcggcagccacggcggcagcaccatgagcctgtgggaggtgatgcagagcgacctgatccccgaggagcagagagcccagctgatggccgacttccaggccggcagagtgaccaaggagagaatgatcatcatcatcatcgagatcatcgagaagaccgagatcatcagacagcagggcctggccagctacgactacgtgagaagaagactgaccgccgaggacctgttcgaggccagaatcatcagcctggagacctacaacctgctgagagagggcaccagaagcctgagagaggccctggaggccgagagcgcctggtgctacctgtacggcaccggcagcgtggccggcgtgtacctgcccggcagcagacagaccctgagcatctaccaggccctgaagaagggcctgctgagcgccgaggtggccagactgctgctggaggcccaggccgccaccggcttcctgctggaccccgtgaagggcgagagactgaccgtggacgaggccgtgagaaagggcctggtgggccccgagctgcacgacagactgctgagcgccgagagagccgtgaccggctacagagacccctacaccgagcagaccatcagcctgttccaggccatgaagaaggagctgatccccaccgaggaggccctgagactgctggacgcccagctggccaccggcggcatcgtggaccccagactgggcttccacctgcccctggaggtggcctaccagagaggctacctgaacaaggacacccacgaccagctgagcgagcccagcgaggtgagaagctacgtggaccccagcaccgacgagagactgagctacacccagctgctgagaagatgcagaagagacgacggcaccggccagctgctgctgcccctgagcgacgccagaaagctgaccttcagaggcctgagaaagcagatcaccatggaggagctggtgagaagccaggtgatggacgaggccaccgccctgcagctgagagagggcctgaccagcatcgaggaggtgaccaagaacctgcagaagttcctggagggcaccagctgcatcgccggcgtgttcgtggacgccaccaaggagagactgagcgtgtaccaggccatgaagaagggcatcatcagacccggcaccgccttcgagctgctggaggcccaggccgccaccggctacgtgatcgaccccatcaagggcctgaagctgaccgtggaggaggccgtgagaatgggcatcgtgggccccgagttcaaggacaagctgctgagcgccgagagagccgtgaccggctacaaggacccctacagcggcaagctgatcagcctgttccaggccatgaagaagggcctgatcctgaaggaccacggcatcagactgctggaggcccagatcgccaccggcggcatcatcgaccccgaggagagccacagactgcccgtggaggtggcctacaagagaggcctgttcgacgaggagatgaacgagatcctgaccgaccccagcgacgacaccaagggcttcttcgaccccaacaccgaggagaacctgacctacctgcagctgatggagagatgcatcaccgacccccagaccggcctgtgcctgctgcccctgaaggagaagaagagagagagaaagaccagcagcaagagcagcgtgagaaagagaagagtggtgatcgtggaccccgagaccggcaaggagatgagcgtgtacgaggcctacagaaagggcctgatcgaccaccagacctacctggagctgagcgagcaggagtgcgagtgggaggagatcaccatcagcagcagcgacggcgtggtgaagagcatgatcatcgacagaagaagcggcagacagtacgacatcgacgacgccatcgccaagaacctgatcgacagaagcgccctggaccagtacagagccggcaccctgagcatcaccgagttcgccgacatgctgagcggcaacgccggcggcttcagaagcagaagcagcagcgtgggcagcagcagcagctaccccatcagccccgccgtgagcagaacccagctggccagctggagcgaccccaccgaggagaccggccccgtggccggcatcctggacaccgagaccctggagaaggtgagcatcaccgaggccatgcacagaaacctggtggacaacatcaccggccagagactgctggaggcccaggcctgcaccggcggcatcatcgaccccagcaccggcgagagattccccgtgaccgacgccgtgaacaagggcctggtggacaagatcatggtggacagaatcaacctggcccagaaggccttctgcggcttcgaggaccccagaaccaagaccaagatgagcgccgcccaggccctgaagaagggctggctgtactacgaggccggccagagattcctggaggtgcagtacctgaccggcggcctgatcgagcccgacacccccggcagagtgcccctggacgaggccctgcagagaggcaccgtggacgccagaaccgcccagaagctgagagacgtgggcgcctacagcaagtacctgacctgccccaagaccaagctgaagatcagctacaaggacgccctggacagaagcatggtggaggagggcaccggcctgagactgctggaggccgccgcccagagcaccaagggctactacagcccctacagcgtgagcggcagcggcagcaccgccggcagcagaaccggcagcagaaccggcagcagagccggcagcagaagaggcagcttcgacgccaccggcagcggcttcagcatgaccttcagcagcagcagctacagcagcagcggctacggcagaagatacgccagcggcagcagcgccagcctgggcggccccgagagcgccgtggcctag

SEQ ID NO: 93618 - DNA, 13602 bp, Artificial Sequence
  Description of Artificial Sequence: Synthetic coding sequence
atggccggccccctgcccgacgagcaggacttcatccaggcctacgaggaggtgagagagaagtacaaggacgagagagacagagtgcagaagaagaccttcaccaagtgggtgaacaagcacctgatcaaggcccagagacacatcagcgacctgtacgaggacctgagagacggccacaacctgatcagcctgctggaggtgctgagcggcgacagcctgcccagagagaagggcagaatgagattccacaagctgcagaacgtgcagatcgccctggactacctgagacacagacaggtgaagctggtgaacatcagaaacgacgacatcgccgacggcaaccccaagctgaccctgggcctgatctggaccatcatcctgcacttccagatcagcgacatccaggtgagcggccagagcgaggacatgaccgccaaggagaagctgctgctgtggagccagagaatggtggagggctaccagggcctgagatgcgacaacttcaccagcagctggagagacggcagactgttcaacgccatcatccacagacacaagcccctgctgatcgacatgaacaaggtgtacagacagaccaacctggagaacctggaccaggccttcagcgtggccgagagagacctgggcgtgaccagactgctggaccccgaggacgtggacgtgccccagcccgacgagaagagcatcatcacctacgtgagcagcctgtacgacgccatgcccagagtgcccgacgtgcaggacggcgtgagagccaacgagctgcagctgagatggcaggagtacagagagctggtgctgctgctgctgcagtggatgagacaccacaccgccgccttcgaggagagaagattccccagcagcttcgaggagatcgagatcctgtggagccagttcctgaagttcaaggagatggagctgcccgccaaggaggccgacaagaacagaagcaagggcatctaccagagcctggagggcgccgtgcaggccggccagctgaaggtgccccccggctaccaccccctggacgtggagaaggagtggggcaagctgcacgtggccatcctggagagagagaagcagctgagaagcgagttcgagagactggagtgcctgcagagaatcgtgaccaagctgcagatggaggccggcctgtgcgaggagcagctgaaccaggccgacgccctgctgcagagcgacgtgagactgctggccgccggcaaggtgccccagagagccggcgaggtggagagagacctggacaaggccgacagcatgatcagactgctgttcaacgacgtgcagaccctgaaggacggcagacacccccagggcgagcagatgtacagaagagtgtacagactgcacgagagactggtggccatcagaaccgagtacaacctgagactgaaggccggcgtggccgcccccgccacccaggtggcccaggtgaccctgcagagcgtgcagagaagacccgagctggaggacagcaccctgagatacctgcaggacctgctggcctgggtggaggagaaccagcacagagtggacggcgccgagtggggcgtggacctgcccagcgtggaggcccagctgggcagccacagaggcctgcaccagagcatcgaggagttcagagccaagatcgagagagccagaagcgacgagggccagctgagccccgccaccagaggcgcctacagagactgcctgggcagactggacctgcagtacgccaagctgctgaacagcagcaaggccagactgagaagcctggagagcctgcacagcttcgtggccgccgccaccaaggagctgatgtggctgaacgagaaggaggaggaggaggtgggcttcgactggagcgacagaaacaccaacatgaccgccaagaaggagagctacagcgccctgatgagagagctggagctgaaggagaagaagatcaaggagctgcagaacgccggcgacagactgctgagagaggaccaccccgccagacccaccgtggagagcttccaggccgccctgcagacccagtggagctggatgctgcagctgtgctgctgcatcgaggcccacctgaaggagaacgccgcctacttccagttcttcagcgacgtgagagaggccgagggccagctgcagaagctgcaggaggccctgagaagaaagtacagctgcgacagaagcgccaccgtgaccagactggaggacctgctgcaggacgcccaggacgagaaggagcagctgaacgagtacaagggccacctgagcggcctggccaagagagccaaggccgtggtgcagctgaagcccagacaccccgcccaccccatgagaggcagactgcccctgctggccgtgtgcgactacaagcaggtggaggtgaccgtgcacaagggcgacgagtgccagctggtgggccccgcccagcccagccactggaaggtgctgagcagcagcggcagcgaggccgccgtgcccagcgtgtgcttcctggtgcccccccccaaccaggaggcccaggaggccgtgaccagactggaggcccagcaccaggccctggtgaccctgtggcaccagctgcacgtggacatgaagagcctgctggcctggcagagcctgagaagagacgtgcagctgatcagaagctggagcctggccaccttcagaaccctgaagcccgaggagcagagacaggccctgcacagcctggagctgcactaccaggccttcctgagagacagccaggacgccggcggcttcggccccgaggacagactgatggccgagagagagtacggcagctgcagccaccactaccagcagctgctgcagagcctggagcagggcgcccaggaggagagcagatgccagagatgcatcagcgagctgaaggacatcagactgcagctggaggcctgcgagaccagaaccgtgcacagactgagactgcccctggacaaggagcccgccagagagtgcgcccagagaatcgccgagcagcagaaggcccaggccgaggtggagggcctgggcaagggcgtggccagactgagcgccgaggccgagaaggtgctggccctgcccgagcccagccccgccgcccccaccctgagaagcgagctggagctgaccctgggcaagctggagcaggtgagaagcctgagcgccatctacctggagaagctgaagaccatcagcctggtgatcagaggcacccagggcgccgaggaggtgctgagagcccacgaggagcagctgaaggaggcccaggccgtgcccgccaccctgcccgagctggaggccaccaaggccagcctgaagaagctgagagcccaggccgaggcccagcagcccaccttcgacgccctgagagacgagctgagaggcgcccaggaggtgggcgagagactgcagcagagacacggcgagagagacgtggaggtggagagatggagagagagagtggcccagctgctggagagatggcaggccgtgctggcccagaccgacgtgagacagagagagctggagcagctgggcagacagctgagatactacagagagagcgccgaccccctgggcgcctggctgcaggacgccagaagaagacaggagcagatccaggccatgcccctggccgacagccaggccgtgagagagcagctgagacaggagcaggccctgctggaggagatcgagagacacggcgagaaggtggaggagtgccagagattcgccaagcagtacatcaacgccatcaaggactacgagctgcagctggtgacctacaaggcccagctggagcccgtggccagccccgccaagaagcccaaggtgcagagcggcagcgagagcgtgatccaggagtacgtggacctgagaacccactacagcgagctgaccaccctgaccagccagtacatcaagttcatcagcgagaccctgagaagaatggaggaggaggagagactggccgagcagcagagagccgaggagagagagagactggccgaggtggaggccgccctggagaagcagagacagctggccgaggcccacgcccaggccaaggcccaggccgagagagaggccaaggagctgcagcagagaatgcaggaggaggtggtgagaagagaggaggccgccgtggacgcccagcagcagaagagaagcatccaggaggagctgcagcagctgagacagagcagcgaggccgagatccaggccaaggccagacaggccgaggccgccgagagaagcagactgagaatcgaggaggagatcagagtggtgagactgcagctggaggccaccgagagacagagaggcggcgccgagggcgagctgcaggccctgagagccagagccgaggaggccgaggcccagaagagacaggcccaggaggaggccgagagactgagaagacaggtgcaggacgagagccagagaaagagacaggccgaggtggagctggccagcagagtgaaggccgaggccgaggccgccagagagaagcagagagccctgcaggccctggaggagctgagactgcaggccgaggaggccgagagaagactgagacaggccgaggtggagagagccagacaggtgcaggtggccctggagaccgcccagagaagcgccgaggccgagctgcagagcaagagagccagcttcgccgagaagaccgcccagctggagagaagcctgcaggaggagcacgtggccgtggcccagctgagagaggaggccgagagaagagcccagcagcaggccgaggccgagagagccagagaggaggccgagagagagctggagagatggcagctgaaggccaacgaggccctgagactgagactgcaggccgaggaggtggcccagcagaagagcctggcccaggccgaggccgagaagcagaaggaggaggccgagagagaggccagaagaagaggcaaggccgaggagcaggccgtgagacagagagagctggccgagcaggagctggagaagcagagacagctggccgagggcaccgcccagcagagactggccgccgagcaggagctgatcagactgagagccgagaccgagcagggcgagcagcagagacagctgctggaggaggagctggccagactgcagagagaggccgccgccgccacccagaagagacaggagctggaggccgagctggccaaggtgagagccgagatggaggtgctgctggccagcaaggccagagccgaggaggagagcagaagcaccagcgagaagagcaagcagagactggaggccgaggccggcagattcagagagctggccgaggaggccgccagactgagagccctggccgaggaggccaagagacagagacagctggccgaggaggacgccgccagacagagagccgaggccgagagagtgctggccgagaagctggccgccatcggcgaggccaccagactgaagaccgaggccgagatcgccctgaaggagaaggaggccgagaacgagagactgagaagactggccgaggacgaggccttccagagaagaagactggaggagcaggccgcccagcacaaggccgacatcgaggagagactggcccagctgagaaaggccagcgacagcgagctggagagacagaagggcctggtggaggacaccctgagacagagaagacaggtggaggaggagatcctggccctgaaggccagcttcgagaaggccgccgccggcaaggccgagctggagctggagctgggcagaatcagaagcaacgccgaggacaccctgagaagcaaggagcaggccgagctggaggccgccagacagagacagctggccgccgaggaggagagaagaagaagagaggccgaggagagagtgcagaagagcctggccgccgaggaggaggccgccagacagagaaaggccgccctggaggaggtggagagactgaaggccaaggtggaggaggccagaagactgagagagagagccgagcaggagagcgccagacagctgcagctggcccaggaggccgcccagaagagactgcaggccgaggagaaggcccacgccttcgccgtgcagcagaaggagcaggagctgcagcagaccctgcagcaggagcagagcgtgctggaccagctgagaggcgaggccgaggccgccagaagagccgccgaggaggccgaggaggccagagtgcaggccgagagagaggccgcccagagcagaagacaggtggaggaggccgagagactgaagcagagcgccgaggagcaggcccaggccagagcccaggcccaggccgccgccgagaagctgagaaaggaggccgagcaggaggccgccagaagagcccaggccgagcaggccgccctgagacagaagcaggccgccgacgccgagatggagaagcacaagaagttcgccgagcagaccctgagacagaaggcccaggtggagcaggagctgaccaccctgagactgcagctggaggagaccgaccaccagaagaacctgctggacgaggagctgcagagactgaaggccgaggccaccgaggccgccagacagagaagccaggtggaggaggagctgttcagcgtgagagtgcagatggaggagctgagcaagctgaaggccagaatcgaggccgagaacagagccctgatcctgagagacaaggacaacacccagagattcctgcaggaggaggccgagaagatgaagcaggtggccgaggaggccgccagactgagcgtggccgcccaggaggccgccagactgagacagctggccgaggaggacctggcccagcagagagccctggccgagaagatgctgaaggagaagatgcaggccgtgcaggaggccaccagactgaaggccgaggccgagctgctgcagcagcagaaggagctggcccaggagcaggccagaagactgcaggaggacaaggagcagatggcccagcagctggccgaggagacccagggcttccagagaaccctggaggccgagagacagagacagctggagatgagcgccgaggccgagagactgaagctgagagtggccgagatgagcagagcccaggccagagccgaggaggacgcccagagattcagaaagcaggccgaggagatcggcgagaagctgcacagaaccgagctggccacccaggagaaggtgaccctggtgcagaccctggagatccagagacagcagagcgaccacgacgccgagagactgagagaggccatcgccgagctggagagagagaaggagaagctgcagcaggaggccaagctgctgcagctgaagagcgaggagatgcagaccgtgcagcaggagcagctgctgcaggagacccaggccctgcagcagagcttcctgagcgagaaggacagcctgctgcagagagagagattcatcgagcaggagaaggccaagctggagcagctgttccaggacgaggtggccaaggcccagcagctgagagaggagcagcagagacagcagcagcagatggagcaggagagacagagactggtggccagcatggaggaggccagaagaagacagcacgaggccgaggagggcgtgagaagaaagcaggaggagctgcagcagctggagcagcagagaagacagcaggaggagctgctggccgaggagaaccagagactgagagagcagctgcagctgctggaggagcagcacagagccgccctggcccacagcgaggaggtgaccgccagccaggtggccgccaccaagaccctgcccaacggcagagacgccctggacggccccgccgccgaggccgagcccgagcacagcttcgacggcctgagaagaaaggtgagcgcccagagactgcaggaggccggcatcctgagcgccgaggagctgcagagactggcccagggccacaccaccgtggacgagctggccagaagagaggacgtgagacactacctgcagggcagaagcagcatcgccggcctgctgctgaaggccaccaacgagaagctgagcgtgtacgccgccctgcagagacagctgctgagccccggcaccgccctgatcctgctggaggcccaggccgccagcggcttcctgctggaccccgtgagaaacagaagactgaccgtgaacgaggccgtgaaggagggcgtggtgggccccgagctgcaccacaagctgctgagcgccgagagagccgtgaccggctacaaggacccctacaccggccagcagatcagcctgttccaggccatgcagaagggcctgatcgtgagagagcacggcatcagactgctggaggcccagatcgccaccggcggcgtgatcgaccccgtgcacagccacagagtgcccgtggacgtggcctacagaagaggctacttcgacgaggagatgaacagagtgctggccgaccccagcgacgacaccaagggcttcttcgaccccaacacccacgagaacctgacctacctgcagctgctggagagatgcgtggaggaccccgagaccggcctgtgcctgctgcccctgaccgacaaggccgccaagggcggcgagctggtgtacaccgacagcgaggccagagacgtgttcgagaaggccaccgtgagcgcccccttcggcaagttccagggcaagaccgtgaccatctgggagatcatcaacagcgagtacttcaccgccgagcagagaagagacctgctgagacagttcagaaccggcagaatcaccgtggagaagatcatcaagatcatcatcaccgtggtggaggagcaggagcagaagggcagactgtgcttcgagggcctgagaagcctggtgcccgccgccgagctgctggagagcagagtgatcgacagagagctgtaccagcagctgcagagaggcgagagaagcgtgagagacgtggccgaggtggacaccgtgagaagagccctgagaggcgccaacgtgatcgccggcgtgtggctggaggaggccggccagaagctgagcatctacaacgccctgaagaaggacctgctgcccagcgacatggccgtggccctgctggaggcccaggccggcaccggccacatcatcgaccccgccaccagcgccagactgaccgtggacgaggccgtgagagccggcctggtgggccccgagttccacgagaagctgctgagcgccgagaaggccgtgaccggctacagagacccctacaccggccagagcgtgagcctgttccaggccctgaagaagggcctgatccccagagagcagggcctgagactgctggacgcccagctgagcaccggcggcatcgtggaccccagcaagagccacagagtgcccctggacgtggcctgcgccagaggctgcctggacgaggagaccagcagagccctgagcgcccccagagccgacgccaaggcctacagcgaccccagcaccggcgagcccgccacctacggcgagctgcagcagagatgcagacccgaccagctgaccggcctgagcctgctgcccctgagcgagaaggccgccagagccagacaggaggagctgtacagcgagctgcaggccagagagaccttcgagaagacccccgtggaggtgcccgtgggcggcttcaagggcagaaccgtgaccgtgtgggagctgatcagcagcgagtacttcaccgccgagcagagacaggagctgctgagacagttcagaaccggcaaggtgaccgtggagaaggtgatcaagatcctgatcaccatcgtggaggaggtggagaccctgagacaggagagactgagcttcagcggcctgagagcccccgtgcccgccagcgagctgctggccagcggcgtgctgagcagagcccagttcgagcagctgaaggacggcaagaccaccgtgaaggacctgagcgagctgggcagcgtgagaaccctgctgcagggcagcggctgcctggccggcatctacctggaggacaccaaggagaaggtgagcatctacgaggccatgagaagaggcctgctgagagccaccaccgccgccctgctgctggaggcccaggccgccaccggcttcctggtggaccccgtgagaaaccagagactgtacgtgcacgaggccgtgaaggccggcgtggtgggccccgagctgcacgagcagctgctgagcgccgagaaggccgtgaccggctacagagacccctacagcggcagcaccatcagcctgttccaggccatgcagaagggcctggtgctgagacagcacggcatcagactgctggaggcccagatcgccaccggcggcatcatcgaccccgtgcacagccacagagtgcccgtggacgtggcctaccagagaggctacttcagcgaggagatgaacagagtgctggccgaccccagcgacgacaccaagggcttcttcgaccccaacacccacgagaacctgacctacagacagctgctggagagatgcgtggaggaccccgagaccggcctgagactgctgcccctgaagggcgccgagaaggccgaggtggtggagaccacccaggtgtacaccgaggaggagaccagaagagccttcgaggagacccagatcgacatccccggcggcggcagccacggcggcagcaccatgagcctgtgggaggtgatgcagagcgacctgatccccgaggagcagagagcccagctgatggccgacttccaggccggcagagtgaccaaggagagaatgatcatcatcatcatcgagatcatcgagaagaccgagatcatcagacagcagggcctggccagctacgactacgtgagaagaagactgaccgccgaggacctgttcgaggccagaatcatcagcctggagacctacaacctgctgagagagggcaccagaagcctgagagaggccctggaggccgagagcgcctggtgctacctgtacggcaccggcagcgtggccggcgtgtacctgcccggcagcagacagaccctgagcatctaccaggccctgaagaagggcctgctgagcgccgaggtggccagactgctgctggaggcccaggccgccaccggcttcctgctggaccccgtgaagggcgagagactgaccgtggacgaggccgtgagaaagggcctggtgggccccgagctgcacgacagactgctgagcgccgagagagccgtgaccggctacagagacccctacaccgagcagaccatcagcctgttccaggccatgaagaaggagctgatccccaccgaggaggccctgagactgctggacgcccagctggccaccggcggcatcgtggaccccagactgggcttccacctgcccctggaggtggcctaccagagaggctacctgaacaaggacacccacgaccagctgagcgagcccagcgaggtgagaagctacgtggaccccagcaccgacgagagactgagctacacccagctgctgagaagatgcagaagagacgacggcaccggccagctgctgctgcccctgagcgacgccagaaagctgaccttcagaggcctgagaaagcagatcaccatggaggagctggtgagaagccaggtgatggacgaggccaccgccctgcagctgagagagggcctgaccagcatcgaggaggtgaccaagaacctgcagaagttcctggagggcaccagctgcatcgccggcgtgttcgtggacgccaccaaggagagactgagcgtgtaccaggccatgaagaagggcatcatcagacccggcaccgccttcgagctgctggaggcccaggccgccaccggctacgtgatcgaccccatcaagggcctgaagctgaccgtggaggaggccgtgagaatgggcatcgtgggccccgagttcaaggacaagctgctgagcgccgagagagccgtgaccggctacaaggacccctacagcggcaagctgatcagcctgttccaggccatgaagaagggcctgatcctgaaggaccacggcatcagactgctggaggcccagatcgccaccggcggcatcatcgaccccgaggagagccacagactgcccgtggaggtggcctacaagagaggcctgttcgacgaggagatgaacgagatcctgaccgaccccagcgacgacaccaagggcttcttcgaccccaacaccgaggagaacctgacctacctgcagctgatggagagatgcatcaccgacccccagaccggcctgtgcctgctgcccctgaaggagaagaagagagagagaaagaccagcagcaagagcagcgtgagaaagagaagagtggtgatcgtggaccccgagaccggcaaggagatgagcgtgtacgaggcctacagaaagggcctgatcgaccaccagacctacctggagctgagcgagcaggagtgcgagtgggaggagatcaccatcagcagcagcgacggcgtggtgaagagcatgatcatcgacagaagaagcggcagacagtacgacatcgacgacgccatcgccaagaacctgatcgacagaagcgccctggaccagtacagagccggcaccctgagcatcaccgagttcgccgacatgctgagcggcaacgccggcggcttcagaagcagaagcagcagcgtgggcagcagcagcagctaccccatcagccccgccgtgagcagaacccagctggccagctggagcgaccccaccgaggagaccggccccgtggccggcatcctggacaccgagaccctggagaaggtgagcatcaccgaggccatgcacagaaacctggtggacaacatcaccggccagagactgctggaggcccaggcctgcaccggcggcatcatcgaccccagcaccggcgagagattccccgtgaccgacgccgtgaacaagggcctggtggacaagatcatggtggacagaatcaacctggcccagaaggccttctgcggcttcgaggaccccagaaccaagaccaagatgagcgccgcccaggccctgaagaagggctggctgtactacgaggccggccagagattcctggaggtgcagtacctgaccggcggcctgatcgagcccgacacccccggcagagtgcccctggacgaggccctgcagagaggcaccgtggacgccagaaccgcccagaagctgagagacgtgggcgcctacagcaagtacctgacctgccccaagaccaagctgaagatcagctacaaggacgccctggacagaagcatggtggaggagggcaccggcctgagactgctggaggccgccgcccagagcaccaagggctactacagcccctacagcgtgagcggcagcggcagcaccgccggcagcagaaccggcagcagaaccggcagcagagccggcagcagaagaggcagcttcgacgccaccggcagcggcttcagcatgaccttcagcagcagcagctacagcagcagcggctacggcagaagatacgccagcggcagcagcgccagcctgggcggccccgagagcgccgtggcctag

SEQ ID NO: 93619 - DNA, 13656 bp, Artificial Sequence
  Description of Artificial Sequence: Synthetic coding sequence
atgagcggcgccggcggcgccttcgccagccccagagaggtgctgctggagagaccctgctggctggacggcggctgcgagcccgccagaagaggctacctgtaccagcagctgtgctgcgtggacgagagagacagagtgcagaagaagaccttcaccaagtgggtgaacaagcacctgatcaaggcccagagacacatcagcgacctgtacgaggacctgagagacggccacaacctgatcagcctgctggaggtgctgagcggcgacagcctgcccagagagaagggcagaatgagattccacaagctgcagaacgtgcagatcgccctggactacctgagacacagacaggtgaagctggtgaacatcagaaacgacgacatcgccgacggcaaccccaagctgaccctgggcctgatctggaccatcatcctgcacttccagatcagcgacatccaggtgagcggccagagcgaggacatgaccgccaaggagaagctgctgctgtggagccagagaatggtggagggctaccagggcctgagatgcgacaacttcaccagcagctggagagacggcagactgttcaacgccatcatccacagacacaagcccctgctgatcgacatgaacaaggtgtacagacagaccaacctggagaacctggaccaggccttcagcgtggccgagagagacctgggcgtgaccagactgctggaccccgaggacgtggacgtgccccagcccgacgagaagagcatcatcacctacgtgagcagcctgtacgacgccatgcccagagtgcccgacgtgcaggacggcgtgagagccaacgagctgcagctgagatggcaggagtacagagagctggtgctgctgctgctgcagtggatgagacaccacaccgccgccttcgaggagagaagattccccagcagcttcgaggagatcgagatcctgtggagccagttcctgaagttcaaggagatggagctgcccgccaaggaggccgacaagaacagaagcaagggcatctaccagagcctggagggcgccgtgcaggccggccagctgaaggtgccccccggctaccaccccctggacgtggagaaggagtggggcaagctgcacgtggccatcctggagagagagaagcagctgagaagcgagttcgagagactggagtgcctgcagagaatcgtgaccaagctgcagatggaggccggcctgtgcgaggagcagctgaaccaggccgacgccctgctgcagagcgacgtgagactgctggccgccggcaaggtgccccagagagccggcgaggtggagagagacctggacaaggccgacagcatgatcagactgctgttcaacgacgtgcagaccctgaaggacggcagacacccccagggcgagcagatgtacagaagagtgtacagactgcacgagagactggtggccatcagaaccgagtacaacctgagactgaaggccggcgtggccgcccccgccacccaggtggcccaggtgaccctgcagagcgtgcagagaagacccgagctggaggacagcaccctgagatacctgcaggacctgctggcctgggtggaggagaaccagcacagagtggacggcgccgagtggggcgtggacctgcccagcgtggaggcccagctgggcagccacagaggcctgcaccagagcatcgaggagttcagagccaagatcgagagagccagaagcgacgagggccagctgagccccgccaccagaggcgcctacagagactgcctgggcagactggacctgcagtacgccaagctgctgaacagcagcaaggccagactgagaagcctggagagcctgcacagcttcgtggccgccgccaccaaggagctgatgtggctgaacgagaaggaggaggaggaggtgggcttcgactggagcgacagaaacaccaacatgaccgccaagaaggagagctacagcgccctgatgagagagctggagctgaaggagaagaagatcaaggagctgcagaacgccggcgacagactgctgagagaggaccaccccgccagacccaccgtggagagcttccaggccgccctgcagacccagtggagctggatgctgcagctgtgctgctgcatcgaggcccacctgaaggagaacgccgcctacttccagttcttcagcgacgtgagagaggccgagggccagctgcagaagctgcaggaggccctgagaagaaagtacagctgcgacagaagcgccaccgtgaccagactggaggacctgctgcaggacgcccaggacgagaaggagcagctgaacgagtacaagggccacctgagcggcctggccaagagagccaaggccgtggtgcagctgaagcccagacaccccgcccaccccatgagaggcagactgcccctgctggccgtgtgcgactacaagcaggtggaggtgaccgtgcacaagggcgacgagtgccagctggtgggccccgcccagcccagccactggaaggtgctgagcagcagcggcagcgaggccgccgtgcccagcgtgtgcttcctggtgcccccccccaaccaggaggcccaggaggccgtgaccagactggaggcccagcaccaggccctggtgaccctgtggcaccagctgcacgtggacatgaagagcctgctggcctggcagagcctgagaagagacgtgcagctgatcagaagctggagcctggccaccttcagaaccctgaagcccgaggagcagagacaggccctgcacagcctggagctgcactaccaggccttcctgagagacagccaggacgccggcggcttcggccccgaggacagactgatggccgagagagagtacggcagctgcagccaccactaccagcagctgctgcagagcctggagcagggcgcccaggaggagagcagatgccagagatgcatcagcgagctgaaggacatcagactgcagctggaggcctgcgagaccagaaccgtgcacagactgagactgcccctggacaaggagcccgccagagagtgcgcccagagaatcgccgagcagcagaaggcccaggccgaggtggagggcctgggcaagggcgtggccagactgagcgccgaggccgagaaggtgctggccctgcccgagcccagccccgccgcccccaccctgagaagcgagctggagctgaccctgggcaagctggagcaggtgagaagcctgagcgccatctacctggagaagctgaagaccatcagcctggtgatcagaggcacccagggcgccgaggaggtgctgagagcccacgaggagcagctgaaggaggcccaggccgtgcccgccaccctgcccgagctggaggccaccaaggccagcctgaagaagctgagagcccaggccgaggcccagcagcccaccttcgacgccctgagagacgagctgagaggcgcccaggaggtgggcgagagactgcagcagagacacggcgagagagacgtggaggtggagagatggagagagagagtggcccagctgctggagagatggcaggccgtgctggcccagaccgacgtgagacagagagagctggagcagctgggcagacagctgagatactacagagagagcgccgaccccctgggcgcctggctgcaggacgccagaagaagacaggagcagatccaggccatgcccctggccgacagccaggccgtgagagagcagctgagacaggagcaggccctgctggaggagatcgagagacacggcgagaaggtggaggagtgccagagattcgccaagcagtacatcaacgccatcaaggactacgagctgcagctggtgacctacaaggcccagctggagcccgtggccagccccgccaagaagcccaaggtgcagagcggcagcgagagcgtgatccaggagtacgtggacctgagaacccactacagcgagctgaccaccctgaccagccagtacatcaagttcatcagcgagaccctgagaagaatggaggaggaggagagactggccgagcagcagagagccgaggagagagagagactggccgaggtggaggccgccctggagaagcagagacagctggccgaggcccacgcccaggccaaggcccaggccgagagagaggccaaggagctgcagcagagaatgcaggaggaggtggtgagaagagaggaggccgccgtggacgcccagcagcagaagagaagcatccaggaggagctgcagcagctgagacagagcagcgaggccgagatccaggccaaggccagacaggccgaggccgccgagagaagcagactgagaatcgaggaggagatcagagtggtgagactgcagctggaggccaccgagagacagagaggcggcgccgagggcgagctgcaggccctgagagccagagccgaggaggccgaggcccagaagagacaggcccaggaggaggccgagagactgagaagacaggtgcaggacgagagccagagaaagagacaggccgaggtggagctggccagcagagtgaaggccgaggccgaggccgccagagagaagcagagagccctgcaggccctggaggagctgagactgcaggccgaggaggccgagagaagactgagacaggccgaggtggagagagccagacaggtgcaggtggccctggagaccgcccagagaagcgccgaggccgagctgcagagcaagagagccagcttcgccgagaagaccgcccagctggagagaagcctgcaggaggagcacgtggccgtggcccagctgagagaggaggccgagagaagagcccagcagcaggccgaggccgagagagccagagaggaggccgagagagagctggagagatggcagctgaaggccaacgaggccctgagactgagactgcaggccgaggaggtggcccagcagaagagcctggcccaggccgaggccgagaagcagaaggaggaggccgagagagaggccagaagaagaggcaaggccgaggagcaggccgtgagacagagagagctggccgagcaggagctggagaagcagagacagctggccgagggcaccgcccagcagagactggccgccgagcaggagctgatcagactgagagccgagaccgagcagggcgagcagcagagacagctgctggaggaggagctggccagactgcagagagaggccgccgccgccacccagaagagacaggagctggaggccgagctggccaaggtgagagccgagatggaggtgctgctggccagcaaggccagagccgaggaggagagcagaagcaccagcgagaagagcaagcagagactggaggccgaggccggcagattcagagagctggccgaggaggccgccagactgagagccctggccgaggaggccaagagacagagacagctggccgaggaggacgccgccagacagagagccgaggccgagagagtgctggccgagaagctggccgccatcggcgaggccaccagactgaagaccgaggccgagatcgccctgaaggagaaggaggccgagaacgagagactgagaagactggccgaggacgaggccttccagagaagaagactggaggagcaggccgcccagcacaaggccgacatcgaggagagactggcccagctgagaaaggccagcgacagcgagctggagagacagaagggcctggtggaggacaccctgagacagagaagacaggtggaggaggagatcctggccctgaaggccagcttcgagaaggccgccgccggcaaggccgagctggagctggagctgggcagaatcagaagcaacgccgaggacaccctgagaagcaaggagcaggccgagctggaggccgccagacagagacagctggccgccgaggaggagagaagaagaagagaggccgaggagagagtgcagaagagcctggccgccgaggaggaggccgccagacagagaaaggccgccctggaggaggtggagagactgaaggccaaggtggaggaggccagaagactgagagagagagccgagcaggagagcgccagacagctgcagctggcccaggaggccgcccagaagagactgcaggccgaggagaaggcccacgccttcgccgtgcagcagaaggagcaggagctgcagcagaccctgcagcaggagcagagcgtgctggaccagctgagaggcgaggccgaggccgccagaagagccgccgaggaggccgaggaggccagagtgcaggccgagagagaggccgcccagagcagaagacaggtggaggaggccgagagactgaagcagagcgccgaggagcaggcccaggccagagcccaggcccaggccgccgccgagaagctgagaaaggaggccgagcaggaggccgccagaagagcccaggccgagcaggccgccctgagacagaagcaggccgccgacgccgagatggagaagcacaagaagttcgccgagcagaccctgagacagaaggcccaggtggagcaggagctgaccaccctgagactgcagctggaggagaccgaccaccagaagaacctgctggacgaggagctgcagagactgaaggccgaggccaccgaggccgccagacagagaagccaggtggaggaggagctgttcagcgtgagagtgcagatggaggagctgagcaagctgaaggccagaatcgaggccgagaacagagccctgatcctgagagacaaggacaacacccagagattcctgcaggaggaggccgagaagatgaagcaggtggccgaggaggccgccagactgagcgtggccgcccaggaggccgccagactgagacagctggccgaggaggacctggcccagcagagagccctggccgagaagatgctgaaggagaagatgcaggccgtgcaggaggccaccagactgaaggccgaggccgagctgctgcagcagcagaaggagctggcccaggagcaggccagaagactgcaggaggacaaggagcagatggcccagcagctggccgaggagacccagggcttccagagaaccctggaggccgagagacagagacagctggagatgagcgccgaggccgagagactgaagctgagagtggccgagatgagcagagcccaggccagagccgaggaggacgcccagagattcagaaagcaggccgaggagatcggcgagaagctgcacagaaccgagctggccacccaggagaaggtgaccctggtgcagaccctggagatccagagacagcagagcgaccacgacgccgagagactgagagaggccatcgccgagctggagagagagaaggagaagctgcagcaggaggccaagctgctgcagctgaagagcgaggagatgcagaccgtgcagcaggagcagctgctgcaggagacccaggccctgcagcagagcttcctgagcgagaaggacagcctgctgcagagagagagattcatcgagcaggagaaggccaagctggagcagctgttccaggacgaggtggccaaggcccagcagctgagagaggagcagcagagacagcagcagcagatggagcaggagagacagagactggtggccagcatggaggaggccagaagaagacagcacgaggccgaggagggcgtgagaagaaagcaggaggagctgcagcagctggagcagcagagaagacagcaggaggagctgctggccgaggagaaccagagactgagagagcagctgcagctgctggaggagcagcacagagccgccctggcccacagcgaggaggtgaccgccagccaggtggccgccaccaagaccctgcccaacggcagagacgccctggacggccccgccgccgaggccgagcccgagcacagcttcgacggcctgagaagaaaggtgagcgcccagagactgcaggaggccggcatcctgagcgccgaggagctgcagagactggcccagggccacaccaccgtggacgagctggccagaagagaggacgtgagacactacctgcagggcagaagcagcatcgccggcctgctgctgaaggccaccaacgagaagctgagcgtgtacgccgccctgcagagacagctgctgagccccggcaccgccctgatcctgctggaggcccaggccgccagcggcttcctgctggaccccgtgagaaacagaagactgaccgtgaacgaggccgtgaaggagggcgtggtgggccccgagctgcaccacaagctgctgagcgccgagagagccgtgaccggctacaaggacccctacaccggccagcagatcagcctgttccaggccatgcagaagggcctgatcgtgagagagcacggcatcagactgctggaggcccagatcgccaccggcggcgtgatcgaccccgtgcacagccacagagtgcccgtggacgtggcctacagaagaggctacttcgacgaggagatgaacagagtgctggccgaccccagcgacgacaccaagggcttcttcgaccccaacacccacgagaacctgacctacctgcagctgctggagagatgcgtggaggaccccgagaccggcctgtgcctgctgcccctgaccgacaaggccgccaagggcggcgagctggtgtacaccgacagcgaggccagagacgtgttcgagaaggccaccgtgagcgcccccttcggcaagttccagggcaagaccgtgaccatctgggagatcatcaacagcgagtacttcaccgccgagcagagaagagacctgctgagacagttcagaaccggcagaatcaccgtggagaagatcatcaagatcatcatcaccgtggtggaggagcaggagcagaagggcagactgtgcttcgagggcctgagaagcctggtgcccgccgccgagctgctggagagcagagtgatcgacagagagctgtaccagcagctgcagagaggcgagagaagcgtgagagacgtggccgaggtggacaccgtgagaagagccctgagaggcgccaacgtgatcgccggcgtgtggctggaggaggccggccagaagctgagcatctacaacgccctgaagaaggacctgctgcccagcgacatggccgtggccctgctggaggcccaggccggcaccggccacatcatcgaccccgccaccagcgccagactgaccgtggacgaggccgtgagagccggcctggtgggccccgagttccacgagaagctgctgagcgccgagaaggccgtgaccggctacagagacccctacaccggccagagcgtgagcctgttccaggccctgaagaagggcctgatccccagagagcagggcctgagactgctggacgcccagctgagcaccggcggcatcgtggaccccagcaagagccacagagtgcccctggacgtggcctgcgccagaggctgcctggacgaggagaccagcagagccctgagcgcccccagagccgacgccaaggcctacagcgaccccagcaccggcgagcccgccacctacggcgagctgcagcagagatgcagacccgaccagctgaccggcctgagcctgctgcccctgagcgagaaggccgccagagccagacaggaggagctgtacagcgagctgcaggccagagagaccttcgagaagacccccgtggaggtgcccgtgggcggcttcaagggcagaaccgtgaccgtgtgggagctgatcagcagcgagtacttcaccgccgagcagagacaggagctgctgagacagttcagaaccggcaaggtgaccgtggagaaggtgatcaagatcctgatcaccatcgtggaggaggtggagaccctgagacaggagagactgagcttcagcggcctgagagcccccgtgcccgccagcgagctgctggccagcggcgtgctgagcagagcccagttcgagcagctgaaggacggcaagaccaccgtgaaggacctgagcgagctgggcagcgtgagaaccctgctgcagggcagcggctgcctggccggcatctacctggaggacaccaaggagaaggtgagcatctacgaggccatgagaagaggcctgctgagagccaccaccgccgccctgctgctggaggcccaggccgccaccggcttcctggtggaccccgtgagaaaccagagactgtacgtgcacgaggccgtgaaggccggcgtggtgggccccgagctgcacgagcagctgctgagcgccgagaaggccgtgaccggctacagagacccctacagcggcagcaccatcagcctgttccaggccatgcagaagggcctggtgctgagacagcacggcatcagactgctggaggcccagatcgccaccggcggcatcatcgaccccgtgcacagccacagagtgcccgtggacgtggcctaccagagaggctacttcagcgaggagatgaacagagtgctggccgaccccagcgacgacaccaagggcttcttcgaccccaacacccacgagaacctgacctacagacagctgctggagagatgcgtggaggaccccgagaccggcctgagactgctgcccctgaagggcgccgagaaggccgaggtggtggagaccacccaggtgtacaccgaggaggagaccagaagagccttcgaggagacccagatcgacatccccggcggcggcagccacggcggcagcaccatgagcctgtgggaggtgatgcagagcgacctgatccccgaggagcagagagcccagctgatggccgacttccaggccggcagagtgaccaaggagagaatgatcatcatcatcatcgagatcatcgagaagaccgagatcatcagacagcagggcctggccagctacgactacgtgagaagaagactgaccgccgaggacctgttcgaggccagaatcatcagcctggagacctacaacctgctgagagagggcaccagaagcctgagagaggccctggaggccgagagcgcctggtgctacctgtacggcaccggcagcgtggccggcgtgtacctgcccggcagcagacagaccctgagcatctaccaggccctgaagaagggcctgctgagcgccgaggtggccagactgctgctggaggcccaggccgccaccggcttcctgctggaccccgtgaagggcgagagactgaccgtggacgaggccgtgagaaagggcctggtgggccccgagctgcacgacagactgctgagcgccgagagagccgtgaccggctacagagacccctacaccgagcagaccatcagcctgttccaggccatgaagaaggagctgatccccaccgaggaggccctgagactgctggacgcccagctggccaccggcggcatcgtggaccccagactgggcttccacctgcccctggaggtggcctaccagagaggctacctgaacaaggacacccacgaccagctgagcgagcccagcgaggtgagaagctacgtggaccccagcaccgacgagagactgagctacacccagctgctgagaagatgcagaagagacgacggcaccggccagctgctgctgcccctgagcgacgccagaaagctgaccttcagaggcctgagaaagcagatcaccatggaggagctggtgagaagccaggtgatggacgaggccaccgccctgcagctgagagagggcctgaccagcatcgaggaggtgaccaagaacctgcagaagttcctggagggcaccagctgcatcgccggcgtgttcgtggacgccaccaaggagagactgagcgtgtaccaggccatgaagaagggcatcatcagacccggcaccgccttcgagctgctggaggcccaggccgccaccggctacgtgatcgaccccatcaagggcctgaagctgaccgtggaggaggccgtgagaatgggcatcgtgggccccgagttcaaggacaagctgctgagcgccgagagagccgtgaccggctacaaggacccctacagcggcaagctgatcagcctgttccaggccatgaagaagggcctgatcctgaaggaccacggcatcagactgctggaggcccagatcgccaccggcggcatcatcgaccccgaggagagccacagactgcccgtggaggtggcctacaagagaggcctgttcgacgaggagatgaacgagatcctgaccgaccccagcgacgacaccaagggcttcttcgaccccaacaccgaggagaacctgacctacctgcagctgatggagagatgcatcaccgacccccagaccggcctgtgcctgctgcccctgaaggagaagaagagagagagaaagaccagcagcaagagcagcgtgagaaagagaagagtggtgatcgtggaccccgagaccggcaaggagatgagcgtgtacgaggcctacagaaagggcctgatcgaccaccagacctacctggagctgagcgagcaggagtgcgagtgggaggagatcaccatcagcagcagcgacggcgtggtgaagagcatgatcatcgacagaagaagcggcagacagtacgacatcgacgacgccatcgccaagaacctgatcgacagaagcgccctggaccagtacagagccggcaccctgagcatcaccgagttcgccgacatgctgagcggcaacgccggcggcttcagaagcagaagcagcagcgtgggcagcagcagcagctaccccatcagccccgccgtgagcagaacccagctggccagctggagcgaccccaccgaggagaccggccccgtggccggcatcctggacaccgagaccctggagaaggtgagcatcaccgaggccatgcacagaaacctggtggacaacatcaccggccagagactgctggaggcccaggcctgcaccggcggcatcatcgaccccagcaccggcgagagattccccgtgaccgacgccgtgaacaagggcctggtggacaagatcatggtggacagaatcaacctggcccagaaggccttctgcggcttcgaggaccccagaaccaagaccaagatgagcgccgcccaggccctgaagaagggctggctgtactacgaggccggccagagattcctggaggtgcagtacctgaccggcggcctgatcgagcccgacacccccggcagagtgcccctggacgaggccctgcagagaggcaccgtggacgccagaaccgcccagaagctgagagacgtgggcgcctacagcaagtacctgacctgccccaagaccaagctgaagatcagctacaaggacgccctggacagaagcatggtggaggagggcaccggcctgagactgctggaggccgccgcccagagcaccaagggctactacagcccctacagcgtgagcggcagcggcagcaccgccggcagcagaaccggcagcagaaccggcagcagagccggcagcagaagaggcagcttcgacgccaccggcagcggcttcagcatgaccttcagcagcagcagctacagcagcagcggctacggcagaagatacgccagcggcagcagcgccagcctgggcggccccgagagcgccgtggcctag

SEQ ID NO: 93620 - DNA, 13548 bp, Artificial Sequence
  Description of Artificial Sequence: Synthetic coding sequence
atgaagatcgtgcccgacgagagagacagagtgcagaagaagaccttcaccaagtgggtgaacaagcacctgatcaaggcccagagacacatcagcgacctgtacgaggacctgagagacggccacaacctgatcagcctgctggaggtgctgagcggcgacagcctgcccagagagaagggcagaatgagattccacaagctgcagaacgtgcagatcgccctggactacctgagacacagacaggtgaagctggtgaacatcagaaacgacgacatcgccgacggcaaccccaagctgaccctgggcctgatctggaccatcatcctgcacttccagatcagcgacatccaggtgagcggccagagcgaggacatgaccgccaaggagaagctgctgctgtggagccagagaatggtggagggctaccagggcctgagatgcgacaacttcaccagcagctggagagacggcagactgttcaacgccatcatccacagacacaagcccctgctgatcgacatgaacaaggtgtacagacagaccaacctggagaacctggaccaggccttcagcgtggccgagagagacctgggcgtgaccagactgctggaccccgaggacgtggacgtgccccagcccgacgagaagagcatcatcacctacgtgagcagcctgtacgacgccatgcccagagtgcccgacgtgcaggacggcgtgagagccaacgagctgcagctgagatggcaggagtacagagagctggtgctgctgctgctgcagtggatgagacaccacaccgccgccttcgaggagagaagattccccagcagcttcgaggagatcgagatcctgtggagccagttcctgaagttcaaggagatggagctgcccgccaaggaggccgacaagaacagaagcaagggcatctaccagagcctggagggcgccgtgcaggccggccagctgaaggtgccccccggctaccaccccctggacgtggagaaggagtggggcaagctgcacgtggccatcctggagagagagaagcagctgagaagcgagttcgagagactggagtgcctgcagagaatcgtgaccaagctgcagatggaggccggcctgtgcgaggagcagctgaaccaggccgacgccctgctgcagagcgacgtgagactgctggccgccggcaaggtgccccagagagccggcgaggtggagagagacctggacaaggccgacagcatgatcagactgctgttcaacgacgtgcagaccctgaaggacggcagacacccccagggcgagcagatgtacagaagagtgtacagactgcacgagagactggtggccatcagaaccgagtacaacctgagactgaaggccggcgtggccgcccccgccacccaggtggcccaggtgaccctgcagagcgtgcagagaagacccgagctggaggacagcaccctgagatacctgcaggacctgctggcctgggtggaggagaaccagcacagagtggacggcgccgagtggggcgtggacctgcccagcgtggaggcccagctgggcagccacagaggcctgcaccagagcatcgaggagttcagagccaagatcgagagagccagaagcgacgagggccagctgagccccgccaccagaggcgcctacagagactgcctgggcagactggacctgcagtacgccaagctgctgaacagcagcaaggccagactgagaagcctggagagcctgcacagcttcgtggccgccgccaccaaggagctgatgtggctgaacgagaaggaggaggaggaggtgggcttcgactggagcgacagaaacaccaacatgaccgccaagaaggagagctacagcgccctgatgagagagctggagctgaaggagaagaagatcaaggagctgcagaacgccggcgacagactgctgagagaggaccaccccgccagacccaccgtggagagcttccaggccgccctgcagacccagtggagctggatgctgcagctgtgctgctgcatcgaggcccacctgaaggagaacgccgcctacttccagttcttcagcgacgtgagagaggccgagggccagctgcagaagctgcaggaggccctgagaagaaagtacagctgcgacagaagcgccaccgtgaccagactggaggacctgctgcaggacgcccaggacgagaaggagcagctgaacgagtacaagggccacctgagcggcctggccaagagagccaaggccgtggtgcagctgaagcccagacaccccgcccaccccatgagaggcagactgcccctgctggccgtgtgcgactacaagcaggtggaggtgaccgtgcacaagggcgacgagtgccagctggtgggccccgcccagcccagccactggaaggtgctgagcagcagcggcagcgaggccgccgtgcccagcgtgtgcttcctggtgcccccccccaaccaggaggcccaggaggccgtgaccagactggaggcccagcaccaggccctggtgaccctgtggcaccagctgcacgtggacatgaagagcctgctggcctggcagagcctgagaagagacgtgcagctgatcagaagctggagcctggccaccttcagaaccctgaagcccgaggagcagagacaggccctgcacagcctggagctgcactaccaggccttcctgagagacagccaggacgccggcggcttcggccccgaggacagactgatggccgagagagagtacggcagctgcagccaccactaccagcagctgctgcagagcctggagcagggcgcccaggaggagagcagatgccagagatgcatcagcgagctgaaggacatcagactgcagctggaggcctgcgagaccagaaccgtgcacagactgagactgcccctggacaaggagcccgccagagagtgcgcccagagaatcgccgagcagcagaaggcccaggccgaggtggagggcctgggcaagggcgtggccagactgagcgccgaggccgagaaggtgctggccctgcccgagcccagccccgccgcccccaccctgagaagcgagctggagctgaccctgggcaagctggagcaggtgagaagcctgagcgccatctacctggagaagctgaagaccatcagcctggtgatcagaggcacccagggcgccgaggaggtgctgagagcccacgaggagcagctgaaggaggcccaggccgtgcccgccaccctgcccgagctggaggccaccaaggccagcctgaagaagctgagagcccaggccgaggcccagcagcccaccttcgacgccctgagagacgagctgagaggcgcccaggaggtgggcgagagactgcagcagagacacggcgagagagacgtggaggtggagagatggagagagagagtggcccagctgctggagagatggcaggccgtgctggcccagaccgacgtgagacagagagagctggagcagctgggcagacagctgagatactacagagagagcgccgaccccctgggcgcctggctgcaggacgccagaagaagacaggagcagatccaggccatgcccctggccgacagccaggccgtgagagagcagctgagacaggagcaggccctgctggaggagatcgagagacacggcgagaaggtggaggagtgccagagattcgccaagcagtacatcaacgccatcaaggactacgagctgcagctggtgacctacaaggcccagctggagcccgtggccagccccgccaagaagcccaaggtgcagagcggcagcgagagcgtgatccaggagtacgtggacctgagaacccactacagcgagctgaccaccctgaccagccagtacatcaagttcatcagcgagaccctgagaagaatggaggaggaggagagactggccgagcagcagagagccgaggagagagagagactggccgaggtggaggccgccctggagaagcagagacagctggccgaggcccacgcccaggccaaggcccaggccgagagagaggccaaggagctgcagcagagaatgcaggaggaggtggtgagaagagaggaggccgccgtggacgcccagcagcagaagagaagcatccaggaggagctgcagcagctgagacagagcagcgaggccgagatccaggccaaggccagacaggccgaggccgccgagagaagcagactgagaatcgaggaggagatcagagtggtgagactgcagctggaggccaccgagagacagagaggcggcgccgagggcgagctgcaggccctgagagccagagccgaggaggccgaggcccagaagagacaggcccaggaggaggccgagagactgagaagacaggtgcaggacgagagccagagaaagagacaggccgaggtggagctggccagcagagtgaaggccgaggccgaggccgccagagagaagcagagagccctgcaggccctggaggagctgagactgcaggccgaggaggccgagagaagactgagacaggccgaggtggagagagccagacaggtgcaggtggccctggagaccgcccagagaagcgccgaggccgagctgcagagcaagagagccagcttcgccgagaagaccgcccagctggagagaagcctgcaggaggagcacgtggccgtggcccagctgagagaggaggccgagagaagagcccagcagcaggccgaggccgagagagccagagaggaggccgagagagagctggagagatggcagctgaaggccaacgaggccctgagactgagactgcaggccgaggaggtggcccagcagaagagcctggcccaggccgaggccgagaagcagaaggaggaggccgagagagaggccagaagaagaggcaaggccgaggagcaggccgtgagacagagagagctggccgagcaggagctggagaagcagagacagctggccgagggcaccgcccagcagagactggccgccgagcaggagctgatcagactgagagccgagaccgagcagggcgagcagcagagacagctgctggaggaggagctggccagactgcagagagaggccgccgccgccacccagaagagacaggagctggaggccgagctggccaaggtgagagccgagatggaggtgctgctggccagcaaggccagagccgaggaggagagcagaagcaccagcgagaagagcaagcagagactggaggccgaggccggcagattcagagagctggccgaggaggccgccagactgagagccctggccgaggaggccaagagacagagacagctggccgaggaggacgccgccagacagagagccgaggccgagagagtgctggccgagaagctggccgccatcggcgaggccaccagactgaagaccgaggccgagatcgccctgaaggagaaggaggccgagaacgagagactgagaagactggccgaggacgaggccttccagagaagaagactggaggagcaggccgcccagcacaaggccgacatcgaggagagactggcccagctgagaaaggccagcgacagcgagctggagagacagaagggcctggtggaggacaccctgagacagagaagacaggtggaggaggagatcctggccctgaaggccagcttcgagaaggccgccgccggcaaggccgagctggagctggagctgggcagaatcagaagcaacgccgaggacaccctgagaagcaaggagcaggccgagctggaggccgccagacagagacagctggccgccgaggaggagagaagaagaagagaggccgaggagagagtgcagaagagcctggccgccgaggaggaggccgccagacagagaaaggccgccctggaggaggtggagagactgaaggccaaggtggaggaggccagaagactgagagagagagccgagcaggagagcgccagacagctgcagctggcccaggaggccgcccagaagagactgcaggccgaggagaaggcccacgccttcgccgtgcagcagaaggagcaggagctgcagcagaccctgcagcaggagcagagcgtgctggaccagctgagaggcgaggccgaggccgccagaagagccgccgaggaggccgaggaggccagagtgcaggccgagagagaggccgcccagagcagaagacaggtggaggaggccgagagactgaagcagagcgccgaggagcaggcccaggccagagcccaggcccaggccgccgccgagaagctgagaaaggaggccgagcaggaggccgccagaagagcccaggccgagcaggccgccctgagacagaagcaggccgccgacgccgagatggagaagcacaagaagttcgccgagcagaccctgagacagaaggcccaggtggagcaggagctgaccaccctgagactgcagctggaggagaccgaccaccagaagaacctgctggacgaggagctgcagagactgaaggccgaggccaccgaggccgccagacagagaagccaggtggaggaggagctgttcagcgtgagagtgcagatggaggagctgagcaagctgaaggccagaatcgaggccgagaacagagccctgatcctgagagacaaggacaacacccagagattcctgcaggaggaggccgagaagatgaagcaggtggccgaggaggccgccagactgagcgtggccgcccaggaggccgccagactgagacagctggccgaggaggacctggcccagcagagagccctggccgagaagatgctgaaggagaagatgcaggccgtgcaggaggccaccagactgaaggccgaggccgagctgctgcagcagcagaaggagctggcccaggagcaggccagaagactgcaggaggacaaggagcagatggcccagcagctggccgaggagacccagggcttccagagaaccctggaggccgagagacagagacagctggagatgagcgccgaggccgagagactgaagctgagagtggccgagatgagcagagcccaggccagagccgaggaggacgcccagagattcagaaagcaggccgaggagatcggcgagaagctgcacagaaccgagctggccacccaggagaaggtgaccctggtgcagaccctggagatccagagacagcagagcgaccacgacgccgagagactgagagaggccatcgccgagctggagagagagaaggagaagctgcagcaggaggccaagctgctgcagctgaagagcgaggagatgcagaccgtgcagcaggagcagctgctgcaggagacccaggccctgcagcagagcttcctgagcgagaaggacagcctgctgcagagagagagattcatcgagcaggagaaggccaagctggagcagctgttccaggacgaggtggccaaggcccagcagctgagagaggagcagcagagacagcagcagcagatggagcaggagagacagagactggtggccagcatggaggaggccagaagaagacagcacgaggccgaggagggcgtgagaagaaagcaggaggagctgcagcagctggagcagcagagaagacagcaggaggagctgctggccgaggagaaccagagactgagagagcagctgcagctgctggaggagcagcacagagccgccctggcccacagcgaggaggtgaccgccagccaggtggccgccaccaagaccctgcccaacggcagagacgccctggacggccccgccgccgaggccgagcccgagcacagcttcgacggcctgagaagaaaggtgagcgcccagagactgcaggaggccggcatcctgagcgccgaggagctgcagagactggcccagggccacaccaccgtggacgagctggccagaagagaggacgtgagacactacctgcagggcagaagcagcatcgccggcctgctgctgaaggccaccaacgagaagctgagcgtgtacgccgccctgcagagacagctgctgagccccggcaccgccctgatcctgctggaggcccaggccgccagcggcttcctgctggaccccgtgagaaacagaagactgaccgtgaacgaggccgtgaaggagggcgtggtgggccccgagctgcaccacaagctgctgagcgccgagagagccgtgaccggctacaaggacccctacaccggccagcagatcagcctgttccaggccatgcagaagggcctgatcgtgagagagcacggcatcagactgctggaggcccagatcgccaccggcggcgtgatcgaccccgtgcacagccacagagtgcccgtggacgtggcctacagaagaggctacttcgacgaggagatgaacagagtgctggccgaccccagcgacgacaccaagggcttcttcgaccccaacacccacgagaacctgacctacctgcagctgctggagagatgcgtggaggaccccgagaccggcctgtgcctgctgcccctgaccgacaaggccgccaagggcggcgagctggtgtacaccgacagcgaggccagagacgtgttcgagaaggccaccgtgagcgcccccttcggcaagttccagggcaagaccgtgaccatctgggagatcatcaacagcgagtacttcaccgccgagcagagaagagacctgctgagacagttcagaaccggcagaatcaccgtggagaagatcatcaagatcatcatcaccgtggtggaggagcaggagcagaagggcagactgtgcttcgagggcctgagaagcctggtgcccgccgccgagctgctggagagcagagtgatcgacagagagctgtaccagcagctgcagagaggcgagagaagcgtgagagacgtggccgaggtggacaccgtgagaagagccctgagaggcgccaacgtgatcgccggcgtgtggctggaggaggccggccagaagctgagcatctacaacgccctgaagaaggacctgctgcccagcgacatggccgtggccctgctggaggcccaggccggcaccggccacatcatcgaccccgccaccagcgccagactgaccgtggacgaggccgtgagagccggcctggtgggccccgagttccacgagaagctgctgagcgccgagaaggccgtgaccggctacagagacccctacaccggccagagcgtgagcctgttccaggccctgaagaagggcctgatccccagagagcagggcctgagactgctggacgcccagctgagcaccggcggcatcgtggaccccagcaagagccacagagtgcccctggacgtggcctgcgccagaggctgcctggacgaggagaccagcagagccctgagcgcccccagagccgacgccaaggcctacagcgaccccagcaccggcgagcccgccacctacggcgagctgcagcagagatgcagacccgaccagctgaccggcctgagcctgctgcccctgagcgagaaggccgccagagccagacaggaggagctgtacagcgagctgcaggccagagagaccttcgagaagacccccgtggaggtgcccgtgggcggcttcaagggcagaaccgtgaccgtgtgggagctgatcagcagcgagtacttcaccgccgagcagagacaggagctgctgagacagttcagaaccggcaaggtgaccgtggagaaggtgatcaagatcctgatcaccatcgtggaggaggtggagaccctgagacaggagagactgagcttcagcggcctgagagcccccgtgcccgccagcgagctgctggccagcggcgtgctgagcagagcccagttcgagcagctgaaggacggcaagaccaccgtgaaggacctgagcgagctgggcagcgtgagaaccctgctgcagggcagcggctgcctggccggcatctacctggaggacaccaaggagaaggtgagcatctacgaggccatgagaagaggcctgctgagagccaccaccgccgccctgctgctggaggcccaggccgccaccggcttcctggtggaccccgtgagaaaccagagactgtacgtgcacgaggccgtgaaggccggcgtggtgggccccgagctgcacgagcagctgctgagcgccgagaaggccgtgaccggctacagagacccctacagcggcagcaccatcagcctgttccaggccatgcagaagggcctggtgctgagacagcacggcatcagactgctggaggcccagatcgccaccggcggcatcatcgaccccgtgcacagccacagagtgcccgtggacgtggcctaccagagaggctacttcagcgaggagatgaacagagtgctggccgaccccagcgacgacaccaagggcttcttcgaccccaacacccacgagaacctgacctacagacagctgctggagagatgcgtggaggaccccgagaccggcctgagactgctgcccctgaagggcgccgagaaggccgaggtggtggagaccacccaggtgtacaccgaggaggagaccagaagagccttcgaggagacccagatcgacatccccggcggcggcagccacggcggcagcaccatgagcctgtgggaggtgatgcagagcgacctgatccccgaggagcagagagcccagctgatggccgacttccaggccggcagagtgaccaaggagagaatgatcatcatcatcatcgagatcatcgagaagaccgagatcatcagacagcagggcctggccagctacgactacgtgagaagaagactgaccgccgaggacctgttcgaggccagaatcatcagcctggagacctacaacctgctgagagagggcaccagaagcctgagagaggccctggaggccgagagcgcctggtgctacctgtacggcaccggcagcgtggccggcgtgtacctgcccggcagcagacagaccctgagcatctaccaggccctgaagaagggcctgctgagcgccgaggtggccagactgctgctggaggcccaggccgccaccggcttcctgctggaccccgtgaagggcgagagactgaccgtggacgaggccgtgagaaagggcctggtgggccccgagctgcacgacagactgctgagcgccgagagagccgtgaccggctacagagacccctacaccgagcagaccatcagcctgttccaggccatgaagaaggagctgatccccaccgaggaggccctgagactgctggacgcccagctggccaccggcggcatcgtggaccccagactgggcttccacctgcccctggaggtggcctaccagagaggctacctgaacaaggacacccacgaccagctgagcgagcccagcgaggtgagaagctacgtggaccccagcaccgacgagagactgagctacacccagctgctgagaagatgcagaagagacgacggcaccggccagctgctgctgcccctgagcgacgccagaaagctgaccttcagaggcctgagaaagcagatcaccatggaggagctggtgagaagccaggtgatggacgaggccaccgccctgcagctgagagagggcctgaccagcatcgaggaggtgaccaagaacctgcagaagttcctggagggcaccagctgcatcgccggcgtgttcgtggacgccaccaaggagagactgagcgtgtaccaggccatgaagaagggcatcatcagacccggcaccgccttcgagctgctggaggcccaggccgccaccggctacgtgatcgaccccatcaagggcctgaagctgaccgtggaggaggccgtgagaatgggcatcgtgggccccgagttcaaggacaagctgctgagcgccgagagagccgtgaccggctacaaggacccctacagcggcaagctgatcagcctgttccaggccatgaagaagggcctgatcctgaaggaccacggcatcagactgctggaggcccagatcgccaccggcggcatcatcgaccccgaggagagccacagactgcccgtggaggtggcctacaagagaggcctgttcgacgaggagatgaacgagatcctgaccgaccccagcgacgacaccaagggcttcttcgaccccaacaccgaggagaacctgacctacctgcagctgatggagagatgcatcaccgacccccagaccggcctgtgcctgctgcccctgaaggagaagaagagagagagaaagaccagcagcaagagcagcgtgagaaagagaagagtggtgatcgtggaccccgagaccggcaaggagatgagcgtgtacgaggcctacagaaagggcctgatcgaccaccagacctacctggagctgagcgagcaggagtgcgagtgggaggagatcaccatcagcagcagcgacggcgtggtgaagagcatgatcatcgacagaagaagcggcagacagtacgacatcgacgacgccatcgccaagaacctgatcgacagaagcgccctggaccagtacagagccggcaccctgagcatcaccgagttcgccgacatgctgagcggcaacgccggcggcttcagaagcagaagcagcagcgtgggcagcagcagcagctaccccatcagccccgccgtgagcagaacccagctggccagctggagcgaccccaccgaggagaccggccccgtggccggcatcctggacaccgagaccctggagaaggtgagcatcaccgaggccatgcacagaaacctggtggacaacatcaccggccagagactgctggaggcccaggcctgcaccggcggcatcatcgaccccagcaccggcgagagattccccgtgaccgacgccgtgaacaagggcctggtggacaagatcatggtggacagaatcaacctggcccagaaggccttctgcggcttcgaggaccccagaaccaagaccaagatgagcgccgcccaggccctgaagaagggctggctgtactacgaggccggccagagattcctggaggtgcagtacctgaccggcggcctgatcgagcccgacacccccggcagagtgcccctggacgaggccctgcagagaggcaccgtggacgccagaaccgcccagaagctgagagacgtgggcgcctacagcaagtacctgacctgccccaagaccaagctgaagatcagctacaaggacgccctggacagaagcatggtggaggagggcaccggcctgagactgctggaggccgccgcccagagcaccaagggctactacagcccctacagcgtgagcggcagcggcagcaccgccggcagcagaaccggcagcagaaccggcagcagagccggcagcagaagaggcagcttcgacgccaccggcagcggcttcagcatgaccttcagcagcagcagctacagcagcagcggctacggcagaagatacgccagcggcagcagcgccagcctgggcggccccgagagcgccgtggcctag

SEQ ID NO: 93621 - DNA, 13725 bp, Artificial Sequence
  Description of Artificial Sequence: Synthetic coding sequence
atgagcggcgaggacgccgaggtgagagccgtgagcgaggacgtgagcaacggcagcagcggcagccccagccccggcgacaccctgccctggaacctgggcaagacccagagaagcagaagaagcggcggcggcgccggcagcaacggcagcgtgctggaccccgccgagagagccgtgatcagaatcgccgacgagagagacagagtgcagaagaagaccttcaccaagtgggtgaacaagcacctgatcaaggcccagagacacatcagcgacctgtacgaggacctgagagacggccacaacctgatcagcctgctggaggtgctgagcggcgacagcctgcccagagagaagggcagaatgagattccacaagctgcagaacgtgcagatcgccctggactacctgagacacagacaggtgaagctggtgaacatcagaaacgacgacatcgccgacggcaaccccaagctgaccctgggcctgatctggaccatcatcctgcacttccagatcagcgacatccaggtgagcggccagagcgaggacatgaccgccaaggagaagctgctgctgtggagccagagaatggtggagggctaccagggcctgagatgcgacaacttcaccagcagctggagagacggcagactgttcaacgccatcatccacagacacaagcccctgctgatcgacatgaacaaggtgtacagacagaccaacctggagaacctggaccaggccttcagcgtggccgagagagacctgggcgtgaccagactgctggaccccgaggacgtggacgtgccccagcccgacgagaagagcatcatcacctacgtgagcagcctgtacgacgccatgcccagagtgcccgacgtgcaggacggcgtgagagccaacgagctgcagctgagatggcaggagtacagagagctggtgctgctgctgctgcagtggatgagacaccacaccgccgccttcgaggagagaagattccccagcagcttcgaggagatcgagatcctgtggagccagttcctgaagttcaaggagatggagctgcccgccaaggaggccgacaagaacagaagcaagggcatctaccagagcctggagggcgccgtgcaggccggccagctgaaggtgccccccggctaccaccccctggacgtggagaaggagtggggcaagctgcacgtggccatcctggagagagagaagcagctgagaagcgagttcgagagactggagtgcctgcagagaatcgtgaccaagctgcagatggaggccggcctgtgcgaggagcagctgaaccaggccgacgccctgctgcagagcgacgtgagactgctggccgccggcaaggtgccccagagagccggcgaggtggagagagacctggacaaggccgacagcatgatcagactgctgttcaacgacgtgcagaccctgaaggacggcagacacccccagggcgagcagatgtacagaagagtgtacagactgcacgagagactggtggccatcagaaccgagtacaacctgagactgaaggccggcgtggccgcccccgccacccaggtggcccaggtgaccctgcagagcgtgcagagaagacccgagctggaggacagcaccctgagatacctgcaggacctgctggcctgggtggaggagaaccagcacagagtggacggcgccgagtggggcgtggacctgcccagcgtggaggcccagctgggcagccacagaggcctgcaccagagcatcgaggagttcagagccaagatcgagagagccagaagcgacgagggccagctgagccccgccaccagaggcgcctacagagactgcctgggcagactggacctgcagtacgccaagctgctgaacagcagcaaggccagactgagaagcctggagagcctgcacagcttcgtggccgccgccaccaaggagctgatgtggctgaacgagaaggaggaggaggaggtgggcttcgactggagcgacagaaacaccaacatgaccgccaagaaggagagctacagcgccctgatgagagagctggagctgaaggagaagaagatcaaggagctgcagaacgccggcgacagactgctgagagaggaccaccccgccagacccaccgtggagagcttccaggccgccctgcagacccagtggagctggatgctgcagctgtgctgctgcatcgaggcccacctgaaggagaacgccgcctacttccagttcttcagcgacgtgagagaggccgagggccagctgcagaagctgcaggaggccctgagaagaaagtacagctgcgacagaagcgccaccgtgaccagactggaggacctgctgcaggacgcccaggacgagaaggagcagctgaacgagtacaagggccacctgagcggcctggccaagagagccaaggccgtggtgcagctgaagcccagacaccccgcccaccccatgagaggcagactgcccctgctggccgtgtgcgactacaagcaggtggaggtgaccgtgcacaagggcgacgagtgccagctggtgggccccgcccagcccagccactggaaggtgctgagcagcagcggcagcgaggccgccgtgcccagcgtgtgcttcctggtgcccccccccaaccaggaggcccaggaggccgtgaccagactggaggcccagcaccaggccctggtgaccctgtggcaccagctgcacgtggacatgaagagcctgctggcctggcagagcctgagaagagacgtgcagctgatcagaagctggagcctggccaccttcagaaccctgaagcccgaggagcagagacaggccctgcacagcctggagctgcactaccaggccttcctgagagacagccaggacgccggcggcttcggccccgaggacagactgatggccgagagagagtacggcagctgcagccaccactaccagcagctgctgcagagcctggagcagggcgcccaggaggagagcagatgccagagatgcatcagcgagctgaaggacatcagactgcagctggaggcctgcgagaccagaaccgtgcacagactgagactgcccctggacaaggagcccgccagagagtgcgcccagagaatcgccgagcagcagaaggcccaggccgaggtggagggcctgggcaagggcgtggccagactgagcgccgaggccgagaaggtgctggccctgcccgagcccagccccgccgcccccaccctgagaagcgagctggagctgaccctgggcaagctggagcaggtgagaagcctgagcgccatctacctggagaagctgaagaccatcagcctggtgatcagaggcacccagggcgccgaggaggtgctgagagcccacgaggagcagctgaaggaggcccaggccgtgcccgccaccctgcccgagctggaggccaccaaggccagcctgaagaagctgagagcccaggccgaggcccagcagcccaccttcgacgccctgagagacgagctgagaggcgcccaggaggtgggcgagagactgcagcagagacacggcgagagagacgtggaggtggagagatggagagagagagtggcccagctgctggagagatggcaggccgtgctggcccagaccgacgtgagacagagagagctggagcagctgggcagacagctgagatactacagagagagcgccgaccccctgggcgcctggctgcaggacgccagaagaagacaggagcagatccaggccatgcccctggccgacagccaggccgtgagagagcagctgagacaggagcaggccctgctggaggagatcgagagacacggcgagaaggtggaggagtgccagagattcgccaagcagtacatcaacgccatcaaggactacgagctgcagctggtgacctacaaggcccagctggagcccgtggccagccccgccaagaagcccaaggtgcagagcggcagcgagagcgtgatccaggagtacgtggacctgagaacccactacagcgagctgaccaccctgaccagccagtacatcaagttcatcagcgagaccctgagaagaatggaggaggaggagagactggccgagcagcagagagccgaggagagagagagactggccgaggtggaggccgccctggagaagcagagacagctggccgaggcccacgcccaggccaaggcccaggccgagagagaggccaaggagctgcagcagagaatgcaggaggaggtggtgagaagagaggaggccgccgtggacgcccagcagcagaagagaagcatccaggaggagctgcagcagctgagacagagcagcgaggccgagatccaggccaaggccagacaggccgaggccgccgagagaagcagactgagaatcgaggaggagatcagagtggtgagactgcagctggaggccaccgagagacagagaggcggcgccgagggcgagctgcaggccctgagagccagagccgaggaggccgaggcccagaagagacaggcccaggaggaggccgagagactgagaagacaggtgcaggacgagagccagagaaagagacaggccgaggtggagctggccagcagagtgaaggccgaggccgaggccgccagagagaagcagagagccctgcaggccctggaggagctgagactgcaggccgaggaggccgagagaagactgagacaggccgaggtggagagagccagacaggtgcaggtggccctggagaccgcccagagaagcgccgaggccgagctgcagagcaagagagccagcttcgccgagaagaccgcccagctggagagaagcctgcaggaggagcacgtggccgtggcccagctgagagaggaggccgagagaagagcccagcagcaggccgaggccgagagagccagagaggaggccgagagagagctggagagatggcagctgaaggccaacgaggccctgagactgagactgcaggccgaggaggtggcccagcagaagagcctggcccaggccgaggccgagaagcagaaggaggaggccgagagagaggccagaagaagaggcaaggccgaggagcaggccgtgagacagagagagctggccgagcaggagctggagaagcagagacagctggccgagggcaccgcccagcagagactggccgccgagcaggagctgatcagactgagagccgagaccgagcagggcgagcagcagagacagctgctggaggaggagctggccagactgcagagagaggccgccgccgccacccagaagagacaggagctggaggccgagctggccaaggtgagagccgagatggaggtgctgctggccagcaaggccagagccgaggaggagagcagaagcaccagcgagaagagcaagcagagactggaggccgaggccggcagattcagagagctggccgaggaggccgccagactgagagccctggccgaggaggccaagagacagagacagctggccgaggaggacgccgccagacagagagccgaggccgagagagtgctggccgagaagctggccgccatcggcgaggccaccagactgaagaccgaggccgagatcgccctgaaggagaaggaggccgagaacgagagactgagaagactggccgaggacgaggccttccagagaagaagactggaggagcaggccgcccagcacaaggccgacatcgaggagagactggcccagctgagaaaggccagcgacagcgagctggagagacagaagggcctggtggaggacaccctgagacagagaagacaggtggaggaggagatcctggccctgaaggccagcttcgagaaggccgccgccggcaaggccgagctggagctggagctgggcagaatcagaagcaacgccgaggacaccctgagaagcaaggagcaggccgagctggaggccgccagacagagacagctggccgccgaggaggagagaagaagaagagaggccgaggagagagtgcagaagagcctggccgccgaggaggaggccgccagacagagaaaggccgccctggaggaggtggagagactgaaggccaaggtggaggaggccagaagactgagagagagagccgagcaggagagcgccagacagctgcagctggcccaggaggccgcccagaagagactgcaggccgaggagaaggcccacgccttcgccgtgcagcagaaggagcaggagctgcagcagaccctgcagcaggagcagagcgtgctggaccagctgagaggcgaggccgaggccgccagaagagccgccgaggaggccgaggaggccagagtgcaggccgagagagaggccgcccagagcagaagacaggtggaggaggccgagagactgaagcagagcgccgaggagcaggcccaggccagagcccaggcccaggccgccgccgagaagctgagaaaggaggccgagcaggaggccgccagaagagcccaggccgagcaggccgccctgagacagaagcaggccgccgacgccgagatggagaagcacaagaagttcgccgagcagaccctgagacagaaggcccaggtggagcaggagctgaccaccctgagactgcagctggaggagaccgaccaccagaagaacctgctggacgaggagctgcagagactgaaggccgaggccaccgaggccgccagacagagaagccaggtggaggaggagctgttcagcgtgagagtgcagatggaggagctgagcaagctgaaggccagaatcgaggccgagaacagagccctgatcctgagagacaaggacaacacccagagattcctgcaggaggaggccgagaagatgaagcaggtggccgaggaggccgccagactgagcgtggccgcccaggaggccgccagactgagacagctggccgaggaggacctggcccagcagagagccctggccgagaagatgctgaaggagaagatgcaggccgtgcaggaggccaccagactgaaggccgaggccgagctgctgcagcagcagaaggagctggcccaggagcaggccagaagactgcaggaggacaaggagcagatggcccagcagctggccgaggagacccagggcttccagagaaccctggaggccgagagacagagacagctggagatgagcgccgaggccgagagactgaagctgagagtggccgagatgagcagagcccaggccagagccgaggaggacgcccagagattcagaaagcaggccgaggagatcggcgagaagctgcacagaaccgagctggccacccaggagaaggtgaccctggtgcagaccctggagatccagagacagcagagcgaccacgacgccgagagactgagagaggccatcgccgagctggagagagagaaggagaagctgcagcaggaggccaagctgctgcagctgaagagcgaggagatgcagaccgtgcagcaggagcagctgctgcaggagacccaggccctgcagcagagcttcctgagcgagaaggacagcctgctgcagagagagagattcatcgagcaggagaaggccaagctggagcagctgttccaggacgaggtggccaaggcccagcagctgagagaggagcagcagagacagcagcagcagatggagcaggagagacagagactggtggccagcatggaggaggccagaagaagacagcacgaggccgaggagggcgtgagaagaaagcaggaggagctgcagcagctggagcagcagagaagacagcaggaggagctgctggccgaggagaaccagagactgagagagcagctgcagctgctggaggagcagcacagagccgccctggcccacagcgaggaggtgaccgccagccaggtggccgccaccaagaccctgcccaacggcagagacgccctggacggccccgccgccgaggccgagcccgagcacagcttcgacggcctgagaagaaaggtgagcgcccagagactgcaggaggccggcatcctgagcgccgaggagctgcagagactggcccagggccacaccaccgtggacgagctggccagaagagaggacgtgagacactacctgcagggcagaagcagcatcgccggcctgctgctgaaggccaccaacgagaagctgagcgtgtacgccgccctgcagagacagctgctgagccccggcaccgccctgatcctgctggaggcccaggccgccagcggcttcctgctggaccccgtgagaaacagaagactgaccgtgaacgaggccgtgaaggagggcgtggtgggccccgagctgcaccacaagctgctgagcgccgagagagccgtgaccggctacaaggacccctacaccggccagcagatcagcctgttccaggccatgcagaagggcctgatcgtgagagagcacggcatcagactgctggaggcccagatcgccaccggcggcgtgatcgaccccgtgcacagccacagagtgcccgtggacgtggcctacagaagaggctacttcgacgaggagatgaacagagtgctggccgaccccagcgacgacaccaagggcttcttcgaccccaacacccacgagaacctgacctacctgcagctgctggagagatgcgtggaggaccccgagaccggcctgtgcctgctgcccctgaccgacaaggccgccaagggcggcgagctggtgtacaccgacagcgaggccagagacgtgttcgagaaggccaccgtgagcgcccccttcggcaagttccagggcaagaccgtgaccatctgggagatcatcaacagcgagtacttcaccgccgagcagagaagagacctgctgagacagttcagaaccggcagaatcaccgtggagaagatcatcaagatcatcatcaccgtggtggaggagcaggagcagaagggcagactgtgcttcgagggcctgagaagcctggtgcccgccgccgagctgctggagagcagagtgatcgacagagagctgtaccagcagctgcagagaggcgagagaagcgtgagagacgtggccgaggtggacaccgtgagaagagccctgagaggcgccaacgtgatcgccggcgtgtggctggaggaggccggccagaagctgagcatctacaacgccctgaagaaggacctgctgcccagcgacatggccgtggccctgctggaggcccaggccggcaccggccacatcatcgaccccgccaccagcgccagactgaccgtggacgaggccgtgagagccggcctggtgggccccgagttccacgagaagctgctgagcgccgagaaggccgtgaccggctacagagacccctacaccggccagagcgtgagcctgttccaggccctgaagaagggcctgatccccagagagcagggcctgagactgctggacgcccagctgagcaccggcggcatcgtggaccccagcaagagccacagagtgcccctggacgtggcctgcgccagaggctgcctggacgaggagaccagcagagccctgagcgcccccagagccgacgccaaggcctacagcgaccccagcaccggcgagcccgccacctacggcgagctgcagcagagatgcagacccgaccagctgaccggcctgagcctgctgcccctgagcgagaaggccgccagagccagacaggaggagctgtacagcgagctgcaggccagagagaccttcgagaagacccccgtggaggtgcccgtgggcggcttcaagggcagaaccgtgaccgtgtgggagctgatcagcagcgagtacttcaccgccgagcagagacaggagctgctgagacagttcagaaccggcaaggtgaccgtggagaaggtgatcaagatcctgatcaccatcgtggaggaggtggagaccctgagacaggagagactgagcttcagcggcctgagagcccccgtgcccgccagcgagctgctggccagcggcgtgctgagcagagcccagttcgagcagctgaaggacggcaagaccaccgtgaaggacctgagcgagctgggcagcgtgagaaccctgctgcagggcagcggctgcctggccggcatctacctggaggacaccaaggagaaggtgagcatctacgaggccatgagaagaggcctgctgagagccaccaccgccgccctgctgctggaggcccaggccgccaccggcttcctggtggaccccgtgagaaaccagagactgtacgtgcacgaggccgtgaaggccggcgtggtgggccccgagctgcacgagcagctgctgagcgccgagaaggccgtgaccggctacagagacccctacagcggcagcaccatcagcctgttccaggccatgcagaagggcctggtgctgagacagcacggcatcagactgctggaggcccagatcgccaccggcggcatcatcgaccccgtgcacagccacagagtgcccgtggacgtggcctaccagagaggctacttcagcgaggagatgaacagagtgctggccgaccccagcgacgacaccaagggcttcttcgaccccaacacccacgagaacctgacctacagacagctgctggagagatgcgtggaggaccccgagaccggcctgagactgctgcccctgaagggcgccgagaaggccgaggtggtggagaccacccaggtgtacaccgaggaggagaccagaagagccttcgaggagacccagatcgacatccccggcggcggcagccacggcggcagcaccatgagcctgtgggaggtgatgcagagcgacctgatccccgaggagcagagagcccagctgatggccgacttccaggccggcagagtgaccaaggagagaatgatcatcatcatcatcgagatcatcgagaagaccgagatcatcagacagcagggcctggccagctacgactacgtgagaagaagactgaccgccgaggacctgttcgaggccagaatcatcagcctggagacctacaacctgctgagagagggcaccagaagcctgagagaggccctggaggccgagagcgcctggtgctacctgtacggcaccggcagcgtggccggcgtgtacctgcccggcagcagacagaccctgagcatctaccaggccctgaagaagggcctgctgagcgccgaggtggccagactgctgctggaggcccaggccgccaccggcttcctgctggaccccgtgaagggcgagagactgaccgtggacgaggccgtgagaaagggcctggtgggccccgagctgcacgacagactgctgagcgccgagagagccgtgaccggctacagagacccctacaccgagcagaccatcagcctgttccaggccatgaagaaggagctgatccccaccgaggaggccctgagactgctggacgcccagctggccaccggcggcatcgtggaccccagactgggcttccacctgcccctggaggtggcctaccagagaggctacctgaacaaggacacccacgaccagctgagcgagcccagcgaggtgagaagctacgtggaccccagcaccgacgagagactgagctacacccagctgctgagaagatgcagaagagacgacggcaccggccagctgctgctgcccctgagcgacgccagaaagctgaccttcagaggcctgagaaagcagatcaccatggaggagctggtgagaagccaggtgatggacgaggccaccgccctgcagctgagagagggcctgaccagcatcgaggaggtgaccaagaacctgcagaagttcctggagggcaccagctgcatcgccggcgtgttcgtggacgccaccaaggagagactgagcgtgtaccaggccatgaagaagggcatcatcagacccggcaccgccttcgagctgctggaggcccaggccgccaccggctacgtgatcgaccccatcaagggcctgaagctgaccgtggaggaggccgtgagaatgggcatcgtgggccccgagttcaaggacaagctgctgagcgccgagagagccgtgaccggctacaaggacccctacagcggcaagctgatcagcctgttccaggccatgaagaagggcctgatcctgaaggaccacggcatcagactgctggaggcccagatcgccaccggcggcatcatcgaccccgaggagagccacagactgcccgtggaggtggcctacaagagaggcctgttcgacgaggagatgaacgagatcctgaccgaccccagcgacgacaccaagggcttcttcgaccccaacaccgaggagaacctgacctacctgcagctgatggagagatgcatcaccgacccccagaccggcctgtgcctgctgcccctgaaggagaagaagagagagagaaagaccagcagcaagagcagcgtgagaaagagaagagtggtgatcgtggaccccgagaccggcaaggagatgagcgtgtacgaggcctacagaaagggcctgatcgaccaccagacctacctggagctgagcgagcaggagtgcgagtgggaggagatcaccatcagcagcagcgacggcgtggtgaagagcatgatcatcgacagaagaagcggcagacagtacgacatcgacgacgccatcgccaagaacctgatcgacagaagcgccctggaccagtacagagccggcaccctgagcatcaccgagttcgccgacatgctgagcggcaacgccggcggcttcagaagcagaagcagcagcgtgggcagcagcagcagctaccccatcagccccgccgtgagcagaacccagctggccagctggagcgaccccaccgaggagaccggccccgtggccggcatcctggacaccgagaccctggagaaggtgagcatcaccgaggccatgcacagaaacctggtggacaacatcaccggccagagactgctggaggcccaggcctgcaccggcggcatcatcgaccccagcaccggcgagagattccccgtgaccgacgccgtgaacaagggcctggtggacaagatcatggtggacagaatcaacctggcccagaaggccttctgcggcttcgaggaccccagaaccaagaccaagatgagcgccgcccaggccctgaagaagggctggctgtactacgaggccggccagagattcctggaggtgcagtacctgaccggcggcctgatcgagcccgacacccccggcagagtgcccctggacgaggccctgcagagaggcaccgtggacgccagaaccgcccagaagctgagagacgtgggcgcctacagcaagtacctgacctgccccaagaccaagctgaagatcagctacaaggacgccctggacagaagcatggtggaggagggcaccggcctgagactgctggaggccgccgcccagagcaccaagggctactacagcccctacagcgtgagcggcagcggcagcaccgccggcagcagaaccggcagcagaaccggcagcagagccggcagcagaagaggcagcttcgacgccaccggcagcggcttcagcatgaccttcagcagcagcagctacagcagcagcggctacggcagaagatacgccagcggcagcagcgccagcctgggcggccccgagagcgccgtggcctag

SEQ ID NO: 93622 - DNA, 13713 bp, Artificial Sequence
  Description of Artificial Sequence: Synthetic coding sequence
atgagcggcgaggacgccgaggtgagagccgtgagcgaggacgtgagcaacggcagcagcggcagccccagccccggcgacaccctgccctggaacctgggcaagacccagagaagcagaagaagcggcggcggcgccggcagcaacggcagcgtgctggaccccgccgagagagccgtgatcagaatcgccgacgagagagacagagtgcagaagaagaccttcaccaagtgggtgaacaagcacctgatcaaggcccagagacacatcagcgacctgtacgaggacctgagagacggccacaacctgatcagcctgctggaggtgctgagcggcgacagcctgcccagagagaagggcagaatgagattccacaagctgcagaacgtgcagatcgccctggactacctgagacacagacaggtgaagctggtgaacatcagaaacgacgacatcgccgacggcaaccccaagctgaccctgggcctgatctggaccatcatcctgcacttccagatcagcgacatccaggtgagcggccagagcgaggacatgaccgccaaggagaagctgctgctgtggagccagagaatggtggagggctaccagggcctgagatgcgacaacttcaccagcagctggagagacggcagactgttcaacgccatcatccacagacacaagcccctgctgatcgacatgaacaaggtgtacagacagaccaacctggagaacctggaccaggccttcagcgtggccgagagagacctgggcgtgaccagactgctggaccccgaggacgtggacgtgccccagcccgacgagaagagcatcatcacctacgtgagcagcctgtacgacgccatgcccagagtgcccgacgtgcaggacggcgagctgcagctgagatggcaggagtacagagagctggtgctgctgctgctgcagtggatgagacaccacaccgccgccttcgaggagagaagattccccagcagcttcgaggagatcgagatcctgtggagccagttcctgaagttcaaggagatggagctgcccgccaaggaggccgacaagaacagaagcaagggcatctaccagagcctggagggcgccgtgcaggccggccagctgaaggtgccccccggctaccaccccctggacgtggagaaggagtggggcaagctgcacgtggccatcctggagagagagaagcagctgagaagcgagttcgagagactggagtgcctgcagagaatcgtgaccaagctgcagatggaggccggcctgtgcgaggagcagctgaaccaggccgacgccctgctgcagagcgacgtgagactgctggccgccggcaaggtgccccagagagccggcgaggtggagagagacctggacaaggccgacagcatgatcagactgctgttcaacgacgtgcagaccctgaaggacggcagacacccccagggcgagcagatgtacagaagagtgtacagactgcacgagagactggtggccatcagaaccgagtacaacctgagactgaaggccggcgtggccgcccccgccacccaggtggcccaggtgaccctgcagagcgtgcagagaagacccgagctggaggacagcaccctgagatacctgcaggacctgctggcctgggtggaggagaaccagcacagagtggacggcgccgagtggggcgtggacctgcccagcgtggaggcccagctgggcagccacagaggcctgcaccagagcatcgaggagttcagagccaagatcgagagagccagaagcgacgagggccagctgagccccgccaccagaggcgcctacagagactgcctgggcagactggacctgcagtacgccaagctgctgaacagcagcaaggccagactgagaagcctggagagcctgcacagcttcgtggccgccgccaccaaggagctgatgtggctgaacgagaaggaggaggaggaggtgggcttcgactggagcgacagaaacaccaacatgaccgccaagaaggagagctacagcgccctgatgagagagctggagctgaaggagaagaagatcaaggagctgcagaacgccggcgacagactgctgagagaggaccaccccgccagacccaccgtggagagcttccaggccgccctgcagacccagtggagctggatgctgcagctgtgctgctgcatcgaggcccacctgaaggagaacgccgcctacttccagttcttcagcgacgtgagagaggccgagggccagctgcagaagctgcaggaggccctgagaagaaagtacagctgcgacagaagcgccaccgtgaccagactggaggacctgctgcaggacgcccaggacgagaaggagcagctgaacgagtacaagggccacctgagcggcctggccaagagagccaaggccgtggtgcagctgaagcccagacaccccgcccaccccatgagaggcagactgcccctgctggccgtgtgcgactacaagcaggtggaggtgaccgtgcacaagggcgacgagtgccagctggtgggccccgcccagcccagccactggaaggtgctgagcagcagcggcagcgaggccgccgtgcccagcgtgtgcttcctggtgcccccccccaaccaggaggcccaggaggccgtgaccagactggaggcccagcaccaggccctggtgaccctgtggcaccagctgcacgtggacatgaagagcctgctggcctggcagagcctgagaagagacgtgcagctgatcagaagctggagcctggccaccttcagaaccctgaagcccgaggagcagagacaggccctgcacagcctggagctgcactaccaggccttcctgagagacagccaggacgccggcggcttcggccccgaggacagactgatggccgagagagagtacggcagctgcagccaccactaccagcagctgctgcagagcctggagcagggcgcccaggaggagagcagatgccagagatgcatcagcgagctgaaggacatcagactgcagctggaggcctgcgagaccagaaccgtgcacagactgagactgcccctggacaaggagcccgccagagagtgcgcccagagaatcgccgagcagcagaaggcccaggccgaggtggagggcctgggcaagggcgtggccagactgagcgccgaggccgagaaggtgctggccctgcccgagcccagccccgccgcccccaccctgagaagcgagctggagctgaccctgggcaagctggagcaggtgagaagcctgagcgccatctacctggagaagctgaagaccatcagcctggtgatcagaggcacccagggcgccgaggaggtgctgagagcccacgaggagcagctgaaggaggcccaggccgtgcccgccaccctgcccgagctggaggccaccaaggccagcctgaagaagctgagagcccaggccgaggcccagcagcccaccttcgacgccctgagagacgagctgagaggcgcccaggaggtgggcgagagactgcagcagagacacggcgagagagacgtggaggtggagagatggagagagagagtggcccagctgctggagagatggcaggccgtgctggcccagaccgacgtgagacagagagagctggagcagctgggcagacagctgagatactacagagagagcgccgaccccctgggcgcctggctgcaggacgccagaagaagacaggagcagatccaggccatgcccctggccgacagccaggccgtgagagagcagctgagacaggagcaggccctgctggaggagatcgagagacacggcgagaaggtggaggagtgccagagattcgccaagcagtacatcaacgccatcaaggactacgagctgcagctggtgacctacaaggcccagctggagcccgtggccagccccgccaagaagcccaaggtgcagagcggcagcgagagcgtgatccaggagtacgtggacctgagaacccactacagcgagctgaccaccctgaccagccagtacatcaagttcatcagcgagaccctgagaagaatggaggaggaggagagactggccgagcagcagagagccgaggagagagagagactggccgaggtggaggccgccctggagaagcagagacagctggccgaggcccacgcccaggccaaggcccaggccgagagagaggccaaggagctgcagcagagaatgcaggaggaggtggtgagaagagaggaggccgccgtggacgcccagcagcagaagagaagcatccaggaggagctgcagcagctgagacagagcagcgaggccgagatccaggccaaggccagacaggccgaggccgccgagagaagcagactgagaatcgaggaggagatcagagtggtgagactgcagctggaggccaccgagagacagagaggcggcgccgagggcgagctgcaggccctgagagccagagccgaggaggccgaggcccagaagagacaggcccaggaggaggccgagagactgagaagacaggtgcaggacgagagccagagaaagagacaggccgaggtggagctggccagcagagtgaaggccgaggccgaggccgccagagagaagcagagagccctgcaggccctggaggagctgagactgcaggccgaggaggccgagagaagactgagacaggccgaggtggagagagccagacaggtgcaggtggccctggagaccgcccagagaagcgccgaggccgagctgcagagcaagagagccagcttcgccgagaagaccgcccagctggagagaagcctgcaggaggagcacgtggccgtggcccagctgagagaggaggccgagagaagagcccagcagcaggccgaggccgagagagccagagaggaggccgagagagagctggagagatggcagctgaaggccaacgaggccctgagactgagactgcaggccgaggaggtggcccagcagaagagcctggcccaggccgaggccgagaagcagaaggaggaggccgagagagaggccagaagaagaggcaaggccgaggagcaggccgtgagacagagagagctggccgagcaggagctggagaagcagagacagctggccgagggcaccgcccagcagagactggccgccgagcaggagctgatcagactgagagccgagaccgagcagggcgagcagcagagacagctgctggaggaggagctggccagactgcagagagaggccgccgccgccacccagaagagacaggagctggaggccgagctggccaaggtgagagccgagatggaggtgctgctggccagcaaggccagagccgaggaggagagcagaagcaccagcgagaagagcaagcagagactggaggccgaggccggcagattcagagagctggccgaggaggccgccagactgagagccctggccgaggaggccaagagacagagacagctggccgaggaggacgccgccagacagagagccgaggccgagagagtgctggccgagaagctggccgccatcggcgaggccaccagactgaagaccgaggccgagatcgccctgaaggagaaggaggccgagaacgagagactgagaagactggccgaggacgaggccttccagagaagaagactggaggagcaggccgcccagcacaaggccgacatcgaggagagactggcccagctgagaaaggccagcgacagcgagctggagagacagaagggcctggtggaggacaccctgagacagagaagacaggtggaggaggagatcctggccctgaaggccagcttcgagaaggccgccgccggcaaggccgagctggagctggagctgggcagaatcagaagcaacgccgaggacaccctgagaagcaaggagcaggccgagctggaggccgccagacagagacagctggccgccgaggaggagagaagaagaagagaggccgaggagagagtgcagaagagcctggccgccgaggaggaggccgccagacagagaaaggccgccctggaggaggtggagagactgaaggccaaggtggaggaggccagaagactgagagagagagccgagcaggagagcgccagacagctgcagctggcccaggaggccgcccagaagagactgcaggccgaggagaaggcccacgccttcgccgtgcagcagaaggagcaggagctgcagcagaccctgcagcaggagcagagcgtgctggaccagctgagaggcgaggccgaggccgccagaagagccgccgaggaggccgaggaggccagagtgcaggccgagagagaggccgcccagagcagaagacaggtggaggaggccgagagactgaagcagagcgccgaggagcaggcccaggccagagcccaggcccaggccgccgccgagaagctgagaaaggaggccgagcaggaggccgccagaagagcccaggccgagcaggccgccctgagacagaagcaggccgccgacgccgagatggagaagcacaagaagttcgccgagcagaccctgagacagaaggcccaggtggagcaggagctgaccaccctgagactgcagctggaggagaccgaccaccagaagaacctgctggacgaggagctgcagagactgaaggccgaggccaccgaggccgccagacagagaagccaggtggaggaggagctgttcagcgtgagagtgcagatggaggagctgagcaagctgaaggccagaatcgaggccgagaacagagccctgatcctgagagacaaggacaacacccagagattcctgcaggaggaggccgagaagatgaagcaggtggccgaggaggccgccagactgagcgtggccgcccaggaggccgccagactgagacagctggccgaggaggacctggcccagcagagagccctggccgagaagatgctgaaggagaagatgcaggccgtgcaggaggccaccagactgaaggccgaggccgagctgctgcagcagcagaaggagctggcccaggagcaggccagaagactgcaggaggacaaggagcagatggcccagcagctggccgaggagacccagggcttccagagaaccctggaggccgagagacagagacagctggagatgagcgccgaggccgagagactgaagctgagagtggccgagatgagcagagcccaggccagagccgaggaggacgcccagagattcagaaagcaggccgaggagatcggcgagaagctgcacagaaccgagctggccacccaggagaaggtgaccctggtgcagaccctggagatccagagacagcagagcgaccacgacgccgagagactgagagaggccatcgccgagctggagagagagaaggagaagctgcagcaggaggccaagctgctgcagctgaagagcgaggagatgcagaccgtgcagcaggagcagctgctgcaggagacccaggccctgcagcagagcttcctgagcgagaaggacagcctgctgcagagagagagattcatcgagcaggagaaggccaagctggagcagctgttccaggacgaggtggccaaggcccagcagctgagagaggagcagcagagacagcagcagcagatggagcaggagagacagagactggtggccagcatggaggaggccagaagaagacagcacgaggccgaggagggcgtgagaagaaagcaggaggagctgcagcagctggagcagcagagaagacagcaggaggagctgctggccgaggagaaccagagactgagagagcagctgcagctgctggaggagcagcacagagccgccctggcccacagcgaggaggtgaccgccagccaggtggccgccaccaagaccctgcccaacggcagagacgccctggacggccccgccgccgaggccgagcccgagcacagcttcgacggcctgagaagaaaggtgagcgcccagagactgcaggaggccggcatcctgagcgccgaggagctgcagagactggcccagggccacaccaccgtggacgagctggccagaagagaggacgtgagacactacctgcagggcagaagcagcatcgccggcctgctgctgaaggccaccaacgagaagctgagcgtgtacgccgccctgcagagacagctgctgagccccggcaccgccctgatcctgctggaggcccaggccgccagcggcttcctgctggaccccgtgagaaacagaagactgaccgtgaacgaggccgtgaaggagggcgtggtgggccccgagctgcaccacaagctgctgagcgccgagagagccgtgaccggctacaaggacccctacaccggccagcagatcagcctgttccaggccatgcagaagggcctgatcgtgagagagcacggcatcagactgctggaggcccagatcgccaccggcggcgtgatcgaccccgtgcacagccacagagtgcccgtggacgtggcctacagaagaggctacttcgacgaggagatgaacagagtgctggccgaccccagcgacgacaccaagggcttcttcgaccccaacacccacgagaacctgacctacctgcagctgctggagagatgcgtggaggaccccgagaccggcctgtgcctgctgcccctgaccgacaaggccgccaagggcggcgagctggtgtacaccgacagcgaggccagagacgtgttcgagaaggccaccgtgagcgcccccttcggcaagttccagggcaagaccgtgaccatctgggagatcatcaacagcgagtacttcaccgccgagcagagaagagacctgctgagacagttcagaaccggcagaatcaccgtggagaagatcatcaagatcatcatcaccgtggtggaggagcaggagcagaagggcagactgtgcttcgagggcctgagaagcctggtgcccgccgccgagctgctggagagcagagtgatcgacagagagctgtaccagcagctgcagagaggcgagagaagcgtgagagacgtggccgaggtggacaccgtgagaagagccctgagaggcgccaacgtgatcgccggcgtgtggctggaggaggccggccagaagctgagcatctacaacgccctgaagaaggacctgctgcccagcgacatggccgtggccctgctggaggcccaggccggcaccggccacatcatcgaccccgccaccagcgccagactgaccgtggacgaggccgtgagagccggcctggtgggccccgagttccacgagaagctgctgagcgccgagaaggccgtgaccggctacagagacccctacaccggccagagcgtgagcctgttccaggccctgaagaagggcctgatccccagagagcagggcctgagactgctggacgcccagctgagcaccggcggcatcgtggaccccagcaagagccacagagtgcccctggacgtggcctgcgccagaggctgcctggacgaggagaccagcagagccctgagcgcccccagagccgacgccaaggcctacagcgaccccagcaccggcgagcccgccacctacggcgagctgcagcagagatgcagacccgaccagctgaccggcctgagcctgctgcccctgagcgagaaggccgccagagccagacaggaggagctgtacagcgagctgcaggccagagagaccttcgagaagacccccgtggaggtgcccgtgggcggcttcaagggcagaaccgtgaccgtgtgggagctgatcagcagcgagtacttcaccgccgagcagagacaggagctgctgagacagttcagaaccggcaaggtgaccgtggagaaggtgatcaagatcctgatcaccatcgtggaggaggtggagaccctgagacaggagagactgagcttcagcggcctgagagcccccgtgcccgccagcgagctgctggccagcggcgtgctgagcagagcccagttcgagcagctgaaggacggcaagaccaccgtgaaggacctgagcgagctgggcagcgtgagaaccctgctgcagggcagcggctgcctggccggcatctacctggaggacaccaaggagaaggtgagcatctacgaggccatgagaagaggcctgctgagagccaccaccgccgccctgctgctggaggcccaggccgccaccggcttcctggtggaccccgtgagaaaccagagactgtacgtgcacgaggccgtgaaggccggcgtggtgggccccgagctgcacgagcagctgctgagcgccgagaaggccgtgaccggctacagagacccctacagcggcagcaccatcagcctgttccaggccatgcagaagggcctggtgctgagacagcacggcatcagactgctggaggcccagatcgccaccggcggcatcatcgaccccgtgcacagccacagagtgcccgtggacgtggcctaccagagaggctacttcagcgaggagatgaacagagtgctggccgaccccagcgacgacaccaagggcttcttcgaccccaacacccacgagaacctgacctacagacagctgctggagagatgcgtggaggaccccgagaccggcctgagactgctgcccctgaagggcgccgagaaggccgaggtggtggagaccacccaggtgtacaccgaggaggagaccagaagagccttcgaggagacccagatcgacatccccggcggcggcagccacggcggcagcaccatgagcctgtgggaggtgatgcagagcgacctgatccccgaggagcagagagcccagctgatggccgacttccaggccggcagagtgaccaaggagagaatgatcatcatcatcatcgagatcatcgagaagaccgagatcatcagacagcagggcctggccagctacgactacgtgagaagaagactgaccgccgaggacctgttcgaggccagaatcatcagcctggagacctacaacctgctgagagagggcaccagaagcctgagagaggccctggaggccgagagcgcctggtgctacctgtacggcaccggcagcgtggccggcgtgtacctgcccggcagcagacagaccctgagcatctaccaggccctgaagaagggcctgctgagcgccgaggtggccagactgctgctggaggcccaggccgccaccggcttcctgctggaccccgtgaagggcgagagactgaccgtggacgaggccgtgagaaagggcctggtgggccccgagctgcacgacagactgctgagcgccgagagagccgtgaccggctacagagacccctacaccgagcagaccatcagcctgttccaggccatgaagaaggagctgatccccaccgaggaggccctgagactgctggacgcccagctggccaccggcggcatcgtggaccccagactgggcttccacctgcccctggaggtggcctaccagagaggctacctgaacaaggacacccacgaccagctgagcgagcccagcgaggtgagaagctacgtggaccccagcaccgacgagagactgagctacacccagctgctgagaagatgcagaagagacgacggcaccggccagctgctgctgcccctgagcgacgccagaaagctgaccttcagaggcctgagaaagcagatcaccatggaggagctggtgagaagccaggtgatggacgaggccaccgccctgcagctgagagagggcctgaccagcatcgaggaggtgaccaagaacctgcagaagttcctggagggcaccagctgcatcgccggcgtgttcgtggacgccaccaaggagagactgagcgtgtaccaggccatgaagaagggcatcatcagacccggcaccgccttcgagctgctggaggcccaggccgccaccggctacgtgatcgaccccatcaagggcctgaagctgaccgtggaggaggccgtgagaatgggcatcgtgggccccgagttcaaggacaagctgctgagcgccgagagagccgtgaccggctacaaggacccctacagcggcaagctgatcagcctgttccaggccatgaagaagggcctgatcctgaaggaccacggcatcagactgctggaggcccagatcgccaccggcggcatcatcgaccccgaggagagccacagactgcccgtggaggtggcctacaagagaggcctgttcgacgaggagatgaacgagatcctgaccgaccccagcgacgacaccaagggcttcttcgaccccaacaccgaggagaacctgacctacctgcagctgatggagagatgcatcaccgacccccagaccggcctgtgcctgctgcccctgaaggagaagaagagagagagaaagaccagcagcaagagcagcgtgagaaagagaagagtggtgatcgtggaccccgagaccggcaaggagatgagcgtgtacgaggcctacagaaagggcctgatcgaccaccagacctacctggagctgagcgagcaggagtgcgagtgggaggagatcaccatcagcagcagcgacggcgtggtgaagagcatgatcatcgacagaagaagcggcagacagtacgacatcgacgacgccatcgccaagaacctgatcgacagaagcgccctggaccagtacagagccggcaccctgagcatcaccgagttcgccgacatgctgagcggcaacgccggcggcttcagaagcagaagcagcagcgtgggcagcagcagcagctaccccatcagccccgccgtgagcagaacccagctggccagctggagcgaccccaccgaggagaccggccccgtggccggcatcctggacaccgagaccctggagaaggtgagcatcaccgaggccatgcacagaaacctggtggacaacatcaccggccagagactgctggaggcccaggcctgcaccggcggcatcatcgaccccagcaccggcgagagattccccgtgaccgacgccgtgaacaagggcctggtggacaagatcatggtggacagaatcaacctggcccagaaggccttctgcggcttcgaggaccccagaaccaagaccaagatgagcgccgcccaggccctgaagaagggctggctgtactacgaggccggccagagattcctggaggtgcagtacctgaccggcggcctgatcgagcccgacacccccggcagagtgcccctggacgaggccctgcagagaggcaccgtggacgccagaaccgcccagaagctgagagacgtgggcgcctacagcaagtacctgacctgccccaagaccaagctgaagatcagctacaaggacgccctggacagaagcatggtggaggagggcaccggcctgagactgctggaggccgccgcccagagcaccaagggctactacagcccctacagcgtgagcggcagcggcagcaccgccggcagcagaaccggcagcagaaccggcagcagagccggcagcagaagaggcagcttcgacgccaccggcagcggcttcagcatgaccttcagcagcagcagctacagcagcagcggctacggcagaagatacgccagcggcagcagcgccagcctgggcggccccgagagcgccgtggcctag

SEQ ID NO: 93623 - DNA, 1503 bp, Artificial Sequence
  Description of Artificial Sequence: Synthetic coding sequence
atggccaccgtgatccccggcgacctgagcgaggtgagagacacccagaaggtgcccagcggcaagagaaagagaggcgagaccaagcccagaaagaacttcccctgccagctgtgcgacaaggccttcaacagcgtggagaagctgaaggtgcacagctacagccacaccggcgagagaccctacaagtgcatccagcaggactgcaccaaggccttcgtgagcaagtacaagctgcagagacacatggccacccacagccccgagaagacccacaagtgcaactactgcgagaagatgttccacagaaaggaccacctgaagaaccacctgcacacccacgaccccaacaaggagaccttcaagtgcgaggagtgcggcaagaactacaacaccaagctgggcttcaagagacacctggccctgcacgccgccaccagcggcgacctgacctgcaaggtgtgcctgcagaccttcgagagcaccggcgtgctgctggagcacctgaagagccacgccggcaagagcagcggcggcgtgaaggagaagaagcaccagtgcgagcactgcgacagaagattctacaccagaaaggacgtgagaagacacatggtggtgcacaccggcagaaaggacttcctgtgccagtactgcgcccagagattcggcagaaaggaccacctgaccagacacatgaagaagagccacaaccaggagctgctgaaggtgaagaccgagcccgtggacttcctggaccccttcacctgcaacgtgagcgtgcccatcaaggacgagctgctgcccgtgatgagcctgcccagcagcgagctgctgagcaagcccttcaccaacaccctgcagctgaacctgtacaacacccccttccagagcatgcagagcagcggcagcgcccaccagatgatcaccaccctgcccctgggcatgacctgccccatcgacatggacaccgtgcaccccagccaccacctgagcttcaagtaccccttcagcagcaccagctacgccatcagcatccccgagaaggagcagcccctgaagggcgagatcgagagctacctgatggagctgcagggcggcgtgcccagcagcagccaggacagccaggccagcagcagcagcaagctgggcctggacccccagatcggcagcctggacgacggcgccggcgacctgagcctgagcaagagcagcatcagcatcagcgaccccctgaacacccccgccctggacttcagccagctgttcaacttcatccccctgaacggccccccctacaaccccctgagcgtgggcagcctgggcatgagctacagccaggaggaggcccacagcagcgtgagccagctgcccccccagacccaggacctgcaggaccccgccaacaccatcggcctgggcagcctgcacagcctgagcgccgccttcaccagcagcctgagcaccagcaccaccctgcccagattccaccaggccttccagtag

SEQ ID NO: 93624 - DNA, 1257 bp, Artificial Sequence
  Description of Artificial Sequence: Synthetic coding sequence
atggccacccacagccccgagaagacccacaagtgcaactactgcgagaagatgttccacagaaaggaccacctgaagaaccacctgcacacccacgaccccaacaaggagaccttcaagtgcgaggagtgcggcaagaactacaacaccaagctgggcttcaagagacacctggccctgcacgccgccaccagcggcgacctgacctgcaaggtgtgcctgcagaccttcgagagcaccggcgtgctgctggagcacctgaagagccacgccggcaagagcagcggcggcgtgaaggagaagaagcaccagtgcgagcactgcgacagaagattctacaccagaaaggacgtgagaagacacatggtggtgcacaccggcagaaaggacttcctgtgccagtactgcgcccagagattcggcagaaaggaccacctgaccagacacatgaagaagagccacaaccaggagctgctgaaggtgaagaccgagcccgtggacttcctggaccccttcacctgcaacgtgagcgtgcccatcaaggacgagctgctgcccgtgatgagcctgcccagcagcgagctgctgagcaagcccttcaccaacaccctgcagctgaacctgtacaacacccccttccagagcatgcagagcagcggcagcgcccaccagatgatcaccaccctgcccctgggcatgacctgccccatcgacatggacaccgtgcaccccagccaccacctgagcttcaagtaccccttcagcagcaccagctacgccatcagcatccccgagaaggagcagcccctgaagggcgagatcgagagctacctgatggagctgcagggcggcgtgcccagcagcagccaggacagccaggccagcagcagcagcaagctgggcctggacccccagatcggcagcctggacgacggcgccggcgacctgagcctgagcaagagcagcatcagcatcagcgaccccctgaacacccccgccctggacttcagccagctgttcaacttcatccccctgaacggccccccctacaaccccctgagcgtgggcagcctgggcatgagctacagccaggaggaggcccacagcagcgtgagccagctgcccccccagacccaggacctgcaggaccccgccaacaccatcggcctgggcagcctgcacagcctgagcgccgccttcaccagcagcctgagcaccagcaccaccctgcccagattccaccaggccttccagtag

SEQ ID NO: 93625 - DNA, 1503 bp, Artificial Sequence; identical to SEQ ID NO: 93623
  Description of Artificial Sequence: Synthetic coding sequence

SEQ ID NO: 93626 - DNA, 1392 bp, Artificial Sequence
  Description of Artificial Sequence: Synthetic coding sequence
atggccaccttcccctgccagctgtgcggcaagaccttcctgaccctggagaagttcaccatccacaactacagccacagcagagagagaccctacaagtgcgtgcagcccgactgcggcaaggccttcgtgagcagatacaagctgatgagacacatggccacccacagcccccagaagagccaccagtgcgcccactgcgagaagaccttcaacagaaaggaccacctgaagaaccacctgcagacccacgaccccaacaagatggccttcggctgcgaggagtgcggcaagaagtacaacaccatgctgggctacaagagacacctggccctgcacgccgccagcagcggcgacctgacctgcggcgtgtgcgccctggagctgggcagcaccgaggtgctgctggaccacctgaaggcccacgccgaggagaagccccccagcggcaccaaggagaagaagcaccagtgcgaccactgcgagagatgcttctacaccagaaaggacgtgagaagacacctggtggtgcacaccggctgcaaggacttcctgtgccagttctgcgcccagagattcggcagaaaggaccacctgaccagacacaccaagaagacccacagccaggagctgatgaaggagagcctgcagaccggcgacctgctgagcaccttccacaccatcagccccagcttccagctgaaggccgccgccctgccccccttccccctgggcgccagcgcccagaacggcctggccagcagcctgcccgccgaggtgcacagcctgaccctgagcccccccgagcaggccgcccagcccatgcagcccctgcccgagagcctggccagcctgcaccccagcgtgagccccggcagcccccccccccccctgcccaaccacaagtacaacaccaccagcaccagctacagccccctggccagcctgcccctgaaggccgacaccaagggcttctgcaacatcagcctgttcgaggacctgcccctgcaggagccccagagcccccagaagctgaaccccggcttcgacctggccaagggcaacgccggcaaggtgaacctgcccaaggagctgcccgccgacgccgtgaacctgaccatccccgccagcctggacctgagccccctgctgggcttctggcagctgcccccccccgccacccagaacaccttcggcaacagcaccctggccctgggccccggcgagagcctgccccacagactgagctgcctgggccagcagcagcaggagccccccctggccatgggcaccgtgagcctgggccagctgcccctgccccccatcccccacgtgttcagcgccggcaccggcagcgccatcctgccccacttccaccacgccttcagatag

SEQ ID NO: 93627 - DNA, 1392 bp, Artificial Sequence; identical to SEQ ID NO: 93626
  Description of Artificial Sequence: Synthetic coding sequence

SEQ ID NO: 93628 - DNA, 1392 bp, Artificial Sequence; identical to SEQ ID NO: 93626
  Description of Artificial Sequence: Synthetic coding sequence

SEQ ID NO: 93629 - DNA, 1236 bp, Artificial Sequence
  Description of Artificial Sequence: Synthetic coding sequence
atggccacccacagcccccagaagagccaccagtgcgcccactgcgagaagaccttcaacagaaaggaccacctgaagaaccacctgcagacccacgaccccaacaagatggccttcggctgcgaggagtgcggcaagaagtacaacaccatgctgggctacaagagacacctggccctgcacgccgccagcagcggcgacctgacctgcggcgtgtgcgccctggagctgggcagcaccgaggtgctgctggaccacctgaaggcccacgccgaggagaagccccccagcggcaccaaggagaagaagcaccagtgcgaccactgcgagagatgcttctacaccagaaaggacgtgagaagacacctggtggtgcacaccggctgcaaggacttcctgtgccagttctgcgcccagagattcggcagaaaggaccacctgaccagacacaccaagaagacccacagccaggagctgatgaaggagagcctgcagaccggcgacctgctgagcaccttccacaccatcagccccagcttccagctgaaggccgccgccctgccccccttccccctgggcgccagcgcccagaacggcctggccagcagcctgcccgccgaggtgcacagcctgaccctgagcccccccgagcaggccgcccagcccatgcagcccctgcccgagagcctggccagcctgcaccccagcgtgagccccggcagcccccccccccccctgcccaaccacaagtacaacaccaccagcaccagctacagccccctggccagcctgcccctgaaggccgacaccaagggcttctgcaacatcagcctgttcgaggacctgcccctgcaggagccccagagcccccagaagctgaaccccggcttcgacctggccaagggcaacgccggcaaggtgaacctgcccaaggagctgcccgccgacgccgtgaacctgaccatccccgccagcctggacctgagccccctgctgggcttctggcagctgcccccccccgccacccagaacaccttcggcaacagcaccctggccctgggccccggcgagagcctgccccacagactgagctgcctgggccagcagcagcaggagccccccctggccatgggcaccgtgagcctgggccagctgcccctgccccccatcccccacgtgttcagcgccggcaccggcagcgccatcctgccccacttccaccacgccttcagatag

SEQ ID NO: 93630 - DNA, 1236 bp, Artificial Sequence; identical to SEQ ID NO: 93629
  Description of Artificial Sequence: Synthetic coding sequence

SEQ ID NO: 93631 - DNA, 1392 bp, Artificial Sequence; identical to SEQ ID NO: 93626
  Description of Artificial Sequence: Synthetic coding sequence

SEQ ID NO: 93632 - DNA, 1392 bp, Artificial Sequence; identical to SEQ ID NO: 93626
  Description of Artificial Sequence: Synthetic coding sequence

SEQ ID NO: 93633 - DNA, 531 bp, Artificial Sequence
  Description of Artificial Sequence: Synthetic coding sequence
atggccacccacagcccccagaagagccaccagtgcgcccactgcgagaagaccttcaacagaaaggaccacctgaagaaccacctgcagacccacgaccccaacaagatggccttcggctgcgaggagtgcggcaagaagtacaacaccatgctgggctacaagagacacctggccctgcacgccgccagcagcggcgacctgacctgcggcgtgtgcgccctggagctgggcagcaccgaggtgctgctggaccacctgaaggcccacgccgaggagaagccccccagcggcaccaaggagaagaagcaccagtgcgaccactgcgagagatgcttctacaccagaaaggacgtgagaagacacctggtggtgcacaccggctgcaaggacttcctgtgccagttctgcgcccagagattcggcagaaaggaccacctgaccagacacaccaagaagacccacagccaggagctgatgaaggagagcctgcagaccggcgacctgctgagcaccttccacaccatctag

SEQ ID NO: 93634 - DNA, 1392 bp, Artificial Sequence; identical to SEQ ID NO: 93626
  Description of Artificial Sequence: Synthetic coding sequence

SEQ ID NO: 93635 - DNA, 1236 bp, Artificial Sequence; identical to SEQ ID NO: 93629
  Description of Artificial Sequence: Synthetic coding sequence

SEQ ID NO: 93636 - DNA, 1392 bp, Artificial Sequence; identical to SEQ ID NO: 93626
  Description of Artificial Sequence: Synthetic coding sequence

SEQ ID NO: 93637 - DNA, 759 bp, Artificial Sequence
  Description of Artificial Sequence: Synthetic coding sequence
atgaaggagagcctgcagaccggcgacctgctgagcaccttccacaccatcagccccagcttccagctgaaggccgccgccctgccccccttccccctgggcgccagcgcccagaacggcctggccagcagcctgcccgccgaggtgcacagcctgaccctgagcccccccgagcaggccgcccagcccatgcagcccctgcccgagagcctggccagcctgcaccccagcgtgagccccggcagcccccccccccccctgcccaaccacaagtacaacaccaccagcaccagctacagccccctggccagcctgcccctgaaggccgacaccaagggcttctgcaacatcagcctgttcgaggacctgcccctgcaggagccccagagcccccagaagctgaaccccggcttcgacctggccaagggcaacgccggcaaggtgaacctgcccaaggagctgcccgccgacgccgtgaacctgaccatccccgccagcctggacctgagccccctgctgggcttctggcagctgcccccccccgccacccagaacaccttcggcaacagcaccctggccctgggccccggcgagagcctgccccacagactgagctgcctgggccagcagcagcaggagccccccctggccatgggcaccgtgagcctgggccagctgcccctgccccccatcccccacgtgttcagcgccggcaccggcagcgccatcctgccccacttccaccacgccttcagatag

SEQ ID NO: 93638 - DNA, 1491 bp, Artificial Sequence
  Description of Artificial Sequence: Synthetic coding sequence
atgaccaccttcttcaccagcgtgcccccctggatccaggacgccaagcaggaggaggaggtgggctggaagctggtgcccagacccagaggcagagaggccgagagccaggtgaagtgccagtgcgagatcagcggcacccccttcagcaacggcgagaagctgagaccccacagcctgccccagcccgagcagagaccctacagctgcccccagctgcactgcggcaaggccttcgccagcaagtacaagctgtacagacacatggccacccacagcgcccagaagccccaccagtgcatgtactgcgacaagatgttccacagaaaggaccacctgagaaaccacctgcagacccacgaccccaacaaggaggccctgcactgcagcgagtgcggcaagaactacaacaccaagctgggctacagaagacacctggccatgcacgccgccagcagcggcgacctgagctgcaaggtgtgcctgcagaccttcgagagcacccaggccctgctggagcacctgaaggcccacagcagaagagtggccggcggcgccaaggagaagaagcacccctgcgaccactgcgacagaagattctacaccagaaaggacgtgagaagacacctggtggtgcacaccggcagaaaggacttcctgtgccagtactgcgcccagagattcggcagaaaggaccacctgaccagacacgtgaagaagagccacagccaggagctgctgaagatcaagaccgagcccgtggacatgctgggcctgctgagctgcagcagcaccgtgagcgtgaaggaggagctgagccccgtgctgtgcatggccagcagagacgtgatgggcaccaaggccttccccggcatgctgcccatgggcatgtacggcgcccacatccccaccatgcccagcaccggcgtgccccacagcctggtgcacaacaccctgcccatgggcatgagctaccccctggagagcagccccatcagcagccccgcccagctgccccccaagtaccagctgggcagcaccagctacctgcccgacaagctgcccaaggtggaggtggacagcttcctggccgagctgcccggcagcctgagcctgagcagcgccgagccccagcccgccagcccccagcccgccgccgccgccgccctgctggacgaggccctgctggccaagagccccgccaacctgagcgaggccctgtgcgccgccaacgtggacttcagccacctgctgggcttcctgcccctgaacctgcccccctgcaacccccccggcgccaccggcggcctggtgatgggctacagccaggccgaggcccagcccctgctgaccaccctgcaggcccagccccaggacagccccggcgccggcggccccctgaacttcggccccctgcacagcctgccccccgtgttcaccagcggcctgagcagcaccaccctgcccagattccaccaggccttccagtag

SEQ ID NO: 93639 - DNA, 507 bp, Artificial Sequence
  Description of Artificial Sequence: Synthetic coding sequence
atgcaggcccagcagtaccagcagcagagaagaaagttcgccgccgccttcctggccttcatcttcatcctggccgccgtggacaccgccgaggccggcaagaaggagaagcccgagaagaaggtgaagaagagcgactgcggcgagtggcagtggagcgtgtgcgtgcccaccagcggcgactgcggcctgggcaccagagagggcaccagaaccggcgccgagtgcaagcagaccatgaagacccagagatgcaagatcccctgcaactggaagaagcagttcggcgccgagtgcaagtaccagttccaggcctggggcgagtgcgacctgaacaccgccctgaagaccagaaccggcagcctgaagagagccctgcacaacgccgagtgccagaagaccgtgaccatcagcaagccctgcggcaagctgaccaagcccaagccccaggccgagagcaagaagaagaagaaggagggcaagaagcaggagaagatgctggactag

SEQ ID NO: 93640 - DNA, 1518 bp, Artificial Sequence
  Description of Artificial Sequence: Synthetic coding sequence
atggtggaggaggtgcagaagcacagcgtgcacaccctggtgttcagaagcctgaagagaacccacgacatgttcgtggccgacaacggcaagcccgtgcccctggacgaggagagccacaagagaaagatggccatcaagctgagaaacgagtacggccccgtgctgcacatgcccaccagcaaggagaacctgaaggagaagggcccccagaacgccaccgacagctacgtgcacaagcagtaccccgccaaccagggccaggaggtggagtacttcgtggccggcgtggccctgaccgccgacaccaagatccagagaatgcccagcgagagcgccgcccagagcctggccgtggccctgcccctgcagaccaaggccgacgccaacagaaccgcccccagcggcagcgagtacagacaccccggcgccagcgacagaccccagcccaccgccatgaacagcatcgtgatggagaccggcaacaccaagaacagcgccctgatggccaagaaggcccccaccatgcccaagccccagtggcaccccccctggaagctgtacagagtgatcagcggccacctgggctgggtgagatgcatcgccgtggagcccggcaaccagtggttcgtgaccggcagcgccgacagaaccatcaagatctgggacctggccagcggcaagctgaagctgagcctgaccggccacatcagcaccgtgagaggcgtgatcgtgagcaccagaagcccctacctgttcagctgcggcgaggacaagcaggtgaagtgctgggacctggagtacaacaaggtgatcagacactaccacggccacctgagcgccgtgtacggcctggacctgcaccccaccatcgacgtgctggtgacctgcagcagagacagcaccgccagaatctgggacgtgagaaccaaggccagcgtgcacaccctgagcggccacaccaacgccgtggccaccgtgagatgccaggccgccgagccccagatcatcaccggcagccacgacaccaccatcagactgtgggacctggtggccggcaagaccagagtgaccctgaccaaccacaagaagagcgtgagagccgtggtgctgcaccccagacactacaccttcgccagcggcagccccgacaacatcaagcagtggaagttccccgacggcagcttcatccagaacctgagcggccacaacgccatcatcaacaccctgaccgtgaacagcgacggcgtgctggtgagcggcgccgacaacggcaccatgcacctgtgggactggagaaccggctacaacttccagagagtgcacgccgccgtgcagcccggcagcctggacagcgagagcggcatcttcgcctgcgccttcgaccagagcgagagcagactgctgaccgccgaggccgacaagaccatcaaggtgtacagagaggacgacaccgccaccgaggagacccaccccgtgagctggaagcccgagatcatcaagagaaagagattctag

SEQ ID NO: 93641 - DNA, 1545 bp, Artificial Sequence
  Description of Artificial Sequence: Synthetic coding sequence
atgatctgcgaggtgcagaagcacagcgtgcacaccctggtgttcagaagcctgaagagaacccacgacatgttcgtggccgacaacggcaagcccgtgcccctggacgaggagagccacaagagaaagatggccatcaagctgagaaacgagtacggccccgtgctgcacatgcccaccagcaaggagaacctgaaggagaagggcccccagaacgccaccgacagctacgtgcacaagcagtaccccgccaaccagggccaggaggtggagtacttcgtggccggcacccacccctacccccccggccccggcgtggccctgaccgccgacaccaagatccagagaatgcccagcgagagcgccgcccagagcctggccgtggccctgcccctgcagaccaaggccgacgccaacagaaccgcccccagcggcagcgagtacagacaccccggcgccagcgacagaccccagcccaccgccatgaacagcatcgtgatggagaccggcaacaccaagaacagcgccctgatggccaagaaggcccccaccatgcccaagccccagtggcaccccccctggaagctgtacagagtgatcagcggccacctgggctgggtgagatgcatcgccgtggagcccggcaaccagtggttcgtgaccggcagcgccgacagaaccatcaagatctgggacctggccagcggcaagctgaagctgagcctgaccggccacatcagcaccgtgagaggcgtgatcgtgagcaccagaagcccctacctgttcagctgcggcgaggacaagcaggtgaagtgctgggacctggagtacaacaaggtgatcagacactaccacggccacctgagcgccgtgtacggcctggacctgcaccccaccatcgacgtgctggtgacctgcagcagagacagcaccgccagaatctgggacgtgagaaccaaggccagcgtgcacaccctgagcggccacaccaacgccgtggccaccgtgagatgccaggccgccgagccccagatcatcaccggcagccacgacaccaccatcagactgtgggacctggtggccggcaagaccagagtgaccctgaccaaccacaagaagagcgtgagagccgtggtgctgcaccccagacactacaccttcgccagcggcagccccgacaacatcaagcagtggaagttccccgacggcagcttcatccagaacctgagcggccacaacgccatcatcaacaccctgaccgtgaacagcgacggcgtgctggtgagcggcgccgacaacggcaccatgcacctgtgggactggagaaccggctacaacttccagagagtgcacgccgccgtgcagcccggcagcctggacagcgagagcggcatcttcgcctgcgccttcgaccagagcgagagcagactgctgaccgccgaggccgacaagaccatcaaggtgtacagagaggacgacaccgccaccgaggagacccaccccgtgagctggaagcccgagatcatcaagagaaagagattctag

SEQ ID NO: 93642 - DNA, 1545 bp, Artificial Sequence
  Description of Artificial Sequence: Synthetic coding sequence
atggtggaggaggtgcagaagcacagcgtgcacaccctggtgttcagaagcctgaagagaacccacgacatgttcgtggccgacaacggcaagcccgtgcccctggacgaggagagccacaagagaaagatggccatcaagctgagaaacgagtacggccccgtgctgcacatgcccaccagcaaggagaacctgaaggagaagggcccccagaacgccaccgacagctacgtgcacaagcagtaccccgccaaccagggccaggaggtggagtacttcgtggccggcacccacccctacccccccggccccggcgtggccctgaccgccgacaccaagatccagagaatgcccagcgagagcgccgcccagagcctggccgtggccctgcccctgcagaccaaggccgacgccaacagaaccgcccccagcggcagcgagtacagacaccccggcgccagcgacagaccccagcccaccgccatgaacagcatcgtgatggagaccggcaacaccaagaacagcgccctgatggccaagaaggcccccaccatgcccaagccccagtggcaccccccctggaagctgtacagagtgatcagcggccacctgggctgggtgagatgcatcgccgtggagcccggcaaccagtggttcgtgaccggcagcgccgacagaaccatcaagatctgggacctggccagcggcaagctgaagctgagcctgaccggccacatcagcaccgtgagaggcgtgatcgtgagcaccagaagcccctacctgttcagctgcggcgaggacaagcaggtgaagtgctgggacctggagtacaacaaggtgatcagacactaccacggccacctgagcgccgtgtacggcctggacctgcaccccaccatcgacgtgctggtgacctgcagcagagacagcaccgccagaatctgggacgtgagaaccaaggccagcgtgcacaccctgagcggccacaccaacgccgtggccaccgtgagatgccaggccgccgagccccagatcatcaccggcagccacgacaccaccatcagactgtgggacctggtggccggcaagaccagagtgaccctgaccaaccacaagaagagcgtgagagccgtggtgctgcaccccagacactacaccttcgccagcggcagccccgacaacatcaagcagtggaagttccccgacggcagcttcatccagaacctgagcggccacaacgccatcatcaacaccctgaccgtgaacagcgacggcgtgctggtgagcggcgccgacaacggcaccatgcacctgtgggactggagaaccggctacaacttccagagagtgcacgccgccgtgcagcccggcagcctggacagcgagagcggcatcttcgcctgcgccttcgaccagagcgagagcagactgctgaccgccgaggccgacaagaccatcaaggtgtacagagaggacgacaccgccaccgaggagacccaccccgtgagctggaagcccgagatcatcaagagaaagagattctag

SEQ ID NO: 93643 - DNA, 5622 bp, Artificial Sequence
  Description of Artificial Sequence: Synthetic coding sequence
atgtgggccgaggccggcctgcccagagccggcggcggcagccagccccccttcagaaccttcagcgccagcgactggggcctgacccacctggtggtgcacgagcagaccggcgaggtgtacgtgggcgccgtgaacagaatctacaagctgagcggcaacctgaccctgctgagagcccacgtgaccggccccgtggaggacaacgagaagtgctaccccccccccagcgtgcagagctgcccccacggcctgggcagcaccgacaacgtgaacaagctgctgctgctggactacgccgccaacagactgctggcctgcggcagcgccagccagggcatctgccagttcctgagactggacgacctgttcaagctgggcgagccccaccacagaaaggagcactacctgagcagcgtgcaggaggccggcagcatggccggcgtgctgatcgccggcccccccggccagggccaggccaagctgttcgtgggcacccccatcgacggcaagagcgagtacttccccaccctgagcagcagaagactgatggccaacgaggaggacgccgacatgttcggcttcgtgtaccaggacgagttcgtgagcagccagctgaagatccccagcgacaccctgagcaagttccccgccttcgacatctactacgtgtacagcttcagaagcgagcagttcgtgtactacctgaccctgcagctggacacccagctgaccagccccgacgccgccggcgagcacttcttcaccagcaagatcgtgagactgtgcgtggacgaccccaagttctacagctacgtggagttccccatcggctgcgagcaggccggcgtggagtacagactggtgcaggacgcctacctgagcagacccggcagagccctggcccaccagctgggcctggccgaggacgaggacgtgctgttcaccgtgttcgcccagggccagaagaacagagtgaagccccccaaggagagcgccctgtgcctgttcaccctgagagccatcaaggagaagatcaaggagagaatccagagctgctacagaggcgagggcaagctgagcctgccctggctgctgaacaaggagctgggctgcatcaacagccccctgcagatcgacgacgacttctgcggccaggacttcaaccagcccctgggcggcaccgtgaccatcgagggcacccccctgttcgtggacaaggacgacggcctgaccgccgtggccgcctacgactacagaggcagaaccgtggtgttcgccggcaccagaagcggcagaatcagaaagatcctggtggacctgagcaaccccggcggcagacccgccctggcctacgagagcgtggtggcccaggagggcagccccatcctgagagacctggtgctgagccccaaccaccagtacctgtacgccatgaccgagaagcaggtgaccagagtgcccgtggagagctgcgtgcagtacaccagctgcgagctgtgcctgggcagcagagacccccactgcggctggtgcgtgctgcacagcatctgcagcagaagagacgcctgcgagagagccgacgagccccagagattcgccgccgacctgctgcagtgcgtgcagctgaccgtgcagcccagaaacgtgagcgtgaccatgagccaggtgcccctggtgctgcaggcctggaacgtgcccgacctgagcgccggcgtgaactgcagcttcgaggacttcaccgagagcgagagcgtgctggaggacggcagaatccactgcagaagccccagcgccagagaggtggcccccatcaccagaggccagggcgaccagagagtggtgaagctgtacctgaagagcaaggagaccggcaagaagttcgccagcgtggacttcgtgttctacaactgcagcgtgcaccagagctgcctgagctgcgtgaacggcagcttcccctgccactggtgcaagtacagacacgtgtgcacccacaacgtggccgactgcgccttcctggagggcagagtgaacgtgagcgaggactgcccccagatcctgcccagcacccagatctacgtgcccgtgggcgtggtgaagcccatcaccctggccgccagaaacctgccccagccccagagcggccagagaggctacgagtgcctgttccacatccccggcagccccgccagagtgaccgccctgagattcaacagcagcagcctgcagtgccagaacagcagctacagctacgagggcaacgacgtgagcgacctgcccgtgaacctgagcgtggtgtggaacggcaacttcgtgatcgacaacccccagaacatccaggcccacctgtacaagtgccccgccctgagagagagctgcggcctgtgcctgaaggccgaccccagattcgagtgcggctggtgcgtggccgagagaagatgcagcctgagacaccactgcgccgccgacacccccgccagctggatgcacgccagacacggcagcagcagatgcaccgaccccaagatcctgaagctgagccccgagaccggccccagacagggcggcaccagactgaccatcaccggcgagaacctgggcctgagattcgaggacgtgagactgggcgtgagagtgggcaaggtgctgtgcagccccgtggagagcgagtacatcagcgccgagcagatcgtgtgcgagatcggcgacgccagcagcgtgagagcccacgacgccctggtggaggtgtgcgtgagagactgcagcccccactacagagccctgagccccaagagattcaccttcgtgacccccaccttctacagagtgagccccagcagaggccccctgagcggcggcacctggatcggcatcgagggcagccacctgaacgccggcagcgacgtggccgtgagcgtgggcggcagaccctgcagcttcagctggagaaacagcagagagatcagatgcctgaccccccccggccagagccccggcagcgcccccatcatcatcaacatcaacagagcccagctgaccaaccccgaggtgaagtacaactacaccgaggaccccaccatcctgagaatcgaccccgagtggagcatcaacagcggcggcaccctgctgaccgtgaccggcaccaacctggccaccgtgagagagcccagaatcagagccaagtacggcggcatcgagagagagaacggctgcctggtgtacaacgacaccaccatggtgtgcagagcccccagcgtggccaaccccgtgagaagcccccccgagctgggcgagagacccgacgagctgggcttcgtgatggacaacgtgagaagcctgctggtgctgaacagcaccagcttcctgtactaccccgaccccgtgctggagcccctgagccccaccggcctgctggagctgaagcccagcagccccctgatcctgaagggcagaaacctgctgccccccgcccccggcaacagcagactgaactacaccgtgctgatcggcagcaccccctgcaccctgaccgtgagcgagacccagctgctgtgcgaggcccccaacctgaccggccagcacaaggtgaccgtgagagccggcggcttcgagttcagccccggcaccctgcaggtgtacagcgacagcctgctgaccctgcccgccatcgtgggcatcggcggcggcggcggcctgctgctgctggtgatcgtggccgtgctgatcgcctacaagagaaagagcagagacgccgacagaaccctgaagagactgcagctgcagatggacaacctggagagcagagtggccctggagtgcaaggaggccttcgccgagctgcagaccgacatccacgagctgaccaacgacctggacggcgccggcatccccttcctggactacagaacctacgccatgagagtgctgttccccggcatcgaggaccaccccgtgctgaaggagatggaggtgcaggccaacgtggagaagagcctgaccctgttcggccagctgctgaccaagaagcacttcctgctgaccttcatcagaaccctggaggcccagagaagcttcagcatgagagacagaggcaacgtggccagcctgatcatgaccgccctgcagggcgagatggagtacgccaccggcgtgctgaagcagctgctgagcgacctgatcgagaagaacctggagagcaagaaccaccccaagctgctgctgagaagaaccgagagcgtggccgagaagatgctgaccaactggttcaccttcctgctgtacaagttcctgaaggagtgcgccggcgagcccctgttcatgctgtactgcgccatcaagcagcagatggagaagggccccatcgacgccatcaccggcgaggccagatacagcctgagcgaggacaagctgatcagacagcagatcgactacaagaccctgaccctgaactgcgtgaaccccgagaacgagaacgcccccgaggtgcccgtgaagggcctggactgcgacaccgtgacccaggccaaggagaagctgctggacgccgcctacaagggcgtgccctacagccagagacccaaggccgccgacatggacctggagtggagacagggcagaatggccagaatcatcctgcaggacgaggacgtgaccaccaagatcgacaacgactggaagagactgaacaccctggcccactaccaggtgaccgacggcagcagcgtggccctggtgcccaagcagaccagcgcctacaacatcagcaacagcagcaccttcaccaagagcctgagcagatacgagagcatgctgagaaccgccagcagccccgacagcctgagaagcagaacccccatgatcacccccgacctggagagcggcaccaagctgtggcacctggtgaagaaccacgaccacctggaccagagagagggcgacagaggcagcaagatggtgagcgagatctacctgaccagactgctggccaccaagggcaccctgcagaagttcgtggacgacctgttcgagaccatcttcagcaccgcccacagaggcagcgccctgcccctggccatcaagtacatgttcgacttcctggacgagcaggccgacaagcaccagatccacgacgccgacgtgagacacacctggaagagcaactgcctgcccctgagattctgggtgaacgtgatcaagaacccccagttcgtgttcgacatccacaagaacagcatcaccgacgcctgcctgagcgtggtggcccagaccttcatggacagctgcagcaccagcgagcacaagctgggcaaggacagccccagcaacaagctgctgtacgccaaggacatccccaactacaagagctgggtggagagatactacgccgacatcgccaagatgcccgccatcagcgaccaggacatgagcgcctacctggccgagcagagcagactgcacctgagccagttcaacagcatgagcgccctgcacgagatctacagctacatcaccaagtacaaggacgagatcctggccgccctggagaaggacgagcaggccagaagacagagactgagaagcaagctggagcaggtggtggacaccatggccctgagcagctag

SEQ ID NO: 93644 - DNA, 5691 bp, Artificial Sequence
  Description of Artificial Sequence: Synthetic coding sequence
atgcccctgccccccagaagcctgcaggtgctgctgctgctgctgctgctgctgctgctgctgcccggcatgtgggccgaggccggcctgcccagagccggcggcggcagccagccccccttcagaaccttcagcgccagcgactggggcctgacccacctggtggtgcacgagcagaccggcgaggtgtacgtgggcgccgtgaacagaatctacaagctgagcggcaacctgaccctgctgagagcccacgtgaccggccccgtggaggacaacgagaagtgctaccccccccccagcgtgcagagctgcccccacggcctgggcagcaccgacaacgtgaacaagctgctgctgctggactacgccgccaacagactgctggcctgcggcagcgccagccagggcatctgccagttcctgagactggacgacctgttcaagctgggcgagccccaccacagaaaggagcactacctgagcagcgtgcaggaggccggcagcatggccggcgtgctgatcgccggcccccccggccagggccaggccaagctgttcgtgggcacccccatcgacggcaagagcgagtacttccccaccctgagcagcagaagactgatggccaacgaggaggacgccgacatgttcggcttcgtgtaccaggacgagttcgtgagcagccagctgaagatccccagcgacaccctgagcaagttccccgccttcgacatctactacgtgtacagcttcagaagcgagcagttcgtgtactacctgaccctgcagctggacacccagctgaccagccccgacgccgccggcgagcacttcttcaccagcaagatcgtgagactgtgcgtggacgaccccaagttctacagctacgtggagttccccatcggctgcgagcaggccggcgtggagtacagactggtgcaggacgcctacctgagcagacccggcagagccctggcccaccagctgggcctggccgaggacgaggacgtgctgttcaccgtgttcgcccagggccagaagaacagagtgaagccccccaaggagagcgccctgtgcctgttcaccctgagagccatcaaggagaagatcaaggagagaatccagagctgctacagaggcgagggcaagctgagcctgccctggctgctgaacaaggagctgggctgcatcaacagccccctgcagatcgacgacgacttctgcggccaggacttcaaccagcccctgggcggcaccgtgaccatcgagggcacccccctgttcgtggacaaggacgacggcctgaccgccgtggccgcctacgactacagaggcagaaccgtggtgttcgccggcaccagaagcggcagaatcagaaagatcctggtggacctgagcaaccccggcggcagacccgccctggcctacgagagcgtggtggcccaggagggcagccccatcctgagagacctggtgctgagccccaaccaccagtacctgtacgccatgaccgagaagcaggtgaccagagtgcccgtggagagctgcgtgcagtacaccagctgcgagctgtgcctgggcagcagagacccccactgcggctggtgcgtgctgcacagcatctgcagcagaagagacgcctgcgagagagccgacgagccccagagattcgccgccgacctgctgcagtgcgtgcagctgaccgtgcagcccagaaacgtgagcgtgaccatgagccaggtgcccctggtgctgcaggcctggaacgtgcccgacctgagcgccggcgtgaactgcagcttcgaggacttcaccgagagcgagagcgtgctggaggacggcagaatccactgcagaagccccagcgccagagaggtggcccccatcaccagaggccagggcgaccagagagtggtgaagctgtacctgaagagcaaggagaccggcaagaagttcgccagcgtggacttcgtgttctacaactgcagcgtgcaccagagctgcctgagctgcgtgaacggcagcttcccctgccactggtgcaagtacagacacgtgtgcacccacaacgtggccgactgcgccttcctggagggcagagtgaacgtgagcgaggactgcccccagatcctgcccagcacccagatctacgtgcccgtgggcgtggtgaagcccatcaccctggccgccagaaacctgccccagccccagagcggccagagaggctacgagtgcctgttccacatccccggcagccccgccagagtgaccgccctgagattcaacagcagcagcctgcagtgccagaacagcagctacagctacgagggcaacgacgtgagcgacctgcccgtgaacctgagcgtggtgtggaacggcaacttcgtgatcgacaacccccagaacatccaggcccacctgtacaagtgccccgccctgagagagagctgcggcctgtgcctgaaggccgaccccagattcgagtgcggctggtgcgtggccgagagaagatgcagcctgagacaccactgcgccgccgacacccccgccagctggatgcacgccagacacggcagcagcagatgcaccgaccccaagatcctgaagctgagccccgagaccggccccagacagggcggcaccagactgaccatcaccggcgagaacctgggcctgagattcgaggacgtgagactgggcgtgagagtgggcaaggtgctgtgcagccccgtggagagcgagtacatcagcgccgagcagatcgtgtgcgagatcggcgacgccagcagcgtgagagcccacgacgccctggtggaggtgtgcgtgagagactgcagcccccactacagagccctgagccccaagagattcaccttcgtgacccccaccttctacagagtgagccccagcagaggccccctgagcggcggcacctggatcggcatcgagggcagccacctgaacgccggcagcgacgtggccgtgagcgtgggcggcagaccctgcagcttcagctggagaaacagcagagagatcagatgcctgaccccccccggccagagccccggcagcgcccccatcatcatcaacatcaacagagcccagctgaccaaccccgaggtgaagtacaactacaccgaggaccccaccatcctgagaatcgaccccgagtggagcatcaacagcggcggcaccctgctgaccgtgaccggcaccaacctggccaccgtgagagagcccagaatcagagccaagtacggcggcatcgagagagagaacggctgcctggtgtacaacgacaccaccatggtgtgcagagcccccagcgtggccaaccccgtgagaagcccccccgagctgggcgagagacccgacgagctgggcttcgtgatggacaacgtgagaagcctgctggtgctgaacagcaccagcttcctgtactaccccgaccccgtgctggagcccctgagccccaccggcctgctggagctgaagcccagcagccccctgatcctgaagggcagaaacctgctgccccccgcccccggcaacagcagactgaactacaccgtgctgatcggcagcaccccctgcaccctgaccgtgagcgagacccagctgctgtgcgaggcccccaacctgaccggccagcacaaggtgaccgtgagagccggcggcttcgagttcagccccggcaccctgcaggtgtacagcgacagcctgctgaccctgcccgccatcgtgggcatcggcggcggcggcggcctgctgctgctggtgatcgtggccgtgctgatcgcctacaagagaaagagcagagacgccgacagaaccctgaagagactgcagctgcagatggacaacctggagagcagagtggccctggagtgcaaggaggccttcgccgagctgcagaccgacatccacgagctgaccaacgacctggacggcgccggcatccccttcctggactacagaacctacgccatgagagtgctgttccccggcatcgaggaccaccccgtgctgaaggagatggaggtgcaggccaacgtggagaagagcctgaccctgttcggccagctgctgaccaagaagcacttcctgctgaccttcatcagaaccctggaggcccagagaagcttcagcatgagagacagaggcaacgtggccagcctgatcatgaccgccctgcagggcgagatggagtacgccaccggcgtgctgaagcagctgctgagcgacctgatcgagaagaacctggagagcaagaaccaccccaagctgctgctgagaagaaccgagagcgtggccgagaagatgctgaccaactggttcaccttcctgctgtacaagttcctgaaggagtgcgccggcgagcccctgttcatgctgtactgcgccatcaagcagcagatggagaagggccccatcgacgccatcaccggcgaggccagatacagcctgagcgaggacaagctgatcagacagcagatcgactacaagaccctgaccctgaactgcgtgaaccccgagaacgagaacgcccccgaggtgcccgtgaagggcctggactgcgacaccgtgacccaggccaaggagaagctgctggacgccgcctacaagggcgtgccctacagccagagacccaaggccgccgacatggacctggagtggagacagggcagaatggccagaatcatcctgcaggacgaggacgtgaccaccaagatcgacaacgactggaagagactgaacaccctggcccactaccaggtgaccgacggcagcagcgtggccctggtgcccaagcagaccagcgcctacaacatcagcaacagcagcaccttcaccaagagcctgagcagatacgagagcatgctgagaaccgccagcagccccgacagcctgagaagcagaacccccatgatcacccccgacctggagagcggcaccaagctgtggcacctggtgaagaaccacgaccacctggaccagagagagggcgacagaggcagcaagatggtgagcgagatctacctgaccagactgctggccaccaagggcaccctgcagaagttcgtggacgacctgttcgagaccatcttcagcaccgcccacagaggcagcgccctgcccctggccatcaagtacatgttcgacttcctggacgagcaggccgacaagcaccagatccacgacgccgacgtgagacacacctggaagagcaactgcctgcccctgagattctgggtgaacgtgatcaagaacccccagttcgtgttcgacatccacaagaacagcatcaccgacgcctgcctgagcgtggtggcccagaccttcatggacagctgcagcaccagcgagcacaagctgggcaaggacagccccagcaacaagctgctgtacgccaaggacatccccaactacaagagctgggtggagagatactacgccgacatcgccaagatgcccgccatcagcgaccaggacatgagcgcctacctggccgagcagagcagactgcacctgagccagttcaacagcatgagcgccctgcacgagatctacagctacatcaccaagtacaaggacgagatcctggccgccctggagaaggacgagcaggccagaagacagagactgagaagcaagctggagcaggtggtggacaccatggccctgagcagctag

SEQ ID NO: 93645 - DNA, 5685 bp, Artificial Sequence
  Description of Artificial Sequence: Synthetic coding sequence
atggagcagagaagaccctggcccagagccctggaggtggacagcagaagcgtggtgctgctgagcgtggtgtgggtgctgctggccccccccgccgccggcatgccccagttcagcaccttccacagcgagaacagagactggaccttcaaccacctgaccgtgcaccagggcaccggcgccgtgtacgtgggcgccatcaacagagtgtacaagctgaccggcaacctgaccatccaggtggcccacaagaccggccccgaggaggacaacaagagctgctacccccccctgatcgtgcagccctgcagcgaggtgctgaccctgaccaacaacgtgaacaagctgctgatcatcgactacagcgagaacagactgctggcctgcggcagcctgtaccagggcgtgtgcaagctgctgagactggacgacctgttcatcctggtggagcccagccacaagaaggagcactacctgagcagcgtgaacaagaccggcaccatgtacggcgtgatcgtgagaagcgagggcgaggacggcaagctgttcatcggcaccgccgtggacggcaagcaggactacttccccaccctgagcagcagaaagctgcccagagaccccgagagcagcgccatgctggactacgagctgcacagcgacttcgtgagcagcctgatcaagatccccagcgacaccctggccctggtgagccacttcgacatcttctacatctacggcttcgccagcggcggcttcgtgtacttcctgaccgtgcagcccgagacccccgagggcgtggccatcaacagcgccggcgacctgttctacaccagcagaatcgtgagactgtgcaaggacgaccccaagttccacagctacgtgagcctgcccttcggctgcaccagagccggcgtggagtacagactgctgcaggccgcctacctggccaagcccggcgacagcctggcccaggccttcaacatcaccagccaggacgacgtgctgttcgccatcttcagcaagggccagaagcagtaccaccacccccccgacgacagcgccctgtgcgccttccccatcagagccatcaacctgcagatcaaggagagactgcagagctgctaccagggcgagggcaacctggagctgaactggctgctgggcaaggacgtgcagtgcaccaaggcccccgtgcccatcgacgacaacttctgcggcctggacatcaaccagcccctgggcggcagcacccccgtggagggcctgaccctgtacaccaccagcagagacagaatgaccagcgtggccagctacgtgtacaacggctacagcgtggtgttcgtgggcaccaagagcggcaagctgaagaagatcagagccgacggccccccccacggcggcgtgcagtacgagatggtgagcgtgctgaaggacggcagccccatcctgagagacatggccttcagcatcgaccagagatacctgtacgtgatgagcgagagacaggtgaccagagtgcccgtggagagctgcgagcagtacaccacctgcggcgagtgcctgagcagcggcgacccccactgcggctggtgcgccctgcacaacatgtgcagcagaagagacaagtgccagcaggcctgggagcccaacagattcgccgccagcatcagccagtgcgtgagcctggccgtgcaccccagcagcatcagcgtgagcgagcacagcagactgctgagcctggtggtgagcgacgcccccgacctgagcgccggcatcgcctgcgccttcggcaacctgaccgaggtggagggccaggtgagcggcagccaggtgatctgcatcagccccggccccaaggacgtgcccgtgatccccctggaccaggactggttcggcctggagctgcagctgagaagcaaggagaccggcaagatcttcgtgagcaccgagttcaagttctacaactgcagcgcccaccagctgtgcctgagctgcgtgaacagcgccttcagatgccactggtgcaagtacagaaacctgtgcacccacgaccccaccacctgcagcttccaggagggcagaatcaacatcagcgaggactgcccccagctggtgcccaccgaggagatcctgatccccgtgggcgaggtgaagcccatcaccctgaaggccagaaacctgccccagccccagagcggccagagaggctacgagtgcgtgctgaacatccagggcgccatccacagagtgcccgccctgagattcaacagcagcagcgtgcagtgccagaacagcagctaccagtacgacggcatggacatcagcaacctggccgtggacttcgccgtggtgtggaacggcaacttcatcatcgacaacccccaggacctgaaggtgcacctgtacaagtgcgccgcccagagagagagctgcggcctgtgcctgaaggccgacagaaagttcgagtgcggctggtgcagcggcgagagaagatgcaccctgcaccagcactgcaccagccccagcagcccctggctggactggagcagccacaacgtgaagtgcagcaacccccagatcaccgagatcctgaccgtgagcggcccccccgagggcggcaccagagtgaccatccacggcgtgaacctgggcctggacttcagcgagatcgcccaccacgtgcaggtggccggcgtgccctgcacccccctgcccggcgagtacatcatcgccgagcagatcgtgtgcgagatgggccacgccctggtgggcaccaccagcggccccgtgagactgtgcatcggcgagtgcaagcccgagttcatgaccaagagccaccagcagtacaccttcgtgaaccccagcgtgctgagcctgaaccccatcagaggccccgagagcggcggcaccatggtgaccatcaccggccactacctgggcgccggcagcagcgtggccgtgtacctgggcaaccagacctgcgagttctacggcagaagcatgagcgagatcgtgtgcgtgagcccccccagcagcaacggcctgggccccgtgcccgtgagcgtgagcgtggacagagcccacgtggacagcaacctgcagttcgagtacatcgacgaccccagagtgcagagaatcgagcccgagtggagcatcgccagcggccacacccccctgaccatcaccggcttcaacctggacgtgatccaggagcccagaatcagagtgaagttcaacggcaaggagagcgtgaacgtgtgcaaggtggtgaacaccaccaccctgacctgcctggcccccagcctgaccaccgactacagacccggcctggacaccgtggagagacccgacgagttcggcttcgtgttcaacaacgtgcagagcctgctgatctacaacgacaccaagttcatctactaccccaaccccaccttcgagctgctgagccccaccggcgtgctggaccagaagcccggcagccccatcatcctgaagggcaagaacctgtgcccccccgccagcggcggcgccaagctgaactacaccgtgctgatcggcgagaccccctgcgccgtgaccgtgagcgagacccagctgctgtgcgagccccccaacctgaccggccagcacaaggtgatggtgcacgtgggcggcatggtgttcagccccggcagcgtgagcgtgatcagcgacagcctgctgaccctgcccgccatcgtgagcatcgccgccggcggcagcctgctgctgatcatcgtgatcatcgtgctgatcgcctacaagagaaagagcagagagaacgacctgaccctgaagagactgcagatgcagatggacaacctggagagcagagtggccctggagtgcaaggaggccttcgccgagctgcagaccgacatcaacgagctgaccagcgacctggacagaagcggcatcccctacctggactacagaacctacgccatgagagtgctgttccccggcatcgaggaccaccccgtgctgagagagctggaggtgcagggcaacggccagcagcacgtggagaaggccctgaagctgttcgcccagctgatcaacaacaaggtgttcctgctgaccttcatcagaaccctggagctgcagagaagcttcagcatgagagacagaggcaacgtggccagcctgatcatgaccggcctgcagggcagactggagtacgccaccgacgtgctgaagcagctgctgagcgacctgatcgacaagaacctggagaacaagaaccaccccaagctgctgctgagaagaaccgagagcgtggccgagaagatgctgaccaactggttcgccttcctgctgcacaagttcctgaaggagtgcgccggcgagcccctgttcatgctgtactgcgccatcaagcagcagatggagaagggccccatcgacgccatcaccggcgaggccagatacagcctgagcgaggacaagctgatcagacagcagatcgagtacaagaccctgatcctgaactgcgtgaaccccgacaacgagaacagccccgagatccccgtgaaggtgctgaactgcgacaccatcacccaggtgaaggagaagatcctggacgccgtgtacaagaacgtgccctacagccagagacccagagccgtggacatggacctggagtggagacagggcagaatcgccagagtggtgctgcaggacgaggacatcaccaccaagatcgagggcgactggaagagactgaacaccctgatgcactaccaggtgagcgacagaagcgtggtggccctggtgcccaagcagaccagcagctacaacatccccgccagcgccagcatcagcagaaccagcatcagcagatacgacagcagcttcagatacaccggcagccccgacagcctgagaagcagagcccccatgatcacccccgacctggagagcggcgtgaaggtgtggcacctggtgaagaaccacgaccacggcgaccagaaggagggcgacagaggcagcaagatggtgagcgagatctacctgaccagactgctggccaccaagggcaccctgcagaagttcgtggacgacctgttcgagaccctgttcagcaccgtgcacagaggcagcgccctgcccctggccatcaagtacatgttcgacttcctggacgagcaggccgacagacacagcatccacgacaccgacgtgagacacacctggaagagcaactgcctgcccctgagattctgggtgaacgtgatcaagaacccccagttcgtgttcgacatccacaagggcagcatcaccgacgcctgcctgagcgtggtggcccagaccttcatggacagctgcagcaccagcgagcacagactgggcaaggacagccccagcaacaagctgctgtacgccaaggacatccccagctacaagagctgggtggagagatactacgccgacatcgccaagctgcccgccatcagcgaccaggacatgaacgcctacctggccgagcagagcagactgcacgccgtggagttcaacatgctgagcgccctgaacgagatctacagctacgtgagcaagtacagcgaggagctgatcggcgccctggagcaggacgagcaggccagaagacagagactggcctacaaggtggagcagctgatcaacgccatgagcatcgagagctag

SEQ ID NO: 93646 - DNA, 5685 bp, Artificial Sequence
  Description of Artificial Sequence: Synthetic coding sequence
atgaaggccatgccctggaactggacctgcctgctgagccacctgctgatggtgggcatgggcagcagcaccctgctgaccagacagcccgcccccctgagccagaagcagagaagcttcgtgaccttcagaggcgagcccgccgagggcttcaaccacctggtggtggacgagagaaccggccacatctacctgggcgccgtgaacagaatctacaagctgagcagcgacctgaaggtgctggtgacccacgagaccggccccgacgaggacaaccccaagtgctacccccccagaatcgtgcagacctgcaacgagcccctgaccaccaccaacaacgtgaacaagatgctgctgatcgactacaaggagaacagactgatcgcctgcggcagcctgtaccagggcatctgcaagctgctgagactggaggacctgttcaagctgggcgagccctaccacaagaaggagcactacctgagcggcgtgaacgagagcggcagcgtgttcggcgtgatcgtgagctacagcaacctggacgacaagctgttcatcgccaccgccgtggacggcaagcccgagtacttccccaccatcagcagcagaaagctgaccaagaacagcgaggccgacggcatgttcgcctacgtgttccacgacgagttcgtggccagcatgatcaagatccccagcgacaccttcaccatcatccccgacttcgacatctactacgtgtacggcttcagcagcggcaacttcgtgtacttcctgaccctgcagcccgagatggtgagcccccccggcagcaccaccaaggagcaggtgtacaccagcaagctggtgagactgtgcaaggaggacaccgccttcaacagctacgtggaggtgcccatcggctgcgagagaagcggcgtggagtacagactgctgcaggccgcctacctgagcaaggccggcgccgtgctgggcagaaccctgggcgtgcaccccgacgacgacctgctgttcaccgtgttcagcaagggccagaagagaaagatgaagagcctggacgagagcgccctgtgcatcttcatcctgaagcagatcaacgacagaatcaaggagagactgcagagctgctacagaggcgagggcaccctggacctggcctggctgaaggtgaaggacatcccctgcagcagcgccctgctgaccatcgacgacaacttctgcggcctggacatgaacgcccccctgggcgtgagcgacatggtgagaggcatccccgtgttcaccgaggacagagacagaatgaccagcgtgatcgcctacgtgtacaagaaccacagcctggccttcgtgggcaccaagagcggcaagctgaagaagatcagagtggacggccccagaggcaacgccctgcagtacgagaccgtgcaggtggtggaccccggccccgtgctgagagacatggccttcagcaaggaccacgagcagctgtacatcatgagcgagagacagctgaccagagtgcccgtggagagctgcggccagtaccagagctgcggcgagtgcctgggcagcggcgacccccactgcggctggtgcgtgctgcacaacacctgcaccagaaaggagagatgcgagagaagcaaggagcccagaagattcgccagcgagatgaagcagtgcgtgagactgaccgtgcaccccaacaacatcagcgtgagccagtacaacgtgctgctggtgctggagacctacaacgtgcccgagctgagcgccggcgtgaactgcaccttcgaggacctgagcgagatggacggcctggtggtgggcaaccagatccagtgctacagccccgccgccaaggaggtgcccagaatcatcaccgagaacggcgaccaccacgtggtgcagctgcagctgaagagcaaggagaccggcatgaccttcgccagcaccagcttcgtgttctacaactgcagcgtgcacaacagctgcctgagctgcgtggagagcccctacagatgccactggtgcaagtacagacacgtgtgcacccacgaccccaagacctgcagcttccaggagggcagagtgaagctgcccgaggactgcccccagctgctgagagtggacaagatcctggtgcccgtggaggtgatcaagcccatcaccctgaaggccaagaacctgccccagccccagagcggccagagaggctacgagtgcatcctgaacatccagggcagcgagcagagagtgcccgccctgagattcaacagcagcagcgtgcagtgccagaacaccagctacagctacgagggcatggagatcaacaacctgcccgtggagctgaccgtggtgtggaacggccacttcaacatcgacaaccccgcccagaacaaggtgcacctgtacaagtgcggcgccatgagagagagctgcggcctgtgcctgaaggccgaccccgacttcgcctgcggctggtgccagggccccggccagtgcaccctgagacagcactgccccgcccaggagagccagtggctggagctgagcggcgccaagagcaagtgcaccaaccccagaatcaccgagatcatccccgtgaccggccccagagagggcggcaccaaggtgaccatcagaggcgagaacctgggcctggagttcagagacatcgccagccacgtgaaggtggccggcgtggagtgcagccccctggtggacggctacatccccgccgagcagatcgtgtgcgagatgggcgaggccaagcccagccagcacgccggcttcgtggagatctgcgtggccgtgtgcagacccgagttcatggccagaagcagccagctgtactacttcatgaccctgaccctgagcgacctgaagcccagcagaggccccatgagcggcggcacccaggtgaccatcaccggcaccaacctgaacgccggcagcaacgtggtggtgatgttcggcaagcagccctgcctgttccacagaagaagccccagctacatcgtgtgcaacaccaccagcagcgacgaggtgctggagatgaaggtgagcgtgcaggtggacagagccaagatccaccaggacctggtgttccagtacgtggaggaccccaccatcgtgagaatcgagcccgagtggagcatcgtgagcggcaacacccccatcgccgtgtggggcacccacctggacctgatccagaacccccagatcagagccaagcacggcggcaaggagcacatcaacatctgcgaggtgctgaacgccaccgagatgacctgccaggcccccgccctggccctgggccccgaccaccagagcgacctgaccgagagacccgaggagttcggcttcatcctggacaacgtgcagagcctgctgatcctgaacaagaccaacttcacctactaccccaaccccgtgttcgaggccttcggccccagcggcatcctggagctgaagcccggcacccccatcatcctgaagggcaagaacctgatcccccccgtggccggcggcaacgtgaagctgaactacaccgtgctggtgggcgagaagccctgcaccgtgaccgtgagcgacgtgcagctgctgtgcgagagccccaacctgatcggcagacacaaggtgatggccagagtgggcggcatggagtacagccccggcatggtgtacatcgcccccgacagccccctgagcctgcccgccatcgtgagcatcgccgtggccggcggcctgctgatcatcttcatcgtggccgtgctgatcgcctacaagagaaagagcagagagagcgacctgaccctgaagagactgcagatgcagatggacaacctggagagcagagtggccctggagtgcaaggaggccttcgccgagctgcagaccgacatccacgagctgaccagcgacctggacggcgccggcatccccttcctggactacagaacctacaccatgagagtgctgttccccggcatcgaggaccaccccgtgctgagagacctggaggtgcccggctacagacaggagagagtggagaagggcctgaagctgttcgcccagctgatcaacaacaaggtgttcctgctgagcttcatcagaaccctggagagccagagaagcttcagcatgagagacagaggcaacgtggccagcctgatcatgaccgtgctgcagagcaagctggagtacgccaccgacgtgctgaagcagctgctggccgacctgatcgacaagaacctggagagcaagaaccaccccaagctgctgctgagaagaaccgagagcgtggccgagaagatgctgaccaactggttcaccttcctgctgtacaagttcctgaaggagtgcgccggcgagcccctgttcagcctgttctgcgccatcaagcagcagatggagaagggccccatcgacgccatcaccggcgaggccagatacagcctgagcgaggacaagctgatcagacagcagatcgactacaagaccctggtgctgagctgcgtgagccccgacaacgccaacagccccgaggtgcccgtgaagatcctgaactgcgacaccatcacccaggtgaaggagaagatcctggacgccatcttcaagaacgtgccctgcagccacagacccaaggccgccgacatggacctggagtggagacagggcagcggcgccagaatgatcctgcaggacgaggacatcaccaccaagatcgagaacgactggaagagactgaacaccctggcccactaccaggtgcccgacggcagcgtggtggccctggtgagcaagcaggtgaccgcctacaacgccgtgaacaacagcaccgtgagcagaaccagcgccagcaagtacgagaacatgatcagatacaccggcagccccgacagcctgagaagcagaacccccatgatcacccccgacctggagagcggcgtgaagatgtggcacctggtgaagaaccacgagcacggcgaccagaaggagggcgacagaggcagcaagatggtgagcgagatctacctgaccagactgctggccaccaagggcaccctgcagaagttcgtggacgacctgttcgagaccatcttcagcaccgcccacagaggcagcgccctgcccctggccatcaagtacatgttcgacttcctggacgagcaggccgacaagcacggcatccacgacccccacgtgagacacacctggaagagcaactgcctgcccctgagattctgggtgaacatgatcaagaacccccagttcgtgttcgacatccacaagaacagcatcaccgacgcctgcctgagcgtggtggcccagaccttcatggacagctgcagcaccagcgagcacagactgggcaaggacagccccagcaacaagctgctgtacgccaaggacatccccagctacaagaactgggtggagagatactacagcgacatcggcaagatgcccgccatcagcgaccaggacatgaacgcctacctggccgagcagagcagaatgcacatgaacgagttcaacaccatgagcgccctgagcgagatcttcagctacgtgggcaagtacagcgaggagatcctgggccccctggaccacgacgaccagtgcggcaagcagaagctggcctacaagctggagcaggtgatcaccctgatgagcctggacagctag

SEQ ID NO: 93647 - DNA, 5685 bp, Artificial Sequence; identical to SEQ ID NO: 93646
  Description of Artificial Sequence: Synthetic coding sequence

SEQ ID NO: 93648 - DNA, 1569 bp, Artificial Sequence
  Description of Artificial Sequence: Synthetic coding sequence
atgaaggccatgccctggaactggacctgcctgctgagccacctgctgatggtgggcatgggcagcagcaccctgctgaccagacagcccgcccccctgagccagaagcagagaagcttcgtgaccttcagaggcgagcccgccgagggcttcaaccacctggtggtggacgagagaaccggccacatctacctgggcgccgtgaacagaatctacaagctgagcagcgacctgaaggtgctggtgacccacgagaccggccccgacgaggacaaccccaagtgctacccccccagaatcgtgcagacctgcaacgagcccctgaccaccaccaacaacgtgaacaagatgctgctgatcgactacaaggagaacagactgatcgcctgcggcagcctgtaccagggcatctgcaagctgctgagactggaggacctgttcaagctgggcgagccctaccacaagaaggagcactacctgagcggcgtgaacgagagcggcagcgtgttcggcgtgatcgtgagctacagcaacctggacgacaagctgttcatcgccaccgccgtggacggcaagcccgagtacttccccaccatcagcagcagaaagctgaccaagaacagcgaggccgacggcatgttcgcctacgtgttccacgacgagttcgtggccagcatgatcaagatccccagcgacaccttcaccatcatccccgacttcgacatctactacgtgtacggcttcagcagcggcaacttcgtgtacttcctgaccctgcagcccgagatggtgagcccccccggcagcaccaccaaggagcaggtgtacaccagcaagctggtgagactgtgcaaggaggacaccgccttcaacagctacgtggaggtgcccatcggctgcgagagaagcggcgtggagtacagactgctgcaggccgcctacctgagcaaggccggcgccgtgctgggcagaaccctgggcgtgcaccccgacgacgacctgctgttcaccgtgttcagcaagggccagaagagaaagatgaagagcctggacgagagcgccctgtgcatcttcatcctgaagcagatcaacgacagaatcaaggagagactgcagagctgctacagaggcgagggcaccctggacctggcctggctgaaggtgaaggacatcccctgcagcagcgccctgctgaccatcgacgacaacttctgcggcctggacatgaacgcccccctgggcgtgagcgacatggtgagaggcatccccgtgttcaccgaggacagagacagaatgaccagcgtgatcgcctacgtgtacaagaaccacagcctggccttcgtgggcaccaagagcggcaagctgaagaagagcttcggcaccggcccccagggcggcatcacccaggagtggatcggcgtggagggcgacccccccggcgccaacatcgccagccaggagcagatgctgtgcgtgtacctgcagtgcagcagccacaaggccatcagcgaccagagagtgcagcccctgctgtgctgcttcctgaacgtgcccggcaacagcagctag

SEQ ID NO: 93649 - DNA, 1479 bp, Artificial Sequence
  Description of Artificial Sequence: Synthetic coding sequence
atgaaggccatgccctggaactggacctgcctgctgagccacctgctgatggtgggcatgggcagcagcaccctgctgaccagacagcccgcccccctgagccagaagcagagaagcttcgtgaccttcagaggcgagcccgccgagggcttcaaccacctggtggtggacgagagaaccggccacatctacctgggcgccgtgaacagaatctacaagctgagcagcgacctgaaggtgctggtgacccacgagaccggccccgacgaggacaaccccaagtgctacccccccagaatcgtgcagacctgcaacgagcccctgaccaccaccaacaacgtgaacaagatgctgctgatcgactacaaggagaacagactgatcgcctgcggcagcctgtaccagggcatctgcaagctgctgagactggaggacctgttcaagctgggcgagccctaccacaagaaggagcactacctgagcggcgtgaacgagagcggcagcgtgttcggcgtgatcgtgagctacagcaacctggacgacaagctgttcatcgccaccgccgtggacggcaagcccgagtacttccccaccatcagcagcagaaagctgaccaagaacagcgaggccgacggcatgttcgcctacgtgttccacgacgagttcgtggccagcatgatcaagatccccagcgacaccttcaccatcatccccgacttcgacatctactacgtgtacggcttcagcagcggcaacttcgtgtacttcctgaccctgcagcccgagatggtgagcccccccggcagcaccaccaaggagcaggtgtacaccagcaagctggtgagactgtgcaaggaggacaccgccttcaacagctacgtggaggtgcccatcggctgcgagagaagcggcgtggagtacagactgctgcaggccgcctacctgagcaaggccggcgccgtgctgggcagaaccctgggcgtgcaccccgacgacgacctgctgttcaccgtgttcagcaagggccagaagagaaagatgaagagcctggacgagagcgccctgtgcatcttcatcctgaagcagatcaacgacagaatcaaggagagactgcagagctgctacagaggcgagggcaccctggacctggcctggctgaaggtgaaggacatcccctgcagcagcgccctgctgaccatcgacgacaacttctgcggcctggacatgaacgcccccctgggcgtgagcgacatggtgagaggcatccccgtgttcaccgaggacagagacagaatgaccagcgtgatcgcctacgtgtacaagaaccacagcctggccttcgtgggcaccaagagcggcaagctgaagaagatgcccggcaccagcctgtgccccaccctggagctgcagaccggccccagaagccacagagccaccgtgaccctggagctgctgttcagcagctgcagcagcaactag

SEQ ID NO: 93650 - DNA, 5517 bp, Artificial Sequence
  Description of Artificial Sequence: Synthetic coding sequence
atggccctgcagctgtgggccctgaccctgctgggcctgctgggcgccggcgccagcctgagacccagaaagctggacttcttcagaagcgagaaggagctgaaccacctggccgtggacgaggccagcggcgtggtgtacctgggcgccgtgaacgccctgtaccagctggacgccaagctgcagctggagcagcaggtggccaccggccccgccctggacaacaagaagtgcaccccccccatcgaggccagccagtgccacgaggccgagatgaccgacaacgtgaaccagctgctgctgctggacccccccagaaagagactggtggagtgcggcagcctgttcaagggcatctgcgccctgagagccctgagcaacatcagcctgagactgttctacgaggacggcagcggcgagaagagcttcgtggccagcaacgacgagggcgtggccaccgtgggcctggtgagcagcaccggccccggcggcgacagagtgctgttcgtgggcaagggcaacggcccccacgacaacggcatcatcgtgagcaccagactgctggacagaaccgacagcagagaggccttcgaggcctacaccgaccacgccacctacaaggccggctacctgagcaccaacacccagcagttcgtggccgccttcgaggacggcccctacgtgttcttcgtgttcaaccagcaggacaagcaccccgccagaaacagaaccctgctggccagaatgtgcagagaggaccccaactactacagctacctggagatggacctgcagtgcagagaccccgacatccacgccgccgccttcggcacctgcctggccgccagcgtggccgcccccggcagcggcagagtgctgtacgccgtgttcagcagagacagcagaagcagcggcggccccggcgccggcctgtgcctgttccccctggacaaggtgcacgccaagatggaggccaacagaaacgcctgctacaccggcaccagagaggccagagacatcttctacaagcccttccacggcgacatccagtgcggcggccacgcccccggcagcagcaagagcttcccctgcggcagcgagcacctgccctaccccctgggcagcagagacggcctgagaggcaccgccgtgctgcagagaggcggcctgaacctgaccgccgtgaccgtggccgccgagaacaaccacaccgtggccttcctgggcaccagcgacggcagaatcctgaaggtgtacctgacccccgacggcaccagcagcgagtacgacagcatcctggtggagatcaacaagagagtgaagagagacctggtgctgagcggcgacctgggcagcctgtacgccatgacccaggacaaggtgttcagactgcccgtgcaggagtgcctgagctaccccacctgcacccagtgcagagacagccaggacccctactgcggctggtgcgtggtggagggcagatgcaccagaaaggccgagtgccccagagccgaggaggccagccactggctgtggagcagaagcaagagctgcgtggccgtgaccagcgcccagccccagaacatgagcagaagagcccagggcgaggtgcagctgaccgtgagccccctgcccgccctgagcgaggaggacgagctgctgtgcctgttcggcgagagccccccccaccccgccagagtggagggcgaggccgtgatctgcaacagccccagcagcatccccgtgaccccccccggccaggaccacgtggccgtgaccatccagctgctgctgagaagaggcaacatcttcctgaccagctaccagtaccccttctacgactgcagacaggccatgagcctggaggagaacctgccctgcatcagctgcgtgagcaacagatggacctgccagtgggacctgagataccacgagtgcagagaggccagccccaaccccgaggacggcatcgtgagagcccacatggaggacagctgcccccagttcctgggccccagccccctggtgatccccatgaaccacgagaccgacgtgaacttccagggcaagaacctggacaccgtgaagggcagcagcctgcacgtgggcagcgacctgctgaagttcatggagcccgtgaccatgcaggagagcggcaccttcgccttcagaacccccaagctgagccacgacgccaacgagaccctgcccctgcacctgtacgtgaagagctacggcaagaacatcgacagcaagctgcacgtgaccctgtacaactgcagcttcggcagaagcgactgcagcctgtgcagagccgccaaccccgactacagatgcgcctggtgcggcggccagagcagatgcgtgtacgaggccctgtgcaacaccaccagcgagtgccccccccccgtgatcaccagaatccagcccgagaccggccccctgggcggcggcatcagaatcaccatcctgggcagcaacctgggcgtgcaggccggcgacatccagagaatcagcgtggccggcagaaactgcagcttccagcccgagagatacagcgtgagcaccagaatcgtgtgcgtgatcgaggccgccgagacccccttcaccggcggcgtggaggtggacgtgttcggcaagctgggcagaagcccccccaacgtgcagttcaccttccagcagcccaagcccctgagcgtggagccccagcagggcccccaggccggcggcaccaccctgaccatccacggcacccacctggacaccggcagccaggaggacgtgagagtgaccctgaacggcgtgccctgcaaggtgaccaagttcggcgcccagctgcagtgcgtgaccggcccccaggccaccagaggccagatgctgctggaggtgagctacggcggcagccccgtgcccaaccccggcatcttcttcacctacagagagaaccccgtgctgagagccttcgagcccctgagaagcttcgccagcggcggcagaagcatcaacgtgaccggccagggcttcagcctgatccagagattcgccatggtggtgatcgccgagcccctgcagagctggcagccccccagagaggccgagagcctgcagcccatgaccgtggtgggcaccgactacgtgttccacaacgacaccaaggtggtgttcctgagccccgccgtgcccgaggagcccgaggcctacaacctgaccgtgctgatcgagatggacggccacagagccctgctgagaaccgaggccggcgccttcgagtacgtgcccgaccccaccttcgagaacttcaccggcggcgtgaagaagcaggtgaacaagctgatccacgccagaggcaccaacctgaacaaggccatgaccctgcaggaggccgaggccttcgtgggcgccgagagatgcaccatgaagaccctgaccgagaccgacctgtactgcgagccccccgaggtgcagcccccccccaagagaagacagaagagagacaccacccacaacctgcccgagttcatcgtgaagttcggcagcagagagtgggtgctgggcagagtggagtacgacaccagagtgagcgacgtgcccctgagcctgatcctgcccctggtgatcgtgcccatggtggtggtgatcgccgtgagcgtgtactgctactggagaaagagccagcaggccgagagagagtacgagaagatcaagagccagctggagggcctggaggagagcgtgagagacagatgcaagaaggagttcaccgacctgatgatcgagatggaggaccagaccaacgacgtgcacgaggccggcatccccgtgctggactacaagacctacaccgacagagtgttcttcctgcccagcaaggacggcgacaaggacgtgatgatcaccggcaagctggacatccccgagcccagaagacccgtggtggagcaggccctgtaccagttcagcaacctgctgaacagcaagagcttcctgatcaacttcatccacaccctggagaaccagagagagttcagcgccagagccaaggtgtacttcgccagcctgctgaccgtggccctgcacggcaagctggagtactacaccgacatcatgcacaccctgttcctggagctgctggagcagtacgtggtggccaagaaccccaagctgatgctgagaagaagcgagaccgtggtggagagaatgctgagcaactggatgagcatctgcctgtaccagtacctgaaggacagcgccggcgagcccctgtacaagctgttcaaggccatcaagcaccaggtggagaagggccccgtggacgccgtgcagaagaaggccaagtacaccctgaacgacaccggcctgctgggcgacgacgtggagtacgcccccctgaccgtgagcgtgatcgtgcaggacgagggcgtggacgccatccccgtgaaggtgctgaactgcgacaccatcagccaggtgaaggagaagatcatcgaccaggtgtacagaggccagccctgcagctgctggcccagacccgacagcgtggtgctggagtggagacccggcagcaccgcccagatcctgagcgacctggacctgaccagccagagagagggcagatggaagagagtgaacaccctgatgcactacaacgtgagagacggcgccaccctgatcctgagcaaggtgggcgtgagccagcagcccgaggacagccagcaggacctgcccggcgagagacacgccctgctggaggaggagaacagagtgtggcacctggtgagacccaccgacgaggtggacgagggcaagagcaagagaggcagcgtgaaggagaaggagagaaccaaggccatcaccgagatctacctgaccagactgctgagcgtgaagggcaccctgcagcagttcgtggacaacttcttccagagcgtgctggcccccggccacgccgtgccccccgccgtgaagtacttcttcgacttcctggacgagcaggccgagaagcacaacatccaggacgaggacaccatccacatctggaagaccaacagcctgcccctgagattctgggtgaacatcctgaagaacccccacttcatcttcgacgtgcacgtgcacgaggtggtggacgccagcctgagcgtgatcgcccagaccttcatggacgcctgcaccagaaccgagcacaagctgagcagagacagccccagcaacaagctgctgtacgccaaggagatcagcacctacaagaagatggtggaggactactacaagggcatcagacagatggtgcaggtgagcgaccaggacatgaacacccacctggccgagatcagcagagcccacaccgacagcctgaacaccctggtggccctgcaccagctgtaccagtacacccagaagtactacgacgagatcatcaacgccctggaggaggaccccgccgcccagaagatgcagctggccttcagactgcagcagatcgccgccgccctggagaacaaggtgaccgacctgtag

SEQ ID NO: 93651 - DNA, 1044 bp, Artificial Sequence
  Description of Artificial Sequence: Synthetic coding sequence
atgcacaccctgttcctggagctgctggagcagtacgtggtggccaagaaccccaagctgatgctgagaagaagcgagaccgtggtggagagaatgctgagcaactggatgagcatctgcctgtaccagtacctgaaggacagcgccggcgagcccctgtacaagctgttcaaggccatcaagcaccaggtggagaagggccccgtggacgccgtgcagaagaaggccaagtacaccctgaacgacaccggcctgctgggcgacgacgtggagtacgcccccctgaccgtgagcgtgatcgtgcaggacgagggcgtggacgccatccccgtgaaggtgctgaactgcgacaccatcagccaggtgaaggagaagatcatcgaccaggtgtacagaggccagccctgcagctgcggccccggccagaccgcctggagctggagcggcgtgagagccccccagagaagaagcgtgggccccggccccgacgtgaccgccggcggccccgtggaggccagacagcacccctacgccctgcagtgccccggctggagccacccccaccccgtgcagggcggcggcctgcccgccgccggcggccagcccgccggccccgcctggagcgccatgccccccggcggcggcgagcccggcgtggcccccggcgccgccgacagaagaggcggcagaggccaggtgcaggagagacagagagagagagagggcgccgacgagggccaccacagagacctgcccgacgccgccgccctgagccagggccacaccgccgccgtgtgcggccagctgctgcccgagagagccggcgcctggcacgccgtgccccccgccgtgaagtacttcttcgacttcctggacgagcaggccgagaagcacaacatccaggacgaggacaccatccacatctggaagaccaacagcctgcccctgagattctgggtgaacatcctgaagaacccccacttcatcttcgacgtgcacgtgaccagatggtggacccccagatgccagagcagcagaagatag

SEQ ID NO: 93652 - DNA, 483 bp, Artificial Sequence
  Description of Artificial Sequence: Synthetic coding sequence
ggccccgacgtgaccgccggcggccccgtggaggccagacagcacccctacgccctgcagtgccccggctggagccacccccaccccgtgcagggcggcggcctgcccgccgccggcggccagcccgccggccccgcctggggcgccccctgcccccccggcggcggcgagcccggcgtggcccccggcgccgccgacagaagaggcggcagaggccaggtgcaggagagacagagagagagagagggcgccgacgagggccaccacagagacctgcccgacgccgccgccctgagccagggccacaccgccgccgtgtgcggccagctgctgcccgagagagccggcctgggcaccagatgccacctgcagagcagcaccagcagcaccagctggaccagcagacagagaagcaccaccagcagaatgaagacccccagcaccagcggcagaagaaccgcctacagaagcggcagcggctag

SEQ ID NO: 93653 - DNA, 1569 bp, Artificial Sequence
  Description of Artificial Sequence: Synthetic coding sequence
atggccctgcagctgtgggccctgaccctgctgggcctgctgggcgccggcgccagcctgagacccagaaagctggacttcttcagaagcgagaaggagctgaaccacctggccgtggacgaggccagcggcgtggtgtacctgggcgccgtgaacgccctgtaccagctggacgccaagctgcagctggagcagcaggtggccaccggccccgccctggacaacaagaagtgcaccccccccatcgaggccagccagtgccacgaggccgagatgaccgacaacgtgaaccagctgctgctgctggacccccccagaaagagactggtggagtgcggcagcctgttcaagggcatctgcgccctgagagccctgagcaacatcagcctgagactgttctacgaggacggcagcggcgagaagagcttcgtggccagcaacgacgagggcgtggccaccgtgggcctggtgagcagcaccggccccggcggcgacagagtgctgttcgtgggcaagggcaacggcccccacgacaacggcatcatcgtgagcaccagactgctggacagaaccgacagcagagaggccttcgaggcctacaccgaccacgccacctacaaggccggctacctgagcaccaacacccagcagttcgtggccgccttcgaggacggcccctacgtgttcttcgtgttcaaccagcaggacaagcaccccgccagaaacagaaccctgctggccagaatgtgcagagaggaccccaactactacagctacctggagatggacctgcagtgcagagaccccgacatccacgccgccgccttcggcacctgcctggccgccagcgtggccgcccccggcagcggcagagtgctgtacgccgtgttcagcagagacagcagaagcagcggcggccccggcgccggcctgtgcctgttccccctggacaaggtgcacgccaagatggaggccaacagaaacgcctgctacaccggcaccagagaggccagagacatcttctacaagcccttccacggcgacatccagtgcggcggccacgcccccggcagcagcaagagcttcccctgcggcagcgagcacctgccctaccccctgggcagcagagacggcctgagaggcaccgccgtgctgcagagaggcggcctgaacctgaccgccgtgaccgtggccgccgagaacaaccacaccgtggccttcctgggcaccagcgacggcagaatcctgaaggtgtacctgacccccgacggcaccagcagcgagtacgacagcatcctggtggagatcaacaagagagtgaagagagacctggtgctgagcggcgacctgggcagcctgtacgccatgacccaggacaaggtgttcagactgcccgtgcaggagtgcctgagctaccccacctgcacccagctgccccccgccgccgagcccgccagcggcgtgcactgcagagtgagcagcgacctgaagatgtgcctgaccctgcccagatggggccagctggccagcgccagcgcccacgcccccgccgccgccagcatgccctag

SEQ ID NO: 93654 - DNA, 489 bp, Artificial Sequence
  Description of Artificial Sequence: Synthetic coding sequence
atggccctgcagctgtgggccctgaccctgctgggcctgctgggcgccggcgccagcctgagacccagaaagctggacttcttcagaagcgagaaggagctgaaccacctggccgtggacgaggccagcggcgtggtgtacctgggcgccgtgaacgccctgtaccagctggacgccaagctgcagctggagcagcaggtggccaccggccccgccctggacaacaagaagtgcaccccccccatcgaggccagccagtgccacgaggccgagatgaccgacaacgtgaaccagctgctgctgctggacccccccagaaagagactggtggagtgcggcagcctgttcaagggcatctgcgccctgagagccctgagcaacatcagcctgagactgttctacgaggacggcagcggcgagaagagcttcgtggccagcaacgacgagggcgtggccaccgtgggcctggtgagcagcaccggcccctag

SEQ ID NO: 93655 - DNA, 1434 bp, Artificial Sequence
  Description of Artificial Sequence: Synthetic coding sequence
atggccctgcagctgtgggccctgaccctgctgggcctgctgggcgccggcgccagcctgagacccagaaagctggacttcttcagaagcgagaaggagctgaaccacctggccgtggacgaggccagcggcgtggtgtacctgggcgccgtgaacgccctgtaccagctggacgccaagctgcagctggagcagcaggtggccaccggccccgccctggacaacaagaagtgcaccccccccatcgaggccagccagtgccacgaggccgagatgaccgacaacgtgaaccagctgctgctgctggacccccccagaaagagactggtggagtgcggcagcctgttcaagggcatctgcgccctgagagccctgagcaacatcagcctgagactgttctacgaggacggcagcggcgagaagagcttcgtggccagcaacgacgagggcgtggccaccgtgggcctggtgagcagcaccggccccggcggcgacagagtgctgttcgtgggcaagggcaacggcccccacgacaacggcatcatcgtgagcaccagactgctggacagaaccgacagcagagaggccttcgaggcctacaccgaccacgccacctacaaggccggctacctgagcaccaacacccagcagttcgtggccgccttcgaggacggcccctacgtgttcttcgtgttcaaccagcaggacaagcaccccgccagaaacagaaccctgctggccagaatgtgcagagaggaccccaactactacagctacctggagatggacctgcagtgcagagaccccgacatccacgccgccgccttcggcacctgcctggccgccagcgtggccgcccccggcagcggcagagtgctgtacgccgtgttcagcagagacagcagaagcagcggcggccccggcgccggcctgtgcctgttccccctggacaaggtgcacgccaagatggaggccaacagaaacgcctgctacaccggcaccagagaggccagagacatcttctacaagcccttccacggcgacatccagtgcggcggccacgcccccggcagcagcaagagcttcccctgcggcagcgagcacctgccctaccccctgggcagcagagacggcctgagaggcaccgccgtgctgcagagaggcggcctgaacctgaccgccgtgaccgtggccgccgagaacaaccacaccgtggccttcctgggcaccagcgacggcagaatcctgaaggtgtacctgacccccgacggcaccagcagcgagtacgacagcatcctggtggagatcaacaagagagtgaagagagacctggtgctgagcggcgacctgggcagcctgtacgccatgacccaggacaaggtgttcagactgcccgtgcaggagtgcctgagctaccccacctgcacccagtag

SEQ ID NO: 93656 - DNA, 5517 bp, Artificial Sequence; identical to SEQ ID NO: 93650
  Description of Artificial Sequence: Synthetic coding sequence

SEQ ID NO: 93657 - DNA, 5730 bp, Artificial Sequence
  Description of Artificial Sequence: Synthetic coding sequence
atgtgccacgccgcccaggagacccccctgctgcaccacttcatggcccccgtgatggccagatggccccccttcggcctgtgcctgctgctgctgctgctgagccccccccccctgcccctgaccggcgcccacagattcagcgcccccaacaccaccctgaaccacctggccctggcccccggcagaggcaccctgtacgtgggcgccgtgaacagactgttccagctgagccccgagctgcagctggaggccgtggccgtgaccggccccgtgatcgacagccccgactgcgtgcccttcagagaccccgccgagtgcccccaggcccagctgaccgacaacgccaaccagctgctgctggtgagcagcagagcccaggagctggtggcctgcggccaggtgagacagggcgtgtgcgagaccagaagactgggcgacgtggccgaggtgctgtaccaggccgaggaccccggcgacggccagttcgtggccgccaacacccccggcgtggccaccgtgggcctggtggtgcccctgcccggcagagacctgctgctggtggccagaggcctggccggcaagctgagcgccggcgtgccccccctggccatcagacagctggccggcagccagcccttcagcagcgagggcctgggcagactggtggtgggcgacttcagcgactacaacaacagctacgtgggcgccttcgccgacgccagaagcgcctacttcgtgttcagaagaagaggcgccagagcccaggccgagtacagaagctacgtggccagagtgtgcctgggcgacaccaacctgtacagctacgtggaggtgcccctggcctgccagggccagggcctgatccaggccgccttcctggcccccggcaccctgctgggcgtgttcgccgccggccccagaggcacccaggccgccctgtgcgccttccccatggtggagctgggcgccagcatggagcaggccagaagactgtgctacaccgccggcggcagaggccccagcggcgccgaggaggccaccgtggagtacggcgtgaccagcagatgcgtgaccctgcccctggacagccccgagagctacccctgcggcgacgagcacacccccagccccatcgccggcagacagcccctggaggtgcagcccctgctgaagctgggccagcccgtgagcgccgtggccgccctgcaggccgacggccacatgatcgccttcctgggcgacacccagggccagctgtacaaggtgttcctgcacggcagccagggccaggtgtaccacagccagcaggtgggcccccccggcagcgccatcagccccgacctgctgctggacagcagcggcagccacctgtacgtgctgaccgcccaccaggtggacagaatccccgtggccgcctgcccccagttccccgactgcgccagctgcctgcaggcccaggaccccctgtgcggctggtgcgtgctgcagggcagatgcaccagaaagggccagtgcggcagagccggccagctgaaccagtggctgtggagctacgaggaggacagccactgcctgcacatccagagcctgctgcccggccaccaccccagacaggagcagggccaggtgaccctgagcgtgcccagactgcccatcctggacgccgacgagtacttccactgcgccttcggcgactacgacagcctggcccacgtggagggcccccacgtggcctgcgtgacccccccccaggaccaggtgcccctgaacccccccggcaccgaccacgtgaccgtgcccctggccctgatgttcgaggacgtgaccgtggccgccaccaacttcagcttctacgactgcagcgccgtgcaggccctggaggccgccgccccctgcagagcctgcgtgggcagcatctggagatgccactggtgcccccagagcagccactgcgtgtacggcgagcactgccccgagggcgagagaaccatctacagcgcccaggaggtggacatccaggtgagaggccccggcgcctgcccccaggtggagggcctggccggcccccacctggtgcccgtgggctgggagagccacctggccctgagagtgagaaacctgcagcacttcagaggcctgcccgccagcttccactgctggctggagctgcccggcgagctgagaggcctgcccgccaccctggaggagaccgccggcgacagcggcctgatccactgccaggcccaccagttctaccccagcatgagccagagagagctgcccgtgcccatctacgtgacccagggcgaggcccagagactggacaacacccacgccctgtacgtgatcctgtacgactgcgccatgggccaccccgactgcagccactgccaggccgccaacagaagcctgggctgcctgtggtgcgccgacggccagcccgcctgcagatacggccccctgtgcccccccggcgccgtggagctgctgtgccccgcccccagcatcgacgccgtggagcccctgaccggcccccccgagggcggcctggccctgaccatcctgggcagcaacctgggcagagccttcgccgacgtgcagtacgccgtgagcgtggccagcagaccctgcaaccccgagcccagcctgtacagaaccagcgccagaatcgtgtgcgtgaccagccccgcccccaacggcaccaccggccccgtgagagtggccatcaagagccagccccccggcatcagcagccagcacttcacctaccaggaccccgtgctgctgagcctgagccccagatggggcccccaggccggcggcacccagctgaccatcagaggccagcacctgcagaccggcggcaacaccagcgccttcgtgggcggccagccctgccccatcctggagcccgtgtgccccgaggccatcgtgtgcagaaccagaccccaggccgcccccggcgaggccgccgtgctggtggtgttcggccacgcccagagaaccctgctggccagccccttcagatacaccgccaacccccagctggtggccgccgagcccagcgccagcttcagaggcggcggcagactgatcagagtgagaggcaccggcctggacgtggtgcagagacccctgctgagcgtgtggctggaggccgacgccgaggtgcaggccagcagagcccagccccaggacccccagcccagaagaagctgcggcgcccccgccgccgacccccaggcctgcatccagctgggcggcggcctgctgcagtgcagcaccgtgtgcagcgtgaacagcagcagcctgctgctgtgcagaagccccgccgtgcccgacagagcccacccccagagagtgttcttcaccctggacaacgtgcaggtggacttcgccagcgccagcggcggccagggcttcctgtaccagcccaaccccagactggcccccctgagcagagagggccccgccagaccctacagactgaagcccggccacgtgctggacgtggagggcgagggcctgaacctgggcatcagcaaggaggaggtgagagtgcacatcggcagaggcgagtgcctggtgaagaccctgaccagaacccacctgtactgcgagccccccgcccacgccccccagcccgccaacggcagcggcctgccccagttcgtggtgcagatgggcaacgtgcagctggccctgggccccgtgcagtacgaggccgagccccccctgagcgccttccccgtggaggcccaggccggcgtgggcatgggcgccgccgtgctgatcgccgccgtgctgctgctgaccctgatgtacagacacaagagcaagcaggccctgagagactaccagaaggtgctggtgcagctggagagcctggagaccggcgtgggcgaccagtgcagaaaggagttcaccgacctgatgaccgagatgaccgacctgagcagcgacctggagggcagcggcatccccttcctggactacagaacctacgccgagagagccttcttccccggccacggcggctgccccctgcagcccaagcccgagggccccggcgaggacggccactgcgccaccgtgagacagggcctgacccagctgagcaacctgctgaacagcaagctgttcctgctgaccctgatccacaccctggaggagcagcccagcttcagccagagagacagatgccacgtggccagcctgctgagcctggccctgcacggcaagctggagtacctgaccgacatcatgagaaccctgctgggcgacctggccgcccactacgtgcacagaaaccccaagctgatgctgagaagaaccgagaccatggtggagaagctgctgaccaactggctgagcatctgcctgtacgccttcctgagagaggtggccggcgagcccctgtacatgctgttcagagccatccagtaccaggtggacaagggccccgtggacgccgtgaccggcaaggccaagagaaccctgaacgacagcagactgctgagagaggacgtggagttccagcccctgaccctgatggtgctggtgggccccggcgccggcggcgccgccggcagcagcgagatgcagagagtgcccgccagagtgctggacaccgacaccatcacccaggtgaaggagaaggtgctggaccaggtgtacaagggcacccccttcagccagagacccagcgtgcacgccctggacctggagtggagaagcggcctggccggccacctgaccctgagcgacgaggacctgaccagcgtgacccagaaccactggaagagactgaacaccctgcagcactacaaggtgcccgacggcgccaccgtgggcctggtgccccagctgcacagaggcagcaccatcagccagagcctggcccagagatgccccctgggcgagaacatccccaccctggaggacggcgaggagggcggcgtgtgcctgtggcacctggtgaaggccaccgaggagcccgagggcgccaaggtgagatgcagcagcctgagagagagagagcccgccagagccaaggccatccccgagatctacctgaccagactgctgagcatgaagggcaccctgcagaagttcgtggacgacaccttccaggccatcctgagcgtgaacagacccatccccatcgccgtgaagtacctgttcgacctgctggacgagctggccgagaagcacggcatcgaggaccccggcaccctgcacatctggaagaccaacagcctgctgctgagattctgggtgaacgccctgaagaacccccagctgatcttcgacgtgagagtgagcgacaacgtggacgccatcctggccgtgatcgcccagaccttcatcgacagctgcaccaccagcgagcacaaggtgggcagagacagccccgtgaacaagctgctgtacgccagagagatccccagatacaagcagatggtggagagatactacgccgacatcagacagagcagccccgccagctaccaggagatgaacagcgccctggccgagctgagcggcaactacaccagcgccccccactgcctggaggccctgcaggagctgtacaaccacatccacagatactacgaccagatcatcagcgccctggaggaggaccccgtgggccagaagctgcagctggcctgcagactgcagcaggtggccgccctggtggagaacaaggtgaccgacctgtag

SEQ ID NO: 93658 - DNA, 777 bp, Artificial Sequence
  Description of Artificial Sequence: Synthetic coding sequence
tgaagcctggagaccggcgtgggcgaccagtgcagaaaggagttcaccgacctgatgaccgagatgaccgacctgagcagcgacctggagggcagcggcatccccttcctggactacagaacctacgccgagagagccttcttccccggccacggcggctgccccctgcagcccaagcccgagggccccggcgaggacggccactgcgccaccgtgagacagggcctgacccagctgagcaacctgctgaacagcaagctgttcctgctgaccctgatccacaccctggaggagcagcccagcttcagccagagagacagatgccacgtggccagcctgctgagcctggccctgcacggcaagctggagtacctgaccgacatcatgagaaccctgctgggcgacctggccgcccactacgtgcacagaaaccccaagctgatgctgagaagaaccgagaccatggtggagaagctgctgaccaactggctgagcatctgcctgtacgccttcctgagagaggtggccggcgagcccctgtacatgctgttcagagccatccagtaccaggtggacaagggccccgtggacgccgtgaccgagtggagaagcggcctggccggccacctgaccctgagcgacgaggacctgaccagcgtgacccagaaccactggaagagactgaacaccctgcagcactacaaggtgcccgacggcgccaccgtgggcctggtgccccagctgcacagaggcagcaccatcagccagagcctgtag

SEQ ID NO: 93659 - DNA, 531 bp, Artificial Sequence
  Description of Artificial Sequence: Synthetic coding sequence
tgagccagccagggcaccctgcagaagttcgtggacgacaccttccaggccatcctgagcgtgaacagacccatccccatcgccgtgaagtacctgttcgacctgctggacgagctggccgagaagcacggcatcgaggaccccggcaccctgcacatctggaagaccaacagcctgctgctgagattctgggtgaacgccctgaagaacccccagctgatcttcgacgtgagagtgagcgacaacgtggacgccatcctggccgtgatcgcccagaccttcatcgacagctgcaccaccagcgagcacaaggtgggcagagtgagagccgtgcccgccgccgccgccggcagaggcctgagaagaaagggcctgtggggcaagcccagaggcctgtgcaccgagctgtgggtgggcagcggcagcatcatgggcgcccccagcccccccagcagctgcctggccccccccctgccccccgagcaggacagccccgtgaacaagctgctgtacgccagagagatcccctag

SEQ ID NO: 93660 - DNA, 492 bp, Artificial Sequence
  Description of Artificial Sequence: Synthetic coding sequence
tgaaagagaaccctgaacgacagcagactgctgagagaggacgtggagttccagcccctgaccctgatggtgctggtgggccccggcgccggcggcgccgccggcagcagcgagatgcagagagtgcccgccagagtgctggacaccgacaccatcacccaggtgaaggagaaggtgctggaccaggtgtacaagggcacccccttcagccagagacccagcgtgcacgccctggacctggagtggagaagcggcctggccggccacctgaccctgagcgacgaggacctgaccagcgtgacccagaaccactggaagagactgaacaccctgcagcactacaaggtgcccgacggcgccaccgtgggcctggtgccccagctgcacagaggcagcaccatcagccagagcctggcccagagatgccccctgggcgagagcgagagcctgggccccgacctgggccccctggagagcagactgggcagatag

SEQ ID NO: 93661 - DNA, 2967 bp, Artificial Sequence
  Description of Artificial Sequence: Synthetic coding sequence
atgtgccacgccgcccaggagacccccctgctgcaccacttcatggacagccccgagagctacccctgcggcgacgagcacacccccagccccatcgccggcagacagcccctggaggtgcagcccctgctgaagctgggccagcccgtgagcgccgtggccgccctgcaggccgacggccacatgatcgccttcctgggcgacacccagggccagctgtacaaggtggacagaatccccgtggccgcctgcccccagttccccgactgcgccagctgcctgcaggcccaggaccccctgtgcggctggtgcgtgctgcagggcagatgcaccagaaagggccagtgcggcagagccggccagctgaaccagtggctgtggagctacgaggaggacagccactgcctgcacatccagagcctgctgcccggccaccaccccagacaggagcagggccaggtgaccctgagcgtgcccagactgcccatcctggacgccgacgagtacttccactgcgccttcggcgactacgacagcctggcccacgtggagggcccccacgtggcctgcgtgacccccccccaggaccaggtgcccctgaacccccccggcaccgaccacgtgaccgtgcccctggccctgatgttcgaggacgtgaccgtggccgccaccaacttcagcttctacgactgcagcgccgtgcaggccctggaggccgccgccccctgcagagcctgcgtgggcagcatctggagatgccactggtgcccccagagcagccactgcgtgtacggcgagcactgccccgagggcgagagaaccatctacagcgcccaggaggtggacatccaggtgagaggccccggcgcctgcccccaggtggagggcctggccggcccccacctggtgcccgtgggctgggagagccacctggccctgagagtgagaaacctgcagcacttcagaggcctgcccgccagcttccactgctggctggagctgcccggcgagctgagaggcctgcccgccaccctggaggagaccgccggcgacagcggcctgatccactgccaggcccaccagttctaccccagcatgagccagagagagctgcccgtgcccatctacgtgacccagggcgaggcccagagactggacaacacccacgccctgtacgtgatcctgtacgactgcgccatgggccaccccgactgcagccactgccaggccgccaacagaagcctgggctgcctgtggtgcgccgacggccagcccgcctgcagatacggccccctgtgcccccccggcgccgtggagctgctgtgccccgcccccagcatcgacgccgtggagcccctgaccggcccccccgagggcggcctggccctgaccatcctgggcagcaacctgggcagagccttcgccgacgtgcagtacgccgtgagcgtggccagcagaccctgcaaccccgagcccagcctgtacagaaccagcgccagaatcgtgtgcgtgaccagccccgcccccaacggcaccaccggccccgtgagagtggccatcaagagccagccccccggcatcagcagccagcacttcacctaccaggaccccgtgctgctgagcctgagccccagatggggcccccaggccggcggcacccagctgaccatcagaggccagcacctgcagaccggcggcaacaccagcgccttcgtgggcggccagccctgccccatcctggagcccgtgtgccccgaggccatcgtgtgcagaaccagaccccaggccgcccccggcgaggccgccgtgctggtggtgttcggccacgcccagagaaccctgctggccagccccttcagatacaccgccaacccccagctggtggccgccgagcccagcgccagcttcagaggcggcggcagactgatcagagtgagaggcaccggcctggacgtggtgcagagacccctgctgagcgtgtggctggaggccgacgccgaggtgcaggccagcagagcccagccccaggacccccagcccagaagaagctgcggcgcccccgccgccgacccccaggcctgcatccagctgggcggcggcctgctgcagtgcagcaccgtgtgcagcgtgaacagcagcagcctgctgctgtgcagaagccccgccgtgcccgacagagcccacccccagagagtgttcttcaccctggacaacgtgcaggtggacttcgccagcgccagcggcggccagggcttcctgtaccagcccaaccccagactggcccccctgagcagagagggccccgccagaccctacagactgaagcccggccacgtgctggacgtggagggcgagggcctgaacctgggcatcagcaaggaggaggtgagagtgcacatcggcagaggcgagtgcctggtgaagaccctgaccagaacccacctgtactgcgagccccccgcccacgccccccagcccgccaacggcagcggcctgccccagttcgtggtgcagatgggcaacgtgcagctggccctgggccccgtgcagtacgaggccgagccccccctgagcgccttccccgtggaggcccaggccggcgtgggcatgggcgccgccgtgctgatcgccgccgtgctgctgctgaccctgatgtacagacacaagagcaagcaggccctgagagactaccagaaggtgctggtgcagctggagagcctggagaccggcgtgggcgaccagtgcagaaaggagttcaccggcggctgcggcggcggcggcaccggctaccccagaggcctgaacagccacctgggcgccagctggcccagaagaccccacgacggcgacgacagaccccagcagagacccggcggccagagagaccccctgcccggcctgccccacctgagaagagccagactgctgccctggccctggagactgcccgccgccgcccaggcctag

SEQ ID NO: 93662 - DNA, 675 bp, Artificial Sequence
  Description of Artificial Sequence: Synthetic coding sequence
atgtgccacgccgcccaggagacccccctgctgcaccacttcatggtggacagaatccccgtggccgcctgcccccagttccccgactgcgccagctgcctgcaggcccaggaccccctgtgcggctggtgcgtgctgcagggcagatgcaccagaaagggccagtgcggcagagccggccagctgaaccagtggctgtggagctacgaggaggacagccactgcctgcacatccagagcctgctgcccggccaccaccccagacaggagcagggccaggtgaccctgagcgtgcccagactgcccatcctggacgccgacgagtacttccactgcgccttcggcgactacgacagcctggcccacgtggagggcccccacgtggcctgcgtgacccccccccaggaccaggtgcccctgaacccccccggcaccgaccacgtgaccgtgcccctggccctgatgttcgaggacgtgaccgtggccgccaccaacttcagcttctacgactgcagcgccgtgcaggccctggaggccgccgcccccgcctgcctgccccccagcaccgccggctggagctgcctggagaacttcggcgactgcagacccccctggagaagacagcagggcatccaggccagcagcaccgccagacccaccagaagcagcccctag

SEQ ID NO: 93663 - DNA, 4689 bp, Artificial Sequence
  Description of Artificial Sequence: Synthetic coding sequence
atgtgccacgccgcccaggagacccccctgctgcaccacttcatggacagccccgagagctacccctgcggcgacgagcacacccccagccccatcgccggcagacagcccctggaggtgcagcccctgctgaagctgggccagcccgtgagcgccgtggccgccctgcaggccgacggccacatgatcgccttcctgggcgacacccagggccagctgtacaaggtgttcctgcacggcagccagggccaggtgtaccacagccagcaggtgggcccccccggcagcgccatcagccccgacctgctgctggacagcagcggcagccacctgtacgtgctgaccgcccaccaggtggacagaatccccgtggccgcctgcccccagttccccgactgcgccagctgcctgcaggcccaggaccccctgtgcggctggtgcgtgctgcagggcagatgcaccagaaagggccagtgcggcagagccggccagctgaaccagtggctgtggagctacgaggaggacagccactgcctgcacatccagagcctgctgcccggccaccaccccagacaggagcagggccaggtgaccctgagcgtgcccagactgcccatcctggacgccgacgagtacttccactgcgccttcggcgactacgacagcctggcccacgtggagggcccccacgtggcctgcgtgacccccccccaggaccaggtgcccctgaacccccccggcaccgaccacgtgaccgtgcccctggccctgatgttcgaggacgtgaccgtggccgccaccaacttcagcttctacgactgcagcgccgtgcaggccctggaggccgccgccccctgcagagcctgcgtgggcagcatctggagatgccactggtgcccccagagcagccactgcgtgtacggcgagcactgccccgagggcgagagaaccatctacagcgcccaggaggtggacatccaggtgagaggccccggcgcctgcccccaggtggagggcctggccggcccccacctggtgcccgtgggctgggagagccacctggccctgagagtgagaaacctgcagcacttcagaggcctgcccgccagcttccactgctggctggagctgcccggcgagctgagaggcctgcccgccaccctggaggagaccgccggcgacagcggcctgatccactgccaggcccaccagttctaccccagcatgagccagagagagctgcccgtgcccatctacgtgacccagggcgaggcccagagactggacaacacccacgccctgtacgtgatcctgtacgactgcgccatgggccaccccgactgcagccactgccaggccgccaacagaagcctgggctgcctgtggtgcgccgacggccagcccgcctgcagatacggccccctgtgcccccccggcgccgtggagctgctgtgccccgcccccagcatcgacgccgtggagcccctgaccggcccccccgagggcggcctggccctgaccatcctgggcagcaacctgggcagagccttcgccgacgtgcagtacgccgtgagcgtggccagcagaccctgcaaccccgagcccagcctgtacagaaccagcgccagaatcgtgtgcgtgaccagccccgcccccaacggcaccaccggccccgtgagagtggccatcaagagccagccccccggcatcagcagccagcacttcacctaccaggaccccgtgctgctgagcctgagccccagatggggcccccaggccggcggcacccagctgaccatcagaggccagcacctgcagaccggcggcaacaccagcgccttcgtgggcggccagccctgccccatcctggagcccgtgtgccccgaggccatcgtgtgcagaaccagaccccaggccgcccccggcgaggccgccgtgctggtggtgttcggccacgcccagagaaccctgctggccagccccttcagatacaccgccaacccccagctggtggccgccgagcccagcgccagcttcagaggcggcggcagactgatcagagtgagaggcaccggcctggacgtggtgcagagacccctgctgagcgtgtggctggaggccgacgccgaggtgcaggccagcagagcccagccccaggacccccagcccagaagaagctgcggcgcccccgccgccgacccccaggcctgcatccagctgggcggcggcctgctgcagtgcagcaccgtgtgcagcgtgaacagcagcagcctgctgctgtgcagaagccccgccgtgcccgacagagcccacccccagagagtgttcttcaccctggacaacgtgcaggtggacttcgccagcgccagcggcggccagggcttcctgtaccagcccaaccccagactggcccccctgagcagagagggccccgccagaccctacagactgaagcccggccacgtgctggacgtggagggcgagggcctgaacctgggcatcagcaaggaggaggtgagagtgcacatcggcagaggcgagtgcctggtgaagaccctgaccagaacccacctgtactgcgagccccccgcccacgccccccagcccgccaacggcagcggcctgccccagttcgtggtgcagatgggcaacgtgcagctggccctgggccccgtgcagtacgaggccgagccccccctgagcgccttccccgtggaggcccaggccggcgtgggcatgggcgccgccgtgctgatcgccgccgtgctgctgctgaccctgatgtacagacacaagagcaagcaggccctgagagactaccagaaggtgctggtgcagctggagagcctggagaccggcgtgggcgaccagtgcagaaaggagttcaccgacctgatgaccgagatgaccgacctgagcagcgacctggagggcagcggcatccccttcctggactacagaacctacgccgagagagccttcttccccggccacggcggctgccccctgcagcccaagcccgagggccccggcgaggacggccactgcgccaccgtgagacagggcctgacccagctgagcaacctgctgaacagcaagctgttcctgctgaccctgatccacaccctggaggagcagcccagcttcagccagagagacagatgccacgtggccagcctgctgagcctggccctgcacggcaagctggagtacctgaccgacatcatgagaaccctgctgggcgacctggccgcccactacgtgcacagaaaccccaagctgatgctgagaagaaccgagaccatggtggagaagctgctgaccaactggctgagcatctgcctgtacgccttcctgagagaggtggccggcgagcccctgtacatgctgttcagagccatccagtaccaggtggacaagggccccgtggacgccgtgaccggcaaggccaagagaaccctgaacgacagcagactgctgagagaggacgtggagttccagcccctgaccctgatggtgctggtgggccccggcgccggcggcgccgccggcagcagcgagatgcagagagtgcccgccagagtgctggacaccgacaccatcacccaggtgaaggagaaggtgctggaccaggtgtacaagggcacccccttcagccagagacccagcgtgcacgccctggacctggagtggagaagcggcctggccggccacctgaccctgagcgacgaggacctgaccagcgtgacccagaaccactggaagagactgaacaccctgcagcactacaaggtgcccgacggcgccaccgtgggcctggtgccccagctgcacagaggcagcaccatcagccagagcctggcccagagatgccccctgggcgagaacatccccaccctggaggacggcgaggagggcggcgtgtgcctgtggcacctggtgaaggccaccgaggagcccgagggcgccaaggtgagatgcagcagcctgagagagagagagcccgccagagccaaggccatccccgagatctacctgaccagactgctgagcatgaagggcaccctgcagaagttcgtggacgacaccttccaggccatcctgagcgtgaacagacccatccccatcgccgtgaagtacctgttcgacctgctggacgagctggccgagaagcacggcatcgaggaccccggcaccctgcacatctggaagaccaacagcctgctgctgagattctgggtgaacgccctgaagaacccccagctgatcttcgacgtgagagtgagcgacaacgtggacgccatcctggccgtgatcgcccagaccttcatcgacagctgcaccaccagcgagcacaaggtgggcagagacagccccgtgaacaagctgctgtacgccagagagatccccagatacaagcagatggtggagagatactacgccgacatcagacagagcagccccgccagctaccaggagatgaacagcgccctggccgagctgagcggcaactacaccagcgccccccactgcctggaggccctgcaggagctgtacaaccacatccacagatactacgaccagatcatcagcgccctggaggaggaccccgtgggccagaagctgcagctggcctgcagactgcagcaggtggccgccctggtggagaacaaggtgaccgacctgtag

SEQ ID NO: 93664 - DNA, 5799 bp, Artificial Sequence
  Description of Artificial Sequence: Synthetic coding sequence
atggagctgacccccgccagcagcctgacctgcagcctgctgagccccagactgcccggcagcttcccccagctgagaagagtgcccccctgcagcagaccctggctgcccaaggcccccgtgatggccagatggccccccttcggcctgtgcctgctgctgctgctgctgagccccccccccctgcccctgaccggcgcccacagattcagcgcccccaacaccaccctgaaccacctggccctggcccccggcagaggcaccctgtacgtgggcgccgtgaacagactgttccagctgagccccgagctgcagctggaggccgtggccgtgaccggccccgtgatcgacagccccgactgcgtgcccttcagagaccccgccgagtgcccccaggcccagctgaccgacaacgccaaccagctgctgctggtgagcagcagagcccaggagctggtggcctgcggccaggtgagacagggcgtgtgcgagaccagaagactgggcgacgtggccgaggtgctgtaccaggccgaggaccccggcgacggccagttcgtggccgccaacacccccggcgtggccaccgtgggcctggtggtgcccctgcccggcagagacctgctgctggtggccagaggcctggccggcaagctgagcgccggcgtgccccccctggccatcagacagctggccggcagccagcccttcagcagcgagggcctgggcagactggtggtgggcgacttcagcgactacaacaacagctacgtgggcgccttcgccgacgccagaagcgcctacttcgtgttcagaagaagaggcgccagagcccaggccgagtacagaagctacgtggccagagtgtgcctgggcgacaccaacctgtacagctacgtggaggtgcccctggcctgccagggccagggcctgatccaggccgccttcctggcccccggcaccctgctgggcgtgttcgccgccggccccagaggcacccaggccgccctgtgcgccttccccatggtggagctgggcgccagcatggagcaggccagaagactgtgctacaccgccggcggcagaggccccagcggcgccgaggaggccaccgtggagtacggcgtgaccagcagatgcgtgaccctgcccctggacagccccgagagctacccctgcggcgacgagcacacccccagccccatcgccggcagacagcccctggaggtgcagcccctgctgaagctgggccagcccgtgagcgccgtggccgccctgcaggccgacggccacatgatcgccttcctgggcgacacccagggccagctgtacaaggtgttcctgcacggcagccagggccaggtgtaccacagccagcaggtgggcccccccggcagcgccatcagccccgacctgctgctggacagcagcggcagccacctgtacgtgctgaccgcccaccaggtggacagaatccccgtggccgcctgcccccagttccccgactgcgccagctgcctgcaggcccaggaccccctgtgcggctggtgcgtgctgcagggcagatgcaccagaaagggccagtgcggcagagccggccagctgaaccagtggctgtggagctacgaggaggacagccactgcctgcacatccagagcctgctgcccggccaccaccccagacaggagcagggccaggtgaccctgagcgtgcccagactgcccatcctggacgccgacgagtacttccactgcgccttcggcgactacgacagcctggcccacgtggagggcccccacgtggcctgcgtgacccccccccaggaccaggtgcccctgaacccccccggcaccgaccacgtgaccgtgcccctggccctgatgttcgaggacgtgaccgtggccgccaccaacttcagcttctacgactgcagcgccgtgcaggccctggaggccgccgccccctgcagagcctgcgtgggcagcatctggagatgccactggtgcccccagagcagccactgcgtgtacggcgagcactgccccgagggcgagagaaccatctacagcgcccaggaggtggacatccaggtgagaggccccggcgcctgcccccaggtggagggcctggccggcccccacctggtgcccgtgggctgggagagccacctggccctgagagtgagaaacctgcagcacttcagaggcctgcccgccagcttccactgctggctggagctgcccggcgagctgagaggcctgcccgccaccctggaggagaccgccggcgacagcggcctgatccactgccaggcccaccagttctaccccagcatgagccagagagagctgcccgtgcccatctacgtgacccagggcgaggcccagagactggacaacacccacgccctgtacgtgatcctgtacgactgcgccatgggccaccccgactgcagccactgccaggccgccaacagaagcctgggctgcctgtggtgcgccgacggccagcccgcctgcagatacggccccctgtgcccccccggcgccgtggagctgctgtgccccgcccccagcatcgacgccgtggagcccctgaccggcccccccgagggcggcctggccctgaccatcctgggcagcaacctgggcagagccttcgccgacgtgcagtacgccgtgagcgtggccagcagaccctgcaaccccgagcccagcctgtacagaaccagcgccagaatcgtgtgcgtgaccagccccgcccccaacggcaccaccggccccgtgagagtggccatcaagagccagccccccggcatcagcagccagcacttcacctaccaggaccccgtgctgctgagcctgagccccagatggggcccccaggccggcggcacccagctgaccatcagaggccagcacctgcagaccggcggcaacaccagcgccttcgtgggcggccagccctgccccatcctggagcccgtgtgccccgaggccatcgtgtgcagaaccagaccccaggccgcccccggcgaggccgccgtgctggtggtgttcggccacgcccagagaaccctgctggccagccccttcagatacaccgccaacccccagctggtggccgccgagcccagcgccagcttcagaggcggcggcagactgatcagagtgagaggcaccggcctggacgtggtgcagagacccctgctgagcgtgtggctggaggccgacgccgaggtgcaggccagcagagcccagccccaggacccccagcccagaagaagctgcggcgcccccgccgccgacccccaggcctgcatccagctgggcggcggcctgctgcagtgcagcaccgtgtgcagcgtgaacagcagcagcctgctgctgtgcagaagccccgccgtgcccgacagagcccacccccagagagtgttcttcaccctggacaacgtgcaggtggacttcgccagcgccagcggcggccagggcttcctgtaccagcccaaccccagactggcccccctgagcagagagggccccgccagaccctacagactgaagcccggccacgtgctggacgtggagggcgagggcctgaacctgggcatcagcaaggaggaggtgagagtgcacatcggcagaggcgagtgcctggtgaagaccctgaccagaacccacctgtactgcgagccccccgcccacgccccccagcccgccaacggcagcggcctgccccagttcgtggtgcagatgggcaacgtgcagctggccctgggccccgtgcagtacgaggccgagccccccctgagcgccttccccgtggaggcccaggccggcgtgggcatgggcgccgccgtgctgatcgccgccgtgctgctgctgaccctgatgtacagacacaagagcaagcaggccctgagagactaccagaaggtgctggtgcagctggagagcctggagaccggcgtgggcgaccagtgcagaaaggagttcaccgacctgatgaccgagatgaccgacctgagcagcgacctggagggcagcggcatccccttcctggactacagaacctacgccgagagagccttcttccccggccacggcggctgccccctgcagcccaagcccgagggccccggcgaggacggccactgcgccaccgtgagacagggcctgacccagctgagcaacctgctgaacagcaagctgttcctgctgaccctgatccacaccctggaggagcagcccagcttcagccagagagacagatgccacgtggccagcctgctgagcctggccctgcacggcaagctggagtacctgaccgacatcatgagaaccctgctgggcgacctggccgcccactacgtgcacagaaaccccaagctgatgctgagaagaaccgagaccatggtggagaagctgctgaccaactggctgagcatctgcctgtacgccttcctgagagaggtggccggcgagcccctgtacatgctgttcagagccatccagtaccaggtggacaagggccccgtggacgccgtgaccggcaaggccaagagaaccctgaacgacagcagactgctgagagaggacgtggagttccagcccctgaccctgatggtgctggtgggccccggcgccggcggcgccgccggcagcagcgagatgcagagagtgcccgccagagtgctggacaccgacaccatcacccaggtgaaggagaaggtgctggaccaggtgtacaagggcacccccttcagccagagacccagcgtgcacgccctggacctggagtggagaagcggcctggccggccacctgaccctgagcgacgaggacctgaccagcgtgacccagaaccactggaagagactgaacaccctgcagcactacaaggtgcccgacggcgccaccgtgggcctggtgccccagctgcacagaggcagcaccatcagccagagcctggcccagagatgccccctgggcgagaacatccccaccctggaggacggcgaggagggcggcgtgtgcctgtggcacctggtgaaggccaccgaggagcccgagggcgccaaggtgagatgcagcagcctgagagagagagagcccgccagagccaaggccatccccgagatctacctgaccagactgctgagcatgaagggcaccctgcagaagttcgtggacgacaccttccaggccatcctgagcgtgaacagacccatccccatcgccgtgaagtacctgttcgacctgctggacgagctggccgagaagcacggcatcgaggaccccggcaccctgcacatctggaagaccaacagcctgctgctgagattctgggtgaacgccctgaagaacccccagctgatcttcgacgtgagagtgagcgacaacgtggacgccatcctggccgtgatcgcccagaccttcatcgacagctgcaccaccagcgagcacaaggtgggcagagacagccccgtgaacaagctgctgtacgccagagagatccccagatacaagcagatggtggagagatactacgccgacatcagacagagcagccccgccagctaccaggagatgaacagcgccctggccgagctgagcggcaactacaccagcgccccccactgcctggaggccctgcaggagctgtacaaccacatccacagatactacgaccagatcatcagcgccctggaggaggaccccgtgggccagaagctgcagctggcctgcagactgcagcaggtggccgccctggtggagaacaaggtgaccgacctgtag

SEQ ID NO: 93665 - DNA, 5778 bp, Artificial Sequence
  Description of Artificial Sequence: Synthetic coding sequence
atggcccccagagccgccggcggcgcccccctgagcgccagagccgccgccgccagccccccccccttccagaccccccccagatgccccgtgcccctgctgctgctgctgctgctgggcgccgccagagccggcgccctggagatccagagaagattccccagccccacccccaccaacaacttcgccctggacggcgccgccggcaccgtgtacctggccgccgtgaacagactgtaccagctgagcggcgccaacctgagcctggaggccgaggccgccgtgggccccgtgcccgacagccccctgtgccacgccccccagctgccccaggccagctgcgagcaccccagaagactgaccgacaactacaacaagatcctgcagctggaccccggccagggcctggtggtggtgtgcggcagcatctaccagggcttctgccagctgagaagaagaggcaacatcagcgccgtggccgtgagattcccccccgccgccccccccgccgagcccgtgaccgtgttccccagcatgctgaacgtggccgccaaccaccccaacgccagcaccgtgggcctggtgctgccccccgccgccggcgccggcggcagcagactgctggtgggcgccacctacaccggctacggcagcagcttcttccccagaaacagaagcctggaggaccacagattcgagaacacccccgagatcgccatcagaagcctggacaccagaggcgacctggccaagctgttcaccttcgacctgaaccccagcgacgacaacatcctgaagatcaagcagggcgccaaggagcagcacaagctgggcttcgtgagcgccttcctgcaccccagcgaccccccccccggcgcccagagctacgcctacctggccctgaacagcgaggccagagccggcgacaaggagagccaggccagaagcctgctggccagaatctgcctgccccacggcgccggcggcgacgccaagaagctgaccgagagctacatccagctgggcctgcagtgcgccggcggcgccggcagaggcgacctgtacagcagactggtgagcgtgttccccgccagagagagactgttcgccgtgttcgagagaccccagggcagccccgccgccagagccgcccccgccgccctgtgcgccttcagattcgccgacgtgagagccgccatcagagccgccagaaccgcctgcttcgtggagcccgcccccgacgtggtggccgtgctggacagcgtggtgcagggcaccggccccgcctgcgagagaaagctgaacatccagctgcagcccgagcagctggactgcggcgccgcccacctgcagcaccccctgagcatcctgcagcccctgaaggccacccccgtgttcagagcccccggcctgaccagcgtggccgtggccagcgtgaacaactacaccgccgtgttcctgggcaccgtgaacggcagactgctgaagatcaacctgaacgagagcatgcaggtggtgagcagaagagtggtgaccgtggcctacggcgagcccgtgcaccacgtgatgcagttcgaccccgccgacagcggctacctgtacctgatgaccagccaccagatggccagagtgaaggtggccgcctgcaacgtgcacagcacctgcggcgactgcgtgggcgccgccgacgcctactgcggctggtgcgccctggagaccagatgcaccctgcagcaggactgcaccaacagcagccagcagcacttctggaccagcgccagcgagggccccagcagatgccccgccatgaccgtgctgcccagcgagatcgacgtgagacaggagtaccccggcatgatcctgcagatcagcggcagcctgcccagcctgagcggcatggagatggcctgcgactacggcaacaacatcagaaccgtggccagagtgcccggccccgccttcggccaccagatcgcctactgcaacctgctgcccagagaccagttcccccccttcccccccaaccaggaccacgtgaccgtggagatgagcgtgagagtgaacggcagaaacatcgtgaaggccaacttcaccatctacgactgcagcagaaccgcccaggtgtacccccacaccgcctgcaccagctgcctgagcgcccagtggccctgcttctggtgcagccagcagcacagctgcgtgagcaaccagagcagatgcgaggccagccccaaccccaccagcccccaggactgccccagaaccctgctgagccccctggcccccgtgcccaccggcggcagccagaacatcctggtgcccctggccaacaccgccttcttccagggcgccgccctggagtgcagcttcggcctggaggagatcttcgaggccgtgtgggtgaacgagagcgtggtgagatgcgaccaggtggtgctgcacaccaccagaaagagccaggtgttccccctgagcctgcagctgaagggcagacccgccagattcctggacagccccgagcccatgaccgtgatggtgtacaactgcgccatgggcagccccgactgcagccagtgcctgggcagagaggacctgggccacctgtgcatgtggagcgacggctgcagactgagaggccccctgcagcccatggccggcacctgccccgcccccgagatccacgccatcgagcccctgagcggccccctggacggcggcaccctgctgaccatcagaggcagaaacctgggcagaagactgagcgacgtggcccacggcgtgtggatcggcggcgtggcctgcgagcccctgcccgacagatacaccgtgagcgaggagatcgtgtgcgtgaccggccccgcccccggccccctgagcggcgtggtgaccgtgaacgccagcaaggagggcaagagcagagacagattcagctacgtgctgcccctggtgcacagcctggagcccaccatgggccccaaggccggcggcaccagaatcaccatccacggcaacgacctgcacgtgggcagcgagctgcaggtgctggtgaacgacaccgacccctgcaccgagctgatgagaaccgacaccagcatcgcctgcaccatgcccgagggcgccctgcccgcccccgtgcccgtgtgcgtgagattcgagagaagaggctgcgtgcacggcaacctgaccttctggtacatgcagaaccccgtgatcaccgccatcagccccagaagaagccccgtgagcggcggcagaaccatcaccgtggccggcgagagattccacatggtgcagaacgtgagcatggccgtgcaccacatcggcagagagcccaccctgtgcaaggtgctgaacagcaccctgatcacctgccccagccccggcgccctgagcaacgccagcgcccccgtggacttcttcatcaacggcagagcctacgccgacgaggtggccgtggccgaggagctgctggaccccgaggaggcccagagaggcagcagattcagactggactacctgcccaacccccagttcagcaccgccaagagagagaagtggatcaagcaccaccccggcgagcccctgaccctggtgatccacaaggagcaggacagcctgggcctgcagagccacgagtacagagtgaagatcggccaggtgagctgcgacatccagatcgtgagcgacagaatcatccactgcagcgtgaacgagagcctgggcgccgccgtgggccagctgcccatcaccatccaggtgggcaacttcaaccagaccatcgccaccctgcagctgggcggcagcgagaccgccatcatcgtgagcatcgtgatctgcagcgtgctgctgctgctgagcgtggtggccctgttcgtgttctgcaccaagagcagaagagccgagagatactggcagaagaccctgctgcagatggaggagatggagagccagatcagagaggagatcagaaagggcttcgccgagctgcagaccgacatgaccgacctgaccaaggagctgaacagaagccagggcatccccttcctggagtacaagcacttcgtgaccagaaccttcttccccaagtgcagcagcctgtacgaggagagatacgtgctgcccagccagaccctgaacagccagggcagcagccaggcccaggagacccaccccctgctgggcgagtggaagatccccgagagctgcagacccaacatggaggagggcatcagcctgttcagcagcctgctgaacaacaagcacttcctgatcgtgttcgtgcacgccctggagcagcagaaggacttcgccgtgagagacagatgcagcctggccagcctgctgaccatcgccctgcacggcaagctggagtactacaccagcatcatgaaggagctgctggtggacctgatcgacgccagcgccgccaagaaccccaagctgatgctgagaagaaccgagagcgtggtggagaagatgctgaccaactggatgagcatctgcatgtacagctgcctgagagagaccgtgggcgagcccttcttcctgctgctgtgcgccatcaagcagcagatcaacaagggcagcatcgacgccatcaccggcaaggccagatacaccctgagcgaggagtggctgctgagagagaacatcgaggccaagcccagaaacctgaacgtgagcttccagggctgcggcatggacagcctgagcgtgagagccatggacaccgacaccctgacccaggtgaaggagaagatcctggaggccttctgcaagaacgtgccctacagccagtggcccagagccgaggacgtggacctggagtggttcgccagcagcacccagagctacatcctgagagacctggacgacaccagcgtggtggaggacggcagaaagaagctgaacaccctggcccactacaagatccccgagggcgccagcctggccatgagcctgatcgacaagaaggacaacaccctgggcagagtgaaggacctggacaccgagaagtacttccacctggtgctgcccaccgacgagctggccgagcccaagaagagccacagacagagccacagaaagaaggtgctgcccgagatctacctgaccagactgctgagcaccaagggcaccctgcagaagttcctggacgacctgttcaaggccatcctgagcatcagagaggacaagccccccctggccgtgaagtacttcttcgacttcctggaggagcaggccgagaagagaggcatcagcgaccccgacaccctgcacatctggaagaccaacagcctgcccctgagattctgggtgaacatcctgaagaacccccagttcgtgttcgacatcgacaagaccgaccacatcgacgcctgcctgagcgtgatcgcccaggccttcatcgacgcctgcagcatcagcgacctgcagctgggcaaggacagccccaccaacaagctgctgtacgccaaggagatccccgagtacagaaagatcgtgcagagatactacaagcagatccaggacatgacccccctgagcgagcaggagatgaacgcccacctggccgaggagagcagaaagtaccagaacgagttcaacaccaacgtggccatggccgagatctacaagtacgccaagagatacagaccccagatcatggccgccctggaggccaaccccaccgccagaagaacccagctgcagcacaagttcgagcaggtggtggccctgatggaggacaacatctacgagtgctacagcgaggcctag

SEQ ID NO: 93666 - DNA, 5358 bp, Artificial Sequence
  Description of Artificial Sequence: Synthetic coding sequence
atggcccccagagccgccggcggcgcccccctgagcgccagagccgccgccgccagccccccccccttccagaccccccccagatgccccgtgcccctgctgctgctgctgctgctgggcgccgccagagccggcgccctggagatccagagaagattccccagccccacccccaccaacaacttcgccctggacggcgccgccggcaccgtgtacctggccgccgtgaacagactgtaccagctgagcggcgccaacctgagcctggaggccgaggccgccgtgggccccgtgcccgacagccccctgtgccacgccccccagctgccccaggccagctgcgagcaccccagaagactgaccgacaactacaacaagatcctgcagctggaccccggccagggcctggtggtggtgtgcggcagcatctaccagggcttctgccagctgagaagaagaggcaacatcagcgccgtggccgtgagattcccccccgccgccccccccgccgagcccgtgaccgtgttccccagcatgctgaacgtggccgccaaccaccccaacgccagcaccgtgggcctggtgctgccccccgccgccggcgccggcggcagcagactgctggtgggcgccacctacaccggctacggcagcagcttcttccccagaaacagaagcctggaggaccacagattcgagaacacccccgagatcgccatcagaagcctggacaccagaggcgacctggccaagctgttcaccttcgacctgaaccccagcgacgacaacatcctgaagatcaagcagggcgccaaggagcagcacaagctgggcttcgtgagcgccttcctgcaccccagcgaccccccccccggcgcccagagctacgcctacctggccctgaacagcgaggccagagccggcgacaaggagagccaggccagaagcctgctggccagaatctgcctgccccacggcgccggcggcgacgccaagaagctgaccgagagctacatccagctgggcctgcagtgcgccggcggcgccggcagaggcgacctgtacagcagactggtgagcgtgttccccgccagagagagactgttcgccgtgttcgagagaccccagggcagccccgccgccagagccgcccccgccgccctgtgcgccttcagattcgccgacgtgagagccgccatcagagccgccagaaccgcctgcttcgtggagcccgcccccgacgtggtggccgtgctggacagcgtggtgcagggcaccggccccgcctgcgagagaaagctgaacatccagctgcagcccgagcagctggactgcggcgccgcccacctgcagcaccccctgagcatcctgcagcccctgaaggccacccccgtgttcagagcccccggcctgaccagcgtggccgtggccagcgtgaacaactacaccgccgtgttcctgggcaccgtgaacggcagactgctgaagatcaacctgaacgagagcatgcaggtggtgagcagaagagtggtgaccgtggcctacggcgagcccgtgcaccacgtgatgcagttcgaccccgccgacagcggctacctgtacctgatgaccagccaccagatggccagagtgaaggtggccgcctgcaacgtgcacagcacctgcggcgactgcgtgggcgccgccgacgcctactgcggctggtgcgccctggagaccagatgcaccctgcagcaggactgcaccaacagcagccagcagcacttctggaccagcgccagcgagggccccagcagatgccccgccatgaccgtgctgcccagcgagatcgacgtgagacaggagtaccccggcatgatcctgcagatcagcggcagcctgcccagcctgagcggcatggagatggcctgcgactacggcaacaacatcagaaccgtggccagagtgcccggccccgccttcggccaccagatcgcctactgcaacctgctgcccagagaccagttcccccccttcccccccaaccaggaccacgtgaccgtggagatgagcgtgagagtgaacggcagaaacatcgtgaaggccaacttcaccatctacgactgcagcagaaccgcccaggtgtacccccacaccgcctgcaccagctgcctgagcgcccagtggccctgcttctggtgcagccagcagcacagctgcgtgagcaaccagagcagatgcgaggccagccccaaccccaccagcccccaggactgccccagaaccctgctgagccccctggcccccgtgcccaccggcggcagccagaacatcctggtgcccctggccaacaccgccttcttccagggcgccgccctggagtgcagcttcggcctggaggagatcttcgaggccgtgtgggtgaacgagagcgtggtgagatgcgaccaggtggtgctgcacaccaccagaaagagccaggtgttccccctgagcctgcagctgaagggcagacccgccagattcctggacagccccgagcccatgaccgtgatggtgtacaactgcgccatgggcagccccgactgcagccagtgcctgggcagagaggacctgggccacctgtgcatgtggagcgacggctgcagactgagaggccccctgcagcccatggccggcacctgccccgcccccgagatccacgccatcgagcccctgagcggccccctggacggcggcaccctgctgaccatcagaggcagaaacctgggcagaagactgagcgacgtggcccacggcgtgtggatcggcggcgtggcctgcgagcccctgcccgacagatacaccgtgagcgaggagatcgtgtgcgtgaccggccccgcccccggccccctgagcggcgtggtgaccgtgaacgccagcaaggagggcaagagcagagacagattcagctacgtgctgcccctggtgcacagcctggagcccaccatgggccccaaggccggcggcaccagaatcaccatccacggcaacgacctgcacgtgggcagcgagctgcaggtgctggtgaacgacaccgacccctgcaccgagctgatgagaaccgacaccagcatcgcctgcaccatgcccgagggcgccctgcccgcccccgtgcccgtgtgcgtgagattcgagagaagaggctgcgtgcacggcaacctgaccttctggtacatgcagaaccccgtgatcaccgccatcagccccagaagaagccccgtgagcggcggcagaaccatcaccgtggccggcgagagattccacatggtgcagaacgtgagcatggccgtgcaccacatcggcagagagcccaccctgtgcaaggtgctgaacagcaccctgatcacctgccccagccccggcgccctgagcaacgccagcgcccccgtggacttcttcatcaacggcagagcctacgccgacgaggtggccgtggccgaggagctgctggaccccgaggaggcccagagaggcagcagattcagactggactacctgcccaacccccagttcagcaccgccaagagagagaagtggatcaagcaccaccccggcgagcccctgaccctggtgatccacaaggagcaggacagcctgggcctgcagagccacgagtacagagtgaagatcggccaggtgagctgcgacatccagatcgtgagcgacagaatcatccactgcagcgtgaacgagagcctgggcgccgccgtgggccagctgcccatcaccatccaggtgggcaacttcaaccagaccatcgccaccctgcagctgggcggcagcgagaccgccatcatcgtgagcatcgtgatctgcagcgtgctgctgctgctgagcgtggtggccctgttcgtgttctgcaccaagagcagaagagccgagagatactggcagaagaccctgctgcagatggaggagatggagagccagatcagagaggagatcagaaagggcttcgccgagctgcagaccgacatgaccgacctgaccaaggagctgaacagaagccagggcatccccttcctggagtacaagcacttcgtgaccagaaccttcttccccaagtgcagcagcctgtacgaggagagatacgtgctgcccagccagaccctgaacagccagggcagcagccaggcccaggagacccaccccctgctgggcgagtggaagatccccgagagctgcagacccaacatggaggagggcatcagcctgttcagcagcctgctgaacaacaagcacttcctgatcgtgttcgtgcacgccctggagcagcagaaggacttcgccgtgagagacagatgcagcctggccagcctgctgaccatcgccctgcacggcaagctggagtactacaccagcatcatgaaggagctgctggtggacctgatcgacgccagcgccgccaagaaccccaagctgatgctgagaagaaccgagagcgtggtggagaagatgctgaccaactggatgagcatctgcatgtacagctgcctgagagagaccgtgggcgagcccttcttcctgctgctgtgcgccatcaagcagcagatcaacaagggcagcatcgacgccatcaccggcaaggccagatacaccctgagcgaggagtggctgctgagagagaacatcgaggccaagcccagaaacctgaacgtgagcttccagggctgcggcatggacagcctgagcgtgagagccatggacaccgacaccctgacccaggtgaaggagaagatcctggaggccttctgcaagaacgtgccctacagccagtggcccagagccgaggacgtggacctggagtggttcgccagcagcacccagagctacatcctgagagacctggacgacaccagcgtggtggaggacggcagaaagaagctgaacaccctggcccactacaagatccccgagggcgccagcctggccatgagcctgatcgacaagaaggacaacaccctgggcagagtgaaggacctggacaccgagaagtacttccacctggtgctgcccaccgacgagctggccgagcccaagaagagccacagacagagccacagaaagaaggtgctgcccgagatctacctgaccagactgctgagcaccaagggcaccctgcagaagttcctggacgacctgttcaaggccatcctgagcatcagagaggacaagccccccctggccgtgaagtacttcttcgacttcctggaggagcaggccgagaagagaggcatcagcgaccccgacaccctgcacatctggaagaccaacagatggagacccagcagccccgtgctgggcgagcaccccgaggagccccccgtgtgcctgtag

SEQ ID NO: 93667 - DNA, 1503 bp, Artificial Sequence
  Description of Artificial Sequence: Synthetic coding sequence
atgagaggcgagctgtggctgctggtgctggtgctgagagaggccgccagagccctgagcccccagcccggcgccggccacgacgagggccccggcagcggctgggccgccaagggcaccgtgagaggctggaacagaagagccagagagagccccggccacgtgagcgagcccgacagaacccagctgagccaggacctgggcggcggcaccctggccatggacaccctgcccgacaacagaaccagagtggtggaggacaaccacagctactacgtgagcagactgtacggccccagcgagccccacagcagagagctgtgggtggacgtggccgaggccaacagaagccaggtgaagatccacaccatcctgagcaacacccacagacaggccagcagagtggtgctgagcttcgacttccccttctacggccaccccctgagacagatcaccatcgccaccggcggcttcatcttcatgggcgacgtgatccacagaatgctgaccgccacccagtacgtggcccccctgatggccaacttcaaccccggctacagcgacaacagcaccgtggtgtacttcgacaacggcaccgtgttcgtggtgcagtgggaccacgtgtacctgcagggctgggaggacaagggcagcttcaccttccaggccgccctgcaccacgacggcagaatcgtgttcgcctacaaggagatccccatgagcgtgcccgagatcagcagcagccagcaccccgtgaagaccggcctgagcgacgccttcatgatcctgaaccccagccccgacgtgcccgagagcagaagaagaagcatcttcgagtaccacagaatcgagctggaccccagcaaggtgaccagcatgagcgccgtggagttcacccccctgcccacctgcctgcagcacagaagctgcgacgcctgcatgagcagcgacctgaccttcaactgcagctggtgccacgtgctgcagagatgcagcagcggcttcgacagatacagacaggagtggatggactacggctgcgcccaggaggccgagggcagaatgtgcgaggacttccaggacgaggaccacgacagcgccagccccgacaccagcttcagcccctacgacggcgacctgaccaccaccagcagcagcctgttcatcgacagcctgaccaccgaggacgacaccaagctgaacccctacgccggcggcgacggcctgcagaacaacctgagccccaagaccaagggcacccccgtgcacctgggcaccatcgtgggcatcgtgctggccgtgctgctggtggccgccatcatcctggccggcatctacatcaacggccaccccaccagcaacgccgccctgttcttcatcgagagaagaccccaccactggcccgccatgaagttcagaagccaccccgaccacagcacctacgccgaggtggagcccagcggccacgagaaggagggcttcatggaggccgagcagtgctag

SEQ ID NO: 93668 - DNA, 1014 bp, Artificial Sequence
  Description of Artificial Sequence: Synthetic coding sequence
atgagaggcgagctgtggctgctggtgctggtgctgagagaggccgccagagccctgagcccccagcccggcgccggccacgacgagggccccggcagcggctgggccgccaagggcaccgtgagaggctggaacagaagagccagagagagccccggccacgtgagcgagcccgacagaacccagctgagccaggacctgggcggcggcaccctggccatggacaccctgcccgacaacagaaccagagtggtggaggacaaccacagctactacgtgagcagactgtacggccccagcgagccccacagcagagagctgtgggtggacgtggccgaggccaacagaagccaggtgaagatccacaccatcctgagcaacacccacagacaggccagcagagtggtgctgagcttcgacttccccttctacggccaccccctgagacagatcaccatcgccaccggcggcttcatcttcatgggcgacgtgatccacagaatgctgaccgccacccagtacgtggcccccctgatggccaacttcaaccccggctacagcgacaacagcaccgtggtgtacttcgacaacggcaccgtgttcgtggtgcagtgggaccacgtgtacctgcagggctgggaggacaagggcagcttcaccttccaggccgccctgcaccacgacggcagaatcgtgttcgcctacaaggagatccccatgagcgtgcccgagatcagcagcagccagcaccccgtgaagaccggcctgagcgacgccttcatgatcctgaaccccagccccgacgtgcccgagagcagaagaagaagcatcttcgagtaccacagaatcgagctggaccccagcaaggtgaccagcatgagcgccgtggagttcacccccctgcccacctgcctgcagcacagaagctgcgacgcctgcatgagcagcgacctgaccttcaactgcagctggtgccacgtgctgcagagcagagacgaggtgagcccctgctag

SEQ ID NO: 93669 - DNA, 1284 bp, Artificial Sequence
  Description of Artificial Sequence: Synthetic coding sequence
atggacaccctgcccgacaacagaaccagagtggtggaggacaaccacagctactacgtgagcagactgtacggccccagcgagccccacagcagagagctgtgggtggacgtggccgaggccaacagaagccaggtgaagatccacaccatcctgagcaacacccacagacaggccagcagagtggtgctgagcttcgacttccccttctacggccaccccctgagacagatcaccatcgccaccggcggcttcatcttcatgggcgacgtgatccacagaatgctgaccgccacccagtacgtggcccccctgatggccaacttcaaccccggctacagcgacaacagcaccgtggtgtacttcgacaacggcaccgtgttcgtggtgcagtgggaccacgtgtacctgcagggctgggaggacaagggcagcttcaccttccaggccgccctgcaccacgacggcagaatcgtgttcgcctacaaggagatccccatgagcgtgcccgagatcagcagcagccagcaccccgtgaagaccggcctgagcgacgccttcatgatcctgaaccccagccccgacgtgcccgagagcagaagaagaagcatcttcgagtaccacagaatcgagctggaccccagcaaggtgaccagcatgagcgccgtggagttcacccccctgcccacctgcctgcagcacagaagctgcgacgcctgcatgagcagcgacctgaccttcaactgcagctggtgccacgtgctgcagagaagcctgaacaaccaggacgagaacacctacgtgaactgcctggacagccagcagtgccacggcagcagcgagagcagaagacccttccaggacgaggaccacgacagcgccagccccgacaccagcttcagcccctacgacggcgacctgaccaccaccagcagcagcctgttcatcgacagcctgaccaccgaggacgacaccaagctgaacccctacgccggcggcgacggcctgcagaacaacctgagccccaagaccaagggcacccccgtgcacctgggcaccatcgtgggcatcgtgctggccgtgctgctggtggccgccatcatcctggccggcatctacatcaacggccaccccaccagcaacgccgccctgttcttcatcgagagaagaccccaccactggcccgccatgaagttcagaagccaccccgaccacagcacctacgccgaggtggagcccagcggccacgagaaggagggcttcatggaggccgagcagtgctag

SEQ ID NO: 93670 - DNA, 375 bp, Artificial Sequence
  Description of Artificial Sequence: Synthetic coding sequence
atggacaccctgcccgacaacagaaccagagtggtggaggacaaccacagctactacgtgagcagactgtacggccccagcgagccccacagcagagagctgtgggtggacgtggccgaggccaacagaagccaggtgaagatccacaccatcctgagcaacacccacagacaggccagcagagtggtgctgagcttcgacttccccttctacggccaccccctgagacagatcaccatcgccaccggcggcttcatcttcatgggcgacgtgatccacagaatgctgaccgccacccagtacgtggcccccctgatggccaacttcaaccccggctacagcgacaacagcaccgtggtgtacttcgacaactag

SEQ ID NO: 93671 - DNA, 669 bp, Artificial Sequence
  Description of Artificial Sequence: Synthetic coding sequence
atggacaccctgcccgacaacagaaccagagtggtggaggacaaccacagctactacgtgagcagactgtacggccccagcgagccccacagcagagagctgtgggtggacgtggccgaggccaacagaagccaggtgaagatccacaccatcctgagcaacacccacagacaggccagcagagtggtgctgagcttcgacttccccttctacggccaccccctgagacagatcaccatcgccaccggcggcttcatcttcatgggcgacgtgatccacagaatgctgaccgccacccagtacgtggcccccctgatggccaacttcaaccccggctacagcgacaacagcaccgtggtgtacttcgacaacggcaccgtgttcgtggtgcagtgggaccacgtgtacctgcagggctgggaggacaagggcagcttcaccttccaggccgccctgcaccacgacggcagaatcgtgttcgcctacaaggagatccccatgagcgtgcccgagatcagcagcagccagcaccccgtgaagaccggcctgagcgacgccttcatgatcctgaaccccagccccgacgtgcccgagagcagaagaagaagcatcttcgagtaccacagaatcgagctggaccccagcaaggtgaccagcatgagcgcctag

SEQ ID NO: 93672 - DNA, 198 bp, Artificial Sequence
  Description of Artificial Sequence: Synthetic coding sequence
tgaagcttcaccttccaggccgccctgcaccacgacggcagaatcgtgttcgcctacaaggagatccccatgagcgtgcccgagatcagcagcagccagcaccccgtgaagaccggcctgagcgacgccttcatgatcctgaaccccagccccgacgtgcccggcttcagcgccgagagcgccaagcacctgtggtag

SEQ ID NO: 93673 - DNA, 1383 bp, Artificial Sequence
  Description of Artificial Sequence: Synthetic coding sequence
atggccctgagcgtgagaaccctgcccctgagaggcttcctggtgcccagaccccagcccaccagaagccaggacgcccccagccccagactgcccctgagcagcgcccccgccccctgcagacacaagaacgaggaggacaaccacagctactacgtgagcagactgtacggccccagcgagccccacagcagagagctgtgggtggacgtggccgaggccaacagaagccaggtgaagatccacaccatcctgagcaacacccacagacaggccagcagagtggtgctgagcttcgacttccccttctacggccaccccctgagacagatcaccatcgccaccggcggcttcatcttcatgggcgacgtgatccacagaatgctgaccgccacccagtacgtggcccccctgatggccaacttcaaccccggctacagcgacaacagcaccgtggtgtacttcgacaacggcaccgtgttcgtggtgcagtgggaccacgtgtacctgcagggctgggaggacaagggcagcttcaccttccaggccgccctgcaccacgacggcagaatcgtgttcgcctacaaggagatccccatgagcgtgcccgagatcagcagcagccagcaccccgtgaagaccggcctgagcgacgccttcatgatcctgaaccccagccccgacgtgcccgagagcagaagaagaagcatcttcgagtaccacagaatcgagctggaccccagcaaggtgaccagcatgagcgccgtggagttcacccccctgcccacctgcctgcagcacagaagctgcgacgcctgcatgagcagcgacctgaccttcaactgcagctggtgccacgtgctgcagagatgcagcagcggcttcgacagatacagacaggagtggatggactacggctgcgcccaggaggccgagggcagaatgtgcgaggacttccaggacgaggaccacgacagcgccagccccgacaccagcttcagcccctacgacggcgacctgaccaccaccagcagcagcctgttcatcgacagcctgaccaccgaggacgacaccaagctgaacccctacgccggcggcgacggcctgcagaacaacctgagccccaagaccaagggcacccccgtgcacctgggcaccatcgtgggcatcgtgctggccgtgctgctggtggccgccatcatcctggccggcatctacatcaacggccaccccaccagcaacgccgccctgttcttcatcgagagaagaccccaccactggcccgccatgaagttcagaagccaccccgaccacagcacctacgccgaggtggagcccagcggccacgagaaggagggcttcatggaggccgagcagtgctag

SEQ ID NO: 93674 - DNA, 723 bp, Artificial Sequence
  Description of Artificial Sequence: Synthetic coding sequence
atggacaccctgcccgacaacagaaccagagtggtggaggacaaccacagctactacgtgagcagactgtacggccccagcgagccccacagcagagagctgtgggtggacgtggccgaggccaacagaagccaggtgaagatccacaccatcctgagcaacacccacagacaggccagcagagtggtgctgagcttcgacttccccttctacggccaccccctgagacagatcaccatcgccaccggcggcttcatcttcatgggcgacgtgatccacagaatgctgaccgccacccagtacgtggcccccctgatggccaacttcaaccccggctacagcgacaacagcaccgtggtgtacttcgacaacggcaccgtgttcgtggtgcagtgggaccacgtgtacctgcagggctgggaggacaagggcagcttcaccttccaggccgccctgcaccacgacggcagaatcgtgttcgcctacaaggagatccccatgagcgtgcccgagatcagcagcagccagcaccccgtgaagaccggcctgagcgacgccttcatgatcctgaaccccagccccgacgtgcccgagagcagaagaagaagcatcttcgagtaccacagaatcgagctggaccccagcaaggtgaccagcatgagcgccgtggagttcacccccctgcccagccccagcaccaccagaatgaagaccagaatgtag

SEQ ID NO: 93675 - DNA, 1179 bp, Artificial Sequence
  Description of Artificial Sequence: Synthetic coding sequence
atggagaaggacaaggtgaagatccacggcatcctgagcaacacccacagacaggccgccagagtgaacctgagcttcgacttccccttctacggccacttcctgagagagatcaccgtggccaccggcggcttcatctacaccggcgaggtggtgcacagaatgctgaccgccacccagtacatcgcccccctgatggccaacttcgaccccagcgtgagcagaaacagcaccgtgagatacttcgacaacggcaccgccctggtggtgcagtgggaccacgtgcacctgcaggacaactacaacctgggcagcttcaccttccaggccaccctgctgatggacggcagaatcatcttcggctacaaggagatccccgtgctggtgacccagatcagcagcaccaaccaccccgtgaaggtgggcctgagcgacgccttcgtggtggtgcacagaatccagcagatccccaacgtgagaagaagaaccatctacgagtaccacagagtggagctgcagatgagcaagatcaccaacatcagcgccgtggagatgacccccctgcccacctgcctgcagttcaacagatgcggcccctgcgtgagcagccagatcggcttcaactgcagctggtgcagcaagctgcagagatgcagcagcggcttcgacagacacagacaggactgggtggacagcggctgccccgaggagagcaaggagaagatgtgcgagaacaccgagcccgtggagaccagcagcagaaccaccaccaccgtgggcgccaccaccacccagttcagagtgctgaccaccaccagaagagccgtgaccagccagttccccaccagcctgcccaccgaggacgacaccaagatcgccctgcacctgaaggacaacggcgccagcaccgacgacagcgccgccgagaagaagggcggcaccctgcacgccggcctgatcatcggcatcctgatcctggtgctgatcgtggccaccgccatcctggtgaccgtgtacatgtaccaccaccccaccagcgccgccagcatcttcttcatcgagagaagacccagcagatggcccgccatgaagttcagaagaggcagcggccaccccgcctacgccgaggtggagcccgtgggcgagaaggagggcttcatcgtgagcgagcagtgctag

SEQ ID NO: 93676 - DNA, 1443 bp, Artificial Sequence
  Description of Artificial Sequence: Synthetic coding sequence
atggccagattccccaaggccgacctggccgccgccggcgtgatgctgctgtgccacttcttcaccgaccagttccagttcgccgacggcaagcccggcgaccagatcctggactggcagtacggcgtgacccaggccttcccccacaccgaggaggaggtggaggtggacagccacgcctacagccacagatggaagagaaacctggacttcctgaaggccgtggacaccaacagagccagcgtgggccaggacagccccgagcccagaagcttcaccgacctgctgctggacgacggccaggacaacaacacccagatcgagagagtgaacctgagcttcgacttccccttctacggccacttcctgagagagatcaccgtggccaccggcggcttcatctacaccggcgaggtggtgcacagaatgctgaccgccacccagtacatcgcccccctgatggccaacttcgaccccagcgtgagcagaaacagcaccgtgagatacttcgacaacggcaccgccctggtggtgcagtgggaccacgtgcacctgcaggacaactacaacctgggcagcttcaccttccaggccaccctgctgatggacggcagaatcatcttcggctacaaggagatccccgtgctggtgacccagatcagcagcaccaaccaccccgtgaaggtgggcctgagcgacgccttcgtggtggtgcacagaatccagcagatccccaacgtgagaagaagaaccatctacgagtaccacagagtggagctgcagatgagcaagatcaccaacatcagcgccgtggagatgacccccctgcccacctgcctgcagttcaacagatgcggcccctgcgtgagcagccagatcggcttcaactgcagctggtgcagcaagctgcagagatgcagcagcggcttcgacagacacagacaggactgggtggacagcggctgccccgaggagagcaaggagaagatgtgcgagaacaccgagcccgtggagaccagcagcagaaccaccaccaccgtgggcgccaccaccacccagttcagagtgctgaccaccaccagaagagccgtgaccagccagttccccaccagcctgcccaccgaggacgacaccaagatcgccctgcacctgaaggacaacggcgccagcaccgacgacagcgccgccgagaagaagggcggcaccctgcacgccggcctgatcatcggcatcctgatcctggtgctgatcgtggccaccgccatcctggtgaccgtgtacatgtaccaccaccccaccagcgccgccagcatcttcttcatcgagagaagacccagcagatggcccgccatgaagttcagaagaggcagcggccaccccgcctacgccgaggtggagcccgtgggcgagaaggagggcttcatcgtgagcgagcagtgctag

SEQ ID NO: 93677 - DNA, 1590 bp, Artificial Sequence
  Description of Artificial Sequence: Synthetic coding sequence
atggccagattccccaaggccgacctggccgccgccggcgtgatgctgctgtgccacttcttcaccgaccagttccagttcgccgacggcaagcccggcgaccagatcctggactggcagtacggcgtgacccaggccttcccccacaccgaggaggaggtggaggtggacagccacgcctacagccacagatggaagagaaacctggacttcctgaaggccgtggacaccaacagagccagcgtgggccaggacagccccgagcccagaagcttcaccgacctgctgctggacgacggccaggacaacaacacccagatcgaggaggacaccgaccacaactactacatcagcagaatctacggccccagcgacagcgccagcagagacctgtgggtgaacatcgaccagatggagaaggacaaggtgaagatccacggcatcctgagcaacacccacagacaggccgccagagtgaacctgagcttcgacttccccttctacggccacttcctgagagagatcaccgtggccaccggcggcttcatctacaccggcgaggtggtgcacagaatgctgaccgccacccagtacatcgcccccctgatggccaacttcgaccccagcgtgagcagaaacagcaccgtgagatacttcgacaacggcaccgccctggtggtgcagtgggaccacgtgcacctgcaggacaactacaacctgggcagcttcaccttccaggccaccctgctgatggacggcagaatcatcttcggctacaaggagatccccgtgctggtgacccagatcagcagcaccaaccaccccgtgaaggtgggcctgagcgacgccttcgtggtggtgcacagaatccagcagatccccaacgtgagaagaagaaccatctacgagtaccacagagtggagctgcagatgagcaagatcaccaacatcagcgccgtggagatgacccccctgcccacctgcctgcagttcaacagatgcggcccctgcgtgagcagccagatcggcttcaactgcagctggtgcagcaagctgcagagatgcagcagcggcttcgacagacacagacaggactgggtggacagcggctgccccgaggagagcaaggagaagatgtgcgagaacaccgagcccgtggagaccagcagcagaaccaccaccaccgtgggcgccaccaccacccagttcagagtgctgaccaccaccagaagagccgtgaccagccagttccccaccagcctgcccaccgaggacgacaccaagatcgccctgcacctgaaggacaacggcgccagcaccgacgacagcgccgccgagaagaagggcggcaccctgcacgccggcctgatcatcggcatcctgatcctggtgctgatcgtggccaccgccatcctggtgaccgtgtacatgtaccaccaccccaccagcgccgccagcatcttcttcatcgagagaagacccagcagatggcccgccatgaagttcagaagaggcagcggccaccccgcctacgccgaggtggagcccgtgggcgagaaggagggcttcatcgtgagcgagcagtgctag

SEQ ID NO: 93678 - DNA, 1548 bp, Artificial Sequence
  Description of Artificial Sequence: Synthetic coding sequence
atgctgctgtgccacttcttcaccgaccagttccagttcgccgacggcaagcccggcgaccagatcctggactggcagtacggcgtgacccaggccttcccccacaccgaggaggaggtggaggtggacagccacgcctacagccacagatggaagagaaacctggacttcctgaaggccgtggacaccaacagagccagcgtgggccaggacagccccgagcccagaagcttcaccgacctgctgctggacgacggccaggacaacaacacccagatcgaggaggacaccgaccacaactactacatcagcagaatctacggccccagcgacagcgccagcagagacctgtgggtgaacatcgaccagatggagaaggacaaggtgaagatccacggcatcctgagcaacacccacagacaggccgccagagtgaacctgagcttcgacttccccttctacggccacttcctgagagagatcaccgtggccaccggcggcttcatctacaccggcgaggtggtgcacagaatgctgaccgccacccagtacatcgcccccctgatggccaacttcgaccccagcgtgagcagaaacagcaccgtgagatacttcgacaacggcaccgccctggtggtgcagtgggaccacgtgcacctgcaggacaactacaacctgggcagcttcaccttccaggccaccctgctgatggacggcagaatcatcttcggctacaaggagatccccgtgctggtgacccagatcagcagcaccaaccaccccgtgaaggtgggcctgagcgacgccttcgtggtggtgcacagaatccagcagatccccaacgtgagaagaagaaccatctacgagtaccacagagtggagctgcagatgagcaagatcaccaacatcagcgccgtggagatgacccccctgcccacctgcctgcagttcaacagatgcggcccctgcgtgagcagccagatcggcttcaactgcagctggtgcagcaagctgcagagatgcagcagcggcttcgacagacacagacaggactgggtggacagcggctgccccgaggagagcaaggagaagatgtgcgagaacaccgagcccgtggagaccagcagcagaaccaccaccaccgtgggcgccaccaccacccagttcagagtgctgaccaccaccagaagagccgtgaccagccagttccccaccagcctgcccaccgaggacgacaccaagatcgccctgcacctgaaggacaacggcgccagcaccgacgacagcgccgccgagaagaagggcggcaccctgcacgccggcctgatcatcggcatcctgatcctggtgctgatcgtggccaccgccatcctggtgaccgtgtacatgtaccaccaccccaccagcgccgccagcatcttcttcatcgagagaagacccagcagatggcccgccatgaagttcagaagaggcagcggccaccccgcctacgccgaggtggagcccgtgggcgagaaggagggcttcatcgtgagcgagcagtgctag

SEQ ID NO: 93679 - DNA, 1581 bp, Artificial Sequence
  Description of Artificial Sequence: Synthetic coding sequence
atgagatgcgccctggccctgagcgccctgctgctgctgctgagcaccccccccctgctgcccagcagccccagccccagccccagccccagccagaacgccacccagaccaccaccgacagcagcaacaagaccgcccccacccccgccagcagcgtgaccatcatggccaccgacaccgcccagcagagcaccgtgcccaccagcaaggccaacgagatcctggccagcgtgaaggccaccaccctgggcgtgagcagcgacagccccggcaccaccaccctggcccagcaggtgagcggccccgtgaacaccaccgtggccagaggcggcggcagcggcaaccccaccaccaccatcgagagccccaagagcaccaagagcgccgacaccaccaccgtggccaccagcaccgccaccgccaagcccaacaccaccagcagccagaacggcgccgaggacaccaccaacagcggcggcaagagcagccacagcgtgaccaccgacctgaccagcaccaaggccgagcacctgaccaccccccaccccaccagccccctgagccccagacagcccaccagcacccaccccgtggccacccccaccagcagcggccacgaccacctgatgaagatcagcagcagcagcagcaccgtggccatccccggctacaccttcaccagccccggcatgaccaccaccctgcccagcagcgtgatcagccagagaacccagcagaccagcagccagatgcccgccagcagcaccgcccccagcagccaggagaccgtgcagcccaccagccccgccaccgccctgagaacccccaccctgcccgagaccatgagcagcagccccaccgccgccagcaccacccacagataccccaagacccccagccccaccgtggcccacgagagcaactgggccaagtgcgaggacctggagacccagacccagagcgagaagcagctggtgctgaacctgaccggcaacaccctgtgcgccggcggcgccagcgacgagaagctgatcagcctgatctgcagagccgtgaaggccaccttcaaccccgcccaggacaagtgcggcatcagactggccagcgtgcccggcagccagaccgtggtggtgaaggagatcaccatccacaccaagctgcccgccaaggacgtgtacgagagactgaaggacaagtgggacgagctgaaggaggccggcgtgagcgacatgaagctgggcgaccagggcccccccgaggaggccgaggacagattcagcatgcccctgatcatcaccatcgtgtgcatggccagcttcctgctgctggtggccgccctgtacggctgctgccaccagagactgagccagagaaaggaccagcagagactgaccgaggagctgcagaccgtggagaacggctaccacgacaaccccaccctggaggtgatggagaccagcagcgagatgcaggagaagaaggtggtgagcctgaacggcgagctgggcgacagctggatcgtgcccctggacaacctgaccaaggacgacctggacgaggaggaggacacccacctgtag

SEQ ID NO: 93680 - DNA, 1677 bp, Artificial Sequence
  Description of Artificial Sequence: Synthetic coding sequence
atgagatgcgccctggccctgagcgccctgctgctgctgctgagcaccccccccctgctgcccagcagccccagccccagccccagccccagccagaacgccacccagaccaccaccgacagcagcaacaagaccgcccccacccccgccagcagcgtgaccatcatggccaccgacaccgcccagcagagcaccgtgcccaccagcaaggccaacgagatcctggccagcgtgaaggccaccaccctgggcgtgagcagcgacagccccggcaccaccaccctggcccagcaggtgagcggccccgtgaacaccaccgtggccagaggcggcggcagcggcaaccccaccaccaccatcgagagccccaagagcaccaagagcgccgacaccaccaccgtggccaccagcaccgccaccgccaagcccaacaccaccagcagccagaacggcgccgaggacaccaccaacagcggcggcaagagcagccacagcgtgaccaccgacctgaccagcaccaaggccgagcacctgaccaccccccaccccaccagccccctgagccccagacagcccaccagcacccaccccgtggccacccccaccagcagcggccacgaccacctgatgaagatcagcagcagcagcagcaccgtggccatccccggctacaccttcaccagccccggcatgaccaccaccctgctggagaccgtgttccaccacgtgagccaggccggcctggagctgctgaccagcggcgacctgcccaccctggccagccagagcgccggcatcaccgccagcagcgtgatcagccagagaacccagcagaccagcagccagatgcccgccagcagcaccgcccccagcagccaggagaccgtgcagcccaccagccccgccaccgccctgagaacccccaccctgcccgagaccatgagcagcagccccaccgccgccagcaccacccacagataccccaagacccccagccccaccgtggcccacgagagcaactgggccaagtgcgaggacctggagacccagacccagagcgagaagcagctggtgctgaacctgaccggcaacaccctgtgcgccggcggcgccagcgacgagaagctgatcagcctgatctgcagagccgtgaaggccaccttcaaccccgcccaggacaagtgcggcatcagactggccagcgtgcccggcagccagaccgtggtggtgaaggagatcaccatccacaccaagctgcccgccaaggacgtgtacgagagactgaaggacaagtgggacgagctgaaggaggccggcgtgagcgacatgaagctgggcgaccagggcccccccgaggaggccgaggacagattcagcatgcccctgatcatcaccatcgtgtgcatggccagcttcctgctgctggtggccgccctgtacggctgctgccaccagagactgagccagagaaaggaccagcagagactgaccgaggagctgcagaccgtggagaacggctaccacgacaaccccaccctggaggtgatggagaccagcagcgagatgcaggagaagaaggtggtgagcctgaacggcgagctgggcgacagctggatcgtgcccctggacaacctgaccaaggacgacctggacgaggaggaggacacccacctgtag

SEQ ID NO: 93681 - DNA, 1581 bp, Artificial Sequence
  Description of Artificial Sequence: Synthetic coding sequence
atgagatgcgccctggccctgagcgccctgctgctgctgctgagcaccccccccctgctgcccagcagccccagccccagccccagccccagccagaacgccacccagaccaccaccgacagcagcaacaagaccgcccccacccccgccagcagcgtgaccatcatggccaccgacaccgcccagcagagcaccgtgcccaccagcaaggccaacgagatcctggccagcgtgaaggccaccaccctgggcgtgagcagcgacagccccggcaccaccaccctggcccagcaggtgagcggccccgtgaacaccaccgtggccagaggcggcggcagcggcaaccccaccaccaccatcgagagccccaagagcaccaagagcgccgacaccaccaccgtggccaccagcaccgccaccgccaagcccaacaccaccagcagccagaacggcgccgaggacaccaccaacagcggcggcaagagcagccacagcgtgaccaccgacctgaccagcaccaaggccgagcacctgaccaccccccaccccaccagccccctgagccccagacagcccaccagcacccaccccgtggccacccccaccagcagcggccacgaccacctgatgaagatcagcagcagcagcagcaccgtggccatccccggctacaccttcaccagccccggcatgaccaccaccctgcccagcagcgtgatcagccagagaacccagcagaccagcagccagatgcccgccagcagcaccgcccccagcagccaggagaccgtgcagcccaccagccccgccaccgccctgagaacccccaccctgcccgagaccatgagcagcagccccaccgccgccagcaccacccacagataccccaagacccccagccccaccgtggcccacgagagcaactgggtgacccccgccggcgtgggcacccagaccagagtggaggaggccctgagacaggccctgacccacagcctgctgcccgccggcggcgccagcgacgagaagctgatcagcctgatctgcagagccgtgaaggccaccttcaaccccgcccaggacaagtgcggcatcagactggccagcgtgcccggcagccagaccgtggtggtgaaggagatcaccatccacaccaagctgcccgccaaggacgtgtacgagagactgaaggacaagtgggacgagctgaaggaggccggcgtgagcgacatgaagctgggcgaccagggcccccccgaggaggccgaggacagattcagcatgcccctgatcatcaccatcgtgtgcatggccagcttcctgctgctggtggccgccctgtacggctgctgccaccagagactgagccagagaaaggaccagcagagactgaccgaggagctgcagaccgtggagaacggctaccacgacaaccccaccctggaggtgatggagaccagcagcgagatgcaggagaagaaggtggtgagcctgaacggcgagctgggcgacagctggatcgtgcccctggacaacctgaccaaggacgacctggacgaggaggaggacacccacctgtag

SEQ ID NO: 93682 - DNA, 1683 bp, Artificial Sequence
  Description of Artificial Sequence: Synthetic coding sequence
atgagatgcgccctggccctgagcgccctgctgctgctgctgagcaccccccccctgctgcccagcagccccagccccagccccagccccagccagaacgagaccgccacccagaccaccaccgacagcagcaacaagaccgcccccacccccgccagcagcgtgaccatcatggccaccgacaccgcccagcagagcaccgtgcccaccagcaaggccaacgagatcctggccagcgtgaaggccaccaccctgggcgtgagcagcgacagccccggcaccaccaccctggcccagcaggtgagcggccccgtgaacaccaccgtggccagaggcggcggcagcggcaaccccaccaccaccatcgagagccccaagagcaccaagagcgccgacaccaccaccgtggccaccagcaccgccaccgccaagcccaacaccaccagcagccagaacggcgccgaggacaccaccaacagcggcggcaagagcagccacagcgtgaccaccgacctgaccagcaccaaggccgagcacctgaccaccccccaccccaccagccccctgagccccagacagcccaccagcacccaccccgtggccacccccaccagcagcggccacgaccacctgatgaagatcagcagcagcagcagcaccgtggccatccccggctacaccttcaccagccccggcatgaccaccaccctgctggagaccgtgttccaccacgtgagccaggccggcctggagctgctgaccagcggcgacctgcccaccctggccagccagagcgccggcatcaccgccagcagcgtgatcagccagagaacccagcagaccagcagccagatgcccgccagcagcaccgcccccagcagccaggagaccgtgcagcccaccagccccgccaccgccctgagaacccccaccctgcccgagaccatgagcagcagccccaccgccgccagcaccacccacagataccccaagacccccagccccaccgtggcccacgagagcaactgggccaagtgcgaggacctggagacccagacccagagcgagaagcagctggtgctgaacctgaccggcaacaccctgtgcgccggcggcgccagcgacgagaagctgatcagcctgatctgcagagccgtgaaggccaccttcaaccccgcccaggacaagtgcggcatcagactggccagcgtgcccggcagccagaccgtggtggtgaaggagatcaccatccacaccaagctgcccgccaaggacgtgtacgagagactgaaggacaagtgggacgagctgaaggaggccggcgtgagcgacatgaagctgggcgaccagggcccccccgaggaggccgaggacagattcagcatgcccctgatcatcaccatcgtgtgcatggccagcttcctgctgctggtggccgccctgtacggctgctgccaccagagactgagccagagaaaggaccagcagagactgaccgaggagctgcagaccgtggagaacggctaccacgacaaccccaccctggaggtgatggagaccagcagcgagatgcaggagaagaaggtggtgagcctgaacggcgagctgggcgacagctggatcgtgcccctggacaacctgaccaaggacgacctggacgaggaggaggacacccacctgtag

SEQ ID NO: 93683 - DNA, 1551 bp, Artificial Sequence
  Description of Artificial Sequence: Synthetic coding sequence
atgagatgcgccctggccctgagcgccctgctgctgctgctgagcaccagccccagccccagccagaacgccacccagaccaccaccgacagcagcaacaagaccgcccccacccccgccagcagcgtgaccatcatggccaccgacaccgcccagcagagcaccgtgcccaccagcaaggccaacgagatcctggccagcgtgaaggccaccaccctgggcgtgagcagcgacagccccggcaccaccaccctggcccagcaggtgagcggccccgtgaacaccaccgtggccagaggcggcggcagcggcaaccccaccaccaccatcgagagccccaagagcaccaagagcgccgacaccaccaccgtggccaccagcaccgccaccgccaagcccaacaccaccagcagccagaacggcgccgaggacaccaccaacagcggcggcaagagcagccacagcgtgaccaccgacctgaccagcaccaaggccgagcacctgaccaccccccaccccaccagccccctgagccccagacagcccaccagcacccaccccgtggccacccccaccagcagcggccacgaccacctgatgaagatcagcagcagcagcagcaccgtggccatccccggctacaccttcaccagccccggcatgaccaccaccctgcccagcagcgtgatcagccagagaacccagcagaccagcagccagatgcccgccagcagcaccgcccccagcagccaggagaccgtgcagcccaccagccccgccaccgccctgagaacccccaccctgcccgagaccatgagcagcagccccaccgccgccagcaccacccacagataccccaagacccccagccccaccgtggcccacgagagcaactgggccaagtgcgaggacctggagacccagacccagagcgagaagcagctggtgctgaacctgaccggcaacaccctgtgcgccggcggcgccagcgacgagaagctgatcagcctgatctgcagagccgtgaaggccaccttcaaccccgcccaggacaagtgcggcatcagactggccagcgtgcccggcagccagaccgtggtggtgaaggagatcaccatccacaccaagctgcccgccaaggacgtgtacgagagactgaaggacaagtgggacgagctgaaggaggccggcgtgagcgacatgaagctgggcgaccagggcccccccgaggaggccgaggacagattcagcatgcccctgatcatcaccatcgtgtgcatggccagcttcctgctgctggtggccgccctgtacggctgctgccaccagagactgagccagagaaaggaccagcagagactgaccgaggagctgcagaccgtggagaacggctaccacgacaaccccaccctggaggtgatggagaccagcagcgagatgcaggagaagaaggtggtgagcctgaacggcgagctgggcgacagctggatcgtgcccctggacaacctgaccaaggacgacctggacgaggaggaggacacccacctgtag

SEQ ID NO: 93684 - DNA, 1986 bp, Artificial Sequence
  Description of Artificial Sequence: Synthetic coding sequence
atggagggcgccagagccagaggcgcccagctgagactgggcgagagagtgagacccgtgggcagaagaagcgcccccggcagaagcagattcagacagccctggagacccggcgccagcgacagcgccccccccgccggcaccatggcccagagcagagtgctgctgctgctgctgctgctgcccccccagctgcacctgggccccgtgctggccgtgagagcccccggcttcggcagaagcggcggccacagcctgagccccgaggagaacgagttcgccgaggaggagcccgtgctggtgctgagccccgaggagcccggccccggccccgccgccgtgagctgccccagagactgcgcctgcagccaggagggcgtggtggactgcggcggcatcgacctgagagagttccccggcgacctgcccgagcacaccaaccacctgagcctgcagaacaaccagctggagaagatctaccccgaggagctgagcagactgcacagactggagaccctgaacctgcagaacaacagactgaccagcagaggcctgcccgagaaggccttcgagcacctgaccaacctgaactacctgtacctggccaacaacaagctgaccctggcccccagattcctgcccaacgccctgatcagcgtggacttcgccgccaactacctgaccaagatctacggcctgaccttcggccagaagcccaacctgagaagcgtgtacctgcacaacaacaagctggccgacgccggcctgcccgacaacatgttcaacggcagcagcaacgtggaggtgctgatcctgagcagcaacttcctgagacacgtgcccaagcacctgccccccgccctgtacaagctgcacctgaagaacaacaagctggagaagatcccccccggcgccttcagcgagctgagcagcctgagagagctgtacctgcagaacaactacctgaccgacgagggcctggacaacgagaccttctggaagctgagcagcctggagtacctggacctgagcagcaacaacctgagcagagtgcccgccggcctgcccagaagcctggtgctgctgcacctggagaagaacgccatcagaagcgtggacgccaacgtgctgacccccatcagaagcctggagtacctgctgctgcacagcaaccagctgagagagcagggcatccaccccctggccttccagggcctgaagagactgcacaccgtgcacctgtacaacaacgccctggagagagtgcccagcggcctgcccagaagagtgagaaccctgatgatcctgcacaaccagatcaccggcatcggcagagaggacttcgccaccacctacttcctggaggagctgaacctgagctacaacagaatcaccagcccccaggtgcacagagacgccttcagaaagctgagactgctgagaagcctggacctgagcggcaacagactgcacaccctgccccccggcctgcccagaaacgtgcacgtgctgaaggtgaagagaaacgagctggccgccctggccagaggcgccctggtgggcatggcccagctgagagagctgtacctgaccagcaacagactgagaagcagagccctgggccccagagcctgggtggacctggcccacctgcagctgctggacatcgccggcaaccagctgaccgagatccccgagggcctgcccgagagcctggagtacctgtacctgcagaacaacaagatcagcgccgtgcccgccaacgccttcgacagcacccccaacctgaagggcatcttcctgagattcaacaagctggccgtgggcagcgtggtggacagcgccttcagaagactgaagcacctgcaggtgctggacatcgagggcaacctggagttcggcgacatcagcaaggacagaggcagactgggcaaggagaaggaggaggaggaggaggaggaggaggaggaggaggagaccagatag

SEQ ID NO: 93685 - DNA, 1929 bp, Artificial Sequence
  Description of Artificial Sequence: Synthetic coding sequence
atggagggcgaggaggccgagcagcccgcctggttcagacagccctggagacccggcgccagcgacagcgccccccccgccggcaccatggcccagagcagagtgctgctgctgctgctgctgctgcccccccagctgcacctgggccccgtgctggccgtgagagcccccggcttcggcagaagcggcggccacagcctgagccccgaggagaacgagttcgccgaggaggagcccgtgctggtgctgagccccgaggagcccggccccggccccgccgccgtgagctgccccagagactgcgcctgcagccaggagggcgtggtggactgcggcggcatcgacctgagagagttccccggcgacctgcccgagcacaccaaccacctgagcctgcagaacaaccagctggagaagatctaccccgaggagctgagcagactgcacagactggagaccctgaacctgcagaacaacagactgaccagcagaggcctgcccgagaaggccttcgagcacctgaccaacctgaactacctgtacctggccaacaacaagctgaccctggcccccagattcctgcccaacgccctgatcagcgtggacttcgccgccaactacctgaccaagatctacggcctgaccttcggccagaagcccaacctgagaagcgtgtacctgcacaacaacaagctggccgacgccggcctgcccgacaacatgttcaacggcagcagcaacgtggaggtgctgatcctgagcagcaacttcctgagacacgtgcccaagcacctgccccccgccctgtacaagctgcacctgaagaacaacaagctggagaagatcccccccggcgccttcagcgagctgagcagcctgagagagctgtacctgcagaacaactacctgaccgacgagggcctggacaacgagaccttctggaagctgagcagcctggagtacctggacctgagcagcaacaacctgagcagagtgcccgccggcctgcccagaagcctggtgctgctgcacctggagaagaacgccatcagaagcgtggacgccaacgtgctgacccccatcagaagcctggagtacctgctgctgcacagcaaccagctgagagagcagggcatccaccccctggccttccagggcctgaagagactgcacaccgtgcacctgtacaacaacgccctggagagagtgcccagcggcctgcccagaagagtgagaaccctgatgatcctgcacaaccagatcaccggcatcggcagagaggacttcgccaccacctacttcctggaggagctgaacctgagctacaacagaatcaccagcccccaggtgcacagagacgccttcagaaagctgagactgctgagaagcctggacctgagcggcaacagactgcacaccctgccccccggcctgcccagaaacgtgcacgtgctgaaggtgaagagaaacgagctggccgccctggccagaggcgccctggtgggcatggcccagctgagagagctgtacctgaccagcaacagactgagaagcagagccctgggccccagagcctgggtggacctggcccacctgcagctgctggacatcgccggcaaccagctgaccgagatccccgagggcctgcccgagagcctggagtacctgtacctgcagaacaacaagatcagcgccgtgcccgccaacgccttcgacagcacccccaacctgaagggcatcttcctgagattcaacaagctggccgtgggcagcgtggtggacagcgccttcagaagactgaagcacctgcaggtgctggacatcgagggcaacctggagttcggcgacatcagcaaggacagaggcagactgggcaaggagaaggaggaggaggaggaggaggaggaggaggaggaggagaccagatag

SEQ ID NO: 93686 - DNA, 1560 bp, Artificial Sequence
  Description of Artificial Sequence: Synthetic coding sequence
atggagggcgccagagccagaggcgcccagctgagactgggcgagagagtgagacccgtgggcagaagaagcgcccccggcagaagcagattcagacagccctggagacccggcgccagcgacagcgccccccccgccggcaccatggcccagagcagagtgctgctgctgctgctgctgctgcccccccagctgcacctgggccccgtgctggccgtgagagcccccggcttcggcagaagcggcggccacagcctgagccccgaggagaacgagttcgccgaggaggagcccgtgctggtgctgagccccgaggagcccggccccggccccgccgccgtgagctgccccagagactgcgcctgcagccaggagggcgtggtggactgcggcggcatcgacctgagagagttccccggcgacctgcccgagcacaccaaccacctgagcctgcagaacaacaagctggagaagatcccccccggcgccttcagcgagctgagcagcctgagagagctgtacctgcagaacaactacctgaccgacgagggcctggacaacgagaccttctggaagctgagcagcctggagtacctggacctgagcagcaacaacctgagcagagtgcccgccggcctgcccagaagcctggtgctgctgcacctggagaagaacgccatcagaagcgtggacgccaacgtgctgacccccatcagaagcctggagtacctgctgctgcacagcaaccagctgagagagcagggcatccaccccctggccttccagggcctgaagagactgcacaccgtgcacctgtacaacaacgccctggagagagtgcccagcggcctgcccagaagagtgagaaccctgatgatcctgcacaaccagatcaccggcatcggcagagaggacttcgccaccacctacttcctggaggagctgaacctgagctacaacagaatcaccagcccccaggtgcacagagacgccttcagaaagctgagactgctgagaagcctggacctgagcggcaacagactgcacaccctgccccccggcctgcccagaaacgtgcacgtgctgaaggtgaagagaaacgagctggccgccctggccagaggcgccctggtgggcatggcccagctgagagagctgtacctgaccagcaacagactgagaagcagagccctgggccccagagcctgggtggacctggcccacctgcagctgctggacatcgccggcaaccagctgaccgagatccccgagggcctgcccgagagcctggagtacctgtacctgcagaacaacaagatcagcgccgtgcccgccaacgccttcgacagcacccccaacctgaagggcatcttcctgagattcaacaagctggccgtgggcagcgtggtggacagcgccttcagaagactgaagcacctgcaggtgctggacatcgagggcaacctggagttcggcgacatcagcaaggacagaggcagactgggcaaggagaaggaggaggaggaggaggaggaggaggaggaggaggagaccagatag

SEQ ID NO: 93687 - DNA, 1095 bp, Artificial Sequence
  Description of Artificial Sequence: Synthetic coding sequence
atggccagagccatggccgccgcctggcccctgctgctggtggccctgctggtgctgagctggcccccccccggcaccggcgacgtggtggtgcaggcccccacccaggtgcccggcttcctgggcgacagcgtgaccctgccctgctacctgcaggtgcccaacatggaggtgacccacgtgagccagctgacctgggccagacacggcgagagcggcagcatggccgtgttccaccagacccagggccccagctacagcgagagcaagagactggagttcgtggccgccagactgggcgccgagctgagaaacgccagcctgagaatgttcggcctgagagtggaggacgagggcaactacacctgcctgttcgtgaccttcccccagggcagcagaagcgtggacatctggctgagagtgctggccaagccccagaacaccgccgaggtgcagaaggtgcagctgaccggcgagcccgtgcccatggccagatgcgtgagcaccggcggcagaccccccgcccagatcacctggcacagcgacctgggcggcatgcccaacaccagccaggtgcccggcttcctgagcggcaccgtgaccgtgaccagcctgtggatcctggtgcccagcagccaggtggacggcaagaacgtgacctgcaaggtggagcacgagagcttcgagaagccccagctgctgaccgtgaacctgaccgtgtactacccccccgaggtgagcatcagcggctacgacaacaactggtacctgggccagaacgaggccaccctgacctgcgacgccagaagcaaccccgagcccaccggctacaactggagcaccaccatgggccccctgccccccttcgccgtggcccagggcgcccagctgctgatcagacccgtggacaagcccatcaacaccaccctgatctgcaacgtgaccaacgccctgggcgccagacaggccgagctgaccgtgcaggtgaagggcaccgagcacgccagcgccagcgccaacggccacgtgagctacagcgccgtgagcagagagaacagcagcagccaggacccccagaccgagggcaccagatag

SEQ ID NO: 93688 - DNA, 1119 bp, Artificial Sequence
  Description of Artificial Sequence: Synthetic coding sequence
atggccagagccatggccgccgcctggcccctgctgctggtggccctgctggtgctgagctggcccccccccggcaccggcgacgtggtggtgcaggcccccacccaggtgcccggcttcctgggcgacagcgtgaccctgccctgctacctgcaggtgcccaacatggaggtgacccacgtgagccagctgacctgggccagacacggcgagagcggcagcatggccgtgttccaccagacccagggccccagctacagcgagagcaagagactggagttcgtggccgccagactgggcgccgagctgagaaacgccagcctgagaatgttcggcctgagagtggaggacgagggcaactacacctgcctgttcgtgaccttcccccagggcagcagaagcgtggacatctggctgagagtgctggccaagccccagaacaccgccgaggtgcagaaggtgcagctgaccggcgagcccgtgcccatggccagatgcgtgagcaccggcggcagaccccccgcccagatcacctggcacagcgacctgggcggcatgcccaacaccagccaggtgcccggcttcctgagcggcaccgtgaccgtgaccagcctgtggatcctggtgcccagcagccaggtggacggcaagaacgtgacctgcaaggtggagcacgagagcttcgagaagccccagctgctgaccgtgaacctgaccgtgtactacccccccgaggtgagcatcagcggctacgacaacaactggtacctgggccagaacgaggccaccctgacctgcgacgccagaagcaaccccgagcccaccggctacaactggagcaccaccatgggccccctgccccccttcgccgtggcccagggcgcccagctgctgatcagacccgtggacaagcccatcaacaccaccctgatctgcaacgtgaccaacgccctgggcgccagacaggccgagctgaccgtgcaggtgaaggagggcccccccagcgagcacagcggcaccgagcacgccagcgccagcgccaacggccacgtgagctacagcgccgtgagcagagagaacagcagcagccaggacccccagaccgagggcaccagatag

SEQ ID NO: 93689 - DNA, 1179 bp, Artificial Sequence
  Description of Artificial Sequence: Synthetic coding sequence
atggccagagccatggccgccgcctggcccctgctgctggtggccctgctggtgctgagctggcccccccccggcaccggcgacgtggtggtgcaggcccccacccaggtgcccggcttcctgggcgacagcgtgaccctgccctgctacctgcaggtgcccaacatggaggtgacccacgtgagccagctgacctgggccagacacggcgagagcggcagcatggccgtgttccaccagacccagggccccagctacagcgagagcaagagactggagttcgtggccgccagactgggcgccgagctgagaaacgccagcctgagaatgttcggcctgagagtggaggacgagggcaactacacctgcctgttcgtgaccttcccccagggcagcagaagcgtggacatctggctgagagtgctggccaagccccagaacaccgccgaggtgcagaaggtgcagctgaccggcgagcccgtgcccatggccagatgcgtgagcaccggcggcagaccccccgcccagatcacctggcacagcgacctgggcggcatgcccaacaccagccaggtgcccggcttcctgagcggcaccgtgaccgtgaccagcctgtggatcctggtgcccagcagccaggtggacggcaagaacgtgacctgcaaggtggagcacgagagcttcgagaagccccagctgctgaccgtgaacctgaccgtgtactacccccccgaggtgagcatcagcggctacgacaacaactggtacctgggccagaacgaggccaccctgacctgcgacgccagaagcaaccccgagcccaccggctacaactggagcaccaccatgggccccctgccccccttcgccgtggcccagggcgcccagctgctgatcagacccgtggacaagcccatcaacaccaccctgatctgcaacgtgaccaacgccctgggcgccagacaggccgagctgaccgtgcaggtgaaggagggcccccccagcgagcacagcggcatcagcagaaacgccatcatcttcctggtgctgggcatcctggtgttcctgatcctgctgggcatcggcatctacttctactggagcaagtgcagcagagaggtgctgtggcactgccacctgtgccccagcagcgagcaccaccagagctgcagaaactag

SEQ ID NO: 93690 - DNA, 1254 bp, Artificial Sequence
  Description of Artificial Sequence: Synthetic coding sequence
atggccagagccatggccgccgcctggcccctgctgctggtggccctgctggtgctgagctggcccccccccggcaccggcgacgtggtggtgcaggcccccacccaggtgcccggcttcctgggcgacagcgtgaccctgccctgctacctgcaggtgcccaacatggaggtgacccacgtgagccagctgacctgggccagacacggcgagagcggcagcatggccgtgttccaccagacccagggccccagctacagcgagagcaagagactggagttcgtggccgccagactgggcgccgagctgagaaacgccagcctgagaatgttcggcctgagagtggaggacgagggcaactacacctgcctgttcgtgaccttcccccagggcagcagaagcgtggacatctggctgagagtgctggccaagccccagaacaccgccgaggtgcagaaggtgcagctgaccggcgagcccgtgcccatggccagatgcgtgagcaccggcggcagaccccccgcccagatcacctggcacagcgacctgggcggcatgcccaacaccagccaggtgcccggcttcctgagcggcaccgtgaccgtgaccagcctgtggatcctggtgcccagcagccaggtggacggcaagaacgtgacctgcaaggtggagcacgagagcttcgagaagccccagctgctgaccgtgaacctgaccgtgtactacccccccgaggtgagcatcagcggctacgacaacaactggtacctgggccagaacgaggccaccctgacctgcgacgccagaagcaaccccgagcccaccggctacaactggagcaccaccatgggccccctgccccccttcgccgtggcccagggcgcccagctgctgatcagacccgtggacaagcccatcaacaccaccctgatctgcaacgtgaccaacgccctgggcgccagacaggccgagctgaccgtgcaggtgaaggagggcccccccagcgagcacagcggcatcagcagaaacgccatcatcttcctggtgctgggcatcctggtgttcctgatcctgctgggcatcggcatctacttctactggagcaagtgcagcagagaggtgctgtggcactgccacctgtgccccagcagcaccgagcacgccagcgccagcgccaacggccacgtgagctacagcgccgtgagcagagagaacagcagcagccaggacccccagaccgagggcaccagatag

SEQ ID NO: 93691 - DNA, 1554 bp, Artificial Sequence
  Description of Artificial Sequence: Synthetic coding sequence
atggccagaatgggcctggccggcgccgccggcagatggtggggcctggccctgggcctgaccgccttcttcctgcccggcgtgcacagccaggtggtgcaggtgaacgacagcatgtacggcttcatcggcaccgacgtggtgctgcactgcagcttcgccaaccccctgcccagcgtgaagatcacccaggtgacctggcagaagagcaccaacggcagcaagcagaacgtggccatctacaaccccagcatgggcgtgagcgtgctggccccctacagagagagagtggagttcctgagacccagcttcaccgacggcaccatcagactgagcagactggagctggaggacgagggcgtgtacatctgcgagttcgccaccttccccaccggcaacagagagagccagctgaacctgaccgtgatggccaagcccaccaactggatcgagggcacccaggccgtgctgagagccaagaagggccaggacgacaaggtgctggtggccacctgcaccagcgccaacggcaagccccccagcgtggtgagctgggagaccagactgaagggcgaggccgagtaccaggagatcagaaaccccaacggcaccgtgaccgtgatcagcagatacagactggtgcccagcagagaggcccaccagcagagcctggcctgcatcgtgaactaccacatggacagattcaaggagagcctgaccctgaacgtgcagtacgagcccgaggtgaccatcgagggcttcgacggcaactggtacctgcagagaatggacgtgaagctgacctgcaaggccgacgccaacccccccgccaccgagtaccactggaccaccctgaacggcagcctgcccaagggcgtggaggcccagaacagaaccctgttcttcaagggccccatcaactacagcctggccggcacctacatctgcgaggccaccaaccccatcggcaccagaagcggccaggtggaggtgaacatcaccgagttcccctacacccccagcccccccgagcacggcagaagagccggccccgtgcccaccgccatcatcggcggcgtggccggcagcatcctgctggtgctgatcgtggtgggcggcatcgtggtggccctgagaagaagaagacacaccttcaagggcgactacagcaccaagaagcacgtgtacggcaacggctacagcaaggccggcatcccccagcaccacccccccatggcccagaacctgcagtaccccgacgacagcgacgacgagaagaaggccggccccctgggcggcagcagctacgaggaggaggaggaggaggaggagggcggcggcggcggcgagagaaaggtgggcggcccccaccccaagtacgacgaggacgccaagagaccctacttcaccgtggacgaggccgaggccagacaggacggctacggcgacagaaccctgggctaccagtacgaccccgagcagctggacctggccgagaacatggtgagccagaacgacggcagcttcatcagcaagaaggagtggtacgtgtag

SEQ ID NO: 93692 - DNA, 1059 bp, Artificial Sequence
  Description of Artificial Sequence: Synthetic coding sequence
atggccagaatgggcctggccggcgccgccggcagatggtggggcctggccctgggcctgaccgccttcttcctgcccggcgtgcacagccaggtggtgcaggtgaacgacagcatgtacggcttcatcggcaccgacgtggtgctgcactgcagcttcgccaaccccctgcccagcgtgaagatcacccaggtgacctggcagaagagcaccaacggcagcaagcagaacgtggccatctacaaccccagcatgggcgtgagcgtgctggccccctacagagagagagtggagttcctgagacccagcttcaccgacggcaccatcagactgagcagactggagctggaggacgagggcgtgtacatctgcgagttcgccaccttccccaccggcaacagagagagccagctgaacctgaccgtgatggccaagcccaccaactggatcgagggcacccaggccgtgctgagagccaagaagggccaggacgacaaggtgctggtggccacctgcaccagcgccaacggcaagccccccagcgtggtgagctgggagaccagactgaagggcgaggccgagtaccaggagatcagaaaccccaacggcaccgtgaccgtgatcagcagatacagactggtgcccagcagagaggcccaccagcagagcctggcctgcatcgtgaactaccacatggacagattcaaggagagcctgaccctgaacgtgcagtacgagcccgaggtgaccatcgagggcttcgacggcaactggtacctgcagagaatggacgtgaagctgacctgcaaggccgacgccaacccccccgccaccgagtaccactggaccaccctgaacggcagcctgcccaagggcgtggaggcccagaacagaaccctgttcttcaagggccccatcaactacagcctggccggcacctacatctgcgaggccaccaaccccatcggcaccagaagcggccaggtggaggtgaacatcaccgccttctgccagctgatctaccccggcaagggcagaaccagagccagaatgttctag

SEQ ID NO: 93693 - DNA, 1377 bp, Artificial Sequence
  Description of Artificial Sequence: Synthetic coding sequence
atggccagaatgggcctggccggcgccgccggcagatggtggggcctggccctgggcctgaccgccttcttcctgcccggcgtgcacagccaggtggtgcaggtgaacgacagcatgtacggcttcatcggcaccgacgtggtgctgcactgcagcttcgccaaccccctgcccagcgtgaagatcacccaggtgacctggcagaagagcaccaacggcagcaagcagaacgtggccatctacaaccccagcatgggcgtgagcgtgctggccccctacagagagagagtggagttcctgagacccagcttcaccgacggcaccatcagactgagcagactggagctggaggacgagggcgtgtacatctgcgagttcgccaccttccccaccggcaacagagagagccagctgaacctgaccgtgatggccaagcccaccaactggatcgagggcacccaggccgtgctgagagccaagaagggccaggacgacaaggtgctggtggccacctgcaccagcgccaacggcaagccccccagcgtggtgagctgggagaccagactgaagggcgaggccgagtaccaggagatcagaaaccccaacggcaccgtgaccgtgatcagcagatacagactggtgcccagcagagaggcccaccagcagagcctggcctgcatcgtgaactaccacatggacagattcaaggagagcctgaccctgaacgtgcagtacgagcccgaggtgaccatcgagggcttcgacggcaactggtacctgcagagaatggacgtgaagctgacctgcaaggccgacgccaacccccccgccaccgagtaccactggaccaccctgaacggcagcctgcccaagggcgtggaggcccagaacagaaccctgttcttcaagggccccatcaactacagcctggccggcacctacatctgcgaggccaccaaccccatcggcaccagaagcggccaggtggaggtgaacatcaccgagaagcccagaccccagagaggcctgggcagcgccgccagactgctggccggcaccgtggccgtgttcctgatcctggtggccgtgctgaccgtgttcttcctgtacaacagacagcagaagagcccccccgagaccgacggcgccggcaccgaccagcccctgagccagaagcccgagcccagccccagcagacagagcagcctggtgcccgaggacatccaggtggtgcacctggaccccggcagacagcagcagcaggaggaggaggacctgcagaagctgagcctgcagcccccctactacgacctgggcgtgagccccagctaccaccccagcgtgagaaccaccgagcccagaggcgagtgcccctag

SEQ ID NO: 93694 - DNA, 1617 bp, Artificial Sequence
  Description of Artificial Sequence: Synthetic coding sequence
atggccagagccgccgccctgctgcccagcagaagcccccccacccccctgctgtggcccctgctgctgctgctgctgctggagaccggcgcccaggacgtgagagtgcaggtgctgcccgaggtgagaggccagctgggcggcaccgtggagctgccctgccacctgctgccccccgtgcccggcctgtacatcagcctggtgacctggcagagacccgacgcccccgccaaccaccagaacgtggccgccttccaccccaagatgggccccagcttccccagccccaagcccggcagcgagagactgagcttcgtgagcgccaagcagagcaccggccaggacaccgaggccgagctgcaggacgccaccctggccctgcacggcctgaccgtggaggacgagggcaactacacctgcgagttcgccaccttccccaagggcagcgtgagaggcatgacctggctgagagtgatcgccaagcccaagaaccaggccgaggcccagaaggtgaccttcagccaggaccccaccaccgtggccctgtgcatcagcaaggagggcagaccccccgccagaatcagctggctgagcagcctggactgggaggccaaggagacccaggtgagcggcaccctggccggcaccgtgaccgtgaccagcagattcaccctggtgcccagcggcagagccgacggcgtgaccgtgacctgcaaggtggagcacgagagcttcgaggagcccgccctgatccccgtgaccctgagcgtgagatacccccccgaggtgagcatcagcggctacgacgacaactggtacctgggcagaaccgacgccaccctgagctgcgacgtgagaagcaaccccgagcccaccggctacgactggagcaccaccagcggcaccttccccaccagcgccgtggcccagggcagccagctggtgatccacgccgtggacagcctgttcaacaccaccttcgtgtgcaccgtgaccaacgccgtgggcatgggcagagccgagcaggtgatcttcgtgagagagacccccaacaccgccggcgccggcgccaccggcggcatcatcggcggcatcatcgccgccatcatcgccaccgccgtggccgccaccggcatcctgatctgcagacagcagagaaaggagcagaccctgcagggcgccgaggaggacgaggacctggagggcccccccagctacaagccccccacccccaaggccaagctggaggcccaggagatgcccagccagctgttcaccctgggcgccagcgagcacagccccctgaagaccccctacttcgacgccggcgccagctgcaccgagcaggagatgcccagataccacgagctgcccaccctggaggagagaagcggccccctgcaccccggcgccaccagcctgggcagccccatccccgtgccccccggcccccccgccgtggaggacgtgagcctggacctggaggacgaggagggcgaggaggaggaggagtacctggacaagatcaaccccatctacgacgccctgagctacagcagccccagcgacagctaccagggcaagggcttcgtgatgagcagagccatgtacgtgtag

SEQ ID NO: 93695 - DNA, 1440 bp, Artificial Sequence
  Description of Artificial Sequence: Synthetic coding sequence
atggccagagccgccgccctgctgcccagcagaagcccccccacccccctgctgtggcccctgctgctgctgctgctgctggagaccggcgcccaggacgtgagagtgcaggtgctgcccgaggtgagaggccagctgggcggcaccgtggagctgccctgccacctgctgccccccgtgcccggcctgtacatcagcctggtgacctggcagagacccgacgcccccgccaaccaccagaacgtggccgccttccaccccaagatgggccccagcttccccagccccaagcccggcagcgagagactgagcttcgtgagcgccaagcagagcaccggccaggacaccgaggccgagctgcaggacgccaccctggccctgcacggcctgaccgtggaggacgagggcaactacacctgcgagttcgccaccttccccaagggcagcgtgagaggcatgacctggctgagagtgatcgccaagcccaagaaccaggccgaggcccagaaggtgaccttcagccaggaccccaccaccgtggccctgtgcatcagcaaggagggcagaccccccgccagaatcagctggctgagcagcctggactgggaggccaaggagacccaggtgagcggcaccctggccggcaccgtgaccgtgaccagcagattcaccctggtgcccagcggcagagccgacggcgtgaccgtgacctgcaaggtggagcacgagagcttcgaggagcccgccctgatccccgtgaccctgagcgtgagatacccccccgaggtgagcatcagcggctacgacgacaactggtacctgggcagaaccgacgccaccctgagctgcgacgtgagaagcaaccccgagcccaccggctacgactggagcaccaccagcggcaccttccccaccagcgccgtggcccagggcagccagctggtgatccacgccgtggacagcctgttcaacaccaccttcgtgtgcaccgtgaccaacgccgtgggcatgggcagagccgagcaggtgatcttcgtgagagagacccccagagccagccccagagacgtgggccccctggtgtggggcgccgtgggcggcaccctgctggtgctgctgctgctggccggcggcagcctggccttcatcctgctgagagtgagaagaagaagaaagagccccggcggcgccggcggcggcgccagcggcgacggcggcttctacgaccccaaggcccaggtgctgggcaacggcgaccccgtgttctggacccccgtggtgcccggccccatggagcccgacggcaaggacgaggaggaggaggaggaggaggagaaggccgagaagggcctgatgctgccccccccccccgccctggaggacgacatggagagccagctggacggcagcctgatcagcagaagagccgtgtacgtgtag

SEQ ID NO: 93696 - DNA, 1101 bp, Artificial Sequence
  Description of Artificial Sequence: Synthetic coding sequence
atggccagaaccctgagacccagccccctgtgccccggcggcggcaaggcccagctgagcagcgccagcctgctgggcgccggcctgctgctgcagccccccacccccccccccctgctgctgctgctgttccccctgctgctgttcagcagactgtgcggcgccctggccggccccatcatcgtggagccccacgtgaccgccgtgtggggcaagaacgtgagcctgaagtgcctgatcgaggtgaacgagaccatcacccagatcagctgggagaagatccacggcaagagcagccagaccgtggccgtgcaccacccccagtacggcttcagcgtgcagggcgagtaccagggcagagtgctgttcaagaactacagcctgaacgacgccaccatcaccctgcacaacatcggcttcagcgacagcggcaagtacatctgcaaggccgtgaccttccccctgggcaacgcccagagcagcaccaccgtgaccgtgctggtggagcccaccgtgagcctgatcaagggccccgacagcctgatcgacggcggcaacgagaccgtggccgccatctgcatcgccgccaccggcaagcccgtggcccacatcgactgggagggcgacctgggcgagatggagagcaccaccaccagcttccccaacgagaccgccaccatcatcagccagtacaagctgttccccaccagattcgccagaggcagaagaatcacctgcgtggtgaagcaccccgccctggagaaggacatcagatacagcttcatcctggacatccagtacgcccccgaggtgagcgtgaccggctacgacggcaactggttcgtgggcagaaagggcgtgaacctgaagtgcaacgccgacgccaaccccccccccttcaagagcgtgtggagcagactggacggccagtggcccgacggcctgctggccagcgacaacaccctgcacttcgtgcaccccctgaccttcaactacagcggcgtgtacatctgcaaggtgaccaacagcctgggccagagaagcgaccagaaggtgatctacatcagcgcctacaacagcgtggccagcctgaactgctag

SEQ ID NO: 93697 - DNA, 1650 bp, Artificial Sequence
  Description of Artificial Sequence: Synthetic coding sequence
atggccagaaccctgagacccagccccctgtgccccggcggcggcaaggcccagctgagcagcgccagcctgctgggcgccggcctgctgctgcagccccccacccccccccccctgctgctgctgctgttccccctgctgctgttcagcagactgtgcggcgccctggccggccccatcatcgtggagccccacgtgaccgccgtgtggggcaagaacgtgagcctgaagtgcctgatcgaggtgaacgagaccatcacccagatcagctgggagaagatccacggcaagagcagccagaccgtggccgtgcaccacccccagtacggcttcagcgtgcagggcgagtaccagggcagagtgctgttcaagaactacagcctgaacgacgccaccatcaccctgcacaacatcggcttcagcgacagcggcaagtacatctgcaaggccgtgaccttccccctgggcaacgcccagagcagcaccaccgtgaccgtgctggtggagcccaccgtgagcctgatcaagggccccgacagcctgatcgacggcggcaacgagaccgtggccgccatctgcatcgccgccaccggcaagcccgtggcccacatcgactgggagggcgacctgggcgagatggagagcaccaccaccagcttccccaacgagaccgccaccatcatcagccagtacaagctgttccccaccagattcgccagaggcagaagaatcacctgcgtggtgaagcaccccgccctggagaaggacatcagatacagcttcatcctggacatccagtacgcccccgaggtgagcgtgaccggctacgacggcaactggttcgtgggcagaaagggcgtgaacctgaagtgcaacgccgacgccaaccccccccccttcaagagcgtgtggagcagactggacggccagtggcccgacggcctgctggccagcgacaacaccctgcacttcgtgcaccccctgaccttcaactacagcggcgtgtacatctgcaaggtgaccaacagcctgggccagagaagcgaccagaaggtgatctacatcagcgacccccccaccaccaccaccctgcagcccaccatccagtggcaccccagcaccgccgacatcgaggacctggccaccgagcccaagaagctgcccttccccctgagcaccctggccaccatcaaggacgacaccatcgccaccatcatcgccagcgtggtgggcggcgccctgttcatcgtgctggtgagcgtgctggccggcatcttctgctacagaagaagaagaaccttcagaggcgactacttcgccaagaactacatcccccccagcgacatgcagaaggagagccagatcgacgtgctgcagcaggacgagctggacagctaccccgacagcgtgaagaaggagaacaagaaccccgtgaacaacctgatcagaaaggactacctggaggagcccgagaagacccagtggaacaacgtggagaacctgaacagattcgagagacccatggactactacgaggacctgaagatgggcatgaagttcgtgagcgacgagcactacgacgagaacgaggacgacctggtgagccacgtggacggcagcgtgatcagcagaagagagtggtacgtgtag

SEQ ID NO: 93698 - DNA, 1464 bp, Artificial Sequence
  Description of Artificial Sequence: Synthetic coding sequence
atggccgagggctggagatggtgcttcgtgagaagaacccccggcctgctgagaggccccctgctgcccagaagcttcagcggcaaccccagagccctggccggccccatcatcgtggagccccacgtgaccgccgtgtggggcaagaacgtgagcctgaagtgcctgatcgaggtgaacgagaccatcacccagatcagctgggagaagatccacggcaagagcagccagaccgtggccgtgcaccacccccagtacggcttcagcgtgcagggcgagtaccagggcagagtgctgttcaagaactacagcctgaacgacgccaccatcaccctgcacaacatcggcttcagcgacagcggcaagtacatctgcaaggccgtgaccttccccctgggcaacgcccagagcagcaccaccgtgaccgtgctggtggagcccaccgtgagcctgatcaagggccccgacagcctgatcgacggcggcaacgagaccgtggccgccatctgcatcgccgccaccggcaagcccgtggcccacatcgactgggagggcgacctgggcgagatggagagcaccaccaccagcttccccaacgagaccgccaccatcatcagccagtacaagctgttccccaccagattcgccagaggcagaagaatcacctgcgtggtgaagcaccccgccctggagaaggacatcagatacagcttcatcctggacatccagtacgcccccgaggtgagcgtgaccggctacgacggcaactggttcgtgggcagaaagggcgtgaacctgaagtgcaacgccgacgccaaccccccccccttcaagagcgtgtggagcagactggacggccagtggcccgacggcctgctggccagcgacaacaccctgcacttcgtgcaccccctgaccttcaactacagcggcgtgtacatctgcaaggtgaccaacagcctgggccagagaagcgaccagaaggtgatctacatcagcgacgtgcccttcaagcagaccagcagcatcgccgtggccggcgccgtgatcggcgccgtgctggccctgttcatcatcgccatcttcgtgaccgtgctgctgacccccagaaagaagagacccagctacctggacaaggtgatcgacctgccccccacccacaagcccccccccctgtacgaggagagaagcccccccctgccccagaaggacctgttccagcccgagcacctgcccctgcagacccagttcaaggagagagaggtgggcaacctgcagcacagcaacggcctgaacagcagaagcttcgactacgaggacgagaaccccgtgggcgaggacggcatccagcagatgtaccccctgtacaaccagatgtgctaccaggacagaagccccggcaagcaccaccagaacaacgaccccaagagagtgtacatcgaccccagagagcactacgtgtag

SEQ ID NO: 93699 - DNA, 1533 bp, Artificial Sequence
  Description of Artificial Sequence: Synthetic coding sequence
atgcccctgagcctgggcgccgagatgtggggccccgaggcctggctgctgctgctgctgctgctggccagcttcaccggcagatgccccgccggcgagctggagaccagcgacgtggtgaccgtggtgctgggccaggacgccaagctgccctgcttctacagaggcgacagcggcgagcaggtgggccaggtggcctgggccagagtggacgccggcgagggcgcccaggagctggccctgctgcacagcaagtacggcctgcacgtgagccccgcctacgagggcagagtggagcagccccccccccccagaaaccccctggacggcagcgtgctgctgagaaacgccgtgcaggccgacgagggcgagtacgagtgcagagtgagcaccttccccgccggcagcttccaggccagactgagactgagagtgctggtgccccccctgcccagcctgaaccccggccccgccctggaggagggccagggcctgaccctggccgccagctgcaccgccgagggcagccccgcccccagcgtgacctgggacaccgaggtgaagggcaccaccagcagcagaagcttcaagcacagcagaagcgccgccgtgaccagcgagttccacctggtgcccagcagaagcatgaacggccagcccctgacctgcgtggtgagccaccccggcctgctgcaggaccagagaatcacccacatcctgcacgtgagcttcctggccgaggccagcgtgagaggcctggaggaccagaacctgtggcacatcggcagagagggcgccatgctgaagtgcctgagcgagggccagcccccccccagctacaactggaccagactggacggccccctgcccagcggcgtgagagtggacggcgacaccctgggcttcccccccctgaccaccgagcacagcggcatctacgtgtgccacgtgagcaacgagttcagcagcagagacagccaggtgaccgtggacgtgctggacccccaggaggacagcggcaagcaggtggacctggtgagcgccagcgtggtggtggtgggcgtgatcgccgccctgctgttctgcctgctggtggtggtggtggtgctgatgagcagataccacagaagaaaggcccagcagatgacccagaagtacgaggaggagctgaccctgaccagagagaacagcatcagaagactgcacagccaccacaccgaccccagaagccagcccgaggagagcgtgggcctgagagccgagggccaccccgacagcctgaaggacaacagcagctgcagcgtgatgagcgaggagcccgagggcagaagctacagcaccctgaccaccgtgagagagatcgagacccagaccgagctgctgagccccggcagcggcagagccgaggaggaggaggaccaggacgagggcatcaagcaggccatgaaccacttcgtgcaggagaacggcaccctgagagccaagcccaccggcaacggcatctacatcaacggcagaggccacctggtgtag

SEQ ID NO: 93700 - DNA, 660 bp, Artificial Sequence
  Description of Artificial Sequence: Synthetic coding sequence
atgctgaagtgcctgagcgagggccagcccccccccagctacaactggaccagactggacggccccctgcccagcggcgtgagagtggacggcgacaccctgggcttcccccccctgaccaccgagcacagcggcatctacgtgtgccacgtgagcaacgagttcagcagcagagacagccaggtgaccgtggacgtgctggacccccaggaggacagcggcaagcaggtggacctggtgagcgccagcgtggtggtggtgggcgtgatcgccgccctgctgttctgcctgctggtggtggtggtggtgctgatgagcagataccacagaagaaaggcccagcagatgacccagaagtacgaggaggagctgaccctgaccagagagaacagcatcagaagactgcacagccaccacaccgaccccagaagccagagcgaggagcccgagggcagaagctacagcaccctgaccaccgtgagagagatcgagacccagaccgagctgctgagccccggcagcggcagagccgaggaggaggaggaccaggacgagggcatcaagcaggccatgaaccacttcgtgcaggagaacggcaccctgagagccaagcccaccggcaacggcatctacatcaacggcagaggccacctggtgtag

SEQ ID NO: 93701 - DNA, 2058 bp, Artificial Sequence
  Description of Artificial Sequence: Synthetic coding sequence
atggagctgctgagaaccatcacctaccagcccgccgccagcaccaagatgtgcgagcaggccctgggcaagggctgcggcgccgacagcaagaagaagagacccccccagccccccgaggagagccagcccccccagagccaggcccaggtgccccccgccgccccccaccaccaccaccaccacagccacagcggccccgagatcagcagaatcatcgtggaccccaccaccggcaagagatactgcagaggcaaggtgctgggcaagggcggcttcgccaagtgctacgagatgaccgacctgaccaacaacaaggtgtacgccgccaagatcatcccccacagcagagtggccaagccccaccagagagagaagatcgacaaggagatcgagctgcacagaatcctgcaccacaagcacgtggtgcagttctaccactacttcgaggacaaggagaacatctacatcctgctggagtactgcagcagaagaagcatggcccacatcctgaaggccagaaaggtgctgaccgagcccgaggtgagatactacctgagacagatcgtgagcggcctgaagtacctgcacgagcaggagatcctgcacagagacctgaagctgggcaacttcttcatcaacgaggccatggagctgaaggtgggcgacttcggcctggccgccagactggagcccctggagcacagaagaagaaccatctgcggcacccccaactacctgagccccgaggtgctgaacaagcagggccacggctgcgagagcgacatctgggccctgggctgcgtgatgtacaccatgctgctgggcagaccccccttcgagaccaccaacctgaaggagacctacagatgcatcagagaggccagatacaccatgcccagcagcctgctggcccccgccaagcacctgatcgccagcatgctgagcaagaaccccgaggacagacccagcctggacgacatcatcagacacgacttcttcctgcagggcttcacccccgacagactgagcagcagctgctgccacaccgtgcccgacttccacctgagcagccccgccaagaacttcttcaagaaggccgccgccgccctgttcggcggcaagaaggacaaggccagatacatcgacacccacaacagagtgagcaaggaggacgaggacatctacaagctgagacacgacctgaagaagaccagcatcacccagcagcccagcaagcacagaaccgacgaggagctgcagccccccaccaccaccgtggccagaagcggcacccccgccgtggagaacaagcagcagatcggcgacgccatcagaatgatcgtgagaggcaccctgggcagctgcagcagcagcagcgagtgcctggaggacagcaccatgggcagcgtggccgacaccgtggccagagtgctgagaggctgcctggagaacatgcccgaggccgactgcatccccaaggagcagctgagcaccagcttccagtgggtgaccaagtgggtggactacagcaacaagtacggcttcggctaccagctgagcgaccacaccgtgggcgtgctgttcaacaacggcgcccacatgagcctgctgcccgacaagaagaccgtgcactactacgccgagctgggccagtgcagcgtgttccccgccaccgacgcccccgagcagttcatcagccaggtgaccgtgctgaagtacttcagccactacatggaggagaacctgatggacggcggcgacctgcccagcgtgaccgacatcagaagacccagactgtacctgctgcagtggctgaagagcgacaaggccctgatgatgctgttcaacgacggcaccttccaggtgaacttctaccacgaccacaccaagatcatcatctgcagccagaacgaggagtacctgctgacctacatcaacgaggacagaatcagcaccaccttcagactgaccaccctgctgatgagcggctgcagcagcgagctgaagaacagaatggagtacgccctgaacatgctgctgcagagatgcaactag

SEQ ID NO: 93702 - DNA, 1164 bp, Artificial Sequence
  Description of Artificial Sequence: Synthetic coding sequence
atggagctgctgagaaccatcacctaccagcccgccgccagcaccaagatgtgcgagcaggccctgggcaagggctgcggcgccgacagcaagaagaagagacccccccagccccccgaggagagccagcccccccagagccaggcccaggtgccccccgagatcagcagaatcatcgtggaccccaccaccggcaagagatactgcagaggcaaggtgctgggcaagggcggcttcgccaagtgctacgagatgaccgacctgaccaacaacaaggtgtacgccgccaagatcatcccccacagcagagtggccaagccccaccagagagagaagatcgacaaggagatcgagctgcacagaatcctgcaccacaagcacgtggtgcagttctaccactacttcgaggacaaggagaacatctacatcctgctggagtactgcagcagaagaagcatggcccacatcctgaaggccagaaaggtgctgaccgagcccgaggtgagatactacctgagacagatcgtgagcggcctgaagtacctgcacgagcaggagatcctgcacagagacctgaagctgggcaacttcttcatcaacgaggccatggagctgaaggtgggcgacttcggcctggccgccagactggagcccctggagcacagaagaagaaccatctgcggcacccccaactacctgagccccgaggtgctgaacaagcagggccacggctgcgagagcgacatctgggccctgggctgcgtgatgtacaccatgctgctgggcagaccccccttcgagaccaccaacctgaaggagacctacagatgcatcagagaggccagatacaccatgcccagcagcctgctggcccccgccaagcacctgatcgccagcatgctgagcaagaaccccgaggacagacccagcctggacgacatcatcagacacgacttcttctgcagagccagcctgagaaccgactgcctgctggccgtggtgatccagttccagatcagcacctaccaggcccagctgagaatcagcctgagaaagcagctgctgctgttcctggtggccaagaagaccaagcaggacatcctgacccacatcatcgagtgcctgaagaagatgaagaccagcaccagcctgggcatgatctag

SEQ ID NO: 93703 - DNA, 1140 bp, Artificial Sequence
  Description of Artificial Sequence: Synthetic coding sequence
atggagctgctgagaaccatcacctaccagcccgccgccagcaccaagatgtgcgagcaggccctgggcaagggctgcggcgccgacagcaagaagaagagacccccccagccccccgaggagagccagcccccccagagccaggcccaggtgccccccgccgccccccaccaccaccaccaccacagccacagcggccccgagatcagcagaatcatcgtggaccccaccaccggcaagagatactgcagaggcaaggtgctgggcaagggcggcttcgccaagtgctacgagatgaccgacctgaccaacaacaaggtgtacgccgccaagatcatcccccacagcagagtggccaagccccaccagagagagaagatcgacaaggagatcgagctgcacagaatcctgcaccacaagcacgtggtgcagttctaccactacttcgaggacaaggagaacatctacatcctgctggagtactgcagcagaagaagcatggcccacatcctgaaggccagaaaggtgctgaccgagcccgaggtgagatactacctgagacagatcgtgagcggcctgaagtacctgcacgagcaggagatcctgcacagagacctgaagctgggcaacttcttcatcaacgaggccatggagctgaaggtgggcgacttcggcctggccgccagactggagcccctggagcacagaagaagaaccatctgcggcacccccaactacctgagccccgaggtgctgaacaagcagggccacggctgcgagagcgacatctgggccctgggctgcgtgatgtacaccatgctgctgggcagaccccccttcgagaccaccaacctgaaggagacctacagatgcatcagagaggccagatacaccatgcccagcagcctgctggcccccgccaagcacctgatcgccagcatgctgagcaagaaccccgaggacagacccagcctggacgacatcatcagacacgacttcttcctgcagggcttcacccccgacagactgagcagcagctgctgccacaccgtgcccgacttccacctgagcagccccgccaagaacttcttcaagagagccgccgagcacatcatcagcgtgggccaccagatgggctag

SEQ ID NO: 93704 - DNA, 1476 bp, Artificial Sequence
  Description of Artificial Sequence: Synthetic coding sequence
gtggacctgctgagagccggcgaggtgcccaagcccttccccacccactacaaggacctgtgggacaacaagcacgtgaagatgccctgcagcgagcagaacctgtaccccgtggaggacgagaacggcgagagaaccgccggcagcagatgggagctgatccagaccgccctgctgaacaagttcaccagaccccagaacctgaaggacgccatcctgaagtacaacgtggcctacagcaagaagtgggacttcaccgccctgatcgacttctgggacaaggtgctggaggaggccgaggcccagcacctgtaccagagcatcctgcccgacatggtgaagatcgccctgtgcctgcccaacatctgcacccagcccatccccctgctgaagcagaagatgaaccacagcatcaccatgagccaggagcagatcgccagcctgctggccaacgccttcttctgcaccttccccagaagaaacgccaagatgaagagcgagtacagcagctaccccgacatcaacttcaacagactgttcgagggcagaagcagcagaaagcccgagaagctgaagaccctgttctgctacttcagaagagtgaccgagaagaagcccaccggcctggtgaccttcaccagacagagcctggaggacttccccgagtgggagagatgcgagaagcccctgaccagactgcacgtgacctacgagggcaccatcgaggagaacggccagggcatgctgcaggtggacttcgccaacagattcgtgggcggcggcgtgaccagcgccggcctggtgcaggaggagatcagattcctgatcaaccccgagctgatcatcagcagactgttcaccgaggtgctggaccacaacgagtgcctgatcatcaccggcaccgagcagtacagcgagtacaccggctacgccgagacctacagatggagcagaagccacgaggacggcagcgagagagacgactggcagagaagatgcaccgagatcgtggccatcgacgccctgcacttcagaagatacctggaccagttcgtgcccgagaagatgagaagagagctgaacaaggcctactgcggcttcctgagacccggcgtgagcagcgagaacctgagcgccgtggccaccggcaactggggctgcggcgccttcggcggcgacgccagactgaaggccctgatccagatcctggccgccgccgccgccgagagagacgtggtgtacttcaccttcggcgacagcgagctgatgagagacatctacagcatgcacatcttcctgaccgagagaaagctgaccgtgggcgacgtgtacaagctgctgctgagatactacaacgaggagtgcagaaactgcagcacccccggccccgacatcaagctgtaccccttcatctaccacgccgtggagagctgcgccgagaccgccgaccacagcggccagagaaccggcacctag

SEQ ID NO: 93705 - DNA, 579 bp, Artificial Sequence
  Description of Artificial Sequence: Synthetic coding sequence
tgaaccgagcagtacagcgagtacaccggctacgccgagacctacagatggagcagaagccacgaggacggcagcgagagagacgactggcagagaagatgcaccgagatcgtggccatcgacgccctgcacttcagaagatacctggaccagttcgtgcccgagaagatgagaagagagctgaacaaggcctactgcggcttcctgagacccggcgtgagcagcgagaacctgagcgccgtggccaccggcaactggggctgcggcgccttcggcggcgacgccagactgaaggccctgatccagatcctggccgccgccgccgccgagagagacgtggtgtacttcaccttcggcgacagcgagctgatgagagacatctacagcatgcacatcttcctgaccgagagaaagctgaccgtgggcgacgtgtacaagctgctgctgagatactacaacgaggagtgcagaaactgcagcacccccggccccgacatcaagctgtaccccttcatctaccacgccgtggagagctgcgccgagaccgccgaccacagcggccagagaaccggcacctag

SEQ ID NO: 93706 - DNA, 468 bp, Artificial Sequence
  Description of Artificial Sequence: Synthetic coding sequence
atggccgagagcagcgacaagctgtacagagtggagtacgccaagagcggcagagccagctgcaagaagtgcagcgagagcatccccaaggacagcctgagaatggccatcatggtgcagagccccatgttcgacggcaaggtgccccactggtaccacttcagctgcttctggaaggtgggccacagcatcagacaccccgacgtggaggtggacggcttcagcgagctgagatgggacgaccagcagaaggtgaagaagaccgccgaggccggcggcgtgaccggcgtgtacatcctgggccagcacggccacagcgcccccaccctgaagctgcccggcggccccagactgagagagcagagcaagcccccccccgcctgccccctgccccacgtgcagatcaagagaatggtgcccatgctgttccagcagcacctgctggacagcgccagcagcgtggcctag

SEQ ID NO: 93707 - DNA, 327 bp, Artificial Sequence
  Description of Artificial Sequence: Synthetic coding sequence
atggccgagagcagcgacaagctgtacagagtggagtacgccaagagcggcagagccagctgcaagaagtgcagcgagagcatccccaaggacagcctgagaatggccatcatggtgcagagccccatgttcgacggcaaggtgccccactggtaccacttcagctgcttctggaaggtgggccacagcatcagacaccccgacgtggaggtggacggcttcagcgagctgagatgggacgaccagcagaaggtgaagaagaccgccgaggccggcggcgtgaccgagccccccatcccctgcggcatcgaggtgatgggcagatag

SEQ ID NO: 93708 - DNA, 327 bp, Artificial Sequence; identical to SEQ ID NO: 93707
  Description of Artificial Sequence: Synthetic coding sequence

SEQ ID NO: 93709 - DNA, 3045 bp, Artificial Sequence
  Description of Artificial Sequence: Synthetic coding sequence
atggccgagagcagcgacaagctgtacagagtggagtacgccaagagcggcagagccagctgcaagaagtgcagcgagagcatccccaaggacagcctgagaatggccatcatggtgcagagccccatgttcgacggcaaggtgccccactggtaccacttcagctgcttctggaaggtgggccacagcatcagacaccccgacgtggaggtggacggcttcagcgagctgagatgggacgaccagcagaaggtgaagaagaccgccgaggccggcggcgtgaccggcaagggccaggacggcatcggcagcaaggccgagaagaccctgggcgacttcgccgccgagtacgccaagagcaacagaagcacctgcaagggctgcatggagaagatcgagaagggccaggtgagactgagcaagaagatggtggaccccgagaagccccagctgggcatgatcgacagatggtaccaccccggctgcttcgtgaagaacagagaggagctgggcttcagacccgagtacagcgccagccagctgaagggcttcagcctgctggccaccgaggacaaggaggccctgaagaagcagctgcccggcgtgaagagcgagggcaagagaaagggcgacgaggtggacggcgtggacgaggtggccaagaagaagagcaagaaggagaaggacaaggacagcaagctggagaaggccctgaaggcccagaacgacctgatctggaacatcaaggacgagctgaagaaggtgtgcagcaccaacgacctgaaggagctgctgatcttcaacaagcagcaggtgcccagcggcgagagcgccatcctggacagagtggccgacggcatggtgttcggcgccctgctgccctgcgaggagtgcagcggccagctggtgttcaagagcgacgcctactactgcaccggcgacgtgaccgcctggaccaagtgcatggtgaagacccagacccccaacagaaaggagtgggtgacccccaaggagttcagagagatcagctacctgaagaagctgaaggtgaagaagcaggacagaatcttcccccccgagaccagcgccagcgtggccgccacccccccccccagcaccgccagcgcccccgccgccgtgaacagcagcgccagcgccgacaagcccctgagcaacatgaagatcctgaccctgggcaagctgagcagaaacaaggacgaggtgaaggccatgatcgagaagctgggcggcaagctgaccggcaccgccaacaaggccagcctgtgcatcagcaccaagaaggaggtggagaagatgaacaagaagatggaggaggtgaaggaggccaacatcagagtggtgagcgaggacttcctgcaggacgtgagcgccagcaccaagagcctgcaggagctgttcctggcccacatcctgagcccctggggcgccgaggtgaaggccgagcccgtggaggtggtggcccccagaggcaagagcggcgccgccctgagcaagaagagcaagggccaggtgaaggaggagggcatcaacaagagcgagaagagaatgaagctgaccctgaagggcggcgccgccgtggaccccgacagcggcctggagcacagcgcccacgtgctggagaagggcggcaaggtgttcagcgccaccctgggcctggtggacatcgtgaagggcaccaacagctactacaagctgcagctgctggaggacgacaaggagaacagatactggatcttcagaagctggggcagagtgggcaccgtgatcggcagcaacaagctggagcagatgcccagcaaggaggacgccatcgagcacttcatgaagctgtacgaggagaagaccggcaacgcctggcacagcaagaacttcaccaagtaccccaagaagttctaccccctggagatcgactacggccaggacgaggaggccgtgaagaagctgaccgtgaaccccggcaccaagagcaagctgcccaagcccgtgcaggacctgatcaagatgatcttcgacgtggagagcatgaagaaggccatggtggagtacgagatcgacctgcagaagatgcccctgggcaagctgagcaagagacagatccaggccgcctacagcatcctgagcgaggtgcagcaggccgtgagccagggcagcagcgacagccagatcctggacctgagcaacagattctacaccctgatcccccacgacttcggcatgaagaagccccccctgctgaacaacgccgacagcgtgcaggccaaggtggagatgctggacaacctgctggacatcgaggtggcctacagcctgctgagaggcggcagcgacgacagcagcaaggaccccatcgacgtgaactacgagaagctgaagaccgacatcaaggtggtggacagagacagcgaggaggccgagatcatcagaaagtacgtgaagaacacccacgccaccacccacaacgcctacgacctggaggtgatcgacatcttcaagatcgagagagagggcgagtgccagagatacaagcccttcaagcagctgcacaacagaagactgctgtggcacggcagcagaaccaccaacttcgccggcatcctgagccagggcctgagaatcgccccccccgaggcccccgtgaccggctacatgttcggcaagggcatctacttcgccgacatggtgagcaagagcgccaactactgccacaccagccagggcgaccccatcggcctgatcctgctgggcgaggtggccctgggcaacatgtacgagctgaagcacgccagccacatcagcaagctgcccaagggcaagcacagcgtgaagggcctgggcaagaccacccccgaccccagcgccaacatcagcctggacggcgtggacgtgcccctgggcaccggcatcagcagcggcgtgaacgacaccagcctgctgtacaacgagtacatcgtgtacgacatcgcccaggtgaacctgaagtacctgctgaagctgaagttcaacttcaagaccagcctgtggtag

SEQ ID NO: 93710 - DNA, 753 bp, Artificial Sequence
  Description of Artificial Sequence: Synthetic coding sequence
atggccgagagcagcgacaagctgtacagagtggagtacgccaagagcggcagagccagctgcaagaagtgcagcgagagcatccccaaggacagcctgagaatggccatcatggtgcagagccccatgttcgacggcaaggtgccccactggtaccacttcagctgcttctggaaggtgggccacagcatcagacaccccgacgtggaggtggacggcttcagcgagctgagatgggacgaccagcagaaggtgaagaagaccgccgaggccggcggcgtgaccggcaagggccaggacggcatcggcagcaaggccgagaagaccctgggcgacttcgccgccgagtacgccaagagcaacagaagcacctgcaagggctgcatggagaagatcgagaagggccaggtgagactgagcaagaagatggtggaccccgagaagccccagctgggcatgatcgacagatggtaccaccccggctgcttcgtgaagaacagagaggagctgggcttcagacccgagtacagcgccagccagctgaagggcttcagcctgctggccaccgaggacaaggaggccctgaagaagcagctgcccggcgtgaagagcgagggcaagagaaagggcgacgaggtggacggcgtggacgaggtggccaagaagaagagcaagaaggagaaggacaagaagaagaagaagaagaagaagaaggagagaaagaagaagaagaagaagagaaagaagaagtag

SEQ ID NO: 93711 - DNA, 2133 bp, Artificial Sequence
  Description of Artificial Sequence: Synthetic coding sequence
atggacttcagcatggtggccggcgccgccgcctacaacgagaagagcgagaccggcgccctgggcgagaactacagctggcagatccccatcaaccacaacgacttcaagatcctgaagaacaacgagagacagctgtgcgaggtgctgcagaacaagttcggctgcatcagcaccctggtgagccccgtgcaggagggcaacagcaagagcctgcaggtgttcagaaagatgctgacccccagaatcgagctgagcgtgtggaaggacgacctgaccacccacgccgtggacgccgtggtgaacgccgccaacgaggacctgctgcacggcggcggcctggccctggccctggtgaaggccggcggcttcgagatccaggaggagagcaagcagttcgtggccagatacggcaaggtgagcgccggcgagatcgccgtgaccggcgccggcagactgccctgcaagcagatcatccacgccgtgggccccagatggatggagtgggacaagcagggctgcaccggcaagctgcagagagccatcgtgagcatcctgaactacgtgatctacaagaacacccacatcaagaccgtggccatccccgccctgagcagcggcatcttccagttccccctgaacctgtgcaccaagaccatcgtggagaccatcagagtgagcctgcagggcaagcccatgatgagcaacctgaaggagatccacctggtgagcaacgaggaccccaccgtggccgccttcaaggccgccagcgagttcatcctgggcaagagcgagctgggccaggagaccacccccagcttcaacgccatggtggtgaacaacctgaccctgcagatcgtgcagggccacatcgagtggcagaccgccgacgtgatcgtgaacagcgtgaacccccacgacatcaccgtgggccccgtggccaagagcatcctgcagcaggccggcgtggagatgaagagcgagttcctggccaccaaggccaagcagttccagagaagccagctggtgctggtgaccaagggcttcaacctgttctgcaagtacatctaccacgtgctgtggcacagcgagttccccaagccccagatcctgaagcacgccatgaaggagtgcctggagaagtgcatcgagcagaacatcaccagcatcagcttccccgccctgggcaccggcaacatggagatcaagaaggagaccgccgccgagatcctgttcgacgaggtgctgaccttcgccaaggaccacgtgaagcaccagctgaccgtgaagttcgtgatcttccccaccgacctggagatctacaaggccttcagcagcgagatggccaagagaagcaagatgctgagcctgaacaactacagcgtgccccagagcaccagagaggagaagagagagaacggcctggaggccagaagccccgccatcaacctgatgggcttcaacgtggaggagatgtacgaggcccacgcctggatccagagaatcctgagcctgcagaaccaccacatcatcgagaacaaccacatcctgtacctgggcagaaaggagcacgacatcctgagccagctgcagaagaccagcagcgtgagcatcaccgagatcatcagccccggcagaaccgagctggagatcgagggcgccagagccgacctgatcgaggtggtgatgaacatcgaggacatgctgtgcaaggtgcaggaggagatggccagaaagaaggagagaggcctgtggagaagcctgggccagtggaccatccagcagcagaagacccaggacgagatgaaggagaacatcatcttcctgaagtgccccgtgccccccacccaggagctgctggaccagaagaagcagttcgagaagtgcggcctgcaggtgctgaaggtggagaagatcgacaacgaggtgctgatggccgccttccagagaaagaagaagatgatggaggagaagctgcacagacagcccgtgagccacagactgttccagcaggtgccctaccagttctgcaacgtggtgtgcagagtgggcttccagagaatgtacagcaccccctgcggcagatgccagtgcctgatcatcggcgccaccctgtggaacctggtgagctag

SEQ ID NO: 93712 - DNA, 2460 bp, Artificial Sequence
  Description of Artificial Sequence: Synthetic coding sequence
atggacttcagcatggtggccggcgccgccgcctacaacgagaagagcgagaccggcgccctgggcgagaactacagctggcagatccccatcaaccacaacgacttcaagatcctgaagaacaacgagagacagctgtgcgaggtgctgcagaacaagttcggctgcatcagcaccctggtgagccccgtgcaggagggcaacagcaagagcctgcaggtgttcagaaagatgctgacccccagaatcgagctgagcgtgtggaaggacgacctgaccacccacgccgtggacgccgtggtgaacgccgccaacgaggacctgctgcacggcggcggcctggccctggccctggtgaaggccggcggcttcgagatccaggaggagagcaagcagttcgtggccagatacggcaaggtgagcgccggcgagatcgccgtgaccggcgccggcagactgccctgcaagcagatcatccacgccgtgggccccagatggatggagtgggacaagcagggctgcaccggcaagctgcagagagccatcgtgagcatcctgaactacgtgatctacaagaacacccacatcaagaccgtggccatccccgccctgagcagcggcatcttccagttccccctgaacctgtgcaccaagaccatcgtggagaccatcagagtgagcctgcagggcaagcccatgatgagcaacctgaaggagatccacctggtgagcaacgaggaccccaccgtggccgccttcaaggccgccagcgagttcatcctgggcaagagcgagctgggccaggagaccacccccagcttcaacgccatggtggtgaacaacctgaccctgcagatcgtgcagggccacatcgagtggcagaccgccgacgtgatcgtgaacagcgtgaacccccacgacatcaccgtgggccccgtggccaagagcatcctgcagcaggccggcgtggagatgaagagcgagttcctggccaccaaggccaagcagttccagagaagccagctggtgctggtgaccaagggcttcaacctgttctgcaagtacatctaccacgtgctgtggcacagcgagttccccaagccccagatcctgaagcacgccatgaaggagtgcctggagaagtgcatcgagcagaacatcaccagcatcagcttccccgccctgggcaccggcaacatggagatcaagaaggagaccgccgccgagatcctgttcgacgaggtgctgaccttcgccaaggaccacgtgaagcaccagctgaccgtgaagttcgtgatcttccccaccgacctggagatctacaaggccttcagcagcgagatggccaagagaagcaagatgctgagcctgaacaactacagcgtgccccagagcaccagagaggagaagagagagaacggcctggaggccagaagccccgccatcaacctgatgggcttcaacgtggaggagatgtacgaggcccacgcctggatccagagaatcctgagcctgcagaaccaccacatcatcgagaacaaccacatcctgtacctgggcagaaaggagcacgacatcctgagccagctgcagaagaccagcagcgtgagcatcaccgagatcatcagccccggcagaaccgagctggagatcgagggcgccagagccgacctgatcgaggtggtgatgaacatcgaggacatgctgtgcaaggtgcaggaggagatggccagaaagaaggagagaggcctgtggagaagcctgggccagtggaccatccagcagcagaagacccaggacgagatgaaggagaacatcatcttcctgaagtgccccgtgccccccacccaggagctgctggaccagaagaagcagttcgagaagtgcggcctgcaggtgctgaaggtggagaagatcgacaacgaggtgctgatggccgccttccagagaaagaagaagatgatggaggagaagctgcacagacagcccgtgagccacagactgttccagcaggtgccctaccagttctgcaacgtggtgtgcagagtgggcttccagagaatgtacagcaccccctgcgaccccaagtacggcgccggcatctacttcaccaagaacctgaagaacctggccgagaaggccaagaagatcagcgccgccgacaagctgatctacgtgttcgaggccgaggtgctgaccggcttcttctgccagggccaccccctgaacatcgtgcccccccccctgagccccggcgccatcgacggccacgacagcgtggtggacaacgtgagcagccccgagaccttcgtgatcttcagcggcatgcaggccatcccccagtacctgtggacctgcacccaggagtacgtgcagagccaggactacagcagcggccccatgagacccttcgcccagcacccctggagaggcttcgccagcggcagccccgtggactag

SEQ ID NO: 93713 - DNA, 2106 bp, Artificial Sequence
  Description of Artificial Sequence: Synthetic coding sequence
atggcccaggccggcgtggtgggcgaggtgacccaggtgctgtgcgccgccggcggcgccctggagctgcccgagctgagaagaagactgagaatgggcctgagcgccgacgccctggagagactgctgagacagagaggcagattcgtggtggccgtgagagccggcggcgccgccgccgcccccgagagagtggtgctggccgccagccccctgagactgtgcagagcccaccagggcagcaagcccggctgcgtgggcctgtgcgcccagctgcacctgtgcagattcatggtgtacggcgcctgcaagttcctgagagccggcaagaactgcagaaacagccacagcctgaccaccgagcacaacctgagcgtgctgagaacccacggcgtggaccacctgagctacaacgagctgtgccagctgctgttccagaacgacccctggctgctgcccgagatctgccagcactacaacaagggcgacggcccccacggcagctgcgccttccagaagcagtgcatcaagctgcacatctgccagtacttcctgcagggcgagtgcaagttcggcaccagctgcaagagaagccacgacttcagcaacagcgagaacctggagaagctggagaagctgggcatgagcagcgacctggtgagcagactgcccaccatctacagaaacgcccacgacatcaagaacaagagcagcgcccccagcagagtgccccccctgttcgtgccccagggcaccagcgagagaaaggacagcagcggcagcgtgagccccaacaccctgagccaggaggagggcgaccagatctgcctgtaccacatcagaaagagctgcagcttccaggacaagtgccacagagtgcacttccacctgccctacagatggcagttcctggacagaggcaagtgggaggacctggacaacatggagctgatcgaggaggcctactgcaaccccaagatcgagagaatcctgtgcagcgagagcgccagcaccttccacagccactgcctgaacttcaacgccatgacctacggcgccacccaggccagaagactgagcaccgccagcagcgtgaccaagcccccccacttcatcctgaccaccgactggatctggtactggagcgacgagttcggcagctggcaggagtacggcagacagggcaccgtgcaccccgtgaccaccgtgagcagcagcgacgtggagaaggcctacctggcctactgcacccccggcagcgacggccaggccgccaccctgaagttccaggccggcaagcacaactacgagctggacttcaaggccttcgtgcagaagaacctggtgtacggcaccaccaagaaggtgtgcagaagacccaagtacgtgagcccccaggacgtgaccaccatgcagacctgcaacaccaagttccccggccccaagagcatccccgactactgggacagcagcgccctgcccgaccccggcttccagaagatcaccctgagcagcagcagcgaggagtaccagaaggtgtggaacctgttcaacagaaccctgcccttctacttcgtgcagaagatcgagagagtgcagaacctggccctgtgggaggtgtaccagtggcagaagggccagatgcagaagcagaacggcggcaaggccgtggacgagagacagctgttccacggcaccagcgccatcttcgtggacgccatctgccagcagaacttcgactggagagtgtgcggcgtgcacggcaccagctacggcaagggcagctacttcgccagagacgccgcctacagccaccactacagcaagagcgacacccagacccacaccatgttcctggccagagtgctggtgggcgagttcgtgagaggcaacgccagcttcgtgagaccccccgccaaggagggctggagcaacgccttctacgacagctgcgtgaacagcgtgagcgaccccagcatcttcgtgatcttcgagaagcaccaggtgtaccccgagtacgtgatccagtacaccaccagcagcaagcccagcgtgacccccagcatcctgctggccctgggcagcctgttcagcagcagacagtag

SEQ ID NO: 93714 - DNA, 393 bp, Artificial Sequence
  Description of Artificial Sequence: Synthetic coding sequence
atgttcctggccagagtgctggtgggcgagttcgtgagaggcaacgccagcttcgtgagaccccccgccaaggagggctggagcaacgccttctacgacagctgcgtgaacagcgtgagcgaccccagcatcttcgtgatcttcgagaagaccagaagcacccagagcatgagcagcagcaccccccccccccccagccccagaagccacccccccagctgctggccctgggccccctgcagcgccgccgacagcgagagaaccggcgtgttccaggccttccacctgctgtgcctggagatggccatctgggccttccccttcctgttcaagcagaagctgctgatgaactgcagcctgaacatcgacctgagcatgaagctgtgcagctag

SEQ ID NO: 93715 - DNA, 849 bp, Artificial Sequence
  Description of Artificial Sequence: Synthetic coding sequence
atgagcaagctggccagcttcctgggcttcagcaagcagagcccccagaagaagaaccacctggtgctggagaagaagaccgagagcgccaccttcagagtgtgcggcgagaacgtgacctgcgtggagtacgccatcagctggctgcaggacctgatcgagaaggagcagtgcccctacaccagcgaggacgagtgcatcaaggacttcgacgagaaggagtaccaggagctgaacgagctgcagaagaagctgaacatcaacatcagcctggaccacaagagacccctgatcaaggtgctgggcatcagcagagacgtgatgcaggccagagacgagatcgaggccatgatcaagagagtgagactggccaaggagcaggagagcagagccgactgcatcagcgagttcatcgagtggcagtacaacgacaacaacaccagccactgcttcaacaagatgaccaacctgaagctggaggacgccagaagagagaagaagaagaccgtggacgtgaagatcaaccacagacactacaccgtgaacctgaacacctacaccgccaccgacaccaagggccacagcctgagcgtgcagagactgaccaagagcaaggtggacatccccgcccactggagcgacatgaagcagcagaacttctgcgtggtggagctgctgcccagcgaccccgagtacaacaccgtggccagcaagttcaaccagacctgcagccacttcagaatcgagaaggtgaacgtgatgatcagagcctgcagccccagctactgggaggccgaggtggagggcctgcacgagcccagaagcctgacccccgtgtgggtgacctag

SEQ ID NO: 93716 - DNA, 2394 bp, Artificial Sequence
  Description of Artificial Sequence: Synthetic coding sequence
atgtacctgagaagactgctgagacccctgcagatgctgctggtgaaggagggcgtgcagaacgccaagaccgacgtggtggtgaacagcgtgcccctggacctggtgctgagcagaggccccctgagcaagagcctgctggagaaggccggccccgagctgcaggaggagctggacaccgtgggccagggcgtggccgtgagcatgggcaccgtgctgaagaccagcagctggaacctggactgcagatacgtgctgcacgtggtggcccccgagtggagaaacggcagcaccagcagcctgaagatcatggaggacatcatcagagagtgcatggagatcaccgagagcctgagcctgaagagcatcgccttccccgccatcggcaccggcaacctgggcttccccaagaacatcttcgccgagctgatcatcagcgaggtgttcaagttcagcagcaagaaccagctgaagaccctgcaggaggtgcacttcctgctgcaccccagcgaccacgagaacatccaggccttcagcgacgagttcgccagaagagccaacggcaacctggtgagcgacaagatccccaaggccaaggacacccagggcttctacggcaccgtgagcagccccgacagcggcgtgtacgagatgaagatcggcagcatcatcttccaggtggccagcggcgacatcaccaaggaggaggccgacgtgatcgtgaacagcaccagcaacagcttcaacctgaaggccggcgtgagcaaggccatcctggagtgcgccggccagaacgtggagagagagtgcagccagcaggcccagcagagaaagaacgactacatcatcaccggcggcggcttcctgagatgcaagaacatcatccacgtgatcggcggcaacgacgtgaagagcagcgtgagcagcgtgctgcaggagtgcgagaagaagaactacagcagcatctgcctgcccgccatcggcaccggcaacgccaagcagcaccccgacaaggtggccgaggccatcatcgacgccatcgaggacttcgtgcagaagggcagcgcccagagcgtgaagaaggtgaaggtggtgatcttcctgccccaggtgctggacgtgttctacgccaacatgaagaagagagagggcacccagctgagcagccagcagagcgtgatgagcaagctggccagcttcctgggcttcagcaagcagagcccccagaagaagaaccacctggtgctggagaagaagaccgagagcgccaccttcagagtgtgcggcgagaacgtgacctgcgtggagtacgccatcagctggctgcaggacctgatcgagaaggagcagtgcccctacaccagcgaggacgagtgcatcaaggacttcgacgagaaggagtaccaggagctgaacgagctgcagaagaagctgaacatcaacatcagcctggaccacaagagacccctgatcaaggtgctgggcatcagcagagacgtgatgcaggccagagacgagatcgaggccatgatcaagagagtgagactggccaaggagcaggagagcagagccgactgcatcagcgagttcatcgagtggcagtacaacgacaacaacaccagccactgcttcaacaagatgaccaacctgaagctggaggacgccagaagagagaagaagaagaccgtggacgtgaagatcaaccacagacactacaccgtgaacctgaacacctacaccgccaccgacaccaagggccacagcctgagcgtgcagagactgaccaagagcaaggtggacatccccgcccactggagcgacatgaagcagcagaacttctgcgtggtggagctgctgcccagcgaccccgagtacaacaccgtggccagcaagttcaaccagacctgcagccacttcagaatcgagaagatcgagagaatccagaaccccgacctgtggaacagctaccaggccaagaagaagaccatggacgccaagaacggccagaccatgaacgagaagcagctgttccacggcaccgacgccggcagcgtgccccacgtgaacagaaacggcttcaacagaagctacgccggcaagaacgccgtggcctacggcaagggcacctacttcgccgtgaacgccaactacagcgccaacgacacctacagcagacccgacgccaacggcagaaagcacgtgtactacgtgagagtgctgaccggcatctacacccacggcaaccacagcctgatcgtgccccccagcaagaacccccagaaccccaccgacctgtacgacaccgtgaccgacaacgtgcaccaccccagcctgttcgtggccttctacgactaccaggcctaccccgagtacctgatcaccttcagaaagtag

SEQ ID NO: 93717 - DNA, 5163 bp, Artificial Sequence
  Description of Artificial Sequence: Synthetic coding sequence
atggccgtgcccggcagcttccccctgctggtggagggcagctggggccccgacccccccaagaacctgaacaccaagctgcagatgtacttccagagccccaagagaagcggcggcggcgagtgcgaggtgagacaggaccccagaagccccagcagattcctggtgttcttctaccccgaggacgtgagacagaaggtgctggagagaaagaaccacgagctggtgtggcagggcaagggcaccttcaagctgaccgtgcagctgcccgccacccccgacgagatcgaccacgtgttcgaggaggagctgctgaccaaggagagcaagaccaaggaggacgtgaaggagcccgacaccatcagattcgtggacgactgcaccaagcaccacagcatcaagcagctgcagctgagccccagactgctggaggtgaccaacaccatcagagtggagaacctgccccccggcgccgacgactacagcctgaagctgttcttcgagaacccctacaacggcggcggcagagtggccaacgtggagtacttccccgaggagagcagcgccctgatcgagttcttcgacagaaaggtgctggacaccatcatggccaccaagctggacttcaacaagatgcccctgagcgtgttcccctactacgccagcctgggcaccgccctgtacggcaaggagaagcccctgatcaagctgcccgcccccttcgaggagagcctggacctgcccctgtggaagttcctgcagaagaagaaccacctgatcgaggagatcaacgacgagatgagaagatgccactgcgagctgacctggagccagctgagcggcaaggtgaccatcagacccgccgccaccctggtgaacgagggcagacccagaatcaagacctggcaggccgacaccagcaccaccctgagcagcatcagaagcaagtacaaggtgaaccccatcaaggtggaccccaccatgtgggacaccatcaagaacgacgtgaaggacgacagaatcctgatcgagttcgacaccctgaaggagatggtgatcctggccggcaagagcgaggacgtgcagagcatcgaggtgcaggtgagagagctgatcgagagcaccacccagaagatcaagagagaggagcagagcctgaaggagaagatgatcatcagccccggcagatacttcctgctgtgccacagcagcctgctggaccacctgctgaccgagtgccccgagatcgagatctgctacgacagagtgacccagcacctgtgcctgaagggccccagcgccgacgtgtacaaggccaagtgcgagatccaggagaaggtgtacaccatggcccagaagaacatccaggtgagccccgagatcttccagttcctgcagcaggtgaactggaaggagttcagcaagtgcctgttcatcgcccagaagatcctggccctgtacgagctggagggcaccaccgtgctgctgaccagctgcagcagcgaggccctgctggaggccgagaagcagatgctgagcgccctgaactacaagagaatcgaggtggagaacaaggaggtgctgcacggcaagaagtggaagggcctgacccacaacctgctgaagaagcagaacagcagccccaacaccgtgatcatcaacgagctgaccagcgagaccaccgccgaggtgatcatcaccggctgcgtgaaggaggtgaacgagacctacaagctgctgttcaacttcgtggagcagaacatgaagatcgagagactggtggaggtgaagcccagcctggtgatcgactacctgaagaccgagaagaagctgttctggcccaagatcaagaaggtgaacgtgcaggtgagcttcaaccccgagaacaagcagaagggcatcctgctgaccggcagcaagaccgaggtgctgaaggccgtggacatcgtgaagcaggtgtgggacagcgtgtgcgtgaagagcgtgcacaccgacaagcccggcgccaagcagttcttccaggacaaggccagattctaccagagcgagatcaagagactgttcggctgctacatcgagctgcaggagaacgaggtgatgaaggagggcggcagccccgccggccagaagtgcttcagcagaaccgtgctggcccccggcgtggtgctgatcgtgcagcagggcgacctggccagactgcccgtggacgtggtggtgaacgccagcaacgaggacctgaagcactacggcggcctggccgccgccctgagcaaggccgccggccccgagctgcaggccgactgcgaccagatcgtgaagagagagggcagactgctgcccggcaacgccaccatcagcaaggccggcaagctgccctaccaccacgtgatccacgccgtgggccccagatggagcggctacgaggcccccagatgcgtgtacctgctgagaagagccgtgcagctgagcctgtgcctggccgagaagtacaagtacagaagcatcgccatccccgccatcagcagcggcgtgttcggcttccccctgggcagatgcgtggagaccatcgtgagcgccatcaaggagaacttccagttcaagaaggacggccactgcctgaaggagatctacctggtggacgtgagcgagaagaccgtggaggccttcgccgaggccgtgaagaccgtgttcaaggccaccctgcccgacaccgccgccccccccggcctgccccccgccgccgccggccccggcaagaccagctgggagaagggcagcctggtgagccccggcggcctgcagatgctgctggtgaaggagggcgtgcagaacgccaagaccgacgtggtggtgaacagcgtgcccctggacctggtgctgagcagaggccccctgagcaagagcctgctggagaaggccggccccgagctgcaggaggagctggacaccgtgggccagggcgtggccgtgagcatgggcaccgtgctgaagaccagcagctggaacctggactgcagatacgtgctgcacgtggtggcccccgagtggagaaacggcagcaccagcagcctgaagatcatggaggacatcatcagagagtgcatggagatcaccgagagcctgagcctgaagagcatcgccttccccgccatcggcaccggcaacctgggcttccccaagaacatcttcgccgagctgatcatcagcgaggtgttcaagttcagcagcaagaaccagctgaagaccctgcaggaggtgcacttcctgctgcaccccagcgaccacgagaacatccaggccttcagcgacgagttcgccagaagagccaacggcaacctggtgagcgacaagatccccaaggccaaggacacccagggcttctacggcaccgtgagcagccccgacagcggcgtgtacgagatgaagatcggcagcatcatcttccaggtggccagcggcgacatcaccaaggaggaggccgacgtgatcgtgaacagcaccagcaacagcttcaacctgaaggtgggcgtgagcaaggccatcctggagtgcgccggccagaacgtggagagagagtgcagccagcaggcccagcagagaaagaacgactacatcatcaccggcggcggcttcctgagatgcaagaacatcatccacgtgatcggcggcaacgacgtgaagagcagcgtgagcagcgtgctgcaggagtgcgagaagaagaactacagcagcatctgcctgcccgccatcggcaccggcaacgccaagcagcaccccgacaaggtggccgaggccatcatcgacgccatcgaggacttcgtgcagaagggcagcgcccagagcgtgaagaaggtgaaggtggtgatcttcctgccccaggtgctggacgtgttctacgccaacatgaagaagagagagggcacccagctgagcagccagcagagcgtgatgagcaagctggccagcttcctgggcttcagcaagcagagcccccagaagaagaaccacctggtgctggagaagaagaccgagagcgccaccttcagagtgtgcggcgagaacgtgacctgcgtggagtacgccatcagctggctgcaggacctgatcgagaaggagcagtgcccctacaccagcgaggacgagtgcatcaaggacttcgacgagaaggagtaccaggagctgaacgagctgcagaagaagctgaacatcaacatcagcctggaccacaagagacccctgatcaaggtgctgggcatcagcagagacgtgatgcaggccagagacgagatcgaggccatgatcaagagagtgagactggccaaggagcaggagagcagagccgactgcatcagcgagttcatcgagtggcagtacaacgacaacaacaccagccactgcttcaacaagatgaccaacctgaagctggaggacgccagaagagagaagaagaagaccgtggacgtgaagatcaaccacagacactacaccgtgaacctgaacacctacaccgccaccgacaccaagggccacagcctgagcgtgcagagactgaccaagagcaaggtggacatccccgcccactggagcgacatgaagcagcagaacttctgcgtggtggagctgctgcccagcgaccccgagtacaacaccgtggccagcaagttcaaccagacctgcagccacttcagaatcgagaagatcgagagaatccagaaccccgacctgtggaacagctaccaggccaagaagaagaccatggacgccaagaacggccagaccatgaacgagaagcagctgttccacggcaccgacgccggcagcgtgccccacgtgaacagaaacggcttcaacagaagctacgccggcaagaacgccgtggcctacggcaagggcacctacttcgccgtgaacgccaactacagcgccaacgacacctacagcagacccgacgccaacggcagaaagcacgtgtactacgtgagagtgctgaccggcatctacacccacggcaaccacagcctgatcgtgccccccagcaagaacccccagaaccccaccgacctgtacgacaccgtgaccgacaacgtgcaccaccccagcctgttcgtggccttctacgactaccaggcctaccccgagtacctgatcaccttcagaaagtag

SEQ ID NO: 93718 - DNA, 5406 bp, Artificial Sequence
  Description of Artificial Sequence: Synthetic coding sequence
atggccgtgcccggcagcttccccctgctggtggagggcagctggggccccgacccccccaagaacctgaacaccaagctgcagatgtacttccagagccccaagagaagcggcggcggcgagtgcgaggtgagacaggaccccagaagccccagcagattcctggtgttcttctaccccgaggacgtgagacagaaggtgctggagagaaagaaccacgagctggtgtggcagggcaagggcaccttcaagctgaccgtgcagctgcccgccacccccgacgagatcgaccacgtgttcgaggaggagctgctgaccaaggagagcaagaccaaggaggacgtgaaggagcccgacgtgagcgaggagctggacaccaagctgcccctggacggcggcctggacaagatggaggacatccccgaggagtgcgagaacatcagcagcctggtggccttcgagaacctgaaggccaacgtgaccgacatcatgctgatcctgctggtggagaacatcagcggcctgagcaacgacgacttccaggtggagatcatcagagacttcgacgtggccgtggtgaccttccagaagcacatcgacaccatcagattcgtggacgactgcaccaagcaccacagcatcaagcagctgcagctgagccccagactgctggaggtgaccaacaccatcagagtggagaacctgccccccggcgccgacgactacagcctgaagctgttcttcgagaacccctacaacggcggcggcagagtggccaacgtggagtacttccccgaggagagcagcgccctgatcgagttcttcgacagaaaggtgctggacaccatcatggccaccaagctggacttcaacaagatgcccctgagcgtgttcccctactacgccagcctgggcaccgccctgtacggcaaggagaagcccctgatcaagctgcccgcccccttcgaggagagcctggacctgcccctgtggaagttcctgcagaagaagaaccacctgatcgaggagatcaacgacgagatgagaagatgccactgcgagctgacctggagccagctgagcggcaaggtgaccatcagacccgccgccaccctggtgaacgagggcagacccagaatcaagacctggcaggccgacaccagcaccaccctgagcagcatcagaagcaagtacaaggtgaaccccatcaaggtggaccccaccatgtgggacaccatcaagaacgacgtgaaggacgacagaatcctgatcgagttcgacaccctgaaggagatggtgatcctggccggcaagagcgaggacgtgcagagcatcgaggtgcaggtgagagagctgatcgagagcaccacccagaagatcaagagagaggagcagagcctgaaggagaagatgatcatcagccccggcagatacttcctgctgtgccacagcagcctgctggaccacctgctgaccgagtgccccgagatcgagatctgctacgacagagtgacccagcacctgtgcctgaagggccccagcgccgacgtgtacaaggccaagtgcgagatccaggagaaggtgtacaccatggcccagaagaacatccaggtgagccccgagatcttccagttcctgcagcaggtgaactggaaggagttcagcaagtgcctgttcatcgcccagaagatcctggccctgtacgagctggagggcaccaccgtgctgctgaccagctgcagcagcgaggccctgctggaggccgagaagcagatgctgagcgccctgaactacaagagaatcgaggtggagaacaaggaggtgctgcacggcaagaagtggaagggcctgacccacaacctgctgaagaagcagaacagcagccccaacaccgtgatcatcaacgagctgaccagcgagaccaccgccgaggtgatcatcaccggctgcgtgaaggaggtgaacgagacctacaagctgctgttcaacttcgtggagcagaacatgaagatcgagagactggtggaggtgaagcccagcctggtgatcgactacctgaagaccgagaagaagctgttctggcccaagatcaagaaggtgaacgtgcaggtgagcttcaaccccgagaacaagcagaagggcatcctgctgaccggcagcaagaccgaggtgctgaaggccgtggacatcgtgaagcaggtgtgggacagcgtgtgcgtgaagagcgtgcacaccgacaagcccggcgccaagcagttcttccaggacaaggccagattctaccagagcgagatcaagagactgttcggctgctacatcgagctgcaggagaacgaggtgatgaaggagggcggcagccccgccggccagaagtgcttcagcagaaccgtgctggcccccggcgtggtgctgatcgtgcagcagggcgacctggccagactgcccgtggacgtggtggtgaacgccagcaacgaggacctgaagcactacggcggcctggccgccgccctgagcaaggccgccggccccgagctgcaggccgactgcgaccagatcgtgaagagagagggcagactgctgcccggcaacgccaccatcagcaaggccggcaagctgccctaccaccacgtgatccacgccgtgggccccagatggagcggctacgaggcccccagatgcgtgtacctgctgagaagagccgtgcagctgagcctgtgcctggccgagaagtacaagtacagaagcatcgccatccccgccatcagcagcggcgtgttcggcttccccctgggcagatgcgtggagaccatcgtgagcgccatcaaggagaacttccagttcaagaaggacggccactgcctgaaggagatctacctggtggacgtgagcgagaagaccgtggaggccttcgccgaggccgtgaagaccgtgttcaaggccaccctgcccgacaccgccgccccccccggcctgccccccgccgccgccggccccggcaagaccagctgggagaagggcagcctggtgagccccggcggcctgcagatgctgctggtgaaggagggcgtgcagaacgccaagaccgacgtggtggtgaacagcgtgcccctggacctggtgctgagcagaggccccctgagcaagagcctgctggagaaggccggccccgagctgcaggaggagctggacaccgtgggccagggcgtggccgtgagcatgggcaccgtgctgaagaccagcagctggaacctggactgcagatacgtgctgcacgtggtggcccccgagtggagaaacggcagcaccagcagcctgaagatcatggaggacatcatcagagagtgcatggagatcaccgagagcctgagcctgaagagcatcgccttccccgccatcggcaccggcaacctgggcttccccaagaacatcttcgccgagctgatcatcagcgaggtgttcaagttcagcagcaagaaccagctgaagaccctgcaggaggtgcacttcctgctgcaccccagcgaccacgagaacatccaggccttcagcgacgagttcgccagaagagccaacggcaacctggtgagcgacaagatccccaaggccaaggacacccagggcttctacggcaccgtgagcagccccgacagcggcgtgtacgagatgaagatcggcagcatcatcttccaggtggccagcggcgacatcaccaaggaggaggccgacgtgatcgtgaacagcaccagcaacagcttcaacctgaaggccggcgtgagcaaggccatcctggagtgcgccggccagaacgtggagagagagtgcagccagcaggcccagcagagaaagaacgactacatcatcaccggcggcggcttcctgagatgcaagaacatcatccacgtgatcggcggcaacgacgtgaagagcagcgtgagcagcgtgctgcaggagtgcgagaagaagaactacagcagcatctgcctgcccgccatcggcaccggcaacgccaagcagcaccccgacaaggtggccgaggccatcatcgacgccatcgaggacttcgtgcagaagggcagcgcccagagcgtgaagaaggtgaaggtggtgatcttcctgccccaggtgctggacgtgttctacgccaacatgaagaagagagagggcacccagctgagcagccagcagagcgtgatgagcaagctggccagcttcctgggcttcagcaagcagagcccccagaagaagaaccacctggtgctggagaagaagaccgagagcgccaccttcagagtgtgcggcgagaacgtgacctgcgtggagtacgccatcagctggctgcaggacctgatcgagaaggagcagtgcccctacaccagcgaggacgagtgcatcaaggacttcgacgagaaggagtaccaggagctgaacgagctgcagaagaagctgaacatcaacatcagcctggaccacaagagacccctgatcaaggtgctgggcatcagcagagacgtgatgcaggccagagacgagatcgaggccatgatcaagagagtgagactggccaaggagcaggagagcagagccgactgcatcagcgagttcatcgagtggcagtacaacgacaacaacaccagccactgcttcaacaagatgaccaacctgaagctggaggacgccagaagagagaagaagaagaccgtggacgtgaagatcaaccacagacactacaccgtgaacctgaacacctacaccgccaccgacaccaagggccacagcctgagcgtgcagagactgaccaagagcaaggtggacatccccgcccactggagcgacatgaagcagcagaacttctgcgtggtggagctgctgcccagcgaccccgagtacaacaccgtggccagcaagttcaaccagacctgcagccacttcagaatcgagaagatcgagagaatccagaaccccgacctgtggaacagctaccaggccaagaagaagaccatggacgccaagaacggccagaccatgaacgagaagcagctgttccacggcaccgacgccggcagcgtgccccacgtgaacagaaacggcttcaacagaagctacgccggcaagaacgccgtggcctacggcaagggcacctacttcgccgtgaacgccaactacagcgccaacgacacctacagcagacccgacgccaacggcagaaagcacgtgtactacgtgagagtgctgaccggcatctacacccacggcaaccacagcctgatcgtgccccccagcaagaacccccagaaccccaccgacctgtacgacaccgtgaccgacaacgtgcaccaccccagcctgttcgtggccttctacgactaccaggcctaccccgagtacctgatcaccttcagaaagtag

SEQ ID NO: 93719 - DNA, 585 bp, Artificial Sequence
  Description of Artificial Sequence: Synthetic coding sequence
tgagtgagaagaagagccgagctgagaatggccgtgcccggcagcttccccctgctggtggagggcagctggggccccgacccccccaagaacctgaacaccaagctgcagatgtacttccagagccccaagagaagcggcggcggcgagtgcgaggtgagacaggaccccagaagccccagcagattcctggtgttcttctaccccgaggacgtgagacagaaggtgctggagagaaagaaccacgagctggtgtggcagggcaagggcaccttcaagctgaccgtgcagctgcccgccacccccgacgagatcgaccacgtgttcgaggaggagctgctgaccaaggagagcaagaccaaggaggacgtgaaggagcccgacaccatcagattcgtggacgactgcaccaagcaccacagcatcaagcagctgcagctgagccccagactgctggaggtgaccaacaccatcagagtggagaacctgccccccggcgccgacgactacagcctgaagctgttcttcgagaacccctacaacggcggcggcagagtggccaacgtggagtacttccccgagtag

SEQ ID NO: 93720 - DNA, 1335 bp, Artificial Sequence
  Description of Artificial Sequence: Synthetic coding sequence
atgctgcagagaatcggcctgatcttcctgcacaacatcgtggtggtgagcaactgcttctacttccaggccttcctggacgagttcaccaactggagcagaatcaaccccaacaaggccagaatccccatggccggcgacacccagggcgtggtgggcaccgtgagcaagccctgcttcaccgcctacgagatgaagatcggcgccatcaccttccaggtggccaccggcgacatcgccaccgagcaggtggacgtgatcgtgaacagcaccgccagaaccttcaacagaaagagcggcgtgagcagagccatcctggagggcgccggccaggccgtggagagcgagtgcgccgtgctggccgcccagccccacagagacttcatcatcacccccggcggctgcctgaagtgcaagatcatcatccacgtgcccggcggcaaggacgtgagaaagaccgtgaccagcgtgctggaggagtgcgagcagagaaagtacaccagcgtgagcctgcccgccatcggcaccggcaacgccggcaagaaccccatcaccgtggccgacaacatcatcgacgccatcgtggacttcagcagccagcacagcacccccagcctgaagaccgtgaaggtggtgatcttccagcccgagctgctgaacatcttctacgacagcatgaagaagagagacctgagcgccagcctgaacttccagagcaccttcagcatgaccacctgcaacctgcccgagcactggaccgacatgaaccaccagctgttctgcatggtgcagctggagcccggccagagcgagtacaacaccatcaaggacaagttcaccagaacctgcagcagctacgccatcgagaagatcgagagaatccagaacgccttcctgtggcagagctaccaggtgaagaagagacagatggacatcaagaacgaccacaagaacaacgagagactgctgttccacggcaccgacgccgacagcgtgccctacgtgaaccagcacggcttcaacagaagctgcgccggcaagaacgccgtgagctacggcaagggcacctacttcgccgtggacgccagctacagcgccaaggacacctacagcaagcccgacagcaacggcagaaagcacatgtacgtggtgagagtgctgaccggcgtgttcaccaagggcagagccggcctggtgacccccccccccaagaacccccacaaccccaccgacctgttcgacagcgtgaccaacaacaccagaagccccaagctgttcgtggtgttcttcgacaaccaggcctaccccgagtacctgatcaccttcaccgcctag

SEQ ID NO: 93721 - DNA, 2037 bp, Artificial Sequence
  Description of Artificial Sequence: Synthetic coding sequence
atggccgcccccggccccctgcccgccgccgccctgagccccggcgcccccacccccagagagctgatgcacggcgtggccggcgtgaccagcagagccggcagagacagagaggccggcagcgtgctgcccgccggcaacagaggcgccagaaaggccagcagaagaagcagcagcagaagcatgagcagagacaacaagttcagcaagaaggactgcctgagcatcagaaacgtggtggccagcatccagaccaaggagggcctgaacctgaagctgatcagcggcgacgtgctgtacatctgggccgacgtgatcgtgaacagcgtgcccatgaacctgcagctgggcggcggccccctgagcagagccttcctgcagaaggccggccccatgctgcagaaggagctggacgacagaagaagagagaccgaggagaaggtgggcaacatcttcatgaccagcggctgcaacctggactgcaaggccgtgctgcacgccgtggccccctactggaacaacggcgccgagaccagctggcagatcatggccaacatcatcaagaagtgcctgaccaccgtggaggtgctgagcttcagcagcatcaccttccccatgatcggcaccggcagcctgcagttccccaaggccgtgttcgccaagctgatcctgagcgaggtgttcgagtacagcagcagcaccagacccatcaccagccccctgcaggaggtgcacttcctggtgtacaccaacgacgacgagggctgccaggccttcctggacgagttcaccaactggagcagaatcaaccccaacaaggccagaatccccatggccggcgacacccagggcgtggtgggcaccgtgagcaagccctgcttcaccgcctacgagatgaagatcggcgccatcaccttccaggtggccaccggcgacatcgccaccgagcaggtggacgtgatcgtgaacagcaccgccagaaccttcaacagaaagagcggcgtgagcagagccatcctggagggcgccggccaggccgtggagagcgagtgcgccgtgctggccgcccagccccacagagacttcatcatcacccccggcggctgcctgaagtgcaagatcatcatccacgtgcccggcggcaaggacgtgagaaagaccgtgaccagcgtgctggaggagtgcgagcagagaaagtacaccagcgtgagcctgcccgccatcggcaccggcaacgccggcaagaaccccatcaccgtggccgacaacatcatcgacgccatcgtggacttcagcagccagcacagcacccccagcctgaagaccgtgaaggtggtgatcttccagcccgagctgctgaacatcttctacgacagcatgaagaagagagacctgagcgccagcctgaacttccagagcaccttcagcatgaccacctgcaacctgcccgagcactggaccgacatgaaccaccagctgttctgcatggtgcagctggagcccggccagagcgagtacaacaccatcaaggacaagttcaccagaacctgcagcagctacgccatcgagaagatcgagagaatccagaacgccttcctgtggcagagctaccaggtgaagaagagacagatggacatcaagaacgaccacaagaacaacgagagactgctgttccacggcaccgacgccgacagcgtgccctacgtgaaccagcacggcttcaacagaagctgcgccggcaagaacgccgtgagctacggcaagggcacctacttcgccgtggacgccagctacagcgccaaggacacctacagcaagcccgacagcaacggcagaaagcacatgtacgtggtgagagtgctgaccggcgtgttcaccaagggcagagccggcctggtgacccccccccccaagaacccccacaaccccaccgacctgttcgacagcgtgaccaacaacaccagaagccccaagctgttcgtggtgttcttcgacaaccaggcctaccccgagtacctgatcaccttcaccgcctag

SEQ ID NO: 93722 - DNA, 1278 bp, Artificial Sequence
  Description of Artificial Sequence: Synthetic coding sequence
atgaagcacaccgccttcctggacgagttcaccaactggagcagaatcaaccccaacaaggccagaatccccatggccggcgacacccagggcgtggtgggcaccgtgagcaagccctgcttcaccgcctacgagatgaagatcggcgccatcaccttccaggtggccaccggcgacatcgccaccgagcaggtggacgtgatcgtgaacagcaccgccagaaccttcaacagaaagagcggcgtgagcagagccatcctggagggcgccggccaggccgtggagagcgagtgcgccgtgctggccgcccagccccacagagacttcatcatcacccccggcggctgcctgaagtgcaagatcatcatccacgtgcccggcggcaaggacgtgagaaagaccgtgaccagcgtgctggaggagtgcgagcagagaaagtacaccagcgtgagcctgcccgccatcggcaccggcaacgccggcaagaaccccatcaccgtggccgacaacatcatcgacgccatcgtggacttcagcagccagcacagcacccccagcctgaagaccgtgaaggtggtgatcttccagcccgagctgctgaacatcttctacgacagcatgaagaagagagacctgagcgccagcctgaacttccagagcaccttcagcatgaccacctgcaacctgcccgagcactggaccgacatgaaccaccagctgttctgcatggtgcagctggagcccggccagagcgagtacaacaccatcaaggacaagttcaccagaacctgcagcagctacgccatcgagaagatcgagagaatccagaacgccttcctgtggcagagctaccaggtgaagaagagacagatggacatcaagaacgaccacaagaacaacgagagactgctgttccacggcaccgacgccgacagcgtgccctacgtgaaccagcacggcttcaacagaagctgcgccggcaagaacgccgtgagctacggcaagggcacctacttcgccgtggacgccagctacagcgccaaggacacctacagcaagcccgacagcaacggcagaaagcacatgtacgtggtgagagtgctgaccggcgtgttcaccaagggcagagccggcctggtgacccccccccccaagaacccccacaaccccaccgacctgttcgacagcgtgaccaacaacaccagaagccccaagctgttcgtggtgttcttcgacaaccaggcctaccccgagtacctgatcaccttcaccgcctag

SEQ ID NO: 93723 - DNA, 2565 bp, Artificial Sequence
  Description of Artificial Sequence: Synthetic coding sequence
atggacttcagcatggtggccggcgccgccgcctacaacgagaagagcggcagaatcaccagcctgagcctgctgttccagaaggtgttcgcccagatcttcccccagtggagaaagggcaacaccgaggagtgcctgccctacaagtgcagcgagaccggcgccctgggcgagaactacagctggcagatccccatcaaccacaacgacttcaagatcctgaagaacaacgagagacagctgtgcgaggtgctgcagaacaagttcggctgcatcagcaccctggtgagccccgtgcaggagggcaacagcaagagcctgcaggtgttcagaaagatgctgacccccagaatcgagctgagcgtgtggaaggacgacctgaccacccacgccgtggacgccgtggtgaacgccgccaacgaggacctgctgcacggcggcggcctggccctggccctggtgaaggccggcggcttcgagatccaggaggagagcaagcagttcgtggccagatacggcaaggtgagcgccggcgagatcgccgtgaccggcgccggcagactgccctgcaagcagatcatccacgccgtgggccccagatggatggagtgggacaagcagggctgcaccggcaagctgcagagagccatcgtgagcatcctgaactacgtgatctacaagaacacccacatcaagaccgtggccatccccgccctgagcagcggcatcttccagttccccctgaacctgtgcaccaagaccatcgtggagaccatcagagtgagcctgcagggcaagcccatgatgagcaacctgaaggagatccacctggtgagcaacgaggaccccaccgtggccgccttcaaggccgccagcgagttcatcctgggcaagagcgagctgggccaggagaccacccccagcttcaacgccatggtggtgaacaacctgaccctgcagatcgtgcagggccacatcgagtggcagaccgccgacgtgatcgtgaacagcgtgaacccccacgacatcaccgtgggccccgtggccaagagcatcctgcagcaggccggcgtggagatgaagagcgagttcctggccaccaaggccaagcagttccagagaagccagctggtgctggtgaccaagggcttcaacctgttctgcaagtacatctaccacgtgctgtggcacagcgagttccccaagccccagatcctgaagcacgccatgaaggagtgcctggagaagtgcatcgagcagaacatcaccagcatcagcttccccgccctgggcaccggcaacatggagatcaagaaggagaccgccgccgagatcctgttcgacgaggtgctgaccttcgccaaggaccacgtgaagcaccagctgaccgtgaagttcgtgatcttccccaccgacctggagatctacaaggccttcagcagcgagatggccaagagaagcaagatgctgagcctgaacaactacagcgtgccccagagcaccagagaggagaagagagagaacggcctggaggccagaagccccgccatcaacctgatgggcttcaacgtggaggagatgtacgaggcccacgcctggatccagagaatcctgagcctgcagaaccaccacatcatcgagaacaaccacatcctgtacctgggcagaaaggagcacgacatcctgagccagctgcagaagaccagcagcgtgagcatcaccgagatcatcagccccggcagaaccgagctggagatcgagggcgccagagccgacctgatcgaggtggtgatgaacatcgaggacatgctgtgcaaggtgcaggaggagatggccagaaagaaggagagaggcctgtggagaagcctgggccagtggaccatccagcagcagaagacccaggacgagatgaaggagaacatcatcttcctgaagtgccccgtgccccccacccaggagctgctggaccagaagaagcagttcgagaagtgcggcctgcaggtgctgaaggtggagaagatcgacaacgaggtgctgatggccgccttccagagaaagaagaagatgatggaggagaagctgcacagacagcccgtgagccacagactgttccagcaggtgccctaccagttctgcaacgtggtgtgcagagtgggcttccagagaatgtacagcaccccctgcgaccccaagtacggcgccggcatctacttcaccaagaacctgaagaacctggccgagaaggccaagaagatcagcgccgccgacaagctgatctacgtgttcgaggccgaggtgctgaccggcttcttctgccagggccaccccctgaacatcgtgcccccccccctgagccccggcgccatcgacggccacgacagcgtggtggacaacgtgagcagccccgagaccttcgtgatcttcagcggcatgcaggccatcccccagtacctgtggacctgcacccaggagtacgtgcagagccaggactacagcagcggccccatgagacccttcgcccagcacccctggagaggcttcgccagcggcagccccgtggactag

SEQ ID NO: 93724 - DNA, 2334 bp, Artificial Sequence
  Description of Artificial Sequence: Synthetic coding sequence
atgagcgtgagctgcgtgaagagcagcagaatcagcctggccgtgagcctgccctggagcctgcagttcagaaaggccaccgccaacctgtgcgtgttcagaaagatgctgacccccagaatcgagctgagcgtgtggaaggacgacctgaccacccacgccgtggacgccgtggtgaacgccgccaacgaggacctgctgcacggcggcggcctggccctggccctggtgaaggccggcggcttcgagatccaggaggagagcaagcagttcgtggccagatacggcaaggtgagcgccggcgagatcgccgtgaccggcgccggcagactgccctgcaagcagatcatccacgccgtgggccccagatggatggagtgggacaagcagggctgcaccggcaagctgcagagagccatcgtgagcatcctgaactacgtgatctacaagaacacccacatcaagaccgtggccatccccgccctgagcagcggcatcttccagttccccctgaacctgtgcaccaagaccatcgtggagaccatcagagtgagcctgcagggcaagcccatgatgagcaacctgaaggagatccacctggtgagcaacgaggaccccaccgtggccgccttcaaggccgccagcgagttcatcctgggcaagagcgagctgggccaggagaccacccccagcttcaacgccatggtggtgaacaacctgaccctgcagatcgtgcagggccacatcgagtggcagaccgccgacgtgatcgtgaacagcgtgaacccccacgacatcaccgtgggccccgtggccaagagcatcctgcagcaggccggcgtggagatgaagagcgagttcctggccaccaaggccaagcagttccagagaagccagctggtgctggtgaccaagggcttcaacctgttctgcaagtacatctaccacgtgctgtggcacagcgagttccccaagccccagatcctgaagcacgccatgaaggagtgcctggagaagtgcatcgagcagaacatcaccagcatcagcttccccgccctgggcaccggcaacatggagatcaagaaggagaccgccgccgagatcctgttcgacgaggtgctgaccttcgccaaggaccacgtgaagcaccagctgaccgtgaagttcgtgatcttccccaccgacctggagatctacaaggccttcagcagcgagatggccaagagaagcaagatgctgagcctgaacaactacagcgtgccccagagcaccagagaggagaagagagagaacggcctggaggccagaagccccgccatcaacctgatgggcttcaacgtggaggagatgtacgaggcccacgcctggatccagagaatcctgagcctgcagaaccaccacatcatcgagaacaaccacatcctgtacctgggcagaaaggagcacgacatcctgagccagctgcagaagaccagcagcgtgagcatcaccgagatcatcagccccggcagaaccgagctggagatcgagggcgccagagccgacctgatcgaggtggtgatgaacatcgaggacatgctgtgcaaggtgcaggaggagatggccagaaagaaggagagaggcctgtggagaagcctgggccagtggaccatccagcagcagaagacccaggacgagatgaaggagaacatcatcttcctgaagtgccccgtgccccccacccaggagctgctggaccagaagaagcagttcgagaagtgcggcctgcaggtgctgaaggtggagaagatcgacaacgaggtgctgatggccgccttccagagaaagaagaagatgatggaggagaagctgcacagacagcccgtgagccacagactgttccagcaggtgccctaccagttctgcaacgtggtgtgcagagtgggcttccagagaatgtacagcaccccctgcgaccccaagtacggcgccggcatctacttcaccaagaacctgaagaacctggccgagaaggccaagaagatcagcgccgccgacaagctgatctacgtgttcgaggccgaggtgctgaccggcttcttctgccagggccaccccctgaacatcgtgcccccccccctgagccccggcgccatcgacggccacgacagcgtggtggacaacgtgagcagccccgagaccttcgtgatcttcagcggcatgcaggccatcccccagtacctgtggacctgcacccaggagtacgtgcagagccaggactacagcagcggccccatgagacccttcgcccagcacccctggagaggcttcgccagcggcagccccgtggactag

SEQ ID NO: 93725 - DNA, 2460 bp, Artificial Sequence; identical to SEQ ID NO: 93712
  Description of Artificial Sequence: Synthetic coding sequence

SEQ ID NO: 93726 - DNA, 1440 bp, Artificial Sequence
  Description of Artificial Sequence: Synthetic coding sequence
atgagcgacggcttcgacagagcccccggcgccggcagaggcagaagcagaggcctgggcagaggcggcggcggccccgagggcggcggcttccccaacggcgccggccccgccgagagagccagacaccagcccccccagcccaaggcccccggcttcctgcagcccccccccctgagacagcccagaaccacccccccccccggcgcccagtgcgaggtgcccgccagcccccagagacccagcagacccggcgccctgcccgagcagaccagacccctgagagccccccccagcagccaggacaagatcccccagcagaacagcgagagcgccatggccaagccccaggtggtggtggcccccgtgctgatgagcaagctgagcgtgaacgcccccgagttctaccccagcggctacagcagcagctacaccgagagctacgaggacggctgcgaggactaccccaccctgagcgagtacgtgcaggacttcctgaaccacctgaccgagcagcccggcagcttcgagaccgagatcgagcagttcgccgagaccctgaacggctgcgtgaccaccgacgacgccctgcaggagctggtggagctgatctaccagcaggccaccagcatccccaacttcagctacatgggcgccagactgtgcaactacctgagccaccacctgaccatcagcccccagagcggcaacttcagacagctgctgctgcagagatgcagaaccgagtacgaggtgaaggaccaggccgccaagggcgacgaggtgaccagaaagagattccacgccttcgtgctgttcctgggcgagctgtacctgaacctggagatcaagggcaccaacggccaggtgaccagagccgacatcctgcaggtgggcctgagagagctgctgaacgccctgttcagcaaccccatggacgacaacctgatctgcgccgtgaagctgctgaagctgaccggcagcgtgctggaggacgcctggaaggagaagggcaagatggacatggaggagatcatccagagaatcgagaacgtggtgctggacgccaactgcagcagagacgtgaagcagatgctgctgaagctggtggagctgagaagcagcaactggggcagagtgcacgccaccagcacctacagagaggccacccccgagaacgaccccaactacttcatgaacgagcccaccttctacaccagcgacggcgtgcccttcaccgccgccgaccccgactaccaggagaagtaccaggagctgctggagagagaggacttcttccccgactacgaggagaacggcaccgacctgagcggcgccggcgacccctacctggacgacatcgacgacgagatggaccccgagatcgaggaggcctacgagaagttctgcctggagagcgagagaaagagaaagcagtag

SEQ ID NO: 93727 - DNA, 1104 bp, Artificial Sequence
  Description of Artificial Sequence: Synthetic coding sequence
atggccaagccccaggtggtggtggcccccgtgctgatgagcaagctgagcgtgaacgcccccgagttctaccccagcggctacagcagcagctacaccgagagctacgaggacggctgcgaggactaccccaccctgagcgagtacgtgcaggacttcctgaaccacctgaccgagcagcccggcagcttcgagaccgagatcgagcagttcgccgagaccctgaacggctgcgtgaccaccgacgacgccctgcaggagctggtggagctgatctaccagcaggccaccagcatccccaacttcagctacatgggcgccagactgtgcaactacctgagccaccacctgaccatcagcccccagagcggcaacttcagacagctgctgctgcagagatgcagaaccgagtacgaggtgaaggaccaggccgccaagggcgacgaggtgaccagaaagagattccacgccttcgtgctgttcctgggcgagctgtacctgaacctggagatcaagggcaccaacggccaggtgaccagagccgacatcctgcaggtgggcctgagagagctgctgaacgccctgttcagcaaccccatggacgacaacctgatctgcgccgtgaagctgctgaagctgaccggcagcgtgctggaggacgcctggaaggagaagggcaagatggacatggaggagatcatccagagaatcgagaacgtggtgctggacgccaactgcagcagagacgtgaagcagatgctgctgaagctggtggagctgagaagcagcaactggggcagagtgcacgccaccagcacctacagagaggccacccccgagaacgaccccaactacttcatgaacgagcccaccttctacaccagcgacggcgtgcccttcaccgccgccgaccccgactaccaggagaagtaccaggagctgctggagagagaggacttcttccccgactacgaggagaacggcaccgacctgagcggcgccggcgacccctacctggacgacatcgacgacgagatggaccccgagatcgaggaggcctacgagaagttctgcctggagagcgagagaaagagaaagcagtag

SEQ ID NO: 93728 - DNA, 1203 bp, Artificial Sequence
  Description of Artificial Sequence: Synthetic coding sequence
atgagcgacggcttcgacagagcccccgagcagaccagacccctgagagccccccccagcagccaggacaagatcccccagcagaacagcgagagcgccatggccaagccccaggtggtggtggcccccgtgctgatgagcaagctgagcgtgaacgcccccgagttctaccccagcggctacagcagcagctacaccgagagctacgaggacggctgcgaggactaccccaccctgagcgagtacgtgcaggacttcctgaaccacctgaccgagcagcccggcagcttcgagaccgagatcgagcagttcgccgagaccctgaacggctgcgtgaccaccgacgacgccctgcaggagctggtggagctgatctaccagcaggccaccagcatccccaacttcagctacatgggcgccagactgtgcaactacctgagccaccacctgaccatcagcccccagagcggcaacttcagacagctgctgctgcagagatgcagaaccgagtacgaggtgaaggaccaggccgccaagggcgacgaggtgaccagaaagagattccacgccttcgtgctgttcctgggcgagctgtacctgaacctggagatcaagggcaccaacggccaggtgaccagagccgacatcctgcaggtgggcctgagagagctgctgaacgccctgttcagcaaccccatggacgacaacctgatctgcgccgtgaagctgctgaagctgaccggcagcgtgctggaggacgcctggaaggagaagggcaagatggacatggaggagatcatccagagaatcgagaacgtggtgctggacgccaactgcagcagagacgtgaagcagatgctgctgaagctggtggagctgagaagcagcaactggggcagagtgcacgccaccagcacctacagagaggccacccccgagaacgaccccaactacttcatgaacgagcccaccttctacaccagcgacggcgtgcccttcaccgccgccgaccccgactaccaggagaagtaccaggagctgctggagagagaggacttcttccccgactacgaggagaacggcaccgacctgagcggcgccggcgacccctacctggacgacatcgacgacgagatggaccccgagatcgaggaggcctacgagaagttctgcctggagagcgagagaaagagaaagcagtag

SEQ ID NO: 93729 - DNA, 507 bp, Artificial Sequence
  Description of Artificial Sequence: Synthetic coding sequence
atggccaagccccaggtggtggtggcccccgtgctgatgagcaagctgagcgtgaacgcccccgagttctaccccagcggctacagcagcagctacaccgagagctacgaggacggctgcgaggactaccccaccctgagcgagtacgtgcaggacttcctgaaccacctgaccgagcagcccggcagcttcgagaccgagatcgagcagttcgccgagaccctgaacggctgcgtgaccaccgacgacgccctgcaggagctggtggagctgatctaccagcaggccaccagcatccccaacttcagctacatgggcgccagactgtgcaactacctgagccaccacctgaccatcagcccccagagcggcaacttcagacagctgctgctgcagagatgcagaaccgagtacgaggtgaaggaccaggccgccaagggcgacgaggtgaccagaaagagattccacgccttcgtgctgttcctgggcgagctgtacctgaactag

SEQ ID NO: 93730 - DNA, 603 bp, Artificial Sequence
  Description of Artificial Sequence: Synthetic coding sequence
atggccaagccccaggtggtggtggcccccgtgctgatgagcaagctgagcgtgaacgcccccgagttctaccccagcggctacagcagcagctacaccgagagctacgaggacggctgcgaggactaccccaccctgagcgagtacgtgcaggacttcctgaaccacctgaccgagcagcccggcagcttcgagaccgagatcgagcagttcgccgagaccctgaacggctgcgtgaccaccgacgacgccctgcaggagctggtggagctgatctaccagcaggccaccagcatccccaacttcagctacatgggcgccagactgtgcaactacctgagccaccacctgaccatcagcccccagagcggcaacttcagacagctgctgctgcagagatgcagaaccgagtacgaggtgaaggaccaggccgccaagggcgacgaggtgaccagaaagagattccacgccttcgtgctgttcctgggcgagctgtacctgaacctggagatcaagggcaccaacggccaggtgaccagagccgacatcctgcaggtgggcctgagagagctgctgaacgccctgttcagcaaccccatgtag

SEQ ID NO: 93731 - DNA, 1056 bp, Artificial Sequence
  Description of Artificial Sequence: Synthetic coding sequence
atgagcgacggcttcgacagagcccccgagcagaccagacccctgagagccccccccagcagccaggacaagatcccccagcagaacagcgagagcgccatggccaagccccaggtggtggtggcccccgtgctgatgagcaagctgagcgtgaacgcccccgagttctaccccagcggctacagcagcagctacaccgagagctacgaggacggctgcgaggactaccccaccctgagcgagtacgtgcaggacttcctgaaccacctgaccgagcagcccggcagcttcgagaccgagatcgagcagttcgccgagaccctgaacggctgcgtgaccaccgacgacgccctgcaggagctggtggagctgatctaccagcaggccaccagcatccccaacttcagctacatgggcgccagactgtgcaactacctgagccaccacctgaccatcagcccccagagcggcaacttcagacagctgctgctgcagagatgcagaaccgagtacgaggtgaaggaccaggccgccaagggcgacgaggtgaccagaaagagattccacgccttcgtgctgttcctgggcgagctgtacctgaacctggagatcaagggcaccaacggccaggtgaccagagccgacatcctgcaggtgggcctgagagagctgctgaacgccctgttcagcaaccccatggacgacaacctgatctgcgccgtgaagctgctgaagctgaccggcagcgtgctggaggacgcctggaaggagaagggcaagatggacatggaggagatcatccagagaatcgagaacgtggtgctggacgccaactgcagcagagacgtgaagcagatgctgctgaagctggtggagctgagaagcagcaactggggcagagtgcacgccaccagcacctacagagaggccacccccgagaacgaccccaactacttcatgaacgagcccaccttctacaccagcgacggcgtgcccttcaccgccgccgaccccgacacctggatgatcctgatgatgagatggacccagagatag

SEQ ID NO: 93732 - DNA, 288 bp, Artificial Sequence
  Description of Artificial Sequence: Synthetic coding sequence
atggccaagccccaggtggtggtggcccccgtgctgatgagcaagctgagcgtgaacgcccccgagttctaccccagcggctacagcagcagctacaccgagagctacgaggacggctgcgaggactaccccaccctgagcgagtacgtgcaggacttcctgaaccacctgaccgagcagcccggcagcttcgagaccgagatcgagcagttcgccgagaccctgaacggctgcgtgaccaccgacgacgccctgcaggagctggtggagctgatctaccagcagtag

SEQ ID NO: 93733 - DNA, 384 bp, Artificial Sequence
  Description of Artificial Sequence: Synthetic coding sequence
atgaaggaccccagcagaagcagcaccagccccagcatcatcaacgaggacgtgatcatcaacggccacagccacgaggacgacaaccccttcgccgagtacatgtggatggagaacgaggaggagttcaacagacagatcgaggaggagctgtgggaggaggagttcatcgagagatgcttccaggagatgctggaggaggaggaggagcacgagtggttcatccccgccagagacctgccccagaccatggaccagatccaggaccagttcaacgacctggtgatcagcgacggcagcagcctggaggacctggtggtgaagagcaacctgaaccccaacgccaaggagttcgtgcccggcgtgaagtacggcaacatctag

SEQ ID NO: 93734 - DNA, 384 bp, Artificial Sequence; identical to SEQ ID NO: 93733
  Description of Artificial Sequence: Synthetic coding sequence

SEQ ID NO: 93735 - DNA, 282 bp, Artificial Sequence
  Description of Artificial Sequence: Synthetic coding sequence
atgaaggaccccagcagaagcagcaccagccccagcatcatcaacgaggacgtgatcatcaacggccacagccacgaggacgacaaccccttcgccgagtacatgtggatggagaacgaggaggagttcaacagacagatcgaggaggagctgtgggaggaggagttcatcgagagatgcttccaggagatgctggaggaggaggaggagcacgagtggttcatccccgccagagacctgccccagaccatggaccagatccaggaccagttcaacgactag

SEQ ID NO: 93736 - DNA, 384 bp, Artificial Sequence; identical to SEQ ID NO: 93733
  Description of Artificial Sequence: Synthetic coding sequence

SEQ ID NO: 93737 - DNA, 372 bp, Artificial Sequence
  Description of Artificial Sequence: Synthetic coding sequence
atgaacggcagcaacatggccaacaccagccccagcgtgaagagcaaggaggaccagggcctgagcggccacgacgagaaggagaaccccttcgccgagtacatgtggatggagaacgaggaggacttcaacagacaggtggaggaggagctgcaggagcaggacttcctggacagatgcttccaggagatgctggacgaggaggaccaggactggttcatccccagcagagacctgccccaggccatgggccagctgcagcagcagctgaacggcctgagcgtgagcgagggccacgacagcgaggacatcctgagcaagagcaacctgaaccccgacgccaaggagttcatccccggcgagaagtactag

SEQ ID NO: 93738 - DNA, 1896 bp, Artificial Sequence
  Description of Artificial Sequence: Synthetic coding sequence
atgaaccccagcacccccagctaccccaccgccagcctgtacgtgggcgacctgcaccccgacgtgaccgaggccatgctgtacgagaagttcagccccgccggccccatcctgagcatcagaatctgcagagacctgatcaccagcggcagcagcaactacgcctacgtgaacttccagcacaccaaggacgccgagcacgccctggacaccatgaacttcgacgtgatcaagggcaagcccgtgagaatcatgtggagccagagagaccccagcctgagaaagagcggcgtgggcaacatcttcgtgaagaacctggacaagagcatcaacaacaaggccctgtacgacaccgtgagcgccttcggcaacatcctgagctgcaacgtggtgtgcgacgagaacggcagcaagggctacggcttcgtgcacttcgagacccacgaggccgccgagagagccatcaagaagatgaacggcatgctgctgaacggcagaaaggtgttcgtgggccagttcaagagcagaaaggagagagaggccgagctgggcgccagagccaaggagttccccaacgtgtacatcaagaacttcggcgaggacatggacgacgagagactgaaggacctgttcggcaagttcggccccgccctgagcgtgaaggtgatgaccgacgagagcggcaagagcaagggcttcggcttcgtgagcttcgagagacacgaggacgcccagaaggccgtggacgagatgaacggcaaggagctgaacggcaagcagatctacgtgggcagagcccagaagaaggtggagagacagaccgagctgaagagaaccttcgagcagatgaagcaggacagaatcaccagataccaggtggtgaacctgtacgtgaagaacctggacgacggcatcgacgacgagagactgagaaaggccttcagccccttcggcaccatcaccagcgccaaggtgatgatggagggcggcagaagcaagggcttcggcttcgtgtgcttcagcagccccgaggaggccaccaaggccgtgaccgagatgaacggcagaatcgtggccaccaagcccctgtacgtggccctggcccagagaaaggaggagagacaggcctacctgaccaacgagtacatgcagagaatggccagcgtgagagccgtgcccaaccagagagccccccccagcggctacttcatgaccgccgtgccccagacccagaaccacgccgcctactacccccccagccagatcgccagactgagacccagccccagatggaccgcccagggcgccagaccccaccccttccagaacaagcccagcgccatcagacccggcgcccccagagtgcccttcagcaccatgagacccgccagcagccaggtgcccagagtgatgagcacccagagagtggccaacaccagcacccagaccgtgggccccagacccgccgccgccgccgccgccgccgccacccccgccgtgagaaccgtgcccagatacaagtacgccgccggcgtgagaaacccccagcagcacagaaacgcccagccccaggtgaccatgcagcagctggccgtgcacgtgcagggccaggagaccctgaccgccagcagactggccagcgcccccccccagaagcagaagcagatgctgggcgagagactgttccccctgatccaggccatgcaccccaccctggccggcaagatcaccggcatgctgctggagatcgacaacagcgagctgctgtacatgctggagagccccgagagcctgagaagcaaggtggacgaggccgtggccgtgctgcaggcccaccaggccaaggaggccacccagaaggccgtgaacagcgccaccggcgtgcccaccgtgtag

SEQ ID NO: 93739 - DNA, 1896 bp, Artificial Sequence
  Description of Artificial Sequence: Synthetic coding sequence
atgaacgccgccgccagcagctaccccatggccagcctgtacgtgggcgacctgcacagcgacgtgaccgaggccatgctgtacgagaagttcagccccgccggccccgtgctgagcatcagagtgtgcagagacatgatcaccagaagaagcctgggctacgcctacgtgaacttccagcagcccgccgacgccgagagagccctggacaccatgaacttcgacgtgatcaagggcaagcccatcagaatcatgtggagccagagagaccccagcctgagaaagagcggcgtgggcaacgtgttcatcaagaacctggacaagagcatcgacaacaaggccctgtacgacaccttcagcgccttcggcaacatcctgagctgcaaggtggtgtgcgacgagaacggcagcaagggctacgccttcgtgcacttcgagacccaggaggccgccgacaaggccatcgagaagatgaacggcatgctgctgaacgacagaaaggtgttcgtgggcagattcaagagcagaaaggagagagaggccgagctgggcgccaaggccaaggagttcaccaacgtgtacatcaagaacttcggcgaggaggtggacgacgagagcctgaaggagctgttcagccagttcggcaagaccctgagcgtgaaggtgatgagagaccccaacggcaagagcaagggcttcggcttcgtgagctacgagaagcacgaggacgccaacaaggccgtggaggagatgaacggcaaggagatcagcggcaagatcatcttcgtgggcagagcccagaagaaggtggagagacaggccgagctgaagagaaagttcgagcagctgaagcaggagagaatcagcagataccagggcgtgaacctgtacatcaagaacctggacgacaccatcgacgacgagaagctgagaaaggagttcagccccttcggcagcatcaccagcgccaaggtgatgctggaggacggcagaagcaagggcttcggcttcgtgtgcttcagcagccccgaggaggccaccaaggccgtgaccgagatgaacggcagaatcgtgggcagcaagcccctgtacgtggccctggcccagagaaaggaggagagaaaggcccacctgaccaaccagtacatgcagagagtggccggcatgagagccctgcccgccaacgccatcctgaaccagttccagcccgccgccggcggctacttcgtgcccgccgtgccccaggcccagggcagacccccctactacacccccaaccagctggcccagatgagacccaaccccagatggcagcagggcggcagaccccagggcttccagggcatgcccagcgccatcagacagagcggccccagacccaccctgagacacctggcccccaccggcaacgcccccgccagcagaggcctgcccaccaccacccagagagtgggcgtgcccaccgccgtgcagaacctggcccccagagccgccgtggccgccgccgcccccagagccgtggccccctacaagtacgccagcagcgtgagaagcccccaccccgccatccagcccctgcaggccccccagcccgccgtgcacgtgcagggccaggagcccctgaccgccagcatgctggccgccgcccccccccaggagcagaagcagatgctgggcgagagactgttccccctgatccagaccatgcacagcaacctggccggcaagatcaccggcatgctgctggagatcgacaacagcgagctgctgcacatgctggagagccccgagagcctgagaagcaaggtggacgaggccgtggccgtgctgcaggcccaccacgccaagaaggaggccgcccagaaggtgggcgccgtggccgccgccaccagctag

SEQ ID NO: 93740 - DNA, 1935 bp, Artificial Sequence
  Description of Artificial Sequence: Synthetic coding sequence
atgaacgccgccgccagcagctaccccatggccagcctgtacgtgggcgacctgcacagcgacgtgaccgaggccatgctgtacgagaagttcagccccgccggccccgtgctgagcatcagagtgtgcagagacatgatcaccagaagaagcctgggctacgcctacgtgaacttccagcagcccgccgacgccgagagagccctggacaccatgaacttcgacgtgatcaagggcaagcccatcagaatcatgtggagccagagagaccccagcctgagaaagagcggcgtgggcaacgtgttcatcaagaacctggacaagagcatcgacaacaaggccctgtacgacaccttcagcgccttcggcaacatcctgagctgcaaggtggtgtgcgacgagaacggcagcaagggctacgccttcgtgcacttcgagacccaggaggccgccgacaaggccatcgagaagatgaacggcatgctgctgaacgacagaaaggtgttcgtgggcagattcaagagcagaaaggagagagaggccgagctgggcgccaaggccaaggagttcaccaacgtgtacatcaagaacttcggcgaggaggtggacgacgagagcctgaaggagctgttcagccagttcggcaagaccctgagcgtgaaggtgatgagagaccccaacggcaagagcaagggcttcggcttcgtgagctacgagaagcacgaggacgccaacaaggccgtggaggagatgaacggcaaggagatcagcggcaagatcatcttcgtgggcagagcccagaagaaggtggagagacaggccgagctgaagagaaagttcgagcagctgaagcaggagagaatcagcagataccagggcgtgaacctgtacatcaagaacctggacgacaccatcgacgacgagaagctgagaaaggagttcagccccttcggcagcatcaccagcgccaaggtgatgctggaggacggcagaagcaagggcttcggcttcgtgtgcttcagcagccccgaggaggccaccaaggccgtgaccgagatgaacggcagaatcgtgggcagcaagcccctgtacgtggccctggcccagagaaaggaggagagaaaggcccacctgaccaaccagtacatgcagagagtggccggcatgagagccctgcccgccaacgccatcctgaaccagttccagcccgccgccggcggctacttcgtgcccgccgtgccccaggcccagggcagacccccctactacacccccaaccagctggcccagatgagacccaaccccagatggcagcagggcggcagaccccagggcttccagggcatgcccagcgccatcagacagagcggccccagacccaccctgagacacctggcccccaccggcagcgagtgccccgacagactggccatggacttcggcggcgccggcgccgcccagcagggcctgaccgacagctgccagagcggcggcgtgcccaccgccgtgcagaacctggcccccagagccgccgtggccgccgccgcccccagagccgtggccccctacaagtacgccagcagcgtgagaagcccccaccccgccatccagcccctgcaggccccccagcccgccgtgcacgtgcagggccaggagcccctgaccgccagcatgctggccgccgcccccccccaggagcagaagcagatgctgggcgagagactgttccccctgatccagaccatgcacagcaacctggccggcaagatcaccggcatgctgctggagatcgacaacagcgagctgctgcacatgctggagagccccgagagcctgagaagcaaggtggacgaggccgtggccgtgctgcaggcccaccacgccaagaaggaggccgcccagaaggtgggcgccgtggccgccgccaccagctag

SEQ ID NO: 93741 - DNA, 1983 bp, Artificial Sequence
  Description of Artificial Sequence: Synthetic coding sequence
atgaacgccgccgccagcagctaccccatggccagcctgtacgtgggcgacctgcacagcgacgtgaccgaggccatgctgtacgagaagttcagccccgccggccccgtgctgagcatcagagtgtgcagagacatgatcaccagaagaagcctgggctacgcctacgtgaacttccagcagcccgccgacgccgagagagccctggacaccatgaacttcgacgtgatcaagggcaagcccatcagaatcatgtggagccagagagaccccagcctgagaaagagcggcgtgggcaacgtgttcatcaagaacctggacaagagcatcgacaacaaggccctgtacgacaccttcagcgccttcggcaacatcctgagctgcaaggtggtgtgcgacgagaacggcagcaagggctacgccttcgtgcacttcgagacccaggaggccgccgacaaggccatcgagaagatgaacggcatgctgctgaacgacagaaaggtgttcgtgggcagattcaagagcagaaaggagagagaggccgagctgggcgccaaggccaaggagttcaccaacgtgtacatcaagaacttcggcgaggaggtggacgacgagagcctgaaggagctgttcagccagttcggcaagaccctgagcgtgaaggtgatgagagaccccaacggcaagagcaagggcttcggcttcgtgagctacgagaagcacgaggacgccaacaaggccgtggaggagatgaacggcaaggagatcagcggcaagatcatcttcgtgggcagagcccagaagaaggtggagagacaggccgagctgaagagaaagttcgagcagctgaagcaggagagaatcagcagataccagggcgtgaacctgtacatcaagaacctggacgacaccatcgacgacgagaagctgagaaaggagttcagccccttcggcagcatcaccagcgccaaggtgatgctggaggacggcagaagcaagggcttcggcttcgtgtgcttcagcagccccgaggaggccaccaaggccgtgaccgagatgaacggcagaatcgtgggcagcaagcccctgtacgtggccctggcccagagaaaggaggagagaaaggcccacctgaccaaccagtacatgcagagagtggccggcatgagagccctgcccgccaacgccatcctgaaccagttccagcccgccgccggcggctacttcgtgcccgccgtgccccaggcccagggcagacccccctactacacccccaaccagctggcccagatgagacccaaccccagatggcagcagggcggcagaccccagggcttccagggcatgcccagcgccatcagacagagcggccccagacccaccctgagacacctggcccccaccggcaacgcccccgccagcagaggcctgcccaccaccacccagagagtgggcagcgagtgccccgacagactggccatggacttcggcggcgccggcgccgcccagcagggcctgaccgacagctgccagagcggcggcgtgcccaccgccgtgcagaacctggcccccagagccgccgtggccgccgccgcccccagagccgtggccccctacaagtacgccagcagcgtgagaagcccccaccccgccatccagcccctgcaggccccccagcccgccgtgcacgtgcagggccaggagcccctgaccgccagcatgctggccgccgcccccccccaggagcagaagcagatgctgggcgagagactgttccccctgatccagaccatgcacagcaacctggccggcaagatcaccggcatgctgctggagatcgacaacagcgagctgctgcacatgctggagagccccgagagcctgagaagcaaggtggacgaggccgtggccgtgctgcaggcccaccacgccaagaaggaggccgcccagaaggtgggcgccgtggccgccgccaccagctag

SEQ ID NO: 93742 - DNA, 390 bp, Artificial Sequence
  Description of Artificial Sequence: Synthetic coding sequence
atgaacgccgccgccagcagctaccccatggccagcctgtacgtgggcgacctgcacagcgacgtgaccgaggccatgctgtacgagaagttcagccccgccggccccgtgctgagcatcagagtgtgcagagacatgatcaccagaagaagcctgggctacgcctacgtgaacttccagcagcccgccgacgccgagagagccctggacaccatgaacttcgacgtgatcaagggcaagcccatcagaatcatgtggagccagagagaccccagcctgagaaagagcggcgtgggcaacgtgttcatcaagaacctggacaagagcatcgacaacaaggccctgtacgacaccttcagcgccttcggcaacatcctgagctgcaagtag

SEQ ID NO: 93743 - DNA, 207 bp, Artificial Sequence
  Description of Artificial Sequence: Synthetic coding sequence
tgactgatccagaccatgcacagcaacctggccggcaagatcaccggcatgctgctggagatcgacaacagcgagctgctgcacatgctggagagccccgagagcctgagaagcaaggtggacgaggccgtggccgtgctgcaggcccaccacgccaagaaggaggccgcccagaaggtgggcgccgtggccgccgccaccagctag

SEQ ID NO: 93744 - DNA, 120 bp, Artificial Sequence
  Description of Artificial Sequence: Synthetic coding sequence
atgaacgccgccgccagcagctaccccatggccagcctgtacgtgggcgacctgcacagcgacgtgaccgaggccatgctgtacgagaagttcagccccgccggccccgtgctgagctag

SEQ ID NO: 93745 - DNA, 1149 bp, Artificial Sequence
  Description of Artificial Sequence: Synthetic coding sequence
atgggcagcggcgagcccaaccccgccggcaagaagaagaagtacctgaaggccgccctgtacgtgggcgacctggaccccgacgtgaccgaggacatgctgtacaagaagttcagacccgccggccccctgagattcaccagaatctgcagagaccccgtgaccagaagccccctgggctacggctacgtgaacttcagattccccgccgacgccgagtgggccctgaacaccatgaacttcgacctgatcaacggcaagcccttcagactgatgtggagccagcccgacgacagactgagaaagagcggcgtgggcaacatcttcatcaagaacctggacaagagcatcgacaacagagccctgttctacctgttcagcgccttcggcaacatcctgagctgcaaggtggtgtgcgacgacaacggcagcaagggctacgcctacgtgcacttcgacagcctggccgccgccaacagagccatctggcacatgaacggcgtgagactgaacaacagacaggtgtacgtgggcagattcaagttccccgaggagagagccgccgaggtgagaaccagagacagagccaccttcaccaacgtgttcgtgaagaacatcggcgacgacatcgacgacgagaagctgaaggagctgttctgcgagtacggccccaccgagagcgtgaaggtgatcagagacgccagcggcaagagcaagggcttcggcttcgtgagatacgagacccacgaggccgcccagaaggccgtgctggacctgcacggcaagagcatcgacggcaaggtgctgtacgtgggcagagcccagaagaagatcgagagactggccgagctgagaagaagattcgagagactgagactgaaggagaagagcagaccccccggcgtgcccatctacatcaagaacctggacgagaccatcaacgacgagaagctgaaggaggagttcagcagcttcggcagcatcagcagagccaaggtgatgatggaggtgggccagggcaagggcttcggcgtggtgtgcttcagcagcttcgaggaggccaccaaggccgtggacgagatgaacggcagaatcgtgggcagcaagcccctgcacgtgaccctgggccaggccagaagaagatgctag

SEQ ID NO: 93746 - DNA, 657 bp, Artificial Sequence
  Description of Artificial Sequence: Synthetic coding sequence
atgaacggcgtgagactgaacaacagacaggtgtacgtgggcagattcaagttccccgaggagagagccgccgaggtgagaaccagagacagagccaccttcaccaacgtgttcgtgaagaacatcggcgacgacatcgacgacgagaagctgaaggagctgttctgcgagtacggccccaccgagagcgtgaaggtgatcagagacgccagcggcaagagcaagggcttcggcttcgtgagatacgagacccacgaggccgcccagaaggccgtgctggacctgcacggcaagagcatcgacggcaaggtgctgtacgtgggcagagcccagaagaagatcgagagactggccgagctgagaagaagattcgagagactgagactgaaggagaagagcagaccccccggcgtgcccatctacatcaagaacctggacgagaccatcaacgacgagaagctgaaggaggagttcagcagcttcggcagcatcagcagagccaaggtgatgatggaggtgggccagggcaagggcttcggcgtggtgtgcttcagcagcttcgaggaggccaccaaggccgtggacgagatgaacggcagaatcgtgggcagcaagcccctgcacgtgaccctgggccaggccagaagaagatgctag

SEQ ID NO: 93747 - DNA, 1053 bp, Artificial Sequence
  Description of Artificial Sequence: Synthetic coding sequence
atgctgtacaagaagttcagacccgccggccccctgagattcaccagaatctgcagagaccccgtgaccagaagccccctgggctacggctacgtgaacttcagattccccgccgacgccgagtgggccctgaacaccatgaacttcgacctgatcaacggcaagcccttcagactgatgtggagccagcccgacgacagactgagaaagagcggcgtgggcaacatcttcatcaagaacctggacaagagcatcgacaacagagccctgttctacctgttcagcgccttcggcaacatcctgagctgcaaggtggtgtgcgacgacaacggcagcaagggctacgcctacgtgcacttcgacagcctggccgccgccaacagagccatctggcacatgaacggcgtgagactgaacaacagacaggtgtacgtgggcagattcaagttccccgaggagagagccgccgaggtgagaaccagagacagagccaccttcaccaacgtgttcgtgaagaacatcggcgacgacatcgacgacgagaagctgaaggagctgttctgcgagtacggccccaccgagagcgtgaaggtgatcagagacgccagcggcaagagcaagggcttcggcttcgtgagatacgagacccacgaggccgcccagaaggccgtgctggacctgcacggcaagagcatcgacggcaaggtgctgtacgtgggcagagcccagaagaagatcgagagactggccgagctgagaagaagattcgagagactgagactgaaggagaagagcagaccccccggcgtgcccatctacatcaagaacctggacgagaccatcaacgacgagaagctgaaggaggagttcagcagcttcggcagcatcagcagagccaaggtgatgatggaggtgggccagggcaagggcttcggcgtggtgtgcttcagcagcttcgaggaggccaccaaggccgtggacgagatgaacggcagaatcgtgggcagcaagcccctgcacgtgaccctgggccaggccagaagaagatgctag

SEQ ID NO: 93748 - DNA, 957 bp, Artificial Sequence
  Description of Artificial Sequence: Synthetic coding sequence
atgcccaagagaggcaagaagggcgccgtggccgaggacggcgacgagctgagaaccgagcccgaggccaagaagagcaagaccgccgccaagaagaacgacaaggaggccgccggcgagggccccgccctgtacgaggacccccccgaccagaagaccagccccagcggcaagcccgccaccctgaagatctgcagctggaacgtggacggcctgagagcctggatcaagaagaagggcctggactgggtgaaggaggaggcccccgacatcctgtgcctgcaggagaccaagtgcagcgagaacaagctgcccgccgagctgcaggagctgcccggcctgagccaccagtactggagcgcccccagcgacaaggagggctacagcggcgtgggcctgctgagcagacagtgccccctgaaggtgagctacggcatcggcgacgaggagcacgaccaggagggcagagtgatcgtggccgagttcgacagcttcgtgctggtgaccgcctacgtgcccaacgccggcagaggcctggtgagactggagtacagacagagatgggacgaggccttcagaaagttcctgaagggcctggccagcagaaagcccctggtgctgtgcggcgacctgaacgtggcccacgaggagatcgacctgagaaaccccaagggcaacaagaagaacgccggcttcaccccccaggagagacagggcttcggcgagctgctgcaggccgtgcccctggccgacagcttcagacacctgtaccccaacaccccctacgcctacaccttctggacctacatgatgaacgccagaagcaagaacgtgggctggagactggactacttcctgctgagccacagcctgctgcccgccctgtgcgacagcaagatcagaagcaaggccctgggcagcgaccactgccccatcaccctgtacctggccctgtag

SEQ ID NO: 93749 - DNA, 891 bp, Artificial Sequence
  Description of Artificial Sequence: Synthetic coding sequence
atggccgccgccgccgccgccgccgccgccgccggcgccgccggcggcagaggcagcggccccggcagaagaagacacctggtgcccggcgccggcggcgaggccggcgagggcgcccccggcggcgccggcgactacggcaacggcctggagagcgaggagctggagcccgaggagctgctgctggagcccgagcccgagcccgagcccgaggaggagccccccagacccagagccccccccggcgcccccggccccggccccggcagcggcgcccccggcagccaggaggaggaggaggagcccggcctggtggagggcgaccccggcgacggcgccatcgaggaccccgagctggaggccatcaaggccagagtgagagagatggaggaggaggccgagaagctgaaggagctgcagaacgaggtggagaagcagatgaacatgagccccccccccggcaacgccggccccgtgatcatgagcatcgaggagaagatggaggccgacgccagaagcatctacgtgggcaacgtggactacggcgccaccgccgaggagctggaggcccacttccacggctgcggcagcgtgaacagagtgaccatcctgtgcgacaagttcagcggccaccccaagggcttcgcctacatcgagttcagcgacaaggagagcgtgagaaccagcctggccctggacgagagcctgttcagaggcagacagatcaaggtgatccccaagagaaccaacagacccggcatcagcaccaccgacagaggcttccccagagccagatacagagccagaaccaccaactacaacagcagcagaagcagattctacagcggcttcaacagcagacccagaggcagagtgtacagaagcggctag

SEQ ID NO: 93750 - DNA, 1557 bp, Artificial Sequence
  Description of Artificial Sequence: Synthetic coding sequence
atgagctgcgtgaagctgtggcccagcggcgcccccgcccccctggtgagcatcgaggagctggagaaccaggagctggtgggcaagggcggcttcggcaccgtgttcagagcccagcacagaaagtggggctacgacgtggccgtgaagatcgtgaacagcaaggccatcagcagagaggtgaaggccatggccagcctggacaacgagttcgtgctgagactggagggcgtgatcgagaaggtgaactgggaccaggaccccaagcccgccctggtgaccaagttcatggagaacggcagcctgagcggcctgctgcagagccagtgccccagaccctggcccctgctgtgcagactgctgaaggaggtggtgctgggcatgttctacctgcacgaccagaaccccgtgctgctgcacagagacctgaagcccagcaacgtgctgctggaccccgagctgcacgtgaagctggccgacttcggcctgagcaccttccagggcggcagccagagcggcaccggcagcggcgagcccggcggcaccctgggctacctggcccccgagctgttcgtgaacgtgaacagaaaggccagcaccgccagcgacgtgtacagcttcggcatcctgatgtgggccgtgctggccggcagagaggtggagctgcccaccgagcccagcctggtgtacgaggccgtgtgcaacagacagaacagacccagcctggccgagctgccccaggccggccccgagacccccggcctggagggcctgaaggagctgatgcagctgtgctggagcagcgagcccaaggacagacccagcttccaggagtgcctgcccaagaccgacgaggtgttccagatggtggagaacaacatgaacgccgccgtgagcaccgtgaaggacttcctgagccagctgagaagcagcaacagaagattcagcatccccgagagcggccagggcggcaccgagatggacggcttcagaagaaccatcgagaaccagcacagcagaaacgacgtgatggtgagcgagtggctgaacaagctgaacctggaggagccccccagcagcgtgcccaagaagtgccccagcctgaccaagagaagcagagcccaggaggagcaggtgccccaggcctggaccgccggcaccagcagcgacagcatggcccagcccccccagacccccgagaccagcaccttcagaaaccagatgcccagccccaccagcaccggcacccccagccccggccccagaggcaaccagggcgccgagagacagggcatgaactggagctgcagaacccccgagcccaaccccgtgaccggcagacccctggtgaacatctacaactgcagcggcgtgcaggtgggcgacaacaactacctgaccatgcagcagaccaccgccctgcccacctggggcctggcccccagcggcaagggcagaggcctgcagcaccccccccccgtgggcagccaggagggccccaaggaccccgaggcctggagcagaccccagggctggtacaaccacagcggcaagtag

SEQ ID NO: 93751 - DNA, 2223 bp, Artificial Sequence
  Description of Artificial Sequence: Synthetic coding sequence
atgctgggcagaagaggcagcgactgggccgtgcccgcccccgagaccatgcccttccccgtgaccacccagggcagccagcagacccagcccccccagaagcactacggcatcaccagccccatcagcctggccgcccccaaggagaccgactgcgtgctgacccagaagctgatcgagaccctgaagcccttcggcgtgttcgaggaggaggaggagctgcagagaagaatcctgatcctgggcaagctgaacaacctggtgaaggagtggatcagagagatcagcgagagcaagaacctgccccagagcgtgatcgagaacgtgggcggcaagatcttcaccttcggcagctacagactgggcgtgcacaccaagggcgccgacatcgacgccctgtgcgtggcccccagacacgtggacagaagcgacttcttcaccagcttctacgacaagctgaagctgcaggaggaggtgaaggacctgagagccgtggaggaggccttcgtgcccgtgatcaagctgtgcttcgacggcatcgagatcgacatcctgttcgccagactggccctgcagaccatccccgaggacctggacctgagagacgacagcctgctgaagaacctggacatcagatgcatcagaagcctgaacggctgcagagtgaccgacgagatcctgcacctggtgcccaacatcgacaacttcagactgaccctgagagccatcaagctgtgggccaagagacacaacatctacagcaacatcctgggcttcctgggcggcgtgagctgggccatgctggtggccagaacctgccagctgtaccccaacgccatcgccagcaccctggtgcacaagttcttcctggtgttcagcaagtgggagtggcccaaccccgtgctgctgaagcagcccgaggagtgcaacctgaacctgcccgtgtgggaccccagagtgaaccccagcgacagataccacctgatgcccatcatcacccccgcctacccccagcagaacagcacctacaacgtgagcgtgagcaccagaatggtgatggtggaggagttcaagcagggcctggccatcaccgacgagatcctgctgagcaaggccgagtggagcaagctgttcgaggcccccaacttcttccagaagtacaagcactacatcgtgctgctggccagcgcccccaccgagaagcagagactggagtgggtgggcctggtggagagcaagatcagaatcctggtgggcagcctggagaagaacgagttcatcaccctggcccacgtgaacccccagagcttccccgcccccaaggagaaccccgacaaggaggagttcagaaccatgtgggtgatcggcctggtgttcaagaagaccgagaacagcgagaacctgagcgtggacctgacctacgacatccagagcttcaccgacaccgtgtacagacaggccatcaacagcaagatgttcgaggtggacatgaagatcgccgccatgcacgtgaagagaaagcagctgcaccagctgctgcccaaccacgtgctgcagaagaagaagaagcacagcaccgagggcgtgaagctgaccgccctgaacgacagcagcctggacctgagcatggacagcgacaacagcatgagcgtgcccagccccaccagcgccaccaagaccagccccctgaacagcagcggcagcagccagggcagaaacagccccgcccccgccgtgaccgccgccagcgtgaccaacatccaggccaccgaggtgagcgtgccccaggtgaacagcagcgagagcagcggcggcaccagcagcgagagcatcccccagaccgccacccagcccgccatcagccccccccccaagcccaccgtgagcagagtggtgagcagcaccagactggtgaaccccccccccagaagcagcggcaacgccgccaccagcggcaacgccgccaccaagatccccacccccatcgtgggcgtgaagagaaccagcagcccccacaaggaggagagccccaagaagaccaagaccgaggaggagcagctggacaccgagaccagcaccacccagagcgagaccatccagaccgccgccagcctgctggccagccagaagaccagcagcaccgacctgagcgacatccccgccctgcccgccaaccccatccccgtgatcaagaacagcatcaagctgagactgaacagatag

SEQ ID NO: 93752 - DNA, 858 bp, Artificial Sequence
  Description of Artificial Sequence: Synthetic coding sequence
atgcccttccccgtgaccacccagggcagccagcagacccagcccccccagaagcactacggcatcaccagccccatcagcctggccgcccccaaggagaccgactgcgtgctgacccagaagctgatcgagaccctgaagcccttcggcgtgttcgaggaggaggaggagctgcagagaagaatcctgatcctgggcaagctgaacaacctggtgaaggagtggatcagagagatcagcgagagcaagaacctgccccagagcgtgatcgagaacgtgggcggcaagatcttcaccttcggcagctacagactgggcgtgcacaccaagggcgccgacatcgacgccctgtgcgtggcccccagacacgtggacagaagcgacttcttcaccagcttctacgacaagctgaagctgcaggaggaggtgaaggacctgagagccgtggaggaggccttcgtgcccgtgatcaagctgtgcttcgacggcatcgagatcgacatcctgttcgccagactggccctgcagaccatccccgaggacctggacctgagagacgacagcctgctgaagaacctggacatcagatgcatcagaagcctgaacggctgcagagtgaccgacgagatcctgcacctggtgcccaacatcgacaacttcagactgaccctgagagccatcaagctgtgggccaagagacacaacatctacagcaacatcctgggcttcctgggcggcgtgagctgggccatgctggtggccagaacctgccagctgtaccccaacgccatcgccagcaccctggtgcacaagttcttcctggtgttcagcaagtggtacgtgttcagactgtactag

SEQ ID NO: 93753 - DNA, 1911 bp, Artificial Sequence
  Description of Artificial Sequence: Synthetic coding sequence
atgcccttccccgtgaccacccagggccccccccagcccgcccccccccccaacagatacggcgtgagcagccccatcagcctggccgtgcccaaggagaccgactgcctgctgacccagagactgatcgagaccctgagacccttcggcgtgttcgaggaggaggaggagctgcagagaagaatcctggtgctggagaagctgaacaacctggtgaaggagtggatcagagagatcagcgagagcaagagcctgccccagagcgtgatcgagaacgtgggcggcaagatcttcaccttcggcagctacagactgggcgtgcacaccaagggcgccgacatcgacgccctgtgcgtggcccccagccacgtggacagaagcgacttcttcaccagcttctacgccaagctgaagctgcaggaggaggtgaaggacctgagagccgtggaggaggccttcgtgcccgtgatcaagctgtgcttcgacggcatcgagatcgacatcctgttcgccagactggccctgcagaccatccccgaggacctggacctgagagacgacagcctgctgaagaacctggacatcagatgcatcagaagcctgaacggctgcagagtgaccgacgagatcctgcacctggtgcccaacatcgacaacttcagactgaccctgagagccatcaagctgtgggccaagtgccacaacatctacagcaacatcctgggcttcctgggcggcgtgagctgggccatgctggtggccagaacctgccagctgtaccccaacgccgtggccagcaccctggtgagaaagttcttcctggtgttcagcgagtgggagtggcccaaccccgtgctgctgaaggagcccgaggagagaaacctgaacctgcccgtgtgggaccccagagtgaaccccagcgacagataccacctgatgcccatcatcacccccgcctacccccagcagaacagcacctacaacgtgagcatcagcaccagaatggtgatgatcgaggagttcaagcagggcctggccatcacccacgagatcctgctgagcaaggccgagtggagcaagctgttcgaggcccccagcttcttccagaagtacaagcactacatcgtgctgctggccagcgccagcaccgagaagcagcacctggagtgggtgggcctggtggagagcaagatcagaatcctggtgggcagcctggagaagaacgagttcatcaccctggcccacgtgaacccccagagcttccccgcccccaaggagaaccccgacatggaggagttcagaaccatgtgggtgatcggcctgggcctgaagaagcccgacaacagcgagatcctgagcatcgacctgacctacgacatccagagcttcaccgacaccgtgtacagacaggccgtgaacagcaagatgttcgagatgggcatgaagatcaccgccatgcacctgagaagaaaggagctgcaccagctgctgccccaccacgtgctgcaggacaagaaggcccacagcaccgagggcagaagactgaccgacctgaacgacagcagcttcgacctgagcgccggctgcgagaacagcatgagcgtgcccagcagcaccagcaccatgaagaccggccccctgatcagcagcagccagggcagaaacagccccgccctggccgtgatgaccgccagcgtggccaacatccaggccaccgagttcagcctgcagcaggtgaacaccaacgagagcagcggcgtggccctgaacgagagcatcccccacgccgtgagccagcccgccatcagccccagccccaaggccatggtggccagagtggtgagcagcacctgcctgatcagccaccccgacctgcaggagacccagcagcagacctacctgatcctgtag

SEQ ID NO: 93754 - DNA, 1737 bp, Artificial Sequence
  Description of Artificial Sequence: Synthetic coding sequence
atggacttcctgctgttccagttcggcctgtgcaccttcaagtacgactacaccgacagcaagtacatcaccaagagcttcaacttctacgtgttccccaagcccttcaacagaagcagccccgacgtgaagttcgtgtgccagagcagcagcatcgacttcctggccagccagggcttcgacttcaacaaggtgttcagaaacggcatcccctacctgaaccaggaggaggagagacagctgagagagcagtacgacgagaagagaagccaggccaacggcgccggcgccctgagctacgtgagccccaacaccagcaagtgccccgtgaccatccccgaggaccagaagaagttcatcgaccaggtggtggagaagatcgaggacctgctgcagagcgaggagaacaagaacctggacctggagccctgcaccggcttccagagaaagctgatctaccagaccctgagctggaagtaccccaagggcatccacgtggagaccctggagaccgagaagaaggagagatacatcgtgatcagcaaggtggacgaggaggagagaaagagaagagagcagcagaagcacgccaaggagcaggaggagctgaacgacgccgtgggcttcagcagagtgatccacgccatcgccaacagcggcaagctggtgatcggccacaacatgctgctggacgtgatgcacaccgtgcaccagttctactgccccctgcccgccgacctgagcgagttcaaggagatgaccacctgcgtgttccccagactgctggacaccaagctgatggccagcacccagcccttcaaggacatcatcaacaacaccagcctggccgagctggagaagagactgaaggagacccccttcaacccccccaaggtggagagcgccgagggcttccccagctacgacaccgccagcgagcagctgcacgaggccggctacgacgcctacatcaccggcctgtgcttcatcagcatggccaactacctgggcagcttcctgagcccccccaagatccacgtgagcgccagaagcaagctgatcgagcccttcttcaacaagctgttcctgatgagagtgatggacatcccctacctgaacctggagggccccgacctgcagcccaagagagaccacgtgctgcacgtgaccttccccaaggagtggaagaccagcgacctgtaccagctgttcagcgccttcggcaacatccagatcagctggatcgacgacaccagcgccttcgtgagcctgagccagcccgagcaggtgaagatcgccgtgaacaccagcaagtacgccgagagctacagaatccagacctacgccgagtacatgggcagaaagcaggaggagaagcagatcaagagaaagtggaccgaggacagctggaaggaggccgacagcaagagactgaacccccagtgcatcccctacaccctgcagaaccactactacagaaacaacagcttcaccgcccccagcaccgtgggcaagagaaacctgagccccagccaggaggaggccggcctggaggacggcgtgagcggcgagatcagcgacaccgagctggagcagaccgacagctgcgccgagcccctgagcgagggcagaaagaaggccaagaagctgaagagaatgaagaaggagctgagccccgccggcagcatcagcaagaacagccccgccaccctgttcgaggtgcccgacacctggtag

SEQ ID NO: 93755 - DNA, 1782 bp, Artificial Sequence
  Description of Artificial Sequence: Synthetic coding sequence
atggagatcatcagaagcaacttcaagagcaacctgcacaaggtgtaccaggccatcgaggaggccgacttcttcgccatcgacggcgagttcagcggcatcagcgacggccccagcgtgagcgccctgaccaacggcttcgacacccccgaggagagaagcagccccgacgtgaagttcgtgtgccagagcagcagcatcgacttcctggccagccagggcttcgacttcaacaaggtgttcagaaacggcatcccctacctgaaccaggaggaggagagacagctgagagagcagtacgacgagaagagaagccaggccaacggcgccggcgccctgagctacgtgagccccaacaccagcaagtgccccgtgaccatccccgaggaccagaagaagttcatcgaccaggtggtggagaagatcgaggacctgctgcagagcgaggagaacaagaacctggacctggagccctgcaccggcttccagagaaagctgatctaccagaccctgagctggaagtaccccaagggcatccacgtggagaccctggagaccgagaagaaggagagatacatcgtgatcagcaaggtggacgaggaggagagaaagagaagagagcagcagaagcacgccaaggagcaggaggagctgaacgacgccgtgggcttcagcagagtgatccacgccatcgccaacagcggcaagctggtgatcggccacaacatgctgctggacgtgatgcacaccgtgcaccagttctactgccccctgcccgccgacctgagcgagttcaaggagatgaccacctgcgtgttccccagactgctggacaccaagctgatggccagcacccagcccttcaaggacatcatcaacaacaccagcctggccgagctggagaagagactgaaggagacccccttcaacccccccaaggtggagagcgccgagggcttccccagctacgacaccgccagcgagcagctgcacgaggccggctacgacgcctacatcaccggcctgtgcttcatcagcatggccaactacctgggcagcttcctgagcccccccaagatccacgtgagcgccagaagcaagctgatcgagcccttcttcaacaagctgttcctgatgagagtgatggacatcccctacctgaacctggagggccccgacctgcagcccaagagagaccacgtgctgcacgtgaccttccccaaggagtggaagaccagcgacctgtaccagctgttcagcgccttcggcaacatccagatcagctggatcgacgacaccagcgccttcgtgagcctgagccagcccgagcaggtgaagatcgccgtgaacaccagcaagtacgccgagagctacagaatccagacctacgccgagtacatgggcagaaagcaggaggagaagcagatcaagagaaagtggaccgaggacagctggaaggaggccgacagcaagagactgaacccccagtgcatcccctacaccctgcagaaccactactacagaaacaacagcttcaccgcccccagcaccgtgggcaagagaaacctgagccccagccaggaggaggccggcctggaggacggcgtgagcggcgagatcagcgacaccgagctggagcagaccgacagctgcgccgagcccctgagcgagggcagaaagaaggccaagaagctgaagagaatgaagaaggagctgagccccgccggcagcatcagcaagaacagccccgccaccctgttcgaggtgcccgacacctggtag

SEQ ID NO: 93756 - DNA, 1920 bp, Artificial Sequence
  Description of Artificial Sequence: Synthetic coding sequence
atggagatcatcagaagcaacttcaagagcaacctgcacaaggtgtaccaggccatcgaggaggccgacttcttcgccatcgacggcgagttcagcggcatcagcgacggccccagcgtgagcgccctgaccaacggcttcgacacccccgaggagagataccagaagctgaagaagcacagcatggacttcctgctgttccagttcggcctgtgcaccttcaagtacgactacaccgacagcaagtacatcaccaagagcttcaacttctacgtgttccccaagcccttcaacagaagcagccccgacgtgaagttcgtgtgccagagcagcagcatcgacttcctggccagccagggcttcgacttcaacaaggtgttcagaaacggcatcccctacctgaaccaggaggaggagagacagctgagagagcagtacgacgagaagagaagccaggccaacggcgccggcgccctgagctacgtgagccccaacaccagcaagtgccccgtgaccatccccgaggaccagaagaagttcatcgaccaggtggtggagaagatcgaggacctgctgcagagcgaggagaacaagaacctggacctggagccctgcaccggcttccagagaaagctgatctaccagaccctgagctggaagtaccccaagggcatccacgtggagaccctggagaccgagaagaaggagagatacatcgtgatcagcaaggtggacgaggaggagagaaagagaagagagcagcagaagcacgccaaggagcaggaggagctgaacgacgccgtgggcttcagcagagtgatccacgccatcgccaacagcggcaagctggtgatcggccacaacatgctgctggacgtgatgcacaccgtgcaccagttctactgccccctgcccgccgacctgagcgagttcaaggagatgaccacctgcgtgttccccagactgctggacaccaagctgatggccagcacccagcccttcaaggacatcatcaacaacaccagcctggccgagctggagaagagactgaaggagacccccttcaacccccccaaggtggagagcgccgagggcttccccagctacgacaccgccagcgagcagctgcacgaggccggctacgacgcctacatcaccggcctgtgcttcatcagcatggccaactacctgggcagcttcctgagcccccccaagatccacgtgagcgccagaagcaagctgatcgagcccttcttcaacaagctgttcctgatgagagtgatggacatcccctacctgaacctggagggccccgacctgcagcccaagagagaccacgtgctgcacgtgaccttccccaaggagtggaagaccagcgacctgtaccagctgttcagcgccttcggcaacatccagatcagctggatcgacgacaccagcgccttcgtgagcctgagccagcccgagcaggtgaagatcgccgtgaacaccagcaagtacgccgagagctacagaatccagacctacgccgagtacatgggcagaaagcaggaggagaagcagatcaagagaaagtggaccgaggacagctggaaggaggccgacagcaagagactgaacccccagtgcatcccctacaccctgcagaaccactactacagaaacaacagcttcaccgcccccagcaccgtgggcaagagaaacctgagccccagccaggaggaggccggcctggaggacggcgtgagcggcgagatcagcgacaccgagctggagcagaccgacagctgcgccgagcccctgagcgagggcagaaagaaggccaagaagctgaagagaatgaagaaggagctgagccccgccggcagcatcagcaagaacagccccgccaccctgttcgaggtgcccgacacctggtag

SEQ ID NO: 93757 - DNA, 624 bp, Artificial Sequence
  Description of Artificial Sequence: Synthetic coding sequence
atggagatcatcagaagcaacttcaagagcaacctgcacaaggtgtaccaggccatcgaggaggccgacttcttcgccatcgacggcgagttcagcggcatcagcgacggccccagcgtgagcgccctgaccaacggcttcgacacccccgaggagagataccagaagctgaagaagcacagcatggacttcctgctgttccagttcggcctgtgcaccttcaagtacgactacaccgacagcaagagcagccccgacgtgaagttcgtgtgccagagcagcagcatcgacttcctggccagccagggcttcgacttcaacaaggtgttcagaaacggcatcccctacctgaaccaggaggaggagagacagctgagagagcagtacgacgagaagagaagccaggccaacggcgccggcgccctgagctacgtgagccccaacaccagcaagtgccccgtgaccatccccgaggaccagaagaagttcatcgaccaggtggtggagaagatcgaggacctgctgcagagcgaggagaacaagaacctggacctggagccctgcaccggcttccagagaaagctgatctaccagaccctgagctggaagagaagcgacatctag

SEQ ID NO: 93758 - DNA, 1395 bp, Artificial Sequence
  Description of Artificial Sequence: Synthetic coding sequence
atggagatcatcagaagcaacttcaagagcaacctgcacaaggtgtaccaggccatcgaggaggccgacttcttcgccatcgacggcgagttcagcggcatcagcgacggccccagcgtgagcgccctgaccaacggcttcgacacccccgaggagagataccagaagctgaagaagaaggagagatacatcgtgatcagcaaggtggacgaggaggagagaaagagaagagagcagcagaagcacgccaaggagcaggaggagctgaacgacgccgtgggcttcagcagagtgatccacgccatcgccaacagcggcaagctggtgatcggccacaacatgctgctggacgtgatgcacaccgtgcaccagttctactgccccctgcccgccgacctgagcgagttcaaggagatgaccacctgcgtgttccccagactgctggacaccaagctgatggccagcacccagcccttcaaggacatcatcaacaacaccagcctggccgagctggagaagagactgaaggagacccccttcaacccccccaaggtggagagcgccgagggcttccccagctacgacaccgccagcgagcagctgcacgaggccggctacgacgcctacatcaccggcctgtgcttcatcagcatggccaactacctgggcagcttcctgagcccccccaagatccacgtgagcgccagaagcaagctgatcgagcccttcttcaacaagctgttcctgatgagagtgatggacatcccctacctgaacctggagggccccgacctgcagcccaagagagaccacgtgctgcacgtgaccttccccaaggagtggaagaccagcgacctgtaccagctgttcagcgccttcggcaacatccagatcagctggatcgacgacaccagcgccttcgtgagcctgagccagcccgagcaggtgaagatcgccgtgaacaccagcaagtacgccgagagctacagaatccagacctacgccgagtacatgggcagaaagcaggaggagaagcagatcaagagaaagtggaccgaggacagctggaaggaggccgacagcaagagactgaacccccagtgcatcccctacaccctgcagaaccactactacagaaacaacagcttcaccgcccccagcaccgtgggcaagagaaacctgagccccagccaggaggaggccggcctggaggacggcgtgagcggcgagatcagcgacaccgagctggagcagaccgacagctgcgccgagcccctgagcgagggcagaaagaaggccaagaagctgaagagaatgaagaaggagctgagccccgccggcagcatcagcaagaacagccccgccaccctgttcgaggtgcccgacacctggtag

SEQ ID NO: 93759 - DNA, 1071 bp, Artificial Sequence
  Description of Artificial Sequence: Synthetic coding sequence
atggacgccggcgtgaccgagagcggcctgaacgtgaccctgaccatcagactgctgatgcacggcaaggaggtgggcagcatcatcggcaagaagggcgagagcgtgaagagaatcagagaggagagcggcgccagaatcaacatcagcgagggcaactgccccgagagaatcatcaccctgaccggccccaccaacgccatcttcaaggccttcgccatgatcatcgacaagctggaggaggacatcaacagcagcatgaccaacagcaccgccgccagcagaccccccgtgaccctgagactggtggtgcccgccacccagtgcggcagcctgatcggcaagggcggctgcaagatcaaggagatcagagagagcaccggcgcccaggtgcaggtggccggcgacatgctgcccaacagcaccgagagagccatcaccatcgccggcgtgccccagagcgtgaccgagtgcgtgaagcagatctgcctggtgatgctggagaccctgagccagagcccccagggcagagtgatgaccatcccctaccagcccatgcccgccagcagccccgtgatctgcgccggcggccaggacagatgcagcgacgccgccggctacccccacgccacccacgacctggagggcccccccctggacgcctacagcatccagggccagcacaccatcagccccctggacctggccaagctgaaccaggtggccagacagcagagccacttcgccatgatgcacggcggcaccggcttcgccggcatcgacagcagcagccccgaggtgaagggctactgggccagcctggacgccagcacccagaccacccacgagctgaccatccccaacaacctgatcggctgcatcatcggcagacagggcgccaacatcaacgagatcagacagatgagcggcgcccagatcaagatcgccaaccccgtggagggcagcagcggcagacaggtgaccatcaccggcagcgccgccagcatcagcctggcccagtacctgatcaacgccagactgagcagcgagaagggcatgggctgcagctag

SEQ ID NO: 93760 - DNA, 957 bp, Artificial Sequence
  Description of Artificial Sequence: Synthetic coding sequence
atggacaccggcgtgatcgagggcggcctgaacgtgaccctgaccatcagactgctgatgcacggcaaggaggtgggcagcatcatcggcaagaagggcgagagcgtgaagaagatgagagaggagagcggcgccagaatcaacatcagcgagggcaactgccccgagagaatcatcaccctggccggccccaccaacgccatcttcaaggccttcgccatgatcatcgacaagctggaggaggacatcagcagcagcatgaccaacagcaccgccgccagcagaccccccgtgaccctgagactggtggtgcccgccagccagtgcggcagcctgatcggcaagggcggctgcaagatcaaggagatcagagagagcaccggcgcccaggtgcaggtggccggcgacatgctgcccaacagcaccgagagagccatcaccatcgccggcatcccccagagcatcatcgagtgcgtgaagcagatctgcgtggtgatgctggagagcccccccaagggcgtgaccatcccctacagacccaagcccagcagcagccccgtgatcttcgccggcggccaggcctacaccatccagggccagtacgccatcccccagcccgacctgaccaagctgcaccagctggccatgcagcagagccacttccccatgacccacggcaacaccggcttcagcgccggcctggacgccagcgcccagaccaccagccacgagctgaccatccccaacgacctgatcggctgcatcatcggcagacagggcgccaagatcaacgagatcagacagatgagcggcgcccagatcaagatcgccaaccccgtggagggcagcaccgacagacaggtgaccatcaccggcagcgccgccagcatcagcctggcccagtacctgatcaacgtgagactgagcagcgagaccggcggcatgggcagcagctag

SEQ ID NO: 93761 - DNA, 1098 bp, Artificial Sequence
  Description of Artificial Sequence: Synthetic coding sequence
atggacaccggcgtgatcgagggcggcctgaacgtgaccctgaccatcagactgctgatgcacggcaaggaggtgggcagcatcatcggcaagaagggcgagagcgtgaagaagatgagagaggagagcggcgccagaatcaacatcagcgagggcaactgccccgagagaatcatcaccctggccggccccaccaacgccatcttcaaggccttcgccatgatcatcgacaagctggaggaggacatcagcagcagcatgaccaacagcaccgccgccagcagaccccccgtgaccctgagactggtggtgcccgccagccagtgcggcagcctgatcggcaagggcggctgcaagatcaaggagatcagagagagcaccggcgcccaggtgcaggtggccggcgacatgctgcccaacagcaccgagagagccatcaccatcgccggcatcccccagagcatcatcgagtgcgtgaagcagatctgcgtggtgatgctggagaccctgagccagagcccccccaagggcgtgaccatcccctacagacccaagcccagcagcagccccgtgatcttcgccggcggccaggacagatacagcaccggcagcgacagcgccagcttcccccacaccacccccagcatgtgcctgaaccccgacctggagggcccccccctggaggcctacaccatccagggccagtacgccatcccccagcccgacctgaccaagctgcaccagctggccatgcagcagagccacttccccatgacccacggcaacaccggcttcagcggcatcgagagcagcagccccgaggtgaagggctactggggcctggacgccagcgcccagaccaccagccacgagctgaccatccccaacgacctgatcggctgcatcatcggcagacagggcgccaagatcaacgagatcagacagatgagcggcgcccagatcaagatcgccaaccccgtggagggcagcaccgacagacaggtgaccatcaccggcagcgccgccagcatcagcctggcccagtacctgatcaacgtgagactgagcagcgagaccggcggcatgggcagcagctag

SEQ ID NO: 93762 - DNA, 1008 bp, Artificial Sequence
  Description of Artificial Sequence: Synthetic coding sequence
atggacaccggcgtgatcgagggcggcctgaacgtgaccctgaccatcagactgctgatgcacggcaaggaggtgggcagcatcatcggcaagaagggcgagagcgtgaagaagatgagagaggagagcggcgccagaatcaacatcagcgagggcaactgccccgagagaatcatcaccctggccggccccaccaacgccatcttcaaggccttcgccatgatcatcgacaagctggaggaggacatcagcagcagcatgaccaacagcaccgccgccagcagaccccccgtgaccctgagactggtggtgcccgccagccagtgcggcagcctgatcggcaagggcggctgcaagatcaaggagatcagagagagcaccggcgcccaggtgcaggtggccggcgacatgctgcccaacagcaccgagagagccatcaccatcgccggcatcccccagagcatcatcgagtgcgtgaagcagatctgcgtggtgatgctggagaccctgagccagagcccccccaagggcgtgaccatcccctacagacccaagcccagcagcagccccgtgatcttcgccggcggccaggcctacaccatccagggccagtacgccatcccccagcccgacctgaccaagctgcaccagctggccatgcagcagagccacttccccatgacccacggcaacaccggcttcagcggcatcgagagcagcagccccgaggtgaagggctactgggccggcctggacgccagcgcccagaccaccagccacgagctgaccatccccaacgacctgatcggctgcatcatcggcagacagggcgccaagatcaacgagatcagacagatgagcggcgcccagatcaagatcgccaaccccgtggagggcagcaccgacagacaggtgaccatcaccggcagcgccgccagcatcagcctggcccagtacctgatcaacgtgagactgagcagcgagaccggcggcatgggcagcagctag

SEQ ID NO: 93763 - DNA, 906 bp, Artificial Sequence
  Description of Artificial Sequence: Synthetic coding sequence
atggacaccggcgtgatcgagggcggcctgaacgtgaccctgaccatcagactgctgatgcacggcaaggaggtgggcagcatcatcggcaagaagggcgagagcgtgaagaagatgagagaggagagcggcgccagaatcaacatcagcgagggcaactgccccgagagaatcatcaccctggccggccccaccaacgccatcttcaaggccttcgccatgatcatcgacaagctggaggaggacatcagcagcagcatgaccaacagcaccgccgccagcagaccccccgtgaccctgagactggtggtgcccgccagccagtgcggcagcctgatcggcaagggcggctgcaagatcaaggagatcagagagagcaccggcgcccaggtgcaggtggccggcgacatgctgcccaacagcaccgagagagccatcaccatcgccggcatcccccagagcatcatcgagtgcgtgaagcagatctgcgtggtgatgctggagagcccccccaagggcgtgaccatcccctacagacccaagcccagcagcagccccgtgatcttcgccggcggccaggacagatacagcaccggcagcgacagcgccagcttcccccacaccacccccagcatgtgcctgaaccccgacctggagggcccccccctggaggcctacaccatccagggccagtacgccatcccccagcccgacctgaccaagctgcaccagctggccatgcagcagagccacttccccatgacccacggcaacaccggcttcagcggcatggacaccagcgtgttcatcagcgtgagatgcagcgccagagagagacccgtgcccagaagccagctggacatctgcctgaagcagaccagcctgagcagcatcctgctggtgtag

SEQ ID NO: 93764 - DNA, 1089 bp, Artificial Sequence
  Description of Artificial Sequence: Synthetic coding sequence
atggacaccggcgtgatcgagggcggcctgaacgtgaccctgaccatcagactgctgatgcacggcaaggaggtgggcagcatcatcggcaagaagggcgagagcgtgaagaagatgagagaggagagcggcgccagaatcaacatcagcgagggcaactgccccgagagaatcatcaccctggccggccccaccaacgccatcttcaaggccttcgccatgatcatcgacaagctggaggaggacatcagcagcagcatgaccaacagcaccgccgccagcagaccccccgtgaccctgagactggtggtgcccgccagccagtgcggcagcctgatcggcaagggcggctgcaagatcaaggagatcagagagagcaccggcgcccaggtgcaggtggccggcgacatgctgcccaacagcaccgagagagccatcaccatcgccggcatcccccagagcatcatcgagtgcgtgaagcagatctgcgtggtgatgctggagagcccccccaagggcgtgaccatcccctacagacccaagcccagcagcagccccgtgatcttcgccggcggccaggacagatacagcaccggcagcgacagcgccagcttcccccacaccacccccagcatgtgcctgaaccccgacctggagggcccccccctggaggcctacaccatccagggccagtacgccatcccccagcccgacctgaccaagctgcaccagctggccatgcagcagagccacttccccatgacccacggcaacaccggcttcagcggcatcgagagcagcagccccgaggtgaagggctactgggccggcctggacgccagcgcccagaccaccagccacgagctgaccatccccaacgacctgatcggctgcatcatcggcagacagggcgccaagatcaacgagatcagacagatgagcggcgcccagatcaagatcgccaaccccgtggagggcagcaccgacagacaggtgaccatcaccggcagcgccgccagcatcagcctggcccagtacctgatcaacgtgagactgagcagcgagaccggcggcatgggcagcagctag

SEQ ID NO: 93765 - DNA, 996 bp, Artificial Sequence
  Description of Artificial Sequence: Synthetic coding sequence
atggacaccggcgtgatcgagggcggcctgaacgtgaccctgaccatcagactgctgatgcacggcaaggaggtgggcagcatcatcggcaagaagggcgagagcgtgaagaagatgagagaggagagcggcgccagaatcaacatcagcgagggcaactgccccgagagaatcatcaccctggccggccccaccaacgccatcttcaaggccttcgccatgatcatcgacaagctggaggaggacatcagcagcagcatgaccaacagcaccgccgccagcagaccccccgtgaccctgagactggtggtgcccgccagccagtgcggcagcctgatcggcaagggcggctgcaagatcaaggagatcagagagagcaccggcgcccaggtgcaggtggccggcgacatgctgcccaacagcaccgagagagccatcaccatcgccggcatcccccagagcatcatcgagtgcgtgaagcagatctgcgtggtgatgctggagagcccccccaagggcgtgaccatcccctacagacccaagcccagcagcagccccgtgatcttcgccggcggccaggcctacaccatccagggccagtacgccatcccccagcccgacctgaccaagctgcaccagctggccatgcagcagagccacttccccatgacccacggcaacaccggcttcagcggcatcgagagcagcagccccgaggtgaagggctactgggccggcctggacgccagcgcccagaccaccagccacgagctgaccatccccaacgacctgatcggctgcatcatcggcagacagggcgccaagatcaacgagatcagacagatgagcggcgcccagatcaagatcgccaaccccgtggagggcagcaccgacagacaggtgaccatcaccggcagcgccgccagcatcagcctggcccagtacctgatcaacgtgagactgagcagcgagaccggcggcatgggcagcagctag

SEQ ID NO: 93766 - DNA, 1101 bp, Artificial Sequence
  Description of Artificial Sequence: Synthetic coding sequence
atggacaccggcgtgatcgagggcggcctgaacgtgaccctgaccatcagactgctgatgcacggcaaggaggtgggcagcatcatcggcaagaagggcgagagcgtgaagaagatgagagaggagagcggcgccagaatcaacatcagcgagggcaactgccccgagagaatcatcaccctggccggccccaccaacgccatcttcaaggccttcgccatgatcatcgacaagctggaggaggacatcagcagcagcatgaccaacagcaccgccgccagcagaccccccgtgaccctgagactggtggtgcccgccagccagtgcggcagcctgatcggcaagggcggctgcaagatcaaggagatcagagagagcaccggcgcccaggtgcaggtggccggcgacatgctgcccaacagcaccgagagagccatcaccatcgccggcatcccccagagcatcatcgagtgcgtgaagcagatctgcgtggtgatgctggagaccctgagccagagcccccccaagggcgtgaccatcccctacagacccaagcccagcagcagccccgtgatcttcgccggcggccaggacagatacagcaccggcagcgacagcgccagcttcccccacaccacccccagcatgtgcctgaaccccgacctggagggcccccccctggaggcctacaccatccagggccagtacgccatcccccagcccgacctgaccaagctgcaccagctggccatgcagcagagccacttccccatgacccacggcaacaccggcttcagcggcatcgagagcagcagccccgaggtgaagggctactgggccggcctggacgccagcgcccagaccaccagccacgagctgaccatccccaacgacctgatcggctgcatcatcggcagacagggcgccaagatcaacgagatcagacagatgagcggcgcccagatcaagatcgccaaccccgtggagggcagcaccgacagacaggtgaccatcaccggcagcgccgccagcatcagcctggcccagtacctgatcaacgtgagactgagcagcgagaccggcggcatgggcagcagctag

SEQ ID NO: 93767 - DNA, 1086 bp, Artificial Sequence
  Description of Artificial Sequence: Synthetic coding sequence
atggacaccggcgtgatcgagggcggcctgaacgtgaccctgaccatcagactgctgatgcacggcaaggaggtgggcagcatcatcggcaagaagggcgagagcgtgaagaagatgagagaggagagcggcgccagaatcaacatcagcgagggcaactgccccgagagaatcatcaccctggccggccccaccaacgccatcttcaaggccttcgccatgatcatcgacaagctggaggaggacatcagcagcagcatgaccaacagcaccgccgccagcagaccccccgtgaccctgagactggtggtgcccgccagccagtgcggcagcctgatcggcaagggcggctgcaagatcaaggagatcagagagagcaccggcgcccaggtgcaggtggccggcgacatgctgcccaacagcaccgagagagccatcaccatcgccggcatcccccagagcatcatcgagtgcgtgaagcagatctgcgtggtgatgctggagagcccccccaagggcgtgaccatcccctacagacccaagcccagcagcagccccgtgatcttcgccggcggccaggacagatacagcaccggcagcgacagcgccagcttcccccacaccacccccagcatgtgcctgaaccccgacctggagggcccccccctggaggcctacaccatccagggccagtacgccatcccccagcccgacctgaccaagctgcaccagctggccatgcagcagagccacttccccatgacccacggcaacaccggcttcagcggcatcgagagcagcagccccgaggtgaagggctactggggcctggacgccagcgcccagaccaccagccacgagctgaccatccccaacgacctgatcggctgcatcatcggcagacagggcgccaagatcaacgagatcagacagatgagcggcgcccagatcaagatcgccaaccccgtggagggcagcaccgacagacaggtgaccatcaccggcagcgccgccagcatcagcctggcccagtacctgatcaacgtgagactgagcagcgagaccggcggcatgggcagcagctag

SEQ ID NO: 93768 - DNA, 1056 bp, Artificial Sequence
  Description of Artificial Sequence: Synthetic coding sequence
ctgagccccggcgacgccttctgggcccccagcgtgctgccccacagcaccctgagcaccctgagccaccacccccagccccagttcggcagaagaatggagagcaaggtgagcgagggcggcctgaacgtgaccctgaccatcagactgctgatgcacggcaaggtgagaggcgccgccatcgtgagcaagggcgagaccgtgaagaagatgagagaggagagcggcgccagaatcaacatcagcgagggcaactgccccgagagaatcgtgaccatcaccggccccaccgacgccatcttcaaggccttcgccatgatcgcctacaagttcgaggaggacatcatcaacagcatgagcaacagccccgccaccagcaagccccccgtgaccctgagactggtggtgcccgccagccagtgcggcagcctgatcggcaagggcggcagcaagatcaaggagatcagagagagcaccggcgcccaggtgcaggtggccggcgacatgctgcccaacagcaccgagagagccgtgaccatcagcggcacccccgacgccatcatccagtgcgtgaagcagatctgcgtggtgatgctggagagcccccccaagggcgccaccatcccctacagacccaagcccgccagcacccccgtgatcttcgccggcggccaggcctacaccatccagggccagtacgccatcccccaccccgaccagctgaccaagctgcaccagctggccatgcagcagacccccttcccccccctgggccagaccaaccccgccttccccggcctggacgccagcccccccgccagcacccacgagctgaccatccccaacgacctgatcggctgcatcatcggcagacagggcaccaagatcaacgagatcagacagatgagcggcgcccagatcaagatcgccaacgccaccgagggcagcagcgagagacagatcaccatcaccggcacccccgccaacatcagcctggcccagtacctgatcaacgccagactgaccagcgaggtgaccggcatgggcaccctgtag

SEQ ID NO: 93769 - DNA, 969 bp, Artificial Sequence
  Description of Artificial Sequence: Synthetic coding sequence
ccccagccccagttcggcagaagaatggagagcaaggtgagcgagggcggcctgaacgtgaccctgaccatcagactgctgatgcacggcaaggaggtgggcagcatcatcggcaagaagggcgagaccgtgaagaagatgagagaggagagcggcgccagaatcaacatcagcgagggcaactgccccgagagaatcgtgaccatcaccggccccaccgacgccatcttcaaggccttcgccatgatcgcctacaagttcgaggaggacatcatcaacagcatgagcaacagccccgccaccagcaagccccccgtgaccctgagactggtggtgcccgccagccagtgcggcagcctgatcggcaagggcggcagcaagatcaaggagatcagagagagcaccggcgcccaggtgcaggtggccggcgacatgctgcccaacagcaccgagagagccgtgaccatcagcggcacccccgacgccatcatccagtgcgtgaagcagatctgcgtggtgatgctggaggcctacaccatccagggccagtacgccatcccccaccccgaccagctgaccaagctgcaccagctggccatgcagcagacccccttcccccccctgggccagaccaaccccgccttccccggcgagaagctgcccctgcacagcagcgaggaggcccagaacctgatgggccagagcagcggcctggacgccagcccccccgccagcacccacgagctgaccatccccaacgacctgatcggctgcatcatcggcagacagggcaccaagatcaacgagatcagacagatgagcggcgcccagatcaagatcgccaacgccaccgagggcagcagcgagagacagatcaccatcaccggcacccccgccaacatcagcctggcccagtacctgatcaacgccagactgaccagcgaggtgaccggcatgggcaccctgtag

SEQ ID NO: 93770 - DNA, 1038 bp, Artificial Sequence
  Description of Artificial Sequence: Synthetic coding sequence
atgggcgagggcgacgccttctgggcccccagcgtgctgccccacagcaccctgagcaccctgagccaccacccccagccccagttcggcagaagaatggagagcaaggtgagcgagggcggcctgaacgtgaccctgaccatcagactgctgatgcacggcaaggaggtgggcagcatcatcggcaagaagggcgagaccgtgaagaagatgagagaggagagcggcgccagaatcaacatcagcgagggcaactgccccgagagaatcgtgaccatcaccggccccaccgacgccatcttcaaggccttcgccatgatcgcctacaagttcgaggaggacatcatcaacagcatgagcaacagccccgccaccagcaagccccccgtgaccctgagactggtggtgcccgccagccagtgcggcagcctgatcggcaagggcggcagcaagatcaaggagatcagagagagcaccggcgcccaggtgcaggtggccggcgacatgctgcccaacagcaccgagagagccgtgaccatcagcggcacccccgacgccatcatccagtgcgtgaagcagatctgcgtggtgatgctggaggcctacaccatccagggccagtacgccatcccccaccccgacctgaccaagctgcaccagctggccatgcagcagacccccttcccccccctgggccagaccaaccccgccttccccggcgagaagctgcccctgcacagcagcgaggaggcccagaacctgatgggccagagcagcggcctggacgccagcccccccgccagcacccacgagctgaccatccccaacgacctgatcggctgcatcatcggcagacagggcaccaagatcaacgagatcagacagatgagcggcgcccagatcaagatcgccaacgccaccgagggcagcagcgagagacagatcaccatcaccggcacccccgccaacatcagcctggcccagtacctgatcaacgccagactgaccagcgaggtgaccggcatgggcaccctgtag

SEQ ID NO: 93771 - DNA, 1113 bp, Artificial Sequence
  Description of Artificial Sequence: Synthetic coding sequence
atgggcgagggcgacgccttctgggcccccagcgtgctgccccacagcaccctgagcaccctgagccaccacccccagccccagttcggcagaagaatggagagcaaggtgagcgagggcggcctgaacgtgaccctgaccatcagactgctgatgcacggcaaggaggtgggcagcatcatcggcaagaagggcgagaccgtgaagaagatgagagaggagagcggcgccagaatcaacatcagcgagggcaactgccccgagagaatcgtgaccatcaccggccccaccgacgccatcttcaaggccttcgccatgatcgcctacaagttcgaggaggacatcatcaacagcatgagcaacagccccgccaccagcaagccccccgtgaccctgagactggtggtgcccgccagccagtgcggcagcctgatcggcaagggcggcagcaagatcaaggagatcagagagagcaccggcgcccaggtgcaggtggccggcgacatgctgcccaacagcaccgagagagccgtgaccatcagcggcacccccgacgccatcatccagtgcgtgaagcagatctgcgtggtgatgctggagagcccccccaagggcgccaccatcccctacagacccaagcccgccagcacccccgtgatcttcgccggcggccaggcctacaccatccagggccagtacgccatcccccaccccgacctgaccaagctgcaccagctggccatgcagcagacccccttcccccccctgggccagaccaaccccgccttccccggcgagaagctgcccctgcacagcagcgaggaggcccagaacctgatgggccagagcagcggcctggacgccagcccccccgccagcacccacgagctgaccatccccaacgacctgatcggctgcatcatcggcagacagggcaccaagatcaacgagatcagacagatgagcggcgcccagatcaagatcgccaacgccaccgagggcagcagcgagagacagatcaccatcaccggcacccccgccaacatcagcctggcccagtacctgatcaacgccagactgaccagcgaggtgaccggcatgggcaccctgtag

SEQ ID NO: 93772 - DNA, 1056 bp, Artificial Sequence
  Description of Artificial Sequence: Synthetic coding sequence
atgggcgagggcgacgccttctgggcccccagcgtgctgccccacagcaccctgagcaccctgagccaccacccccagccccagttcggcagaagaatggagagcaaggtgagcgagggcggcctgaacgtgaccctgaccatcagactgctgatgcacggcaaggaggtgggcagcatcatcggcaagaagggcgagaccgtgaagaagatgagagaggagagcggcgccagaatcaacatcagcgagggcaactgccccgagagaatcgtgaccatcaccggccccaccgacgccatcttcaaggccttcgccatgatcgcctacaagttcgaggaggacatcatcaacagcatgagcaacagccccgccaccagcaagccccccgtgaccctgagactggtggtgcccgccagccagtgcggcagcctgatcggcaagggcggcagcaagatcaaggagatcagagagagcaccggcgcccaggtgcaggtggccggcgacatgctgcccaacagcaccgagagagccgtgaccatcagcggcacccccgacgccatcatccagtgcgtgaagcagatctgcgtggtgatgctggagagcccccccaagggcgccaccatcccctacagacccaagcccgccagcacccccgtgatcttcgccggcggccaggcctacaccatccagggccagtacgccatcccccaccccgaccagctgaccaagctgcaccagctggccatgcagcagacccccttcccccccctgggccagaccaaccccgccttccccggcctggacgccagcccccccgccagcacccacgagctgaccatccccaacgacctgatcggctgcatcatcggcagacagggcaccaagatcaacgagatcagacagatgagcggcgcccagatcaagatcgccaacgccaccgagggcagcagcgagagacagatcaccatcaccggcacccccgccaacatcagcctggcccagtacctgatcaacgccagactgaccagcgaggtgaccggcatgggcaccctgtag

SEQ ID NO: 93773 - DNA, 1116 bp, Artificial Sequence
  Description of Artificial Sequence: Synthetic coding sequence
atgggcgagggcgacgccttctgggcccccagcgtgctgccccacagcaccctgagcaccctgagccaccacccccagccccagttcggcagaagaatggagagcaaggtgagcgagggcggcctgaacgtgaccctgaccatcagactgctgatgcacggcaaggaggtgggcagcatcatcggcaagaagggcgagaccgtgaagaagatgagagaggagagcggcgccagaatcaacatcagcgagggcaactgccccgagagaatcgtgaccatcaccggccccaccgacgccatcttcaaggccttcgccatgatcgcctacaagttcgaggaggacatcatcaacagcatgagcaacagccccgccaccagcaagccccccgtgaccctgagactggtggtgcccgccagccagtgcggcagcctgatcggcaagggcggcagcaagatcaaggagatcagagagagcaccggcgcccaggtgcaggtggccggcgacatgctgcccaacagcaccgagagagccgtgaccatcagcggcacccccgacgccatcatccagtgcgtgaagcagatctgcgtggtgatgctggagagcccccccaagggcgccaccatcccctacagacccaagcccgccagcacccccgtgatcttcgccggcggccaggcctacaccatccagggccagtacgccatcccccaccccgaccagctgaccaagctgcaccagctggccatgcagcagacccccttcccccccctgggccagaccaaccccgccttccccggcgagaagctgcccctgcacagcagcgaggaggcccagaacctgatgggccagagcagcggcctggacgccagcccccccgccagcacccacgagctgaccatccccaacgacctgatcggctgcatcatcggcagacagggcaccaagatcaacgagatcagacagatgagcggcgcccagatcaagatcgccaacgccaccgagggcagcagcgagagacagatcaccatcaccggcacccccgccaacatcagcctggcccagtacctgatcaacgccagactgaccagcgaggtgaccggcatgggcaccctgtag

SEQ ID NO: 93774 - DNA, 1116 bp, Artificial Sequence; identical to SEQ ID NO: 93773
  Description of Artificial Sequence: Synthetic coding sequence

SEQ ID NO: 93775 - DNA, 18 bp, Artificial Sequence
  Description of Artificial Sequence: Synthetic coding sequence
atggagagcaaggtgtag

SEQ ID NO: 93776 - DNA, 5070 bp, Artificial Sequence
  Description of Artificial Sequence: Synthetic coding sequence
atgggcagcaagagaagaagagccaccagccccagcagcagcgtgagcggcgacttcgacgacggccaccacagcgtgagcacccccggccccagcagaaagagaagaagactgagcaacctgcccaccgtggaccccatcgccgtgtgccacgagctgtacaacaccatcagagactacaaggacgagcagggcagactgctgtgcgagctgttcatcagagcccccaagagaagaaaccagcccgactactacgaggtggtgagccagcccatcgacctgatgaagatccagcagaagctgaagatggaggagtacgacgacgtgaacctgctgaccgccgacttccagctgctgttcaacaacgccaagagctactacaagcccgacagccccgagtacaaggccgcctgcaagctgtgggacctgtacctgagaaccagaaacgagttcgtgcagaagggcgaggccgacgacgaggacgacgacgaggacggccaggacaaccagggcaccgtgaccgagggcagcagccccgcctacctgaaggagatcctggagcagctgctggaggccatcgtggtggccaccaaccccagcggcagactgatcagcgagctgttccagaagctgcccagcaaggtgcagtaccccgactactacgccatcatcaaggagcccatcgacctgaagaccatcgcccagagaatccagaacggcagctacaagagcatccacgccatggccaaggacatcgacctgctggccaagaacgccaagacctacaacgagcccggcagccaggtgttcaaggacgccaacagcatcaagaagatcttctacatgaagaaggccgagatcgagcaccacgagatggccaagagcagcctgagaatgagaacccccagcaacctggccgccgccagactgaccggccccagccacagcaagggcagcctgggcgaggagagaaaccccaccagcaagtactacagaaacaagagagccgtgcagggcggcagactgagcgccatcaccatggccctgcagtacggcagcgagagcgaggaggacgccgccctggccgccgccagatacgaggagggcgagagcgaggccgagagcatcaccagcttcatggacgtgagcaaccccttctaccagctgtacgacaccgtgagaagctgcagaaacaaccagggccagctgatcgccgagcccttctaccacctgcccagcaagaagaagtaccccgactactaccagcagatcaagatgcccatcagcctgcagcagatcagaaccaagctgaagaaccaggagtacgagaccctggaccacctggagtgcgacctgaacctgatgttcgagaacgccaagagatacaacgtgcccaacagcgccatctacaagagagtgctgaagctgcagcaggtgatgcaggccaagaagaaggagctggccagaagagacgacatcgaggacggcgacagcatgatcagcagcgccaccagcgacaccggcagcgccaagagaaagagcaagaagaacatcagaaagcagagaatgaagatcctgttcaacgtggtgctggaggccagagagcccggcagcggcagaagactgtgcgacctgttcatggtgaagcccagcaagaaggactaccccgactactacaagatcatcctggagcccatggacctgaagatcatcgagcacaacatcagaaacgacaagtacgccggcgaggagggcatgatcgaggacatgaagctgatgttcagaaacgccagacactacaacgaggagggcagccaggtgtacaacgacgcccacatcctggagaagctgctgaaggagaagagaaaggagctgggccccctgcccgacgacgacgacatggccagccccaagctgaagctgagcagaaagagcggcatcagccccaagaagagcaagtacatgacccccatgcagcagaagctgaacgaggtgtacgaggccgtgaagaactacaccgacaagagaggcagaagactgagcgccatcttcctgagactgcccagcagaagcgagctgcccgactactacctgaccatcaagaagcccatggacatggagaagatcagaagccacatgatggccaacaagtaccaggacatcgacagcatggtggaggacttcgtgatgatgttcaacaacgcctgcacctacaacgagcccgagagcctgatctacaaggacgccctggtgctgcacaaggtgctgctggagaccagaagagacctggagggcgacgaggacagccacgtgcccaacgtgaccctgctgatccaggagctgatccacaacctgttcgtgagcgtgatgagccaccaggacgacgagggcagatgctacagcgacagcctggccgagatccccgccgtggaccccaacttccccaacaagccccccctgaccttcgacatcatcagaaagaacgtggagaacaacagatacagaagactggacctgttccaggagcacatgttcgaggtgctggagagagccagaagaatgaacagaaccgacagcgagatctacgaggacgccgtggagctgcagcagttcttcatcaagatcagagacgagctgtgcaagaacggcgagatcctgctgagccccgccctgagctacaccaccaagcacctgcacaacgacgtggagaaggagagaaaggagaagctgcccaaggagatcgaggaggacaagctgaagagagaggaggagaagagagaggccgagaagagcgaggacagcagcggcgccgccggcctgagcggcctgcacagaacctacagccaggactgcagcttcaagaacagcatgtaccacgtgggcgactacgtgtacgtggagcccgccgaggccaacctgcagccccacatcgtgtgcatcgagagactgtgggaggacagcgccggcgagaagtggctgtacggctgctggttctacagacccaacgagaccttccacctggccaccagaaagttcctggagaaggaggtgttcaagagcgactactacaacaaggtgcccgtgagcaagatcctgggcaagtgcgtggtgatgttcgtgaaggagtacttcaagctgtgccccgagaacttcagagacgaggacgtgttcgtgtgcgagagcagatacagcgccaagaccaagagcttcaagaagatcaagctgtggaccatgcccatcagcagcgtgagattcgtgcccagagacgtgcccctgcccgtggtgagagtggccagcgtgttcgccaacgccgacaagggcgacgacgagaagaacaccgacaacagcgaggacagcagagccgaggacaacttcaacctggagaaggagaaggaggacgtgcccgtggagatgagcaacggcgagcccggctgccactacttcgagcagctgcactacaacgacatgtggctgaaggtgggcgactgcgtgttcatcaagagccacggcctggtgagacccagagtgggcagaatcgagaaggtgtgggtgagagacggcgccgcctacttctacggccccatcttcatccaccccgaggagaccgagcacgagcccaccaagatgttctacaagaaggaggtgttcctgagcaacctggaggagacctgccccatgacctgcatcctgggcaagtgcgccgtgctgagcttcaaggacttcctgagctgcagacccaccgagatccccgagaacgacatcctgctgtgcgagagcagatacaacgagagcgacaagcagatgaagaagttcaagggcctgaagagattcagcctgagcgccaaggtggtggacgacgagatctactacttcagaaagcccatcgtgccccagaaggagcccagccccctgctggagaagaagatccagctgctggaggccaagttcgccgagctggagggcggcgacgacgacatcgaggagatgggcgaggaggacagcgaggtgatcgagccccccagcctgccccagctgcagacccccctggccagcgagctggacctgatgccctacacccccccccagagcacccccaagagcgccaagggcagcgccaagaaggagggcagcaagagaaagatcaacatgagcggctacatcctgttcagcagcgagatgagagccgtgatcaaggcccagcaccccgactacagcttcggcgagctgagcagactggtgggcaccgagtggagaaacctggagaccgccaagaaggccgagtacgaggagagagccgccaaggtggccgagcagcaggagagagagagagccgcccagcagcagcagcccagcgccagccccagagccggcacccccgtgggcgccctgatgggcgtggtgcccccccccacccccatgggcatgctgaaccagcagctgacccccgtggccggcatgatgggcggctacccccccggcctgccccccctgcagggccccgtggacggcctggtgagcatgggcagcatgcagcccctgcaccccggcggcccccccccccaccacctgccccccggcgtgcccggcctgcccggcatccccccccccggcgtgatgaaccagggcgtggcccccatggtgggcacccccgcccccggcggcagcccctacggccagcaggtgggcgtgctgggcccccccggccagcaggccccccccccctaccccggcccccaccccgccggcccccccgtgatccagcagcccaccacccccatgttcgtggcccccccccccaagacccagagactgctgcacagcgaggcctacctgaagtacatcgagggcctgagcgccgagagcaacagcatcagcaagtgggaccagaccctggccgccagaagaagagacgtgcacctgagcaaggagcaggagagcagactgcccagccactggctgaagagcaagggcgcccacaccaccatggccgacgccctgtggagactgagagacctgatgctgagagacaccctgaacatcagacaggcctacaacctggagaacgtgtag

SEQ ID NO: 93777 - DNA, 4749 bp, Artificial Sequence
  Description of Artificial Sequence: Synthetic coding sequence
atgggcagcaagagaagaagagccaccagccccagcagcagcgtgagcggcgacttcgacgacggccaccacagcgtgagcacccccggccccagcagaaagagaagaagactgagcaacctgcccaccgtggaccccatcgccgtgtgccacgagctgtacaacaccatcagagactacaaggacgagcagggcagactgctgtgcgagctgttcatcagagcccccaagagaagaaaccagcccgactactacgaggtggtgagccagcccatcgacctgatgaagatccagcagaagctgaagatggaggagtacgacgacgtgaacctgctgaccgccgacttccagctgctgttcaacaacgccaagagctactacaagcccgacagccccgagtacaaggccgcctgcaagctgtgggacctgtacctgagaaccagaaacgagttcgtgcagaagggcgaggccgacgacgaggacgacgacgaggacggccaggacaaccagggcaccgtgaccgagggcagcagccccgcctacctgaaggagatcctggagcagctgctggaggccatcgtggtggccaccaaccccagcggcagactgatcagcgagctgttccagaagctgcccagcaaggtgcagtaccccgactactacgccatcatcaaggagcccatcgacctgaagaccatcgcccagagaatccagaacggcagctacaagagcatccacgccatggccaaggacatcgacctgctggccaagaacgccaagacctacaacgagcccggcagccaggtgttcaaggacgccaacagcatcaagaagatcttctacatgaagaaggccgagatcgagcaccacgagatggccaagagcagcctgagaatgagaacccccagcaacctggccgccgccagactgaccggccccagccacagcaagggcagcctgggcgaggagagaaaccccaccagcaagtactacagaaacaagagagccgtgcagggcggcagactgagcgccatcaccatggccctgcagtacggcagcgagagcgaggaggacgccgccctggccgccgccagatacgaggagggcgagagcgaggccgagagcatcaccagcttcatggacgtgagcaaccccttctaccagctgtacgacaccgtgagaagctgcagaaacaaccagggccagctgatcgccgagcccttctaccacctgcccagcaagaagaagtaccccgactactaccagcagatcaagatgcccatcagcctgcagcagatcagaaccaagctgaagaaccaggagtacgagaccctggaccacctggagtgcgacctgaacctgatgttcgagaacgccaagagatacaacgtgcccaacagcgccatctacaagagagtgctgaagctgcagcaggtgatgcaggccaagaagaaggagctggccagaagagacgacatcgaggacggcgacagcatgatcagcagcgccaccagcgacaccggcagcgccaagagaaagagcaagaagaacatcagaaagcagagaatgaagatcctgttcaacgtggtgctggaggccagagagcccggcagcggcagaagactgtgcgacctgttcatggtgaagcccagcaagaaggactaccccgactactacaagatcatcctggagcccatggacctgaagatcatcgagcacaacatcagaaacgacaagtacgccggcgaggagggcatgatcgaggacatgaagctgatgttcagaaacgccagacactacaacgaggagggcagccaggtgtacaacgacgcccacatcctggagaagctgctgaaggagaagagaaaggagctgggccccctgcccgacgacgacgacatggccagccccaagctgaagctgagcagaaagagcggcatcagccccaagaagagcaagtacatgacccccatgcagcagaagctgaacgaggtgtacgaggccgtgaagaactacaccgacaagagaggcagaagactgagcgccatcttcctgagactgcccagcagaagcgagctgcccgactactacctgaccatcaagaagcccatggacatggagaagatcagaagccacatgatggccaacaagtaccaggacatcgacagcatggtggaggacttcgtgatgatgttcaacaacgcctgcacctacaacgagcccgagagcctgatctacaaggacgccctggtgctgcacaaggtgctgctggagaccagaagagacctggagggcgacgaggacagccacgtgcccaacgtgaccctgctgatccaggagctgatccacaacctgttcgtgagcgtgatgagccaccaggacgacgagggcagatgctacagcgacagcctggccgagatccccgccgtggaccccaacttccccaacaagccccccctgaccttcgacatcatcagaaagaacgtggagaacaacagatacagaagactggacctgttccaggagcacatgttcgaggtgctggagagagccagaagaatgaacagaaccgacagcgagatctacgaggacgccgtggagctgcagcagttcttcatcaagatcagagacgagctgtgcaagaacggcgagatcctgctgagccccgccctgagctacaccaccaagcacctgcacaacgacgtggagaaggagagaaaggagaagctgcccaaggagatcgaggaggacaagctgaagagagaggaggagaagagagaggccgagaagagcgaggacagcagcggcgccgccggcctgagcggcctgcacagaacctacagccaggactgcagcttcaagaacagcatgtaccacgtgggcgactacgtgtacgtggagcccgccgaggccaacctgcagccccacatcgtgtgcatcgagagactgtgggaggacagcgccggcgagaagtggctgtacggctgctggttctacagacccaacgagaccttccacctggccaccagaaagttcctggagaaggaggtgttcaagagcgactactacaacaaggtgcccgtgagcaagatcctgggcaagtgcgtggtgatgttcgtgaaggagtacttcaagctgtgccccgagaacttcagagacgaggacgtgttcgtgtgcgagagcagatacagcgccaagaccaagagcttcaagaagatcaagctgtggaccatgcccatcagcagcgtgagattcgtgcccagagacgtgcccctgcccgtggtgagagtggccagcgtgttcgccaacgccgacaagggcgacgacgagaagaacaccgacaacagcgaggacagcagagccgaggacaacttcaacctggagaaggagaaggaggacgtgcccgtggagatgagcaacggcgagcccggctgccactacttcgagcagctgcactacaacgacatgtggctgaaggtgggcgactgcgtgttcatcaagagccacggcctggtgagacccagagtgggcagaatcgagaaggtgtgggtgagagacggcgccgcctacttctacggccccatcttcatccaccccgaggagaccgagcacgagcccaccaagatgttctacaagaaggaggtgttcctgagcaacctggaggagacctgccccatgacctgcatcctgggcaagtgcgccgtgctgagcttcaaggacttcctgagctgcagacccaccgagatccccgagaacgacatcctgctgtgcgagagcagatacaacgagagcgacaagcagatgaagaagttcaagggcctgaagagattcagcctgagcgccaaggtggtggacgacgagatctactacttcagaaagcccatcgtgccccagaaggagcccagccccctgctggagaagaagatccagctgctggaggccaagttcgccgagctggagggcggcgacgacgacatcgaggagatgggcgaggaggacagcgaggtgatcgagccccccagcctgccccagctgcagacccccctggccagcgagctggacctgatgccctacacccccccccagagcacccccaagagcgccaagggcagcgccaagaaggagggcagcaagagaaagatcaacatgagcggctacatcctgttcagcagcgagatgagagccgtgatcaaggcccagcaccccgactacagcttcggcgagctgagcagactggtgggcaccgagtggagaaacctggagaccgccaagaaggccgagtacgagggcgtgatgaaccagggcgtggcccccatggtgggcacccccgcccccggcggcagcccctacggccagcaggtgggcgtgctgggcccccccggccagcaggccccccccccctaccccggcccccaccccgccggcccccccgtgatccagcagcccaccacccccatgttcgtggcccccccccccaagacccagagactgctgcacagcgaggcctacctgaagtacatcgagggcctgagcgccgagagcaacagcatcagcaagtgggaccagaccctggccgccagaagaagagacgtgcacctgagcaaggagcaggagagcagactgcccagccactggctgaagagcaagggcgcccacaccaccatggccgacgccctgtggagactgagagacctgatgctgagagacaccctgaacatcagacaggcctacaacctggagaacgtgtag

SEQ ID NO: 93778 - DNA, 4809 bp, Artificial Sequence
  Description of Artificial Sequence: Synthetic coding sequence
atgggcagcaagagaagaagagccaccagccccagcagcagcgtgagcggcgacttcgacgacggccaccacagcgtgagcacccccggccccagcagaaagagaagaagactgagcaacctgcccaccgtggaccccatcgccgtgtgccacgagctgtacaacaccatcagagactacaaggacgagcagggcagactgctgtgcgagctgttcatcagagcccccaagagaagaaaccagcccgactactacgaggtggtgagccagcccatcgacctgatgaagatccagcagaagctgaagatggaggagtacgacgacgtgaacctgctgaccgccgacttccagctgctgttcaacaacgccaagagctactacaagcccgacagccccgagtacaaggccgcctgcaagctgtgggacctgtacctgagaaccagaaacgagttcgtgcagaagggcgaggccgacgacgaggacgacgacgaggacggccaggacaaccagggcaccgtgaccgagggcagcagccccgcctacctgaaggagatcctggagcagctgctggaggccatcgtggtggccaccaaccccagcggcagactgatcagcgagctgttccagaagctgcccagcaaggtgcagtaccccgactactacgccatcatcaaggagcccatcgacctgaagaccatcgcccagagaatccagaacggcagctacaagagcatccacgccatggccaaggacatcgacctgctggccaagaacgccaagacctacaacgagcccggcagccaggtgttcaaggacgccaacagcatcaagaagatcttctacatgaagaaggccgagatcgagcaccacgagatggccaagagcagcctgagaatgagcaacaagagagccgtgcagggcggcagactgagcgccatcaccatggccctgcagtacggcagcgagagcgaggaggacgccgccctggccgccgccagatacgaggagggcgagagcgaggccgagagcatcaccagcttcatggacgtgagcaaccccttctaccagctgtacgacaccgtgagaagctgcagaaacaaccagggccagctgatcgccgagcccttctaccacctgcccagcaagaagaagtaccccgactactaccagcagatcaagatgcccatcagcctgcagcagatcagaaccaagctgaagaaccaggagtacgagaccctggaccacctggagtgcgacctgaacctgatgttcgagaacgccaagagatacaacgtgcccaacagcgccatctacaagagagtgctgaagctgcagcaggtgatgcaggccaagaagaaggagctggccagaagagacgacatcgaggacggcgacagcatgatcagcagcgccaccagcgacaccggcagcgccaagagaaagagcaagaagaacatcagaaagcagagaatgaagatcctgttcaacgtggtgctggaggccagagagcccggcagcggcagaagactgtgcgacctgttcatggtgaagcccagcaagaaggactaccccgactactacaagatcatcctggagcccatggacctgaagatcatcgagcacaacatcagaaacgacaagtacgccggcgaggagggcatgatcgaggacatgaagctgatgttcagaaacgccagacactacaacgaggagggcagccaggtgtacaacgacgcccacatcctggagaagctgctgaaggagaagagaaaggagctgggccccctgcccgacgacgacgacatggccagccccaagctgaagctgagcagaaagagcggcatcagccccaagaagagcaagtacatgacccccatgcagcagaagctgaacgaggtgtacgaggccgtgaagaactacaccgacaagagaggcagaagactgagcgccatcttcctgagactgcccagcagaagcgagctgcccgactactacctgaccatcaagaagcccatggacatggagaagatcagaagccacatgatggccaacaagtaccaggacatcgacagcatggtggaggacttcgtgatgatgttcaacaacgcctgcacctacaacgagcccgagagcctgatctacaaggacgccctggtgctgcacaaggtgctgctggagaccagaagagacctggagggcgacgaggacagccacgtgcccaacgtgaccctgctgatccaggagctgatccacaacctgttcgtgagcgtgatgagccaccaggacgacgagggcagatgctacagcgacagcctggccgagatccccgccgtggaccccaacttccccaacaagccccccctgaccttcgacatcatcagaaagaacgtggagaacaacagatacagaagactggacctgttccaggagcacatgttcgaggtgctggagagagccagaagaatgaacagaaccgacagcgagatctacgaggacgccgtggagctgcagcagttcttcatcaagatcagagacgagctgtgcaagaacggcgagatcctgctgagccccgccctgagctacaccaccaagcacctgcacaacgacgtggagaaggagagaaaggagaagctgcccaaggagatcgaggaggacaagctgaagagagaggaggagaagagagaggccgagaagagcgaggacagcagcggcgccgccggcctgagcggcctgcacagaacctacagccaggactgcagcttcaagaacagcatgtaccacgtgggcgactacgtgtacgtggagcccgccgaggccaacctgcagccccacatcgtgtgcatcgagagactgtgggaggacagcgccggcgagaagtggctgtacggctgctggttctacagacccaacgagaccttccacctggccaccagaaagttcctggagaaggaggtgttcaagagcgactactacaacaaggtgcccgtgagcaagatcctgggcaagtgcgtggtgatgttcgtgaaggagtacttcaagctgtgccccgagaacttcagagacgaggacgtgttcgtgtgcgagagcagatacagcgccaagaccaagagcttcaagaagatcaagctgtggaccatgcccatcagcagcgtgagattcgtgcccagagacgtgcccctgcccgtggtgagagtggccagcgtgttcgccaacgccgacaagggcgacgacgagaagaacaccgacaacagcgaggacagcagagccgaggacaacttcaacctggagaaggagaaggaggacgtgcccgtggagatgagcaacggcgagcccggctgccactacttcgagcagctgcactacaacgacatgtggctgaaggtgggcgactgcgtgttcatcaagagccacggcctggtgagacccagagtgggcagaatcgagaaggtgtgggtgagagacggcgccgcctacttctacggccccatcttcatccaccccgaggagaccgagcacgagcccaccaagatgttctacaagaaggaggtgttcctgagcaacctggaggagacctgccccatgacctgcatcctgggcaagtgcgccgtgctgagcttcaaggacttcctgagctgcagacccaccgagatccccgagaacgacatcctgctgtgcgagagcagatacaacgagagcgacaagcagatgaagaagttcaagggcctgaagagattcagcctgagcgccaaggtggtggacgacgagatctactacttcagaaagcccatcgtgccccagaaggagcccagccccctgctggagaagaagatccagctgctggaggccaagttcgccgagctggagggcggcgacgacgacatcgaggagatgggcgaggaggacagcgaggtgatcgagccccccagcctgccccagctgcagacccccctggccagcgagctggacctgatgccctacacccccccccagagcacccccaagagcgccaagggcagcgccaagaaggagggcagcaagagaaagatcaacatgagcggctacatcctgttcagcagcgagatgagagccgtgatcaaggcccagcaccccgactacagcttcggcgagctgagcagactggtgggcaccgagtggagaaacctggagaccgccaagaaggccgagtacgagggcatgatgggcggctacccccccggcctgccccccctgcagggccccgtggacggcctggtgagcatgggcagcatgcagcccctgcaccccggcggcccccccccccaccacctgccccccggcgtgcccggcctgcccggcatccccccccccggcgtgatgaaccagggcgtggcccccatggtgggcacccccgcccccggcggcagcccctacggccagcaggtgggcgtgctgggcccccccggccagcaggccccccccccctaccccggcccccaccccgccggcccccccgtgatccagcagcccaccacccccatgttcgtggcccccccccccaagacccagagactgctgcacagcgaggcctacctgaagtacatcgagggcctgagcgccgagagcaacagcatcagcaagtgggaccagaccctggccgccagaagaagagacgtgcacctgagcaaggagcaggagagcagactgcccagccactggctgaagagcaagggcgcccacaccaccatggccgacgccctgtggagactgagagacctgatgctgagagacaccctgaacatcagacaggcctacaacctggagaacgtgtag

SEQ ID NO: 93779 - DNA, 4749 bp, Artificial Sequence
  Description of Artificial Sequence: Synthetic coding sequence
atgggcagcaagagaagaagagccaccagccccagcagcagcgtgagcggcgacttcgacgacggccaccacagcgtgagcacccccggccccagcagaaagagaagaagactgagcaacctgcccaccgtggaccccatcgccgtgtgccacgagctgtacaacaccatcagagactacaaggacgagcagggcagactgctgtgcgagctgttcatcagagcccccaagagaagaaaccagcccgactactacgaggtggtgagccagcccatcgacctgatgaagatccagcagaagctgaagatggaggagtacgacgacgtgaacctgctgaccgccgacttccagctgctgttcaacaacgccaagagctactacaagcccgacagccccgagtacaaggccgcctgcaagctgtgggacctgtacctgagaaccagaaacgagttcgtgcagaagggcgaggccgacgacgaggacgacgacgaggacggccaggacaaccagggcaccgtgaccgagggcagcagccccgcctacctgaaggagatcctggagcagctgctggaggccatcgtggtggccaccaaccccagcggcagactgatcagcgagctgttccagaagctgcccagcaaggtgcagtaccccgactactacgccatcatcaaggagcccatcgacctgaagaccatcgcccagagaatccagaacggcagctacaagagcatccacgccatggccaaggacatcgacctgctggccaagaacgccaagacctacaacgagcccggcagccaggtgttcaaggacgccaacagcatcaagaagatcttctacatgaagaaggccgagatcgagcaccacgagatggccaagagcagcctgagaatgagaacccccagcaacctggccgccgccagactgaccggccccagccacagcaagggcagcctgggcgaggagagaaaccccaccagcaagtactacagaaacaagagagccgtgcagggcggcagactgagcgccatcaccatggccctgcagtacggcagcgagagcgaggaggacgccgccctggccgccgccagatacgaggagggcgagagcgaggccgagagcatcaccagcttcatggacgtgagcaaccccttctaccagctgtacgacaccgtgagaagctgcagaaacaaccagggccagctgatcgccgagcccttctaccacctgcccagcaagaagaagtaccccgactactaccagcagatcaagatgcccatcagcctgcagcagatcagaaccaagctgaagaaccaggagtacgagaccctggaccacctggagtgcgacctgaacctgatgttcgagaacgccaagagatacaacgtgcccaacagcgccatctacaagagagtgctgaagctgcagcaggtgatgcaggccaagaagaaggagctggccagaagagacgacatcgaggacggcgacagcatgatcagcagcgccaccagcgacaccggcagcgccaagagaaagagcaagaagaacatcagaaagcagagaatgaagatcctgttcaacgtggtgctggaggccagagagcccggcagcggcagaagactgtgcgacctgttcatggtgaagcccagcaagaaggactaccccgactactacaagatcatcctggagcccatggacctgaagatcatcgagcacaacatcagaaacgacaagtacgccggcgaggagggcatgatcgaggacatgaagctgatgttcagaaacgccagacactacaacgaggagggcagccaggtgtacaacgacgcccacatcctggagaagctgctgaaggagaagagaaaggagctgggccccctgcccgacgacgacgacatggccagccccaagctgaagctgagcagaaagagcggcatcagccccaagaagagcaagtacatgacccccatgcagcagaagctgaacgaggtgtacgaggccgtgaagaactacaccgacaagagaggcagaagactgagcgccatcttcctgagactgcccagcagaagcgagctgcccgactactacctgaccatcaagaagcccatggacatggagaagatcagaagccacatgatggccaacaagtaccaggacatcgacagcatggtggaggacttcgtgatgatgttcaacaacgcctgcacctacaacgagcccgagagcctgatctacaaggacgccctggtgctgcacaaggtgctgctggagaccagaagagacctggagggcgacgaggacagccacgtgcccaacgtgaccctgctgatccaggagctgatccacaacctgttcgtgagcgtgatgagccaccaggacgacgagggcagatgctacagcgacagcctggccgagatccccgccgtggaccccaacttccccaacaagccccccctgaccttcgacatcatcagaaagaacgtggagaacaacagatacagaagactggacctgttccaggagcacatgttcgaggtgctggagagagccagaagaatgaacagaaccgacagcgagatctacgaggacgccgtggagctgcagcagttcttcatcaagatcagagacgagctgtgcaagaacggcgagatcctgctgagccccgccctgagctacaccaccaagcacctgcacaacgacgtggagaaggagagaaaggagaagctgcccaaggagatcgaggaggacaagctgaagagagaggaggagaagagagaggccgagaagagcgaggacagcagcggcgccgccggcctgagcggcctgcacagaacctacagccaggactgcagcttcaagaacagcatgtaccacgtgggcgactacgtgtacgtggagcccgccgaggccaacctgcagccccacatcgtgtgcatcgagagactgtgggaggacagcgccgagaaggaggtgttcaagagcgactactacaacaaggtgcccgtgagcaagatcctgggcaagtgcgtggtgatgttcgtgaaggagtacttcaagctgtgccccgagaacttcagagacgaggacgtgttcgtgtgcgagagcagatacagcgccaagaccaagagcttcaagaagatcaagctgtggaccatgcccatcagcagcgtgagattcgtgcccagagacgtgcccctgcccgtggtgagagtggccagcgtgttcgccaacgccgacaagggcgacgacgagaagaacaccgacaacagcgaggacagcagagccgaggacaacttcaacctggagaaggagaaggaggacgtgcccgtggagatgagcaacggcgagcccggctgccactacttcgagcagctgcactacaacgacatgtggctgaaggtgggcgactgcgtgttcatcaagagccacggcctggtgagacccagagtgggcagaatcgagaaggtgtgggtgagagacggcgccgcctacttctacggccccatcttcatccaccccgaggagaccgagcacgagcccaccaagatgttctacaagaaggaggtgttcctgagcaacctggaggagacctgccccatgacctgcatcctgggcaagtgcgccgtgctgagcttcaaggacttcctgagctgcagacccaccgagatccccgagaacgacatcctgctgtgcgagagcagatacaacgagagcgacaagcagatgaagaagttcaagggcctgaagagattcagcctgagcgccaaggtggtggacgacgagatctactacttcagaaagcccatcgtgccccagaaggagcccagccccctgctggagaagaagatccagctgctggaggccaagttcgccgagctggagggcggcgacgacgacatcgaggagatgggcgaggaggacagcgagagcacccccaagagcgccaagggcagcgccaagaaggagggcagcaagagaaagatcaacatgagcggctacatcctgttcagcagcgagatgagagccgtgatcaaggcccagcaccccgactacagcttcggcgagctgagcagactggtgggcaccgagtggagaaacctggagaccgccaagaaggccgagtacgagggcatgatgggcggctacccccccggcctgccccccctgcagggccccgtggacggcctggtgagcatgggcagcatgcagcccctgcaccccggcggcccccccccccaccacctgccccccggcgtgcccggcctgcccggcatccccccccccggcgtgatgaaccagggcgtggcccccatggtgggcacccccgcccccggcggcagcccctacggccagcaggtgggcgtgctgggcccccccggccagcaggccccccccccctaccccggcccccaccccgccggcccccccgtgatccagcagcccaccacccccatgttcgtggcccccccccccaagacccagagactgctgcacagcgaggcctacctgaagtacatcgagggcctgagcgccgagagcaacagcatcagcaagtgggaccagaccctggccgccagaagaagagacgtgcacctgagcaaggagcaggagagcagactgcccagccactggctgaagagcaagggcgcccacaccaccatggccgacgccctgtggagactgagagacctgatgctgagagacaccctgaacatcagacaggcctacaacctggagaacgtgtag

SEQ ID NO: 93780 - DNA, 4905 bp, Artificial Sequence
  Description of Artificial Sequence: Synthetic coding sequence
atgggcagcaagagaagaagagccaccagccccagcagcagcgtgagcggcgacttcgacgacggccaccacagcgtgagcacccccggccccagcagaaagagaagaagactgagcaacctgcccaccgtggaccccatcgccgtgtgccacgagctgtacaacaccatcagagactacaaggacgagcagggcagactgctgtgcgagctgttcatcagagcccccaagagaagaaaccagcccgactactacgaggtggtgagccagcccatcgacctgatgaagatccagcagaagctgaagatggaggagtacgacgacgtgaacctgctgaccgccgacttccagctgctgttcaacaacgccaagagctactacaagcccgacagccccgagtacaaggccgcctgcaagctgtgggacctgtacctgagaaccagaaacgagttcgtgcagaagggcgaggccgacgacgaggacgacgacgaggacggccaggacaaccagggcaccgtgaccgagggcagcagccccgcctacctgaaggagatcctggagcagctgctggaggccatcgtggtggccaccaaccccagcggcagactgatcagcgagctgttccagaagctgcccagcaaggtgcagtaccccgactactacgccatcatcaaggagcccatcgacctgaagaccatcgcccagagaatccagaacggcagctacaagagcatccacgccatggccaaggacatcgacctgctggccaagaacgccaagacctacaacgagcccggcagccaggtgttcaaggacgccaacagcatcaagaagatcttctacatgaagaaggccgagatcgagcaccacgagatggccaagagcagcctgagaatgagaacccccagcaacctggccgccgccagactgaccggccccagccacagcaagggcagcctgggcgaggagagaaaccccaccagcaagtactacagaaacaagagagccgtgcagggcggcagactgagcgccatcaccatggccctgcagtacggcagcgagagcgaggaggacgccgccctggccgccgccagatacgaggagggcgagagcgaggccgagagcatcaccagcttcatggacgtgagcaaccccttctaccagctgtacgacaccgtgagaagctgcagaaacaaccagggccagctgatcgccgagcccttctaccacctgcccagcaagaagaagtaccccgactactaccagcagatcaagatgcccatcagcctgcagcagatcagaaccaagctgaagaaccaggagtacgagaccctggaccacctggagtgcgacctgaacctgatgttcgagaacgccaagagatacaacgtgcccaacagcgccatctacaagagagtgctgaagctgcagcaggtgatgcaggccaagaagaaggagctggccagaagagacgacatcgaggacggcgacagcatgatcagcagcgccaccagcgacaccggcagcgccaagagaaagagcaagaagaacatcagaaagcagagaatgaagatcctgttcaacgtggtgctggaggccagagagcccggcagcggcagaagactgtgcgacctgttcatggtgaagcccagcaagaaggactaccccgactactacaagatcatcctggagcccatggacctgaagatcatcgagcacaacatcagaaacgacaagtacgccggcgaggagggcatgatcgaggacatgaagctgatgttcagaaacgccagacactacaacgaggagggcagccaggtgtacaacgacgcccacatcctggagaagctgctgaaggagaagagaaaggagctgggccccctgcccgacgacgacgacatggccagccccaagctgaagctgagcagaaagagcggcatcagccccaagaagagcaagtacatgacccccatgcagcagaagctgaacgaggtgtacgaggccgtgaagaactacaccgacaagagaggcagaagactgagcgccatcttcctgagactgcccagcagaagcgagctgcccgactactacctgaccatcaagaagcccatggacatggagaagatcagaagccacatgatggccaacaagtaccaggacatcgacagcatggtggaggacttcgtgatgatgttcaacaacgcctgcacctacaacgagcccgagagcctgatctacaaggacgccctggtgctgcacaaggtgctgctggagaccagaagagacctggagggcgacgaggacagccacgtgcccaacgtgaccctgctgatccaggagctgatccacaacctgttcgtgagcgtgatgagccaccaggacgacgagggcagatgctacagcgacagcctggccgagatccccgccgtggaccccaacttccccaacaagccccccctgaccttcgacatcatcagaaagaacgtggagaacaacagatacagaagactggacctgttccaggagcacatgttcgaggtgctggagagagccagaagaatgaacagaaccgacagcgagatctacgaggacgccgtggagctgcagcagttcttcatcaagatcagagacgagctgtgcaagaacggcgagatcctgctgagccccgccctgagctacaccaccaagcacctgcacaacgacgtggagaaggagagaaaggagaagctgcccaaggagatcgaggaggacaagctgaagagagaggaggagaagagagaggccgagaagagcgaggacagcagcggcgccgccggcctgagcggcctgcacagaacctacagccaggactgcagcttcaagaacagcatgtaccacgtgggcgactacgtgtacgtggagcccgccgaggccaacctgcagccccacatcgtgtgcatcgagagactgtgggaggacagcgccggcgagaagtggctgtacggctgctggttctacagacccaacgagaccttccacctggccaccagaaagttcctggagaaggaggtgttcaagagcgactactacaacaaggtgcccgtgagcaagatcctgggcaagtgcgtggtgatgttcgtgaaggagtacttcaagctgtgccccgagaacttcagagacgaggacgtgttcgtgtgcgagagcagatacagcgccaagaccaagagcttcaagaagatcaagctgtggaccatgcccatcagcagcgtgagattcgtgcccagagacgtgcccctgcccgtggtgagagtggccagcgtgttcgccaacgccgacaagggcgacgacgagaagaacaccgacaacagcgaggacagcagagccgaggacaacttcaacctggagaaggagaaggaggacgtgcccgtggagatgagcaacggcgagcccggctgccactacttcgagcagctgcactacaacgacatgtggctgaaggtgggcgactgcgtgttcatcaagagccacggcctggtgagacccagagtgggcagaatcgagaaggtgtgggtgagagacggcgccgcctacttctacggccccatcttcatccaccccgaggagaccgagcacgagcccaccaagatgttctacaagaaggaggtgttcctgagcaacctggaggagacctgccccatgacctgcatcctgggcaagtgcgccgtgctgagcttcaaggacttcctgagctgcagacccaccgagatccccgagaacgacatcctgctgtgcgagagcagatacaacgagagcgacaagcagatgaagaagttcaagggcctgaagagattcagcctgagcgccaaggtggtggacgacgagatctactacttcagaaagcccatcgtgccccagaaggagcccagccccctgctggagaagaagatccagctgctggaggccaagttcgccgagctggagggcggcgacgacgacatcgaggagatgggcgaggaggacagcgaggtgatcgagccccccagcctgccccagctgcagacccccctggccagcgagctggacctgatgccctacacccccccccagagcacccccaagagcgccaagggcagcgccaagaaggagggcagcaagagaaagatcaacatgagcggctacatcctgttcagcagcgagatgagagccgtgatcaaggcccagcaccccgactacagcttcggcgagctgagcagactggtgggcaccgagtggagaaacctggagaccgccaagaaggccgagtacgagggcatgatgggcggctacccccccggcctgccccccctgcagggccccgtggacggcctggtgagcatgggcagcatgcagcccctgcaccccggcggcccccccccccaccacctgccccccggcgtgcccggcctgcccggcatccccccccccggcgtgatgaaccagggcgtggcccccatggtgggcacccccgcccccggcggcagcccctacggccagcaggtgggcgtgctgggcccccccggccagcaggccccccccccctaccccggcccccaccccgccggcccccccgtgatccagcagcccaccacccccatgttcgtggcccccccccccaagacccagagactgctgcacagcgaggcctacctgaagtacatcgagggcctgagcgccgagagcaacagcatcagcaagtgggaccagaccctggccgccagaagaagagacgtgcacctgagcaaggagcaggagagcagactgcccagccactggctgaagagcaagggcgcccacaccaccatggccgacgccctgtggagactgagagacctgatgctgagagacaccctgaacatcagacaggcctacaacctggagaacgtgtag

SEQ ID NO: 93781 - DNA, 459 bp, Artificial Sequence
  Description of Artificial Sequence: Synthetic coding sequence
atgggcagcaagagaagaagagccaccagccccagcagcagcgtgagcggcgacttcgacgacggccaccacagcgtgagcacccccggccccagcagaaagagaagaagactgagcaacctgcccaccgtggaccccatcgccgtgtgccacgagctgtacaacaccatcagagactacaaggacgagcagggcagactgctgtgcgagctgttcatcagagcccccaagagaagaaaccagcccgactactacgaggtggtgagccagcccatcgacctgatgaagatccagcagaagctgaagatggaggagtacgacgacgtgaacctgctgaccgccgacttccagctgctgttcaacaacgccaagagctactacaagcccgacagccccgagtacaaggccgcctgcaagctgtgggacctgtacctgagaaccagaaacgagttcgtgtag

SEQ ID NO: 93782 - DNA, 81 bp, Artificial Sequence
  Description of Artificial Sequence: Synthetic coding sequence
atgggcagcaagagaagaagagccaccagccccagcagcagcgtgagcggcgacttcgacgacggccaccacagcgtgtag

SEQ ID NO: 93783 - DNA, 693 bp, Artificial Sequence
  Description of Artificial Sequence: Synthetic coding sequence
atgggcagcaagagaagaagagccaccagccccagcagcagcgtgagcggcgacttcgacgacggccaccacagcgtgagcacccccggccccagcagaaagagaagaagactgagcaacctgcccaccgtggaccccatcgccgtgtgccacgagctgtacaacaccatcagagactacaaggacgagcagggcagactgctgtgcgagctgttcatcagagcccccaagagaagaaaccagcccgactactacgaggtggtgagccagcccatcgacctgatgaagatccagcagaagctgaagatggaggagtacgacgacgtgaacctgctgaccgccgacttccagctgctgttcaacaacgccaagagctactacaagcccgacagccccgagtacaaggccgcctgcaagctgtgggacctgtacctgagaaccagaaacgagttcgtgcagaagggcgaggccgacgacgaggacgacgacgaggacggccaggacaaccagggcaccgtgaccgagggcagcagccccgcctacctgaaggagatcctggagcagctgctggaggccatcgtggtggccaccaaccccagcggcagactgatcagcgagctgttccagaagctgcccagcaaggtgcagtaccccgactactacgccatcatcaaggagcccatcgacctgtag

SEQ ID NO: 93784 - DNA, 132 bp, Artificial Sequence
  Description of Artificial Sequence: Synthetic coding sequence
atgggcagcaagagaagaagagccaccagccccagcagcagcgtgagcggcgacttcgacgacggccaccacagcgtgagcacccccggccccagcagaaagagaagaagactgagcaacctgcccacctag

SEQ ID NO: 93785 - DNA, 357 bp, Artificial Sequence
  Description of Artificial Sequence: Synthetic coding sequence
atgggcagcaagagaagaagagccaccagccccagcagcagcgtgagcggcgacttcgacgacggccaccacagcgtgagcacccccggccccagcagaaagagaagaagactgagcaacctgcccaccgtggaccccatcgccgtgtgccacgagctgtacaacaccatcagagactacaaggacgagcagggcagactgctgtgcgagctgttcatcagagcccccaagagaagaaaccagcccgactactacgaggtggtgagccagcccatcgacctgatgaagatccagcagaagctgaagatggaggagtacgacgacgtgaacctgctgaccgccgacttccagctgtag

SEQ ID NO: 93786 - DNA, 264 bp, Artificial Sequence
  Description of Artificial Sequence: Synthetic coding sequence
atgggcagcaagagaagaagagccaccagccccagcagcagcgtgagcggcgacttcgacgacggccaccacagcgtgagcacccccggccccagcagaaagagaagaagactgagcaacctgcccaccgtggaccccatcgccgtgtgccacgagctgtacaacaccatcagagactacaaggacgagcagggcagactgctgtgcgagctgttcatcagagcccccaagagaagaaaccagcccgactactacgaggtgtag

SEQ ID NO: 93787 - DNA, 132 bp, Artificial Sequence; identical to SEQ ID NO: 93784
  Description of Artificial Sequence: Synthetic coding sequence

SEQ ID NO: 93788 - DNA, 828 bp, Artificial Sequence
  Description of Artificial Sequence: Synthetic coding sequence
atggagggcgtggccgtggtgaccgccggcagcgtgggcgccgccaagaccgagggcgccgccgccctgcccccccccccccccgtgagcccccccgccctgacccccgcccccgccgccggcgaggagggccccgcccccctgagcgagaccggcgcccccggctgcagcggcagcagaccccccgagctggagcccgagagaagcctgggcagattcagaggcagattcgaggacgaggacgaggagctggaggaggaggaggagctggaggaggaggaggaggaggaggaggaggacatgagccacttcagcctgagactggagggcggcagacaggacagcgaggacgaggaggagagactgatcaacctgagcgagctgaccccctacatcctgtgcagcatctgcaagggctacctgatcgacgccaccaccatcaccgagtgcctgcacaccttctgcaagagctgcatcgtgagacacttctactacagcaacagatgccccaagtgcaacatcgtggtgcaccagacccagcccctgtacaacatcagcgccaacgagggcaccggccacttcaagcccctggagaagaagttcgtgagagtgagcggcgaggccaccatcggccacgtggagaagttcctgagaagaaagatgggcctggaccccgcctgccaggtggacatcatctgcggcgaccacctgctggagcagtaccagaccctgagagagatcagaagagccatcggcgacgccgccatgcaggacggcctgctggtgctgcactacggcctggtggtgagccccctgaagatcacctag

SEQ ID NO: 93789 - DNA, 1053 bp, Artificial Sequence
  Description of Artificial Sequence: Synthetic coding sequence
atggagggcgtggccgtggtgaccgccggcagcgtgggcgccgccaagaccgagggcgccgccgccctgcccccccccccccccgtgagcccccccgccctgacccccgcccccgccgccggcgaggagggccccgcccccctgagcgagaccggcgcccccggctgcagcggcagcagaccccccgagctggagcccgagagaagcctgggcagattcagaggcagattcgaggacgaggacgaggagctggaggaggaggaggagctggaggaggaggaggaggaggaggaggaggacatgagccacttcagcctgagactggagggcggcagacaggacagcgaggacgaggaggagagactgatcaacctgagcgagctgaccccctacatcctgtgcagcatctgcaagggctacctgatcgacgccaccaccatcaccgagtgcctgcacaccttctgcaagagctgcatcgtgagacacttctactacagcaacagatgccccaagtgcaacatcgtggtgcaccagacccagcccctgtacaacatcagactggacagacagctgcaggacatcgtgtacaagctggtgatcaacctggaggagagagagaagaagcagatgcacgacttctacaaggagagaggcctggaggtgcccaagcccgccgtgccccagcccgtgcccagcagcaagggcagaagcaagaaggtgctggagagcgtgttcagaatcccccccgagctggacatgagcctgctgctggagttcatcggcgccaacgagggcaccggccacttcaagcccctggagaagaagttcgtgagagtgagcggcgaggccaccatcggccacgtggagaagttcctgagaagaaagatgggcctggaccccgcctgccaggtggacatcatctgcggcgaccacctgctggagcagtaccagaccctgagagagatcagaagagccatcggcgacgccgccatgcaggacggcctgctggtgctgcactacggcctggtggtgagccccctgaagatcacctag

SEQ ID NO: 93790 - DNA, 10191 bp, Artificial Sequence
  Description of Artificial Sequence: Synthetic coding sequence
atgaccgcctggctgatcagcctgatgagcatcgaggtgctgctgctggccgtgagacacctgagcctgcacatcgagcccgaggagggcagcctggccggcggcacctggatcaccgtgatcttcgacggcctggagctgggcgtgctgtaccccaacaacggcagccagctggagatccacctggtgaacgtgaacatggtggtgcccgccctgagaagcgtgccctgcgacgtgttccccgtgttcctggacctgcccgtggtgacctgcagaaccagaagcgtgctgagcgaggcccacgagggcctgtacttcctggaggcctacttcggcggccagctggtgagcagccccaaccccggccccagagacagctgcaccttcaagttcagcaaggcccagacccccatcgtgcaccaggtgtacccccccagcggcgtgcccggcaagctgatccacgtgtacggctggatcatcaccggcagactggagaccttcgacttcgacgccgagtacatcgacagccccgtgatcctggaggcccagggcgacaagtgggtgaccccctgcagcctgatcaacagacagatgggcagctgctaccccatccaggaggaccacggcctgggcaccctgcagtgccacgtggagggcgactacatcggcagccagaacgtgagcttcagcgtgttcaacaagggcaagagcatggtgcacaagaaggcctggctgatcagcgccaagcaggacctgttcctgtaccagacccacagcgagatcctgagcgtgttccccgagaccggcagcctgggcggcagaaccaacatcaccatcaccggcgacttcttcgacaacagcgcccaggtgaccatcgccggcatcccctgcgacatcagacacgtgagccccagaaagatcgagtgcaccaccagagcccccggcaaggacgtgagactgaccaccccccagcccggcaacagaggcctgctgttcgaggtgggcgacgccgtggagggcctggagctgaccgaggccacccccggctacagatggcagatcgtgcccaacgccagcagccccttcggcttctggagccaggagggccagcccttcagagccagactgagcggcttcttcgtggcccccgagaccaacaactacaccttctggatccaggccgacagccaggccagcctgcacttcagctggagcgaggagcccagaaccaaggtgaaggtggccagcatcagcgtgggcaccgccgactggttcgacagctgggagcagaacagagacgagggcacctggcagcagaagacccccaagctggagctgctgggcggcgccatgtactacctggaggccgagcaccacggcatcgcccccagcagaggcatgagaatcggcgtgcagatccacaacacctggctgaaccccgacgtggtgaccacctacctgagagagaagcaccagatcagagtgagagcccagagactgcccgaggtgcaggtgctgaacgtgagcggcagaggcaacttcttcctgacctgggacaacgtgagcagccagcccatccccgccaacgccaccgcccacctgatccagaccaccatcgaggagctgctggccgtgaagtgcaagctggagcccctgtggagcaacatcctgctgagactgggcttcgagagaggccccgaggtgagcaacagcgacggcgacctgaccagcggcaccgagcccttctgcggcagattcagcctgagacagcccagacacctggtgctgaccccccccgccgcccagaagggctacagactggaccagtacacccacctgtgcctggcctacaagggccacatgaacaagatcctgaagatgatcgtgagcttcaccatcggcttccagaacatggtgaagaacaccacctgcgactggagcctgaccagaaccagccccgagagctggcagttcgactgcaccgacctgtgggagacctgcgtgagatgcttcggcgacctgcagcccccccccgccaacagccccgtgctggtgcaccagatcaacctgctgcccctggcccaggagaccggcctgttctacgtggacgagatcatcatcgccgacaccaacgtgaccgtgagccaggccgacagcggcaccgccagacccggcggcaacctggtggagagcgtgagcgtggtgggcagcccccccgtgtacagcgtgaccagctggctggccggctgcggcaccgagctgcccctgatcaccgccagaagcgtgcccaccgagggcaccgaggagggcagcggcctggtgctggtgaccacccagagaagacagagaaccagcccccccctgggcggccacttcagaatccagctgcccaacaccgtgatcagcgacgtgcccgtgcagatcagcgcccaccacctgcaccagctgctgcagaacaacgccgacgacttcaccagcagatacctgaacgccagcgacttcaccgtgaaggaggacctgtacacctgctacgagcacgtgtggaccctgagctggagcacccagatcggcgacctgcccaacttcatcagagtgagcgacgagaacctgaccggcgtgaaccccgccgccgccaccagagtggtgtacgacggcggcgtgttcctgggccccatcttcggcgacatgctggccaccgccaaccagcacacccaggtggtggtgagagtgaacgacgtgcccgcccactgccccggcagctgcagcttccagtacctgcagggcagcaccccctgcgtgcacagcgtgtggtacagcatcgacggcgacatcaacctgatgatctacatcaccggcaccggcttcagcggcgacagccagttcctgcaggtgaccgtgaacaagaccagctgcaaggtgatcttcagcaaccagaccaacgtggtgtgccagaccgacctgctgcccgtgggcatgcacagaatcctgatgctggtgagacccagcggcctggccatcagcgccaccggcgaggacctgttcctgaacgtgaagcccagactggacatggtggagcccagcagagccgccgacatcggcggcctgtgggccaccatcagaggcagcagcctggagggcgtgagcctgatcctgttcggcagctacagctgcgccatcaacgtggccaccagcaacagcagcagaatccagtgcaaggtgccccccagaggcaaggacggcagaatcgtgaacgtgaccgtgatcagaggcgactacagcgccgtgctgcccagagccttcacctacgtgagcagcctgaaccccgtgatcgtgaccctgagcagaaacatcagcaacatcgccggcggcgagaccctggtgatcggcgtggccagactgatgaactacaccgacctggacgtggaggtgcacgtgcaggacgccctggcccccgtgcacacccagagcgcctggggcctggaggtggccctgccccccctgcccgccggcctgcacagaatcagcgtgagcatcaacggcgtgagcatccacagccagggcgtggacctgcacatccagtacctgaccgaggtgttcagcatcgagccctgctgcggcagcctgctgggcggcaccatcctgagcatcagcggcatcggcttcagcagagaccccgccctggtgtgggtgctggtgggcaacagaagctgcgacatcgtgaacctgaccgaggccagcatctggtgcgagaccctgcccgccccccagatccccgacgccggcgcccccaccgtgcccgccgccgtggaggtgtgggccggcaacagattcttcgccagaggccccagccccagcctggtgggcaagggcttcaccttcatgtacgaggccgccgccacccccgtggtgaccgccatgcagggcgagatcaccaacagcagcctgagcctgcacgtgggcggcagcaacctgagcaacagcgtgatcctgctgggcaacctgaactgcgacgtggagacccagagcttccagggcaacgtgagcctgagcggctgcagcatccccctgcacagcctggaggccggcatctaccccctgcaggtgagacagaagcagatgggcttcgccaacatgagcgtggtgctgcagcagttcgccgtgatgcccagaatcatggccatcttccccagccagggcagcgcctgcggcggcaccatcctgaccgtgagaggcctgctgctgaacagcagaagaagaagcgtgagagtggacctgagcggccccttcacctgcgtgatcctgagcctgggcgaccacaccatcctgtgccaggtgagcctggagggcgaccccctgcccggcgccagcttcagcctgaacgtgaccgtgctggtgaacggcctgaccagcgagtgccagggcaactgcaccctgttcatcagagaggaggccagccccgtgatggacgccctgagcaccaacaccagcggcagcctgaccaccgtgctgatcagaggccagagactggccaccaccgccgacgagcccatggtgttcgtggacgaccagctgccctgcaacgtgaccttcttcaacgccagccacgtggtgtgccagaccagagacctggcccccggcccccactacctgagcgtgttctacaccagaaacggctacgcctgcagcggcaacgtgagcagacacttctacatcatgccccaggtgttccactacttccccaagaacttcagcctgcacggcggcagcctgctgaccatcgagggcaccggcctgagaggccagaacaccaccagcgtgtacatcgaccagcagacctgcctgaccgtgaacatcggcgccgagctgatcagatgcatcgtgcccaccggcaacggcagcgtggccctggagatcgaggtggacggcctgtggtaccacatcggcgtgatcggctacaacaaggccttcacccccgagctgatcagcatcagccagagcgacgacatcctgaccttcgccgtggcccagatcagcggcgccgccaacatcgacatcttcatcggcatgagcccctgcgtgggcgtgagcggcaaccacaccgtgctgcagtgcgtggtgcccagcctgcccgccggcgagtaccacgtgagaggctacgactgcatcagaggctgggccagcagcgccctggtgttcaccagcagagtgatcatcaccgccgtgaccgagaacttcggctgcctgggcggcagactggtgcacgtgttcggcgccggcttcagccccggcaacgtgagcgccgccgtgtgcggcgccccctgcagagtgctggccaacgccaccgtgagcgccttcagctgcctggtgctgcccctggacgtgagcctggccttcctgtgcggcctgaagagagaggaggacagctgcgaggccgccagacacacctacgtgcagtgcgacctgaccgtggccatggccaccgagcagctgctggagagctggccctacctgtacatctgcgaggagagcagccagtgcctgttcgtgcccgaccactgggccgagagcatgttccccagcttcagcggcctgttcatcagccccaagctggagagagacgaggtgctgatctacaacagcagctgcaacatcaccatggagaccgaggccgagatggagtgcgagacccccaaccagcccatcaccgtgaagatcaccgagatcagaaagagatggggccagaacacccagggcaacttcagcctgcagttctgcagaagatggagcagaacccacagctggttccccgagagactgccccaggacggcgacaacgtgaccgtggagaacggccagctgctgctgctggacaccaacaccagcatcctgaacctgctgcacatcaagggcggcaagctgatcttcatggcccccggccccatcgagctgagagcccacgccatcctggtgagcgacggcggcgagctgagaatcggcagcgaggacaagcccttccagggcagagcccagatcaccctgtacggcagcagctacagcacccccttcttcccctacggcgtgaagttcctggccgtgagaaacggcaccctgagcctgcacggcagcctgcccgaggtgatcgtgacctgcctgagagccaccgcccacgccctggacaccgtgctggccctggaggacgccgtggactggaaccccggcgacgaggtggtgatcatcagcggcaccggcgtgaagggcgccaagcccatggaggagatcgtgaccgtggagaccgtgcaggacaccgacctgtacctgaagagccccctgagatacagccacaacttcaccgagaactgggtggccggcgagcaccacatcctgaaggccaccgtggccctgctgagcagaagcatcaccatccagggcaacctgaccaacgagagagagaagctgctggtgagctgccaggaggccaacgcccccgagggcaacctgcagcactgcctgtacagcatgagcgagaagatgctgggcagcagagacatgggcgccagagtgatcgtgcagagcttccccgaggagcccagccaggtgcagctgaagggcgtgcagttccaggtgctgggccaggccttccacaagcacctgagcagcctgaccctggtgggcgccatgagagagagcttcatccagggctgcaccgtgagaaacagcttcagcagaggcctgagcatgtgcggcaccctgggcctgaaggtggacagcaacgtgttctacaacatcctgggccacgccctgctggtgggcacctgcaccgagatgagatacatcagctgggaggccatccacggcagaaaggacgactggagcggccacggcaacatcatcagaaacaacgtgatcatccaggtgagcggcgccgagggcctgagcaaccccgagatgctgacccccagcggcatctacatctgcagccccaccaacgtgatcgagggcaacagagtgtgcggcgccggctacggctacttcttccacctgatgaccaaccagaccagccaggcccccctgctgagcttcacccagaacatcgcccacagctgcaccagatacggcctgttcgtgtaccccaagttccagcccccctgggacaacgtgaccggcaccaccctgttccagagcttcaccgtgtgggagagcgccggcggcgcccagatcttcagaagcagcaacctgagactgaagaacttcaaggtgtacagctgcagagacttcggcatcgacgtgctggagagcgacgccaacaccagcgtgaccgacagcctgctgctgggccacttcgcccacaagggcagcctgtgcatgagcagcggcatcaagacccccaagagatgggagctgatggtgagcaacaccaccttcgtgaacttcgacctgatcaactgcgtggccatcagaacctgcagcgactgcagccagggccagggcggcttcaccgtgaagaccagccagctgaagttcaccaacagcagcaacctggtggccttccccttcccccacgccgccatcctggaggacctggacggcagcctgagcggcaagaacagaagccacatcctggccagcatggagaccctgagcgccagctgcctggtgaacagcagcttcggcagagtggtgcacggcagcgcctgcggcggcggcgtgctgttccacagaatgagcatcggcctggccaacacccccgaggtgagctacgacctgaccatgaccgacagcagaaacaagaccaccaccgtgaactacgtgagagacaccctgagcaaccccagaggctggatggccctgctgctggaccaggagacctacagcctgcagagcgagaacctgtggatcaacagaagcctgcagtacagcgccaccttcgacaacttcgcccccggcaactacctgctgctggtgcacaccgacctgcccccctaccccgacatcctgctgagatgcggcagcagagtgggcctgagcttccccttcctgcccagccccggccagaaccagggctgcgactggttcttcaacagccagctgagacagctgacctacctggtgagcggcgagggccaggtgcaggtgatcctgagagtgaaggagggcatgccccccaccatcagcgccagcaccagcgcccccgagagcgccctgaagtggagcctgcccgagacctggcagggcgtggaggagggctggggcggctacaacaacaccatccccggccccggcgacgacgtgctgatcctgcccaacagaaccgtgctggtggacaccgacctgcccttcttcaagggcctgtacgtgatgggcaccctggacttccccgtggacagaagcaacgtgctgagcgtggcctgcatggtgatcgccggcggcgagctgaaggtgggcaccctggagaaccccctggagaaggagcagaagctgctgatcctgctgagagccagcgagggcgtgttctgcgacagaatgaacggcatccacatcgaccccggcaccatcggcgtgtacggcaaggtgcacctgtacagcgcctaccccaagaacagctggacccacctgggcgccgacatcgccagcggcaacgagagaatcatcgtggaggacgccgtggactggagaccccacgacaagatcgtgctgagcagcagcagctacgagccccacgaggccgaggtgctgaccgtgaaggaggtgaagggccaccacgtgagaatctacgagagactgaagcacagacacatcggcagcgtgcacgtgaccgaggacggcagacacatcagactggccgccgaggtgggcctgctgaccagaaacatccagatccagcccgacgtgagctgcagaggcagactgttcgtgggcagcttcagaaagagcagcagagaggagttcagcggcgtgctgcagctgctgaacgtggagatccagaacttcggcagccccctgtacagcagcgtggagttcagcaacgtgagcgccggcagctggatcatcagcagcaccctgcaccagagctgcggcggcggcatccacgccgccgccagccacggcgtgctgctgaacgacaacatcgtgttcggcaccgccggccacggcatcgacctggagggccaggcctacaccgtgaccaacaacctggtggtgctgatgacccagcccgcctggagcaccatctgggtggccggcatcaaggtgaaccaggtgaaggacatcaacctgcacggcaacgtggtggccggcagcgagagactgggcttccacatcagaggccacaagtgcagcagctgcgagctgctgtggagcgacaacgtggcccacagcagcctgcacggcctgcacctgtacaaggagagcggcctggacaactgcaccagaatcagcggcttcctggccttcaagaacttcgactacggcgccatgctgcacgtggagaacagcgtggagatcgagaacatcaccctggtggacaacaccatcggcctgctggccgtggtgtacgtgttcagcgccccccagaacagcgtgaagaaggtgcagatcgtgctgagaaacagcgtgatcgtggccaccagcagcagcttcgactgcatccaggacaaggtgaagccccacagcgccaacctgaccagcaccgacagagcccccagcaaccccagaggcggcagaatcggcatcctgtggcccgtgttcaccagcgagcccaaccagtggccccaggagccctggcacaaggtgagaaacgaccacagcatcagcggcatcatgaagctgcaggacgtgaccttcagcagcttcgtgaagagctgctacagcgacgacctggacgtgtgcatcctgcccaacgccgagaacagcggcatcatgcaccccatcaccgccgagagaaccagaatgctgaagatcaaggacaagaacaagttctacttccccagcctgcagcccagaaaggacctgggcaaggtggtgtgccccgagctggactgcgccagccccagaaagtacctgttcaaggacctggacggcagagccctgggcctgcccccccccgtgagcgtgttccccaagaccgaggccgagtggaccgccagcttcttcaacgccgtgaccaccgagcaggccctgaagatcagcgagtag

SEQ ID NO: 93791 - DNA, 12225 bp, Artificial Sequence
  Description of Artificial Sequence: Synthetic coding sequence
atgaccgcctggctgatcagcctgatgagcatcgaggtgctgctgctggccgtgagacacctgagcctgcacatcgagcccgaggagggcagcctggccggcggcacctggatcaccgtgatcttcgacggcctggagctgggcgtgctgtaccccaacaacggcagccagctggagatccacctggtgaacgtgaacatggtggtgcccgccctgagaagcgtgccctgcgacgtgttccccgtgttcctggacctgcccgtggtgacctgcagaaccagaagcgtgctgagcgaggcccacgagggcctgtacttcctggaggcctacttcggcggccagctggtgagcagccccaaccccggccccagagacagctgcaccttcaagttcagcaaggcccagacccccatcgtgcaccaggtgtacccccccagcggcgtgcccggcaagctgatccacgtgtacggctggatcatcaccggcagactggagaccttcgacttcgacgccgagtacatcgacagccccgtgatcctggaggcccagggcgacaagtgggtgaccccctgcagcctgatcaacagacagatgggcagctgctaccccatccaggaggaccacggcctgggcaccctgcagtgccacgtggagggcgactacatcggcagccagaacgtgagcttcagcgtgttcaacaagggcaagagcatggtgcacaagaaggcctggctgatcagcgccaagcaggacctgttcctgtaccagacccacagcgagatcctgagcgtgttccccgagaccggcagcctgggcggcagaaccaacatcaccatcaccggcgacttcttcgacaacagcgcccaggtgaccatcgccggcatcccctgcgacatcagacacgtgagccccagaaagatcgagtgcaccaccagagcccccggcaaggacgtgagactgaccaccccccagcccggcaacagaggcctgctgttcgaggtgggcgacgccgtggagggcctggagctgaccgaggccacccccggctacagatggcagatcgtgcccaacgccagcagccccttcggcttctggagccaggagggccagcccttcagagccagactgagcggcttcttcgtggcccccgagaccaacaactacaccttctggatccaggccgacagccaggccagcctgcacttcagctggagcgaggagcccagaaccaaggtgaaggtggccagcatcagcgtgggcaccgccgactggttcgacagctgggagcagaacagagacgagggcacctggcagcagaagacccccaagctggagctgctgggcggcgccatgtactacctggaggccgagcaccacggcatcgcccccagcagaggcatgagaatcggcgtgcagatccacaacacctggctgaaccccgacgtggtgaccacctacctgagagagaagcaccagatcagagtgagagcccagagactgcccgaggtgcaggtgctgaacgtgagcggcagaggcaacttcttcctgacctgggacaacgtgagcagccagcccatccccgccaacgccaccgcccacctgatccagaccaccatcgaggagctgctggccgtgaagtgcaagctggagcccctgtggagcaacatcctgctgagactgggcttcgagagaggccccgaggtgagcaacagcgacggcgacctgaccagcggcaccgagcccttctgcggcagattcagcctgagacagcccagacacctggtgctgaccccccccgccgcccagaagggctacagactggaccagtacacccacctgtgcctggcctacaagggccacatgaacaagatcctgaagatgatcgtgagcttcaccatcggcttccagaacatggtgaagaacaccacctgcgactggagcctgaccagaaccagccccgagagctggcagttcgactgcaccgacctgtgggagacctgcgtgagatgcttcggcgacctgcagcccccccccgccaacagccccgtgctggtgcaccagatcaacctgctgcccctggcccaggagaccggcctgttctacgtggacgagatcatcatcgccgacaccaacgtgaccgtgagccaggccgacagcggcaccgccagacccggcggcaacctggtggagagcgtgagcgtggtgggcagcccccccgtgtacagcgtgaccagctggctggccggctgcggcaccgagctgcccctgatcaccgccagaagcgtgcccaccgagggcaccgaggagggcagcggcctggtgctggtgaccacccagagaagacagagaaccagcccccccctgggcggccacttcagaatccagctgcccaacaccgtgatcagcgacgtgcccgtgcagatcagcgcccaccacctgcaccagctgctgcagaacaacgccgacgacttcaccagcagatacctgaacgccagcgacttcaccgtgaaggaggacctgtacacctgctacgagcacgtgtggaccctgagctggagcacccagatcggcgacctgcccaacttcatcagagtgagcgacgagaacctgaccggcgtgaaccccgccgccgccaccagagtggtgtacgacggcggcgtgttcctgggccccatcttcggcgacatgctggccaccgccaaccagcacacccaggtggtggtgagagtgaacgacgtgcccgcccactgccccggcagctgcagcttccagtacctgcagggcagcaccccctgcgtgcacagcgtgtggtacagcatcgacggcgacatcaacctgatgatctacatcaccggcaccggcttcagcggcgacagccagttcctgcaggtgaccgtgaacaagaccagctgcaaggtgatcttcagcaaccagaccaacgtggtgtgccagaccgacctgctgcccgtgggcatgcacagaatcctgatgctggtgagacccagcggcctggccatcagcgccaccggcgaggacctgttcctgaacgtgaagcccagactggacatggtggagcccagcagagccgccgacatcggcggcctgtgggccaccatcagaggcagcagcctggagggcgtgagcctgatcctgttcggcagctacagctgcgccatcaacgtggccaccagcaacagcagcagaatccagtgcaaggtgccccccagaggcaaggacggcagaatcgtgaacgtgaccgtgatcagaggcgactacagcgccgtgctgcccagagccttcacctacgtgagcagcctgaaccccgtgatcgtgaccctgagcagaaacatcagcaacatcgccggcggcgagaccctggtgatcggcgtggccagactgatgaactacaccgacctggacgtggaggtgcacgtgcaggacgccctggcccccgtgcacacccagagcgcctggggcctggaggtggccctgccccccctgcccgccggcctgcacagaatcagcgtgagcatcaacggcgtgagcatccacagccagggcgtggacctgcacatccagtacctgaccgaggtgttcagcatcgagccctgctgcggcagcctgctgggcggcaccatcctgagcatcagcggcatcggcttcagcagagaccccgccctggtgtgggtgctggtgggcaacagaagctgcgacatcgtgaacctgaccgaggccagcatctggtgcgagaccctgcccgccccccagatccccgacgccggcgcccccaccgtgcccgccgccgtggaggtgtgggccggcaacagattcttcgccagaggccccagccccagcctggtgggcaagggcttcaccttcatgtacgaggccgccgccacccccgtggtgaccgccatgcagggcgagatcaccaacagcagcctgagcctgcacgtgggcggcagcaacctgagcaacagcgtgatcctgctgggcaacctgaactgcgacgtggagacccagagcttccagggcaacgtgagcctgagcggctgcagcatccccctgcacagcctggaggccggcatctaccccctgcaggtgagacagaagcagatgggcttcgccaacatgagcgtggtgctgcagcagttcgccgtgatgcccagaatcatggccatcttccccagccagggcagcgcctgcggcggcaccatcctgaccgtgagaggcctgctgctgaacagcagaagaagaagcgtgagagtggacctgagcggccccttcacctgcgtgatcctgagcctgggcgaccacaccatcctgtgccaggtgagcctggagggcgaccccctgcccggcgccagcttcagcctgaacgtgaccgtgctggtgaacggcctgaccagcgagtgccagggcaactgcaccctgttcatcagagaggaggccagccccgtgatggacgccctgagcaccaacaccagcggcagcctgaccaccgtgctgatcagaggccagagactggccaccaccgccgacgagcccatggtgttcgtggacgaccagctgccctgcaacgtgaccttcttcaacgccagccacgtggtgtgccagaccagagacctggcccccggcccccactacctgagcgtgttctacaccagaaacggctacgcctgcagcggcaacgtgagcagacacttctacatcatgccccaggtgttccactacttccccaagaacttcagcctgcacggcggcagcctgctgaccatcgagggcaccggcctgagaggccagaacaccaccagcgtgtacatcgaccagcagacctgcctgaccgtgaacatcggcgccgagctgatcagatgcatcgtgcccaccggcaacggcagcgtggccctggagatcgaggtggacggcctgtggtaccacatcggcgtgatcggctacaacaaggccttcacccccgagctgatcagcatcagccagagcgacgacatcctgaccttcgccgtggcccagatcagcggcgccgccaacatcgacatcttcatcggcatgagcccctgcgtgggcgtgagcggcaaccacaccgtgctgcagtgcgtggtgcccagcctgcccgccggcgagtaccacgtgagaggctacgactgcatcagaggctgggccagcagcgccctggtgttcaccagcagagtgatcatcaccgccgtgaccgagaacttcggctgcctgggcggcagactggtgcacgtgttcggcgccggcttcagccccggcaacgtgagcgccgccgtgtgcggcgccccctgcagagtgctggccaacgccaccgtgagcgccttcagctgcctggtgctgcccctggacgtgagcctggccttcctgtgcggcctgaagagagaggaggacagctgcgaggccgccagacacacctacgtgcagtgcgacctgaccgtggccatggccaccgagcagctgctggagagctggccctacctgtacatctgcgaggagagcagccagtgcctgttcgtgcccgaccactgggccgagagcatgttccccagcttcagcggcctgttcatcagccccaagctggagagagacgaggtgctgatctacaacagcagctgcaacatcaccatggagaccgaggccgagatggagtgcgagacccccaaccagcccatcaccgtgaagatcaccgagatcagaaagagatggggccagaacacccagggcaacttcagcctgcagttctgcagaagatggagcagaacccacagctggttccccgagagactgccccaggacggcgacaacgtgaccgtggagaacggccagctgctgctgctggacaccaacaccagcatcctgaacctgctgcacatcaagggcggcaagctgatcttcatggcccccggccccatcgagctgagagcccacgccatcctggtgagcgacggcggcgagctgagaatcggcagcgaggacaagcccttccagggcagagcccagatcaccctgtacggcagcagctacagcacccccttcttcccctacggcgtgaagttcctggccgtgagaaacggcaccctgagcctgcacggcagcctgcccgaggtgatcgtgacctgcctgagagccaccgcccacgccctggacaccgtgctggccctggaggacgccgtggactggaaccccggcgacgaggtggtgatcatcagcggcaccggcgtgaagggcgccaagcccatggaggagatcgtgaccgtggagaccgtgcaggacaccgacctgtacctgaagagccccctgagatacagccacaacttcaccgagaactgggtggccggcgagcaccacatcctgaaggccaccgtggccctgctgagcagaagcatcaccatccagggcaacctgaccaacgagagagagaagctgctggtgagctgccaggaggccaacgcccccgagggcaacctgcagcactgcctgtacagcatgagcgagaagatgctgggcagcagagacatgggcgccagagtgatcgtgcagagcttccccgaggagcccagccaggtgcagctgaagggcgtgcagttccaggtgctgggccaggccttccacaagcacctgagcagcctgaccctggtgggcgccatgagagagagcttcatccagggctgcaccgtgagaaacagcttcagcagaggcctgagcatgtgcggcaccctgggcctgaaggtggacagcaacgtgttctacaacatcctgggccacgccctgctggtgggcacctgcaccgagatgagatacatcagctgggaggccatccacggcagaaaggacgactggagcggccacggcaacatcatcagaaacaacgtgatcatccaggtgagcggcgccgagggcctgagcaaccccgagatgctgacccccagcggcatctacatctgcagccccaccaacgtgatcgagggcaacagagtgtgcggcgccggctacggctacttcttccacctgatgaccaaccagaccagccaggcccccctgctgagcttcacccagaacatcgcccacagctgcaccagatacggcctgttcgtgtaccccaagttccagcccccctgggacaacgtgaccggcaccaccctgttccagagcttcaccgtgtgggagagcgccggcggcgcccagatcttcagaagcagcaacctgagactgaagaacttcaaggtgtacagctgcagagacttcggcatcgacgtgctggagagcgacgccaacaccagcgtgaccgacagcctgctgctgggccacttcgcccacaagggcagcctgtgcatgagcagcggcatcaagacccccaagagatgggagctgatggtgagcaacaccaccttcgtgaacttcgacctgatcaactgcgtggccatcagaacctgcagcgactgcagccagggccagggcggcttcaccgtgaagaccagccagctgaagttcaccaacagcagcaacctggtggccttccccttcccccacgccgccatcctggaggacctggacggcagcctgagcggcaagaacagaagccacatcctggccagcatggagaccctgagcgccagctgcctggtgaacagcagcttcggcagagtggtgcacggcagcgcctgcggcggcggcgtgctgttccacagaatgagcatcggcctggccaacacccccgaggtgagctacgacctgaccatgaccgacagcagaaacaagaccaccaccgtgaactacgtgagagacaccctgagcaaccccagaggctggatggccctgctgctggaccaggagacctacagcctgcagagcgagaacctgtggatcaacagaagcctgcagtacagcgccaccttcgacaacttcgcccccggcaactacctgctgctggtgcacaccgacctgcccccctaccccgacatcctgctgagatgcggcagcagagtgggcctgagcttccccttcctgcccagccccggccagaaccagggctgcgactggttcttcaacagccagctgagacagctgacctacctggtgagcggcgagggccaggtgcaggtgatcctgagagtgaaggagggcatgccccccaccatcagcgccagcaccagcgcccccgagagcgccctgaagtggagcctgcccgagacctggcagggcgtggaggagggctggggcggctacaacaacaccatccccggccccggcgacgacgtgctgatcctgcccaacagaaccgtgctggtggacaccgacctgcccttcttcaagggcctgtacgtgatgggcaccctggacttccccgtggacagaagcaacgtgctgagcgtggcctgcatggtgatcgccggcggcgagctgaaggtgggcaccctggagaaccccctggagaaggagcagaagctgctgatcctgctgagagccagcgagggcgtgttctgcgacagaatgaacggcatccacatcgaccccggcaccatcggcgtgtacggcaaggtgcacctgtacagcgcctaccccaagaacagctggacccacctgggcgccgacatcgccagcggcaacgagagaatcatcgtggaggacgccgtggactggagaccccacgacaagatcgtgctgagcagcagcagctacgagccccacgaggccgaggtgctgaccgtgaaggaggtgaagggccaccacgtgagaatctacgagagactgaagcacagacacatcggcagcgtgcacgtgaccgaggacggcagacacatcagactggccgccgaggtgggcctgctgaccagaaacatccagatccagcccgacgtgagctgcagaggcagactgttcgtgggcagcttcagaaagagcagcagagaggagttcagcggcgtgctgcagctgctgaacgtggagatccagaacttcggcagccccctgtacagcagcgtggagttcagcaacgtgagcgccggcagctggatcatcagcagcaccctgcaccagagctgcggcggcggcatccacgccgccgccagccacggcgtgctgctgaacgacaacatcgtgttcggcaccgccggccacggcatcgacctggagggccaggcctacaccgtgaccaacaacctggtggtgctgatgacccagcccgcctggagcaccatctgggtggccggcatcaaggtgaaccaggtgaaggacatcaacctgcacggcaacgtggtggccggcagcgagagactgggcttccacatcagaggccacaagtgcagcagctgcgagctgctgtggagcgacaacgtggcccacagcagcctgcacggcctgcacctgtacaaggagagcggcctggacaactgcaccagaatcagcggcttcctggccttcaagaacttcgactacggcgccatgctgcacgtggagaacagcgtggagatcgagaacatcaccctggtggacaacaccatcggcctgctggccgtggtgtacgtgttcagcgccccccagaacagcgtgaagaaggtgcagatcgtgctgagaaacagcgtgatcgtggccaccagcagcagcttcgactgcatccaggacaaggtgaagccccacagcgccaacctgaccagcaccgacagagcccccagcaaccccagaggcggcagaatcggcatcctgtggcccgtgttcaccagcgagcccaaccagtggccccaggagccctggcacaaggtgagaaacgaccacagcatcagcggcatcatgaagctgcaggacgtgaccttcagcagcttcgtgaagagctgctacagcgacgacctggacgtgtgcatcctgcccaacgccgagaacagcggcatcatgcaccccatcaccgccgagagaaccagaatgctgaagatcaaggacaagaacaagttctacttccccagcctgcagcccagaaaggacctgggcaaggtggtgtgccccgagctggactgcgccagccccagaaagtacctgttcaaggacctggacggcagagccctgggcctgcccccccccgtgagcgtgttccccaagaccgaggccgagtggaccgccagcttcttcaacgccggcaccttcagagaggagcagaagtgcacctaccagttcctgatgcagggcttcatctgcaagcagaccgaccaggtggtgctgatcctggacagcgccgacgccatctgggccatccagaagctgtaccccgtggtgagcgtgaccagcggcttcgtggacgtgttcagcagcgtgaacgccaacatcccctgcagcaccagcggcagcgtgagcaccttctacagcatcctgcccatcagacagatcaccaaggtgtgcttcatggaccagaccccccaggtgctgagattcttcctgctgggcaacaagagcaccagcaagctgctgctggccgtgttctaccacgagctgcagagcccccacgtgttcctgggcgagagcttcatcccccccaccctggtgcagagcgccagcctgctgctgaacgagagcatcggcgccaactacttcaacatcatggacaacctgctgtacgtggtgctgcagggcgaggagcccatcgagatcagaagcggcgtgagcatccacctggccctgaccgtgatggtgagcgtgctggagaagggctgggagatcgtgatcctggagagactgaccaacttcctgcagatcggccagaaccagatcagattcatccacgagatgcccggccacgaggagaccctgaaggccatcgccgacagcagagccaagagaaagagaaactgccccaccgtgacctgcaccagccactacagaagagtgggccagagaagacccctgatgatggagatgaacagccacagagccagcccccccatgaccgtggagaccatcagcaaggtgatcgtgatcgagatcggcgacagccccaccgtgagaagcaccggcatgatcagcagcctgagcagcaacaagctgcagaacctggcccacagagtgatcaccgcccagcagaccggcgtgctggagaacgtgctgaacatgaccatcggcgccctgctggtgacccagagcaagggcgtgatcggctacggcaacaccagcagcttcaagaccggcaacctgatctacatcagaccctacgccctgagcatcctggtgcagcccagcgacggcgaggtgggcaacgagctgcccgtgcagccccagctggtgttcctggacgagcagaacagaagagtggagagcctgggcccccccagcgagccctggaccatcagcgccagcctggagggcgccagcgacagcgtgctgaagggctgcacccaggccgagacccaggacggctacgtgagcttctacaacctggccgtgctgatcagcggcagcaactggcacttcatcttcaccgtgaccagcccccccggcgtgaacttcaccgccagaagcaagcccttcgccgtgctgcccgtgaccagaaaggagaagagcaccatcatcctggccgccagcctgagcagcgtggccagctggctggccctgagctgcctggtgtgctgctggctgaagagaagcaagagcagaaagaccaagcccgaggagatccccgagagccagaccaacaaccagaacatccacatccacatcagcagcaagagaagagagagccagggccccaagaaggaggacaccgtggtgggcgaggacatgagaatgaaggtgatgctgggcaaggtgaaccagtgcccccaccagctgatgaacggcgtgagcagaagaaaggtgagcagacacatcgtgagagaggaggaggccgccgtgcccgcccccggcaccaccggcatcaccagccacggccacatctgcgcccccggcgcccccgcccagcaggtgtacctgcaggagaccggcaactggaaggagggccaggagcagctgctgagataccagctggccggccagaaccagctgctgctgctgtgccccgacttcagacaggagagacagcagctgcccggccagagcagactgagcaagcagagcggcagcctgggcctgagccaggagaagaaggccagctgcggcgccaccgaggccttctgcctgcacagcgtgcaccccgagaccatccaggagcagctgtag

SEQ ID NO: 93792 - DNA, 10191 bp, Artificial Sequence
  Description of Artificial Sequence: Synthetic coding sequence
atgaccgcctggctgatcagcctgatgagcatcgaggtgctgctgctggccgtgagacacctgagcctgcacatcgagcccgaggagggcagcctggccggcggcacctggatcaccgtgatcttcgacggcctggagctgggcgtgctgtaccccaacaacggcagccagctggagatccacctggtgaacgtgaacatggtggtgcccgccctgagaagcgtgccctgcgacgtgttccccgtgttcctggacctgcccgtggtgacctgcagaaccagaagcgtgctgagcgaggcccacgagggcctgtacttcctggaggcctacttcggcggccagctggtgagcagccccaaccccggccccagagacagctgcaccttcaagttcagcaaggcccagacccccatcgtgcaccaggtgtacccccccagcggcgtgcccggcaagctgatccacgtgtacggctggatcatcaccggcagactggagaccttcgacttcgacgccgagtacatcgacagccccgtgatcctggaggcccagggcgacaagtgggtgaccccctgcagcctgatcaacagacagatgggcagctgctaccccatccaggaggaccacggcctgggcaccctgcagtgccacgtggagggcgactacatcggcagccagaacgtgagcttcagcgtgttcaacaagggcaagagcatggtgcacaagaaggcctggctgatcagcgccaagcaggacctgttcctgtaccagacccacagcgagatcctgagcgtgttccccgagaccggcagcctgggcggcagaaccaacatcaccatcaccggcgacttcttcgacaacagcgcccaggtgaccatcgccggcatcccctgcgacatcagacacgtgagccccagaaagatcgagtgcaccaccagagcccccggcaaggacgtgagactgaccaccccccagcccggcaacagaggcctgctgttcgaggtgggcgacgccgtggagggcctggagctgaccgaggccacccccggctacagatggcagatcgtgcccaacgccagcagccccttcggcttctggagccaggagggccagcccttcagagccagactgagcggcttcttcgtggcccccgagaccaacaactacaccttctggatccaggccgacagccaggccagcctgcacttcagctggagcgaggagcccagaaccaaggtgaaggtggccagcatcagcgtgggcaccgccgactggttcgacagctgggagcagaacagagacgagggcacctggcagcagaagacccccaagctggagctgctgggcggcgccatgtactacctggaggccgagcaccacggcatcgcccccagcagaggcatgagaatcggcgtgcagatccacaacacctggctgaaccccgacgtggtgaccacctacctgagagagaagcaccagatcagagtgagagcccagagactgcccgaggtgcaggtgctgaacgtgagcggcagaggcaacttcttcctgacctgggacaacgtgagcagccagcccatccccgccaacgccaccgcccacctgatccagaccaccatcgaggagctgctggccgtgaagtgcaagctggagcccctgtggagcaacatcctgctgagactgggcttcgagagaggccccgaggtgagcaacagcgacggcgacctgaccagcggcaccgagcccttctgcggcagattcagcctgagacagcccagacacctggtgctgaccccccccgccgcccagaagggctacagactggaccagtacacccacctgtgcctggcctacaagggccacatgaacaagatcctgaagatgatcgtgagcttcaccatcggcttccagaacatggtgaagaacaccacctgcgactggagcctgaccagaaccagccccgagagctggcagttcgactgcaccgacctgtgggagacctgcgtgagatgcttcggcgacctgcagcccccccccgccaacagccccgtgctggtgcaccagatcaacctgctgcccctggcccaggagaccggcctgttctacgtggacgagatcatcatcgccgacaccaacgtgaccgtgagccaggccgacagcggcaccgccagacccggcggcaacctggtggagagcgtgagcgtggtgggcagcccccccgtgtacagcgtgaccagctggctggccggctgcggcaccgagctgcccctgatcaccgccagaagcgtgcccaccgagggcaccgaggagggcagcggcctggtgctggtgaccacccagagaagacagagaaccagcccccccctgggcggccacttcagaatccagctgcccaacaccgtgatcagcgacgtgcccgtgcagatcagcgcccaccacctgcaccagctgctgcagaacaacgccgacgacttcaccagcagatacctgaacgccagcgacttcaccgtgaaggaggacctgtacacctgctacgagcacgtgtggaccctgagctggagcacccagatcggcgacctgcccaacttcatcagagtgagcgacgagaacctgaccggcgtgaaccccgccgccgccaccagagtggtgtacgacggcggcgtgttcctgggccccatcttcggcgacatgctggccaccgccaaccagcacacccaggtggtggtgagagtgaacgacgtgcccgcccactgccccggcagctgcagcttccagtacctgcagggcagcaccccctgcgtgcacagcgtgtggtacagcatcgacggcgacatcaacctgatgatctacatcaccggcaccggcttcagcggcgacagccagttcctgcaggtgaccgtgaacaagaccagctgcaaggtgatcttcagcaaccagaccaacgtggtgtgccagaccgacctgctgcccgtgggcatgcacagaatcctgatgctggtgagacccagcggcctggccatcagcgccaccggcgaggacctgttcctgaacgtgaagcccagactggacatggtggagcccagcagagccgccgacatcggcggcctgtgggccaccatcagaggcagcagcctggagggcgtgagcctgatcctgttcggcagctacagctgcgccatcaacgtggccaccagcaacagcagcagaatccagtgcaaggtgccccccagaggcaaggacggcagaatcgtgaacgtgaccgtgatcagaggcgactacagcgccgtgctgcccagagccttcacctacgtgagcagcctgaaccccgtgatcgtgaccctgagcagaaacatcagcaacatcgccggcggcgagaccctggtgatcggcgtggccagactgatgaactacaccgacctggacgtggaggtgcacgtgcaggacgccctggcccccgtgcacacccagagcgcctggggcctggaggtggccctgccccccctgcccgccggcctgcacagaatcagcgtgagcatcaacggcgtgagcatccacagccagggcgtggacctgcacatccagtacctgaccgaggtgttcagcatcgagccctgctgcggcagcctgctgggcggcaccatcctgagcatcagcggcatcggcttcagcagagaccccgccctggtgtgggtgctggtgggcaacagaagctgcgacatcgtgaacctgaccgaggccagcatctggtgcgagaccctgcccgccccccagatccccgacgccggcgcccccaccgtgcccgccgccgtggaggtgtgggccggcaacagattcttcgccagaggccccagccccagcctggtgggcaagggcttcaccttcatgtacgaggccgccgccacccccgtggtgaccgccatgcagggcgagatcaccaacagcagcctgagcctgcacgtgggcggcagcaacctgagcaacagcgtgatcctgctgggcaacctgaactgcgacgtggagacccagagcttccagggcaacgtgagcctgagcggctgcagcatccccctgcacagcctggaggccggcatctaccccctgcaggtgagacagaagcagatgggcttcgccaacatgagcgtggtgctgcagcagttcgccgtgatgcccagaatcatggccatcttccccagccagggcagcgcctgcggcggcaccatcctgaccgtgagaggcctgctgctgaacagcagaagaagaagcgtgagagtggacctgagcggccccttcacctgcgtgatcctgagcctgggcgaccacaccatcctgtgccaggtgagcctggagggcgaccccctgcccggcgccagcttcagcctgaacgtgaccgtgctggtgaacggcctgaccagcgagtgccagggcaactgcaccctgttcatcagagaggaggccagccccgtgatggacgccctgagcaccaacaccagcggcagcctgaccaccgtgctgatcagaggccagagactggccaccaccgccgacgagcccatggtgttcgtggacgaccagctgccctgcaacgtgaccttcttcaacgccagccacgtggtgtgccagaccagagacctggcccccggcccccactacctgagcgtgttctacaccagaaacggctacgcctgcagcggcaacgtgagcagacacttctacatcatgccccaggtgttccactacttccccaagaacttcagcctgcacggcggcagcctgctgaccatcgagggcaccggcctgagaggccagaacaccaccagcgtgtacatcgaccagcagacctgcctgaccgtgaacatcggcgccgagctgatcagatgcatcgtgcccaccggcaacggcagcgtggccctggagatcgaggtggacggcctgtggtaccacatcggcgtgatcggctacaacaaggccttcacccccgagctgatcagcatcagccagagcgacgacatcctgaccttcgccgtggcccagatcagcggcgccgccaacatcgacatcttcatcggcatgagcccctgcgtgggcgtgagcggcaaccacaccgtgctgcagtgcgtggtgcccagcctgcccgccggcgagtaccacgtgagaggctacgactgcatcagaggctgggccagcagcgccctggtgttcaccagcagagtgatcatcaccgccgtgaccgagaacttcggctgcctgggcggcagactggtgcacgtgttcggcgccggcttcagccccggcaacgtgagcgccgccgtgtgcggcgccccctgcagagtgctggccaacgccaccgtgagcgccttcagctgcctggtgctgcccctggacgtgagcctggccttcctgtgcggcctgaagagagaggaggacagctgcgaggccgccagacacacctacgtgcagtgcgacctgaccgtggccatggccaccgagcagctgctggagagctggccctacctgtacatctgcgaggagagcagccagtgcctgttcgtgcccgaccactgggccgagagcatgttccccagcttcagcggcctgttcatcagccccaagctggagagagacgaggtgctgatctacaacagcagctgcaacatcaccatggagaccgaggccgagatggagtgcgagacccccaaccagcccatcaccgtgaagatcaccgagatcagaaagagatggggccagaacacccagggcaacttcagcctgcagttctgcagaagatggagcagaacccacagctggttccccgagagactgccccaggacggcgacaacgtgaccgtggagaacggccagctgctgctgctggacaccaacaccagcatcctgaacctgctgcacatcaagggcggcaagctgatcttcatggcccccggccccatcgagctgagagcccacgccatcctggtgagcgacggcggcgagctgagaatcggcagcgaggacaagcccttccagggcagagcccagatcaccctgtacggcagcagctacagcacccccttcttcccctacggcgtgaagttcctggccgtgagaaacggcaccctgagcctgcacggcagcctgcccgaggtgatcgtgacctgcctgagagccaccgcccacgccctggacaccgtgctggccctggaggacgccgtggactggaaccccggcgacgaggtggtgatcatcagcggcaccggcgtgaagggcgccaagcccatggaggagatcgtgaccgtggagaccgtgcaggacaccgacctgtacctgaagagccccctgagatacagccacaacttcaccgagaactgggtggccggcgagcaccacatcctgaaggccaccgtggccctgctgagcagaagcatcaccatccagggcaacctgaccaacgagagagagaagctgctggtgagctgccaggaggccaacgcccccgagggcaacctgcagcactgcctgtacagcatgagcgagaagatgctgggcagcagagacatgggcgccagagtgatcgtgcagagcttccccgaggagcccagccaggtgcagctgaagggcgtgcagttccaggtgctgggccaggccttccacaagcacctgagcagcctgaccctggtgggcgccatgagagagagcttcatccagggctgcaccgtgagaaacagcttcagcagaggcctgagcatgtgcggcaccctgggcctgaaggtggacagcaacgtgttctacaacatcctgggccacgccctgctggtgggcacctgcaccgagatgagatacatcagctgggaggccatccacggcagaaaggacgactggagcggccacggcaacatcatcagaaacaacgtgatcatccaggtgagcggcgccgagggcctgagcaaccccgagatgctgacccccagcggcatctacatctgcagccccaccaacgtgatcgagggcaacagagtgtgcggcgccggctacggctacttcttccacctgatgaccaaccagaccagccaggcccccctgctgagcttcacccagaacatcgcccacagctgcaccagatacggcctgttcgtgtaccccaagttccagcccccctgggacaacgtgaccggcaccaccctgttccagagcttcaccgtgtgggagagcgccggcggcgcccagatcttcagaagcagcaacctgagactgaagaacttcaaggtgtacagctgcagagacttcggcatcgacgtgctggagagcgacgccaacaccagcgtgaccgacagcctgctgctgggccacttcgcccacaagggcagcctgtgcatgagcagcggcatcaagacccccaagagatgggagctgatggtgagcaacaccaccttcgtgaacttcgacctgatcaactgcgtggccatcagaacctgcagcgactgcagccagggccagggcggcttcaccgtgaagaccagccagctgaagttcaccaacagcagcaacctggtggccttccccttcccccacgccgccatcctggaggacctggacggcagcctgagcggcaagaacagaagccacatcctggccagcatggagaccctgagcgccagctgcctggtgaacagcagcttcggcagagtggtgcacggcagcgcctgcggcggcggcgtgctgttccacagaatgagcatcggcctggccaacacccccgaggtgagctacgacctgaccatgaccgacagcagaaacaagaccaccaccgtgaactacgtgagagacaccctgagcaaccccagaggctggatggccctgctgctggaccaggagacctacagcctgcagagcgagaacctgtggatcaacagaagcctgcagtacagcgccaccttcgacaacttcgcccccggcaactacctgctgctggtgcacaccgacctgcccccctaccccgacatcctgctgagatgcggcagcagagtgggcctgagcttccccttcctgcccagccccggccagaaccagggctgcgactggttcttcaacagccagctgagacagctgacctacctggtgagcggcgagggccaggtgcaggtgatcctgagagtgaaggagggcatgccccccaccatcagcgccagcaccagcgcccccgagagcgccctgaagtggagcctgcccgagacctggcagggcgtggaggagggctggggcggctacaacaacaccatccccggccccggcgacgacgtgctgatcctgcccaacagaaccgtgctggtggacaccgacctgcccttcttcaagggcctgtacgtgatgggcaccctggacttccccgtggacagaagcaacgtgctgagcgtggcctgcatggtgatcgccggcggcgagctgaaggtgggcaccctggagaaccccctggagaaggagcagaagctgctgatcctgctgagagccagcgagggcgtgttctgcgacagaatgaacggcatccacatcgaccccggcaccatcggcgtgtacggcaaggtgcacctgtacagcgcctaccccaagaacagctggacccacctgggcgccgacatcgccagcggcaacgagagaatcatcgtggaggacgccgtggactggagaccccacgacaagatcgtgctgagcagcagcagctacgagccccacgaggccgaggtgctgaccgtgaaggaggtgaagggccaccacgtgagaatctacgagagactgaagcacagacacatcggcagcgtgcacgtgaccgaggacggcagacacatcagactggccgccgaggtgggcctgctgaccagaaacatccagatccagcccgacgtgagctgcagaggcagactgttcgtgggcagcttcagaaagagcagcagagaggagttcagcggcgtgctgcagctgctgaacgtggagatccagaacttcggcagccccctgtacagcagcgtggagttcagcaacgtgagcgccggcagctggatcatcagcagcaccctgcaccagagctgcggcggcggcatccacgccgccgccagccacggcgtgctgctgaacgacaacatcgtgttcggcaccgccggccacggcatcgacctggagggccaggcctacaccgtgaccaacaacctggtggtgctgatgacccagcccgcctggagcaccatctgggtggccggcatcaaggtgaaccaggtgaaggacatcaacctgcacggcaacgtggtggccggcagcgagagactgggcttccacatcagaggccacaagtgcagcagctgcgagctgctgtggagcgacaacgtggcccacagcagcctgcacggcctgcacctgtacaaggagagcggcctggacaactgcaccagaatcagcggcttcctggccttcaagaacttcgactacggcgccatgctgcacgtggagaacagcgtggagatcgagaacatcaccctggtggacaacaccatcggcctgctggccgtggtgtacgtgttcagcgccccccagaacagcgtgaagaaggtgcagatcgtgctgagaaacagcgtgatcgtggccaccagcagcagcttcgactgcatccaggacaaggtgaagccccacagcgccaacctgaccagcaccgacagagcccccagcaaccccagaggcggcagaatcggcatcctgtggcccgtgttcaccagcgagcccaaccagtggccccaggagccctggcacaaggtgagaaacgaccacagcatcagcggcatcatgaagctgcaggacgtgaccttcagcagcttcgtgaagagctgctacagcgacgacctggacgtgtgcatcctgcccaacgccgagaacagcggcatcatgcaccccatcaccgccgagagaaccagaatgctgaagatcaaggacaagaacaagttctacttccccagcctgcagcccagaaaggacctgggcaaggtggtgtgccccgagctggactgcgccagccccagaaagtacctgttcaaggacctggacggcagagccctgggcctgcccccccccgtgagcgtgttccccaagaccgaggccgagtggaccgccagcttcttcaacgccggcaccaaggagcagagcatcgagatcaacgtgtag

SEQ ID NO: 93793 - DNA, 12732 bp, Artificial Sequence
  Description of Artificial Sequence: Synthetic coding sequence
atgggccacctgtggctgctgggcatctggggcctgtgcggcctgctgctgtgcgccgccgaccccagcaccgacggcagccagatcatccccaaggtgaccgagatcatccccaagtacggcagcatcaacggcgccaccagactgaccatcagaggcgagggcttcagccaggccaaccagttcaactacggcgtggacaacgccgagctgggcaacagcgtgcagctgatcagcagcttccagagcatcacctgcgacgtggagaaggacgccagccacagcacccagatcacctgctacaccagagccatgcccgaggacagctacaccgtgagagtgagcgtggacggcgtgcccgtgaccgagaacaacacctgcaagggccacatcaacagctgggagtgcaccttcaacgccaagagcttcagaacccccaccatcagaagcatcacccccctgagcggcacccccggcaccctgatcaccatccagggcagaatcttcaccgacgtgtacggcagcaacatcgccctgagcagcaacggcaagaacgtgagaatcctgagagtgtacatcggcggcatgccctgcgagctgctgatcccccagagcgacaacctgtacggcctgaagctggaccaccccaacggcgacatgggcagcatggtgtgcaagaccaccggcaccttcatcggccaccacaacgtgagcttcatcctggacaacgactacggcagaagcttcccccagaagatggcctacttcgtgagcagcctgaacaagatcgccatgttccagacctacgccgaggtgaccatgatcttccccagccagggcagcatcagaggcggcaccaccctgaccatcagcggcagattcttcgaccagaccgacttccccgtgagagtgctggtgggcggcgagccctgcgacatcctgaacgtgaccgagaacagcatctgctgcaagaccccccccaagccccacatcctgaagaccgtgtaccccggcggcagaggcctgaagctggaggtgtggaacaacagcagacccatcagactggaggagatcctggagtacaacgagaagacccccggctacatgggcgccagctgggtggacagcgccagctacatctggctgatggagcaggacaccttcgtggccagattcagcggcttcctggtggcccccgacagcgacgtgtacagattctacatcaagggcgacgacagatacgccatctacttcagccagaccggcctgcccgaggacaaggtgagaatcgcctaccacagcgccaacgccaacagctacttcagcagccccacccagagaagcgacgacatccacctgcagaagggcaaggagtactacatcgagatcctgctgcaggagtacagactgagcgccttcgtggacgtgggcctgtaccagtacagaaacgtgtacaccgagcagcagaccggcgacgccgtgaacgaggagcaggtgatcaagagccagagcaccatcctgcaggaggtgcaggtgatcaccctggagaactgggagaccaccaacgccatcaacgaggtgcagaagatcaaggtgaccagcccctgcgtggaggccaacagctgcagcctgtaccagtacagactgatctacaacatggagaagaccgtgttcctgcccgccgacgccagcgagttcatcctgcagagcgccctgaacgacctgtggagcatcaagcccgacaccgtgcaggtgatcagaacccagaacccccagagctacgtgtacatggtgaccttcatcagcaccagaggcgacttcgacctgctgggctacgaggtggtggagggcaacaacgtgaccctggacatcaccgagcagaccaagggcaagcccaacctggagaccttcaccctgaactgggacggcatcgccagcaagcccctgaccctgtggagcagcgaggccgagttccagggcgccgtggaggagatggtgagcaccaagtgccccccccagatcgccaacttcgaggagggcttcgtggtgaagtacttcagagactacgagaccgacttcaacctggagcacatcaacagaggccagaagaccgccgagaccgacgcctactgcggcagatacagcctgaagaaccccgccgtgctgttcgacagcgccgacgtgaagcccaacagaagaccctacggcgacatcctgctgttcccctacaaccagctgtgcctggcctacaagggcttcctggccaactacatcggcctgaagttccagtaccaggacaacagcaagatcaccagaagcaccgacacccagttcacctacaacttcgcctacggcaacaactggacctacacctgcatcgacctgctggacctggtgagaaccaagtacaccggcaccaacgtgagcctgcagagaatcagcctgcacaaggccagcgagagccagagcttctacgtggacgtggtgtacatcggccacaccagcaccatcagcaccctggacgagatgcccaagagaagactgcccgccctggccaacaagggcatcttcctggagcacttccaggtgaaccagaccaagaccaacggccccaccatgaccaaccagtacagcgtgaccatgaccagctacaactgcagctacaacatccccatgatggccgtgagcttcggccagatcatcacccacgagaccgagaacgagttcgtgtacagaggcaacaactggcccggcgagagcaagatccacatccagagaatccaggccgccagcccccccctgagcggcagcttcgacatccaggcctacggccacatcctgaagggcctgcccgccgccgtgagcgccgccgacctgcagttcgccctgcagagcctggagggcatgggcagaatcagcgtgaccagagagggcacctgcgccggctacgcctggaacatcaagtggagaagcacctgcggcaagcagaacctgctgcagatcaacgacagcaacatcatcggcgagaaggccaacatgaccgtgaccagaatcaaggagggcggcctgttcagacagcacgtgctgggcgacctgctgagaacccccagccagcagccccaggtggaggtgtacgtgaacggcatccccgccaagtgcagcggcgactgcggcttcacctgggacagcaacatcacccccctggtgctggccatcagccccagccagggcagctacgaggagggcaccatcctgaccatcgtgggcagcggcttcagccccagcagcgccgtgaccgtgagcgtgggccccgtgggctgcagcctgctgagcgtggacgagaaggagctgaagtgccagatcctgaacggcagcgccggccacgcccccgtggccgtgagcatggccgacgtgggcctggcccagaacgtgggcggcgaggagttctacttcgtgtaccagagccagatcagccacatctggcccgacagcggcagcatcgccggcggcaccctgctgaccctgagcggcttcggcttcaacgagaacagcaaggtgctggtgggcaacgagacctgcaacgtgatcgagggcgacctgaacagaatcacctgcagaacccccaagaagaccgagggcaccgtggacatcagcgtgaccaccaacggcttccaggccaccgccagagacgccttcagctacaactgcctgcagacccccatcatcaccgacttcagccccaaggtgagaaccatcctgggcgaggtgaacctgaccatcaagggctacaacttcggcaacgagctgacccagaacatggccgtgtacgtgggcggcaagacctgccagatcctgcactggaacttcaccgacatcagatgcctgctgcccaagctgagccccggcaagcacgacatctacgtggaggtgagaaactggggcttcgccagcaccagagacaagctgaacagcagcatccagtacgtgctggaggtgaccagcatgttcccccagagaggcagcctgttcggcggcaccgagatcaccatcagaggcttcggcttcagcaccatccccgccgagaacaccgtgctgctgggcagcatcccctgcaacgtgaccagcagcagcgagaacgtgatcaagtgcatcctgcacagcaccggcaacatcttcagaatcaccaacaacggcaaggacagcgtgcacggcctgggctacgcctggagcccccccgtgctgaacgtgagcgtgggcgacaccgtggcctggcactggcagacccaccccttcctgagaggcatcggctacagaatcttcagcgtgagcagccccggcagcgtgatctacgacggcaagggcttcaccagcggcagacagaagagcaccagcggcagcttcagctaccagttcaccagccccggcatccactactacagcagcggctacgtggacgaggcccacagcatcttcctgcagggcgtgatcaacgtgctgcccgccgagaccagacacatccccctgcacctgttcgtgggcagaagcgaggccacctacgcctacggcggccccgagaacctgcacctgggcagcagcgtggccggctgcctggccaccgagcccctgtgcagcctgaacaacaccagagtgaagaacagcaagagactgctgttcgaggtgagcagctgcttcagccccagcatcagcaacatcacccccagcaccggcaccgtgaacgagctgatcaccatcatcggccacggcttcagcaacctgccctgggccaacaaggtgaccatcggcagctacccctgcgtggtggaggagagcagcgaggacagcatcacctgccacatcgacccccagaacagcatggacgtgggcatcagagagaccgtgaccctgaccgtgtacaacctgggcaccgccatcaacaccctgagcaacgagttcgacagaagattcgtgctgctgcccaacatcgacctggtgctgcccaacgccggcagcaccaccggcatgaccagcgtgaccatcaagggcagcggcttcgccgtgagcagcgccggcgtgaaggtgctgatgggccacttcccctgcaaggtgctgagcgtgaactacaccgccatcgagtgcgagaccagccccgccgcccagcagctggtggacgtggacctgctgatccacggcgtgcccgcccagtgccagggcaactgcaccttcagctacctggagagcatcaccccctacatcaccggcgtgttccccaacagcgtgatcggcagcgtgaaggtgctgatcgagggcgagggcctgggcaccgtgctggaggacatcgccgtgttcatcggcaaccagcagttcagagccatcgaggtgaacgagaacaacatcaccgccctggtgacccccctgcccgtgggccaccacagcgtgagcgtggtggtgggcagcaagggcctggccctgggcaacctgaccgtgagcagcccccccgtggccagcctgagccccaccagcggcagcatcggcggcggcaccaccctggtgatcaccggcaacggcttctaccccggcaacaccaccgtgaccatcggcgacgagccctgccagatcatcagcatcaaccccaacgaggtgtactgcagaacccccgccggcaccaccggcatggtggacgtgaagatcttcgtgaacaccatcgcctacccccccctgctgttcacctacgccctggaggacacccccttcctgagaggcatcatccccagcagaggcccccccggcaccgagatcgagatcaccggcagcaacttcggcttcgagatcctggagatcagcgtgatgatcaacaacatccagtgcaacgtgaccatggccaacgacagcgtggtgcagtgcatcgtgggcgaccacgccggcggcaccttccccgtgatgatgcaccacaagaccaagggcagcgccatgagcaccgtggtgttcgagtaccccctgaacatccagaacatcaaccccagccagggcagcttcggcggcggccagaccatgaccgtgaccggcaccggcttcaacccccagaacagcatcatcctggtgtgcggcagcgagtgcgccatcgacagactgagaagcgactacaccaccctgctgtgcgagatccccagcaacaacggcaccggcgccgagcaggcctgcgaggtgagcgtggtgaacggcaaggacctgagccagagcatgacccccttcacctacgccgtgagcctgacccccctgatcaccgccgtgagccccaagagaggcagcaccgccggcggcaccagactgaccgtggtgggcagcggcttcagcgagaacatggaggacgtgcacatcaccatcgccgaggccaagtgcgacgtggagtacagcaacaagacccacatcatctgcatgaccgacgcccacaccctgagcggctgggcccccgtgtgcgtgcacatcagaggcgtgggcatggccaagctggacaacgccgacttcctgtacgtggacgcctggagcagcaacttcagctggggcggcaagagcccccccgaggagggcagcctggtggtgatcaccaagggccagaccatcctgctggaccagagcacccccatcctgaagatgctgctgatccagggcggcaccctgatcttcgacgaggccgacatcgagctgcaggccgagaacatcctgatcaccgacggcggcgtgctgcagatcggcaccgagaccagccccttccagcacaaggccgtgatcaccctgcacggccacctgagaagccccgagctgcccgtgtacggcgccaagaccctggccgtgagagagggcatcctggacctgcacggcgtgcccgtgcccgtgacctggaccagactggcccacaccgccaaggccggcgagagaatcctgatcctgcaggaggccgtgacctggaagcccggcgacaacatcgtgatcgccagcaccggccacagacacagccagggcgagaacgagaagatgaccatcgccagcgtgagcgccgacggcatcaacatcaccctgagcaaccccctgaactacacccacctgggcatcaccgtgaccctgcccgacggcaccctgttcgaggccagagccgaggtgggcatcctgaccagaaacatcctgatcagaggcagcgacaacgtggagtggaacaacaagatccccgcctgccccgacggcttcgacaccggcgagttcgccacccagacctgcctgcagggcaagttcggcgaggagatcggcagcgaccagttcggcggctgcgtgatgttccacgcccccgtgcccggcgccaacatggtgaccggcagaatcgagtacgtggaggtgttccacgccggccaggccttcagactgggcagataccccatccactggcacctgctgggcgacctgcagttcaagagctacgtgagaggctgcgccatccaccaggcctacaacagagccgtgaccatccacaacacccaccacctgctggtggagagaaacatcatctacgacatcaagggcggcgccttcttcatcgaggacggcatcgagcacggcaacatcctgcagtacaacctggccgtgttcgtgcagcagagcaccagcctgctgaacgacgacgtgacccccgccgccttctgggtgaccaaccccaacaacaccatcagacacaacgccgtggccggcggcacccacttcggcttctggtacagaatgaacaaccaccccgacggccccagctacgacagaaacatctgccagaagagagtgcccctgggcgagttcttcaacaacaccgtgcacagccagggctggttcggcatgtggatcttcgaggagtacttccccatgcagaccggcagctgcaccagcaccgtgcccgcccccgccatcttcaacagcctgaccacctggaactgccagaagggcgccgagtgggtgaacggcggcgccctgcagttccacaacttcgtgatggtgaacaactacgaggccggcatcgagaccaagagaatcctggccccctacgtgggcggctggggcgagaccaacggcgccgtgatcaagaacgccaagatcgtgggccacctggacgagctgggcatgggcagcgccttctgcaccgccaagggcctggtgctgcccttcagcgagggcctgaccgtgagcagcgtgcacttcatgaacttcgacagacccaactgcgtggccctgggcgtgaccagcatcagcggcgtgtgcaacgacagatgcggcggctggagcgccaagttcgtggacgtgcagtacagccacacccccaacaaggccggcttcagatgggagcacgagatggtgatgatcgacgtggacggcagcctgaccggccacaagggccacaccgtgatcccccacagcagcctgctggaccccagccactgcacccaggaggccgagtggagcatcggcttccccggcagcgtgtgcgacgccagcgtgagcttccacagactggccttcaaccagcccagccccgtgagcctgctggagaaggacgtggtgctgagcgacagcttcggcaccagcatcatccccttccagaagaagagactgacccacatgagcggctggatggccctgatccccaacgccaaccacatcaactggtacttcaagggcgtggaccacatcaccaacatcagctacaccagcaccttctacggcttcaaggaggaggactacgtgatcatcagccacaacttcacccagaaccccgacatgttcaacatcatcgacatgagaaacggcagcagcaaccccctgaactggaacaccagcaagaacggcgactggcacctggaggccaacaccagcaccctgtactacctggtgagcggcagaaacgacctgcaccagagccagctgatcagcggcaacctggaccccgacgtgaaggacgtggtgatcaacttccaggcctactgctgcatcctgcaggactgcttccccgtgcacccccccagcagaaagcccatccccaagaagagacccgccacctacaacctgtggagcaacgacagcttctggcagagcagcagagagaacaactacaccgtgccccaccccggcgccaacgtgatcatccccgagggcacctggatcgtggccgacatcgacatgcccagcatggagagactgatcatctggggcgtgctggagctggaggacaagtacaacgtgggcgccgccgagagcagctacagagaggtggtgctgaacgccacctacatcagcctgcagggcggcagactgatcggcggctgggaggacaaccccttcaagggcgacctgaagatcgtgctgagaggcaaccacaccacccaggactgggccctgcccgagggccccaaccagggcgccaaggtgctgggcgtgttcggcgagctggacctgcacggcatcccccacagcatctacaagaccaagctgagcgagaccgccttcgccggcagcaaggtgctgagcctgatggacgccgtggactggcaggagggcgaggagatcgtgatcaccaccaccagctacgacttccaccagaccgagaccagaagcatcgtgaagatcctgcacgaccacaagatcctgatcctgaacgacagcctgagctacacccacttcgccgagaagtaccacgtgcccggcaccggcgagagctacaccctggccgccgacgtgggcatcctgagcagaaacatcaagatcgtgggcgaggactaccccggctggagcgaggacagcttcggcgccagagtgctggtgggcagcttcaccgagaacatgatgaccttcaagggcaacgccagaatcagcaacgtggagttctaccacagcggccaggagggcttcagagacagcaccgaccccagatacgccgtgaccttcctgaacctgggccagatccaggagcacggcagcagctacatcagaggctgcgccttccaccacggcttcagccccgccatcggcgtgttcggcaccgacggcctggacatcgacgacaacatcatccacttcaccgtgggcgagggcatcagaatctggggcaacgccaacagagtgagaggcaacctgatcgccctgagcgtgtggcccggcacctaccagaacagaaaggacctgagcagcaccctgtggcacgccgccatcgagatcaacagaggcaccaacaccgtgctgcagaacaacgtggtggccggcttcggcagagccggctacagaatcgacggcgagccctgccccggccagttcaaccccgtggagaagtggttcgacaacgaggcccacggcggcctgtacggcatctacatgaaccaggacggcctgcccggctgcagcctgatccagggcttcaccatctggacctgctgggactacggcatctacttccagaccaccgagagcgtgcacatctacaacgtgaccctggtggacaacggcatggccatcttccccatgatctacatgcccgccgccatcagccacaagatcagcagcaagaacgtgcagatcaagagcagcctgatcgtgggcagcagccccggcttcaactgcagcgacgtgctgaccaacgacgaccccaacatcgagctgaccgccgcccacagaagccccagaagccccagcggcggcagaagcggcatctgctggcccaccttcgccagcgcccacaacatggcccccagaaagccccacgccggcatcatgagctacaacgccatcagcggcctgctggacatcagcggcagcaccttcgtgggcttcaagaacgtgtgcagcggcgagaccaacgtgatcttcatcaccaaccccctgaacgaggacctgcagcaccccatccacgtgaagaacatcaagctggtggacaccaccgagcagagcaagatcttcatccacagacccgacatcagcaaggtgaaccccagcgactgcgtggacatggtgtgcgacgccaagagaaagagcttcctgagagacatcgacggcagcttcctgggcaacgccggcagcgtgatcccccaggccgagtacgagtgggacggcaacagccaggtgggcatcggcgactacagaatccccaaggccatgctgaccttcctgaacggcagcagaatccccgtgaccgagaaggccccccacaagggcatcatcagagacagcacctgcaagtacctgcccgagtggcagagctaccagtgcttcggcatggagtacgccatgatggtgatcgagagcctggaccccgacaccgagaccagaagactgagccccgtggccatcatgggcaacggctacgtggacctgatcaacggcccccaggaccacggctggtgcgccggctacacctgccagagaagactgagcctgttccacagcatcgtggccctgaacaagagctacgaggtgtacttcaccggcaccagcccccagaacctgagactgatgctgctgaacgtggaccacaacaaggccgtgctggtgggcatcttcttcagcaccctgcagagactggacgtgtacgtgaacaacctgctggtgtgccccaagaccaccatctggaacgcccagcagaagcactgcgagctgaacaaccacctgtacaaggaccagttcctgcccaacctggacagcaccgtgctgggcgagaactacttcgacggcacctaccagatgctgtacctgctggtgaagggcaccatccccgtggagatccacaccgccaccgtgatcttcgtgagcttccagctgagcgtggccaccgaggacgacttctacaccagccacaacctggtgaagaacctggccctgttcctgaagatccccagcgacaagatcagaatcagcaagatcagaggcaagagcctgagaagaaagagaagcatgggcttcatcatcgagatcgagatcggcgacccccccatccagttcatcagcaacggcaccaccggccagatgcagctgagcgagctgcaggagatcgccggcagcctgggccaggccgtgatcctgggcaacatcagcagcatcctgggcttcaacatcagcagcatgagcatcaccaaccccctgcccagccccagcgacagcggctggatcaaggtgaccgcccagcccgtggagagaagcgccttccccgtgcaccacgtggccttcgtgagcagcctgctggtgatcacccagcccgtggccgcccagcccggccagcccttcccccagcagcccagcgtgaaggccaccgacagcgacggcaactgcgtgagcgtgggcatcaccgccctgaccctgagagccatcctgaaggacagcaacaacaaccaggtgaacggcctgagcggcaacaccaccatccccttcagcagctgctgggccaactacaccgacctgacccccctgagaaccggcaagaactacaagatcgagttcatcctggacaacgtggtgggcgtggagagcagaaccttcagcctgctggccgagagcgtgagcagcagcggcagcagcagcagcagcaacagcaaggccagcaccgtgggcacctacgcccagatcatgaccgtggtgatcagctgcctggtgggcagaatgtggctgctggagatcttcatggccgccgtgagcaccctgaacatcaccctgagaagctactag

SEQ ID NO: 93794 - DNA, 6762 bp, Artificial Sequence
  Description of Artificial Sequence: Synthetic coding sequence
atgagacccggccccgccctgctgctgctgggcgtgggcctgagcctgagcgtgggcagactgcccctgccccccgtgcccagaggcgcccaggccgccgtgagcggcgcccccggcggcctgctgagaggcgcccccggcctgggcgtgagaggcggcagagccctgctgagcctgagacccagcgccgtgagagccggcggcgccgtgctgagcggcagaggcagcctgtgcttcccccacggcggcaccggcagaagatggtactgcctggacctgagagtgctgctgagcgcccagagactgccctggcccgccgcccccgccctggccctggtggacctgcagctgagcgccagaggcggcagactgagcctgacctggagcgtgagactgcccagaagccccggcagactggcctgggccttcagactgagactgctgggccccggcgccgccagacccgccagccccgccgccagagtgagccccagaagcgccgcccccggccccagaccccagcagggcttcgtggccagaaccgagtgccccaccgacggccccgccagagtgatgctgcaggccgtgaacagcagcagccacagagccgtggagagcagcgtgagctgccagatcaacgcctgcgtgatccagagagtgagaatcaacaccgaccagaagggcgcccccgtgagactgagcatgcaggccgaggccaccatcaacgccagcgtgcagctggactgccccgccgccagagccatcgcccagtactggcaggtgttcagcgtgcccgccgtgggccaggcccccgactggacccagcccctggacctgccccagctggagatcagaaacagccccctgttcatccacatccccaacaacagcctgcagtggggcgtgtacgtgttcaacttcaccgtgagcatcaccaccggcaaccccaagatgcccgaggtgaaggacagcgacgccgtgtacgtgtggatcgtgagaagcagcctgcaggccgtgatgctgggcgacgccaacatcaccgccaacttcaccgagcagctgatcctggacggcagcaccagcagcgaccccgacgccgacagccccctgcagggcctgcagttcttctggtactgcaccaccgaccccagaaactacggcggcgacagaatcatcctgggcagcaaggaggtgtgccaccccgagcaggccaacctgaagtggccctgggccagcggccccgtgctgaccctgctgcccgagaccctgaagggcgaccacgtgtacttcttcagaatggtgatcagaaaggacagcagaaccgccttcagcgacaagagagtgcacgtgctgcagggccccaaggccatcgcccacatcacctgcatcgagaactgcgagagaaacttcatcgtgagcgacagattcagcctgttcctgaactgcaccaactgcgccagcagagacttctacaagtggagcatcctgagcagcagcggcggcgagatgctgttcgactggatgggcgagaccgtgaccggcagaaacggcgcctacctgagcatcaaggccttcgccttcagacacttcctggaggccgagttcagcatcagcctgtacctggcctgctggagcggcgtgaccagcgtgttcagacacagcttcatcatcaaccacggcccccagatcggcgagtgcaagatcaaccccgccaagggcatcgccctgatcaccaagttcgtggtgcagtgcagcaacttcagagacaagcacgtgcccctgacctacaagatcatcgtgagcgacctgcacagcgtgggcgagatcagcagcgtgaaggagaacaccctgggcaccatcctgtacctgggcccccagagcaccgtgccccccagcttcctgcccgtgggcatgctggccagccagtacggcctgaagatctacgcccaggtgtacgacagcctgggcgccttcagccaggtgaccctgcacgccaccgcccaggcccccaccgacaagaacagcagcaagaccgtgctgaaccagctgctgagcttcaccgtgggccccagcagcctgctgagcaccctgatccagaagaaggacttcctgcccgccggctacctgctgtacatcgtggccagcgtgctgaacaacatgaagaccgagctgcccctgagagacgacagagtgaacctgagaaagcacctgatcgaccagagcttcctgctgcccgtgagcaccctggtggagatcggccaggtggtgatgaccatcaccaagctgacccagaagcccagcgagttcacctgggacgcccagaagagagccaccatgagagtgtggcaggccaaccaggccctgcaggagtaccagcagaaggacaagagattcagaagcgagcagatcgagatcgtgagcaccggcatcctgatgagcctgagcaacatcctgaagatgaccagcccccaccaggtggtgaaggaccccttctacgtgatcgagagcctgagcgacaccatcctggccaacaaggtgcccggcaacaagaccaccagcatgagaacccccaacttcaacatgtacgtgaagaaggtggagaagtggggcatcaaccagctgttcagaaacgagaagcactgcagaaactgcttctaccccaccctgaacgtgagcagcgtgcccggcctgagcgccaacggccccatcagcaccatgttctgcgacttcaccaacgacctgttcccctggctgaacgaccaggagaacaccagcgtggaggtgagcggcttcagaatgaccggcgtggccgacaacggcagcgtgctggagatcacccccgacgtggccgaggtgtacctggtgagaaagaacctgaccttcgccgccttcaacctgaccgtgggccccaacagcgaggtggacggcagcctgaagaagaccaccggcggcttcagcttccaggtggacagcaccgtgctgagagaggtgctggtgcacatcgtgaccgaggtgatggtgctgttcaccgtgctggtgtacaccggcagccagatcacccccaccgccctggtggccaccttcctggtgccccacgacatcccccccttcgccagccagagcgccctgttcgaccccgcctgcaccgtgaagaaggccagagtggtgtgcctgcccgtgagcctgctgcagctgatcgcccagcacagccacagcccccactgcaccgtgagcatcgtgctgcaggcccccagattcgtgatgaagctgaacgacaagctggtgagaatcagcatcttcagcgtgcagtgcctggacatgtacggcatccagagcgagtggagagagggctactgcatcctgggcgagaagaccagctggtacgaggtgcactgcatctgcaagaacgtggtgagagccagaagacagctgggcaccatcggcctgaccggcatccacctgcacacccactacgtgatggccaaggtgatcgtgatccccaaccccgtggacctgagactgaacatcatcaagagcctgcaccagaaccccgtgaccctgttcaccgtgctgttcatcatcctgctgtacgtgggcctggccttctgggccctgtacagagacgagatggaccagcacctgagaggccacgtgatcgtgctgcccgacaacgacccctacgacaacctgtgctacctggtgaccatcttcaccggcagcagatggggcagcggcaccagagccaacgtgttcgtgcagctgagaggcaccgtgagcaccagcgacgtgcactgcctgagccacccccacttcaccaccctgtacagaggcagcatcaacaccttcctgctgaccaccaagagcgacctgggcgacatccacagcatcagagtgtggcacaacaacgagggcagaagccccagctggtacctgagcagaatcaaggtggagaacctgttcagcagacacatctggctgttcatctgccagaagtggctgagcgtggacaccaccctggacagaaccttccacgtgacccaccccgacgagagactgaccagaaaggacttcttcttcatcgacgtgagcagcaacctgagaaagaaccacatgtggttcagcatcttcgccagcgtggtggccaagaccttcaacagactgcagagactgagctgctgcctggccatgctgctgagcagcctgctgtgcaacatcatgttcttcaacctgaacagacaggagcagaccgagagcagagagagaaagtacatgagaagcatgatgatcggcatcgagagcgtgctgatcaccatccccgtgcagctgctgatcaccttcctgttcacctgcagccagagaaagccccaggccgacctgaaggaggtgagcccccagaagcaccccctgatgagcgaggccagcgagcactgggaggagtacctgagaaagtggcacgcctacgagaccgccaaggtgcaccccagagaggtggccaagcccgccagcaagggcaagcccagactgcccaaggccagccccaaggccaccagcaagcccaagcacagacacagaaaggcccagatcaagacccccgagaccctgggccccaacaccaacagcaacaacaacatcgaggacgaccaggacgtgcacagcgagcagcaccccagccagaaggacctgcagcagctgaagaagaagcccagaatcgtgctgccctggtggtgcgtgtacgtggcctggttcctggtgttcgccaccagcagcatcagcagcttcttcatcgtgttctacggcctgacctacggctacgacaagagcatcgagtggctgttcgccagcttctgcagcttctgccagagcgtgctgctggtgcagcccagcaagatcatcctgctgagcggcttcagaaccaacaagcccaagtactgcaagaacctgagctggagcaccaagtacaagtacaccgagatcagactggacggcatgagaatgcaccccgaggagatgcagagaatccacgaccagatcgtgagaatcagaggcaccagaatgtaccagcccctgaccgaggacgagatcagaatcttcaagagaaagaagagaatcaagagaagagccctgctgttcctgagctacatcctgacccacttcatcttcctggccctgctgctgatcctgatcgtgctgctgagacacaccgactgcttctactacaaccagttcatcagagacagattcagcatggacctggccaccgtgaccaagctggaggacatctacagatggctgaacagcgtgctgctgcccctgctgcacaacgacctgaaccccaccttcctgcccgagagcagcagcaagatcctgggcctgcccctgatgagacaggtgagagccaagagcagcgagaagatgtgcctgcccgccgagaagttcgtgcagaacagcatcagaagagagatccactgccaccccaagtacggcatcgaccccgaggacaccaagaactacagcggcttctggaacgaggtggacaagcaggccatcgacgagagcaccaacggcttcacctacaagccccagggcacccagtggctgtactacagctacggcctgctgcacacctacggcagcggcggctacgccctgtacttcttccccgagcagcagagattcaacagcaccctgagactgaaggagctgcaggagagcaactggctggacgagaagacctgggccgtggtgctggagctgaccaccttcaaccccgacatcaacctgttctgcagcatcagcgtgatcttcgaggtgagccagctgggcgtggtgaacaccagcatcagcctgcacagcttcagcctggccgacttcgacagaaaggccagcgccgagatctacctgtacgtggccatcctgatcttcttcctggcctacgtggtggacgagggctgcatcatcatgcaggagagagccagctacgtgagaagcgtgtacaacctgctgaacttcgccctgaagtgcatcttcaccgtgctgatcgtgctgttcctgagaaagcacttcctggccaccggcatcatcagattctacctgagcaaccccgaggacttcatccccttccacgccgtgagccaggtggaccacatcatgagaatcatcctgggcttcctgctgttcctgaccatcctgaagaccctgagatacagcagattcttctacgacgtgagactggcccagagagccatccaggccgccctgcccggcatctgccacatggccttcgtggtgagcgtgtacttcttcgtgtacatggccttcggctacctggtgttcggccagcacgagtggaactacagcaacctgatccacagcacccagaccgtgttcagctactgcgtgagcgccttccagaacaccgagttcagcaacaacagaatcctgggcgtgctgttcctgagcagcttcatgctggtgatgatctgcgtgctgatcaacctgttccaggccgtgatcctgagcgcctacgaggagatgaagcagcccgtgtacgaggagcccagcgacgaggtggaggccatgacctacctgtgcagaaagctgagaaccatgttcagcttcctgaccagccagagcaaggccaaggacgagcccgagttcttcatcgacatgctgtacggccagcccgagaagaacagccacagatacctgggcctgaagaccagaaacatcaacggcaagaagatggtgtacctggtggtgtag

SEQ ID NO: 93795 - DNA, 12912 bp, Artificial Sequence
  Description of Artificial Sequence: Synthetic coding sequence
atgccccccgccgcccccgccagactggccctggccctgggcctgggcctgtggctgggcgccctggccggcggccccggcagaggctgcggcccctgcgagcccccctgcctgtgcggccccgcccccggcgccgcctgcagagtgaactgcagcggcagaggcctgagaaccctgggccccgccctgagaatccccgccgacgccaccgccctggacgtgagccacaacctgctgagagccctggacgtgggcctgctggccaacctgagcgccctggccgagctggacatcagcaacaacaagatcagcaccctggaggagggcatcttcgccaacctgttcaacctgagcgagatcaacctgagcggcaaccccttcgagtgcgactgcggcctggcctggctgcccagatgggccgaggagcagcaggtgagagtggtgcagcccgaggccgccacctgcgccggccccggcagcctggccggccagcccctgctgggcatccccctgctggacagcggctgcggcgaggagtacgtggcctgcctgcccgacaacagcagcggcaccgtggccgccgtgagcttcagcgccgcccacgagggcctgctgcagcccgaggcctgcagcgccttctgcttcagcaccggccagggcctggccgccctgagcgagcagggctggtgcctgtgcggcgccgcccagcccagcagcgccagcttcgcctgcctgagcctgtgcagcggccccccccccccccccgcccccacctgcagaggccccaccctgctgcagcacgtgttccccgccagccccggcgccaccctggtgggcccccacggccccctggccagcggccagctggccgccttccacatcgccgcccccctgcccgtgaccgccaccagatgggacttcggcgacggcagcgccgaggtggacgccgccggccccgccgccagccacagatacgtgctgcccggcagataccacgtgaccgccgtgctggccctgggcgccggcagcgccctgctgggcaccgacgtgcaggtggaggccgcccccgccgccctggagctggtgtgccccagcagcgtgcagagcgacgagagcctggacctgagcatccagaacagaggcggcagcggcctggaggccgcctacagcatcgtggccctgggcgaggagcccgccagagccgtgcaccccctgtgccccagcgacaccgagatcttccccggcaacggccactgctacagactggtggtggagaaggccgcctggctgcaggcccaggagcagtgccaggcctgggccggcgccgccctggccatggtggacagccccgccgtgcagagattcctggtgagcagagtgaccagaagcctggacgtgtggatcggcttcagcaccgtgcagggcgtggaggtgggccccgccccccagggcgaggccttcagcctggagagctgccagaactggctgcccggcgagccccaccccgccaccgccgagcactgcgtgagactgggccccaccggctggtgcaacaccgacctgtgcagcgccccccacagctacgtgtgcgagctgcagcccggcggccccgtgcaggacgccgagaacctgctggtgggcgcccccagcggcgacctgcagggccccctgacccccctggcccagcaggacggcctgagcgccccccacgagcccgtggaggtgatggtgttccccggcctgagactgagcagagaggccttcctgaccaccgccgagttcggcacccaggagctgagaagacccgcccagctgagactgcaggtgtacagactgctgagcaccgccggcacccccgagaacggcagcgagcccgagagcagaagccccgacaacagaacccagctggcccccgcctgcatgcccggcggcagatggtgccccggcgccaacatctgcctgcccctggacgccagctgccacccccaggcctgcgccaacggctgcaccagcggccccggcctgcccggcgccccctacgccctgtggagagagttcctgttcagcgtgcccgccggcccccccgcccagtacagcgtgaccctgcacggccaggacgtgctgatgctgcccggcgacctggtgggcctgcagcacgacgccggccccggcgccctgctgcactgcagccccgcccccggccaccccggccccagagccccctacctgagcgccaacgccagcagctggctgccccacctgcccgcccagctggagggcacctgggcctgccccgcctgcgccctgagactgctggccgccaccgagcagctgaccgtgctgctgggcctgagacccaaccccggcctgagactgcccggcagatacgaggtgagagccgaggtgggcaacggcgtgagcagacacaacctgagctgcagcttcgacgtggtgagccccgtggccggcctgagagtgatctaccccgcccccagagacggcagactgtacgtgcccaccaacggcagcgccctggtgctgcaggtggacagcggcgccaacgccaccgccaccgccagatggcccggcggcagcgtgagcgccagattcgagaacgtgtgccccgccctggtggccaccttcgtgcccggctgcccctgggagaccaacgacaccctgttcagcgtggtggccctgccctggctgagcgagggcgagcacgtggtggacgtggtggtggagaacagcgccagcagagccaacctgagcctgagagtgaccgccgaggagcccatctgcggcctgagagccacccccagccccgaggccagagtgctgcagggcgtgctggtgagatacagccccgtggtggaggccggcagcgacatggtgttcagatggaccatcaacgacaagcagagcctgaccttccagaacgtggtgttcaacgtgatctaccagagcgccgccgtgttcaagctgagcctgaccgccagcaaccacgtgagcaacgtgaccgtgaactacaacgtgaccgtggagagaatgaacagaatgcagggcctgcaggtgagcaccgtgcccgccgtgctgagccccaacgccaccctggccctgaccgccggcgtgctggtggacagcgccgtggaggtggccttcctgtggaccttcggcgacggcgagcaggccctgcaccagttccagcccccctacaacgagagcttccccgtgcccgaccccagcgtggcccaggtgctggtggagcacaacgtgatgcacacctacgccgcccccggcgagtacctgctgaccgtgctggccagcaacgccttcgagaacctgacccagcaggtgcccgtgagcgtgagagccagcctgcccagcgtggccgtgggcgtgagcgacggcgtgctggtggccggcagacccgtgaccttctacccccaccccctgcccagccccggcggcgtgctgtacacctgggacttcggcgacggcagccccgtgctgacccagagccagcccgccgccaaccacacctacgccagcagaggcacctaccacgtgagactggaggtgaacaacaccgtgagcggcgccgccgcccaggccgacgtgagagtgttcgaggagctgagaggcctgagcgtggacatgagcctggccgtggagcagggcgcccccgtggtggtgagcgccgccgtgcagaccggcgacaacatcacctggaccttcgacatgggcgacggcaccgtgctgagcggccccgaggccaccgtggagcacgtgtacctgagagcccagaactgcaccgtgaccgtgggcgccgccagccccgccggccacctggccagaagcctgcacgtgctggtgttcgtgctggaggtgctgagagtggagcccgccgcctgcatccccacccagcccgacgccagactgaccgcctacgtgaccggcaaccccgcccactacctgttcgactggaccttcggcgacggcagcagcaacaccaccgtgagaggctgccccaccgtgacccacaacttcaccagaagcggcaccttccccctggccctggtgctgagcagcagagtgaacagagcccactacttcaccagcatctgcgtggagcccgaggtgggcaacgtgaccctgcagcccgagagacagttcgtgcagctgggcgacgaggcctggctggtggcctgcgcctggccccccttcccctacagatacacctgggacttcggcaccgaggaggccgcccccaccagagccagaggccccgaggtgaccttcatctacagagaccccggcagctacctggtgaccgtgaccgccagcaacaacatcagcgccgccaacgacagcgccctggtggaggtgcaggagcccgtgctggtgaccagcatcaaggtgaacggcagcctgggcctggagctgcagcagccctacctgttcagcgccgtgggcagaggcagacccgccagctacctgtgggacctgggcgacggcggctggctggagggccccgaggtgacccacgcctacaacagcaccggcgacttcaccgtgagagtggccggctggaacgaggtgagcagaagcgaggcctggctgaacgtgaccgtgaagagaagagtgagaggcctggtggtgaacgccagcagaaccgtggtgcccctgaacggcagcgtgagcttcagcaccagcctggaggccggcagcgacgtgagatacagctgggtgctgtgcgacagatgcacccccatccccggcggccccaccatcagctacaccttcagaagcgtgggcaccttcaacatcatcgtgaccgccgagaacgaggtgggcagcgcccaggacagcatcttcgtgtacgtgctgcagctgatcgagggcctgcaggtggtgggcggcggcagatacttccccaccaaccacaccgtgcagctgcaggccgtggtgagagacggcaccaacgtgagctacagctggaccgcctggagagacagaggccccgccctggccggcagcggcaagggcttcagcctgaccgtgctggaggccggcacctaccacgtgcagctgagagccaccaacatgctgggcagcgcctgggccgactgcaccatggacttcgtggagcccgtgggctggctgatggtggccgccagccccaaccccgccgccgtgaacaccagcgtgaccctgagcgccgagctggccggcggcagcggcgtggtgtacacctggagcctggaggagggcctgagctgggagaccagcgagcccttcaccacccacagcttccccacccccggcctgcacctggtgaccatgaccgccggcaaccccctgggcagcgccaacgccaccgtggaggtggacgtgcaggtgcccgtgagcggcctgagcatcagagccagcgagcccggcggcagcttcgtggccgccggcagcagcgtgcccttctggggccagctggccaccggcaccaacgtgagctggtgctgggccgtgcccggcggcagcagcaagagaggcccccacgtgaccatggtgttccccgacgccggcaccttcagcatcagactgaacgccagcaacgccgtgagctgggtgagcgccacctacaacctgaccgccgaggagcccatcgtgggcctggtgctgtgggccagcagcaaggtggtggcccccggccagctggtgcacttccagatcctgctggccgccggcagcgccgtgaccttcagactgcaggtgggcggcgccaaccccgaggtgctgcccggccccagattcagccacagcttccccagagtgggcgaccacgtggtgagcgtgagaggcaagaaccacgtgagctgggcccaggcccaggtgagaatcgtggtgctggaggccgtgagcggcctgcaggtgcccaactgctgcgagcccggcatcgccaccggcaccgagagaaacttcaccgccagagtgcagagaggcagcagagtggcctacgcctggtacttcagcctgcagaaggtgcagggcgacagcctggtgatcctgagcggcagagacgtgacctacacccccgtggccgccggcctgctggagatccaggtgagagccttcaacgccctgggcagcgagaacagaaccctggtgctggaggtgcaggacgccgtgcagtacgtggccctgcagagcggcccctgcttcaccaacagaagcgcccagttcgaggccgccaccagccccagccccagaagagtggcctaccactgggacttcggcgacggcagccccggccaggacaccgacgagcccagagccgagcacagctacctgagacccggcgactacagagtgcaggtgaacgccagcaacctggtgagcttcttcgtggcccaggccaccgtgaccgtgcaggtgctggcctgcagagagcccgaggtggacgtggtgctgcccctgcaggtgctgatgagaagaagccagagaaactacctggaggcccacgtggacctgagagactgcgtgacctaccagaccgagtacagatgggaggtgtacagaaccgccagctgccagagacccggcagacccgccagagtggccctgcccggcgtggacgtgagcagacccagactggtgctgcccagactggccctgcccgtgggccactactgcttcgtgttcgtggtgagcttcggcgacacccccctgacccagagcatccaggccaacgtgaccgtggcccccgagagactggtgcccatcatcgagggcggcagctacagagtgtggagcgacaccagagacctggtgctggacggcagcgagagctacgaccccaacctggaggacggcgaccagacccccctgagcttccactgggcctgcgtggccagcacccagagagaggccggcggctgcgccctgaacttcggccccagaggcagcagcaccgtgaccatccccagagagagactggccgccggcgtggagtacaccttcagcctgaccgtgtggaaggccggcagaaaggaggaggccaccaaccagaccgtgctgatcagaagcggcagagtgcccatcgtgagcctggagtgcgtgagctgcaaggcccaggccgtgtacgaggtgagcagaagcagctacgtgtacctggagggcagatgcctgaactgcagcagcggcagcaagagaggcagatgggccgccagaaccttcagcaacaagaccctggtgctggacgagaccaccaccagcaccggcagcgccggcatgagactggtgctgagaagaggcgtgctgagagacggcgagggctacaccttcaccctgaccgtgctgggcagaagcggcgaggaggagggctgcgccagcatcagactgagccccaacagaccccccctgggcggcagctgcagactgttccccctgggcgccgtgcacgccctgaccaccaaggtgcacttcgagtgcaccggctggcacgacgccgaggacgccggcgcccccctggtgtacgccctgctgctgagaagatgcagacagggccactgcgaggagttctgcgtgtacaagggcagcctgagcagctacggcgccgtgctgccccccggcttcagaccccacttcgaggtgggcctggccgtggtggtgcaggaccagctgggcgccgccgtggtggccctgaacagaagcctggccatcaccctgcccgagcccaacggcagcgccaccggcctgaccgtgtggctgcacggcctgaccgccagcgtgctgcccggcctgctgagacaggccgacccccagcacgtgatcgagtacagcctggccctggtgaccgtgctgaacgagtacgagagagccctggacgtggccgccgagcccaagcacgagagacagcacagagcccagatcagaaagaacatcaccgagaccctggtgagcctgagagtgcacaccgtggacgacatccagcagatcgccgccgccctggcccagtgcatgggccccagcagagagctggtgtgcagaagctgcctgaagcagaccctgcacaagctggaggccatgatgctgatcctgcaggccgagaccaccgccggcaccgtgacccccaccgccatcggcgacagcatcctgaacatcaccggcgacctgatccacctggccagcagcgacgtgagagccccccagcccagcgagctgggcgccgagagccccagcagaatggtggccagccaggcctacaacctgaccagcgccctgatgagaatcctgatgagaagcagagtgctgaacgaggagcccctgaccctggccggcgaggagatcgtggcccagggcaagagaagcgaccccagaagcctgctgtgctacggcggcgcccccggccccggctgccacttcagcatccccgaggccttcagcggcgccctggccaacctgagcgacgtggtgcagctgatcttcctggtggacagcaaccccttccccttcggctacatcagcaactacaccgtgagcaccaaggtggccagcatggccttccagacccaggccggcgcccagatccccatcgagagactggccagcgagagagccatcaccgtgaaggtgcccaacaacagcgactgggccgccagaggccacagaagcagcgccaacagcgccaacagcgtggtggtgcagccccaggccagcgtgggcgccgtggtgaccctggacagcagcaaccccgccgccggcctgcacctgcagctgaactacaccctgctggacggccactacctgagcgaggagcccgagccctacctggccgtgtacctgcacagcgagcccagacccaacgagcacaactgcagcgccagcagaagaatcagacccgagagcctgcagggcgccgaccacagaccctacaccttcttcatcagccccggcagcagagaccccgccggcagctaccacctgaacctgagcagccacttcagatggagcgccctgcaggtgagcgtgggcctgtacaccagcctgtgccagtacttcagcgaggaggacatggtgtggagaaccgagggcctgctgcccctggaggagaccagccccagacaggccgtgtgcctgaccagacacctgaccgccttcggcgccagcctgttcgtgccccccagccacgtgagattcgtgttccccgagcccaccgccgacgtgaactacatcgtgatgctgacctgcgccgtgtgcctggtgacctacatggtgatggccgccatcctgcacaagctggaccagctggacgccagcagaggcagagccatccccttctgcggccagagaggcagattcaagtacgagatcctggtgaagaccggctggggcagaggcagcggcaccaccgcccacgtgggcatcatgctgtacggcgtggacagcagaagcggccacagacacctggacggcgacagagccttccacagaaacagcctggacatcttcagaatcgccaccccccacagcctgggcagcgtgtggaagatcagagtgtggcacgacaacaagggcctgagccccgcctggttcctgcagcacgtgatcgtgagagacctgcagaccgccagaagcgccttcttcctggtgaacgactggctgagcgtggagaccgaggccaacggcggcctggtggagaaggaggtgctggccgccagcgacgccgccctgctgagattcagaagactgctggtggccgagctgcagagaggcttcttcgacaagcacatctggctgagcatctgggacagaccccccagaagcagattcaccagaatccagagagccacctgctgcgtgctgctgatctgcctgttcctgggcgccaacgccgtgtggtacggcgccgtgggcgacagcgcctacagcaccggccacgtgagcagactgagccccctgagcgtggacaccgtggccgtgggcctggtgagcagcgtggtggtgtaccccgtgtacctggccatcctgttcctgttcagaatgagcagaagcaaggtggccggcagccccagccccacccccgccggccagcaggtgctggacatcgacagctgcctggacagcagcgtgctggacagcagcttcctgaccttcagcggcctgcacgccgagcaggccttcgtgggccagatgaagagcgacctgttcctggacgacagcaagagcctggtgtgctggcccagcggcgagggcaccctgagctggcccgacctgctgagcgaccccagcatcgtgggcagcaacctgagacagctggccagaggccaggccggccacggcctgggccccgaggaggacggcttcagcctggccagcccctacagccccgccaagagcttcagcgccagcgacgaggacctgatccagcaggtgctggccgagggcgtgagcagccccgcccccacccaggacacccacatggagaccgacctgctgagcagcctgagcagcacccccggcgagaagaccgagaccctggccctgcagagactgggcgagctgggcccccccagccccggcctgaactgggagcagccccaggccgccagactgagcagaaccggcctggtggagggcctgagaaagagactgctgcccgcctggtgcgccagcctggcccacggcctgagcctgctgctggtggccgtggccgtggccgtgagcggctgggtgggcgccagcttcccccccggcgtgagcgtggcctggctgctgagcagcagcgccagcttcctggccagcttcctgggctgggagcccctgaaggtgctgctggaggccctgtacttcagcctggtggccaagagactgcaccccgacgaggacgacaccctggtggagagccccgccgtgacccccgtgagcgccagagtgcccagagtgagacccccccacggcttcgccctgttcctggccaaggaggaggccagaaaggtgaagagactgcacggcatgctgagaagcctgctggtgtacatgctgttcctgctggtgaccctgctggccagctacggcgacgccagctgccacggccacgcctacagactgcagagcgccatcaagcaggagctgcacagcagagccttcctggccatcaccagaagcgaggagctgtggccctggatggcccacgtgctgctgccctacgtgcacggcaaccagagcagccccgagctgggcccccccagactgagacaggtgagactgcaggaggccctgtaccccgacccccccggccccagagtgcacacctgcagcgccgccggcggcttcagcaccagcgactacgacgtgggctgggagagcccccacaacggcagcggcacctgggcctacagcgcccccgacctgctgggcgcctggagctggggcagctgcgccgtgtacgacagcggcggctacgtgcaggagctgggcctgagcctggaggagagcagagacagactgagattcctgcagctgcacaactggctggacaacagaagcagagccgtgttcctggagctgaccagatacagccccgccgtgggcctgcacgccgccgtgaccctgagactggagttccccgccgccggcagagccctggccgccctgagcgtgagacccttcgccctgagaagactgagcgccggcctgagcctgcccctgctgaccagcgtgtgcctgctgctgttcgccgtgcacttcgccgtggccgaggccagaacctggcacagagagggcagatggagagtgctgagactgggcgcctgggccagatggctgctggtggccctgaccgccgccaccgccctggtgagactggcccagctgggcgccgccgacagacagtggaccagattcgtgagaggcagacccagaagattcaccagcttcgaccaggtggcccagctgagcagcgccgccagaggcctggccgccagcctgctgttcctgctgctggtgaaggccgcccagcagctgagattcgtgagacagtggagcgtgttcggcaagaccctgtgcagagccctgcccgagctgctgggcgtgaccctgggcctggtggtgctgggcgtggcctacgcccagctggccatcctgctggtgagcagctgcgtggacagcctgtggagcgtggcccaggccctgctggtgctgtgccccggcaccggcctgagcaccctgtgccccgccgagagctggcacctgagccccctgctgtgcgtgggcctgtgggccctgagactgtggggcgccctgagactgggcgccgtgatcctgagatggagataccacgccctgagaggcgagctgtacagacccgcctgggagccccaggactacgagatggtggagctgttcctgagaagactgagactgtggatgggcctgagcaaggtgaaggagttcagacacaaggtgagattcgagggcatggagcccctgcccagcagaagcagcagaggcagcaaggtgagccccgacgtgcccccccccagcgccggcagcgacgccagccaccccagcaccagcagcagccagctggacggcctgagcgtgagcctgggcagactgggcaccagatgcgagcccgagcccagcagactgcaggccgtgttcgaggccctgctgacccagttcgacagactgaaccaggccaccgaggacgtgtaccagctggagcagcagctgcacagcctgcagggcagaagaagcagcagagcccccgccggcagcagcagaggccccagccccggcctgagacccgccctgcccagcagactggccagagccagcagaggcgtggacctggccaccggccccagcagaacccccctgagagccaagaacaaggtgcaccccagcagcacctag

SEQ ID NO: 93796 - DNA, 10914 bp, Artificial Sequence
  Description of Artificial Sequence: Synthetic coding sequence
atgccccccgccgcccccgccagactggccctggccctgggcctgggcctgtggctgggcgccctggccggcggccccggcagaggctgcggcccctgcgagcccccctgcctgtgcggccccgcccccggcgccgcctgcagagtgaactgcagcggcagaggcctgagaaccctgggccccgccctgagaatccccgccgacgccaccgccctgaccgccatggccaaggccgacggcgacgtgaagaagtacggcagcaagagaggcgccctggccctgacccacggccacagcctgctgagagacgtgagccacaacctgctgagagccctggacgtgggcctgctggccaacctgagcgccctggccgagctggacatcagcaacaacaagatcagcaccctggaggagggcatcttcgccaacctgttcaacctgagcgagatcaacctgagcggcaaccccttcgagtgcgactgcggcctggcctggctgcccagatgggccgaggagcagcaggtgagagtggtgcagcccgaggccgccacctgcgccggccccggcagcctggccggccagcccctgctgggcatccccctgctggacagcggctgcggcgccaccctggtgggcccccacggccccctggccagcggccagctggccgccttccacatcgccgcccccctgcccgtgaccgccaccagatgggacttcggcgacggcagcgccgaggtggacgccgccggccccgccgccagccacagatacgtgctgcccggcagataccacgtgaccgccgtgctggccctgggcgccggcagcgccctgctgggcaccgacgtgcaggtggaggccgcccccgccgccctggagctggtgtgccccagcagcgtgcagagcgacgagagcctggacctgagcatccagaacagaggcggcagcggcctggaggccgcctacagcatcgtggccctgggcgaggagcccgccagagccgtgcaccccctgtgccccagcgacaccgagatcttccccggcaacggccactgctacagactggtggtggagaaggccgcctggctgcaggcccaggagcagtgccaggcctgggccggcgccgccctggccatggtggacagccccgccgtgcagagattcctggtgagcagagtgaccagaagcctggacgtgtggatcggcttcagcaccgtgcagggcgtggaggtgggccccgccccccagggcgaggccttcagcctggagagctgccagaactggctgcccggcgagccccaccccgccaccgccgagcactgcgtgagactgggccccaccggctggtgcaacaccgacctgtgcagcgccccccacagctacgtgtgcgagctgcagcccggcggccccgtgcaggacgccgagaacctgctggtgggcgcccccagcggcgacctgcagggccccctgacccccctggcccagcaggacggcctgagcgccccccacgagcccgtggaggccggcatgggcagcgtggagctgagaagaccccccgcccaccaggtgatggtgttccccggcctgagactgagcagagaggccttcctgaccaccgccgagttcggcacccaggagctgagaagacccgcccagctgagactgcaggtgtacagactgctgagcaccgccggcacccccgagaacggcagcgagcccgagagcagaagccccgacaacagaacccagctggcccccgcctgcatgcccggcggcagatggtgccccggcgccaacatctgcctgcccctggacgccagctgccacccccaggcctgcgccaacggctgcaccgagggcgagcacgtggtggacgtggtggtggagaacagcgccagcagagccaacctgagcctgagagtgaccgccgaggagcccatctgcggcctgagagccacccccagccccgaggccagagtgctgcagggcgtgctggtgagatacagccccgtggtggaggccggcagcgacatggtgttcagatggaccatcaacgacaagcagagcctgaccttccagaacgtggtgttcaacgtgatctaccagagcgccgccgtgttcaagctgagcctgaccgccagcaaccacgtgagcaacgtgaccgtgaactacaacgtgaccgtggagagaatgaacagaatgcagggcctgcaggtgagcaccgtgcccgccgtgctgagccccaacgccaccctggccctgaccgccggcgtgctggtggacagcgccgtggaggtggccttcctgtggaccttcggcgacggcgagcaggccctgcaccagttccagcccccctacaacgagagcttccccgtgcccgaccccagcgtggcccaggtgctggtggagcacaacgtgatgcacacctacgccgcccccggcgagtacctgctgaccgtgctggccagcaacgccttcgagaacctgacccagcaggtgcccgtgagcgtgagagccagcctgcccagcgtggccgtgggcgtgagcgacggcgtgctgagccagcccgccgccaaccacacctacgccagcagaggcacctaccacgtgagactggaggtgaacaacaccgtgagcggcgccgccgcccaggccgacgtgagagtgttcgaggagctgagaggcctgagcgtggacatgagcctggccgtggagcagggcgcccccgtggtggtgagcgccgccgtgcagaccggcgacaacatcacctggaccttcgacatgggcgacggcaccgtgctgagcggccccgaggccaccgtggagcacgtgtacctgagagcccagaactgcaccgtgaccgtgggcgccgccagccccgccggccacctggccagaagcctgcacgtgctggtgttcgtgctggaggtgctgagagtggagcccgccgcctgcatccccacccagcccgacgccagactgaccgcctacgtgaccggcaaccccgcccactacctgttcgactggaccttcggcgacggcagcagcaacaccaccgtgagaggctgccccaccgtgacccacaacttcaccagaagcggcaccttccccctggccctggtgctgagcagcagagtgaacagagcccactacttcaccagcatctgcgtggagcccgaggtgggcaacgtgaccctgcagcccgagagacagttcgtgcagctgggcgacgaggcctggctggtggcctgcgcctggccccccttcccctacagatacacctgggacttcggcaccgaggaggccgcccccaccagagccagaggccccgaggtgaccttcatctacagagaccccggcagctacctggtgaccgtgaccgccagcaacaacatcagcgccgccaacgacagcgccctggtggaggtgcaggagcccgtgctggtgaccagcatcaaggtgaacggcagcctgggcctggagctgcagcagccctacctgttcagcgccgtgggcagaggcagacccgccagctacctgtgggacctgggcgacggcggctggctggagggccccgaggtgacccacgcctacaacagcaccggcgacttcaccggccccggccccggcagacagagacagagactgctggcccacagagaggccggcacctaccacgtgcagctgagagccaccaacatgctgggcagcgcctgggccgactgcaccatggacttcgtggagcccgtgggctggctgatggtggccgccagccccaaccccgccgccgtgaacaccagcgtgaccctgagcgccgagctggccggcggcagcggcgtggtgtacacctggagcctggaggagggcctgagctgggagaccagcgagcccttcaccacccacagcttccccacccccggcctgcacctggtgaccatgaccgccggcaaccccctgggcagcgccaacgccaccgtggaggtggacgtgcaggtgcccgtgagcggcctgagcatcagagccagcgagcccggcggcagcttcgtggccgccggcagcagcgtgcccttctggggccagctggccaccggcaccaacgtgagctggtgctgggccgtgcccggcggcagcagcaagagaggcccccacgtgaccatggtgttccccgacgccggcaccttcagcatcagactgaacgccagcaacgccgtgagctgggtgagcgccacctacaacctgaccgccgaggagcccatcgtgggcctggtgctgtgggccagcagcaaggtggtggcccccggccagctggtgcacttccagatcctgctggccgccggcagcgccgtgaccttcagactgcaggacaccgacgagcccagagccgagcacagctacctgagacccggcgactacagagtgcaggtgaacgccagcaacctggtgagcttcttcgtggcccaggccaccgtgaccgtgcaggtgctggcctgcagagagcccgaggtggacgtggtgctgcccctgcaggtgctgatgagaagaagccagagaaactacctggaggcccacgtggacctgagagactgcgtgacctaccagaccgagtacagatgggaggtgtacagaaccgccagctgccagagacccggcagacccgccagagtggccctgcccggcgtggacgtgagcagacccagactggtgctgcccagactggccctgcccgtgggccactactgcttcgtgttcgtggtgagcttcggcgacacccccctgacccagagcatccaggccaacgtgaccgtggcccccgagagactggtgcccatcatcgagggcggcagctacagagtgtggagcgacaccagagacctggtgctggacggcagcgagagctacgaccccaacctggaggacggcgaccagacccccctgagcttccactgggcctgcgtggccagcacccagagagaggccggcggctgcgccctgaacttcggccccagaggcagcagcaccgtgaccatccccagagagagactggccgccggcgtggagtacaccttcagcctgaccgtgtggaaggccggcagaaaggaggaggccaccaaccagaccgtgctgatcagaagcggcagagtgcccatcgtgagcctggagtgcgtgagctgcaaggcccaggccgtgtacgaggtgagcagaagcagctacgtgtacctggagggcagatgcctgaactgcagcagcggcagcaagagaggcagatgggccgccagaaccttcagcaacaagaccctggtgctggacgagaccaccaccagcaccggcagcgccggcatgagactggtgctgagaagaggcgtgctgagagacggcgagggctacaccttcaccctgaccgtgctgggcagaagcggcgaggaggagggctgcgccagcatcagactgagccccaacagaccccccctgggcggcagctgcagactgttccccctgggcgccgtgcacgccctgaccaccaaggtgcacttcgagtgcaccggctggcacgacgccgaggacgccggcgcccccctggtgtacgccctgctgctgagaagatgcagacagggccactgcgaggagttctgcgtgtacaagggcagcctgagcagctacggcgccgtgctgccccccggcttcagaccccacttcgaggtgggcctggccgtggtggtgcaggaccagctgggcgccgccgtggtggccctgaacagaagcctggccatcaccctgcccgagcccaacggcagcgccaccggcctgaccgtgtggctgcacggcctgaccgccagcgtgctgcccggcctgctgagacaggccgacccccagcacgtgatcgagtacagcctggccctggtgaccgtgctgaacgagcacagagcccagatcagaaagaacatcaccgagaccctggtgagcctgagagtgcacaccgtggacgacatccagcagatcgccgccgccctggcccagtgcatgggccccagcagagagctggtgtgcagaagctgcctgaagcagaccctgcacaagctggaggccatgatgctgatcctgcaggccgagaccaccgccggcaccgtgacccccaccgccatcggcgacagcatcctgaacatcaccggcgacctgatccacctggccagcagcgacgtgagagccccccagcccagcgagctgggcgccgagagccccagcagaatggtggccagccaggcctacaacctgaccagcgccctgatgagaatcctgatgagaagcagagtgctgaacgaggagcccctgaccctggccggcgaggagatcgtggcccagggcaagagaagcgaccccagaagcctgctgtgctacggcggcgcccccggccccggctgccacttcagcatccccgaggccttcagcggcgccctggccaacctgagcgacgtggtgcagctgatcttcctggtggacagcaaccccttccccttcggctacatcagcaactacaccgtgagcaccaaggtggccagcatggccttccagacccaggccggcgcccagatccccatcgagagactggccagcgagagagccatcaccgtgaaggtgcccaacaacagcgactgggccgccagaggccacagaagcagcgccaacagcgccaacagcgtggtggtgcagccccaggccagcgtgggcgccgtggtgaccctggacagcagcaaccccgccgccggcctgcacctgcagctgaactacaccctgctggacggccactacctgagcgaggagcccgagccctacctggccgtgtacctgcacagcgagcccagacccaacgagcacaactgcagcgccagcagaagaatcagacccgagagcctgcagggcgccgaccacagaccctacaccttcttcatcagccccggcagcagagaccccgccggcagctaccacctgaacctgagcagccacttcagatggagcgccctgcaggtgagcgtgggcctgtacaccagcctgtgccagtacttcagcgaggaggacatggtgtggagaaccgagggcctgctgcccctggaggagaccagccccagacaggccgtgtgcctgaccagacacctgaccgccttcggcgccagcctgttcgtgccccccagccacgtgagattcgtgttccccgagcccaccgccgacgtgaactacatcgtgatgctgacctgcgccgtgtgcctggtgacctacatggtgatggccgccatcctgcacaagctggaccagctggacgccagcagaggcagagccatccccttctgcggccagagaggcagattcaagtacgagatcctggtgaagaccggctggggcagaggcagcggcaccaccgcccacgtgggcatcatgctgtacggcgtggacagcagaagcggccacagacacctggacggcgacagagccttccacagaaacagcctggacatcttcagaatcgccaccccccacagcctgggcagcgtgtggaagatcagagtgtggcacgacaacaagggcctgagccccgcctggttcctgcagcacgtgatcgtgagagacctgcagaccgccagaagcgccttcttcctggtgaacgactggctgagcgtggagaccgaggccaacggcggcctggtggagaaggaggtgctggccgccagcgacgccgccctgctgagattcagaagactgctggtggccgagctgcagagaggcttcttcgacaagcacatctggctgagcatctgggacagaccccccagaagcagattcaccagaatccagagagccacctgctgcgtgctgctgatctgcctgttcctgggcgccaacgccgtgtggtacggcgccgtgggcgacagcgcctacagcaccggccacgtgagcagactgagccccctgagcgtggacaccgtggccgtgggcctggtgagcagcgtggtggtgtaccccgtgtacctggccatcctgttcctgttcagaatgagcagaagcaaggtggccggcagccccagccccacccccgccggccagcaggtgctggacatcgacagctgcctggacagcagcgtgctggacagcagcttcctgaccttcagcggcctgcacgccgaggccttcgtgggccagatgaagagcgacctgttcctggacgacagcaagagcctggtgtgctggcccagcggcgagggcaccctgagctggcccgacctgctgagcgaccccagcatcgtgggcagcaacctgagacagctggccagaggccaggccggccacggcctgggccccgaggaggacggcttcagcctggccagcccctacagccccgccaagagcttcagcgccagcgacgaggacctgatccagcaggtgctggccgagggcgtgagcagccccgcccccacccaggacacccacatggagaccgacctgctgagcagcctgagcagcacccccggcgagaagaccgagaccctggccctgcagagactgggcgagctgggcccccccagccccggcctgaactgggagcagccccaggccgccagactgagcagaaccggcctggtggagggcctgagaaagagactgctgcccgcctggtgcgccagcctggcccacggcctgagcctgctgctggtggccgtggccgtggccgtgagcggctgggtgggcgccagcttcccccccggcgtgagcgtggcctggctgctgagcagcagcgccagcttcctggccagcttcctgggctgggagcccctgaaggtgctgctggaggccctgtacttcagcctggtggccaagagactgcaccccgacgaggacgacaccctggtggagagccccgccgtgacccccgtgagcgccagagtgcccagagtgagacccccccacggcttcgccctgttcctggccaaggaggaggccagaaaggtgaagagactgcacggcatgctgagaagcctgctggtgtacatgctgttcctgctggtgaccctgctggccagctacggcgacgccagctgccacggccacgcctacagactgcagagcgccatcaagcaggagctgcacagcagagccttcctggccatcaccagaagcgaggagctgtggccctggatggcccacgtgctgctgccctacgtgcacggcaaccagagcagccccgagctgggcccccccagactgagacaggtgagactgcaggaggccctgtaccccgacccccccggccccagagtgcacacctgcagcgccgccggcggcttcagcaccagcgactacgacgtgggctgggagagcccccacaacggcagcggcacctgggcctacagcgcccccgacctgctgggcgcctggagctggggcagctgcgccgtgtacgacagcggcggctacgtgcaggagctgggcctgagcctggaggagagcagagacagactgagattcctgcagctgcacaactggctggacaacagaagcagagccgtgttcctggagctgaccagatacagccccgccgtgggcctgcacgccgccgtgaccctgagactggagttccccgccgccggcagagccctggccgccctgagcgtgagacccttcgccctgagaagactgagcgccggcctgagcctgcccctgctgaccagcgtgtgcctgctgctgttcgccgtgcacttcgccgtggccgaggccagaacctggcacagagagggcagatggagagtgctgagactgggcgcctgggccagatggctgctggtggccctgaccgccgccaccgccctggtgagactggcccagctgggcgccgccgacagacagtggaccagattcgtgagaggcagacccagaagattcaccagcttcgaccaggtggcccagctgagcagcgccgccagaggcctggccgccagcctgctgttcctgctgctggtgaaggccgcccagcagctgagattcgtgagacagtggagcgtgttcggcaagaccctgtgcagagccctgcccgagctgctgggcgtgaccctgggcctggtggtgctgggcgtggcctacgcccagctggccatcctgctggtgagcagctgcgtggacagcctgtggagcgtggcccaggccctgctggtgctgtgccccggcaccggcctgagcaccctgtgccccgccgagagctggcacctgagccccctgctgtgcgtgggcctgtgggccctgagactgtggggcgccctgagactgggcgccgtgatcctgagatggagataccacgccctgagaggcgagctgtacagacccgcctgggagccccaggactacgagatggtggagctgttcctgagaagactgagactgtggatgggcctgagcaaggtgaaggagttcagacacaaggtgagattcgagggcatggagcccctgcccagcagaagcagcagaggcagcaaggtgagccccgacgtgcccccccccagcgccggcagcgacgccagccaccccagcaccagcagcagccagctggacggcctgagcgtgagcctgggcagactgggcaccagatgcgagcccgagcccagcagactgcaggccgtgttcgaggccctgctgacccagttcgacagactgaaccaggccaccgaggacgtgtaccagctggagcagcagctgcacagcctgcagggcagaagaagcagcagagcccccgccggcagcagcagaggccccagccccggcctgagacccgccctgcccagcagactggccagagccagcagaggcgtggacctggccaccggccccagcagaacccccctgagagccaagaacaaggtgcaccccagcagcacctag

SEQ ID NO: 93797 - DNA, 3693 bp, Artificial Sequence
  Description of Artificial Sequence: Synthetic coding sequence
atggtggccgccagccccaaccccgccgccgtgaacaccagcgtgaccctgagcgccgagctggccggcggcagcggcgtggtgtacacctggagcctggaggagggcctgagctgggagaccagcgagcccttcaccacccacagcttccccacccccggcctgcacctggtgaccatgaccgccggcaaccccctgggcagcgccaacgccaccgtggaggtggacgtgcaggtgcccgtgagcggcctgagcatcagagccagcgagcccggcggcagcttcgtggccgccggcagcagcgtgcccttctggggccagctggccaccggcaccaacgtgagctggtgctgggccgtgcccggcggcagcagcaagagaggcccccacgtgaccatggtgttccccgacgccggcaccttcagcatcagactgaacgccagcaacgccgtgagctgggtgagcgccacctacaacctgaccgccgaggagcccatcgtgggcctggtgctgtgggccagcagcaaggtggtggcccccggccagctggtgcacttccagatcctgctggccgccggcagcgccgtgaccttcagactgcaggtgggcggcgccaaccccgaggtgctgcccggccccagattcagccacagcttccccagagtgggcgaccacgtggtgagcgtgagaggcaagaaccacgtgagctgggcccaggcccaggtgagaatcgtggtgctggaggccgtgagcggcctgcaggtgcccaactgctgcgagcccggcatcgccaccggcaccgagagaaacttcaccgccagagtgcagagaggcagcagagtggcctacgcctggtacttcagcctgcagaaggtgcagggcgacagcctggtgatcctgagcggcagagacgtgacctacacccccgtggccgccggcctgctggagatccaggtgagagccttcaacgccctgggcagcgagaacagaaccctggtgctggaggtgcaggacgccgtgcagtacgtggccctgcagagcggcccctgcttcaccaacagaagcgcccagttcgaggccgccaccagccccagccccagaagagtggcctaccactgggacttcggcgacggcagccccggccaggacaccgacgagcccagagccgagcacagctacctgagacccggcgactacagagtgcaggtgaacgccagcaacctggtgagcttcttcgtggcccaggccaccgtgaccgtgcaggtgctggcctgcagagagcccgaggtggacgtggtgctgcccctgcaggtgctgatgagaagaagccagagaaactacctggaggcccacgtggacctgagagactgcgtgacctaccagaccgagtacagatgggaggtgtacagaaccgccagctgccagagacccggcagacccgccagagtggccctgcccggcgtggacgtgagcagacccagactggtgctgcccagactggccctgcccgtgggccactactgcttcgtgttcgtggtgagcttcggcgacacccccctgacccagagcatccaggccaacgtgaccgtggcccccgagagactggtgcccatcatcgagggcggcagctacagagtgtggagcgacaccagagacctggtgctggacggcagcgagagctacgaccccaacctggaggacggcgaccagacccccctgagcttccactgggcctgcgtggccagcacccagagagaggccggcggctgcgccctgaacttcggccccagaggcagcagcaccgtgaccatccccagagagagactggccgccggcgtggagtacaccttcagcctgaccgtgtggaaggccggcagaaaggaggaggccaccaaccagaccgtgctgatcagaagcggcagagtgcccatcgtgagcctggagtgcgtgagctgcaaggcccaggccgtgtacgaggtgagcagaagcagctacgtgtacctggagggcagatgcctgaactgcagcagcggcagcaagagaggcagatgggccgccagaaccttcagcaacaagaccctggtgctggacgagaccaccaccagcaccggcagcgccggcatgagactggtgctgagaagaggcgtgctgagagacggcgagggctacaccttcaccctgaccgtgctgggcagaagcggcgaggaggagggctgcgccagcatcagactgagccccaacagaccccccctgggcggcagctgcagactgttccccctgggcgccgtgcacgccctgaccaccaaggtgcacttcgagtgcaccggctggcacgacgccgaggacgccggcgcccccctggtgtacgccctgctgctgagaagatgcagacagggccactgcgaggagttctgcgtgtacaagggcagcctgagcagctacggcgccgtgctgccccccggcttcagaccccacttcgaggtgggcctggccgtggtggtgcaggaccagctgggcgccgccgtggtggccctgaacagaagcctggccatcaccctgcccgagcccaacggcagcgccaccggcctgaccgtgtggctgcacggcctgaccgccagcgtgctgcccggcctgctgagacaggccgacccccagcacgtgatcgagtacagcctggccctggtgaccgtgctgaacgagtacgagagagccctggacgtggccgccgagcccaagcacgagagacagcacagagcccagatcagaaagaacatcaccgagaccctggtgagcctgagagtgcacaccgtggacgacatccagcagatcgccgccgccctggcccagtgcatgggccccagcagagagctggtgtgcagaagctgcctgaagcagaccctgcacaagctggaggccatgatgctgatcctgcaggccgagaccaccgccggcaccgtgacccccaccgccatcggcgacagcatcctgaacatcaccggcgacctgatccacctggccagcagcgacgtgagagccccccagcccagcgagctgggcgccgagagccccagcagaatggtggccagccaggcctacaacctgaccagcgccctgatgagaatcctgatgagaagcagagtgctgaacgaggagcccctgaccctggccggcgaggagatcgtggcccagggcaagagaagcgaccccagaagcctgctgtgctacggcggcgcccccggccccggctgccacttcagcatccccgaggccttcagcggcgccctggccaacctgagcgacgtggtgcagctgatcttcctggtggacagcaaccccttccccttcggctacatcagcaactacaccgtgagcaccaaggccccccccaccccccccacccccctgtggagcagccccagaccccccagcgtgctgtggagcccctggaccgccgccaccctgagacccggctgcatctgcagcagcaccatcagatgctggaccgccaccacctgcctgagaaacctgagccccacctggcagagcacctacaccagaagccccggccccatgagcaccaccgccagactggccggcggcagcgcccagagccacagcagagtgctgaccaccggccccacccccagcagcttccccagaggcgccgagacccagagaggcgtgaccatctag

SEQ ID NO: 93798 - DNA, 12909 bp, Artificial Sequence
  Description of Artificial Sequence: Synthetic coding sequence
atgccccccgccgcccccgccagactggccctggccctgggcctgggcctgtggctgggcgccctggccggcggccccggcagaggctgcggcccctgcgagcccccctgcctgtgcggccccgcccccggcgccgcctgcagagtgaactgcagcggcagaggcctgagaaccctgggccccgccctgagaatccccgccgacgccaccgccctggacgtgagccacaacctgctgagagccctggacgtgggcctgctggccaacctgagcgccctggccgagctggacatcagcaacaacaagatcagcaccctggaggagggcatcttcgccaacctgttcaacctgagcgagatcaacctgagcggcaaccccttcgagtgcgactgcggcctggcctggctgcccagatgggccgaggagcagcaggtgagagtggtgcagcccgaggccgccacctgcgccggccccggcagcctggccggccagcccctgctgggcatccccctgctggacagcggctgcggcgaggagtacgtggcctgcctgcccgacaacagcagcggcaccgtggccgccgtgagcttcagcgccgcccacgagggcctgctgcagcccgaggcctgcagcgccttctgcttcagcaccggccagggcctggccgccctgagcgagcagggctggtgcctgtgcggcgccgcccagcccagcagcgccagcttcgcctgcctgagcctgtgcagcggccccccccccccccccgcccccacctgcagaggccccaccctgctgcagcacgtgttccccgccagccccggcgccaccctggtgggcccccacggccccctggccagcggccagctggccgccttccacatcgccgcccccctgcccgtgaccgccaccagatgggacttcggcgacggcagcgccgaggtggacgccgccggccccgccgccagccacagatacgtgctgcccggcagataccacgtgaccgccgtgctggccctgggcgccggcagcgccctgctgggcaccgacgtgcaggtggaggccgcccccgccgccctggagctggtgtgccccagcagcgtgcagagcgacgagagcctggacctgagcatccagaacagaggcggcagcggcctggaggccgcctacagcatcgtggccctgggcgaggagcccgccagagccgtgcaccccctgtgccccagcgacaccgagatcttccccggcaacggccactgctacagactggtggtggagaaggccgcctggctgcaggcccaggagcagtgccaggcctgggccggcgccgccctggccatggtggacagccccgccgtgcagagattcctggtgagcagagtgaccagaagcctggacgtgtggatcggcttcagcaccgtgcagggcgtggaggtgggccccgccccccagggcgaggccttcagcctggagagctgccagaactggctgcccggcgagccccaccccgccaccgccgagcactgcgtgagactgggccccaccggctggtgcaacaccgacctgtgcagcgccccccacagctacgtgtgcgagctgcagcccggcggccccgtgcaggacgccgagaacctgctggtgggcgcccccagcggcgacctgcagggccccctgacccccctggcccagcaggacggcctgagcgccccccacgagcccgtggaggtgatggtgttccccggcctgagactgagcagagaggccttcctgaccaccgccgagttcggcacccaggagctgagaagacccgcccagctgagactgcaggtgtacagactgctgagcaccgccggcacccccgagaacggcagcgagcccgagagcagaagccccgacaacagaacccagctggcccccgcctgcatgcccggcggcagatggtgccccggcgccaacatctgcctgcccctggacgccagctgccacccccaggcctgcgccaacggctgcaccagcggccccggcctgcccggcgccccctacgccctgtggagagagttcctgttcagcgtgcccgccggcccccccgcccagtacagcgtgaccctgcacggccaggacgtgctgatgctgcccggcgacctggtgggcctgcagcacgacgccggccccggcgccctgctgcactgcagccccgcccccggccaccccggccccagagccccctacctgagcgccaacgccagcagctggctgccccacctgcccgcccagctggagggcacctgggcctgccccgcctgcgccctgagactgctggccgccaccgagcagctgaccgtgctgctgggcctgagacccaaccccggcctgagactgcccggcagatacgaggtgagagccgaggtgggcaacggcgtgagcagacacaacctgagctgcagcttcgacgtggtgagccccgtggccggcctgagagtgatctaccccgcccccagagacggcagactgtacgtgcccaccaacggcagcgccctggtgctgcaggtggacagcggcgccaacgccaccgccaccgccagatggcccggcggcagcgtgagcgccagattcgagaacgtgtgccccgccctggtggccaccttcgtgcccggctgcccctgggagaccaacgacaccctgttcagcgtggtggccctgccctggctgagcgagggcgagcacgtggtggacgtggtggtggagaacagcgccagcagagccaacctgagcctgagagtgaccgccgaggagcccatctgcggcctgagagccacccccagccccgaggccagagtgctgcagggcgtgctggtgagatacagccccgtggtggaggccggcagcgacatggtgttcagatggaccatcaacgacaagcagagcctgaccttccagaacgtggtgttcaacgtgatctaccagagcgccgccgtgttcaagctgagcctgaccgccagcaaccacgtgagcaacgtgaccgtgaactacaacgtgaccgtggagagaatgaacagaatgcagggcctgcaggtgagcaccgtgcccgccgtgctgagccccaacgccaccctggccctgaccgccggcgtgctggtggacagcgccgtggaggtggccttcctgtggaccttcggcgacggcgagcaggccctgcaccagttccagcccccctacaacgagagcttccccgtgcccgaccccagcgtggcccaggtgctggtggagcacaacgtgatgcacacctacgccgcccccggcgagtacctgctgaccgtgctggccagcaacgccttcgagaacctgacccagcaggtgcccgtgagcgtgagagccagcctgcccagcgtggccgtgggcgtgagcgacggcgtgctggtggccggcagacccgtgaccttctacccccaccccctgcccagccccggcggcgtgctgtacacctgggacttcggcgacggcagccccgtgctgacccagagccagcccgccgccaaccacacctacgccagcagaggcacctaccacgtgagactggaggtgaacaacaccgtgagcggcgccgccgcccaggccgacgtgagagtgttcgaggagctgagaggcctgagcgtggacatgagcctggccgtggagcagggcgcccccgtggtggtgagcgccgccgtgcagaccggcgacaacatcacctggaccttcgacatgggcgacggcaccgtgctgagcggccccgaggccaccgtggagcacgtgtacctgagagcccagaactgcaccgtgaccgtgggcgccgccagccccgccggccacctggccagaagcctgcacgtgctggtgttcgtgctggaggtgctgagagtggagcccgccgcctgcatccccacccagcccgacgccagactgaccgcctacgtgaccggcaaccccgcccactacctgttcgactggaccttcggcgacggcagcagcaacaccaccgtgagaggctgccccaccgtgacccacaacttcaccagaagcggcaccttccccctggccctggtgctgagcagcagagtgaacagagcccactacttcaccagcatctgcgtggagcccgaggtgggcaacgtgaccctgcagcccgagagacagttcgtgcagctgggcgacgaggcctggctggtggcctgcgcctggccccccttcccctacagatacacctgggacttcggcaccgaggaggccgcccccaccagagccagaggccccgaggtgaccttcatctacagagaccccggcagctacctggtgaccgtgaccgccagcaacaacatcagcgccgccaacgacagcgccctggtggaggtgcaggagcccgtgctggtgaccagcatcaaggtgaacggcagcctgggcctggagctgcagcagccctacctgttcagcgccgtgggcagaggcagacccgccagctacctgtgggacctgggcgacggcggctggctggagggccccgaggtgacccacgcctacaacagcaccggcgacttcaccgtgagagtggccggctggaacgaggtgagcagaagcgaggcctggctgaacgtgaccgtgaagagaagagtgagaggcctggtggtgaacgccagcagaaccgtggtgcccctgaacggcagcgtgagcttcagcaccagcctggaggccggcagcgacgtgagatacagctgggtgctgtgcgacagatgcacccccatccccggcggccccaccatcagctacaccttcagaagcgtgggcaccttcaacatcatcgtgaccgccgagaacgaggtgggcagcgcccaggacagcatcttcgtgtacgtgctgcagctgatcgagggcctgcaggtggtgggcggcggcagatacttccccaccaaccacaccgtgcagctgcaggccgtggtgagagacggcaccaacgtgagctacagctggaccgcctggagagacagaggccccgccctggccggcagcggcaagggcttcagcctgaccgtgctggaggccggcacctaccacgtgcagctgagagccaccaacatgctgggcagcgcctgggccgactgcaccatggacttcgtggagcccgtgggctggctgatggtggccgccagccccaaccccgccgccgtgaacaccagcgtgaccctgagcgccgagctggccggcggcagcggcgtggtgtacacctggagcctggaggagggcctgagctgggagaccagcgagcccttcaccacccacagcttccccacccccggcctgcacctggtgaccatgaccgccggcaaccccctgggcagcgccaacgccaccgtggaggtggacgtgcaggtgcccgtgagcggcctgagcatcagagccagcgagcccggcggcagcttcgtggccgccggcagcagcgtgcccttctggggccagctggccaccggcaccaacgtgagctggtgctgggccgtgcccggcggcagcagcaagagaggcccccacgtgaccatggtgttccccgacgccggcaccttcagcatcagactgaacgccagcaacgccgtgagctgggtgagcgccacctacaacctgaccgccgaggagcccatcgtgggcctggtgctgtgggccagcagcaaggtggtggcccccggccagctggtgcacttccagatcctgctggccgccggcagcgccgtgaccttcagactgcaggtgggcggcgccaaccccgaggtgctgcccggccccagattcagccacagcttccccagagtgggcgaccacgtggtgagcgtgagaggcaagaaccacgtgagctgggcccaggcccaggtgagaatcgtggtgctggaggccgtgagcggcctgcaggtgcccaactgctgcgagcccggcatcgccaccggcaccgagagaaacttcaccgccagagtgcagagaggcagcagagtggcctacgcctggtacttcagcctgcagaaggtgcagggcgacagcctggtgatcctgagcggcagagacgtgacctacacccccgtggccgccggcctgctggagatccaggtgagagccttcaacgccctgggcagcgagaacagaaccctggtgctggaggtgcaggacgccgtgcagtacgtggccctgcagagcggcccctgcttcaccaacagaagcgcccagttcgaggccgccaccagccccagccccagaagagtggcctaccactgggacttcggcgacggcagccccggccaggacaccgacgagcccagagccgagcacagctacctgagacccggcgactacagagtgcaggtgaacgccagcaacctggtgagcttcttcgtggcccaggccaccgtgaccgtgcaggtgctggcctgcagagagcccgaggtggacgtggtgctgcccctgcaggtgctgatgagaagaagccagagaaactacctggaggcccacgtggacctgagagactgcgtgacctaccagaccgagtacagatgggaggtgtacagaaccgccagctgccagagacccggcagacccgccagagtggccctgcccggcgtggacgtgagcagacccagactggtgctgcccagactggccctgcccgtgggccactactgcttcgtgttcgtggtgagcttcggcgacacccccctgacccagagcatccaggccaacgtgaccgtggcccccgagagactggtgcccatcatcgagggcggcagctacagagtgtggagcgacaccagagacctggtgctggacggcagcgagagctacgaccccaacctggaggacggcgaccagacccccctgagcttccactgggcctgcgtggccagcacccagagagaggccggcggctgcgccctgaacttcggccccagaggcagcagcaccgtgaccatccccagagagagactggccgccggcgtggagtacaccttcagcctgaccgtgtggaaggccggcagaaaggaggaggccaccaaccagaccgtgctgatcagaagcggcagagtgcccatcgtgagcctggagtgcgtgagctgcaaggcccaggccgtgtacgaggtgagcagaagcagctacgtgtacctggagggcagatgcctgaactgcagcagcggcagcaagagaggcagatgggccgccagaaccttcagcaacaagaccctggtgctggacgagaccaccaccagcaccggcagcgccggcatgagactggtgctgagaagaggcgtgctgagagacggcgagggctacaccttcaccctgaccgtgctgggcagaagcggcgaggaggagggctgcgccagcatcagactgagccccaacagaccccccctgggcggcagctgcagactgttccccctgggcgccgtgcacgccctgaccaccaaggtgcacttcgagtgcaccggctggcacgacgccgaggacgccggcgcccccctggtgtacgccctgctgctgagaagatgcagacagggccactgcgaggagttctgcgtgtacaagggcagcctgagcagctacggcgccgtgctgccccccggcttcagaccccacttcgaggtgggcctggccgtggtggtgcaggaccagctgggcgccgccgtggtggccctgaacagaagcctggccatcaccctgcccgagcccaacggcagcgccaccggcctgaccgtgtggctgcacggcctgaccgccagcgtgctgcccggcctgctgagacaggccgacccccagcacgtgatcgagtacagcctggccctggtgaccgtgctgaacgagtacgagagagccctggacgtggccgccgagcccaagcacgagagacagcacagagcccagatcagaaagaacatcaccgagaccctggtgagcctgagagtgcacaccgtggacgacatccagcagatcgccgccgccctggcccagtgcatgggccccagcagagagctggtgtgcagaagctgcctgaagcagaccctgcacaagctggaggccatgatgctgatcctgcaggccgagaccaccgccggcaccgtgacccccaccgccatcggcgacagcatcctgaacatcaccggcgacctgatccacctggccagcagcgacgtgagagccccccagcccagcgagctgggcgccgagagccccagcagaatggtggccagccaggcctacaacctgaccagcgccctgatgagaatcctgatgagaagcagagtgctgaacgaggagcccctgaccctggccggcgaggagatcgtggcccagggcaagagaagcgaccccagaagcctgctgtgctacggcggcgcccccggccccggctgccacttcagcatccccgaggccttcagcggcgccctggccaacctgagcgacgtggtgcagctgatcttcctggtggacagcaaccccttccccttcggctacatcagcaactacaccgtgagcaccaaggtggccagcatggccttccagacccaggccggcgcccagatccccatcgagagactggccagcgagagagccatcaccgtgaaggtgcccaacaacagcgactgggccgccagaggccacagaagcagcgccaacagcgccaacagcgtggtggtgcagccccaggccagcgtgggcgccgtggtgaccctggacagcagcaaccccgccgccggcctgcacctgcagctgaactacaccctgctggacggccactacctgagcgaggagcccgagccctacctggccgtgtacctgcacagcgagcccagacccaacgagcacaactgcagcgccagcagaagaatcagacccgagagcctgcagggcgccgaccacagaccctacaccttcttcatcagccccggcagcagagaccccgccggcagctaccacctgaacctgagcagccacttcagatggagcgccctgcaggtgagcgtgggcctgtacaccagcctgtgccagtacttcagcgaggaggacatggtgtggagaaccgagggcctgctgcccctggaggagaccagccccagacaggccgtgtgcctgaccagacacctgaccgccttcggcgccagcctgttcgtgccccccagccacgtgagattcgtgttccccgagcccaccgccgacgtgaactacatcgtgatgctgacctgcgccgtgtgcctggtgacctacatggtgatggccgccatcctgcacaagctggaccagctggacgccagcagaggcagagccatccccttctgcggccagagaggcagattcaagtacgagatcctggtgaagaccggctggggcagaggcagcggcaccaccgcccacgtgggcatcatgctgtacggcgtggacagcagaagcggccacagacacctggacggcgacagagccttccacagaaacagcctggacatcttcagaatcgccaccccccacagcctgggcagcgtgtggaagatcagagtgtggcacgacaacaagggcctgagccccgcctggttcctgcagcacgtgatcgtgagagacctgcagaccgccagaagcgccttcttcctggtgaacgactggctgagcgtggagaccgaggccaacggcggcctggtggagaaggaggtgctggccgccagcgacgccgccctgctgagattcagaagactgctggtggccgagctgcagagaggcttcttcgacaagcacatctggctgagcatctgggacagaccccccagaagcagattcaccagaatccagagagccacctgctgcgtgctgctgatctgcctgttcctgggcgccaacgccgtgtggtacggcgccgtgggcgacagcgcctacagcaccggccacgtgagcagactgagccccctgagcgtggacaccgtggccgtgggcctggtgagcagcgtggtggtgtaccccgtgtacctggccatcctgttcctgttcagaatgagcagaagcaaggtggccggcagccccagccccacccccgccggccagcaggtgctggacatcgacagctgcctggacagcagcgtgctggacagcagcttcctgaccttcagcggcctgcacgccgaggccttcgtgggccagatgaagagcgacctgttcctggacgacagcaagagcctggtgtgctggcccagcggcgagggcaccctgagctggcccgacctgctgagcgaccccagcatcgtgggcagcaacctgagacagctggccagaggccaggccggccacggcctgggccccgaggaggacggcttcagcctggccagcccctacagccccgccaagagcttcagcgccagcgacgaggacctgatccagcaggtgctggccgagggcgtgagcagccccgcccccacccaggacacccacatggagaccgacctgctgagcagcctgagcagcacccccggcgagaagaccgagaccctggccctgcagagactgggcgagctgggcccccccagccccggcctgaactgggagcagccccaggccgccagactgagcagaaccggcctggtggagggcctgagaaagagactgctgcccgcctggtgcgccagcctggcccacggcctgagcctgctgctggtggccgtggccgtggccgtgagcggctgggtgggcgccagcttcccccccggcgtgagcgtggcctggctgctgagcagcagcgccagcttcctggccagcttcctgggctgggagcccctgaaggtgctgctggaggccctgtacttcagcctggtggccaagagactgcaccccgacgaggacgacaccctggtggagagccccgccgtgacccccgtgagcgccagagtgcccagagtgagacccccccacggcttcgccctgttcctggccaaggaggaggccagaaaggtgaagagactgcacggcatgctgagaagcctgctggtgtacatgctgttcctgctggtgaccctgctggccagctacggcgacgccagctgccacggccacgcctacagactgcagagcgccatcaagcaggagctgcacagcagagccttcctggccatcaccagaagcgaggagctgtggccctggatggcccacgtgctgctgccctacgtgcacggcaaccagagcagccccgagctgggcccccccagactgagacaggtgagactgcaggaggccctgtaccccgacccccccggccccagagtgcacacctgcagcgccgccggcggcttcagcaccagcgactacgacgtgggctgggagagcccccacaacggcagcggcacctgggcctacagcgcccccgacctgctgggcgcctggagctggggcagctgcgccgtgtacgacagcggcggctacgtgcaggagctgggcctgagcctggaggagagcagagacagactgagattcctgcagctgcacaactggctggacaacagaagcagagccgtgttcctggagctgaccagatacagccccgccgtgggcctgcacgccgccgtgaccctgagactggagttccccgccgccggcagagccctggccgccctgagcgtgagacccttcgccctgagaagactgagcgccggcctgagcctgcccctgctgaccagcgtgtgcctgctgctgttcgccgtgcacttcgccgtggccgaggccagaacctggcacagagagggcagatggagagtgctgagactgggcgcctgggccagatggctgctggtggccctgaccgccgccaccgccctggtgagactggcccagctgggcgccgccgacagacagtggaccagattcgtgagaggcagacccagaagattcaccagcttcgaccaggtggcccagctgagcagcgccgccagaggcctggccgccagcctgctgttcctgctgctggtgaaggccgcccagcagctgagattcgtgagacagtggagcgtgttcggcaagaccctgtgcagagccctgcccgagctgctgggcgtgaccctgggcctggtggtgctgggcgtggcctacgcccagctggccatcctgctggtgagcagctgcgtggacagcctgtggagcgtggcccaggccctgctggtgctgtgccccggcaccggcctgagcaccctgtgccccgccgagagctggcacctgagccccctgctgtgcgtgggcctgtgggccctgagactgtggggcgccctgagactgggcgccgtgatcctgagatggagataccacgccctgagaggcgagctgtacagacccgcctgggagccccaggactacgagatggtggagctgttcctgagaagactgagactgtggatgggcctgagcaaggtgaaggagttcagacacaaggtgagattcgagggcatggagcccctgcccagcagaagcagcagaggcagcaaggtgagccccgacgtgcccccccccagcgccggcagcgacgccagccaccccagcaccagcagcagccagctggacggcctgagcgtgagcctgggcagactgggcaccagatgcgagcccgagcccagcagactgcaggccgtgttcgaggccctgctgacccagttcgacagactgaaccaggccaccgaggacgtgtaccagctggagcagcagctgcacagcctgcagggcagaagaagcagcagagcccccgccggcagcagcagaggccccagccccggcctgagacccgccctgcccagcagactggccagagccagcagaggcgtggacctggccaccggccccagcagaacccccctgagagccaagaacaaggtgcaccccagcagcacctag

SEQ ID NO: 93799 - DNA, 8550 bp, Artificial Sequence
  Description of Artificial Sequence: Synthetic coding sequence
atggccgaggaggccgcccagaacatcagcgacgaccaggagagatgcctgcaggccgcctgctgcctgagcttcggcggcgagctgagcgtgagcaccgacaagagctggggcctgcacctgtgcagctgcagcccccccggcggcggcctgtgggtggaggtgtacgccaaccacgtgctgctgatgagcgacggcaagtgcggctgcccctggtgcgccctgaacggcaaggccgaggacagagagagccagagccccagcagcagcgccagcagacagaagaacatctggaagaccaccagcgaggccgccctgagcgtggtgaacgagaagacccaggccgtggtgaacgagaagacccaggcccccctggactgcgacaacagcgccgacagaatcccccacaagcccttcatcatcatcgccagagcctggagcagcggcggccccagattccaccacagaagactgtgcgccaccggcaccgccgacagcaccttcagcgccctgctgcagctgcagggcaccaccagcgccgccgccccctgcagcctgaagatggaggccagctgctgcgtgctgagactgctgtgctgcgccgaggacgtggccaccggcctgctgcccggcaccgtgaccatggagacccccaccaaggtggccagacccacccagaccagcagccagagagtgcccctgtggcccatcagccacttccccaccagccccagaagcagccacggcctgccccccggcatccccagaacccccagcttcaccgccagccagagcggcagcgagatcctgtacccccccacccagcacccccccgtggccatcctggccagaaacagcgacaacttcatgaaccccgtgctgaactgcagcctggaggtggaggccagagccccccccaacctgggcttcagagtgcacatggccagcggcgaggccctgtgcctgatgatggacttcggcgacagcagcggcgtggagatgagactgcacaacatgagcgaggccatggccgtgaccgcctaccaccagtacagcaagggcatcttcttccacctgctgcacttccagctggacatgagcacctacaaggaggccgagacccagaacaccaccctgaacgtgtacctgtgccagagcgagaacagctgcctggaggacagcgaccccagcaacctgggctacgagctgatcagcgccttcgtgaccaagggcgtgtacatgctgaaggccgtgatctacaacgagttccacggcaccgaggtggagctgggcccctactacgtggagatcggccacgaggccgtgagcgccttcatgaacagcagcagcgtgcacgaggacgaggtgctggtgttcgccgacagccaggtgaaccagaagagcaccgtggtgatccaccacttccccagcatccccagctacaacgtgagcttcatcagccagacccaggtgggcgacagccaggcctggcacagcatgaccgtgtggtacaagatgcagagcgtgagcgtgtacaccaacggcaccgtgttcgccaccgacaccgacatcaccttcaccgccgtgaccaaggagaccatccccctggagttcgagtggtacttcggcgaggacccccccgtgagaaccaccagcagaagcatcaagaagagactgagcatcccccagtggtacagagtgatggtgaaggccagcaacagaatgagcagcgtggtgagcgagccccacgtgatcagagtgcagaagaagatcgtggccaacagactgaccagccccagcagcgccctggtgaacgccagcgtggccttcgagtgctggatcaacttcggcaccgacgtggcctacctgtgggacttcggcgacggcaccgtgagcctgggcagcagcagcagcagccacgtgtacagcagagagggcgagttcaccgtggaggtgctggccttcaacaacgtgagcgccagcaccctgagacagcagctgttcatcgtgtgcgagccctgccagccccccctggtgaagaacatgggccccggcaaggtgcagatctggagaagccagcccgtgagactgggcgtgaccttcgaggccgccgtgttctgcgacatcagccagggcctgagctacacctggaacctgatggacagcgagggcctgcccgtgagcctgcccgccgccgtggacacccacagacagaccctgatcctgcccagccacaccctggagtacggcaactacaccgccctggccaaggtgcagatcgagggcagcgtggtgtacagcaactactgcgtgggcctggaggtgagagcccaggcccccgtgagcgtgatcagcgagggcacccacctgttcttcagcagaaccaccagcagccccatcgtgctgagaggcacccagagcttcgaccccgacgaccccggcgccaccctgagataccactgggagtgcgccaccgccggcagccccgcccacccctgcttcgacagcagcaccgcccaccagctggacgccgccgcccccaccgtgagcttcgaggcccagtggctgagcgacagctacgaccagttcctggtgatgctgagagtgagcagcggcggcagaaacagcagcgagaccagagtgttcctgagcccctaccccgacagcgccttcagattcgtgcacatcagctgggtgagcttcaaggacaccttcgtgaactggaacgacgagctgagcctgcaggccatgtgcgaggactgcagcgagatccccaacctgagctacagctgggacctgttcctggtgaacgccaccgagaagaacagaatcgaggtgcccttctgcagagtggtgggcctgctgggcagcctgggcctgggcgccatcagcgagagcagccagctgaacctgctgcccaccgagcccggcaccgccgaccccgacgccaccaccacccccttcagcagagagcccagccccgtgaccctgggccagcccgccaccagcgcccccagaggcacccccaccgagcccatgaccggcgtgtactggatcccccccgccggcgacagcgccgtgctgggcgaggcccccgaggagggcagcctggacctggagcccggcccccagagcaagggcagcctgatgaccggcagaagcgagagaagccagcccacccacagccccgacccccacctgagcgacttcgaggcctactacagcgacatccaggaggccatccccagcggcggcagacagcccgccaaggacaccagcttccccggcagcggccccagcctgagcgccgaggagagccccggcgacggcgacaacctggtggaccccagcctgagcgccggcagagccgagcccgtgctgatgatcgactggcccaaggccctgctgggcagagccgtgttccagggctacagcagcagcggcatcaccgagcagaccgtgaccatcaagccctacagcctgagcagcggcgagacctacgtgctgcaggtgagcgtggccagcaagcacggcctgctgggcaaggcccagctgtacctgaccgtgaaccccgcccccagagacatggcctgccaggtgcagccccaccacggcctggaggcccacaccgtgttcagcgtgttctgcatgagcggcaagcccgacttccactacgagttcagctaccagatcggcaacaccagcaagcacaccctgtaccacggcagagacacccagtactacttcgtgctgcccgccggcgagcacctggacaactacaaggtgatggtgagcaccgagatcaccgacggcaagggcagcaaggtgcagccctgcaccgtggtggtgaccgtgctgcccagataccacggcaacgactgcctgggcgaggacctgtacaacagcagcctgaagaacctgagcaccctgcagctgatgggcagctacaccgagatcagaaactacatcaccgtgatcaccagaatcctgagcagactgagcaaggaggacaagaccgccagctgcaaccagtggagcagaatccaggacgccctgatcagcagcgtgtgcagactggccttcgtggaccaggaggagatgatcggcagcgtgctgatgctgagagacctggtgagcttcagcaacaagctgggcttcatgagcgccgtgctgatcctgaagtacaccagagccctgctggcccagggccagttcagcggccccttcgtgatcgacaagggcgtgagactggagctgatcggcctgatcagcagagtgtgggaggtgagcgagcaggagaacagcaaggaggaggtgtacagacacgaggagggcatcaccgtgatcagcgacctgctgctgggctgcctgagcctgaaccacgtgagcaccggccagatggagttcagaaccctgctgcactacaacctgcagagcagcgtgcagagcctgggcagcgtgcaggtgcacctgcccggcgacctggccggccacagccccgccggcgccgagacccagagcccctgctacatcagccagctgatcctgttcaagaagaacccctaccccggcagccaggcccccggccagatcggcggcgtggtgggcctgaacctgtacacctgcagcagcagaagacccatcaacagacagtggctgagaaagcccgtgatggtggagttcggcgaggaggacggcctggacaacagaagaaacaagaccaccttcgtgctgctgagagacaaggtgaacctgcaccagttcaccgagctgagcgagaacccccaggagagcctgcagatcgagatcgagttcagcaagcccgtgaccagagccttccccgtgatgctgctggtgagattcagcgagaagcccacccccagcgacttcctggtgaagcagatctacttctgggacgagagcatcgtgcagatctacatccccgccgccagccagaaggacgccagcgtgggctacctgagcctgctggacgccgactacgacagaaagccccccaacagatacctggccaaggccgtgaactacaccgtgcacttccagtggatcagatgcctgttctgggacaagagagagtggaagagcgagagattcagcccccagcccggcaccagccccgagaaggtgaactgcagctaccacagactggccgccttcgccctgctgagaagaaagctgaaggccagcttcgaggtgagcgacatcagcaagctgcagagccaccccgagaacctgctgcccagcatcttcatcatgggcagcgtgatcctgtacggcttcctggtggccaagagcagacaggtggaccaccacgagaagaagaaggccggctacatcttcctgcaggaggccagcctgcccggccaccagctgtacgccgtggtgatcgacaccggcttcagagcccccgccagactgaccagcaaggtgtacatcgtgctgtgcggcgacaacggcctgagcgagaccaaggagctgagctgccccgagaagcccctgttcgagagaaacagcagacacaccttcatcctgagcgcccccgcccagctgggcctgctgagaaagatcagactgtggcacgacagcagaggccccagccccggctggttcatcagccacgtgatggtgaaggagctgcacaccggccagggctggttcttccccgcccagtgctggctgagcgccggcagacacgacggcagagtggagagagagctgacctgcctgcagggcggcctgggcttcagaaagctgttctactgcaagttcaccgagtacctggaggacttccacgtgtggctgagcgtgtacagcagacccagcagcagcagatacctgcacacccccagactgaccgtgagcttcagcctgctgtgcgtgtacgcctgcctgaccgccctggtggccgccggcggccaggagcagccccacctggacgtgagccccaccctgggcagcttcagagtgggcctgctgtgcaccctgctggccagccccggcgcccagctgctgagcctgctgttcagactgagcaaggaggcccccggcagcgccagagtggagccccacagccccctgagaggcggcgcccagaccgaggccccccacggccccaacagctggggcagaatccccgacgcccaggagcccagaaagcagcccgccagcgccatcctgagcggcagcggcagagcccagagaaaggccgccagcgacaacggcaccgcctgccccgcccccaagctgcaggtgcacggcgccgaccacagcagaaccagcctgatgggcaagagccactgctgccccccccacacccaggcccccagcagcggcctggagggcctgatgccccagtggagcagagccctgcagccctggtggagcagcgccgtgtgggccatctgcggcaccgccagcctggcctgcagcctgggcaccggcttcctggcctacagattcggccaggagcagtgcgtgcagtggctgcacctgctgagcctgagcgtggtgtgctgcatcttcatcacccagcccctgatggtgtgcctgatggccctgggcttcgcctggaagagaagagccgacaaccacttcttcaccgagagcctgtgcgaggccaccagagacctggacagcgagctggccgagagaagctggaccagactgcccttcagcagcagctgcagcatccccgactgcgccggcgaggtggagaaggtgctggccgccagacagcaggccagacacctgagatgggcccacccccccagcaaggcccagctgagaggcaccagacagagaatgagaagagagagcagaaccagagccgccctgagagacatcagcatggacatcctgatgctgctgctgctgctgtgcgtgatctacggcagattcagccaggacgagtacagcctgaaccaggccatcagaaaggagttcaccagaaacgccagaaactgcctgggcggcctgagaaacatcgccgactggtgggactggagcctgaccaccctgctggacggcctgtaccccggcggcacccccagcgccagagtgcccggcgcccagcccggcgccctgggcggcaagtgctacctgatcggcagcagcgtgatcagacagctgaaggtgttccccagacacctgtgcaagccccccagacccttcagcgccctgatcgaggacagcatccccacctgcagccccgaggtgggcggccccgagaacccctacctgatcgaccccgagaaccagaacgtgaccctgaacggccccggcggctgcggcaccagagaggactgcgtgctgagcctgggcagaaccagaaccgaggcccacaccgccctgagcagactgagagccagcatgtggatcgacagaagcaccagagccgtgagcgtgcacttcaccctgtacaacccccccacccagctgttcaccagcgtgagcctgagagtggagatcctgcccaccggcagcctggtgcccagcagcctggtggagagcttcagcatcttcagaagcgacagcgccctgcagtaccacctgatgctgccccagctggtgttcctggccctgagcctgatccacctgtgcgtgcagctgtacagaatgatggacaagggcgtgctgagctactggagaaagcccagaaactggctggagctgagcgtggtgggcgtgagcctgacctactacgccgtgagcggccacctggtgaccctggccggcgacgtgaccaaccagttccacagaggcctgtgcagagccttcatggacctgaccctgatggccagctggaaccagagagccagatggctgagaggcatcctgctgttcctgttcaccctgaagtgcgtgtacctgcccggcatccagaacaccatggccagctgcagcagcatgatgagacacagcctgcccagcatcttcgtggccggcctggtgggcgccctgatgctggccgccctgagccacctgcacagattcctgctgagcatgtgggtgctgccccccggcaccttcaccgacgccttccccggcctgctgttccacttccccagaagaagccagaaggactgcctgctgggcctgagcaagagcgaccagagagccatggcctgctacttcggcatcctgctgatcgtgagcgccaccctgtgcttcggcatgctgagaggcttcctgatgaccctgccccagaagagaaagagcttccagagcaagagcttcgtgagactgaaggacgtgaccgcctacatgtgggagaaggtgctgaccttcctgagactggagacccccaagctggaggaggccgagatggtggagaaccacaactactacctggacgagttcgccaacctgctggacgagctgctgatgaagatcaacggcctgagcgacagcctgcagctgcccctgctggagaagaccagcaacaacaccggcgaggccagaaccgaggagagccccctggtggacatcagcagctaccaggccgccgagcccgccgacatcaaggacttctag

SEQ ID NO: 93800 - DNA, 495 bp, Artificial Sequence
  Description of Artificial Sequence: Synthetic coding sequence
tgagtgggcggccccgagaacccctacctgatcgaccccgagaaccagaacgtgaccctgaacggccccggcggctgcggcaccagagaggactgcgtgctgagcctgggcagaaccagaaccgaggcccacaccgccctgagcagactgagagccagcatgtggatcgacagaagcaccagagccgtgagcgtgcacttcaccctgtacaacccccccacccagctgttcaccagcgtgagcctgagagtggagatcctgcccaccggcagcctggtgcccagcagcctggtggagagcttcagcatcttcagaagcgacagcgccctgcagtaccacctgatgctgccccagctggtgttcctggccctgagcctgatccacctgtgcgtgcagctgtacagaatgatggacaagggcgtgctgagctactggagaaagcccagaaactggctggaggtggccagcctggtgagcttcagcttcgagaagtag

SEQ ID NO: 93801 - DNA, 2907 bp, Artificial Sequence
  Description of Artificial Sequence: Synthetic coding sequence
atggtgaacagcagcagagtgcagccccagcagcccggcgacgccaagagaccccccgcccccagagcccccgaccccggcagactgatggccggctgcgccgccgtgggcgccagcctggccgcccccggcggcctgtgcgagcagagaggcctggagatcgagatgcagagaatcagacaggccgccgccagagacccccccgccggcgccgccgccagccccagcccccccctgagcagctgcagcagacaggcctggagcagagacaaccccggcttcgaggccgaggaggaggaggaggaggtggagggcgaggagggcggcatggtggtggagatggacgtggagtggagacccggcagcagaagaagcgccgccagcagcgccgtgagcagcgtgggcgccagaagcagaggcctgggcggctaccacggcgccggccaccccagcggcagaagaagaagaagagaggaccagggccccccctgccccagccccgtgggcggcggcgaccccctgcacagacacctgcccctggagggccagccccccagagtggcctgggccgagagactggtgagaggcctgagaggcctgtggggcaccagactgatggaggagagcagcaccaacagagagaagtacctgaagagcgtgctgagagagctggtgacctacctgctgttcctgatcgtgctgtgcatcctgacctacggcatgatgagcagcaacgtgtactactacaccagaatgatgagccagctgttcctggacacccccgtgagcaagaccgagaagaccaacttcaagaccctgagcagcatggaggacttctggaagttcaccgagggcagcctgctggacggcctgtactggaagatgcagcccagcaaccagaccgaggccgacaacagaagcttcatcttctacgagaacctgctgctgggcgtgcccagaatcagacagctgagagtgagaaacggcagctgcagcatcccccaggacctgagagacgagatcaaggagtgctacgacgtgtacagcgtgagcagcgaggacagagcccccttcggccccagaaacggcaccgcctggatctacaccagcgagaaggacctgaacggcagcagccactggggcatcatcgccacctacagcggcgccggctactacctggacctgagcagaaccagagaggagaccgccgcccaggtggccagcctgaagaagaacgtgtggctggacagaggcaccagagccaccttcatcgacttcagcgtgtacaacgccaacatcaacctgttctgcgtggtgagactgctggtggagttccccgccaccggcggcgtgatccccagctggcagttccagcccctgaagctgatcagatacgtgaccaccttcgacttcttcctggccgcctgcgagatcatcttctgcttcttcatcttctactacgtggtggaggagatcctggagatcagaatccacaagctgcactacttcagaagcttctggaactgcctggacgtggtgatcgtggtgctgagcgtggtggccatcggcatcaacatctacagaaccagcaacgtggaggtgctgctgcagttcctggaggaccagaacaccttccccaacttcgagcacctggcctactggcagatccagttcaacaacatcgccgccgtgaccgtgttcttcgtgtggatcaagctgttcaagttcatcaacttcaacagaaccatgagccagctgagcaccaccatgagcagatgcgccaaggacctgttcggcttcgccatcatgttcttcatcatcttcctggcctacgcccagctggcctacctggtgttcggcacccaggtggacgacttcagcaccttccaggagtgcatcttcacccagttcagaatcatcctgggcgacatcaacttcgccgagatcgaggaggccaacagagtgctgggccccatctacttcaccaccttcgtgttcttcatgttcttcatcctgctgaacatgttcctggccatcatcaacgacacctacagcgaggtgaagagcgacctggcccagcagaaggccgagatggagctgagcgacctgatcagaaagggctaccacaaggccctggtgaagctgaagctgaagaagaacaccgtggacgacatcagcgagagcctgagacagggcggcggcaagctgaacttcgacgagctgagacaggacctgaagggcaagggccacaccgacgccgagatcgaggccatcttcaccaagtacgaccaggacggcgaccaggagctgaccgagcacgagcaccagcagatgagagacgacctggagaaggagagagaggacctggacctggaccacagcagcctgcccagacccatgagcagcagaagcttccccagaagcctggacgacagcgaggaggacgacgacgaggacagcggccacagcagcagaagaagaggcagcatcagcagcggcgtgagctacgaggagttccaggtgctggtgagaagagtggacagaatggagcacagcatcggcagcatcgtgagcaagatcgacgccgtgatcgtgaagctggagatcatggagagagccaagctgaagagaagagaggtgctgggcagactgctggacggcgtggccgaggacgagagactgggcagagacagcgagatccacagagagcagatggagagactggtgagagaggagctggagagatgggagagcgacgacgccgccagccagatcagccacggcctgggcacccccgtgggcctgaacggccagcccagacccagaagcagcagacccagcagcagccagagcaccgagggcatggagggcgccggcggcaacggcagcagcaacgtgcacgtgtag

SEQ ID NO: 93802 - DNA, 1161 bp, Artificial Sequence
  Description of Artificial Sequence: Synthetic coding sequence
atgagccagctgagcaccaccatgagcagatgcgccaaggacctgttcggcttcgccatcatgttcttcatcatcttcctggcctacgcccagctggcctacctggtgttcggcacccaggtggacgacttcagcaccttccaggagtgcatcttcacccagttcagaatcatcctgggcgacatcaacttcgccgagatcgaggaggccaacagagtgctgggccccatctacttcaccaccttcgtgttcttcatgttcttcatcctgctgaacatgttcctggccatcatcaacgacacctacagcgaggtgaagagcgacctggcccagcagaaggccgagatggagctgagcgacctgatcagaaagggctaccacaaggccctggtgaagctgaagctgaagaagaacaccgtggacgacatcagcgagagcctgagacagggcggcggcaagctgaacttcgacgagctgagacaggacctgaagggcaagggccacaccgacgccgagatcgaggccatcttcaccaagtacgaccaggacggcgaccaggagctgaccgagcacgagcaccagcagatgagagacgacctggagaaggagagagaggacctggacctggaccacagcagcctgcccagacccatgagcagcagaagcttccccagaagcctggacgacagcgaggaggacgacgacgaggacagcggccacagcagcagaagaagaggcagcatcagcagcggcgtgagctacgaggagttccaggtgctggtgagaagagtggacagaatggagcacagcatcggcagcatcgtgagcaagatcgacgccgtgatcgtgaagctggagatcatggagagagccaagctgaagagaagagaggtgctgggcagactgctggacggcgtggccgaggacgagagactgggcagagacagcgagatccacagagagcagatggagagactggtgagagaggagctggagagatgggagagcgacgacgccgccagccagatcagccacggcctgggcacccccgtgggcctgaacggccagcccagacccagaagcagcagacccagcagcagccagagcaccgagggcatggagggcgccggcggcaacggcagcagcaacgtgcacgtgtag

SEQ ID NO: 93803 - DNA, 1161 bp, Artificial Sequence; identical to SEQ ID NO: 93802
  Description of Artificial Sequence: Synthetic coding sequence

SEQ ID NO: 93804 - DNA, 2418 bp, Artificial Sequence
  Description of Artificial Sequence: Synthetic coding sequence
atgaacgccgtgggcagccccgagggccaggagctgcagaagctgggcagcggcgcctgggacaaccccgcctacagcggcccccccagcccccacggcaccctgagagtgtgcaccatcagcagcaccggccccctgcagccccagcccaagaagcccgaggacgagccccaggagaccgcctacagaacccaggtgagcagctgctgcctgcacatctgccagggcatcagaggcctgtggggcaccaccctgaccgagaacaccgccgagaacagagagctgtacatcaagaccaccctgagagagctgctggtgtacatcgtgttcctggtggacatctgcctgctgacctacggcatgaccagcagcagcgcctactactacaccaaggtgatgagcgagctgttcctgcacacccccagcgacaccggcgtgagcttccaggccatcagcagcatggccgacttctgggacttcgcccagggccccctgctggacagcctgtactggaccaagtggtacaacaaccagagcctgggccacggcagccacagcttcatctactacgagaacatgctgctgggcgtgcccagactgagacagctgaaggtgagaaacgacagctgcgtggtgcacgaggacttcagagaggacatcctgagctgctacgacgtgtacagccccgacaaggaggagcagctgcccttcggccccttcaacggcaccgcctggacctaccacagccaggacgagctgggcggcttcagccactggggcagactgaccagctacagcggcggcggctactacctggacctgcccggcagcagacagggcagcgccgaggccctgagagccctgcaggagggcctgtggctggacagaggcaccagagtggtgttcatcgacttcagcgtgtacaacgccaacatcaacctgttctgcgtgctgagactggtggtggagttccccgccaccggcggcgccatccccagctggcagatcagaaccgtgaagctgatcagatacgtgagcaactgggacttcttcatcgtgggctgcgaggtgatcttctgcgtgttcatcttctactacgtggtggaggagatcctggagctgcacatccacagactgagatacctgagcagcatctggaacatcctggacctggtggtgatcctgctgagcatcgtggccgtgggcttccacatcttcagaaccctggaggtgaacagactgatgggcaagctgctgcagcagcccaacacctacgccgacttcgagttcctggccttctggcagacccagtacaacaacatgaacgccgtgaacctgttcttcgcctggatcaagatcttcaagtacatcagcttcaacaagaccatgacccagctgagcagcaccctggccagatgcgccaaggacatcctgggcttcgccgtgatgttcttcatcgtgttcttcgcctacgcccagctgggctacctgctgttcggcacccaggtggagaacttcagcaccttcatcaagtgcatcttcacccagttcagaatcatcctgggcgacttcgactacaacgccatcgacaacgccaacagaatcctgggccccgcctacttcgtgacctacgtgttcttcgtgttcttcgtgctgctgaacatgttcctggccatcatcaacgacacctacagcgaggtgaaggaggagctggccggccagaaggacgagctgcagctgagcgacctgctgaagcagggctacaacaagaccctgctgagactgagactgagaaaggagagagtgagcgacgtgcagaaggtgctgcagggcggcgagcaggagatccagttcgaggacttcaccaacaccctgagagagctgggccacgccgagcacgagatcaccgagctgaccgccaccttcaccaagttcgacagagacggcaacagaatcctggacgagaaggagcaggagaagatgagacaggacctggaggaggagagagtggccctgaacaccgagatcgagaagctgggcagaagcatcgtgagcagcccccagggcaagagcggccccgaggccgccagagccggcggctgggtgagcggcgaggagttctacatgctgaccagaagagtgctgcagctggagaccgtgctggagggcgtggtgagccagatcgacgccgtgggcagcaagctgaagatgctggagagaaagggctggctggcccccagccccggcgtgaaggagcaggccatctggaagcacccccagcccgcccccgccgtgacccccgacccctggggcgtgcagggcggccaggagagcgaggtgccctacaagagagaggaggaggccctggaggagagaagactgagcagaggcgagatccccaccctgcagagaagctag

SEQ ID NO: 93805 - DNA, 2193 bp, Artificial Sequence
  Description of Artificial Sequence: Synthetic coding sequence
atgaacgccgtgggcagccccgagggccaggagctgcagaagctgggcagcggcgcctgggacaaccccgcctacagcggcccccccagcccccacggcaccctgagagtgtgcaccatcagcagcaccggccccctgcagccccagcccaagaagcccgaggacgagccccaggagaccgcctacagaacccaggtgagcagctgctgcctgcacatctgccagggcatcagaggcctgtggggcaccaccctgaccgagaacaccgccgagaacagagagctgtacatcaagaccaccctgagagagctgctggtgtacatcgtgttcctggtggacatctgcctgctgacctacggcatgaccagcagcagcgcctactactacaccaaggtgatgagcgagctgttcctgcacacccccagcgacaccggcgtgagcttccaggccatcagcagcatggccgacttctgggacttcgcccagggccccctgctggacagcctgtactggaccaagtggtacaacaaccagagcctgggccacggcagccacagcttcatctactacgagaacatgctgctgggcgtgcccagactgagacagctgaaggtgagaaacgacagctgcgtggtgcacgaggacttcagagaggacatcctgagctgctacgacgtgtacagccccgacaaggaggagcagctgcccttcggccccttcaacggcaccgccctggtggtggagttccccgccaccggcggcgccatccccagctggcagatcagaaccgtgaagctgatcagatacgtgagcaactgggacttcttcatcgtgggctgcgaggtgatcttctgcgtgttcatcttctactacgtggtggaggagatcctggagctgcacatccacagactgagatacctgagcagcatctggaacatcctggacctggtggtgatcctgctgagcatcgtggccgtgggcttccacatcttcagaaccctggaggtgaacagactgatgggcaagctgctgcagcagcccaacacctacgccgacttcgagttcctggccttctggcagacccagtacaacaacatgaacgccgtgaacctgttcttcgcctggatcaagatcttcaagtacatcagcttcaacaagaccatgacccagctgagcagcaccctggccagatgcgccaaggacatcctgggcttcgccgtgatgttcttcatcgtgttcttcgcctacgcccagctgggctacctgctgttcggcacccaggtggagaacttcagcaccttcatcaagtgcatcttcacccagttcagaatcatcctgggcgacttcgactacaacgccatcgacaacgccaacagaatcctgggccccgcctacttcgtgacctacgtgttcttcgtgttcttcgtgctgctgaacatgttcctggccatcatcaacgacacctacagcgaggtgaaggaggagctggccggccagaaggacgagctgcagctgagcgacctgctgaagcagggctacaacaagaccctgctgagactgagactgagaaaggagagagtgagcgacgtgcagaaggtgctgcagggcggcgagcaggagatccagttcgaggacttcaccaacaccctgagagagctgggccacgccgagcacgagatcaccgagctgaccgccaccttcaccaagttcgacagagacggcaacagaatcctggacgagaaggagcaggagaagatgagacaggacctggaggaggagagagtggccctgaacaccgagatcgagaagctgggcagaagcatcgtgagcagcccccagggcaagagcggccccgaggccgccagagccggcggctgggtgagcggcgaggagttctacatgctgaccagaagagtgctgcagctggagaccgtgctggagggcgtggtgagccagatcgacgccgtgggcagcaagctgaagatgctggagagaaagggctggctggcccccagccccggcgtgaaggagcaggccatctggaagcacccccagcccgcccccgccgtgacccccgacccctggggcgtgcagggcggccaggagagcgaggtgccctacaagagagaggaggaggccctggaggagagaagactgagcagaggcgagatccccaccctgcagagaagctag

SEQ ID NO: 93806 - DNA, 2328 bp, Artificial Sequence
  Description of Artificial Sequence: Synthetic coding sequence
atgaacgccgtgggcagccccgagggccaggagctgcagaagctgggcagcggcgcctgggacaaccccgcctacagcggcccccccagcccccacggcaccctgagagtgtgcaccatcagcagcaccggccccctgcagccccagcccaagaagcccgaggacgagccccaggagaccgcctacagaacccaggtgagcagctgctgcctgcacatctgccagggcatcagaggcctgtggggcaccaccctgaccgagaacaccgccgagaacagagagctgtacatcaagaccaccctgagagagctgctggtgtacatcgtgttcctggtggacatctgcctgctgacctacggcatgaccagcagcagcgcctactactacaccaaggtgatgagcgagctgttcctgcacacccccagcgacaccggcgtgagcttccaggccatcagcagcatggccgacttctgggacttcgcccagggccccctgctggacagcctgtactggaccaagtggtacaacaaccagagcctgggccacggcagccacagcttcatctactacgagaacatgctgctgggcgtgcccagactgagacagctgaaggtgagaaacgacagctgcgtggtgcacgaggacttcagagaggacatcctgagctgctacgacgtgtacagccccgacaaggaggagcagctgcccttcggccccttcaacggcaccgcctggacctaccacagccaggacgagctgggcggcttcagccactggggcagactgaccagctacagcggcggcggctactacctggacctgcccggcagcagacagggcagcgccgaggccctgagagccctgcaggagggcctgtggctggacagaggcaccagagtggtgttcatcgacttcagcgtgtacaacgccaacatcaacctgttctgcgtgctgagactggtggtggagttccccgccagaagatgccaccccatcctggccaacccccacagccaggccgaccccctgtgccagcagctgttcttcatcgtgggctgcgaggtgatcttctgcgtgttcatcttctactacgtggtggaggagatcctggagctgcacatccacagactgagatacctgagcagcatctggaacatcctggacctggtggtgatcctgctgagcatcgtggccgtgggcttccacatcttcagaaccctggaggtgaacagactgatgggcaagctgctgcagcagcccaacacctacgccgacttcgagttcctggccttctggcagacccagtacaacaacatgaacgccgtgaacctgttcttcgcctggatcaagatcttcaagtacatcagcttcaacaagaccatgacccagctgagcagcaccctggccagatgcgccaaggacatcctgggcttcgccgtgatgttcttcatcgtgttcttcgcctacgcccagctgggctacctgctgttcggcacccaggtggagaacttcagcaccttcatcaagtgcatcttcacccagttcagaatcatcctgggcgacttcgactacaacgccatcgacaacgccaacagaatcctgggccccgcctacttcgtgacctacgtgttcttcgtgttcttcgtgctgctgaacatgttcctggccatcatcaacgacacctacagcgaggtgaaggaggagctggccggccagaaggacgagctgcagctgagcgacctgctgaagcagggctacaacaagaccctgctgagactgagactgagaaaggagagagtgagcgacgtgcagaaggtgctgcagggcggcgagcaggagatccagttcgaggacttcaccaacaccctgagagagctgggccacgccgagcacgagatcaccgagctgaccgccaccttcaccaagttcgacagagacggcaacagaatcctggacgagaaggagcaggagaagatgagacaggacctggaggaggagagagtggccctgaacaccgagatcgagaagctgggcagaagcatcgtgagcagcccccagggcaagagcggccccgaggccgccagagccggcggctgggtgagcggcgaggagttctacatgctgaccagaagagtgctgcagctggagaccgtgctggagggcgtggtgagccagatcgacgccgtgggcagcaagctgaagatgctggagagaaagggctggctggcccccagccccggcgtgaaggagcaggccatctggaagcacccccagcccgcccccgccgtgacccccgacccctggggccccggctgggccggcgagtag

SEQ ID NO: 93807 - DNA, 2283 bp, Artificial Sequence
  Description of Artificial Sequence: Synthetic coding sequence
atgaacgccgtgggcagccccgagggccaggagctgcagaagctgggcagcggcgcctgggacaaccccgcctacagcggcccccccagcccccacggcaccctgagagtgtgcaccatcagcagcaccggccccctgcagccccagcccaagaagcccgaggacgagccccaggagaccgcctacagaacccaggtgagcagctgctgcctgcacatctgccagggcatcagaggcctgtggggcaccaccctgaccgagaacaccgccgagaacagagagctgtacatcaagaccaccctgagagagctgctggtgtacatcgtgttcctggtggacatctgcctgctgacctacggcatgaccagcagcagcgcctactactacaccaaggtgatgagcgagctgttcctgcacacccccagcgacaccggcgtgagcttccaggccatcagcagcatggccgacttctgggacttcgcccagggccccctgctggacagcctgtactggaccaagtggtacaacaaccagagcctgggccacggcagccacagcttcatctactacgagaacatgctgctgggcgtgcccagactgagacagctgaaggtgagaaacgacagctgcgtggtgcacgaggacttcagagaggacatcctgagctgctacgacgtgtacagccccgacaaggaggagcagctgcccttcggccccttcaacggcaccgcctggacctaccacagccaggacgagctgggcggcttcagccactggggcagactgaccagctacagcggcggcggctactacctggacctgcccggcagcagacagggcagcgccgaggccctgagagccctgcaggagggcctgtggctggacagaggcaccagagtggtgttcatcgacttcagcgtgtacaacgccaacatcaacctgttctgcgtgctgagactggtggtggagttccccgccaccggcggcgccatccccagctggcagatcagaaccgtgaagctgatcagatacgtgagcaactgggacttcttcatcgtgggctgcgaggtgatcttctgcgtgttcatcttctactacgtggtggaggagatcctggagctgcacatccacagactgagatacctgagcagcatctggaacatcctggacctggtggtgatcctgctgagcatcgtggccgtgggcttccacatcttcagaaccctggaggtgaacagactgatgggcaagctgctgcagcagcccaacacctacgccgacttcgagttcctggccttctggcagacccagtacaacaacatgaacgccgtgaacctgttcttcgcctggatcaagatcttcaagtacatcagcttcaacaagaccatgacccagctgagcagcaccctggccagatgcgccaaggacatcctgggcttcgccgtgatgttcttcatcgtgttcttcgcctacgcccagctgggctacctgctgttcggcacccaggtggagaacttcagcaccttcatcaagtgcatcttcacccagttcagaatcatcctgggcgacttcgactacaacgccatcgacaacgccaacagaatcctgggccccgcctacttcgtgacctacgtgttcttcgtgttcttcgtgctgctgaacatgttcctggccatcatcaacgacacctacagcgaggtgaaggaggagctggccggccagaaggacgagctgcagctgagcgacctgctgaagcagggctacaacaagaccctgctgagactgagactgagaaaggagagagtgagcgacgtgcagaaggtgctgcagggcggcgagcaggagatccagttcgaggacttcaccaacaccctgagagagctgggccacgccgagcacgagatcaccgagctgaccgccaccttcaccaagttcgacagagacggcaacagaatcctggacgagaaggagcaggagaagatgagacaggacctggaggaggagagagtggccctgaacaccgagatcgagaagctgggcagaagcatcgtgagcagcccccagggcaagagcggccccgaggccgccagagccggcggctgggtgagcggcgaggagttctacatgctgaccagaagagtgctgcagctggagaccgtgctggagggcgtggtgagccagatcgacgccgtgggcagcaagctgaagatgctggagagaaagggctggctggcccccagccccggcgtgagattccccatcaaggagaagagaaagccctag

SEQ ID NO: 93808 - DNA, 1842 bp, Artificial Sequence
  Description of Artificial Sequence: Synthetic coding sequence
atggccgaggccagcagatggcacagaggcggcgccagcaagcacaagctgcactacagaaaggaggtggagatcaccaccaccctgcaggagctgctgctgtacttcatcttcctgatcaacctgtgcatcctgaccttcggcatggtgaacccccacatgtactacctgaacaaggtgatgagcagcctgttcctggacaccagcgtgcccggcgaggagagaaccaacttcaagagcatcagaagcatcaccgacttctggaagttcatggagggccccctgctggagggcctgtactgggacagctggtacaacaaccagcagctgtacaacctgaagaacagcagcagaatctactacgagaacatcctgctgggcgtgcccagagtgagacagctgaaggtgagaaacaacacctgcaaggtgtacagcagcttccagagcctgatgagcgagtgctacggcaagtacaccagcgccaacgaggacctgagcaacttcggcctgcagatcaacaccgagtggagatacagcaccagcaacaccaacagcccctggcactggggcttcctgggcgtgtacagaaacggcggctacatcttcaccctgagcaagagcaagagcgagaccaagaacaagttcatcgacctgagactgaacagctggatcaccagaggcaccagagtgatcttcatcgacttcagcctgtacaacgccaacgtgaacctgttctgcatcatcagactggtggccgagttccccgccaccggcggcatcctgaccagctggcagttctacagcgtgaagctgctgagatacgtgagctactacgactacttcatcgccagctgcgagatcaccttctgcatcttcctgttcgtgttcaccacccaggaggtgaagaagatcaaggagttcaagagcgcctacttcaagagcatctggaactggctggagctgctgctgctgctgctgtgcttcgtggccgtgagcttcaacacctactacaacgtgcagatcttcctgctgctgggccagctgctgaagagcaccgagaagtacagcgacttctacttcctggcctgctggcacatctactacaacaacatcatcgccatcaccatcttcttcgcctggatcaagatcttcaagttcatcagcttcaacaagaccatgagccagctgagcagcaccctgagcagatgcgtgaaggacatcgtgggcttcgccatcatgttcttcatcatcttcttcgcctacgcccagctgggcttcctggtgttcggcagccaggtggacgacttcagcaccttccagaacagcatcttcgcccagttcagaatcgtgctgggcgacttcaacttcgccggcatccagcaggccaaccccatcctgggccccatctacttcatcaccttcatcttcttcgtgttcttcgtgctgctgaacatgttcctggccatcatcaacgacacctacagcgaggtgaaggccgactacagcatcggcagaagactggacttcgagctgggcaagatgatcaagcagagctacaagaacgtgctggagaagttcagactgaagaaggcccagaaggacgaggacaagaagaccaagggcagcggcgacctggccgagcaggccagaagagagggcttcgacgagaacgagatccagaacgccgagcagatgaagaagtggaaggagagactggagaagaagtactacagcatggagatccaggacgactaccagcccgtgacccaggaggagttcagagacggcaccaccaccaagtacaagatgagattcagcgagtgcctgaccaagagaatctag

SEQ ID NO: 93809 - DNA, 1773 bp, Artificial Sequence
  Description of Artificial Sequence: Synthetic coding sequence
atggccgaggccagcagatggcacagaggcgtgaccttcggcatggtgaacccccacatgtactacctgaacaaggtgatgagcagcctgttcctggacaccagcgtgcccggcgaggagagaaccaacttcaagagcatcagaagcatcaccgacttctggaagttcatggagggccccctgctggagggcctgtactgggacagctggtacaacaaccagcagctgtacaacctgaagaacagcagcagaatctactacgagaacatcctgctgggcgtgcccagagtgagacagctgaaggtgagaaacaacacctgcaaggtgtacagcagcttccagagcctgatgagcgagtgctacggcaagtacaccagcgccaacgaggacctgagcaacttcggcctgcagatcaacaccgagtggagatacagcaccagcaacaccaacagcccctggcactggggcttcctgggcgtgtacagaaacggcggctacatcttcaccctgagcaagagcaagagcgagaccaagaacaagttcatcgacctgagactgaacagctggatcaccagaggcaccagagtgatcttcatcgacttcagcctgtacaacgccaacgtgaacctgttctgcatcatcagactggtggccgagttccccgccaccggcggcatcctgaccagctggcagttctacagcgtgaagctgctgagatacgtgagctactacgactacttcatcgccagctgcgagatcaccttctgcatcttcctgttcgtgttcaccacccaggaggtgaagaagatcaaggagttcaagagcgcctacttcaagagcatctggaactggctggagctgctgctgctgctgctgtgcttcgtggccgtgagcttcaacacctactacaacgtgcagatcttcctgctgctgggccagctgctgaagagcaccgagaagtacagcgacttctacttcctggcctgctggcacatctactacaacaacatcatcgccatcaccatcttcttcgcctggatcaagatcttcaagttcatcagcttcaacaagaccatgagccagctgagcagcaccctgagcagatgcgtgaaggacatcgtgggcttcgccatcatgttcttcatcatcttcttcgcctacgcccagctgggcttcctggtgttcggcagccaggtggacgacttcagcaccttccagaacagcatcttcgcccagttcagaatcgtgctgggcgacttcaacttcgccggcatccagcaggccaaccccatcctgggccccatctacttcatcaccttcatcttcttcgtgttcttcgtgctgctgaacatgttcctggccatcatcaacgacacctacagcgaggtgaaggccgactacagcatcggcagaagactggacttcgagctgggcaagatgatcaagcagagctacaagaacgtgctggagaagttcagactgaagaaggcccagaaggacgaggacaagaagaccaagggcagcggcgacctggccgagcaggccagaagagagggcttcgacgagaacgagatccagaacgccgagcagatgaagaagtggaaggagagactggagaagaagtactacagcatggagatccaggacgactaccagcccgtgacccaggaggagttcagagagctgttcctgtacgccgtggagctggagaaggagctgcactacatcaacctgaagctgaaccaggtggtgagaaaggtgagcgccctgtag

SEQ ID NO: 93810 - DNA, 1875 bp, Artificial Sequence
  Description of Artificial Sequence: Synthetic coding sequence
atggccgaggccagcagatggcacagaggcggcgccagcaagcacaagctgcactacagaaaggaggtggagatcaccaccaccctgcaggagctgctgctgtacttcatcttcctgatcaacctgtgcatcctgaccttcggcatggtgaacccccacatgtactacctgaacaaggtgatgagcagcctgttcctggacaccagcgtgcccggcgaggagagaaccaacttcaagagcatcagaagcatcaccgacttctggaagttcatggagggccccctgctggagggcctgtactgggacagctggtacaacaaccagcagctgtacaacctgaagaacagcagcagaatctactacgagaacatcctgctgggcgtgcccagagtgagacagctgaaggtgagaaacaacacctgcaaggtgtacagcagcttccagagcctgatgagcgagtgctacggcaagtacaccagcgccaacgaggacctgagcaacttcggcctgcagatcaacaccgagtggagatacagcaccagcaacaccaacagcccctggcactggggcttcctgggcgtgtacagaaacggcggctacatcttcaccctgagcaagagcaagagcgagaccaagaacaagttcatcgacctgagactgaacagctggatcaccagaggcaccagagtgatcttcatcgacttcagcctgtacaacgccaacgtgaacctgttctgcatcatcagactggtggccgagttccccgccaccggcggcatcctgaccagctggcagttctacagcgtgaagctgctgagatacgtgagctactacgactacttcatcgccagctgcgagatcaccttctgcatcttcctgttcgtgttcaccacccaggaggtgaagaagatcaaggagttcaagagcgcctacttcaagagcatctggaactggctggagctgctgctgctgctgctgtgcttcgtggccgtgagcttcaacacctactacaacgtgcagatcttcctgctgctgggccagctgctgaagagcaccgagaagtacagcgacttctacttcctggcctgctggcacatctactacaacaacatcatcgccatcaccatcttcttcgcctggatcaagatcttcaagttcatcagcttcaacaagaccatgagccagctgagcagcaccctgagcagatgcgtgaaggacatcgtgggcttcgccatcatgttcttcatcatcttcttcgcctacgcccagctgggcttcctggtgttcggcagccaggtggacgacttcagcaccttccagaacagcatcttcgcccagttcagaatcgtgctgggcgacttcaacttcgccggcatccagcaggccaaccccatcctgggccccatctacttcatcaccttcatcttcttcgtgttcttcgtgctgctgaacatgttcctggccatcatcaacgacacctacagcgaggtgaaggccgactacagcatcggcagaagactggacttcgagctgggcaagatgatcaagcagagctacaagaacgtgctggagaagttcagactgaagaaggcccagaaggacgaggacaagaagaccaagggcagcggcgacctggccgagcaggccagaagagagggcttcgacgagaacgagatccagaacgccgagcagatgaagaagtggaaggagagactggagaagaagtactacagcatggagatccaggacgactaccagcccgtgacccaggaggagttcagagagctgttcctgtacgccgtggagctggagaaggagctgcactacatcaacctgaagctgaaccaggtggtgagaaaggtgagcgccctgtag

SEQ ID NO: 93811 - DNA, 1809 bp, Artificial Sequence
  Description of Artificial Sequence: Synthetic coding sequence
atggccgaggccagcagatggcacagaggcggcgccagcaagcacaagctgcactacagaaaggaggtggagatcaccaccaccctgcaggagctgctgctgtacttcatcttcctgatcaacctgtgcatcctgaccttcggcatggtgaacccccacatgtactacctgaacaaggtgatgagcagcctgttcctggacaccagcgtgcccggcgaggagagaaccaacttcaagagcatcagaagcatcaccgacttctggaagttcatggagggccccctgctggagggcctgtactgggacagctggtacaacaaccagcagctgtacaacctgaagaacagcagcagaatctactacgagaacatcctgctgggcgtgcccagagtgagacagctgaaggtgagaaacaacacctgcaaggtgtacagcagcttccagagcctgatgagcgagtgctacggcaagtacaccagcgccaacgaggacctgagcaacttcggcctgcagatcaacaccgagtggagatacagcaccagcaacaccaacagcccctggcactggggcttcctgggcgtgtacagaaacggcggctacatcttcaccctgagcaagagcaagagcgagaccaagaacaagttcatcgacctgagactgaacagctggatcaccagaggcaccagagtgatcttcatcgacttcagcctgtacaacgccaacgtgaacctgttctgcatcatcagactggtggccgagttccccgccaccggcggcatcctgaccagctggcagttctacagcgtgaagctgctgagatacgtgagctactacgactacttcatcgccagctgcgagatcaccttctgcatcttcctgttcgtgttcaccacccaggaggtgaagaagatcaaggagttcaagagcgcctacttcaagagcatctggaactggctggagctgctgctgctgctgctgctgaagagcaccgagaagtacagcgacttctacttcctggcctgctggcacatctactacaacaacatcatcgccatcaccatcttcttcgcctggatcaagatcttcaagttcatcagcttcaacaagaccatgagccagctgagcagcaccctgagcagatgcgtgaaggacatcgtgggcttcgccatcatgttcttcatcatcttcttcgcctacgcccagctgggcttcctggtgttcggcagccaggtggacgacttcagcaccttccagaacagcatcttcgcccagttcagaatcgtgctgggcgacttcaacttcgccggcatccagcaggccaaccccatcctgggccccatctacttcatcaccttcatcttcttcgtgttcttcgtgctgctgaacatgttcctggccatcatcaacgacacctacagcgaggtgaaggccgactacagcatcggcagaagactggacttcgagctgggcaagatgatcaagcagagctacaagaacgtgctggagaagttcagactgaagaaggcccagaaggacgaggacaagaagaccaagggcagcggcgacctggccgagcaggccagaagagagggcttcgacgagaacgagatccagaacgccgagcagatgaagaagtggaaggagagactggagaagaagtactacagcatggagatccaggacgactaccagcccgtgacccaggaggagttcagagagctgttcctgtacgccgtggagctggagaaggagctgcactacatcaacctgaagctgaaccaggtggtgagaaaggtgagcgccctgtag

SEQ ID NO: 93812 - DNA, 1572 bp, Artificial Sequence
  Description of Artificial Sequence: Synthetic coding sequence
atggccgaggccagcagatggcacagaggcggcgccagcaagcacaagctgcactacagaaaggaggtggagatcaccaccaccctgcaggagctgctgctgtacttcatcttcctgatcaacctgtgcatcctgaccttcggcatggtgaacccccacatgtactacctgaacaaggtgatgagcagcctgttcctggacaccagcgtgcccggcgaggagagaaccaacttcaagagcatcagaagcatcaccgacttctggaagttcatggagggccccctgctggagggcctgtactgggacagctggtacaacaaccagcagctgtacaacctgaagaacagcagcagaatctactacgagaacatcctgctgggcgtgcccagagtgagacagctgaaggtgagaaacaacacctgcaaggtgtacagcagcttccagagcctgatgagcgagtgctacggcaagtacaccagcgccaacgaggacctgagcaacttcggcctgcagatcaacaccgagtggagatacagcaccagcaacaccaacagcccctggcactggggcttcctgggcgtgtacagaaacggcggctacatcttcaccctgagcaagagcaagagcgagaccaagaacaagttcatcgacctgagactgaacagctggatcaccagaggcaccagagtgatcttcatcgacttcagcctgtacaacgccaacgtgaacctgttctgcatcatcagactggtggccgagttccccgccaccggcggcatcctgaccagctggcagttctacagcgtgaagctgctgagatacgtgagctactacgactacttcatcgccagctgcgagatcaccttctgcatcttcctgttcgtgttcaccacccaggaggtgaagaagatcaaggagttcaagagcgcctacttcaagagcatctggaactggctggagctgctgctgctgctgctgtgcttcgtggccgtgagcttcaacacctactacaacgtgcagatcttcctgctgctgggccagctgctgaagagcaccgagaagtacagcgacttctacttcctggcctgctggcacatctactacaacaacatcatcgccatcaccatcttcttcgcctggatcaagaacatgttcctggccatcatcaacgacacctacagcgaggtgaaggccgactacagcatcggcagaagactggacttcgagctgggcaagatgatcaagcagagctacaagaacgtgctggagaagttcagactgaagaaggcccagaaggacgaggacaagaagaccaagggcagcggcgacctggccgagcaggccagaagagagggcttcgacgagaacgagatccagaacgccgagcagatgaagaagtggaaggagagactggagaagaagtactacagcatggagatccaggacgactaccagcccgtgacccaggaggagttcagagagctgttcctgtacgccgtggagctggagaaggagctgcactacatcaacctgaagctgaaccaggtggtgagaaaggtgagcgccctgtag

SEQ ID NO: 93813 - DNA, 1836 bp, Artificial Sequence
  Description of Artificial Sequence: Synthetic coding sequence
atggaggagctggtggtggaggtgagaggcagcaacggcgccttctacaaggccttcgtgaaggacgtgcacgaggacagcatcaccgtggccttcgagaacaactggcagcccgacagacagatccccttccacgacgtgagattccccccccccgtgggctacaacaaggacatcaacgagagcgacgaggtggaggtgtacagcagagccaacgagaaggagccctgctgctggtggctggccaaggtgagaatgatcaagggcgagttctacgtgatcgagtacgccgcctgcgacgccacctacaacgagatcgtgaccatcgagagactgagaagcgtgaaccccaacaagcccgccaccaaggacaccttccacaagatcaagctggacgtgcccgaggacctgagacagatgtgcgccaaggaggccgcccacaaggacttcaagaaggccgtgggcgccttcagcgtgacctacgaccccgagaactaccagctggtgatcctgagcatcaacgaggtgaccagcaagagagcccacatgctgatcgacatgcacttcagaagcctgagaaccaagctgagcctgatcatgagaaacgaggaggccagcaagcagctggagagcagcagacagctggccagcagattccacgagcagttcatcgtgagagaggacctgatgggcctggccatcggcacccacggcgccaacatccagcaggccagaaaggtgcccggcgtgaccgccatcgacctggacgaggacacctgcaccttccacatctacggcgaggaccaggacgccgtgaagaaggccagaagcttcctggagttcgccgaggacgtgatccaggtgcccagaaacctggtgggcaaggtgatcggcaagaacggcaagctgatccaggagatcgtggacaagagcggcgtggtgagagtgagaatcgaggccgagaacgagaagaacgtgccccaggaggaggagatcatgccccccaacagcctgcccagcaacaacagcagagtgggccccaacgcccccgaggagaagaagcacctggacatcaaggagaacagcacccacttcagccagcccaacagcaccaaggtgcagagaggcatggtgcccttcgtgttcgtgggcaccaaggacagcatcgccaacgccaccgtgctgctggactaccacctgaactacctgaaggaggtggaccagctgagactggagagactgcagatcgacgagcagctgagacagatcggcgccagcagcagacccccccccaacagaaccgacaaggagaagagctacgtgaccgacgacggccagggcatgggcagaggcagcagaccctacagaaacagaggccacggcagaagaggccccggctacaccagcggcaccaacagcgaggccagcaacgccagcgagaccgagagcgaccacagagacgagctgagcgactggagcctggcccccaccgaggaggagagagagagcttcctgagaagaggcgacggcagaagaagaggcggcggcggcagaggccagggcggcagaggcagaggcggcggcttcaagggcaacgacgaccacagcagaaccgacaacagacccagaaaccccagagaggccaagggcagaaccaccgacggcagcctgcagatcagagtggactgcaacaacgagagaagcgtgcacaccaagaccctgcagaacaccagcagcgagggcagcagactgagaaccggcaaggacagaaaccagaagaaggagaagcccgacagcgtggacggccagcagcccctggtgaacggcgtgccctag

SEQ ID NO: 93814 - DNA, 513 bp, Artificial Sequence
  Description of Artificial Sequence: Synthetic coding sequence
atgcccctgcccgtggccctgcagaccagactggccaagagaggcatcctgaagcacctggagcccgagcccgaggaggagatcatcgccgaggactacgacgacgaccccgtggactacgaggccaccagactggagggcctgccccccagctggtacaaggtgttcgaccccagctgcggcctgccctactactggaacgccgacaccgacctggtgagctggctgagcccccacgaccccaacagcgtggtgaccaagagcgccaagaagctgagaagcagcaacgccgccgtgagcagaaaggacgaggagctggaccccatggaccccagcagctacagcgacgcccccagaggcacctggagcaccggcctgcccaagagaaacgaggccaagaccggcgccgacaccaccgccgccggccccctgttccagcagagaccctaccccagccccggcgccgtgctgagagccaacgccgaggccagcagaaccaagcagcaggactag

SEQ ID NO: 93815 - DNA, 204 bp, Artificial Sequence
  Description of Artificial Sequence: Synthetic coding sequence
atgcccctgcccgtggccctgcagaccagactggccaagagaggcatcctgaagcacctggagcccgagcccgaggaggagatcatcgccgaggactacgacgacgaccccgtggactacgaggccaccagactggagggcctgccccccagctggtacaaggtgttcgaccccagctgccccggctggagcgccatggtgtag

SEQ ID NO: 93816 - DNA, 798 bp, Artificial Sequence
  Description of Artificial Sequence: Synthetic coding sequence
atgcccctgcccgtggccctgcagaccagactggccaagagaggcatcctgaagcacctggagcccgagcccgaggaggagatcatcgccgaggactacgacgacgaccccgtggactacgaggccaccagactggagggcctgccccccagctggtacaaggtgttcgaccccagctgcggcctgccctactactggaacgccgacaccgacctggtgagctggctgagcccccacgaccccaacagcgtggtgaccaagagcgccaagaagctgagaagcagcaacgccgacgccgaggagaagctggacagaagccacgacaagagcgacagaggccacgacaagagcgacagaagccacgagaagctggacagaggccacgacaagagcgacagaggccacgacaagagcgacagagacagagagagaggctacgacaaggtggacagagagagagagagagacagagagagagacagagacagaggctacgacaaggccgacagagaggagggcaaggagagaagacaccacagaagagaggagctggccccctaccccaagagcaagaaggccgtgagcagaaaggacgaggagctggaccccatggaccccagcagctacagcgacgcccccagaggcacctggagcaccggcctgcccaagagaaacgaggccaagaccggcgccgacaccaccgccgccggccccctgttccagcagagaccctaccccagccccggcgccgtgctgagagccaacgccgaggccagcagaaccaagcagcaggactag

SEQ ID NO: 93817 - DNA, 513 bp, Artificial Sequence; identical to SEQ ID NO: 93814
  Description of Artificial Sequence: Synthetic coding sequence

SEQ ID NO: 93818 - DNA, 798 bp, Artificial Sequence; identical to SEQ ID NO: 93816
  Description of Artificial Sequence: Synthetic coding sequence

SEQ ID NO: 93819 - DNA, 642 bp, Artificial Sequence
  Description of Artificial Sequence: Synthetic coding sequence
atgcccctgcccgtggccctgcagaccagactggccaagagaggcatcctgaagcacctggagcccgagcccgaggaggagatcatcgccgaggactacgacgacgaccccgtggactacgaggccaccagactggagggcctgccccccagctggtacaaggtgttcgaccccagctgcggcctgccctactactggaacgccgacaccgacctggtgagctggctgagcccccacgaccccaacagcgtggtgaccaagagcgccaagaagctgagaagcagcaacgccgacgccgaggagaagctggacagaagccacgacaagagcgacagaggccacgacaagagcgacagaagccacgagaagctggacagaggccacgacaagagcgacagaggccacgacaagagcgacagagacagagagagaggctacgacaaggtggacagagagagagagagagacagagagagagacagagacagaggctacgacaaggccgacagagaggagggcaaggagagaagacaccacagaagagaggagctggccccctaccccaagagcaagaaggccgtgagcagaaaggacgaggagctggaccccatggaccccagcagctacagcgacgccccctag

SEQ ID NO: 93820 - DNA, 798 bp, Artificial Sequence; identical to SEQ ID NO: 93816
  Description of Artificial Sequence: Synthetic coding sequence

SEQ ID NO: 93821 - DNA, 453 bp, Artificial Sequence
  Description of Artificial Sequence: Synthetic coding sequence
tgaatcgccacctacctgctgcacctgctggtgcagcccgaggaggagatcatcgccgaggactacgacgacgaccccgtggactacgaggccaccagactggagggcctgccccccagctggtacaaggtgttcgaccccagctgcggcctgccctactactggaacgccgacaccgacctggtgagctggctgagcccccacgaccccaacagcgtggtgaccaagagcgccaagaagctgagaagcagcaacgccgccgtgagcagaaaggacgaggagctggaccccatggaccccagcagctacagcgacgcccccagaggcacctggagcaccggcctgcccaagagaaacgaggccaagaccggcgccgacaccaccgccgccggccccctgttccagcagagaccctaccccagccccggcgccgtgctgagagccaacgcctag

SEQ ID NO: 93822 - DNA, 699 bp, Artificial Sequence
  Description of Artificial Sequence: Synthetic coding sequence
atgggcagcgtgctgagcaccgacagcggcaagagcgcccccgccagcgccaccgccagagccctggagagaagaagagaccccgagctgcccgtgaccagcttcgactgcgccgtgtgcctggaggtgctgcaccagcccgtgagaaccagatgcggccacgtgttctgcagaagctgcatcgccaccagcctgaagaacaacaagtggacctgcccctactgcagagcctacctgcccagcgagggcgtgcccgccaccgacgtggccaagagaatgaagagcgagtacaagaactgcgccgagtgcgacaccctggtgtgcctgagcgagatgagagcccacatcagaacctgccagaagtacatcgacaagtacggccccctgcaggagctggaggagaccgccgccagatgcgtgtgccccttctgccagagagagctgtacgaggacagcctgctggaccactgcatcacccaccacagaagcgagagaagacccgtgttctgccccctgtgcagactgatccccgacgagaaccccagcagcttcagcggcagcctgatcagacacctgcaggtgagccacaccctgttctacgacgacttcatcgacttcaacatcatcgaggaggccctgatcagaagagtgctggacagaagcctgctggagtacgtgaaccacagcaacaccacctag

SEQ ID NO: 93823 - DNA, 1986 bp, Artificial Sequence
  Description of Artificial Sequence: Synthetic coding sequence
atggagaagctgggcgtggagcccgaggaggagggcggcggcgacgacgacgaggaggacgccgaggcctgggccatggagctggccgacgtgggcgccgccgccagcagccagggcgtgcacgaccaggtgctgcccacccccaacgccagcagcagagtgatcgtgcacgtggacctggactgcttctacgcccaggtggagatgatcagcaaccccgagctgaaggacaagcccctgggcgtgcagcagaagtacctggtggtgacctgcaactacgaggccagaaagctgggcgtgaagaagctgatgaacgtgagagacgccaaggagaagtgcccccagctggtgctggtgaacggcgaggacctgaccagatacagagagatgagctacaaggtgaccgagctgctggaggagttcagccccgtggtggagagactgggcttcgacgagaacttcgtggacctgaccgagatggtggagaagagactgcagcagctgcagagcgacgagctgagcgccgtgaccgtgagcggccacgtgtacaacaaccagtgcatcggctacaagaccgccaagtgcctggaggccctgggcatcaacagcgtgagagacctgcagaccttcagccccaagatcctggagaaggagctgggcatcagcgtggcccagagaatccagaagctgagcttcggcgaggacaacagccccgtgatcctgagcggccccccccagagcttcagcgaggaggacagcttcaagaagtgcagcagcgaggtggaggccaagaacaagatcgaggagctgctggccagcctgctgaacagagtgtgccaggacggcagaaagccccacaccgtgagactgatcatcagaagatacagcagcgagaagcactacggcagagagagcagacagtgccccatccccagccacgtgatccagaagctgggcaccggcaactacgacgtgatgacccccatggtggacatcctgatgaagctgttcagaaacatggtgaacgtgaagatgcccttccacctgaccctgctgagcgtgtgcttctgcaacctgaaggccctgaacaccgccaagaagggcctgatcgactactacctgatgcccagcctgagcaccaccagcagaagcggcaagcacagcttcaagatgaaggacacccacatggaggacttccccaaggacaaggagaccaacagagacttcctgcccagcggcagaatcgagagcaccagaaccagagagagccccctggacaccaccaacttcagcaaggagaaggacatcaacgagttccccctgtgcagcctgcccgagggcgtggaccaggaggtgttcaagcagctgcccgtggacatccaggaggagatcctgagcggcaagagcagagagaagttccagggcaagggcagcgtgagctgccccctgcacgccagcagaggcgtgctgagcttcttcagcaagaagcagatgcaggacatccccatcaaccccagagaccacctgagcagcagcaagcaggtgagcagcgtgagcccctgcgagcccggcaccagcggcttcaacagcagcagcagcagctacatgagcagccagaaggactacagctactacctggacaacagactgaaggacgagagaatcagccagggccccaaggagccccagggcttccacttcaccaacagcaaccccgccgtgagcgccttccacagcttccccaacctgcagagcgagcagctgttcagcagaaaccacaccaccgacagccacaagcagaccgtggccaccgacagccacgagggcctgaccgagaacagagagcccgacagcgtggacgagaagatcaccttccccagcgacatcgacccccaggtgttctacgagctgcccgaggccgtgcagaaggagctgctggccgagtggaagagagccggcagcgacttccacatcggccacaagtag

SEQ ID NO: 93824 - DNA, 2223 bp, Artificial Sequence; identical to SEQ ID NO: 90398
  Description of Artificial Sequence: Synthetic coding sequence

SEQ ID NO: 93825 - DNA, 2613 bp, Artificial Sequence
  Description of Artificial Sequence: Synthetic coding sequence
atggacagcaccaaggagaagtgcgacagctacaaggacgacctgctgctgagaatgggcctgaacgacaacaaggccggcatggagggcctggacaaggagaagatcaacaagatcatcatggaggccaccaagggcagcagattctacggcaacgagctgaagaaggagaagcaggtgaaccagagaatcgagaacatgatgcagcagaaggcccagatcaccagccagcagctgagaaaggcccagctgcaggtggacagattcgccatggagctggagcagagcagaaacctgagcaacaccatcgtgcacatcgacatggacgccttctacgccgccgtggagatgagagacaaccccgagctgaaggacaagcccatcgccgtgggcagcatgagcatgctgagcaccagcaactaccacgccagaagattcggcgtgagagccgccatgcccggcttcatcgccaagagactgtgcccccagctgatcatcgtgccccccaacttcgacaagtacagagccgtgagcaaggaggtgaaggagatcctggccgactacgaccccaacttcatggccatgagcctggacgaggcctacctgaacatcaccaagcacctggaggagagacagaactggcccgaggacaagagaagatacttcatcaagatgggcagcagcgtggagaacgacaaccccggcaaggaggtgaacaagctgagcgagcacgagagaagcatcagccccctgctgttcgaggagagccccagcgacgtgcagccccccggcgaccccttccaggtgaacttcgaggagcagaacaacccccagatcctgcagaacagcgtggtgttcggcaccagcgcccaggaggtggtgaaggagatcagattcagaatcgagcagaagaccaccctgaccgccagcgccggcatcgcccccaacaccatgctggccaaggtgtgcagcgacaagaacaagcccaacggccagtaccagatcctgcccaacagacaggccgtgatggacttcatcaaggacctgcccatcagaaaggtgagcggcatcggcaaggtgaccgagaagatgctgaaggccctgggcatcatcacctgcaccgagctgtaccagcagagagccctgctgagcctgctgttcagcgagaccagctggcactacttcctgcacatcagcctgggcctgggcagcacccacctgaccagagacggcgagagaaagagcatgagcgtggagagaaccttcagcgagatcaacaaggccgaggagcagtacagcctgtgccaggagctgtgcagcgagctggcccaggacctgcagaaggagagactgaagggcagaaccgtgaccatcaagctgaagaacgtgaacttcgaggtgaagaccagagccagcaccgtgagcagcgtggtgagcaccgccgaggagatcttcgccatcgccaaggagctgctgaagaccgagatcgacgccgacttcccccaccccctgagactgagactgatgggcgtgagaatcagcagcttccccaacgaggaggacagaaagcaccagcagagaagcatcatcggcttcctgcaggccggcaaccaggccctgagcgccaccgagtgcaccctggagaagaccgacaaggacaagttcgtgaagcccctggagatgagccacaagaagagcttcttcgacaagaagagaagcgagagaaagtggagccaccaggacaccttcaagtgcgaggccgtgaacaagcagagcttccagaccagccagcccttccaggtgctgaagaagaagatgaacgagaacctggagatcagcgagaacagcgacgactgccagatcctgacctgccccgtgtgcttcagagcccagggctgcatcagcctggaggccctgaacaagcacgtggacgagtgcctggacggccccagcatcagcgagaacttcaagatgttcagctgcagccacgtgagcgccaccaaggtgaacaagaaggagaacgtgcccgccagcagcctgtgcgagaagcaggactacgaggcccaccccaagatcaaggagatcagcagcgtggactgcatcgccctggtggacaccatcgacaacagcagcaaggccgagagcatcgacgccctgagcaacaagcacagcaaggaggagtgcagcagcctgcccagcaagagcttcaacatcgagcactgccaccagaacagcagcagcaccgtgagcctggagaacgaggacgtgggcagcttcagacaggagtacagacagccctacctgtgcgaggtgaagaccggccaggccctggtgtgccccgtgtgcaacgtggagcagaagaccagcgacctgaccctgttcaacgtgcacgtggacgtgtgcctgaacaagagcttcatccaggagctgagaaaggacaagttcaaccccgtgaaccagcccaaggagagcagcagaagcaccggcagcagcagcggcgtgcagaaggccgtgaccagaaccaagagacccggcctgatgaccaagtacagcaccagcaagaagatcaagcccaacaaccccaagcacaccctggacatcttcttcaagtag

SEQ ID NO: 93826 - DNA, 2019 bp, Artificial Sequence
  Description of Artificial Sequence: Synthetic coding sequence
atggacagcaccaaggagaagtgcgacagctacaaggacgacctgctgctgagaatgggcctgaacgacaacaaggccggcatggagggcctggacaaggagaagatcaacaagatcatcatggaggccaccaagggcagcagattctacggcaacgagctgaagaaggagaagcaggtgaaccagagaatcgagaacatgatgcagcagaaggcccagatcaccagccagcagctgagaaaggcccagctgcaggtggacagattcgccatggagctggagcagagcagaaacctgagcaacaccatcgtgcacatcgacatggacgccttctacgccgccgtggagatgagagacaaccccgagctgaaggacaagcccatcgccgtgggcagcatgagcatgctgagcaccagcaactaccacgccagaagattcggcgtgagagccgccatgcccggcttcatcgccaagagactgtgcccccagctgatcatcgtgccccccaacttcgacaagtacagagccgtgagcaaggaggtgaaggagatcctggccgactacgaccccaacttcatggccatgagcctggacgaggcctacctgaacatcaccaagcacctggaggagagacagaactggcccgaggacaagagaagatacttcatcaagatgggcagcagcgtggagaacgacaaccccggcaaggaggtgaacaagctgagcgagcacgagagaagcatcagccccctgctgttcgaggagagccccagcgacgtgcagccccccggcgaccccttccaggtgaacttcgaggagcagaacaacccccagatcctgcagaacagcgtggtgttcggcaccagcgcccaggaggtggtgaaggagatcagattcagaatcgagcagaagaccaccctgaccgccagcgccggcgtgagaatcagcagcttccccaacgaggaggacagaaagcaccagcagagaagcatcatcggcttcctgcaggccggcaaccaggccctgagcgccaccgagtgcaccctggagaagaccgacaaggacaagttcgtgaagcccctggagatgagccacaagaagagcttcttcgacaagaagagaagcgagagaaagtggagccaccaggacaccttcaagtgcgaggccgtgaacaagcagagcttccagaccagccagcccttccaggtgctgaagaagaagatgaacgagaacctggagatcagcgagaacagcgacgactgccagatcctgacctgccccgtgtgcttcagagcccagggctgcatcagcctggaggccctgaacaagcacgtggacgagtgcctggacggccccagcatcagcgagaacttcaagatgttcagctgcagccacgtgagcgccaccaaggtgaacaagaaggagaacgtgcccgccagcagcctgtgcgagaagcaggactacgaggcccaccccaagatcaaggagatcagcagcgtggactgcatcgccctggtggacaccatcgacaacagcagcaaggccgagagcatcgacgccctgagcaacaagcacagcaaggaggagtgcagcagcctgcccagcaagagcttcaacatcgagcactgccaccagaacagcagcagcaccgtgagcctggagaacgaggacgtgggcagcttcagacaggagtacagacagccctacctgtgcgaggtgaagaccggccaggccctggtgtgccccgtgtgcaacgtggagcagaagaccagcgacctgaccctgttcaacgtgcacgtggacgtgtgcctgaacaagagcttcatccaggagctgagaaaggacaagttcaaccccgtgaaccagcccaaggagagcagcagaagcaccggcagcagcagcggcgtgcagaaggccgtgaccagaaccaagagacccggcctgatgaccaagtacagcaccagcaagaagatcaagcccaacaaccccaagcacaccctggacatcttcttcaagtag

SEQ ID NO: 93827 - DNA, 2343 bp, Artificial Sequence
  Description of Artificial Sequence: Synthetic coding sequence
atggagctggagcagagcagaaacctgagcaacaccatcgtgcacatcgacatggacgccttctacgccgccgtggagatgagagacaaccccgagctgaaggacaagcccatcgccgtgggcagcatgagcatgctgagcaccagcaactaccacgccagaagattcggcgtgagagccgccatgcccggcttcatcgccaagagactgtgcccccagctgatcatcgtgccccccaacttcgacaagtacagagccgtgagcaaggaggtgaaggagatcctggccgactacgaccccaacttcatggccatgagcctggacgaggcctacctgaacatcaccaagcacctggaggagagacagaactggcccgaggacaagagaagatacttcatcaagatgggcagcagcgtggagaacgacaaccccggcaaggaggtgaacaagctgagcgagcacgagagaagcatcagccccctgctgttcgaggagagccccagcgacgtgcagccccccggcgaccccttccaggtgaacttcgaggagcagaacaacccccagatcctgcagaacagcgtggtgttcggcaccagcgcccaggaggtggtgaaggagatcagattcagaatcgagcagaagaccaccctgaccgccagcgccggcatcgcccccaacaccatgctggccaaggtgtgcagcgacaagaacaagcccaacggccagtaccagatcctgcccaacagacaggccgtgatggacttcatcaaggacctgcccatcagaaaggtgagcggcatcggcaaggtgaccgagaagatgctgaaggccctgggcatcatcacctgcaccgagctgtaccagcagagagccctgctgagcctgctgttcagcgagaccagctggcactacttcctgcacatcagcctgggcctgggcagcacccacctgaccagagacggcgagagaaagagcatgagcgtggagagaaccttcagcgagatcaacaaggccgaggagcagtacagcctgtgccaggagctgtgcagcgagctggcccaggacctgcagaaggagagactgaagggcagaaccgtgaccatcaagctgaagaacgtgaacttcgaggtgaagaccagagccagcaccgtgagcagcgtggtgagcaccgccgaggagatcttcgccatcgccaaggagctgctgaagaccgagatcgacgccgacttcccccaccccctgagactgagactgatgggcgtgagaatcagcagcttccccaacgaggaggacagaaagcaccagcagagaagcatcatcggcttcctgcaggccggcaaccaggccctgagcgccaccgagtgcaccctggagaagaccgacaaggacaagttcgtgaagcccctggagatgagccacaagaagagcttcttcgacaagaagagaagcgagagaaagtggagccaccaggacaccttcaagtgcgaggccgtgaacaagcagagcttccagaccagccagcccttccaggtgctgaagaagaagatgaacgagaacctggagatcagcgagaacagcgacgactgccagatcctgacctgccccgtgtgcttcagagcccagggctgcatcagcctggaggccctgaacaagcacgtggacgagtgcctggacggccccagcatcagcgagaacttcaagatgttcagctgcagccacgtgagcgccaccaaggtgaacaagaaggagaacgtgcccgccagcagcctgtgcgagaagcaggactacgaggcccaccccaagatcaaggagatcagcagcgtggactgcatcgccctggtggacaccatcgacaacagcagcaaggccgagagcatcgacgccctgagcaacaagcacagcaaggaggagtgcagcagcctgcccagcaagagcttcaacatcgagcactgccaccagaacagcagcagcaccgtgagcctggagaacgaggacgtgggcagcttcagacaggagtacagacagccctacctgtgcgaggtgaagaccggccaggccctggtgtgccccgtgtgcaacgtggagcagaagaccagcgacctgaccctgttcaacgtgcacgtggacgtgtgcctgaacaagagcttcatccaggagctgagaaaggacaagttcaaccccgtgaaccagcccaaggagagcagcagaagcaccggcagcagcagcggcgtgcagaaggccgtgaccagaaccaagagacccggcctgatgaccaagtacagcaccagcaagaagatcaagcccaacaaccccaagcacaccctggacatcttcttcaagtag

SEQ ID NO: 93828 - DNA, 1386 bp, Artificial Sequence
  Description of Artificial Sequence: Synthetic coding sequence
atggacagcaccaaggagaagtgcgacagctacaaggacgacctgctgctgagaatgggcctgaacgacaacaaggccggcatggagggcctggacaaggagaagatcaacaagatcatcatggaggccaccaagggcagcagattctacggcaacgagctgaagaaggagaagcaggtgaaccagagaatcgagaacatgatgcagcagaaggcccagatcaccagccagcagctgagaaaggcccagctgcaggtggacagattcgccatggagctggagcagagcagaaacctgagcaacaccatcgtgcacatcgacatggacgccttctacgccgccgtggagatgagagacaaccccgagctgaaggacaagcccatcgccgtgggcagcatgagcatgctgagcaccagcaactaccacgccagaagattcggcgtgagagccgccatgcccggcttcatcgccaagagactgtgcccccagctgatcatcgtgccccccaacttcgacaagtacagagccgtgagcaaggaggtgaaggagatcctggccgactacgaccccaacttcatggccatgagcctggacgaggcctacctgaacatcaccaagcacctggaggagagacagaactggcccgaggacaagagaagatacttcatcaagatgggcagcagcgtggagaacgacaaccccggcaaggaggtgaacaagctgagcgagcacgagagaagcatcagccccctgctgttcgaggagagccccagcgacgtgcagccccccggcgaccccttccaggtgaacttcgaggagcagaacaacccccagatcctgcagaacagcgtggtgttcggcaccagcgcccaggaggtggtgaaggagatcagattcagaatcgagcagaagaccaccctgaccgccagcgccggcatcgcccccaacaccatgctggccaaggtgtgcagcgacaagaacaagcccaacggccagtaccagatcctgcccaacagacaggccgtgatggacttcatcaaggacctgcccatcagaaaggtgagcggcatcggcaaggtgaccgagaagatgctgaaggccctgggcatcatcacctgcaccgagctgtaccagcagagagccctgctgagcctgctgttcagcgagaccagctggcactacttcctgcacatcagcctgggcctgggcagcacccacctgaccagagacggcgagagaaagagcatgagcgtggagagaaccttcagcgagatcaacaaggccgaggagcagtacagcctgtgccaggagctgtgcagcgagctggcccaggacctgcagaaggagagactgaaggtggcccaggtggagtacagaagactgtag

SEQ ID NO: 93829 - DNA, 2019 bp, Artificial Sequence; identical to SEQ ID NO: 93826
  Description of Artificial Sequence: Synthetic coding sequence

SEQ ID NO: 93830 - DNA, 1470 bp, Artificial Sequence
  Description of Artificial Sequence: Synthetic coding sequence
atggacagcaccaaggagaagtgcgacagctacaaggacgacctgctgctgagaatgggcctgaacgacaacaaggccggcatggagggcctggacaaggagaagatcaacaagatcatcatggaggccaccaagggcagcagattctacggcaacgagctgaagaaggagaagcaggtgaaccagagaatcgagaacatgatgcagcagaaggcccagatcaccagccagcagctgagaaaggcccagctgcaggtggacagattcgccatggagctggagcagagcagaaacctgagcaacaccatcgtgcacatcgacatggacgccttctacgccgccgtggagatgagagacaaccccgagctgaaggacaagcccatcgccgtgggcagcatgagcatgctgagcaccagcaactaccacgccagaagattcggcgtgagagccgccatgcccggcttcatcgccaagagactgtgcccccagctgatcatcgtgccccccaacttcgacaagtacagagccgtgagcaaggaggtgaaggagatcctggccgactacgaccccaacttcatggccatgagcctggacgaggcctacctgaacatcaccaagcacctggaggagagacagaactggcccgaggacaagagaagatacttcatcaagatgggcagcagcgtggagaacgacaaccccggcaaggaggtgaacaagctgagcgagcacgagagaagcatcagccccctgctgttcgaggagagccccagcgacgtgcagccccccggcgaccccttccaggtgaacttcgaggagcagaacaacccccagatcctgcagaacagcgtggtgttcggcaccagcgcccaggaggtggtgaaggagatcagattcagaatcgagcagaagaccaccctgaccgccagcgccggcatcgcccccaacaccatgctggccaaggtgtgcagcgacaagaacaagcccaacggccagtaccagatcctgcccaacagacaggccgtgatggacttcatcaaggacctgcccatcagaaaggtgagcggcatcggcaaggtgaccgagaagatgctgaaggccctgggcatcatcacctgcaccgagctgtaccagcagagagccctgctgagcctgctgttcagcgagaccagctggcactacttcctgcacatcagcctgggcctgggcagcacccacctgaccagagacggcgagagaaagagcatgagcgtggagagaaccttcagcgagatcaacaaggccgaggagcagtacagcctgtgccaggagctgtgcagcgagctggcccaggacctgcagaaggagagactgaaggtgttcggctacctggtgttccccatgaagagaaccggcaacaccaacaagggcgccctgctggccttctacagactggagaccaagccctgccagcccctgagcgtgcactag

SEQ ID NO: 93831 - DNA, 426 bp, Artificial Sequence
  Description of Artificial Sequence: Synthetic coding sequence
atggacagcaccaaggagaagtgcgacagctacaaggacgacctgctgctgagaatgggcctgaacgacaacaaggccggcatggagggcctggacaaggagaagatcaacaagatcatcatggaggccaccaagggcagcagattctacggcaacgagctgaagaaggagaagcaggtgaaccagagaatcgagaacatgatgcagcagaaggcccagatcaccagccagcagctgagaaaggcccagctgcaggtggacagattcgccatggagctggagcagagcagaaacctgagcaacaccatcgtgcacatcgacatggacgccttctacgccgccgtggagatgagagacaaccccgagctgaaggacaagcccatcgccgtgggcagcatgagcatgctgagcaccagcaactactag

SEQ ID NO: 93832 - DNA, 1419 bp, Artificial Sequence
  Description of Artificial Sequence: Synthetic coding sequence
atggacagcaccaaggagaagtgcgacagctacaaggacgacctgctgctgagaatgggcctgaacgacaacaaggccggcatggagggcctggacaaggagaagatcaacaagatcatcatggaggccaccaagggcagcagattctacggcaacgagctgaagaaggagaagcaggtgaaccagagaatcgagaacatgatgcagcagaaggcccagatcaccagccagcagctgagaaaggcccagctgcaggtggacagattcgccatggagctggagcagagcagaaacctgagcaacaccatcgtgcacatcgacatggacgccttctacgccgccgtggagatgagagacaaccccgagctgaaggacaagcccatcgccgtgggcagcatgagcatgctgagcaccagcaactaccacgccagaagattcggcgtgagagccgccatgcccggcttcatcgccaagagactgtgcccccagctgatcatcgtgccccccaacttcgacaagtacagagccgtgagcaaggaggtgaaggagatcctggccgactacgaccccaacttcatggccatgagcctggacgaggcctacctgaacatcaccaagcacctggaggagagacagaactggcccgaggacaagagaagatacttcatcaagatgggcagcagcgtggagaacgacaaccccggcaaggaggtgaacaagctgagcgagcacgagagaagcatcagccccctgctgttcgaggagagccccagcgacgtgcagccccccggcgaccccttccaggtgaacttcgaggagcagaacaacccccagatcctgcagaacagcgtggtgttcggcaccagcgcccaggaggtggtgaaggagatcagattcagaatcgagcagaagaccaccctgaccgccagcgccggcatcgcccccaacaccatgctggccaaggtgtgcagcgacaagaacaagcccaacggccagtaccagatcctgcccaacagacaggccgtgatggacttcatcaaggacctgcccatcagaaaggtgagcggcatcggcaaggtgaccgagaagatgctgaaggccctgggcatcatcacctgcaccgagctgtaccagcagagagccctgctgagcctgctgttcagcgagaccagctggcactacttcctgcacatcagcctgggcctgggcagcacccacctgaccagagacggcgagagaaagagcatgagcgtggagagaaccttcagcgagatcaacaaggccgaggagcagtacagcctgtgccaggagctgtgcagcgagctggcccaggacctgcagaaggagagactgaaggtgctgtacttcgacatggtgagcctggtgttcaagttcttcaacagcaagatgctgccctag

SEQ ID NO: 93833 - DNA, 1911 bp, Artificial Sequence
  Description of Artificial Sequence: Synthetic coding sequence
atgaagtgcaagtgccccgtgatctgcttcaacgccaaggacttcgtgagaatcgtgctgcagttcttcggcaacgacggcagctggaagcacgtggccgacttcatcggcctggaccccagaatcgccgcctggctgatcgaccccagcgacgccacccccagcttcgaggacctggtggagaagtactgcgagaagagcatcaccgtgaaggtgaacagcacctacggcaacagcagcagaaacatcgtgaaccagaacgtgagagagaacctgaagaccctgtacagactgaccatggacctgtgcagcaagctgaaggactacggcctgtggcagctgttcagaaccctggagctgcccctgatccccatcctggccgtgatggagagccacgccatccaggtgaacaaggaggagatggagaagaccagcgccctgctgggcgccagactgaaggagctggagcaggaggcccacttcgtggccggcgagagattcctgatcaccagcaacaaccagctgagagagatcctgttcggcaagctgaagctgcacctgctgagccagagaaacagcctgcccagaaccggcctgcagaagtaccccagcaccagcgaggccgtgctgaacgccctgagagacctgcaccccctgcccaagatcatcctggagtacagacaggtgcacaagatcaagagcaccttcgtggacggcctgctggcctgcatgaagaagggcagcatcagcagcacctggaaccagaccggcaccgtgaccggcagactgagcgccaagcaccccaacatccagggcatcagcaagcaccccatccagatcaccacccccaagaacttcaagggcaaggaggacaagatcctgaccatcagccccagagccatgttcgtgagcagcaagggccacaccttcctggccgccgacttcagccagatcgagctgagaatcctgacccacctgagcggcgaccccgagctgctgaagctgttccaggagagcgagagagacgacgtgttcagcaccctgaccagccagtggaaggacgtgcccgtggagcaggtgacccacgccgacagagagcagaccaagaaggtggtgtacgccgtggtgtacggcgccggcaaggagagactggccgcctgcctgggcgtgcccatccaggaggccgcccagttcctggagagcttcctgcagaagtacaagaagatcaaggacttcgccagagccgccatcgcccagtgccaccagaccggctgcgtggtgagcatcatgggcagaagaagacccctgcccagaatccacgcccacgaccagcagctgagagcccaggccgagagacaggccgtgaacttcgtggtgcagggcagcgccgccgacctgtgcaagctggccatgatccacgtgttcaccgccgtggccgccagccacaccctgaccgccagactggtggcccagatccacgacgagctgctgttcgaggtggaggacccccagatccccgagtgcgccgccctggtgagaagaaccatggagagcctggagcaggtgcccctgaaggtgagcctgagcgccggcagaagctggggccacctggtgcccctgcaggaggcctggctgagacaggcccacgtggccctgagcctgcccgccaccgcctggctgcccctgggccccctgcccgcccccagcccccacccctgcatcttcagactgcacttcgtgtgcagccccagacagcagtgggaggagagaaccggcttccagcagagcatcgtgtggcccagccccagaagccccgccctgtacgcccccggcagaatcaaccccctgggcctgggctggcccgccatcccctggagcaagtgcctgtgcaaggccctgctgatcctgtag

SEQ ID NO: 93834 - DNA, 936 bp, Artificial Sequence
  Description of Artificial Sequence: Synthetic coding sequence
atggccgtgggcagccaggactacggcctgtggcagctgttcagaaccctggagctgcccctgatccccatcctggccgtgatggagagccacgccatccaggtgaacaaggaggagatggagaagaccagcgccctgctgggcgccagactgaaggagctggagcaggaggcccacttcgtggccggcgagagattcctgatcaccagcaacaaccagctgagagagatcctgttcggcaagctgaagctgcacctgctgagccagagaaacagcctgcccagaaccggcctgcagaagtaccccagcaccagcgaggccgtgaacatccagggcatcagcaagcaccccatccagatcaccacccccaagaacttcaagggcaaggaggacaagatcctgaccatcagccccagagccatgttcgtgagcagcaagggccacaccttcctggccgccgacttcagccagatcgagctgagaatcctgacccacctgagcggcgaccccgagctgctgaagctgttccaggagagcgagagagacgacgtgttcagcaccctgaccagccagtggaaggacgtgcccgtggagcaggtgacccacgccgacagagagcagaccaagaaggtggtgtacgccgtggtgtacggcgccggcaaggagagactggccgcctgcctgggcgtgcccatccaggaggccgcccagttcctggagagcttcctgcagaagtacaagaagatcaaggacttcgccagagccgccatcgcccagtgccaccagaccggctgcgtggtgagcatcatgggcagaagaagacccctgcccagaatccacgcccacgaccagcagctgagagcccaggccgagagacaggccgtgaacttcgtggtgcaggcccagagccagcacctgtgcgtggaggtgccctag

SEQ ID NO: 93835 - DNA, 2703 bp, Artificial Sequence
  Description of Artificial Sequence: Synthetic coding sequence
atggagaactacgaggccctggtgggcttcgacctgtgcaacacccccctgagcagcgtggcccagaagatcatgagcgccatgcacagcggcgacctggtggacagcaagacctggggcaagagcaccgagaccatggaggtgatcaacaagagcagcgtgaagtacagcgtgcagctggaggacagaaagacccagagccccgagaagaaggacctgaagagcctgagaagccagaccagcagaggcagcgccaagctgagcccccagagcttcagcgtgagactgaccgaccagctgagcgccgaccagaagcagaagagcatcagcagcctgaccctgagcagctgcctgatcccccagtacaaccaggaggccagcgtgctgcagaagaagggccacaagagaaagcacttcctgatggagaacatcaacaacgagaacaagggcagcatcaacctgaagagaaagcacatcacctacaacaacctgagcgagaagaccagcaagcagatggccctggaggaggacaccgacgacgccgagggctacctgaacagcggcaacagcggcgccctgaagaagcacttctgcgacatcagacacctggacgactgggccaagagccagctgatcgagatgctgaagcaggccgccgccctggtgatcaccgtgatgtacaccgacggcagcacccagctgggcgccgaccagacccccgtgagcagcgtgagaggcatcgtggtgctggtgaagagacaggccgagggcggccacggctgccccgacgcccccgcctgcggccccgtgctggagggcttcgtgagcgacgacccctgcatctacatccagatcgagcacagcgccatctgggaccaggagcaggaggcccaccagcagttcgccagaaacgtgctgttccagaccatgaagtgcaagtgccccgtgatctgcttcaacgccaaggacttcgtgagaatcgtgctgcagttcttcggcaacgacggcagctggaagcacgtggccgacttcatcggcctggaccccagaatcgccgcctggctgatcgaccccagcgacgccacccccagcttcgaggacctggtggagaagtactgcgagaagagcatcaccgtgaaggtgaacagcacctacggcaacagcagcagaaacatcgtgaaccagaacgtgagagagaacctgaagaccctgtacagactgaccatggacctgtgcagcaagctgaaggactacggcctgtggcagctgttcagaaccctggagctgcccctgatccccatcctggccgtgatggagagccacgccatccaggtgaacaaggaggagatggagaagaccagcgccctgctgggcgccagactgaaggagctggagcaggaggcccacttcgtggccggcgagagattcctgatcaccagcaacaaccagctgagagagatcctgttcggcaagctgaagctgcacctgctgagccagagaaacagcctgcccagaaccggcctgcagaagtaccccagcaccagcgaggccgtgctgaacgccctgagagacctgcaccccctgcccaagatcatcctggagtacagacaggtgcacaagatcaagagcaccttcgtggacggcctgctggcctgcatgaagaagggcagcatcagcagcacctggaaccagaccggcaccgtgaccggcagactgagcgccaagcaccccaacatccagggcatcagcaagcaccccatccagatcaccacccccaagaacttcaagggcaaggaggacaagatcctgaccatcagccccagagccatgttcgtgagcagcaagggccacaccttcctggccgccgacttcagccagatcgagctgagaatcctgacccacctgagcggcgaccccgagctgctgaagctgttccaggagagcgagagagacgacgtgttcagcaccctgaccagccagtggaaggacgtgcccgtggagcaggtgacccacgccgacagagagcagaccaagaaggtggtgtacgccgtggtgtacggcgccggcaaggagagactggccgcctgcctgggcgtgcccatccaggaggccgcccagttcctggagagcttcctgcagaagtacaagaagatcaaggacttcgccagagccgccatcgcccagtgccaccagaccggctgcgtggtgagcatcatgggcagaagaagacccctgcccagaatccacgcccacgaccagcagctgagagcccaggccgagagacaggccgtgaacttcgtggtgcagggcagcgccgccgacctgtgcaagctggccatgatccacgtgttcaccgccgtggccgccagccacaccctgaccgccagactggtggcccagatccacgacgagctgctgttcgaggtggaggacccccagatccccgagtgcgccgccctggtgagaagaaccatggagagcctggagcaggtgcaggccctggagctgcagctgcaggtgcccctgaaggtgagcctgagcgccggcagaagctggggccacctggtgcccctgcaggaggcctggggccccccccccggcccctgcagaaccgagagccccagcaacagcctggccgcccccggcagccccgccagcacccagcccccccccctgcacttcagccccagcttctgcctgtag

SEQ ID NO: 93836 - DNA, 2703 bp, Artificial Sequence; identical to SEQ ID NO: 93835
  Description of Artificial Sequence: Synthetic coding sequence

SEQ ID NO: 93837 - DNA, 3033 bp, Artificial Sequence
  Description of Artificial Sequence: Synthetic coding sequence
agaatggacggcaagagaagacccggccccggccccggcgtgccccccaagagagccagaggcggcctgtgggacgacgacgacgcccccagacccagccagttcgaggaggacctggccctgatggaggagatggaggccgagcacagactgcaggagcaggaggaggaggagctgcagagcgtgctggagggcgtggccgacggccaggtgccccccagcgccatcgaccccagatggctgagacccaccccccccgccctggacccccagaccgagcccctgatcttccagcagctggagatcgaccactacgtgggccccgcccagcccgtgcccggcggccccccccccagcagaggcagcgtgcccgtgctgagagccttcggcgtgaccgacgagggcttcagcgtgtgctgccacatccacggcttcgccccctacttctacacccccgccccccccggcttcggccccgagcacatgggcgacctgcagagagagctgaacctggccatcagcagagacagcagaggcggcagagagctgaccggccccgccgtgctggccgtggagctgtgcagcagagagagcatgttcggctaccacggccacggccccagccccttcctgagaatcaccgtggccctgcccagactggtggcccccgccagaagactgctggagcagggcatcagagtggccggcctgggcacccccagcttcgccccctacgaggccaacgtggacttcgagatcagattcatggtggacaccgacatcgtgggctgcaactggctggagctgcccgccggcaagtacgccctgagactgaaggagaaggccacccagtgccagctggaggccgacgtgctgtggagcgacgtggtgagccacccccccgagggcccctggcagagaatcgcccccctgagagtgctgagcttcgacatcgagtgcgccggcagaaagggcatcttccccgagcccgagagagaccccgtgatccagatctgcagcctgggcctgagatggggcgagcccgagcccttcctgagactggccctgaccctgagaccctgcgcccccatcctgggcgccaaggtgcagagctacgagaaggaggaggacctgctgcaggcctggagcaccttcatcagaatcatggaccccgacgtgatcaccggctacaacatccagaacttcgacctgccctacctgatcagcagagcccagaccctgaaggtgcagaccttccccttcctgggcagagtggccggcctgtgcagcaacatcagagacagcagcttccagagcaagcagaccggcagaagagacaccaaggtggtgagcatggtgggcagagtgcagatggacatgctgcaggtgctgctgagagagtacaagctgagaagctacaccctgaacgccgtgagcttccacttcctgggcgagcagaaggaggacgtgcagcacagcatcatcaccgacctgcagaacggcaacgaccagaccagaagaagactggccgtgtactgcctgaaggacgcctacctgcccctgagactgctggagagactgatggtgctggtgaacgccgtggagatggccagagtgaccggcgtgcccctgagctacctgctgagcagaggccagcaggtgaaggtggtgagccagctgctgagacaggccatgcacgagggcctgctgatgcccgtggtgaagagcgagggcggcgaggactacaccggcgccaccgtgatcgagcccctgaagggctactacgacgtgcccatcgccaccctggacttcagcagcctgtaccccagcatcatgatggcccacaacctgtgctacaccaccctgctgagacccggcaccgcccagaagctgggcctgaccgaggaccagttcatcagaacccccaccggcgacgagttcgtgaagaccagcgtgagaaagggcctgctgccccagatcctggagaacctgctgagcgccagaaagagagccaaggccgagctggccaaggagaccgaccccctgagaagacaggtgctggacggcagacagctggccctgaaggtgagcgccaacagcgtgtacggcttcaccggcgcccaggtgggcaagctgccctgcctggagatcagccagagcgtgaccggcttcggcagacagatgatcgagaagaccaagcagctggtggagagcaagtacaccgtggagaacggctacagcaccagcgccaaggtggtgtacggcgacaccgacagcgtgatgtgcagattcggcgtgagcagcgtggccgaggccatggccctgggcagagaggccgccgactgggtgagcggccacttccccagccccatcagactggagttcgagaaggtgtacttcccctacctgctgatcagcaagaagagatacgccggcctgctgttcagcagcagacccgacgcccacgacagaatggactgcaagggcctggaggccgtgagaagagacaactgccccctggtggccaacctggtgaccgccagcctgagaagactgctgatcgacagagaccccgagggcgccgtggcccacgcccaggacgtgatcagcgacctgctgtgcaacagaatcgacatcagccagctggtgatcaccaaggagctgaccagagccgccagcgactacgccggcaagcaggcccacgtggagctggccgagagaaccagatgcagctgctggagcaccgcctgccccctgaccagaagcaccacctggagcagcagctggcccagccccagctgcgccagcagcagccccagctgggccagagccgtgcccagactgtgctactgcggcggcaccaccagagccgccagaagatgcagcagagccagatgggccgccagctggcccagccccaacgccgccaccgccgccctggccgccgcccagtgcagcgccaccagagagccctgcgtgagcagcgccagccccggcagcctgagctgcatcagaagaagataccccatctag

SEQ ID NO: 93838 - DNA, 3324 bp, Artificial Sequence
  Description of Artificial Sequence: Synthetic coding sequence
atggacggcaagagaagacccggccccggccccggcgtgccccccaagagagccagaggcggcctgtgggacgacgacgacgcccccagacccagccagttcgaggaggacctggccctgatggaggagatggaggccgagcacagactgcaggagcaggaggaggaggagctgcagagcgtgctggagggcgtggccgacggccaggtgccccccagcgccatcgaccccagatggctgagacccaccccccccgccctggacccccagaccgagcccctgatcttccagcagctggagatcgaccactacgtgggccccgcccagcccgtgcccggcggccccccccccagcagaggcagcgtgcccgtgctgagagccttcggcgtgaccgacgagggcttcagcgtgtgctgccacatccacggcttcgccccctacttctacacccccgccccccccggcttcggccccgagcacatgggcgacctgcagagagagctgaacctggccatcagcagagacagcagaggcggcagagagctgaccggccccgccgtgctggccgtggagctgtgcagcagagagagcatgttcggctaccacggccacggccccagccccttcctgagaatcaccgtggccctgcccagactggtggcccccgccagaagactgctggagcagggcatcagagtggccggcctgggcacccccagcttcgccccctacgaggccaacgtggacttcgagatcagattcatggtggacaccgacatcgtgggctgcaactggctggagctgcccgccggcaagtacgccctgagactgaaggagaaggccacccagtgccagctggaggccgacgtgctgtggagcgacgtggtgagccacccccccgagggcccctggcagagaatcgcccccctgagagtgctgagcttcgacatcgagtgcgccggcagaaagggcatcttccccgagcccgagagagaccccgtgatccagatctgcagcctgggcctgagatggggcgagcccgagcccttcctgagactggccctgaccctgagaccctgcgcccccatcctgggcgccaaggtgcagagctacgagaaggaggaggacctgctgcaggcctggagcaccttcatcagaatcatggaccccgacgtgatcaccggctacaacatccagaacttcgacctgccctacctgatcagcagagcccagaccctgaaggtgcagaccttccccttcctgggcagagtggccggcctgtgcagcaacatcagagacagcagcttccagagcaagcagaccggcagaagagacaccaaggtggtgagcatggtgggcagagtgcagatggacatgctgcaggtgctgctgagagagtacaagctgagaagctacaccctgaacgccgtgagcttccacttcctgggcgagcagaaggaggacgtgcagcacagcatcatcaccgacctgcagaacggcaacgaccagaccagaagaagactggccgtgtactgcctgaaggacgcctacctgcccctgagactgctggagagactgatggtgctggtgaacgccgtggagatggccagagtgaccggcgtgcccctgagctacctgctgagcagaggccagcaggtgaaggtggtgagccagctgctgagacaggccatgcacgagggcctgctgatgcccgtggtgaagagcgagggcggcgaggactacaccggcgccaccgtgatcgagcccctgaagggctactacgacgtgcccatcgccaccctggacttcagcagcctgtaccccagcatcatgatggcccacaacctgtgctacaccaccctgctgagacccggcaccgcccagaagctgggcctgaccgaggaccagttcatcagaacccccaccggcgacgagttcgtgaagaccagcgtgagaaagggcctgctgccccagatcctggagaacctgctgagcgccagaaagagagccaaggccgagctggccaaggagaccgaccccctgagaagacaggtgctggacggcagacagctggccctgaaggtgagcgccaacagcgtgtacggcttcaccggcgcccaggtgggcaagctgccctgcctggagatcagccagagcgtgaccggcttcggcagacagatgatcgagaagaccaagcagctggtggagagcaagtacaccgtggagaacggctacagcaccagcgccaaggtggtgtacggcgacaccgacagcgtgatgtgcagattcggcgtgagcagcgtggccgaggccatggccctgggcagagaggccgccgactgggtgagcggccacttccccagccccatcagactggagttcgagaaggtgtacttcccctacctgctgatcagcaagaagagatacgccggcctgctgttcagcagcagacccgacgcccacgacagaatggactgcaagggcctggaggccgtgagaagagacaactgccccctggtggccaacctggtgaccgccagcctgagaagactgctgatcgacagagaccccgagggcgccgtggcccacgcccaggacgtgatcagcgacctgctgtgcaacagaatcgacatcagccagctggtgatcaccaaggagctgaccagagccgccagcgactacgccggcaagcaggcccacgtggagctggccgagagaatgagaaagagagaccccggcagcgcccccagcctgggcgacagagtgccctacgtgatcatcagcgccgccaagggcgtggccgcctacatgaagagcgaggaccccctgttcgtgctggagcacagcctgcccatcgacacccagtactacctggagcagcagctggccaagcccctgctgagaatcttcgagcccatcctgggcgagggcagagccgaggccgtgctgctgagaggcgaccacaccagatgcaagaccgtgctgaccggcaaggtgggcggcctgctggccttcgccaagagaagaaactgctgcatcggctgcagaaccgtgctgagccaccagggcgccgtgtgcgagttctgccagcccagagagagcgagctgtaccagaaggaggtgagccacctgaacgccctggaggagagattcagcagactgtggacccagtgccagagatgccagggcagcctgcacgaggacgtgatctgcaccagcagagactgccccatcttctacatgagaaagaaggtgagaaaggacctggaggaccaggagcagctgctgagaagattcggcccccccggccccgaggcctggtag

SEQ ID NO: 93839 - DNA, 1410 bp, Artificial Sequence
  Description of Artificial Sequence: Synthetic coding sequence
atgttcagcgagcaggccgcccagagagcccacaccctgctgagcccccccagcgccaacaacgccaccttcgccagagtgcccgtggccacctacaccaacagcagccagcccttcagactgggcgagagaagcttcagcagacagtacgcccacatctacgccaccagactgatccagatgagacccttcctggagaacagagcccagcagcactggggcagcggcgtgggcgtgaagaagctgtgcgagctgcagcccgaggagaagtgctgcgtggtgggcaccctgttcaaggccatgcccctgcagcccagcatcctgagagaggtgagcgaggagcacaacctgctgccccagccccccagaagcaagtacatccaccccgacgacgagctggtgctggaggacgagctgcagagaatcaagctgaagggcaccatcgacgtgagcaagctggtgaccggcaccgtgctggccgtgttcggcagcgtgagagacgacggcaagttcctggtggaggactactgcttcgccgacctggccccccagaagcccgccccccccctggacaccgacagattcgtgctgctggtgagcggcctgggcctgggcggcggcggcggcgagagcctgctgggcacccagctgctggtggacgtggtgaccggccagctgggcgacgagggcgagcagtgcagcgccgcccacgtgagcagagtgatcctggccggcaacctgctgagccacagcacccagagcagagacagcatcaacaaggccaagtacctgaccaagaagacccaggccgccagcgtggaggccgtgaagatgctggacgagatcctgctgcagctgagcgccagcgtgcccgtggacgtgatgcccggcgagttcgaccccaccaactacaccctgccccagcagcccctgcacccctgcatgttccccctggccaccgcctacagcaccctgcagctggtgaccaacccctaccaggccaccatcgacggcgtgagattcctgggcaccagcggccagaacgtgagcgacatcttcagatacagcagcatggaggaccacctggagatcctggagtggaccctgagagtgagacacatcagccccaccgcccccgacaccctgggctgctaccccttctacaagaccgaccccttcatcttccccgagtgcccccacgtgtacttctgcggcaacacccccagcttcggcagcaagatcatcagaggccccgaggaccagaccgtgctgctggtgaccgtgcccgacttcagcgccacccagaccgcctgcctggtgaacctgagaagcctggcctgccagcccatcagcttcagcggcttcggcgccgaggacgacgacctgggcggcctgggcctgggcccctag

SEQ ID NO: 93840 - DNA, 447 bp, Artificial Sequence
  Description of Artificial Sequence: Synthetic coding sequence
atgttcagcgagcaggccgcccagagagcccacaccctgctgagcccccccagcgccaacaacgccaccttcgccagagtgcccgtggccacctacaccaacagcagccagcccttcagactgggcgagagaagcttcagcagacagtacgcccacatctacgccaccagactgatccagatgagacccttcctggagaacagagcccagcagcactggggcagcggcgtgggcgtgaagaagctgtgcgagctgcagcccgaggagaagtgctgcgtggtgggcaccctgttcaaggccatgcccctgcagcccagcatcctgagagaggtgagcgaggagcacaacctgctgccccagccccccagaagcaagtacatccaccccgacgacgagctggtgctggaggacgagctgcagagaatcaagctgaagggcaccatctag

SEQ ID NO: 93841 - DNA, 663 bp, Artificial Sequence
  Description of Artificial Sequence: Synthetic coding sequence
atgttcagcgagcaggccgcccagagagcccacaccctgctgagcccccccagcgccaacaacgccaccttcgccagagtgcccgtggccacctacaccaacagcagccagcccttcagactgggcgagagaagcttcagcagacagtacgcccacatctacgccaccagactgatccagatgagacccttcctggagaacagagcccagcagcactggggcagcggcgtgggcgtgaagaagctgtgcgagctgcagcccgaggagaagtgctgcgtggtgggcaccctgttcaaggccatgcccctgcagcccagcatcctgagagaggtgagcgaggagcacaacctgctgccccagccccccagaagcaagtacatccaccccgacgacgagctggtgctggaggacgagctgcagagaatcaagctgaagggcaccatcgacgtgagcaagctggtgaccggcaccgtgctggccgtgttcggcagcgtgagagacgacggcaagttcctggtggaggactactgcttcgccgacctggccccccagaagcccgccccccccctggacaccgacagattcgtgctgctggtgagcggcctgggcctgggcggcggcggcggcgagagcctgctgggcacccagctgctggtggactag

SEQ ID NO: 93842 - DNA, 1410 bp, Artificial Sequence; identical to SEQ ID NO: 93839
  Description of Artificial Sequence: Synthetic coding sequence

SEQ ID NO: 93843 - DNA, 468 bp, Artificial Sequence
  Description of Artificial Sequence: Synthetic coding sequence
atgttcagcgagcaggccgcccagagagcccacaccctgctgagcccccccagcgccaacaacgccaccttcgccagagtgcccgtggccacctacaccaacagcagccagcccttcagactgggcgagagaagcttcagcagacagtacgcccacatctacgccaccagactgatccagatgagacccttcctggagaacagagcccagcagcactggggcagcggcgtgggcgtgaagaagctgtgcgagctgcagcccgaggagaagtgctgcgtggtgggcaccctgttcaaggccatgcccctgcagcccagcatcctgagagaggtgagcgaggagcacaacctgctgccccagccccccagaagcaagtacatccaccccgacgacgagctggtgctggaggacgagctgcagagaatcaagctgaagggcaccatcgacgtgagcaagctggtgacctag

SEQ ID NO: 93844 - DNA, 771 bp, Artificial Sequence
  Description of Artificial Sequence: Synthetic coding sequence
atgttccccgtgctgcccggcagccacctgctgctgaacaaccccgccctggagttcatcaagtacgtgtgcaaggtgctgagcctggacaccaacatcaccaaccaggtgaacaagctgaacagagacctgctgagactggtggacgtgggcgagttcagcgaggaggcccagttcagagacccctgcagaagctacgtgctgcccgaggtgatctgcagaagctgcaacttctgcagagacctggacctgtgcaaggacagcagcttcagcgaggacggcgccgtgctgccccagtggctgtgcagcaactgccaggccccctacgacagcagcgccatcgagatgaccctggtggaggtgctgcagaagaagctgatggccttcaccctgcaggacctgaaggaggccgacacccccaagtgcgaggagaaggagagaagaaagagagagctgcacagcagcgccaccggcagaagctgcagaggcgccagcgagcagagactgggcgacgcccccagctgcagagtggtggtgcacggcgtgcaggcctgcagaatggagggcgtgtgcctgaagtgcagaggcgtgaaggagaccagcatgcccgtgtactgcagctgcgccggcgacttcgccctgaccatccacacccaggtgttcatggagcagatcggcatcttcagaaacatcgcccagcactacggcatgagctacctgctggagaccctggagtggctgctgcagaagaacccccagctgggccactag

SEQ ID NO: 93845 - DNA, 6861 bp, Artificial Sequence
  Description of Artificial Sequence: Synthetic coding sequence
atgagcctgagaagcggcggcagaagaagagccgaccccggcgccgacggcgaggccagcagagacgacggcgccaccagcagcgtgagcgccctgaagagactggagagaagccagtggaccgacaagatggacctgagattcggcttcgagagactgaaggagcccggcgagaagaccggctggctgatcaacatgcaccccaccgagatcctggacgaggacaagagactgggcagcgccgtggactactacttcatccaggacgacggcagcagattcaaggtggccctgccctacaagccctacttctacatcgccaccagaaagggctgcgagagagaggtgagcagcttcctgagcaagaagttccagggcaagatcgccaaggtggagaccgtgcccaaggaggacctggacctgcccaaccacctggtgggcctgaagagaaactacatcagactgagcttccacaccgtggaggacctggtgaaggtgagaaaggagatcagccccgccgtgaagaagaacagagagcaggaccacgccagcgacgcctacaccgccctgctgagcagcgtgctgcagagaggcggcgtgatcaccgacgaggaggagaccagcaagaagatcgccgaccagctggacaacatcgtggacatgagagagtacgacgtgccctaccacatcagactgagcatcgacctgaagatccacgtggcccactggtacaacgtgagatacagaggcaacgccttccccgtggagatcaccagaagagacgacctggtggagagacccgaccccgtggtgctggccttcgacatcgagaccaccaagctgcccctgaagttccccgacgccgagaccgaccagatcatgatgatcagctacatgatcgacggccagggctacctgatcaccaacagagagatcgtgagcgaggacatcgaggacttcgagttcacccccaagcccgagtacgagggccccttctgcgtgttcaacgagcccgacgaggcccacctgatccagagatggttcgagcacgtgcaggagaccaagcccaccatcatggtgacctacaacggcgacttcttcgactggcccttcgtggaggccagagccgccgtgcacggcctgagcatgcagcaggagatcggcttccagaaggacagccagggcgagtacaaggccccccagtgcatccacatggactgcctgagatgggtgaagagagacagctacctgcccgtgggcagccacaacctgaaggccgccgccaaggccaagctgggctacgaccccgtggagctggaccccgaggacatgtgcagaatggccaccgagcagccccagaccctggccacctacagcgtgagcgacgccgtggccacctactacctgtacatgaagtacgtgcaccccttcatcttcgccctgtgcaccatcatccccatggagcccgacgaggtgctgagaaagggcagcggcaccctgtgcgaggccctgctgatggtgcaggccttccacgccaacatcatcttccccaacaagcaggagcaggagttcaacaagctgaccgacgacggccacgtgctggacagcgagacctacgtgggcggccacgtggaggccctggagagcggcgtgttcagaagcgacatcccctgcagattcagaatgaaccccgccgccttcgacttcctgctgcagagagtggagaagaccctgagacacgccctggaggaggaggagaaggtgcccgtggagcaggtgaccaacttcgaggaggtgtgcgacgagatcaagagcaagctggccagcctgaaggacgtgcccagcagaatcgagtgccccctgatctaccacctggacgtgggcgccatgtaccccaacatcatcctgaccaacagactgcagcccagcgccatggtggacgaggccacctgcgccgcctgcgacttcaacaagcccggcgccaactgccagagaaagatggcctggcagtggagaggcgagttcatgcccgccagcagaagcgagtaccacagaatccagcaccagctggagagcgagaagttcccccccctgttccccgagggccccgccagagccttccacgagctgagcagagaggagcaggccaagtacgagaagagaagactggccgactactgcagaaaggcctacaagaagatccacatcaccaaggtggaggagagactgaccaccatctgccagagagagaacagcttctacgtggacaccgtgagagccttcagagacagaagatacgagttcaagggcctgcacaaggtgtggaagaagaagctgagcgccgccgtggaggtgggcgacgccgccgaggtgaagagatgcaagaacatggaggtgctgtacgacagcctgcagctggcccacaagtgcatcctgaacagcttctacggctacgtgatgagaaagggcgccagatggtacagcatggagatggccggcatcgtgtgcttcaccggcgccaacatcatcacccaggccagagagctgatcgagcagatcggcagacccctggagctggacaccgacggcatctggtgcgtgctgcccaacagcttccccgagaacttcgtgttcaagaccaccaacgtgaagaagcccaaggtgaccatcagctaccccggcgccatgctgaacatcatggtgaaggagggcttcaccaacgaccagtaccaggagctggccgagcccagcagcctgacctacgtgaccagaagcgagaacagcatcttcttcgaggtggacggcccctacctggccatgatcctgcccgccagcaaggaggagggcaagaagctgaagaagagatacgccgtgttcaacgaggacggcagcctggccgagctgaagggcttcgaggtgaagagaagaggcgagctgcagctgatcaagatcttccagagcagcgtgttcgaggccttcctgaagggcagcaccctggaggaggtgtacggcagcgtggccaaggtggccgactactggctggacgtgctgtacagcaaggccgccaacatgcccgacagcgagctgttcgagctgatcagcgagaacagaagcatgagcagaaagctggaggactacggcgagcagaagagcaccagcatcagcaccgccaagagactggccgagttcctgggcgaccagatggtgaaggacgccggcctgagctgcagatacatcatcagcagaaagcccgagggcagccccgtgaccgagagagccatccccctggccatcttccaggccgagcccaccgtgagaaagcacttcctgagaaagtggctgaagagcagcagcctgcaggacttcgacatcagagccatcctggactgggactactacatcgagagactgggcagcgccatccagaagatcatcaccatccccgccgccctgcagcaggtgaagaaccccgtgcccagagtgaagcaccccgactggctgcacaagaagctgctggagaagaacgacgtgtacaagcagaagaagatcagcgagctgttcaccctggagggcagaagacaggtgaccatggccgaggccagcgaggacagccccagacccagcgcccccgacatggaggacttcggcctggtgaagctgccccaccccgccgcccccgtgaccgtgaagagaaagagagtgctgtgggagagccaggaggagagccaggacctgacccccaccgtgccctggcaggagatcctgggccagccccccgccctgggcaccagccaggaggagtggctggtgtggctgagattccacaagaagaagtggcagctgcaggccagacagagactggccagaagaaagagacagagactggagagcgccgagggcgtgctgagacccggcgccatcagagacggccccgccaccggcctgggcagcttcctgagaagaaccgccagaagcatcctggacctgccctggcagatcgtgcagatcagcgagaccagccaggccggcctgttcagactgtgggccctggtgggcagcgacctgcactgcatcagactgagcatccccagagtgttctacgtgaaccagagagtggccaaggccgaggagggcgccagctacagaaaggtgaacagagtgctgcccagaagcaacatggtgtacaacctgtacgagtacagcgtgcccgaggacatgtaccaggagcacatcaacgagatcaacgccgagctgagcgcccccgacatcgagggcgtgtacgagacccaggtgcccctgctgttcagagccctggtgcacctgggctgcgtgtgcgtggtgaacaagcagctggtgagacacctgagcggctgggaggccgagaccttcgccctggagcacctggagatgagaagcctggcccagttcagctacctggagcccggcagcatcagacacatctacctgtaccaccacgcccaggcccacaaggccctgttcggcatcttcatccccagccagagaagagccagcgtgttcgtgctggacaccgtgagaagcaaccagatgcccagcctgggcgccctgtacagcgccgagcacggcctgctgctggagaaggtgggccccgagctgctgcccccccccaagcacaccttcgaggtgagagccgagaccgacctgaagaccatctgcagagccatccagagattcctgctggcctacaaggaggagagaagaggccccaccctgatcgccgtgcagagcagctgggagctgaagagactggccagcgagatccccgtgctggaggagttccccctggtgcccatctgcgtggccgacaagatcaactacggcgtgctggactggcagagacacggcgccagaagaatgatcagacactacctgaacctggacacctgcctgagccaggccttcgagatgagcagatacttccacatccccatcggcaacctgcccgaggacatcagcaccttcggcagcgacctgttcttcgccagacacctgcagagacacaaccacctgctgtggctgagccccaccgccagacccgacctgggcggcaaggaggccgacgacaactgcctggtgatggagttcgacgaccaggccaccgtggagatcaacagcagcggctgctacagcaccgtgtgcgtggagctggacctgcagaacctggccgtgaacaccatcctgcagagccaccacgtgaacgacatggagggcgccgacagcatgggcatcagcttcgacgtgatccagcaggccagcctggaggacatgatcaccggcggccaggccgccagcgcccccgccagctacgacgagaccgccctgtgcagcaacaccttcagaatcctgaagagcatggtggtgggctgggtgaaggagatcacccagtaccacaacatctacgccgacaaccaggtgatgcacttctacagatggctgagaagccccagcagcctgctgcacgaccccgccctgcacagaaccctgcacaacatgatgaagaagctgttcctgcagctgatcgccgagttcaagagactgggcagcagcgtgatctacgccaacttcaacagaatcatcctgtgcaccaagaagagaagagtggaggacgccatcgcctacgtggagtacatcaccagcagcatccacagcaaggagaccttccacagcctgaccatcagcttcagcagatgctgggagttcctgctgtggatggaccccagcaactacggcggcatcaagggcaaggtgagcagcagaatccactgcggcctgcaggacagccagaaggccggcggcgccgaggacgagcaggagaacgaggacgacgaggaggagagagacggcgaggaggaggaggaggccgaggagagcaacgtggaggacctgctggagaacaactggaacatcctgcagttcctgccccaggccgccagctgccagaactacttcctgatgatcgtgagcgcctacatcgtggccgtgtaccactgcatgaaggacggcctgagaagaagcgcccccggcagcacccccgtgagaagaagaggcgccagccagctgagccaggaggccgagggcgccgtgggcgccctgcccggcatgatcaccttcagccaggactacgtggccaacgagctgacccagagcttcttcaccatcacccagaagatccagaagaaggtgaccggcagcagaaacagcaccgagctgagcgagatgttccccgtgctgcccggcagccacctgctgctgaacaaccccgccctggagttcatcaagtacgtgtgcaaggtgctgagcctggacaccaacatcaccaaccaggtgaacaagctgaacagagacctgctgagactggtggacgtgggcgagttcagcgaggaggcccagttcagagacccctgcagaagctacgtgctgcccgaggtgatctgcagaagctgcaacttctgcagagacctggacctgtgcaaggacagcagcttcagcgaggacggcgccgtgctgccccagtggctgtgcagcaactgccaggccccctacgacagcagcgccatcgagatgaccctggtggaggtgctgcagaagaagctgatggccttcaccctgcaggacctggtgtgcctgaagtgcagaggcgtgaaggagaccagcatgcccgtgtactgcagctgcgccggcgacttcgccctgaccatccacacccaggtgttcatggagcagatcggcatcttcagaaacatcgcccagcactacggcatgagctacctgctggagaccctggagtggctgctgcagaagaacccccagctgggccactag

SEQ ID NO: 93846 - DNA, 3330 bp, Artificial Sequence
  Description of Artificial Sequence: Synthetic coding sequence
atgcaccccaccgagatcctggacgaggacaagagactgggcagcgccgtggactactacttcatccaggacgacggcagcagattcaaggtggccctgccctacaagccctacttctacatcgccaccagaaagggctgcgagagagaggtgagcagcttcctgagcaagaagttccagggcaagatcgccaaggtggagaccgtgcccaaggaggacctggacctgcccaaccacctggtgggcctgaagagaaactacatcagactgagcttccacaccgtggaggacctggtgaaggtgagaaaggagatcagccccgccgtgaagaagaacagagagcaggaccacgccagcgacgcctacaccgccctgctgagcagcgtgctgcagagaggcggcgtgatcaccgacgaggaggagaccagcaagaagatcgccgaccagctggacaacatcgtggacatgagagagtacgacgtgccctaccacatcagactgagcatcgacctgaagatccacgtggcccactggtacaacgtgagatacagaggcaacgccttccccgtggagatcaccagaagagacgacctggtggagagacccgaccccgtggtgctggccttcgacatcgagaccaccaagctgcccctgaagttccccgacgccgagaccgaccagatcatgatgatcagctacatgatcgacggccagggctacctgatcaccaacagagagatcgtgagcgaggacatcgaggacttcgagttcacccccaagcccgagtacgagggccccttctgcgtgttcaacgagcccgacgaggcccacctgatccagagatggttcgagcacgtgcaggagaccaagcccaccatcatggtgacctacaacggcgacttcttcgactggcccttcgtggaggccagagccgccgtgcacggcctgagcatgcagcaggagatcggcttccagaaggacagccagggcgagtacaaggccccccagtgcatccacatggactgcctgagatgggtgaagagagacagctacctgcccgtgggcagccacaacctgaaggccgccgccaaggccaagctgggctacgaccccgtggagctggaccccgaggacatgtgcagaatggccaccgagcagccccagaccctggccacctacagcgtgagcgacgccgtggccacctactacctgtacatgaagtacgtgcaccccttcatcttcgccctgtgcaccatcatccccatggagcccgacgaggtgctgagaaagggcagcggcaccctgtgcgaggccctgctgatggtgcaggccttccacgccaacatcatcttccccaacaagcaggagcaggagttcaacaagctgaccgacgacggccacgtgctggacagcgagacctacgtgggcggccacgtggaggccctggagagcggcgtgttcagaagcgacatcccctgcagattcagaatgaaccccgccgccttcgacttcctgctgcagagagtggagaagaccctgagacacgccctggaggaggaggagaaggtgcccgtggagcaggtgaccaacttcgaggaggtgtgcgacgagatcaagagcaagctggccagcctgaaggacgtgcccagcagaatcgagtgccccctgatctaccacctggacgtgggcgccatgtaccccaacatcatcctgaccaacagactgcagcccagcgccatggtggacgaggccacctgcgccgcctgcgacttcaacaagcccggcgccaactgccagagaaagatggcctggcagtggagaggcgagttcatgcccgccagcagaagcgagtaccacagaatccagcaccagctggagagcgagaagttcccccccctgttccccgagggccccgccagagccttccacgagctgagcagagaggagcaggccaagtacgagaagagaagactggccgactactgcagaaaggcctacaagaagatccacatcaccaaggtggaggagagactgaccaccatctgccagagagagaacagcttctacgtggacaccgtgagagccttcagagacagaagatacgagttcaagggcctgcacaaggtgtggaagaagaagctgagcgccgccgtggaggtgggcgacgccgccgaggtgaagagatgcaagaacatggaggtgctgtacgacagcctgcagctggcccacaagtgcatcctgaacagcttctacggctacgtgatgagaaagggcgccagatggtacagcatggagatggccggcatcgtgtgcttcaccggcgccaacatcatcacccaggccagagagctgatcgagcagatcggcagacccctggagctggacaccgacggcatctggtgcgtgctgcccaacagcttccccgagaacttcgtgttcaagaccaccaacgtgaagaagcccaaggtgaccatcagctaccccggcgccatgctgaacatcatggtgaaggagggcttcaccaacgaccagtaccaggagctggccgagcccagcagcctgacctacgtgaccagaagcgagaacagcatcttcttcgaggtggacggcccctacctggccatgatcctgcccgccagcaaggaggagggcaagaagctgaagaagagatacgccgtgttcaacgaggacggcagcctggccgagctgaagggcttcgaggtgaagagaagaggcgagctgcagctgatcaagatcttccagagcagcgtgttcgaggccttcctgaagggcagcaccctggaggaggtgtacggcagcgtggccaaggtggccgactactggctggacgtgctgtacagcaaggccgccaacatgcccgacagcgagctgttcgagctgatcagcgagaacagaagcatgagcagaaagctggaggactacggcgagcagaagagcaccagcatcagcaccgccaagagactggccgagttcctgggcgaccagatggtgaaggacgccggcctgagctgcagatacatcatcagcagaaagcccgagggcagccccgtgaccgagagagccatccccctggccatcttccaggccgagcccaccgtgagaaagcacttcctgagaaagtggctgaagagcagcagcctgcaggacttcgacatcagagccatcctggactgggactactacatcgagagactgggcagcgccatccagaagatcatcaccatccccgccgccctgcagcaggtgaagaaccccgtgcccagagtgaagcaccccgactggctgcacaagaccgccggcgaggagtag

SEQ ID NO: 93847 - DNA, 1491 bp, Artificial Sequence
  Description of Artificial Sequence: Synthetic coding sequence
atggagggcatcctgaagagcatggtggtgggctgggtgaaggagatcacccagtaccacaacatctacgccgacaaccaggtgatgcacttctacagatggctgagaagccccagcagcctgctgcacgaccccgccctgcacagaaccctgcacaacatgatgaagaagctgttcctgcagctgatcgccgagttcaagagactgggcagcagcgtgatctacgccaacttcaacagaatcatcctgtgcaccaagaagagaagagtggaggacgccatcgcctacgtggagtacatcaccagcagcatccacagcaaggagaccttccacagcctgaccatcagcttcagcagatgctgggagttcctgctgtggatggaccccagcaactacggcggcatcaagggcaaggtgagcagcagaatccactgcggcctgcaggacagccagaaggccggcggcgccgaggacgagcaggagaacgaggacgacgaggaggagagagacggcgaggaggaggaggaggccgaggagagcaacgtggaggacctgctggagaacaactggaacatcctgcagttcctgccccaggccgccagctgccagaactacttcctgatgatcgtgagcgcctacatcgtggccgtgtaccactgcatgaaggacggcctgagaagaagcgcccccggcagcacccccgtgagaagaagaggcgccagccagctgagccaggaggccgagggcgccgtgggcgccctgcccggcatgatcaccttcagccaggactacgtggccaacgagctgacccagagcttcttcaccatcacccagaagatccagaagaaggtgaccggcagcagaaacagcaccgagctgagcgagatgttccccgtgctgcccggcagccacctgctgctgaacaaccccgccctggagttcatcaagtacgtgtgcaaggtgctgagcctggacaccaacatcaccaaccaggtgaacaagctgaacagagacctgctgagactggtggacgtgggcgagttcagcgaggaggcccagttcagagacccctgcagaagctacgtgctgcccgaggtgatctgcagaagctgcaacttctgcagagacctggacctgtgcaaggacagcagcttcagcgaggacggcgccgtgctgccccagtggctgtgcagcaactgccaggccccctacgacagcagcgccatcgagatgaccctggtggaggtgctgcagaagaagctgatggccttcaccctgcaggacctggtgtgcctgaagtgcagaggcgtgaaggagaccagcatgcccgtgtactgcagctgcgccggcgacttcgccctgaccatccacacccaggtgttcatggagcagatcggcatcttcagaaacatcgcccagcactacggcatgagctacctgctggagaccctggagtggctgctgcagaagaacccccagctgggccactag

SEQ ID NO: 93848 - DNA, 6894 bp, Artificial Sequence
  Description of Artificial Sequence: Synthetic coding sequence
atgagcagacccctgggcctgaagagcttccccagacacaagcaggcccccctgcccctgagcctgaccttccacggctgcctgctgctgagaagagacgacggcgccaccagcagcgtgagcgccctgaagagactggagagaagccagtggaccgacaagatggacctgagattcggcttcgagagactgaaggagcccggcgagaagaccggctggctgatcaacatgcaccccaccgagatcctggacgaggacaagagactgggcagcgccgtggactactacttcatccaggacgacggcagcagattcaaggtggccctgccctacaagccctacttctacatcgccaccagaaagggctgcgagagagaggtgagcagcttcctgagcaagaagttccagggcaagatcgccaaggtggagaccgtgcccaaggaggacctggacctgcccaaccacctggtgggcctgaagagaaactacatcagactgagcttccacaccgtggaggacctggtgaaggtgagaaaggagatcagccccgccgtgaagaagaacagagagcaggaccacgccagcgacgcctacaccgccctgctgagcagcgtgctgcagagaggcggcgtgatcaccgacgaggaggagaccagcaagaagatcgccgaccagctggacaacatcgtggacatgagagagtacgacgtgccctaccacatcagactgagcatcgacctgaagatccacgtggcccactggtacaacgtgagatacagaggcaacgccttccccgtggagatcaccagaagagacgacctggtggagagacccgaccccgtggtgctggccttcgacatcgagaccaccaagctgcccctgaagttccccgacgccgagaccgaccagatcatgatgatcagctacatgatcgacggccagggctacctgatcaccaacagagagatcgtgagcgaggacatcgaggacttcgagttcacccccaagcccgagtacgagggccccttctgcgtgttcaacgagcccgacgaggcccacctgatccagagatggttcgagcacgtgcaggagaccaagcccaccatcatggtgacctacaacggcgacttcttcgactggcccttcgtggaggccagagccgccgtgcacggcctgagcatgcagcaggagatcggcttccagaaggacagccagggcgagtacaaggccccccagtgcatccacatggactgcctgagatgggtgaagagagacagctacctgcccgtgggcagccacaacctgaaggccgccgccaaggccaagctgggctacgaccccgtggagctggaccccgaggacatgtgcagaatggccaccgagcagccccagaccctggccacctacagcgtgagcgacgccgtggccacctactacctgtacatgaagtacgtgcaccccttcatcttcgccctgtgcaccatcatccccatggagcccgacgaggtgctgagaaagggcagcggcaccctgtgcgaggccctgctgatggtgcaggccttccacgccaacatcatcttccccaacaagcaggagcaggagttcaacaagctgaccgacgacggccacgtgctggacagcgagacctacgtgggcggccacgtggaggccctggagagcggcgtgttcagaagcgacatcccctgcagattcagaatgaaccccgccgccttcgacttcctgctgcagagagtggagaagaccctgagacacgccctggaggaggaggagaaggtgcccgtggagcaggtgaccaacttcgaggaggtgtgcgacgagatcaagagcaagctggccagcctgaaggacgtgcccagcagaatcgagtgccccctgatctaccacctggacgtgggcgccatgtaccccaacatcatcctgaccaacagactgcagcccagcgccatggtggacgaggccacctgcgccgcctgcgacttcaacaagcccggcgccaactgccagagaaagatggcctggcagtggagaggcgagttcatgcccgccagcagaagcgagtaccacagaatccagcaccagctggagagcgagaagttcccccccctgttccccgagggccccgccagagccttccacgagctgagcagagaggagcaggccaagtacgagaagagaagactggccgactactgcagaaaggcctacaagaagatccacatcaccaaggtggaggagagactgaccaccatctgccagagagagaacagcttctacgtggacaccgtgagagccttcagagacagaagatacgagttcaagggcctgcacaaggtgtggaagaagaagctgagcgccgccgtggaggtgggcgacgccgccgaggtgaagagatgcaagaacatggaggtgctgtacgacagcctgcagctggcccacaagtgcatcctgaacagcttctacggctacgtgatgagaaagggcgccagatggtacagcatggagatggccggcatcgtgtgcttcaccggcgccaacatcatcacccaggccagagagctgatcgagcagatcggcagacccctggagctggacaccgacggcatctggtgcgtgctgcccaacagcttccccgagaacttcgtgttcaagaccaccaacgtgaagaagcccaaggtgaccatcagctaccccggcgccatgctgaacatcatggtgaaggagggcttcaccaacgaccagtaccaggagctggccgagcccagcagcctgacctacgtgaccagaagcgagaacagcatcttcttcgaggtggacggcccctacctggccatgatcctgcccgccagcaaggaggagggcaagaagctgaagaagagatacgccgtgttcaacgaggacggcagcctggccgagctgaagggcttcgaggtgaagagaagaggcgagctgcagctgatcaagatcttccagagcagcgtgttcgaggccttcctgaagggcagcaccctggaggaggtgtacggcagcgtggccaaggtggccgactactggctggacgtgctgtacagcaaggccgccaacatgcccgacagcgagctgttcgagctgatcagcgagaacagaagcatgagcagaaagctggaggactacggcgagcagaagagcaccagcatcagcaccgccaagagactggccgagttcctgggcgaccagatggtgaaggacgccggcctgagctgcagatacatcatcagcagaaagcccgagggcagccccgtgaccgagagagccatccccctggccatcttccaggccgagcccaccgtgagaaagcacttcctgagaaagtggctgaagagcagcagcctgcaggacttcgacatcagagccatcctggactgggactactacatcgagagactgggcagcgccatccagaagatcatcaccatccccgccgccctgcagcaggtgaagaaccccgtgcccagagtgaagcaccccgactggctgcacaagaagctgctggagaagaacgacgtgtacaagcagaagaagatcagcgagctgttcaccctggagggcagaagacaggtgaccatggccgaggccagcgaggacagccccagacccagcgcccccgacatggaggacttcggcctggtgaagctgccccaccccgccgcccccgtgaccgtgaagagaaagagagtgctgtgggagagccaggaggagagccaggacctgacccccaccgtgccctggcaggagatcctgggccagccccccgccctgggcaccagccaggaggagtggctggtgtggctgagattccacaagaagaagtggcagctgcaggccagacagagactggccagaagaaagagacagagactggagagcgccgagggcgtgctgagacccggcgccatcagagacggccccgccaccggcctgggcagcttcctgagaagaaccgccagaagcatcctggacctgccctggcagatcgtgcagatcagcgagaccagccaggccggcctgttcagactgtgggccctggtgggcagcgacctgcactgcatcagactgagcatccccagagtgttctacgtgaaccagagagtggccaaggccgaggagggcgccagctacagaaaggtgaacagagtgctgcccagaagcaacatggtgtacaacctgtacgagtacagcgtgcccgaggacatgtaccaggagcacatcaacgagatcaacgccgagctgagcgcccccgacatcgagggcgtgtacgagacccaggtgcccctgctgttcagagccctggtgcacctgggctgcgtgtgcgtggtgaacaagcagctggtgagacacctgagcggctgggaggccgagaccttcgccctggagcacctggagatgagaagcctggcccagttcagctacctggagcccggcagcatcagacacatctacctgtaccaccacgcccaggcccacaaggccctgttcggcatcttcatccccagccagagaagagccagcgtgttcgtgctggacaccgtgagaagcaaccagatgcccagcctgggcgccctgtacagcgccgagcacggcctgctgctggagaaggtgggccccgagctgctgcccccccccaagcacaccttcgaggtgagagccgagaccgacctgaagaccatctgcagagccatccagagattcctgctggcctacaaggaggagagaagaggccccaccctgatcgccgtgcagagcagctgggagctgaagagactggccagcgagatccccgtgctggaggagttccccctggtgcccatctgcgtggccgacaagatcaactacggcgtgctggactggcagagacacggcgccagaagaatgatcagacactacctgaacctggacacctgcctgagccaggccttcgagatgagcagatacttccacatccccatcggcaacctgcccgaggacatcagcaccttcggcagcgacctgttcttcgccagacacctgcagagacacaaccacctgctgtggctgagccccaccgccagacccgacctgggcggcaaggaggccgacgacaactgcctggtgatggagttcgacgaccaggccaccgtggagatcaacagcagcggctgctacagcaccgtgtgcgtggagctggacctgcagaacctggccgtgaacaccatcctgcagagccaccacgtgaacgacatggagggcgccgacagcatgggcatcagcttcgacgtgatccagcaggccagcctggaggacatgatcaccggcggccaggccgccagcgcccccgccagctacgacgagaccgccctgtgcagcaacaccttcagaatcctgaagagcatggtggtgggctgggtgaaggagatcacccagtaccacaacatctacgccgacaaccaggtgatgcacttctacagatggctgagaagccccagcagcctgctgcacgaccccgccctgcacagaaccctgcacaacatgatgaagaagctgttcctgcagctgatcgccgagttcaagagactgggcagcagcgtgatctacgccaacttcaacagaatcatcctgtgcaccaagaagagaagagtggaggacgccatcgcctacgtggagtacatcaccagcagcatccacagcaaggagaccttccacagcctgaccatcagcttcagcagatgctgggagttcctgctgtggatggaccccagcaactacggcggcatcaagggcaaggtgagcagcagaatccactgcggcctgcaggacagccagaaggccggcggcgccgaggacgagcaggagaacgaggacgacgaggaggagagagacggcgaggaggaggaggaggccgaggagagcaacgtggaggacctgctggagaacaactggaacatcctgcagttcctgccccaggccgccagctgccagaactacttcctgatgatcgtgagcgcctacatcgtggccgtgtaccactgcatgaaggacggcctgagaagaagcgcccccggcagcacccccgtgagaagaagaggcgccagccagctgagccaggaggccgagggcgccgtgggcgccctgcccggcatgatcaccttcagccaggactacgtggccaacgagctgacccagagcttcttcaccatcacccagaagatccagaagaaggtgaccggcagcagaaacagcaccgagctgagcgagatgttccccgtgctgcccggcagccacctgctgctgaacaaccccgccctggagttcatcaagtacgtgtgcaaggtgctgagcctggacaccaacatcaccaaccaggtgaacaagctgaacagagacctgctgagactggtggacgtgggcgagttcagcgaggaggcccagttcagagacccctgcagaagctacgtgctgcccgaggtgatctgcagaagctgcaacttctgcagagacctggacctgtgcaaggacagcagcttcagcgaggacggcgccgtgctgccccagtggctgtgcagcaactgccaggccccctacgacagcagcgccatcgagatgaccctggtggaggtgctgcagaagaagctgatggccttcaccctgcaggacctggtgtgcctgaagtgcagaggcgtgaaggagaccagcatgcccgtgtactgcagctgcgccggcgacttcgccctgaccatccacacccaggtgttcatggagcagatcggcatcttcagaaacatcgcccagcactacggcatgagctacctgctggagaccctggagtggctgctgcagaagaacccccagctgggccactag

SEQ ID NO: 93849 - DNA, 6780 bp, Artificial Sequence
  Description of Artificial Sequence: Synthetic coding sequence
atgagcctgagaagcggcggcagaagaagagccgaccccggcgccgacggcgaggccagcagagacgacggcgccaccagcagcgtgagcgccctgaagagactggagagaagccagtggaccgacaagatggacctgagattcggcttcgagagactgaaggagcccggcgagaagaccggctggctgatcaacatgcaccccgtggccctgccctacaagccctacttctacatcgccaccagaaagggctgcgagagagaggtgagcagcttcctgagcaagaagttccagggcaagatcgccaaggtggagaccgtgcccaaggaggacctggacctgcccaaccacctggtgggcctgaagagaaactacatcagactgagcttccacaccgtggaggacctggtgaaggtgagaaaggagatcagccccgccgtgaagaagaacagagagcaggaccacgccagcgacgcctacaccgccctgctgagcagcgtgctgcagagaggcggcgtgatcaccgacgaggaggagaccagcaagaagatcgccgaccagctggacaacatcgtggacatgagagagtacgacgtgccctaccacatcagactgagcatcgacctgaagatccacgtggcccactggtacaacgtgagatacagaggcaacgccttccccgtggagatcaccagaagagacgacctggtggagagacccgaccccgtggtgctggccttcgacatcgagaccaccaagctgcccctgaagttccccgacgccgagaccgaccagatcatgatgatcagctacatgatcgacggccagggctacctgatcaccaacagagagatcgtgagcgaggacatcgaggacttcgagttcacccccaagcccgagtacgagggccccttctgcgtgttcaacgagcccgacgaggcccacctgatccagagatggttcgagcacgtgcaggagaccaagcccaccatcatggtgacctacaacggcgacttcttcgactggcccttcgtggaggccagagccgccgtgcacggcctgagcatgcagcaggagatcggcttccagaaggacagccagggcgagtacaaggccccccagtgcatccacatggactgcctgagatgggtgaagagagacagctacctgcccgtgggcagccacaacctgaaggccgccgccaaggccaagctgggctacgaccccgtggagctggaccccgaggacatgtgcagaatggccaccgagcagccccagaccctggccacctacagcgtgagcgacgccgtggccacctactacctgtacatgaagtacgtgcaccccttcatcttcgccctgtgcaccatcatccccatggagcccgacgaggtgctgagaaagggcagcggcaccctgtgcgaggccctgctgatggtgcaggccttccacgccaacatcatcttccccaacaagcaggagcaggagttcaacaagctgaccgacgacggccacgtgctggacagcgagacctacgtgggcggccacgtggaggccctggagagcggcgtgttcagaagcgacatcccctgcagattcagaatgaaccccgccgccttcgacttcctgctgcagagagtggagaagaccctgagacacgccctggaggaggaggagaaggtgcccgtggagcaggtgaccaacttcgaggaggtgtgcgacgagatcaagagcaagctggccagcctgaaggacgtgcccagcagaatcgagtgccccctgatctaccacctggacgtgggcgccatgtaccccaacatcatcctgaccaacagactgcagcccagcgccatggtggacgaggccacctgcgccgcctgcgacttcaacaagcccggcgccaactgccagagaaagatggcctggcagtggagaggcgagttcatgcccgccagcagaagcgagtaccacagaatccagcaccagctggagagcgagaagttcccccccctgttccccgagggccccgccagagccttccacgagctgagcagagaggagcaggccaagtacgagaagagaagactggccgactactgcagaaaggcctacaagaagatccacatcaccaaggtggaggagagactgaccaccatctgccagagagagaacagcttctacgtggacaccgtgagagccttcagagacagaagatacgagttcaagggcctgcacaaggtgtggaagaagaagctgagcgccgccgtggaggtgggcgacgccgccgaggtgaagagatgcaagaacatggaggtgctgtacgacagcctgcagctggcccacaagtgcatcctgaacagcttctacggctacgtgatgagaaagggcgccagatggtacagcatggagatggccggcatcgtgtgcttcaccggcgccaacatcatcacccaggccagagagctgatcgagcagatcggcagacccctggagctggacaccgacggcatctggtgcgtgctgcccaacagcttccccgagaacttcgtgttcaagaccaccaacgtgaagaagcccaaggtgaccatcagctaccccggcgccatgctgaacatcatggtgaaggagggcttcaccaacgaccagtaccaggagctggccgagcccagcagcctgacctacgtgaccagaagcgagaacagcatcttcttcgaggtggacggcccctacctggccatgatcctgcccgccagcaaggaggagggcaagaagctgaagaagagatacgccgtgttcaacgaggacggcagcctggccgagctgaagggcttcgaggtgaagagaagaggcgagctgcagctgatcaagatcttccagagcagcgtgttcgaggccttcctgaagggcagcaccctggaggaggtgtacggcagcgtggccaaggtggccgactactggctggacgtgctgtacagcaaggccgccaacatgcccgacagcgagctgttcgagctgatcagcgagaacagaagcatgagcagaaagctggaggactacggcgagcagaagagcaccagcatcagcaccgccaagagactggccgagttcctgggcgaccagatggtgaaggacgccggcctgagctgcagatacatcatcagcagaaagcccgagggcagccccgtgaccgagagagccatccccctggccatcttccaggccgagcccaccgtgagaaagcacttcctgagaaagtggctgaagagcagcagcctgcaggacttcgacatcagagccatcctggactgggactactacatcgagagactgggcagcgccatccagaagatcatcaccatccccgccgccctgcagcaggtgaagaaccccgtgcccagagtgaagcaccccgactggctgcacaagaagctgctggagaagaacgacgtgtacaagcagaagaagatcagcgagctgttcaccctggagggcagaagacaggtgaccatggccgaggccagcgaggacagccccagacccagcgcccccgacatggaggacttcggcctggtgaagctgccccaccccgccgcccccgtgaccgtgaagagaaagagagtgctgtgggagagccaggaggagagccaggacctgacccccaccgtgccctggcaggagatcctgggccagccccccgccctgggcaccagccaggaggagtggctggtgtggctgagattccacaagaagaagtggcagctgcaggccagacagagactggccagaagaaagagacagagactggagagcgccgagggcgtgctgagacccggcgccatcagagacggccccgccaccggcctgggcagcttcctgagaagaaccgccagaagcatcctggacctgccctggcagatcgtgcagatcagcgagaccagccaggccggcctgttcagactgtgggccctggtgggcagcgacctgcactgcatcagactgagcatccccagagtgttctacgtgaaccagagagtggccaaggccgaggagggcgccagctacagaaaggtgaacagagtgctgcccagaagcaacatggtgtacaacctgtacgagtacagcgtgcccgaggacatgtaccaggagcacatcaacgagatcaacgccgagctgagcgcccccgacatcgagggcgtgtacgagacccaggtgcccctgctgttcagagccctggtgcacctgggctgcgtgtgcgtggtgaacaagcagctggtgagacacctgagcggctgggaggccgagaccttcgccctggagcacctggagatgagaagcctggcccagttcagctacctggagcccggcagcatcagacacatctacctgtaccaccacgcccaggcccacaaggccctgttcggcatcttcatccccagccagagaagagccagcgtgttcgtgctggacaccgtgagaagcaaccagatgcccagcctgggcgccctgtacagcgccgagcacggcctgctgctggagaaggtgggccccgagctgctgcccccccccaagcacaccttcgaggtgagagccgagaccgacctgaagaccatctgcagagccatccagagattcctgctggcctacaaggaggagagaagaggccccaccctgatcgccgtgcagagcagctgggagctgaagagactggccagcgagatccccgtgctggaggagttccccctggtgcccatctgcgtggccgacaagatcaactacggcgtgctggactggcagagacacggcgccagaagaatgatcagacactacctgaacctggacacctgcctgagccaggccttcgagatgagcagatacttccacatccccatcggcaacctgcccgaggacatcagcaccttcggcagcgacctgttcttcgccagacacctgcagagacacaaccacctgctgtggctgagccccaccgccagacccgacctgggcggcaaggaggccgacgacaactgcctggtgatggagttcgacgaccaggccaccgtggagatcaacagcagcggctgctacagcaccgtgtgcgtggagctggacctgcagaacctggccgtgaacaccatcctgcagagccaccacgtgaacgacatggagggcgccgacagcatgggcatcagcttcgacgtgatccagcaggccagcctggaggacatgatcaccggcggccaggccgccagcgcccccgccagctacgacgagaccgccctgtgcagcaacaccttcagaatcctgaagagcatggtggtgggctgggtgaaggagatcacccagtaccacaacatctacgccgacaaccaggtgatgcacttctacagatggctgagaagccccagcagcctgctgcacgaccccgccctgcacagaaccctgcacaacatgatgaagaagctgttcctgcagctgatcgccgagttcaagagactgggcagcagcgtgatctacgccaacttcaacagaatcatcctgtgcaccaagaagagaagagtggaggacgccatcgcctacgtggagtacatcaccagcagcatccacagcaaggagaccttccacagcctgaccatcagcttcagcagatgctgggagttcctgctgtggatggaccccagcaactacggcggcatcaagggcaaggtgagcagcagaatccactgcggcctgcaggacagccagaaggccggcggcgccgaggacgagcaggagaacgaggacgacgaggaggagagagacggcgaggaggaggaggaggccgaggagagcaacgtggaggacctgctggagaacaactggaacatcctgcagttcctgccccaggccgccagctgccagaactacttcctgatgatcgtgagcgcctacatcgtggccgtgtaccactgcatgaaggacggcctgagaagaagcgcccccggcagcacccccgtgagaagaagaggcgccagccagctgagccaggaggccgagggcgccgtgggcgccctgcccggcatgatcaccttcagccaggactacgtggccaacgagctgacccagagcttcttcaccatcacccagaagatccagaagaaggtgaccggcagcagaaacagcaccgagctgagcgagatgttccccgtgctgcccggcagccacctgctgctgaacaaccccgccctggagttcatcaagtacgtgtgcaaggtgctgagcctggacaccaacatcaccaaccaggtgaacaagctgaacagagacctgctgagactggtggacgtgggcgagttcagcgaggaggcccagttcagagacccctgcagaagctacgtgctgcccgaggtgatctgcagaagctgcaacttctgcagagacctggacctgtgcaaggacagcagcttcagcgaggacggcgccgtgctgccccagtggctgtgcagcaactgccaggccccctacgacagcagcgccatcgagatgaccctggtggaggtgctgcagaagaagctgatggccttcaccctgcaggacctggtgtgcctgaagtgcagaggcgtgaaggagaccagcatgcccgtgtactgcagctgcgccggcgacttcgccctgaccatccacacccaggtgttcatggagcagatcggcatcttcagaaacatcgcccagcactacggcatgagctacctgctggagaccctggagtggctgctgcagaagaacccccagctgggccactag

SEQ ID NO: 93850 - DNA, 480 bp, Artificial Sequence
  Description of Artificial Sequence: Synthetic coding sequence
atgatcaagttcttcctgatggtgaacaagcagggccagaccagactgagcaagtactacgagcacgtggacatcaacaagagaaccctgctggagaccgaggtgatcaagagctgcctgagcagaagcaacgagcagtgcagcttcatcgagtacaaggacttcaagctgatctacagacagtacgccgccctgttcatcgtggtgggcgtgaacgacaccgagaacgagatggccatctacgagttcatccacaacttcgtggaggtgctggacgagtacttcagcagagtgagcgagctggacgtgagcttcttcaacaccgtgttccacagcacctggcagatgcacagcggcccctaccaggagcccatcgacgagctgcccaagatctgcagcgccctggagccccagcagacctgcttcagccccgacagcagcagcttcaagggcgccgccagcaccacccccatctactag

SEQ ID NO: 93851 - DNA, 1506 bp, Artificial Sequence
  Description of Artificial Sequence: Synthetic coding sequence
atggcccccgagagactgagaagcagagccctgagcgccttcaagctgagaggcctgctgctgagaggcgaggccatcaagtacctgaccgaggccctgcagagcatcagcgagctggagctggaggacaagctggagaagatcatcaacgccgtggagaagcagcccctgagcagcaacatgatcgagagaagcgtggtggaggccgccgtgcaggagtgcagccagagcgtggacgagaccatcctgctgatgaccaaccaccccgcccccaacctgttcggcacccccagagacaaggccgagatgttcagagagagatacaccatcctgcaccagagaacccacagacacgagctgttcaccccccccgtgatcggcagccaccccgacgagagcggcagcaagttccagctgaagaccatcgagaccctgctgggcagcaccaccaagatcggcgacgccatcgtgctgggcatgatcacccagctgaaggagggcaagttcttcctggaggaccccaccggcaccgtgcagctggacctgagcaaggcccagttccacagcggcctgtacaccgaggcctgcttcgtgctggccgagggctggttcgaggaccaggtgttccacgtgaacgccttcggcttcccccccaccgagcccagcagcaccaccagagcctactacggcaacatcaacttcttcggcggccccagcaacaccagcgtgaagaccagcgccaagctgaagcagctggaggaggagaacaaggacgccatgttcgtgttcctgagcgacgtgtggctggaccaggtggaggtgctggagaagctgagaatcatgttcgccggctacagccccgccccccccacctgcttcatcctgtgcggcaacttcagcagcgccccctacggcaagaaccaggtgcaggccctgaaggacagcctgaagaccctggccgacatcatctgcgagtaccccgacatccaccagagcagcagattcgtgttcgtgcccggccccgaggaccccggcttcggcagcatcctgcccagaccccccctggccgagagcatcaccaacgagttcagacagagagtgcccttcagcgtgttcaccaccaacccctgcagaatccagtactgcacccaggagatcaccgtgttcagagaggacctggtgaacaagatgtgcagaaactgcgtgagattccccagcagcaacctggccatccccaaccacttcgtgaagaccatcctgagccagggccacctgacccccctgcccctgtacgtgtgccccgtgtactgggcctacgactacgccctgagagtgtaccccgtgcccgacctgctggtgatcgccgacaagtacgaccccttcaccaccaccaacaccgagtgcctgtgcatcaaccccggcagcttccccagaagcggcttcagcttcaaggtgttctaccccagcaacaagaccgtggaggacagcaagctgcagggcttctag

SEQ ID NO: 93852 - DNA, 1509 bp, Artificial Sequence
  Description of Artificial Sequence: Synthetic coding sequence
atggcccccgagagactgagaagcagagccctgagcgccttcaagctgagaggcctgctgctgagaggcgaggccatcaagtacctgaccgaggccctgcagagcatcagcgagctggagctggaggacaagctggagaagatcatcaacgccgtggagaagcagcccctgagcagcaacatgatcgagagaagcgtggtggaggccgccgtgcaggagtgcagccagagcgtggacgagaccatcgagcacgtgttcaacatcatcggcgccttcgacatccccagattcgtgtacaacagcgagagaaagaagttcctgcccctgctgatgaccaaccaccccgcccccaacctgttcggcacccccagagacaaggccgagatgttcagagagagatacaccatcctgcaccagagaacccacagacacgagctgttcaccccccccgtgatcggcagccaccccgacgagagcggcagcaagttccagctgaagaccatcgagaccctgctgggcagcaccaccaagatcggcgacgccatcgtgctgggcatgatcacccagctgaaggagggcaagttcttcctggaggaccccaccggcaccgtgcagctggacctgagcaaggcccagttccacagcggcctgtacaccgaggcctgcttcgtgctggccgagggctggttcgaggaccaggtgttccacgtgaacgccttcggcttcccccccaccgagcccagcagcaccaccagagcctactacggcaacatcaacttcttcggcggccccagcaacaccagcgtgaagaccagcgccaagctgaagcagctggaggaggagaacaaggacgccatgttcgtgttcctgagcgacgtgtggctggaccaggtggaggtgctggagaagctgagaatcatgttcgccggctacagccccgccccccccacctgcttcatcctgtgcggcaacttcagcagcgccccctacggcaagaaccaggtgcaggccctgaaggacagcctgaagaccctggccgacatcatctgcgagtaccccgacatccaccagagcagcagattcgtgttcgtgcccggccccgaggaccccggcttcggcagcatcctgcccagaccccccctggccgagagcatcaccaacgagttcagacagagagtgcccttcagcgtgttcaccaccaacccctgcagaatccagtactgcacccaggagatcaccgtgttcagagaggacctggtgaacaagatgtgcagaaactgcgtgagattccccagcagcaacctggccatccccaaccacttcgtgaagaccatcctgagccagggccacctgacccccctgcccctgtacgtgtgccccgtgtactgggcctacgactacgccctgagagtgtaccccgtgcccgacctgctggtgatcgccgacaagtacgaccccttcaccaccaccaacaccgagtgcctgtgcatcaaccccgtgagaatgtag

SEQ ID NO: 93853 - DNA, 444 bp, Artificial Sequence
  Description of Artificial Sequence: Synthetic coding sequence
atggccgagagacccgaggacctgaacctgcccaacgccgtgatcaccagaatcatcaaggaggccctgcccgacggcgtgaacatcagcaaggaggccagaagcgccatcagcagagccgccagcgtgttcgtgctgtacgccaccagctgcgccaacaacttcgccatgaagggcaagagaaagaccctgaacgccagcgacgtgctgagcgccatggaggagatggagttccagagattcgtgacccccctgaaggaggccctggaggcctacagaagagagcagaagggcaagaaggaggccagcgagcagaagaagaaggacaaggacaagaagaccgacagcgaggagcaggacaagagcagagacgaggacaacgacgaggacgaggagagactggaggaggaggagcagaacgaggaggaggaggtggacaactag

SEQ ID NO: 93854 - DNA, 444 bp, Artificial Sequence; identical to SEQ ID NO: 93853
  Description of Artificial Sequence: Synthetic coding sequence

SEQ ID NO: 93855 - DNA, 1245 bp, Artificial Sequence
  Description of Artificial Sequence: Synthetic coding sequence
atggccaccggccaggacagagtggtggccctggtggacatggactgcttcttcgtgcaggtggagcagagacagaacccccacctgagaaacaagccctgcgccgtggtgcagtacaagagctggaagggcggcggcatcatcgccgtgagctacgaggccagagccttcggcgtgaccagaagcatgtgggccgacgacgccaagaagctgtgccccgacctgctgctggcccaggtgagagagagcagaggcaaggccaacctgaccaagtacagagaggccagcgtggaggtgatggagatcatgagcagattcgccgtgatcgagagagccagcatcgacgaggcctacgtggacctgaccagcgccgtgcaggagagactgcagaagctgcagggccagcccatcagcgccgacctgctgcccagcacctacatcgagggcctgccccagggccccaccaccgccgaggagaccgtgcagaaggagggcatgagaaagcagggcctgttccagtggctggacagcctgcagatcgacaacctgaccagccccgacctgcagctgaccgtgggcgccgtgatcgtggaggagatgagagccgccatcgagagagagaccggcttccagtgcagcgccggcatcagccacaacaaggtgctggccaagctggcctgcggcctgaacaagcccaacagacagaccctggtgagccacggcagcgtgccccagctgttcagccagatgcccatcagaaagatcagaagcctgggcggcaagctgggcgccagcgtgatcgagatcctgggcatcgagtacatgggcgagctgacccagttcaccgagagccagctgcagagccacttcggcgagaagaacggcagctggctgtacgccatgtgcagaggcatcgagcacgaccccgtgaagcccagacagctgcccaagaccatcggctgcagcaagaacttccccggcaagaccgccctggccaccagagagcaggtgcagtggtggctgctgcagctggcccaggagctggaggagagactgaccaaggacagaaacgacaacgacagagtggccacccagctggtggtgagcatcagagtgcagggcgacaagagactgagcagcctgagaagatgctgcgccctgaccagatacgacgcccacaagatgagccacgacgccttcaccgtgatcaagaactgcaacaccagcggcatccagaccgagtag

SEQ ID NO: 93856 - DNA, 2142 bp, Artificial Sequence
  Description of Artificial Sequence: Synthetic coding sequence
atggccaccggccaggacagagtggtggccctggtggacatggactgcttcttcgtgcaggtggagcagagacagaacccccacctgagaaacaagccctgcgccgtggtgcagtacaagagctggaagggcggcggcatcatcgccgtgagctacgaggccagagccttcggcgtgaccagaagcatgtgggccgacgacgccaagaagctgtgccccgacctgctgctggcccaggtgagagagagcagaggcaaggccaacctgaccaagtacagagaggccagcgtggaggtgatggagatcatgagcagattcgccgtgatcgagagagccagcatcgacgaggcctacgtggacctgaccagcgccgtgcaggagagactgcagaagctgcagggccagcccatcagcgccgacctgctgcccagcacctacatcgagggcctgccccagggccccaccaccgccgaggagaccgtgcagaaggagggcatgagaaagcagggcctgttccagtggctggacagcctgcagatcgacaacctgaccagccccgacctgcagctgaccgtgggcgccgtgatcgtggaggagatgagagccgccatcgagagagagaccggcttccagtgcagcgccggcatcagccacaacaaggtgctggccaagctggcctgcggcctgaacaagcccaacagacagaccctggtgagccacggcagcgtgccccagctgttcagccagatgcccatcagaaagatcagaagcctgggcggcaagctgggcgccagcgtgatcgagatcctgggcatcgagtacatgggcgagctgacccagttcaccgagagccagctgcagagccacttcggcgagaagaacggcagctggctgtacgccatgtgcagaggcatcgagcacgaccccgtgaagcccagacagctgcccaagaccatcggctgcagcaagaacttccccggcaagaccgccctggccaccagagagcaggtgcagtggtggctgctgcagctggcccaggagctggaggagagactgaccaaggacagaaacgacaacgacagagtggccacccagctggtggtgagcatcagagtgcagggcgacaagagactgagcagcctgagaagatgctgcgccctgaccagatacgacgcccacaagatgagccacgacgccttcaccgtgatcaagaactgcaacaccagcggcatccagaccgagtggagcccccccctgaccatgctgttcctgtgcgccaccaagttcagcgccagcgcccccagcagcagcaccgacatcaccagcttcctgagcagcgaccccagcagcctgcccaaggtgcccgtgaccagcagcgaggccaagacccagggcagcggccccgccgtgaccgccaccaagaaggccaccaccagcctggagagcttcttccagaaggccgccgagagacagaaggtgaaggaggccagcctgagcagcctgaccgcccccacccaggcccccatgagcaacagccccagcaagcccagcctgcccttccagaccagccagagcaccggcaccgagcccttcttcaagcagaagagcctgctgctgaagcagaagcagctgaacaacagcagcgtgagcagcccccagcagaacccctggagcaactgcaaggccctgcccaacagcctgcccaccgagtaccccggctgcgtgcccgtgtgcgagggcgtgagcaagctggaggagagcagcaaggccacccccgccgagatggacctggcccacaacagccagagcatgcacgccagcagcgccagcaagagcgtgctggaggtgacccagaaggccacccccaaccccagcctgctggccgccgaggaccaggtgccctgcgagaagtgcggcagcctggtgcccgtgtgggacatgcccgagcacatggactaccacttcgccctggagctgcagaagagcttcctgcagccccacagcagcaacccccaggtggtgagcgccgtgagccaccagggcaagagaaaccccaagagccccctggcctgcaccaacaagagacccagacccgagggcatgcagaccctggagagcttcttcaagcccctgacccactag

SEQ ID NO: 93857 - DNA, 219 bp, Artificial Sequence
  Description of Artificial Sequence: Synthetic coding sequence
atgtgggccgacgacgccaagaagctgtgccccgacctgctgctggcccaggtgagagagagcagaggcaaggccaacctgaccaagtacagagaggccagcgtggaggtgatggagatcatgagcagattcgccgtgatcgagagagccagcatcgacgaggcctacgtggacctgaccagcgccgtgcaggagagactgcagaagctgcagggctag

SEQ ID NO: 93858 - DNA, 1956 bp, Artificial Sequence
  Description of Artificial Sequence: Synthetic coding sequence
atgtgggccgacgacgccaagaagctgtgccccgacctgctgctggcccaggtgagagagagcagaggcaaggccaacctgaccaagtacagagaggccagcgtggaggtgatggagatcatgagcagattcgccgtgatcgagagagccagcatcgacgaggcctacgtggacctgaccagcgccgtgcaggagagactgcagaagctgcagggccagcccatcagcgccgacctgctgcccagcacctacatcgagggcctgccccagggccccaccaccgccgaggagaccgtgcagaaggagggcatgagaaagcagggcctgttccagtggctggacagcctgcagatcgacaacctgaccagccccgacctgcagctgaccgtgggcgccgtgatcgtggaggagatgagagccgccatcgagagagagaccggcttccagtgcagcgccggcatcagccacaacaaggtgctggccaagctggcctgcggcctgaacaagcccaacagacagaccctggtgagccacggcagcgtgccccagctgttcagccagatgcccatcagaaagatcagaagcctgggcggcaagctgggcgccagcgtgatcgagatcctgggcatcgagtacatgggcgagctgacccagttcaccgagagccagctgcagagccacttcggcgagaagaacggcagctggctgtacgccatgtgcagaggcatcgagcacgaccccgtgaagcccagacagctgcccaagaccatcggctgcagcaagaacttccccggcaagaccgccctggccaccagagagcaggtgcagtggtggctgctgcagctggcccaggagctggaggagagactgaccaaggacagaaacgacaacgacagagtggccacccagctggtggtgagcatcagagtgcagggcgacaagagactgagcagcctgagaagatgctgcgccctgaccagatacgacgcccacaagatgagccacgacgccttcaccgtgatcaagaactgcaacaccagcggcatccagaccgagtggagcccccccctgaccatgctgttcctgtgcgccaccaagttcagcgccagcgcccccagcagcagcaccgacatcaccagcttcctgagcagcgaccccagcagcctgcccaaggtgcccgtgaccagcagcgaggccaagacccagggcagcggccccgccgtgaccgccaccaagaaggccaccaccagcctggagagcttcttccagaaggccgccgagagacagaaggtgaaggaggccagcctgagcagcctgaccgcccccacccaggcccccatgagcaacagccccagcaagcccagcctgcccttccagaccagccagagcaccggcaccgagcccttcttcaagcagaagagcctgctgctgaagcagaagcagctgaacaacagcagcgtgagcagcccccagcagaacccctggagcaactgcaaggccctgcccaacagcctgcccaccgagtaccccggctgcgtgcccgtgtgcgagggcgtgagcaagctggaggagagcagcaaggccacccccgccgagatggacctggcccacaacagccagagcatgcacgccagcagcgccagcaagagcgtgctggaggtgacccagaaggccacccccaaccccagcctgctggccgccgaggaccaggtgccctgcgagaagtgcggcagcctggtgcccgtgtgggacatgcccgagcacatggactaccacttcgccctggagctgcagaagagcttcctgcagccccacagcagcaacccccaggtggtgagcgccgtgagccaccagggcaagagaaaccccaagagccccctggcctgcaccaacaagagacccagacccgagggcatgcagaccctggagagcttcttcaagcccctgacccactag

SEQ ID NO: 93859 - DNA, 3720 bp, Artificial Sequence
  Description of Artificial Sequence: Synthetic coding sequence
atgagcagactgctgtggagaaaggtggccggcgccaccgtgggccccggccccgtgcccgcccccggcagatgggtgagcagcagcgtgcccgccagcgaccccagcgacggccagagaagaagacagcagcagcagcagcagcagcagcagcagcagcagcagccccagcagccccaggtgctgagcagcgagggcggccagctgagacacaaccccctggacatccagatgctgagcagaggcctgcacgagcagatcttcggccagggcggcgagatgcccggcgaggccgccgtgagaagaagcgtggagcacctgcagaagcacggcctgtggggccagcccgccgtgcccctgcccgacgtggagctgagactgccccccctgtacggcgacaacctggaccagcacttcagactgctggcccagaagcagagcctgccctacctggaggccgccaacctgctgctgcaggcccagctgccccccaagccccccgcctgggcctgggccgagggctggaccagatacggccccgagggcgaggccgtgcccgtggccatccccgaggagagagccctggtgttcgacgtggaggtgtgcctggccgagggcacctgccccaccctggccgtggccatcagccccagcgcctggtacagctggtgcagccagagactggtggaggagagatacagctggaccagccagctgagccccgccgacctgatccccctggaggtgcccaccggcgccagcagccccacccagagagactggcaggagcagctggtggtgggccacaacgtgagcttcgacagagcccacatcagagagcagtacctgatccagggcagcagaatgagattcctggacaccatgagcatgcacatggccatcagcggcctgagcagcttccagagaagcctgtggatcgccgccaagcagggcaagcacaaggtgcagccccccaccaagcagggccagaagagccagagaaaggccagaagaggccccgccatcagcagctgggactggctggacatcagcagcgtgaacagcctggccgaggtgcacagactgtacgtgggcggcccccccctggagaaggagcccagagagctgttcgtgaagggcaccatgaaggacatcagagagaacttccaggacctgatgcagtactgcgcccaggacgtgtgggccacccacgaggtgttccagcagcagctgcccctgttcctggagagatgcccccaccccgtgaccctggccggcatgctggagatgggcgtgagctacctgcccgtgaaccagaactgggagagatacctggccgaggcccagggcacctacgaggagctgcagagagagatgaagaagagcctgatggacctggccaacgacgcctgccagctgctgagcggcgagagatacaaggaggacccctggctgtgggacctggagtgggacctgcaggagttcaagcagaagaaggccaagaaggtgaagaaggagcccgccaccgccagcaagctgcccatcgagggcgccggcgcccccggcgaccccatggaccaggaggacctgggcccctgcagcgaggaggaggagttccagcaggacgtgatggccagagcctgcctgcagaagctgaagggcaccaccgagctgctgcccaagagaccccagcacctgcccggccaccccggctggtacagaaagctgtgccccagactggacgaccccgcctggacccccggccccagcctgctgagcctgcagatgagagtgacccccaagctgatggccctgacctgggacggcttccccctgcactacagcgagagacacggctggggctacctggtgcccggcagaagagacaacctggccaagctgcccaccggcaccaccctggagagcgccggcgtggtgtgcccctacagagccatcgagagcctgtacagaaagcactgcctggagcagggcaagcagcagctgatgccccaggaggccggcctggccgaggagttcctgctgaccgacaacagcgccatctggcagaccgtggaggagctggactacctggaggtggaggccgaggccaagatggagaacctgagagccgccgtgcccggccagcccctggccctgaccgccagaggcggccccaaggacacccagcccagctaccaccacggcaacggcccctacaacgacgtggacatccccggctgctggttcttcaagctgccccacaaggacggcaacagctgcaacgtgggcagccccttcgccaaggacttcctgcccaagatggaggacggcaccctgcaggccggccccggcggcgccagcggccccagagccctggagatcaacaagatgatcagcttctggagaaacgcccacaagagaatcagcagccagatggtggtgtggctgcccagaagcgccctgcccagagccgtgatcagacaccccgactacgacgaggagggcctgtacggcgccatcctgccccaggtggtgaccgccggcaccatcaccagaagagccgtggagcccacctggctgaccgccagcaacgccagacccgacagagtgggcagcgagctgaaggccatggtgcaggccccccccggctacaccctggtgggcgccgacgtggacagccaggagctgtggatcgccgccgtgctgggcgacgcccacttcgccggcatgcacggctgcaccgccttcggctggatgaccctgcagggcagaaagagcagaggcaccgacctgcacagcaagaccgccaccaccgtgggcatcagcagagagcacgccaagatcttcaactacggcagaatctacggcgccggccagcccttcgccgagagactgctgatgcagttcaaccacagactgacccagcaggaggccgccgagaaggcccagcagatgtacgccgccaccaagggcctgagatggtacagactgagcgacgagggcgagtggctggtgagagagctgaacctgcccgtggacagaaccgagggcggctggatcagcctgcaggacctgagaaaggtgcagagagagaccgccagaaagagccagtggaagaagtgggaggtggtggccgagagagcctggaagggcggcaccgagagcgagatgttcaacaagctggagagcatcgccaccagcgacatccccagaacccccgtgctgggctgctgcatcagcagagccctggagcccagcgccgtgcaggaggagttcatgaccagcagagtgaactgggtggtgcagagcagcgccgtggactacctgcacctgatgctggtggccatgaagtggctgttcgaggagttcgccatcgacggcagattctgcatcagcatccacgacgaggtgagatacctggtgagagaggaggacagatacagagccgccctggccctgcagatcaccaacctgctgaccagatgcatgttcgcctacaagctgggcctgaacgacctgccccagagcgtggccttcttcagcgccgtggacatcgacagatgcctgagaaaggaggtgaccatggactgcaagacccccagcaaccccaccggcatggagagaagatacggcatcccccagggcgaggccctggacatctaccagatcatcgagctgaccaagggcagcctggagaagagaagccagcccggcccctag

SEQ ID NO: 93860 - DNA, 3720 bp, Artificial Sequence; identical to SEQ ID NO: 93859
  Description of Artificial Sequence: Synthetic coding sequence

SEQ ID NO: 93861 - DNA, 1458 bp, Artificial Sequence
  Description of Artificial Sequence: Synthetic coding sequence
atgagaagcagagtggccgtgagagcctgccacaaggtgtgcagatgcctgctgagcggcttcggcggcagagtggacgccggccagcccgagctgctgaccgagagaagcagccccaagggcggccacgtgaagagccacgccgagctggagggcaacggcgagcaccccgaggcccccggcagcggcgagggcagcgaggccctgctggagatctgccagagaagacacttcctgagcggcagcaagcagcagctgagcagagacagcctgctgagcggctgccaccccggcttcggccccctgggcgtggagctgagaaagaacctggccgccgagtggtggaccagcgtggtggtgttcagagagcaggtgttccccgtggacgccctgcaccacaagcccggccccctgctgcccggcgacagcgccttcagactggtgagcgccgagaccctgagagagatcctgcaggacaaggagctgagcaaggagcagctggtggccttcctggagaacgtgctgaagaccagcggcaagctgagagagaacctgctgcacggcgccctggagcactacgtgaactgcctggacctggtgaacaagagactgccctacggcctggcccagatcggcgtgtgcttccaccccgtgttcgacaccaagcagatcagaaacggcgtgaagagcatcggcgagaagaccgaggccagcctggtgtggttcaccccccccagaaccagcaaccagtggctggacttctggctgagacacagactgcagtggtggagaaagttcgccatgagccccagcaacttcagcagcagcgactgccaggacgaggagggcagaaagggcaacaagctgtactacaacttcccctggggcaaggagctgatcgagaccctgtggaacctgggcgaccacgagctgctgcacatgtaccccggcaacgtgagcaagctgcacggcagagacggcagaaagaacgtggtgccctgcgtgctgagcgtgaacggcgacctggacagaggcatgctggcctacctgtacgacagcttccagctgaccgagaacagcttcaccagaaagaagaacctgcacagaaaggtgctgaagctgcacccctgcctggcccccatcaaggtggccctggacgtgggcagaggccccaccctggagctgagacaggtgtgccagggcctgttcaacgagctgctggagaacggcatcagcgtgtggcccggctacctggagaccatgcagagcagcctggagcagctgtacagcaagtacgacgagatgagcatcctgttcaccgtgctggtgaccgagaccaccctggagaacggcctgatccacctgagaagcagagacaccaccatgaaggagatgatgcacatcagcaagctgaaggacttcctgatcaagtacatcagcagcgccaagaacgtgtag

SEQ ID NO: 93862 - DNA, 7773 bp, Artificial Sequence
  Description of Artificial Sequence: Synthetic coding sequence
atgaacctgctgagaagaagcggcaagagaagaagaagcgagagcggcagcgacagcttcagcggcagcggcggcgacagcagcgccagcccccagttcctgagcggcagcgtgctgagccccccccccggcctgggcagatgcctgaaggccgccgccgccggcgagtgcaagcccaccgtgcccgactacgagagagacaagctgctgctggccaactggggcctgcccaaggccgtgctggagaagtaccacagcttcggcgtgaagaagatgttcgagtggcaggccgagtgcctgctgctgggccaggtgctggagggcaagaacctggtgtacagcgcccccaccagcgccggcaagaccctggtggccgagctgctgatcctgaagagagtgctggagatgagaaagaaggccctgttcatcctgcccttcgtgagcgtggccaaggagaagaagtactacctgcagagcctgttccaggaggtgggcatcaaggtggacggctacatgggcagcaccagccccagcagacacttcagcagcctggacatcgccgtgtgcaccatcgagagagccaacggcctgatcaacagactgatcgaggagaacaagatggacctgctgggcatggtggtggtggacgagctgcacatgctgggcgacagccacagaggctacctgctggagctgctgctgaccaagatctgctacatcaccagaaagagcgccagctgccaggccgacctggccagcagcctgagcaacgccgtgcagatcgtgggcatgagcgccaccctgcccaacctggagctggtggccagctggctgaacgccgagctgtaccacaccgacttcagacccgtgcccctgctggagagcgtgaaggtgggcaacagcatctacgacagcagcatgaagctggtgagagagttcgagcccatgctgcaggtgaagggcgacgaggaccacgtggtgagcctgtgctacgagaccatctgcgacaaccacagcgtgctgctgttctgccccagcaagaagtggtgcgagaagctggccgacatcatcgccagagagttctacaacctgcaccaccaggccgagggcctggtgaagcccagcgagtgcccccccgtgatcctggagcagaaggagctgctggaggtgatggaccagctgagaagactgcccagcggcctggacagcgtgctgcagaagaccgtgccctggggcgtggccttccaccacgccggcctgaccttcgaggagagagacatcatcgagggcgccttcagacagggcctgatcagagtgctggccgccaccagcaccctgagcagcggcgtgaacctgcccgccagaagagtgatcatcagaacccccatcttcggcggcagacccctggacatcctgacctacaagcagatggtgggcagagccggcagaaagggcgtggacaccgtgggcgagagcatcctgatctgcaagaacagcgagaagagcaagggcatcgccctgctgcagggcagcctgaagcccgtgagaagctgcctgcagagaagagagggcgaggaggtgaccggcagcatgatcagagccatcctggagatcatcgtgggcggcgtggccagcaccagccaggacatgcacacctacgccgcctgcaccttcctggccgccagcatgaaggagggcaagcagggcatccagagaaaccaggagagcgtgcagctgggcgccatcgaggcctgcgtgatgtggctgctggagaacgagttcatccagagcaccgaggccagcgacggcaccgagggcaaggtgtaccaccccacccacctgggcagcgccaccctgagcagcagcctgagccccgccgacaccctggacatcttcgccgacctgcagagagccatgaagggcttcgtgctggagaacgacctgcacatcctgtacctggtgacccccatgttcgaggactggaccaccatcgactggtacagattcttctgcctgtgggagaagctgcccaccagcatgaagagagtggccgagctggtgggcgtggaggagggcttcctggccagatgcgtgaagggcaaggtggtggccagaaccgagagacagcacagacagatggccatccacaagagattcttcaccagcctggtgctgctggacctgatcagcgaggtgcccctgagagagatcaaccagaagtacggctgcaacagaggccagatccagagcctgcagcagagcgccgccgtgtacgccggcatgatcaccgtgttcagcaacagactgggctggcacaacatggagctgctgctgagccagttccagaagagactgaccttcggcatccagagagagctgtgcgacctggtgagagtgagcctgctgaacgcccagagagccagagtgctgtacgccagcggcttccacaccgtggccgacctggccagagccaacatcgtggaggtggaggtgatcctgaagaacgccgtgcccttcaagagcgccagaaaggccgtggacgaggaggaggaggccgtggaggagagaagaaacatgagaaccatctgggtgaccggcagaaagggcctgaccgagagagaggccgccgccctgatcgtggaggaggccagaatgatcctgcagcaggacctggtggagatgggcgtgcagtggaacccctgcgccctgctgcacagcagcacctgcagcctgacccacagcgagagcgaggtgaaggagcacaccttcatcagccagaccaagagcagctacaagaagctgaccagcaagaacaagagcaacaccatcttcagcgacagctacatcaagcacagccccaacatcgtgcaggacctgaacaagagcagagagcacaccagcagcttcaactgcaacttccagaacggcaaccaggagcaccagacctgcagcatcttcagagccagaaagagagccagcctggacatcaacaaggagaagcccggcgccagccagaacgagggcaagaccagcgacaagaaggtggtgcagaccttcagccagaagaccaagaaggcccccctgaacttcaacagcgagaagatgagcagaagcttcagaagctggaagagaagaaagcacctgaagagaagcagagacagcagccccctgaaggacagcggcgcctgcagaatccacctgcagggccagaccctgagcaaccccagcctgtgcgaggaccccttcaccctggacgagaagaagaccgagttcagaaacagcggccccttcgccaagaacgtgagcctgagcggcaaggagaaggacaacaagaccagcttccccctgcagatcaagcagaactgcagctggaacatcaccctgaccaacgacaacttcgtggagcacatcgtgaccggcagccagagcaagaacgtgacctgccaggccaccagcgtggtgagcgagaagggcagaggcgtggccgtggaggccgagaagatcaacgaggtgctgatccagaacggcagcaagaaccagaacgtgtacatgaagcaccacgacatccaccccatcaaccagtacctgagaaagcagagccacgagcagaccagcaccatcaccaagcagaagaacatcatcgagagacagatgccctgcgaggccgtgagcagctacatcaacagagacagcaacgtgaccatcaactgcgagagaatcaagctgaacaccgaggagaacaagcccagccacttccaggccctgggcgacgacatcagcagaaccgtgatccccagcgaggtgctgcccagcgccggcgccttcagcaagagcgagggccagcacgagaacttcctgaacatcagcagactgcaggagaagaccggcacctacaccaccaacaagaccaagaacaaccacgtgagcgacctgggcctggtgctgtgcgacttcgaggacagcttctacctggacacccagagcgagaagatcatccagcagatggccaccgagaacgccaagctgggcgccaaggacaccaacctggccgccggcatcatgcagaagagcctggtgcagcagaacagcatgaacagcttccagaaggagtgccacatccccttccccgccgagcagcaccccctgggcgccaccaagatcgaccacctggacctgaagaccgtgggcaccatgaagcagagcagcgacagccacggcgtggacatcctgacccccgagagccccatcttccacagccccatcctgctggaggagaacggcctgttcctgaagaagaacgaggtgagcgtgaccgacagccagctgaacagcttcctgcagggctaccagacccaggagaccgtgaagcccgtgatcctgctgatcccccagaagagaacccccaccggcgtggagggcgagtgcctgcccgtgcccgagaccagcctgaacatgagcgacagcctgctgttcgacagcttcagcgacgactacctggtgaaggagcagctgcccgacatgcagatgaaggagcccctgcccagcgaggtgaccagcaaccacttcagcgacagcctgtgcctgcaggaggacctgatcaagaagagcaacgtgaacgagaaccaggacacccaccagcagctgacctgcagcaacgacgagagcatcatcttcagcgagatggacagcgtgcagatggtggaggccctggacaacgtggacatcttccccgtgcaggagaagaaccacaccgtggtgagccccagagccctggagctgagcgaccccgtgctggacgagcaccaccagggcgaccaggacggcggcgaccaggacgagagagccgagaagagcaagctgaccggcaccagacagaaccacagcttcatctggagcggcgccagcttcgacctgagccccggcctgcagagaatcctggacaaggtgagcagccccctggagaacgagaagctgaagagcatgaccatcaacttcagcagcctgaacagaaagaacaccgagctgaacgaggagcaggaggtgatcagcaacctggagaccaagcaggtgcagggcatcagcttcagcagcaacaacgaggtgaagagcaagatcgagatgctggagaacaacgccaaccacgacgagaccagcagcctgctgcccagaaaggagagcaacatcgtggacgacaacggcctgatcccccccacccccatccccaccagcgccagcaagctgaccttccccggcatcctggagacccccgtgaacccctggaagaccaacaacgtgctgcagcccggcgagagctacctgttcggcagccccagcgacatcaagaaccacgacctgagccccggcagcagaaacggcttcaaggacaacagccccatcagcgacaccagcttcagcctgcagctgagccaggacggcctgcagctgacccccgccagcagcagcagcgagagcctgagcatcatcgacgtggccagcgaccagaacctgttccagaccttcatcaaggagtggagatgcaagaagagattcagcatcagcctggcctgcgagaagatcagaagcctgaccagcagcaagaccgccaccatcggcagcagattcaagcaggccagcagcccccaggagatccccatcagagacgacggcttccccatcaagggctgcgacgacaccctggtggtgggcctggccgtgtgctggggcggcagagacgcctactacttcagcctgcagaaggagcagaagcacagcgagatcagcgccagcctggtgccccccagcctggaccccagcctgaccctgaaggacagaatgtggtacctgcagagctgcctgagaaaggagagcgacaaggagtgcagcgtggtgatctacgacttcatccagagctacaagatcctgctgctgagctgcggcatcagcctggagcagagctacgaggaccccaaggtggcctgctggctgctggaccccgacagccaggagcccaccctgcacagcatcgtgaccagcttcctgccccacgagctgcccctgctggagggcatggagaccagccagggcatccagagcctgggcctgaacgccggcagcgagcacagcggcagatacagagccagcgtggagagcatcctgatcttcaacagcatgaaccagctgaacagcctgctgcagaaggagaacctgcaggacgtgttcagaaaggtggagatgcccagccagtactgcctggccctgctggagctgaacggcatcggcttcagcaccgccgagtgcgagagccagaagcacatcatgcaggccaagctggacgccatcgagacccaggcctaccagctggccggccacagcttcagcttcaccagcagcgacgacatcgccgaggtgctgttcctggagctgaagctgccccccaacagagagatgaagaaccagggcagcaagaagaccctgggcagcaccagaagaggcatcgacaacggcagaaagctgagactgggcagacagttcagcaccagcaaggacgtgctgaacaagctgaaggccctgcaccccctgcccggcctgatcctggagtggagaagaatcaccaacgccatcaccaaggtggtgttccccctgcagagagagaagtgcctgaaccccttcctgggcatggagagaatctaccccgtgagccagagccacaccgccaccggcagaatcaccttcaccgagcccaacatccagaacgtgcccagagacttcgagatcaagatgcccaccctggtgggcgagagcccccccagccaggccgtgggcaagggcctgctgcccatgggcagaggcaagtacaagaagggcttcagcgtgaaccccagatgccaggcccagatggaggagagagccgccgacagaggcatgcccttcagcatcagcatgagacacgccttcgtgcccttccccggcggcagcatcctggccgccgactacagccagctggagctgagaatcctggcccacctgagccacgacagaagactgatccaggtgctgaacaccggcgccgacgtgttcagaagcatcgccgccgagtggaagatgatcgagcccgagagcgtgggcgacgacctgagacagcaggccaagcagatctgctacggcatcatctacggcatgggcgccaagagcctgggcgagcagatgggcatcaaggagaacgacgccgcctgctacatcgacagcttcaagagcagatacaccggcatcaaccagttcatgaccgagaccgtgaagaactgcaagagagacggcttcgtgcagaccatcctgggcagaagaagatacctgcccggcatcaaggacaacaacccctacagaaaggcccacgccgagagacaggccatcaacaccatcgtgcagggcagcgccgccgacatcgtgaagatcgccaccgtgaacatccagaagcagctggagaccttccacagcaccttcaagagccacggccacagagagggcatgctgcagagcgaccagaccggcctgagcagaaagagaaagctgcagggcatgttctgccccatcagaggcggcttcttcatcctgcagctgcacgacgagctgctgtacgaggtggccgaggaggacgtggtgcaggtggcccagatcgtgaagaacgagatggagagcgccgtgaagctgagcgtgaagctgaaggtgaaggtgaagatcggcgccagctggggcgagctgaaggacttcgacgtgtag

SEQ ID NO: 93863 - DNA, 8181 bp, Artificial Sequence
  Description of Artificial Sequence: Synthetic coding sequence
atgaacggccacagattcaccttcagaaccagaagcctgctgcccctgcagaagggccagcacagatgcatcaccaagctgctggcccacaacgacccctggggcatcttcagagcccccagcagcagaagaagctacagcgtgagcggcgtgtgccagcccgccatccccaacagcagcctgcacatcccccacaacgcctgctggctgaagtggaagctgtgcagcgagatcgccctgccctaccaccacatcctgggcgagagaagaaagctgtgcagcatcagaagattcgagttcgaggactggagagaggacgtgagaagctgctgccaggccagagtgctgcccagaggcagaaccctgggcctgtggctggccctgatcggcagagaggagttcgccatgaacctgctgagaagaagcggcaagagaagaagaagcgagagcggcagcgacagcttcagcggcagcggcggcgacagcagcgccagcccccagttcctgagcggcagcgtgctgagccccccccccggcctgggcagatgcctgaaggccgccgccgccggcgagtgcaagcccaccgtgcccgactacgagagagacaagctgctgctggccaactggggcctgcccaaggccgtgctggagaagtaccacagcttcggcgtgaagaagatgttcgagtggcaggccgagtgcctgctgctgggccaggtgctggagggcaagaacctggtgtacagcgcccccaccagcgccggcaagaccctggtggccgagctgctgatcctgaagagagtgctggagatgagaaagaaggccctgttcatcctgcccttcgtgagcgtggccaaggagaagaagtactacctgcagagcctgttccaggaggtgggcatcaaggtggacggctacatgggcagcaccagccccagcagacacttcagcagcctggacatcgccgtgtgcaccatcgagagagccaacggcctgatcaacagactgatcgaggagaacaagatggacctgctgggcatggtggtggtggacgagctgcacatgctgggcgacagccacagaggctacctgctggagctgctgctgaccaagatctgctacatcaccagaaagagcgccagctgccaggccgacctggccagcagcctgagcaacgccgtgcagatcgtgggcatgagcgccaccctgcccaacctggagctggtggccagctggctgaacgccgagctgtaccacaccgacttcagacccgtgcccctgctggagagcgtgaaggtgggcaacagcatctacgacagcagcatgaagctggtgagagagttcgagcccatgctgcaggtgaagggcgacgaggaccacgtggtgagcctgtgctacgagaccatctgcgacaaccacagcgtgctgctgttctgccccagcaagaagtggtgcgagaagctggccgacatcatcgccagagagttctacaacctgcaccaccaggccgagggcgagggcctggtgaagcccagcgagtgcccccccgtgatcctggagcagaaggagctgctggaggtgatggaccagctgagaagactgcccagcggcctggacagcgtgctgcagaagaccgtgccctggggcgtggccttccaccacgccggcctgaccttcgaggagagagacatcatcgagggcgccttcagacagggcctgatcagagtgctggccgccaccagcaccctgagcagcggcgtgaacctgcccgccagaagagtgatcatcagaacccccatcttcggcggcagacccctggacatcctgacctacaagcagatggtgggcagagccggcagaaagggcgtggacaccgtggagagcatcctgatctgcaagaacagcgagaagagcaagggcatcgccctgctgcagggcagcctgaagcccgtgagaagctgcctgcagagaagagagggcgaggaggtgaccggcagcatgatcagagccatcctggagatcatcgtgggcggcgtggccagcaccagccaggacatgcacacctacgccgcctgcaccttcctggccgccagcatgaaggagggcaagcagggcatccagagaaaccaggagagcgtgcagctgggcgccatcgaggcctgcgtgatgtggctgctggagaacgagttcatccagagcaccgaggccagcgacggcaccgagggcaaggtgtaccaccccacccacctgggcagcgccaccctgagcagcagcctgagccccgccgacaccctggacatcttcgccgacctgcagagagccatgaagggcttcgtgctggagaacgacctgcacatcctgtacctggtgacccccatgttcgaggactggaccaccatcgactggtacagattcttctgcctgtgggagaagctgcccaccagcatgaagagagtggccgagctggtgggcgtggaggagggcttcctggccagatgcgtgaagggcaaggtggtggccagaaccgagagacagcacagacagatggccatccacaagagattcttcaccagcctggtgctgctggacctgatcagcgaggtgcccctgagagagatcaaccagaagtacggctgcaacagaggccagatccagagcctgcagcagagcgccgccgtgtacgccggcatgatcaccgtgttcagcaacagactgggctggcacaacatggagctgctgctgagccagttccagaagagactgaccttcggcatccagagagagctgtgcgacctggtgagagtgagcctgctgaacgcccagagagccagagtgctgtacgccagcggcttccacaccgtggccgacctggccagagccaacatcgtggaggtggaggtgatcctgaagaacgccgtgcccttcaagagcgccagaaaggccgtggacgaggaggaggaggccgtggaggagagaagaaacatgagaaccatctgggtgaccggcagaaagggcctgaccgagagagaggccgccgccctgatcgtggaggaggccagaatgatcctgcagcaggacctggtggagatgggcgtgcagtggaacccctgcgccctgctgcacagcagcacctgcagcctgacccacagcgagagcgaggtgaaggagcacaccttcatcagccagaccaagagcagctacaagaagctgaccagcaagaacaagagcaacaccatcttcagcgacagctacatcaagcacagccccaacatcgtgcaggacctgaacaagagcagagagcacaccagcagcttcaactgcaacttccagaacggcaaccaggagcaccagacctgcagcatcttcagagccagaaagagagccagcctggacatcaacaaggagaagcccggcgccagccagaacgagggcaagaccagcgacaagaaggtggtgcagaccttcagccagaagaccaagaaggcccccctgaacttcaacagcgagaagatgagcagaagcttcagaagctggaagagaagaaagcacctgaagagaagcagagacagcagccccctgaaggacagcggcgcctgcagaatccacctgcagggccagaccctgagcaaccccagcctgtgcgaggaccccttcaccctggacgagaagaagaccgagttcagaaacagcggccccttcgccaagaacgtgagcctgagcggcaaggagaaggacaacaagaccagcttccccctgcagatcaagcagaactgcagctggaacatcaccctgaccaacgacaacttcgtggagcacatcgtgaccggcagccagagcaagaacgtgacctgccaggccaccagcgtggtgagcgagaagggcagaggcgtggccgtggaggccgagaagatcaacgaggtgctgatccagaacggcagcaagaaccagaacgtgtacatgaagcaccacgacatccaccccatcaaccagtacctgagaaagcagagccacgagcagaccagcaccatcaccaagcagaagaacatcatcgagagacagatgccctgcgaggccgtgagcagctacatcaacagagacagcaacgtgaccatcaactgcgagagaatcaagctgaacaccgaggagaacaagcccagccacttccaggccctgggcgacgacatcagcagaaccgtgatccccagcgaggtgctgcccagcgccggcgccttcagcaagagcgagggccagcacgagaacttcctgaacatcagcagactgcaggagaagaccggcacctacaccaccaacaagaccaagaacaaccacgtgagcgacctgggcctggtgctgtgcgacttcgaggacagcttctacctggacacccagagcgagaagatcatccagcagatggccaccgagaacgccaagctgggcgccaaggacaccaacctggccgccggcatcatgcagaagagcctggtgcagcagaacagcatgaacagcttccagaaggagtgccacatccccttccccgccgagcagcaccccctgggcgccaccaagatcgaccacctggacctgaagaccgtgggcaccatgaagcagagcagcgacagccacggcgtggacatcctgacccccgagagccccatcttccacagccccatcctgctggaggagaacggcctgttcctgaagaagaacgaggtgagcgtgaccgacagccagctgaacagcttcctgcagggctaccagacccaggagaccgtgaagcccgtgatcctgctgatcccccagaagagaacccccaccggcgtggagggcgagtgcctgcccgtgcccgagaccagcctgaacatgagcgacagcctgctgttcgacagcttcagcgacgactacctggtgaaggagcagctgcccgacatgcagatgaaggagcccctgcccagcgaggtgaccagcaaccacttcagcgacagcctgtgcctgcaggaggacctgatcaagaagagcaacgtgaacgagaaccaggacacccaccagcagctgacctgcagcaacgacgagagcatcatcttcagcgagatggacagcgtgcagatggtggaggccctggacaacgtggacatcttccccgtgcaggagaagaaccacaccgtggtgagccccagagccctggagctgagcgaccccgtgctggacgagcaccaccagggcgaccaggacggcggcgaccaggacgagagagccgagaagagcaagctgaccggcaccagacagaaccacagcttcatctggagcggcgccagcttcgacctgagccccggcctgcagagaatcctggacaaggtgagcagccccctggagaacgagaagctgaagagcatgaccatcaacttcagcagcctgaacagaaagaacaccgagctgaacgaggagcaggaggtgatcagcaacctggagaccaagcaggtgcagggcatcagcttcagcagcaacaacgaggtgaagagcaagatcgagatgctggagaacaacgccaaccacgacgagaccagcagcctgctgcccagaaaggagagcaacatcgtggacgacaacggcctgatcccccccacccccatccccaccagcgccagcaagctgaccttccccggcatcctggagacccccgtgaacccctggaagaccaacaacgtgctgcagcccggcgagagctacctgttcggcagccccagcgacatcaagaaccacgacctgagccccggcagcagaaacggcttcaaggacaacagccccatcagcgacaccagcttcagcctgcagctgagccaggacggcctgcagctgacccccgccagcagcagcagcgagagcctgagcatcatcgacgtggccagcgaccagaacctgttccagaccttcatcaaggagtggagatgcaagaagagattcagcatcagcctggcctgcgagaagatcagaagcctgaccagcagcaagaccgccaccatcggcagcagattcaagcaggccagcagcccccaggagatccccatcagagacgacggcttccccatcaagggctgcgacgacaccctggtggtgggcctggccgtgtgctggggcggcagagacgcctactacttcagcctgcagaaggagcagaagcacagcgagatcagcgccagcctggtgccccccagcctggaccccagcctgaccctgaaggacagaatgtggtacctgcagagctgcctgagaaaggagagcgacaaggagtgcagcgtggtgatctacgacttcatccagagctacaagatcctgctgctgagctgcggcatcagcctggagcagagctacgaggaccccaaggtggcctgctggctgctggaccccgacagccaggagcccaccctgcacagcatcgtgaccagcttcctgccccacgagctgcccctgctggagggcatggagaccagccagggcatccagagcctgggcctgaacgccggcagcgagcacagcggcagatacagagccagcgtggagagcatcctgatcttcaacagcatgaaccagctgaacagcctgctgcagaaggagaacctgcaggacgtgttcagaaaggtggagatgcccagccagtactgcctggccctgctggagctgaacggcatcggcttcagcaccgccgagtgcgagagccagaagcacatcatgcaggccaagctggacgccatcgagacccaggcctaccagctggccggccacagcttcagcttcaccagcagcgacgacatcgccgaggtgctgttcctggagctgaagctgccccccaacagagagatgaagaaccagggcagcaagaagaccctgggcagcaccagaagaggcatcgacaacggcagaaagctgagactgggcagacagttcagcaccagcaaggacgtgctgaacaagctgaaggccctgcaccccctgcccggcctgatcctggagtggagaagaatcaccaacgccatcaccaaggtggtgttccccctgcagagagagaagtgcctgaaccccttcctgggcatggagagaatctaccccgtgagccagagccacaccgccaccggcagaatcaccttcaccgagcccaacatccagaacgtgcccagagacttcgagatcaagatgcccaccctggtgggcgagagcccccccagccaggccgtgggcaagggcctgctgcccatgggcagaggcaagtacaagaagggcttcagcgtgaaccccagatgccaggcccagatggaggagagagccgccgacagaggcatgcccttcagcatcagcatgagacacgccttcgtgcccttccccggcggcagcatcctggccgccgactacagccagctggagctgagaatcctggcccacctgagccacgacagaagactgatccaggtgctgaacaccggcgccgacgtgttcagaagcatcgccgccgagtggaagatgatcgagcccgagagcgtgggcgacgacctgagacagcaggccaagcagatctgctacggcatcatctacggcatgggcgccaagagcctgggcgagcagatgggcatcaaggagaacgacgccgcctgctacatcgacagcttcaagagcagatacaccggcatcaaccagttcatgaccgagaccgtgaagaactgcaagagagacggcttcgtgcagaccatcctgggcagaagaagatacctgcccggcatcaaggacaacaacccctacagaaaggcccacgccgagagacaggccatcaacaccatcgtgcagggcagcgccgccgacatcgtgaagatcgccaccgtgaacatccagaagcagctggagaccttccacagcaccttcaagagccacggccacagagagggcatgctgcagagcgaccagaccggcctgagcagaaagagaaagctgcagggcatgttctgccccatcagaggcggcttcttcatcctgcagctgcacgacgagctgctgtacgaggtggccgaggaggacgtggtgcaggtggcccagatcgtgaagaacgagatggagagcgccgtgaagctgagcgtgaagctgaaggtgaaggtgaagatcggcgccagctggggcgagctgaaggacttcgacgtgtag

SEQ ID NO: 93864 - DNA, 6642 bp, Artificial Sequence
  Description of Artificial Sequence: Synthetic coding sequence
atgcccaccagcaacagccagaaggagctgctggaggtgatggaccagctgagaagactgcccagcggcctggacagcgtgctgcagaagaccgtgccctggggcgtggccttccaccacgccggcctgaccttcgaggagagagacatcatcgagggcgccttcagacagggcctgatcagagtgctggccgccaccagcaccctgagcagcggcgtgaacctgcccgccagaagagtgatcatcagaacccccatcttcggcggcagacccctggacatcctgacctacaagcagatggtgggcagagccggcagaaagggcgtggacaccgtgggcgagagcatcctgatctgcaagaacagcgagaagagcaagggcatcgccctgctgcagggcagcctgaagcccgtgagaagctgcctgcagagaagagagggcgaggaggtgaccggcagcatgatcagagccatcctggagatcatcgtgggcggcgtggccagcaccagccaggacatgcacacctacgccgcctgcaccttcctggccgccagcatgaaggagggcaagcagggcatccagagaaaccaggagagcgtgcagctgggcgccatcgaggcctgcgtgatgtggctgctggagaacgagttcatccagagcaccgaggccagcgacggcaccgagggcaaggtgtaccaccccacccacctgggcagcgccaccctgagcagcagcctgagccccgccgacaccctggacatcttcgccgacctgcagagagccatgaagggcttcgtgctggagaacgacctgcacatcctgtacctggtgacccccatgttcgaggactggaccaccatcgactggtacagattcttctgcctgtgggagaagctgcccaccagcatgaagagagtggccgagctggtgggcgtggaggagggcttcctggccagatgcgtgaagggcaaggtggtggccagaaccgagagacagcacagacagatggccatccacaagagattcttcaccagcctggtgctgctggacctgatcagcgaggtgcccctgagagagatcaaccagaagtacggctgcaacagaggccagatccagagcctgcagcagagcgccgccgtgtacgccggcatgatcaccgtgttcagcaacagactgggctggcacaacatggagctgctgctgagccagttccagaagagactgaccttcggcatccagagagagctgtgcgacctggtgagagtgagcctgctgaacgcccagagagccagagtgctgtacgccagcggcttccacaccgtggccgacctggccagagccaacatcgtggaggtggaggtgatcctgaagaacgccgtgcccttcaagagcgccagaaaggccgtggacgaggaggaggaggccgtggaggagagaagaaacatgagaaccatctgggtgaccggcagaaagggcctgaccgagagagaggccgccgccctgatcgtggaggaggccagaatgatcctgcagcaggacctggtggagatgggcgtgcagtggaacccctgcgccctgctgcacagcagcacctgcagcctgacccacagcgagagcgaggtgaaggagcacaccttcatcagccagaccaagagcagctacaagaagctgaccagcaagaacaagagcaacaccatcttcagcgacagctacatcaagcacagccccaacatcgtgcaggacctgaacaagagcagagagcacaccagcagcttcaactgcaacttccagaacggcaaccaggagcaccagacctgcagcatcttcagagccagaaagagagccagcctggacatcaacaaggagaagcccggcgccagccagaacgagggcaagaccagcgacaagaaggtggtgcagaccttcagccagaagaccaagaaggcccccctgaacttcaacagcgagaagatgagcagaagcttcagaagctggaagagaagaaagcacctgaagagaagcagagacagcagccccctgaaggacagcggcgcctgcagaatccacctgcagggccagaccctgagcaaccccagcctgtgcgaggaccccttcaccctggacgagaagaagaccgagttcagaaacagcggccccttcgccaagaacgtgagcctgagcggcaaggagaaggacaacaagaccagcttccccctgcagatcaagcagaactgcagctggaacatcaccctgaccaacgacaacttcgtggagcacatcgtgaccggcagccagagcaagaacgtgacctgccaggccaccagcgtggtgagcgagaagggcagaggcgtggccgtggaggccgagaagatcaacgaggtgctgatccagaacggcagcaagaaccagaacgtgtacatgaagcaccacgacatccaccccatcaaccagtacctgagaaagcagagccacgagcagaccagcaccatcaccaagcagaagaacatcatcgagagacagatgccctgcgaggccgtgagcagctacatcaacagagacagcaacgtgaccatcaactgcgagagaatcaagctgaacaccgaggagaacaagcccagccacttccaggccctgggcgacgacatcagcagaaccgtgatccccagcgaggtgctgcccagcgccggcgccttcagcaagagcgagggccagcacgagaacttcctgaacatcagcagactgcaggagaagaccggcacctacaccaccaacaagaccaagaacaaccacgtgagcgacctgggcctggtgctgtgcgacttcgaggacagcttctacctggacacccagagcgagaagatcatccagcagatggccaccgagaacgccaagctgggcgccaaggacaccaacctggccgccggcatcatgcagaagagcctggtgcagcagaacagcatgaacagcttccagaaggagtgccacatccccttccccgccgagcagcaccccctgggcgccaccaagatcgaccacctggacctgaagaccgtgggcaccatgaagcagagcagcgacagccacggcgtggacatcctgacccccgagagccccatcttccacagccccatcctgctggaggagaacggcctgttcctgaagaagaacgaggtgagcgtgaccgacagccagctgaacagcttcctgcagggctaccagacccaggagaccgtgaagcccgtgatcctgctgatcccccagaagagaacccccaccggcgtggagggcgagtgcctgcccgtgcccgagaccagcctgaacatgagcgacagcctgctgttcgacagcttcagcgacgactacctggtgaaggagcagctgcccgacatgcagatgaaggagcccctgcccagcgaggtgaccagcaaccacttcagcgacagcctgtgcctgcaggaggacctgatcaagaagagcaacgtgaacgagaaccaggacacccaccagcagctgacctgcagcaacgacgagagcatcatcttcagcgagatggacagcgtgcagatggtggaggccctggacaacgtggacatcttccccgtgcaggagaagaaccacaccgtggtgagccccagagccctggagctgagcgaccccgtgctggacgagcaccaccagggcgaccaggacggcggcgaccaggacgagagagccgagaagagcaagctgaccggcaccagacagaaccacagcttcatctggagcggcgccagcttcgacctgagccccggcctgcagagaatcctggacaaggtgagcagccccctggagaacgagaagctgaagagcatgaccatcaacttcagcagcctgaacagaaagaacaccgagctgaacgaggagcaggaggtgatcagcaacctggagaccaagcaggtgcagggcatcagcttcagcagcaacaacgaggtgaagagcaagatcgagatgctggagaacaacgccaaccacgacgagaccagcagcctgctgcccagaaaggagagcaacatcgtggacgacaacggcctgatcccccccacccccatccccaccagcgccagcaagctgaccttccccggcatcctggagacccccgtgaacccctggaagaccaacaacgtgctgcagcccggcgagagctacctgttcggcagccccagcgacatcaagaaccacgacctgagccccggcagcagaaacggcttcaaggacaacagccccatcagcgacaccagcttcagcctgcagctgagccaggacggcctgcagctgacccccgccagcagcagcagcgagagcctgagcatcatcgacgtggccagcgaccagaacctgttccagaccttcatcaaggagtggagatgcaagaagagattcagcatcagcctggcctgcgagaagatcagaagcctgaccagcagcaagaccgccaccatcggcagcagattcaagcaggccagcagcccccaggagatccccatcagagacgacggcttccccatcaagggctgcgacgacaccctggtggtgggcctggccgtgtgctggggcggcagagacgcctactacttcagcctgcagaaggagcagaagcacagcgagatcagcgccagcctggtgccccccagcctggaccccagcctgaccctgaaggacagaatgtggtacctgcagagctgcctgagaaaggagagcgacaaggagtgcagcgtggtgatctacgacttcatccagagctacaagatcctgctgctgagctgcggcatcagcctggagcagagctacgaggaccccaaggtggcctgctggctgctggaccccgacagccaggagcccaccctgcacagcatcgtgaccagcttcctgccccacgagctgcccctgctggagggcatggagaccagccagggcatccagagcctgggcctgaacgccggcagcgagcacagcggcagatacagagccagcgtggagagcatcctgatcttcaacagcatgaaccagctgaacagcctgctgcagaaggagaacctgcaggacgtgttcagaaaggtggagatgcccagccagtactgcctggccctgctggagctgaacggcatcggcttcagcaccgccgagtgcgagagccagaagcacatcatgcaggccaagctggacgccatcgagacccaggcctaccagctggccggccacagcttcagcttcaccagcagcgacgacatcgccgaggtgctgttcctggagctgaagctgccccccaacagagagatgaagaaccagggcagcaagaagaccctgggcagcaccagaagaggcatcgacaacggcagaaagctgagactgggcagacagttcagcaccagcaaggacgtgctgaacaagctgaaggccctgcaccccctgcccggcctgatcctggagtggagaagaatcaccaacgccatcaccaaggtggtgttccccctgcagagagagaagtgcctgaaccccttcctgggcatggagagaatctaccccgtgagccagagccacaccgccaccggcagaatcaccttcaccgagcccaacatccagaacgtgcccagagacttcgagatcaagatgcccaccctggtgggcgagagcccccccagccaggccgtgggcaagggcctgctgcccatgggcagaggcaagtacaagaagggcttcagcgtgaaccccagatgccaggcccagatggaggagagagccgccgacagaggcatgcccttcagcatcagcatgagacacgccttcgtgcccttccccggcggcagcatcctggccgccgactacagccagctggagctgagaatcctggcccacctgagccacgacagaagactgatccaggtgctgaacaccggcgccgacgtgttcagaagcatcgccgccgagtggaagatgatcgagcccgagagcgtgggcgacgacctgagacagcaggccaagcagatctgctacggcatcatctacggcatgggcgccaagagcctgggcgagcagatgggcatcaaggagaacgacgccgcctgctacatcgacagcttcaagagcagatacaccggcatcaaccagttcatgaccgagaccgtgaagaactgcaagagagacggcttcgtgcagaccatcctgggcagaagaagatacctgcccggcatcaaggacaacaacccctacagaaaggcccacgccgagagacaggccatcaacaccatcgtgcagggcagcgccgccgacatcgtgaagatcgccaccgtgaacatccagaagcagctggagaccttccacagcaccttcaagagccacggccacagagagggcatgctgcagagcgaccagaccggcctgagcagaaagagaaagctgcagggcatgttctgccccatcagaggcggcttcttcatcctgcagctgcacgacgagctgctgtacgaggtggccgaggaggacgtggtgcaggtggcccagatcgtgaagaacgagatggagagcgccgtgaagctgagcgtgaagctgaaggtgaaggtgaagatcggcgccagctggggcgagctgaaggacttcgacgtgtag

SEQ ID NO: 93865 - DNA, 240 bp, Artificial Sequence
  Description of Artificial Sequence: Synthetic coding sequence
atgggcagaaagagactgatcaccgacagctaccccgtggtgaagagaagagagggccccgccggccacagcaagggcgagctggcccccgagctgggcgaggagccccagcccagagacgaggaggaggccgagctggagctgctgagacagttcgacctggcctggcagtacggcccctgcaccgtgagcggcatcagcatcccctacgaggcccccagaaagaccagctgcccctag

SEQ ID NO: 93866 - DNA, 324 bp, Artificial Sequence
  Description of Artificial Sequence: Synthetic coding sequence
atgggcagaaagagactgatcaccgacagctaccccgtggtgaagagaagagagggccccgccggccacagcaagggcgagctggcccccgagctgggcgaggagccccagcccagagacgaggaggaggccgagctggagctgctgagacagttcgacctggcctggcagtacggcccctgcaccggcatcaccagactgcagagatggtgcagagccaagcagatgggcctggagcccccccccgaggtgtggcaggtgctgaagacccaccccggcgaccccagattccagtgcagcctgtggcacctgtaccccctgtag

SEQ ID NO: 93867 - DNA, 105 bp, Artificial Sequence
  Description of Artificial Sequence: Synthetic coding sequence
atgggcagaaagagactgatcaccgacagctaccccgtggtgaagagaagagagggccccgccggccacagcaagggcgagctggcccccgagctgggcctgtag

SEQ ID NO: 93868 - DNA, 1266 bp, Artificial Sequence
  Description of Artificial Sequence: Synthetic coding sequence
atggccgacatcagcctggacgagctgatcagaaagagaggcgccgccgccaagggcagactgaacgccagacccggcgtgggcggcgtgagaagcagagtgggcatccagcagggcctgctgagccagagcaccagaaccgccaccttccagcagagattcgacgccagacagaagatcggcctgagcgacgccagactgaagctgggcgtgaaggacgccagagagaagctgctgcagaaggacgccagattcagaatcaagggcaaggtgcaggacgccagagagatgctgaacagcagaaagcagcagaccaccgtgccccagaagcccagacaggtggccgacgccagagagaagatcagcctgaagagaagcagccccgccgccttcatcaacccccccatcggcaccgtgacccccgccctgaagctgaccaagaccatccaggtgccccagcagaaggccatggcccccctgcacccccaccccgccggcatgagaatcaacgtggtgaacaaccaccaggccaagcagaacctgtacgacctggacgaggacgacgacggcatcgccagcgtgcccaccaagcagatgaagttcgccgccagcggcggcttcctgcaccacatggccggcctgagcagcagcaagctgagcatgagcaaggccctgcccctgaccaaggtggtgcagaacgacgcctacaccgcccccgccctgcccagcagcatcagaaccaaggccctgaccaacatgagcagaaccctggtgaacaaggaggagccccccaaggagctgcccgccgccgagcccgtgctgagccccctggagggcaccaagatgaccgtgaacaacctgcaccccagagtgaccgaggaggacatcgtggagctgttctgcgtgtgcggcgccctgaagagagccagactggtgcaccccggcgtggccgaggtggtgttcgtgaagaaggacgacgccatcaccgcctacaagaagtacaacaacagatgcctggacggccagcccatgaagtgcaacctgcacatgaacggcaacgtgatcaccagcgaccagcccatcctgctgagactgagcgacagccccagcatgaagaaggagagcgagctgcccagaagagtgaacagcgccagcagcagcaacccccccgccgaggtggaccccgacaccatcctgaaggccctgttcaagagcagcggcgccagcgtgaccacccagcccaccgagttcaagatcaagctgtag

SEQ ID NO: 93869 - DNA, 558 bp, Artificial Sequence
  Description of Artificial Sequence: Synthetic coding sequence
atggccgacatcagcctggacgagctgatcagaaagagaggcgccgccgccaagggcagactgaacgccagacccggcgtgggcggcgtgagaagcagagtgggcatccagcagggcctgctgagccagagcaccagaaccgccaccttccagcagagattcgacgccagacagaagatcggcctgagcgacgccagactgaagctgggcgtgaaggacgccagagagaagctgctgcagaaggacgccagattcagaatcaagggcaaggtgcaggacgccagagagatgctgaacagcagaaagcagcagaccaccgtgccccagaagcccagacaggtggccgacgccagagagaagatcagcctgaagagaagcagccccgccgccttcatcaacccccccatcggcaccgtgacccccgccctgaagctgaccaagaccatccaggtgggcctgagagccgtgcccctgctgtgcctggtgagcggcggcgcctgggtgggcagcagaagccaggccagctgccccctgcccagcggcagcagaccccactag

SEQ ID NO: 93870 - DNA, 1179 bp, Artificial Sequence
  Description of Artificial Sequence: Synthetic coding sequence
atggccgacatcagcctggacgagctgatcagaaagagaggcgccgccgccaagggcagactgaacgccagacccggcgtgggcggcgtgagaagcagagtgggcatccagcagggcctgctgagccagagcaccagaaccgccaccttccagcagagattcgacgccagacagaagatcggcctgagcgacgccagactgaagctgggcgtgaaggacgccagagagaagctgctgcagaaggacgccagattcagaatcaagggcaaggtgcaggacgccagagagatgctgaacagcagaaagcagcagaccaccgtgccccagaagcccagacaggtggccgacgccagagagaagatcagcctgaagagaagcagccccgccgccttcatcaacccccccatcggcaccgtgacccccgccctgaagctgaccaagaccatccagaacctgtacgacctggacgaggacgacgacggcatcgccagcgtgcccaccaagcagatgaagttcgccgccagcggcggcttcctgcaccacatggccggcctgagcagcagcaagctgagcatgagcaaggccctgcccctgaccaaggtggtgcagaacgacgcctacaccgcccccgccctgcccagcagcatcagaaccaaggccctgaccaacatgagcagaaccctggtgaacaaggaggagccccccaaggagctgcccgccgccgagcccgtgctgagccccctggagggcaccaagatgaccgtgaacaacctgcaccccagagtgaccgaggaggacatcgtggagctgttctgcgtgtgcggcgccctgaagagagccagactggtgcaccccggcgtggccgaggtggtgttcgtgaagaaggacgacgccatcaccgcctacaagaagtacaacaacagatgcctggacggccagcccatgaagtgcaacctgcacatgaacggcaacgtgatcaccagcgaccagcccatcctgctgagactgagcgacagccccagcatgaagaaggagagcgagctgcccagaagagtgaacagcgccagcagcagcaacccccccgccgaggtggaccccgacaccatcctgaaggccctgttcaagagcagcggcgccagcgtgaccacccagcccaccgagttcaagatcaagctgtag

SEQ ID NO: 93871 - DNA, 690 bp, Artificial Sequence
  Description of Artificial Sequence: Synthetic coding sequence
atggccgacatcagcctggacgagctgatcagaaagagaggcgccgccgccaagggcagactgaacgccagacccggcgtgggcggcgtgagaagcagagtgggcatccagcagggcctgctgagccagagcaccagaaccgccaccttccagcagagattcgacgccagacagaagatcggcctgagcgacgccagactgaagctgggcgtgaaggacgccagagagaagctgctgcagaaggacgccagattcagaatcaagggcaaggtgcaggacgccagagagatgctgaacagcagaaagcagcagaccaccgtgccccagaagcccagacaggtggccgacgccagagagaagatcagcctgaagagaagcagccccgccgccttcatcaacccccccatcggcaccgtgacccccgccctgaagctgaccaagaccatccagaacctgtacgacctggacgaggacgacgacggcatcgccagcgtgcccaccaagcagatgaagttcgccgccagcggcggcttcctgcaccacatggccggcctgagcagcagcaagctgagcatgagcaaggccctgcccctgaccaaggtggtgcagaacgacgcctacaccgcccccgccctgcccagcagcatcagaaccaaggccctgcccgtgctgaccagccccggcacctag

SEQ ID NO: 93872 - DNA, 561 bp, Artificial Sequence
  Description of Artificial Sequence: Synthetic coding sequence
atggcccccctgcacccccaccccgccggcatgagaatcaacgtggtgaacaaccaccaggccaagcagaacctgtacgacctggacgaggacgacgacggcatcgccagcgtgcccaccaagcagatgaagttcgccgccagcggcggcttcctgcaccacatggccggcctgagcagcagcaagctgagcatgagcaaggccctgcccctgaccaaggtggtgcagaacgacgcctacaccgcccccgccctgcccagcagcatcagaaccaaggccctgaccaacatgagcagaaccctggtgaacaaggaggagccccccaaggagctgcccgccgccgagcccgtgctgagccccctggagggcaccaagatgaccgtgaacaacctgcaccccagagtgaccgaggaggacatcgtggagctgttctgcgtgtgcggcgccctgaagagagccagactggtgcaccccggcgtggccgaggtggtgttcgtgaagaaggacgacgccatcaccgcctacaagaagtacaacaacagatgcctggacggcggctag

SEQ ID NO: 93873 - DNA, 555 bp, Artificial Sequence
  Description of Artificial Sequence: Synthetic coding sequence
atggccgacatcagcctggacgagctgatcagaaagagaggcgccgccgccaagggcagactgaacgccagacccggcgtgggcggcgtgagaagcagagtgggcatccagcagggcctgctgagccagagcaccagaaccgccaccttccagcagagattcgacgccagacagaagatcggcctgagcgacgccagactgaagctgggcgtgaaggacgccagagagaagctgctgcagaaggacgccagattcagaatcaagggcaaggtgcaggacgccagagagatgctgaacagcagaaagcagcagaccaccgtgccccagaagcccagacaggtggccgacgccagagagaagatcagcctgaagagaagcagccccgccgccttcatcaacccccccatcggcaccgtgacccccgccctgaagctgaccaagaccatccaggtgcccagcttcccctgccccagacccagcctgagccccaagtggttcagaatgatgcacacccagctgctgctgagcctgcccctgttcgagcagaagccctag

SEQ ID NO: 93874 - DNA, 354 bp, Artificial Sequence
  Description of Artificial Sequence: Synthetic coding sequence
atggccgccgccgccgccgccggcagcggcacccccagagaggaggagggccccgccggcgaggccgccgccagccagccccaggcccccaccagcgtgcccggcgccagactgagcagactgcccctggccagagtgaaggccctggtgaaggccgaccccgacgtgaccctggccggccaggaggccatcttcatcctggccagagccgccgagctgttcgtggagaccatcgccaaggacgcctactgctgcgcccagcagggcaagagaaagaccctgcagagaagagacctggacaacgccatcgaggccgtggacgagttcgccttcctggagggcaccctggactag

SEQ ID NO: 93875 - DNA, 1029 bp, Artificial Sequence
  Description of Artificial Sequence: Synthetic coding sequence
atggccgccagccaggccgtggaggagatgagaagcagagtggtgctgggcgagttcggcgtgagaaacgtgcacaccaccgacttccccggcaactacagcggctacgacgacgcctgggaccaggacagattcgagaagaacttcagagtggacgtggtgcacatggacgagaacagcctggagttcgacatggtgggcatcgacgccgccatcgccaacgccttcagaagaatcctgctggccgaggtgcccaccatggccgtggagaaggtgctggtgtacaacaacaccagcatcgtgcaggacgagatcctggcccacagactgggcctgatccccatccacgccgaccccagactgttcgagtacagaaaccagggcgacgaggagggcaccgagatcgacaccctgcagttcagactgcaggtgagatgcaccagaaacccccacgccgccaaggacagcagcgaccccaacgagctgtacgtgaaccacaaggtgtacaccagacacatgacctggatccccctgggcaaccaggccgacctgttccccgagggcaccatcagacccgtgcacgacgacatcctgatcgcccagctgagacccggccaggagatcgacctgctgatgcactgcgtgaagggcatcggcaaggaccacgccaagttcagccccgtggccaccgccagctacagactgctgcccgacatcaccctgctggagcccgtggagggcgaggccgccgaggagctgagcagatgcttcagccccggcgtgatcgaggtgcaggaggtgcagggcaagaaggtggccagagtggccaaccccagactggacaccttcagcagagagatcttcagaaacgagaagctgaagaaggtggtgagactggccagagtgagagaccactacatctgcaagaaggacctgctggccgccgtggcccacacctgcaaccccagcaccctgggcggccagggcgagtggatcaccggcagcagagagagagaccaccccggctag

SEQ ID NO: 93876 - DNA, 633 bp, Artificial Sequence
  Description of Artificial Sequence: Synthetic coding sequence
atggccgtggagaaggtgctggtgtacaacaacaccagcatcgtgcaggacgagatcctggcccacagactgggcctgatccccatccacgccgaccccagactgttcgagtacagaaaccagggcgacgaggagggcaccgagatcgacaccctgcagttcagactgcaggtgagatgcaccagaaacccccacgccgccaaggacagcagcgaccccaacgagctgtacgtgaaccacaaggtgtacaccagacacatgacctggatccccctgggcaaccaggccgacctgttccccgagggcaccatcagacccgtgcacgacgacatcctgatcgcccagctgagacccggccaggagatcgacctgctgatgcactgcgtgaagggcatcggcaagaaggtggccagagtggccaaccccagactggacaccttcagcagagagatcttcagaaacgagaagctgaagaaggtggtgagactggccagagtgagagaccactacatcttcagcgtggagagcaccggcgtgctgccccccgacgtgctggtgagcgaggccatcaaggtgctgatgggcaagtgcagaagattcctggacgagctggacgccgtgcagatggactag

SEQ ID NO: 93877 - DNA, 1041 bp, Artificial Sequence
  Description of Artificial Sequence: Synthetic coding sequence
atggccgccagccaggccgtggaggagatgagaagcagagtggtgctgggcgagttcggcgtgagaaacgtgcacaccaccgacttccccggcaactacagcggctacgacgacgcctgggaccaggacagattcgagaagaacttcagagtggacgtggtgcacatggacgagaacagcctggagttcgacatggtgggcatcgacgccgccatcgccaacgccttcagaagaatcctgctggccgaggtgcccaccatggccgtggagaaggtgctggtgtacaacaacaccagcatcgtgcaggacgagatcctggcccacagactgggcctgatccccatccacgccgaccccagactgttcgagtacagaaaccagggcgacgaggagggcaccgagatcgacaccctgcagttcagactgcaggtgagatgcaccagaaacccccacgccgccaaggacagcagcgaccccaacgagctgtacgtgaaccacaaggtgtacaccagacacatgacctggatccccctgggcaaccaggccgacctgttccccgagggcaccatcagacccgtgcacgacgacatcctgatcgcccagctgagacccggccaggagatcgacctgctgatgcactgcgtgaagggcatcggcaaggaccacgccaagttcagccccgtggccaccgccagctacagactgctgcccgacatcaccctgctggagcccgtggagggcgaggccgccgaggagctgagcagatgcttcagccccggcgtgatcgaggtgcaggaggtgcagggcaagaaggtggccagagtggccaaccccagactggacaccttcagcagagagatcttcagaaacgagaagctgaagaaggtggtgagactggccagagtgagagaccactacatcttcagcgtggagagcaccggcgtgctgccccccgacgtgctggtgagcgaggccatcaaggtgctgatgggcaagtgcagaagattcctggacgagctggacgccgtgcagatggactag

SEQ ID NO: 93878 - DNA, 369 bp, Artificial Sequence
  Description of Artificial Sequence: Synthetic coding sequence
atggaggaggaccaggagctggagagaaaggccatcgaggagctgctgaaggaggccaagagaggcaagaccagagccgagaccatgggccccatgggctggatgaagtgccccctggccagcaccaacaagagattcctgatcaacaccatcaagaacaccctgcccagccacaaggagcaggaccacgagcagaaggagggcgacaaggagcccgccaagagccaggcccagaaggaggagaaccccaagaagcacagaagccacccctacaagcacagcttcagagccagaggcagcgccagctacagcccccccagaaagagaagcagccaggacaagtacgagaagagaagcaacagaagatag

SEQ ID NO: 93879 - DNA, 402 bp, Artificial Sequence
  Description of Artificial Sequence: Synthetic coding sequence
atggaggaggaccaggagctggagagaaagatcagcggcctgaagaccagcatggccgagggcgagagaaagaccgccctggagatggtgcaggccgccggcaccgacagacactgcgtgaccttcgtgctgcacgaggaggaccacaccctgggcaacagcctgagatacatgatcatgaagaaccccgaggtggagttctgcggctacaccaccacccaccccagcgagagcaagatcaacctgagaatccagaccagaggcaccctgcccgccgtggagcccttccagagaggcctgaacgagctgatgaacgtgtgccagcacgtgctggacaagttcgaggccagcatcaaggactacaaggaccagaaggccagcagaaacgagagcaccttctag

SEQ ID NO: 93880 - DNA, 402 bp, Artificial Sequence; identical to SEQ ID NO: 93879
  Description of Artificial Sequence: Synthetic coding sequence

SEQ ID NO: 93881 - DNA, 5913 bp, Artificial Sequence
  Description of Artificial Sequence: Synthetic coding sequence
atgcacggcggcggcccccccagcggcgacagcgcctgccccctgagaaccatcaagagagtgcagttcggcgtgctgagccccgacgagctgaagagaatgagcgtgaccgagggcggcatcaagtaccccgagaccaccgagggcggcagacccaagctgggcggcctgatggaccccagacagggcgtgatcgagagaaccggcagatgccagacctgcgccggcaacatgaccgagtgccccggccacttcggccacatcgagctggccaagcccgtgttccacgtgggcttcctggtgaagaccatgaaggtgctgagatgcgtgtgcttcttctgcagcaagctgctggtggacagcaacaaccccaagatcaaggacatcctggccaagagcaagggccagcccaagaagagactgacccacgtgtacgacctgtgcaagggcaagaacatctgcgagggcggcgaggagatggacaacaagttcggcgtggagcagcccgagggcgacgaggacctgaccaaggagaagggccacggcggctgcggcagataccagcccagaatcagaagaagcggcctggagctgtacgccgagtggaagcacgtgaacgaggacagccaggagaagaagatcctgctgagccccgagagagtgcacgagatcttcaagagaatcagcgacgaggagtgcttcgtgctgggcatggagcccagatacgccagacccgagtggatgatcgtgaccgtgctgcccgtgccccccctgagcgtgagacccgccgtggtgatgcagggcagcgccagaaaccaggacgacctgacccacaagctggccgacatcgtgaagatcaacaaccagctgagaagaaacgagcagaacggcgccgccgcccacgtgatcgccgaggacgtgaagctgctgcagttccacgtggccaccatggtggacaacgagctgcccggcctgcccagagccatgcagaagagcggcagacccctgaagagcctgaagcagagactgaagggcaaggagggcagagtgagaggcaacctgatgggcaagagagtggacttcagcgccagaaccgtgatcacccccgaccccaacctgagcatcgaccaggtgggcgtgcccagaagcatcgccgccaacatgaccttcgccgagatcgtgacccccttcaacatcgacagactgcaggagctggtgagaagaggcaacagccagtaccccggcgccaagtacatcatcagagacaacggcgacagaatcgacctgagattccaccccaagcccagcgacctgcacctgcagaccggctacaaggtggagagacacatgtgcgacggcgacatcgtgatcttcaacagacagcccaccctgcacaagatgagcatgatgggccacagagtgagaatcctgccctggagcaccttcagactgaacctgagcgtgaccaccccctacaacgccgacttcgacggcgacgagatgaacctgcacctgccccagagcctggagaccagagccgagatccaggagctggccatggtgcccagaatgatcgtgaccccccagagcaacagacccgtgatgggcatcgtgcaggacaccctgaccgccgtgagaaagttcaccaagagagacgtgttcctggagagaggcgaggtgatgaacctgctgatgttcctgagcacctgggacggcaaggtgccccagcccgccatcctgaagcccagacccctgtggaccggcaagcagatcttcagcctgatcatccccggccacatcaactgcatcagaacccacagcacccaccccgacgacgaggacagcggcccctacaagcacatcagccccggcgacaccaaggtggtggtggagaacggcgagctgatcatgggcatcctgtgcaagaagagcctgggcaccagcgccggcagcctggtgcacatcagctacctggagatgggccacgacatcaccagactgttctacagcaacatccagaccgtgatcaacaactggctgctgatcgagggccacaccatcggcatcggcgacagcatcgccgacagcaagacctaccaggacatccagaacaccatcaagaaggccaagcaggacgtgatcgaggtgatcgagaaggcccacaacaacgagctggagcccacccccggcaacaccctgagacagaccttcgagaaccaggtgaacagaatcctgaacgacgccagagacaagaccggcagcagcgcccagaagagcctgagcgagtacaacaacttcaagagcatggtggtgagcggcgccaagggcagcaagatcaacatcagccaggtgatcgccgtggtgggccagcagaacgtggagggcaagagaatccccttcggcttcaagcacagaaccctgccccacttcatcaaggacgactacggccccgagagcagaggcttcgtggagaacagctacctggccggcctgacccccaccgagttcttcttccacgccatgggcggcagagagggcctgatcgacaccgccgtgaagaccgccgagaccggctacatccagagaagactgatcaagagcatggagagcgtgatggtgaagtacgacgccaccgtgagaaacagcatcaaccaggtggtgcagctgagatacggcgaggacggcctggccggcgagagcgtggagttccagaacctggccaccctgaagcccagcaacaaggccttcgagaagaagttcagattcgactacaccaacgagagagccctgagaagaaccctgcaggaggacctggtgaaggacgtgctgagcaacgcccacatccagaacgagctggagagagagttcgagagaatgagagaggacagagaggtgctgagagtgatcttccccaccggcgacagcaaggtggtgctgccctgcaacctgctgagaatgatctggaacgcccagaagatcttccacatcaaccccagactgcccagcgacctgcaccccatcaaggtggtggagggcgtgaaggagctgagcaagaagctggtgatcgtgaacggcgacgaccccctgagcagacaggcccaggagaacgccaccctgctgttcaacatccacctgagaagcaccctgtgcagcagaagaatggccgaggagttcagactgagcggcgaggccttcgactggctgctgggcgagatcgagagcaagttcaaccaggccatcgcccaccccggcgagatggtgggcgccctggccgcccagagcctgggcgagcccgccacccagatgaccctgaacaccttccactacgccggcgtgagcgccaagaacgtgaccctgggcgtgcccagactgaaggagctgatcaacatcagcaagaagcccaagacccccagcctgaccgtgttcctgctgggccagagcgccagagacgccgagagagccaaggacatcctgtgcagactggagcacaccaccctgagaaaggtgaccgccaacaccgccatctactacgaccccaacccccagagcaccgtggtggccgaggaccaggagtgggtgaacgtgtactacgagatgcccgacttcgacgtggccagaatcagcccctggctgctgagagtggagctggacagaaagcacatgaccgacagaaagctgaccatggagcagatcgccgagaagatcaacgccggcttcggcgacgacctgaactgcatcttcaacgacgacaacgccgagaagctggtgctgagaatcagaatcatgaacagcgacgagaacaagatgcaggaggaggaggaggtggtggacaagatggacgacgacgtgttcctgagatgcatcgagagcaacatgctgaccgacatgaccctgcagggcatcgagcagatcagcaaggtgtacatgcacctgccccagaccgacaacaagaagaagatcatcatcaccgaggacggcgagttcaaggccctgcaggagtggatcctggagaccgacggcgtgagcctgatgagagtgctgagcgagaaggacgtggaccccgtgagaaccaccagcaacgacatcgtggagatcttcaccgtgctgggcatcgaggccgtgagaaaggccctggagagagagctgtaccacgtgatcagcttcgacggcagctacgtgaactacagacacctggccctgctgtgcgacaccatgacctgcagaggccacctgatggccatcaccagacacggcgtgaacagacaggacaccggccccctgatgaagtgcagcttcgaggagaccgtggacgtgctgatggaggccgccgcccacggcgagagcgaccccatgaagggcgtgagcgagaacatcatgctgggccagctggcccccgccggcaccggctgcttcgacctgctgctggacgccgagaagtgcaagtacggcatggagatccccaccaacatccccggcctgggcgccgccggccccaccggcatgttcttcggcagcgcccccagccccatgggcggcatcagccccgccatgaccccctggaaccagggcgccacccccgcctacggcgcctggagccccagcgtgggcagcggcatgacccccggcgccgccggcttcagccccagcgccgccagcgacgccagcggcttcagccccggctacagccccgcctggagccccacccccggcagccccggcagccccggccccagcagcccctacatccccagccccggcggcgccatgagccccagctacagccccaccagccccgcctacgagcccagaagccccggcggctacaccccccagagccccagctacagccccaccagccccagctacagccccaccagccccagctacagccccaccagccccaactacagccccaccagccccagctacagccccaccagccccagctacagccccaccagccccagctacagccccaccagccccagctacagccccaccagccccagctacagccccaccagccccagctacagccccaccagccccagctacagccccaccagccccagctacagccccaccagccccagctacagccccaccagccccagctacagccccaccagccccagctacagccccaccagccccagctacagccccaccagccccagctacagccccaccagccccagctacagccccaccagccccagctacagccccaccagccccaactacagccccaccagccccaactacacccccaccagccccagctacagccccaccagccccagctacagccccaccagccccaactacacccccaccagccccaactacagccccaccagccccagctacagccccaccagccccagctacagccccaccagccccagctacagccccagcagccccagatacaccccccagagccccacctacacccccagcagccccagctacagccccagcagccccagctacagccccgccagccccaagtacacccccaccagccccagctacagccccagcagccccgagtacacccccaccagccccaagtacagccccaccagccccaagtacagccccaccagccccaagtacagccccaccagccccacctacagccccaccacccccaagtacagccccaccagccccacctacagccccaccagccccgtgtacacccccaccagccccaagtacagccccaccagccccacctacagccccaccagccccaagtacagccccaccagccccacctacagccccaccagccccaagggcagcacctacagccccaccagccccggctacagccccaccagccccacctacagcctgaccagccccgccatcagccccgacgacagcgacgaggagaactag

SEQ ID NO: 93882 - DNA, 1626 bp, Artificial Sequence
  Description of Artificial Sequence: Synthetic coding sequence
atgcccggcagatgccagagcgacgccgccatgagagtgaacggccccgccagcagagcccccgccggctggaccagcggcagcctgcacaccggccccagagccggcagacccagagcccaggccagaggcgtgagaggcagaggcctgctgctgagacccagacccgccaaggagctgcccctgcccagaaagggcggcgcctgggcccccgccggcaaccccggccccctgcaccccctgggcgtggccgtgggcatggccggcagcggcagactggtgctgagaccctggatcagagagctgatcctgggcagcgagacccccagcagccccagagccggccagctgctggaggacgccgaggccgccgtggccggccccagccacgcccccgacaccagcgacgtgggcgccaccctgctggtgagcgacggcacccacagcgtgagatgcctggtgaccagagaggccctggacaccagcgactgggaggagaaggagttcggcttcagaggcaccgagggcagactgctgctgctgcaggactgcggcgtgcacgtgcaggtggccgagggcggcgcccccgccgagttctacctgcaggtggacagattcagcctgctgcccaccgagcagcccagactgagagtgcccggctgcaaccaggacctggacgtgcagaagaagctgtacgactgcctggaggagcacctgagcgagagcaccagcagcaacgccggcctgagcctgagccagctgctggacgagatgagagaggaccaggagcaccagggcgccctggtgtgcctggccgagagctgcctgaccctggagggcccctgcaccgccccccccgtgacccactgggccgccagcagatgcaaggccaccggcgaggccgtgtacaccgtgcccagcagcatgctgtgcatcagcgagaacgaccagctgatcctgagcagcctgggcccctgccagagaacccagggccccgagctgcccccccccgaccccgccctgcaggacctgagcctgaccctgatcgccagcccccccagcagccccagcagcagcggcacccccgccctgcccggccacatgagcagcgaggagagcggcaccagcatcagcctgctgcccgccctgagcctggccgcccccgaccccggccagagaagcagcagccagcccagccccgccatctgcagcgcccccgccaccctgacccccagaagcccccacgccagcagaacccccagcagccccctgcagagctgcacccccagcctgagccccagaagccacgtgcccagcccccaccaggccctggtgaccagaccccagaagcccagcctggagttcaaggagttcgtgggcctgccctgcaagaacagaccccccttccccagaaccggcgccaccagaggcgcccaggagccctgcagcgtgtgggagccccccaagagacacagagacggcagcgccttccagtacgagtacgagcccccctgcaccagcctgtgcgccagagtgcaggccgtgagactgcccccccagctgatggcctgggccctgcacttcctgatggacgcccagcccggcagcgagcccacccccatgtag

SEQ ID NO: 93883 - DNA, 2040 bp, Artificial Sequence
  Description of Artificial Sequence: Synthetic coding sequence
atggacagagtgaccagataccccatcctgggcatcccccaggcccacagaggcaccggcctggtgctggacggcgacaccagctacacctaccacctggtgtgcatgggccccgaggccagcggctggggccaggacgagccccagacctggcccaccgaccacagagcccagcagggcgtgcagagacagggcgtgagctacagcgtgcacgcctacaccggccagcccagccccagaggcctgcacagcgagaacagagaggacgagggctggcaggtgtacagactgggcgccagagacgcccaccagggcagacccacctgggccctgagacccgaggacggcgaggacaaggagatgaagacctacagactggacgccggcgacgccgaccccagaagactgtgcgacctggagagagagagatgggccgtgatccagggccaggccgtgagaaagagcagcaccgtggccaccctgcagggcacccccgaccacggcgaccccagaacccccggcccccccagaagcacccccctggaggagaacgtggtggacagagagcagatcgacttcctggccgccagacagcagttcctgagcctggagcaggccaacaagggcgccccccacagcagccccgccagaggcacccccgccggcaccacccccggcgccagccaggcccccaaggccttcaacaagccccacctggccaacggccacgtggtgcccatcaagccccaggtgaagggcgtggtgagagaggagaacaaggtgagagccgtgcccacctgggccagcgtgcaggtggtggacgaccccggcagcctggccagcgtggagagccccggcacccccaaggagacccccatcgagagagagatcagactggcccaggagagagaggccgacctgagagagcagagaggcctgagacaggccaccgaccaccaggagctggtggagatccccaccagacccctgctgaccaagctgagcctgatcaccgcccccagaagagagagaggcagacccagcctgtacgtgcagagagacatcgtgcaggagacccagagagaggaggaccacagaagagagggcctgcacgtgggcagagccagcacccccgactgggtgagcgagggcccccagcccggcctgagaagagccctgagcagcgacagcatcctgagccccgcccccgacgccagagccgccgaccccgcccccgaggtgagaaaggtgaacagaatcccccccgacgcctaccagccctacctgagccccggcaccccccagctggagttcagcgccttcggcgccttcggcaagcccagcagcctgagcaccgccgaggccaaggccgccaccagccccaaggccaccatgagccccagacacctgagcgagagcagcggcaagcccctgagcaccaagcaggaggccagcaagccccccagaggctgcccccaggccaacagaggcgtggtgagatgggagtacttcagactgagacccctgagattcagagcccccgacgagccccagcaggcccaggtgccccacgtgtggggctgggaggtggccggcgcccccgccctgagactgcagaagagccagagcagcgacctgctggagagagagagagagagcgtgctgagaagagagcaggaggtggccgaggagagaagaaacgccctgttccccgaggtgttcagccccacccccgacgagaacagcgaccagaacagcagaagcagcagccaggccagcggcatcaccggcagctacagcgtgagcgagagccccttcttcagccccatccacctgcacagcaacgtggcctggaccgtggaggaccccgtggacagcgccccccccggccagagaaagaaggagcagtggtacgccggcatcaaccccagcgacggcatcaacagcgaggtgctggaggccatcagagtgaccagacacaagaacgccatggccgagagatgggagagcagaatctacgccagcgaggaggacgactag

SEQ ID NO: 93884 - DNA, 381 bp, Artificial Sequence
  Description of Artificial Sequence: Synthetic coding sequence
atgagcgacaacgaggacaacttcgacggcgacgacttcgacgacgtggaggaggacgagggcctggacgacctggagaacgccgaggaggagggccaggagaacgtggagatcctgcccagcggcgagagaccccaggccaaccagaagagaatcaccaccccctacatgaccaagtacgagagagccagagtgctgggcaccagagccctgcagatcgccatgtgcgcccccgtgatggtggagctggagggcgagaccgaccccctgctgatcgccatgaaggagctgaagctgctgtggggcctggagtacaccgtgctgagacccagctacgccctggcccacagcctgggcagcttcagcatcagcagcagatag

SEQ ID NO: 93885 - DNA, 477 bp, Artificial Sequence
  Description of Artificial Sequence: Synthetic coding sequence
atgagcgacaacgaggacaacttcgacggcgacgacttcgacgacgtggaggaggacgagggcctggacgacctggagaacgccgaggaggagggccaggagaacgtggagatcctgcccagcggcgagagaccccaggccaaccagaagagaatcaccaccccctacatgaccaagtacgagagagccagagtgctgggcaccagagccctgcagatcgccatgtgcgcccccgtgatggtggagctggagggcgagaccgaccccctgctgatcgccatgaaggagctgaacgccagaagcgccagcgagccccccggcgaggagcccccctggatggacagaggcaccagagacgagcacctgcccagctgccccggctgccccgccgtggccagcaacaccagatgctgcccccccgccgcctgcctgcccggcatcagcctgagcagaagaagaagactgagagaggagtag

SEQ ID NO: 93886 - DNA, 384 bp, Artificial Sequence
  Description of Artificial Sequence: Synthetic coding sequence
atgagcgacaacgaggacaacttcgacggcgacgacttcgacgacgtggaggaggacgagggcctggacgacctggagaacgccgaggaggagggccaggagaacgtggagatcctgcccagcggcgagagaccccaggccaaccagaagagaatcaccaccccctacatgaccaagtacgagagagccagagtgctgggcaccagagccctgcagatcgccatgtgcgcccccgtgatggtggagctggagggcgagaccgaccccctgctgatcgccatgaaggagctgaaggccagaaagatccccatcatcatcagaagatacctgcccgacggcagctacgaggactggggcgtggacgagctgatcatcaccgactag

SEQ ID NO: 93887 - DNA, 519 bp, Artificial Sequence
  Description of Artificial Sequence: Synthetic coding sequence
atgttctaccacatcagcctggagcacgagatcctgctgcaccccagatacttcggccccaacctgctgaacaccgtgaagcagaagctgttcaccgaggtggagggcacctgcaccggcaagtacggcttcgtgatcgccgtgaccaccatcgacaacatcggcgccggcgtgatccagcccggcagaggcttcgtgctgtaccccgtgaagtacaaggccatcgtgttcagacccttcaagggcgaggtggtggacgccgtggtgacccaggtgaacaaggtgggcctgttcaccgagatcggccccatgagctgcttcatcagcagacacagcatccccagcgagatggagttcgaccccaacagcaaccccccctgctacaagaccatggacgaggacatcgtgatccagcaggacgacgagatcagactgaagatcgtgggcaccagagtggacaagaacgacatcttcgccatcggcagcctgatggacgactacctgggcctggtgagctag

SEQ ID NO: 93888 - DNA, 453 bp, Artificial Sequence
  Description of Artificial Sequence: Synthetic coding sequence
atggccggcatcctgttcgaggacatcttcgacgtgaaggacatcgaccccgagggcaagaagttcgacagagtgagcagactgcactgcgagagcgagagcttcaagatggacctgatcctggacgtgaacatccagatctaccccgtggacctgggcgacaagttcagactggtgatcgccagcaccctgtacgaggacggcaccctggacgacggcgagtacaaccccaccgacgacagacccagcagagccgaccagttcgagtacgtgatgtacggcaaggtgtacagaatcgagggcgacgagaccagcaccgaggccgccaccagactgagcgcctacgtgagctacggcggcctgctgatgagactgcagggcgacgccaacaacctgcacggcttcgaggtggacagcagagtgtacctgctgatgaagaagctggccttctag

SEQ ID NO: 93889 - DNA, 39 bp, Artificial Sequence
  Description of Artificial Sequence: Synthetic coding sequence
atggccggcatcctgttcgaggacatcttcgacgtgtag

SEQ ID NO: 93890 - DNA, 450 bp, Artificial Sequence
  Description of Artificial Sequence: Synthetic coding sequence
atggccggcatcctgttcgaggacatcttcgacgtgaaggacatcgaccccgagggcaagaagttcgacagagtgagcagactgcactgcgagagcgagagcttcaagatggacctgatcctggacgtgaacatccagatctaccccgtggacctgggcgacaagttcagactggtgatcgccagcaccctgtacgaggacggcaccctggacgacggcgagtacaaccccaccgacgacagacccagcagagccgaccagttcgagtacgtgatgtacggcaaggtgtacagaatcgagggcgacgagaccagcaccgaggccgccaccagactgagcgcctacgtgagctacggcggcctgctgatgagactgcagggcgacgccaacaacctgcacggcttcgaggtggacagcagagtgtacctgctgatgaagaagctggcctag

SEQ ID NO: 93891 - DNA, 453 bp, Artificial Sequence; identical to SEQ ID NO: 93888
  Description of Artificial Sequence: Synthetic coding sequence

SEQ ID NO: 93892 - DNA, 1491 bp, Artificial Sequence
  Description of Artificial Sequence: Synthetic coding sequence
atggaggagcagagagaggccctgagaaagatcatcaagaccctggccgtgaagaacgaggagatccagagcttcatctacagcctgaagcagatgctgctgaacgtggaggccaacagcgccaaggtgcaggaggacctggaggccgagttccagagcctgttcagcctgctggaggagctgaaggagggcatgctgatgaagatcaagcaggacagagccagcagaacctacgagctgcagaaccagctggccgcctgcaccagagccctggagagcagcgaggagctgctggagaccgccaaccagaccctgcaggccatggacagcgaggacttcccccaggccgccaagcagatcaaggacggcgtgaccatggcccccgccttcagactgagcctgaaggccaaggtgagcgacaacatgagccacctgatggtggacttcgcccaggagagacagatgctgcaggccctgaagttcctgcccgtgcccagcgcccccgtgatcgacctggccgagagcctggtggccgacaactgcgtgaccctggtgtggagaatgcccgacgaggacagcaagatcgaccactacgtgctggagtacagaagaaccaacttcgagggcccccccagactgaaggaggaccagccctggatggtgatcgagggcatcagacagaccgagtacaccctgaccggcctgaagttcgacatgaagtacatgaacttcagagtgaaggcctgcaacaaggccgtggccggcgagttcagcgagcccgtgaccctggagacccccgccttcatgttcagactggacgccagcaccagccaccagaacctgagagtggacgacctgagcgtggagtgggacgccatgggcggcaaggtgcaggacatcaaggccagagagaaggacggcaagggcagaaccgccagccccatcaacagccccgccagaggcacccccagccccaagagaatgcccagcggcagaggcggcagagacagattcaccgccgagagctacaccgtgctgggcgacaccctgatcgacggcggcgagcactactgggaggtgagatacgagcccgacagcaaggccttcggcgtgggcgtggcctacagaagcctgggcagattcgagcagctgggcaagaccgccgccagctggtgcctgcacgtgaacaactggctgcaggtgagcttcaccgccaagcacgccaacaaggtgaaggtgctggacgcccccgtgcccgactgcctgggcgtgcactgcgacttccaccagggcctgctgagcttctacaacgccagaaccaagcaggtgctgcacaccttcaagaccagattcacccagcccctgctgcccgccttcaccgtgtggtgcggcagcttccaggtgaccaccggcctgcaggtgcccagcgccgtgagatgcctgcagaagagaggcagcgccaccagcagcagcaacaccagcctgacctag

SEQ ID NO: 93893 - DNA, 354 bp, Artificial Sequence
  Description of Artificial Sequence: Synthetic coding sequence
atgaacgccccccccgccttcgagagcttcctgctgttcgagggcgagaagaagatcaccatcaacaaggacaccaaggtgcccaacgcctgcctgttcaccatcaacaaggaggaccacaccctgggcaacatcatcaagagccagctgctgaaggacccccaggtgctgttcgccggctacaaggtgccccaccccctggagcacaagatcatcatcagagtgcagaccacccccgactacagcccccaggaggccttcaccaacgccatcaccgacctgatcagcgagctgagcctgctggaggagagattcagagtggccatcaaggacaagcaggagggcatcgagtag

SEQ ID NO: 93894 - DNA, 384 bp, Artificial Sequence
  Description of Artificial Sequence: Synthetic coding sequence
atgaacgccccccccgccttcgagagcttcctgctgttcgagggcgagaagaagatcaccatcaacaaggacaccaaggtgcccaacgcctgcctgttcaccatcaacaaggaggaccacaccctgggcaacatcatcaagagccagctgctgaaggacccccaggtgctgttcgccggctacaaggtgccccaccccctggagcacaagatcatcatcagagtgcagaccacccccgactacagcccccaggaggccttcaccaacgccatcaccgacctgatcagcgagctgagcctgctggaggagagattcagagtgagagccggccccggcggcgccgacggcgtggccatcaaggacaagcaggagggcatcgagtag

SEQ ID NO: 93895 - DNA, 351 bp, Artificial Sequence
  Description of Artificial Sequence: Synthetic coding sequence
atgaacgccccccccgccttcgagagcttcctgctgttcgagggcgagaagatcaccatcaacaaggacaccaaggtgcccaaggcctgcctgttcaccatcaacaaggaggaccacaccctgggcaacatcatcaagagcagagcctgcttccccttcgccttctgcagagactgccagttccccgaggccagccccgccaccctgcccgtgcagcccgccgagctgtgccccagagcccaccagctgtgcgcccccgccctgaagagacacctgggcggcgaggcccaccccgtgcacctgcacgccggcgccgccagcagacccgtgcagcagccccagcacctgtag

SEQ ID NO: 93896 - DNA, 348 bp, Artificial Sequence
  Description of Artificial Sequence: Synthetic coding sequence
atgaacgccccccccgccttcgagagcttcctgctgttcgagggcgagaagatcaccatcaacaaggacaccaaggtgcccaaggcctgcctgttcaccatcaacaaggaggaccacaccctgggcaacatcatcaagagccagctgctgaaggacccccaggtgctgttcgccggctacaaggtgccccaccccctggagcacaagatcatcatcagagtgcagaccacccccgactacagcccccaggaggccttcaccaacgccatcaccgacctgatcagcgagctgagcctgctggaggagagattcagaacctgcctgctgcccctgagactgctgccctag

SEQ ID NO: 93897 - DNA, 177 bp, Artificial Sequence
  Description of Artificial Sequence: Synthetic coding sequence
atggacacccagaaggacgtgcagccccccaagcagcagcccatgatctacatctgcggcgagtgccacaccgagaacgagatcaagagcagagaccccatcagatgcagagagtgcggctacagaatcatgtacaagaagagaaccaagagactggtggtgttcgacgccagatag

SEQ ID NO: 93898 - DNA, 204 bp, Artificial Sequence
  Description of Artificial Sequence: Synthetic coding sequence
atgatcatccccgtgagatgcttcacctgcggcaagatcgtgggcaacaagtgggaggcctacctgggcctgctgcaggccgagtacaccgagggcgacgccctggacgccctgggcctgaagagatactgctgcagaagaatgctgctggcccacgtggacctgatcgagaagctgctgaactacgcccccctggagaagtag

SEQ ID NO: 93899 - DNA, 204 bp, Artificial Sequence; identical to SEQ ID NO: 93898
  Description of Artificial Sequence: Synthetic coding sequence

SEQ ID NO: 93900 - DNA, 4173 bp, Artificial Sequence
  Description of Artificial Sequence: Synthetic coding sequence
atggtgaaggagcagttcagagagaccgacgtggccaagaagatcagccacatctgcttcggcatgaagagccccgaggagatgagacagcaggcccacatccaggtggtgagcaagaacctgtacagccaggacaaccagcacgcccccctgctgtacggcgtgctggaccacagaatgggcaccagcgagaaggacagaccctgcgagacctgcggcaagaacctggccgactgcctgggccactacggctacatcgacctggagctgccctgcttccacgtgggctacttcagagccgtgatcggcatcctgcagatgatctgcaagacctgctgccacatcatgctgagccaggaggagaagaagcagttcctggactacctgaagagacccggcctgacctacctgcagaagagaggcctgaagaagaagatcagcgacaagtgcagaaagaagaacatctgccaccactgcggcgccttcaacggcaccgtgaagaagtgcggcctgctgaagatcatccacgagaagtacaagaccaacaagaaggtggtggaccccatcgtgagcaacttcctgcagagcttcgagaccgccatcgagcacaacaaggaggtggagcccctgctgggcagagcccaggagaacctgaaccccctggtggtgctgaacctgttcaagagaatccccgccgaggacgtgcccctgctgctgatgaaccccgaggccggcaagcccagcgacctgatcctgaccagactgctggtgccccccctgtgcatcagacccagcgtggtgagcgacctgaagagcggcaccaacgaggacgacctgaccatgaagctgaccgagatcatcttcctgaacgacgtgatcaagaagcacagaatcagcggcgccaagacccagatgatcatggaggactgggacttcctgcagctgcagtgcgccctgtacatcaacagcgagctgagcggcatccccctgaacatggcccccaagaagtggaccagaggcttcgtgcagagactgaagggcaagcagggcagattcagaggcaacctgagcggcaagagagtggacttcagcggcagaaccgtgatcagccccgaccccaacctgagaatcgacgaggtggccgtgcccgtgcacgtggccaagatcctgaccttccccgagaaggtgaacaaggccaacatcaacttcctgagaaagctggtgcagaacggccccgaggtgcaccccggcgccaacttcatccagcagagacacacccagatgaagagattcctgaagtacggcaacagagagaagatggcccaggagctgaagtacggcgacatcgtggagagacacctgatcgacggcgacgtggtgctgttcaacagacagcccagcctgcacaagctgagcatcatggcccacctggccagagtgaagccccacagaaccttcagattcaacgagtgcgtgtgcaccccctacaacgccgacttcgacggcgacgagatgaacctgcacctgccccagaccgaggaggccaaggccgaggccctggtgctgatgggcaccaaggccaacctggtgacccccagaaacggcgagcccctgatcgccgccatccaggacttcctgaccggcgcctacctgctgaccctgaaggacaccttcttcgacagagccaaggcctgccagatcatcgccagcatcctggtgggcaaggacgagaagatcaaggtgagactgcccccccccaccatcctgaagcccgtgaccctgtggaccggcaagcagatcttcagcgtgatcctgagacccagcgacgacaaccccgtgagagccaacctgagaaccaagggcaagcagtactgcggcaagggcgaggacctgtgcgccaacgacagctacgtgaccatccagaacagcgagctgatgagcggcagcatggacaagggcaccctgggcagcggcagcaagaacaacatcttctacatcctgctgagagactggggccagaacgaggccgccgacgccatgagcagactggccagactggcccccgtgtacctgagcaacagaggcttcagcatcggcatcggcgacgtgacccccggccagggcctgctgaaggccaagtacgagctgctgaacgccggctacaagaagtgcgacgagtacatcgaggccctgaacaccggcaagctgcagcagcagcccggctgcaccgccgaggagaccctggaggccctgatcctgaaggagctgagcgtgatcagagaccacgccggcagcgcctgcctgagagagctggacaagagcaacagccccctgaccatggccctgtgcggcagcaagggcagcttcatcaacatcagccagatgatcgcctgcgtgggccagcaggccatcagcggcagcagagtgcccgacggcttcgagaacagaagcctgccccacttcgagaagcacagcaagctgcccgccgccaagggcttcgtggccaacagcttctacagcggcctgacccccaccgagttcttcttccacaccatggccggcagagagggcctggtggacaccgccgtgaagaccgccgagaccggctacatgcagagaagactggtgaagagcctggaggacctgtgcagccagtacgacctgaccgtgagaagcagcaccggcgacatcatccagttcatctacggcggcgacggcctggaccccgccgccatggagggcaaggacgagcccctggagttcaagagagtgctggacaacatcaaggccgtgttcccctgccccagcgagcccgccctgagcaagaacgagctgatcctgaccaccgagagcatcatgaagaagagcgagttcctgtgctgccaggacagcttcctgcaggagatcaagaagttcatcaagggcgtgagcgagaagatcaagaagaccagagacaagtacggcatcaacgacaacggcaccaccgagcccagagtgctgtaccagctggacagaatcacccccacccaggtggagaagttcctggagacctgcagagacaagtacatgagagcccagatggagcccggcagcgccgtgggcgccctgtgcgcccagagcatcggcgagcccggcacccagatgaccctgaagaccttccacttcgccggcgtggccagcatgaacatcaccctgggcgtgcccagaatcaaggagatcatcaacgccagcaaggccatcagcacccccatcatcaccgcccagctggacaaggacgacgacgccgactacgccagactggtgaagggcagaatcgagaagaccctgctgggcgagatcagcgagtacatcgaggaggtgttcctgcccgacgactgcttcatcctggtgaagctgagcctggagagaatcagactgctgagactggaggtgaacgccgagaccgtgagatacagcatctgcaccagcaagctgagagtgaagcccggcgacgtggccgtgcacggcgaggccgtggtgtgcgtgacccccagagagaacagcaagagcagcatgtactacgtgctgcagttcctgaaggaggacctgcccaaggtggtggtgcagggcatccccgaggtgagcagagccgtgatccacatcgacgagcagagcggcaaggagaagtacaagctgctggtggagggcgacaacctgagagccgtgatggccacccacggcgtgaagggcaccagaaccaccagcaacaacacctacgaggtggagaagaccctgggcatcgaggccgccagaaccaccatcatcaacgagatccagtacaccatggtgaaccacggcatgagcatcgacagaagacacgtgatgctgctgagcgacctgatgacctacaagggcgaggtgctgggcatcaccagattcggcctggccaagatgaaggagagcgtgctgatgctggccagcttcgagaagaccgccgaccacctgttcgacgccgcctacttcggccagaaggacagcgtgtgcggcgtgagcgagtgcatcatcatgggcatccccatgaacatcggcaccggcctgttcaagctgctgcacaaggccgacagagaccccaacccccccaagagacccctgatcttcgacaccaacgagttccacatccccctggtgacctag

SEQ ID NO: 93901 - DNA, 489 bp, Artificial Sequence
  Description of Artificial Sequence: Synthetic coding sequence
atgtactacgtgctgcagttcctgaaggaggacctgcccaaggtggtggtgcagggcatccccgaggtgagcagagccgtgatccacatcgacgagcagagcggcaaggagaagtacaagctgctggtggagggcgacaacctgagagccgtgatggccacccacggcgtgaagggcaccagaaccaccagcaacaacacctacgaggtggagaagaccctgggcatcgaggccgccagaaccaccatcatcaacgagatccagtacaccatggtgaaccacggcatgagcatcgacagaagacacgtgatgctgctgagcgacctgatgacctacaagggcgaggtgctgggcatcaccagattcggcctggccaagatgaaggagagcgtgctgatgctggccagcttcgagaagaccgccgaccacctgttcgacgccgcctacttcggccagaaggacagcgtgtgcgcctggccccagccctag

SEQ ID NO: 93902 - DNA, 4110 bp, Artificial Sequence
  Description of Artificial Sequence: Synthetic coding sequence
atggtgaaggagcagttcagagagaccgacgtggccaagaagatcagccacatctgcttcggcatgaagagccccgaggagatgagacagcaggcccacatccaggtggtgagcaagaacctgtacagccaggacaaccagcacgcccccctgctgtacggcgtgctggaccacagaatgggcaccagcgagaaggacagaccctgcgagacctgcggcaagaacctggccgactgcctgggccactacggctacatcgacctggagctgccctgcttccacgtgggctacttcagagccgtgatcggcatcctgcagatgatctgcaagacctgctgccacatcatgctgagccaggaggagaagaagcagttcctggactacctgaagagacccggcctgacctacctgcagaagagaggcctgaagaagaagatcagcgacaagtgcagaaagaagaacatctgccaccactgcggcgccttcaacggcaccgtgaagaagtgcggcctgctgaagatcatccacgagaagtacaagaccaacaagaaggtggtggaccccatcgtgagcaacttcctgcagagcttcgagaccgccatcgagcacaacaaggaggtggagcccctgctgggcagagcccaggagaacctgaaccccctggtggtgctgaacctgttcaagagaatccccgccgaggacgtgcccctgctgctgatgaaccccgaggccggcaagcccagcgacctgatcctgaccagactgctggtgccccccctgtgcatcagacccagcgtggtgagcgacctgaagagcggcaccaacgaggacgacctgaccatgaagctgaccgagatcatcttcctgaacgacgtgatcaagaagcacagaatcagcggcgccaagacccagatgatcatggaggactgggacttcctgcagctgcagtgcgccctgtacatcaacagcgagctgagcggcatccccctgaacatggcccccaagaagtggaccagaggcttcgtgcagagactgaagggcaagcagggcagattcagaggcaacctgagcggcaagagagtggacttcagcggcagaaccgtgatcagccccgaccccaacctgagaatcgacgaggtggccgtgcccgtgcacgtggccaagatcctgaccttccccgagaaggtgaacaaggccaacatcaacttcctgagaaagctggtgcagaacggccccgaggtgcaccccggcgccaacttcatccagcagagacacacccagatgaagagattcctgaagtacggcaacagagagaagatggcccaggagctgaagtacggcgacatcgtggagagacacctgatcgacggcgacgtggtgctgttcaacagacagcccagcctgcacaagctgagcatcatggcccacctggccagagtgaagccccacagaaccttcagattcaacgagtgcgtgtgcaccccctacaacgccgacttcgacggcgacgagatgaacctgcacctgccccagaccgaggaggccaaggccgaggccctggtgctgatgggcaccaaggccaacctggtgacccccagaaacggcgagcccctgatcgccgccatccaggacttcctgaccggcgcctacctgctgaccctgaaggacaccttcttcgacagagccaaggcctgccagatcatcgccagcatcctggtgggcaaggacgagaagatcaaggtgagactgcccccccccaccatcctgaagcccgtgaccctgtggaccggcaagcagatcttcagcgtgatcctgagacccagcgacgacaaccccgtgagagccaacctgagaaccaagggcaagcagtactgcggcaagggcgaggacctgtgcgccaacgacagctacgtgaccatccagaacagcgagctgatgagcggcagcatggacaagggcaccctgggcagcggcagcaagaacaacatcttctacatcctgctgagagactggggccagaacgaggccgccgacgccatgagcagactggccagactggcccccgtgtacctgagcaacagaggcttcagcatcggcatcggcgacgtgacccccggccagggcctgctgaaggccaagtacgagctgctgaacgccggctacaagaagtgcgacgagtacatcgaggccctgaacaccggcaagctgcagcagcagcccggctgcaccgccgaggagaccctggaggccctgatcctgaaggagctgagcgtgatcagagaccacgccggcagcgcctgcctgagagagctggacaagagcaacagccccctgaccatggccctgtgcggcagcaagggcagcttcatcaacatcagccagatgatcgcctgcgtgggccagcaggccatcagcggcagcagagtgcccgacggcttcgagaacagaagcctgccccacttcgagaagcacagcaagctgcccgccgccaagggcttcgtggccaacagcttctacagcggcctgacccccaccgagttcttcttccacaccatggccggcagagagggcctggtggacaccgccgtgaagaccgccgagaccggctacatgcagagaagactggtgaagagcctggaggacctgtgcagccagtacgacctgaccgtgagaagcagcaccggcgacatcatccagttcatctacggcggcgacggcctggaccccgccgccatggagggcaaggacgagcccctggagttcaagagagtgctggacaacatcaaggccgtgttcccctgccccagcgagcccgccctgagcaagaacgagctgatcctgaccaccgagagcatcatgaagaagagcgagttcctgtgctgccaggacagcttcctgcaggagatcaagaagttcatcaagggcgtgagcgagaagatcaagaagaccagagacaagtacggcatcaacgacaacggcaccaccgagcccagagtgctgtaccagctggacagaatcacccccacccaggtggagaagttcctggagacctgcagagacaagtacatgagagcccagatggagcccggcagcgccgtgggcgccctgtgcgcccagagaaacatcaccctgggcgtgcccagaatcaaggagatcatcaacgccagcaaggccatcagcacccccatcatcaccgcccagctggacaaggacgacgacgccgactacgccagactggtgaagggcagaatcgagaagaccctgctgggcgagatcagcgagtacatcgaggaggtgttcctgcccgacgactgcttcatcctggtgaagctgagcctggagagaatcagactgctgagactggaggtgaacgccgagaccgtgagatacagcatctgcaccagcaagctgagagtgaagcccggcgacgtggccgtgcacggcgaggccgtggtgtgcgtgacccccagagagaacagcaagagcagcatgtactacgtgctgcagttcctgaaggaggacctgcccaaggtggtggtgcagggcatccccgaggtgagcagagccgtgatccacatcgacgagcagagcggcaaggagaagtacaagctgctggtggagggcgacaacctgagagccgtgatggccacccacggcgtgaagggcaccagaaccaccagcaacaacacctacgaggtggagaagaccctgggcatcgaggccgccagaaccaccatcatcaacgagatccagtacaccatggtgaaccacggcatgagcatcgacagaagacacgtgatgctgctgagcgacctgatgacctacaagggcgaggtgctgggcatcaccagattcggcctggccaagatgaaggagagcgtgctgatgctggccagcttcgagaagaccgccgaccacctgttcgacgccgcctacttcggccagaaggacagcgtgtgcggcgtgagcgagtgcatcatcatgggcatccccatgaacatcggcaccggcctgttcaagctgctgcacaaggccgacagagaccccaacccccccaagagacccctgatcttcgacaccaacgagttccacatccccctggtgacctag

SEQ ID NO: 93903 - DNA, 753 bp, Artificial Sequence; identical to SEQ ID NO: 78837
  Description of Artificial Sequence: Synthetic coding sequence

SEQ ID NO: 93904 - DNA, 3228 bp, Artificial Sequence
  Description of Artificial Sequence: Synthetic coding sequence
atgaaggccaacgagaaggtgaccagcgacgccgaccccatgtggtacctgaagtacctgaacatctacgtgggcctgcccgacgtggaggagagcttcaacgtgaccagacccgtgagcccccacgagtgcagactgagagacatgacctacagcgcccccatcaccgtggacatcgagtacaccagaggcagccagagaatcatcagaaacgccctgcccatcggcagaatgcccatcatgctgagaagcagcaactgcgtgctgaccggcaagacccccgccgagttcgccaagctgaacgagtgccccctggaccccggcggctacttcatcgtgaagggcgtggagaaggtgatcctgatccaggagcagctgagcaagaacagaatcatcgtggaggccgacagaaagggcgccgtgggcgccagcgtgaccagcagcacccacgagaagaagagcagaaccaacatggccgtgaagcagggcagattctacctgagacacaacaccctgagcgaggacatccccatcgtgatcatcttcaaggccatgggcgtggagagcgaccaggagatcgtgcagatgatcggcaccgaggagcacgtgatggccgccttcggccccagcctggaggagtgccagaaggcccagatcttcacccagatgcaggccctgaagtacatcggcaacaaggtgagaagacagagaatgtggggcggcggccccaagaagaccaagatcgaggaggccagagagctgctggccagcaccatcctgacccacgtgcccgtgaaggagttcaacttcagagccaagtgcatctacaccgccgtgatggtgagaagagtgatcctggcccagggcgacaacaaggtggacgacagagactactacggcaacaagagactggagctggccggccagctgctgagcctgctgttcgaggacctgttcaagaagttcaacagcgagatgaagaagatcgccgaccaggtgatccccaagcagagagccgcccagttcgacgtggtgaagcacatgagacaggaccagatcaccaacggcatggtgaacgccatcagcaccggcaactggagcctgaagagattcaagatggacagacagggcgtgacccaggtgctgagcagactgagctacatcagcgccctgggcatgatgaccagaatcagcagccagttcgagaagaccagaaaggtgagcggccccagaagcctgcagcccagccagtggggcatgctgtgccccagcgacacccccgagggcgaggcctgcggcctggtgaagaacctggccctgatgacccacatcaccaccgacatggaggacggccccatcgtgaagctggccagcaacctgggcgtggaggacgtgaacctgctgtgcggcgaggagctgagctaccccaacgtgttcctggtgttcctgaacggcaacatcctgggcgtgatcagagaccacaagaagctggtgaacaccttcagactgatgagaagagccggctacatcaacgagttcgtgagcatcagcaccaacctgaccgacagatgcgtgtacatcagcagcgacggcggcagactgtgcagaccctacatcatcgtgaagaagcagaagcccgccgtgaccaacaagcacatggaggagctggcccagggctacagaaacttcgaggacttcctgcacgagagcctggtggagtacctggacgtgaacgaggagaacgactgcaacatcgccctgtacgagcacaccatcaacaaggacaccacccacctggagatcgagcccttcaccctgctgggcgtgtgcgccggcctgatcccctacccccaccacaaccagagccccagaaacacctaccagtgcgccatgggcaagcaggccatgggcaccatcggctacaaccagagaaacagaatcgacaccctgatgtacctgctggcctacccccagaagcccatggtgaagaccaagaccatcgagctgatcgagttcgagaagctgcccgccggccagaacgccaccgtggccgtgatgagctacagcggctacgacatcgaggacgccctggtgctgaacaaggccagcctggacagaggcttcggcagatgcctggtgtacaagaacgccaagtgcaccctgaagagatacaccaaccagaccttcgacaaggtgatgggccccatgctggacgccgccaccagaaagcccatctggagacacgagatcctggacgccgacggcatctgcagccccggcgagaaggtggagaacaagcaggtgctggtgaacaagagcatgcccaccgtgacccagatccccctggagggcagcaacgtgccccagcagccccagtacaaggacgtgcccatcacctacaagggcgccaccgacagctacatcgagaaggtgatgatcagcagcaacgccgaggacgccttcctgatcaagatgctgctgagacagaccagaagacccgagatcggcgacaagttcagcagcagacacggccagaagggcgtgtgcggcctgatcgtgccccaggaggacatgcccttctgcgacagcggcatctgccccgacatcatcatgaacccccacggcttccccagcagaatgaccgtgggcaagctgatcgagctgctggccggcaaggccggcgtgctggacggcagattccactacggcaccgccttcggcggcagcaaggtgaaggacgtgtgcgaggacctggtgagacacggctacaactacctgggcaaggactacgtgaccagcggcatcaccggcgagcccctggaggcctacatctacttcggccccgtgtactaccagaagctgaagcacatggtgctggacaagatgcacgccagagccagaggccccagagccgtgctgaccagacagcccaccgagggcagaagcagagacggcggcctgagactgggcgagatggagagagactgcctgatcggctacggcgccagcatgctgctgctggagagactgatgatcagcagcgacgccttcgaggtggacgtgtgcggccagtgcggcctgctgggctacagcggctggtgccactactgcaagagcagctgccacgtgagcagcctgagaatcccctacgcctgcaagctgctgttccaggagctgcagagcatgaacatcatccccagactgaagctgagcaagtacaacgagtag

SEQ ID NO: 93905 - DNA, 633 bp, Artificial Sequence
  Description of Artificial Sequence: Synthetic coding sequence
atggacgacgaggaggagacctacagactgtggaagatcagaaagaccatcatgcagctgtgccacgacagaggctacctggtgacccaggacgagctggaccagaccctggaggagttcaaggcccagagcggcgacaagcccagcgagggcagacccagaagaaccgacctgaccgtgctggtggcccacaacgacgaccccaccgaccagatgttcgtgttcttccccgaggagcccaaggtgggcatcaagaccatcaaggtgtactgccagagaatgcaggaggagaacatcaccagagccctgatcgtggtgcagcagggcatgacccccagcgccaagcagagcctggtggacatggcccccaagtacatcctggagcagttcctgcagcaggagctgctgatcaacatcaccgagcacgagctggtgcccgagcacgtggtgatgaccaaggaggaggtgaccgagctgctggccagatacaagctgagagagaaccagctgcccagaatccaggccggcgaccccgtggccagatacttcggcatcaagagaggccaggtggtgaagatcatcagacccagcgagaccgccggcagatacatcacctacagactggtgcagtag

SEQ ID NO: 93906 - DNA, 1173 bp, Artificial Sequence
  Description of Artificial Sequence: Synthetic coding sequence
atggaggaccccaccctgtacatcgtggagagacccctgcccggctaccccgacgccgaggcccccgagcccagcagcgccggcgcccaggccgccgaggagcccagcggcgccggcagcgaggagctgatcaagagcgaccaggtgaacggcgtgctggtgctgagcctgctggacaagatcatcggcgccgtggaccagatccagctgacccaggcccagctggaggagagacaggccgagatggagggcgccgtgcagagcatccagggcgagctgagcaagctgggcaaggcccacgccaccaccagcaacaccgtgagcaagctgctggagaaggtgagaaaggtgagcgtgaacgtgaagaccgtgagaggcagcctggagagacaggccggccagatcaagaagctggaggtgaacgaggccgagctgctgagaagaagaaacttcaaggtgatgatctaccaggacgaggtgaagctgcccgccaagctgagcatcagcaagagcctgaaggagagcgaggccctgcccgagaaggagggcgaggagctgggcgagggcgagagacccgaggaggacgccgccgccctggagctgagcagcgacgaggccgtggaggtggaggaggtgatcgaggagagcagagccgagagaatcaagagaagcggcctgagaagagtggacgacttcaagaaggccttcagcaaggagaagatggagaagaccaaggtgagaaccagagagaacctggagaagaccagactgaagaccaaggagaacctggagaagaccagacacaccctggagaagagaatgaacaagctgggcaccagactggtgcccgccgagagaagagagaagctgaagaccagcagagacaagctgagaaagagcttcacccccgaccacgtggtgtacgccagaagcaagaccgccgtgtacaaggtgccccccttcaccttccacgtgaagaagatcagagagggccaggtggaggtgctgaaggccaccgagatggtggaggtgggcgccgacgacgacgagggcggcgccgagagaggcgaggccggcgacctgagaagaggcagcagccccgacgtgcacgccctgctggagatcaccgaggagagcgacgccgtgctggtggacaagagcgacagcgactag

SEQ ID NO: 93907 - DNA, 1038 bp, Artificial Sequence
  Description of Artificial Sequence: Synthetic coding sequence
atggaggaccccaccctgtacatcgtggagagacccctgcccggctaccccgacgccgtggaccagatccagctgacccaggcccagctggaggagagacaggccgagatggagggcgccgtgcagagcatccagggcgagctgagcaagctgggcaaggcccacgccaccaccagcaacaccgtgagcaagctgctggagaaggtgagaaaggtgagcgtgaacgtgaagaccgtgagaggcagcctggagagacaggccggccagatcaagaagctggaggtgaacgaggccgagctgctgagaagaagaaacttcaaggtgatgatctaccaggacgaggtgaagctgcccgccaagctgagcatcagcaagagcctgaaggagagcgaggccctgcccgagaaggagggcgaggagctgggcgagggcgagagacccgaggaggacgccgccgccctggagctgagcagcgacgaggccgtggaggtggaggaggtgatcgaggagagcagagccgagagaatcaagagaagcggcctgagaagagtggacgacttcaagaaggccttcagcaaggagaagatggagaagaccaaggtgagaaccagagagaacctggagaagaccagactgaagaccaaggagaacctggagaagaccagacacaccctggagaagagaatgaacaagctgggcaccagactggtgcccgccgagagaagagagaagctgaagaccagcagagacaagctgagaaagagcttcacccccgaccacgtggtgtacgccagaagcaagaccgccgtgtacaaggtgccccccttcaccttccacgtgaagaagatcagagagggccaggtggaggtgctgaaggccaccgagatggtggaggtgggcgccgacgacgacgagggcggcgccgagagaggcgaggccggcgacctgagaagaggcagcagccccgacgtgcacgccctgctggagatcaccgaggagagcgacgccgtgctggtggacaagagcgacagcgactag

SEQ ID NO: 93908 - DNA, 2295 bp, Artificial Sequence
  Description of Artificial Sequence: Synthetic coding sequence
atgctgctgttcgtgctgacctgcctgctggccgtgttccccgccatcagcaccaagagccccatcttcggccccgaggaggtgaacagcgtggagggcaacagcgtgagcatcacctgctactacccccccaccagcgtgaacagacacaccagaaagtactggtgcagacagggcgccagaggcggctgcatcaccctgatcagcagcgagggctacgtgagcagcaagtacgccggcagagccaacctgaccaacttccccgagaacggcaccttcgtggtgaacatcgcccagctgagccaggacgacagcggcagatacaagtgcggcctgggcatcaacagcagaggcctgagcttcgacgtgagcctggaggtgagccagggccccggcctgctgaacgacaccaaggtgtacaccgtggacctgggcagaaccgtgaccatcaactgccccttcaagaccgagaacgcccagaagagaaagagcctgtacaagcagatcggcctgtaccccgtgctggtgatcgacagcagcggctacgtgaaccccaactacaccggcagaatcagactggacatccagggcaccggccagctgctgttcagcgtggtgatcaaccagctgagactgagcgacgccggccagtacctgtgccaggccggcgacgacagcaacagcaacaagaagaacgccgacctgcaggtgctgaagcccgagcccgagctggtgtacgaggacctgagaggcagcgtgaccttccactgcgccctgggccccgaggtggccaacgtggccaagttcctgtgcagacagagcagcggcgagaactgcgacgtggtggtgaacaccctgggcaagagagcccccgccttcgagggcagaatcctgctgaacccccaggacaaggacggcagcttcagcgtggtgatcaccggcctgagaaaggaggacgccggcagatacctgtgcggcgcccacagcgacggccagctgcaggagggcagccccatccaggcctggcagctgttcgtgaacgaggagagcaccatccccagaagccccaccgtggtgaagggcgtggccggcggcagcgtggccgtgctgtgcccctacaacagaaaggagagcaagagcatcaagtactggtgcctgtgggagggcgcccagaacggcagatgccccctgctggtggacagcgagggctgggtgaaggcccagtacgagggcagactgagcctgctggaggagcccggcaacggcaccttcaccgtgatcctgaaccagctgaccagcagagacgccggcttctactggtgcctgaccaacggcgacaccctgtggagaaccaccgtggagatcaagatcatcgagggcgagcccaacctgaaggtgcccggcaacgtgaccgccgtgctgggcgagaccctgaaggtgccctgccacttcccctgcaagttcagcagctacgagaagtactggtgcaagtggaacaacaccggctgccaggccctgcccagccaggacgagggccccagcaaggccttcgtgaactgcgacgagaacagcagactggtgagcctgaccctgaacctggtgaccagagccgacgagggctggtactggtgcggcgtgaagcagggccacttctacggcgagaccgccgccgtgtacgtggccgtggaggagagaaaggccgccggcagcagagacgtgagcctggccaaggccgacgccgcccccgacgagaaggtgctggacagcggcttcagagagatcgagaacaaggccatccaggaccccagactgttcgccgaggagaaggccgtggccgacaccagagaccaggccgacggcagcagagccagcgtggacagcggcagcagcgaggagcagggcggcagcagcagagccctggtgagcaccctggtgcccctgggcctggtgctggccgtgggcgccgtggccgtgggcgtggccagagccagacacagaaagaacgtggacagagtgagcatcagaagctacagaaccgacatcagcatgagcgacttcgagaacagcagagagttcggcgccaacgacaacatgggcgccagcagcatcacccaggagaccagcctgggcggcaaggaggagttcgtggccaccaccgagagcaccaccgagaccaaggagcccaagaaggccaagagaagcagcaaggaggaggccgagatggcctacaaggacttcctgctgcagagcagcaccgtggccgccgaggcccaggacggcccccaggaggcctag

SEQ ID NO: 93909 - DNA, 1596 bp, Artificial Sequence
  Description of Artificial Sequence: Synthetic coding sequence
atggacggcatcgtgcccgacatcgccgtgggcaccaagagaggcagcgacgagctgttcagcacctgcgtgaccaacggccccttcatcatgagcagcaacagcgccagcgccgccaacggcaacgacagcaagaagttcaagggcgacagcagaagcgccggcgtgcccagcagagtgatccacatcagaaagctgcccatcgacgtgaccgagggcgaggtgatcagcctgggcctgcccttcggcaaggtgaccaacctgctgatgctgaagggcaagaaccaggccttcatcgagatgaacaccgaggaggccgccaacaccatggtgaactactacaccagcgtgacccccgtgctgagaggccagcccatctacatccagttcagcaaccacaaggagctgaagaccgacagcagccccaaccaggccagagcccaggccgccctgcaggccgtgaacagcgtgcagagcggcaacctggccctggccgccagcgccgccgccgtggacgccggcatggccatggccggccagagccccgtgctgagaatcatcgtggagaacctgttctaccccgtgaccctggacgtgctgcaccagatcttcagcaagttcggcaccgtgctgaagatcatcaccttcaccaagaacaaccagttccaggccctgctgcagtacgccgaccccgtgagcgcccagcacgccaagctgagcctggacggccagaacatctacaacgcctgctgcaccctgagaatcgacttcagcaagctgaccagcctgaacgtgaagtacaacaacgacaagagcagagactacaccagacccgacctgcccagcggcgacagccagcccagcctggaccagaccatggccgccgccttcggcctgagcgtgcccaacgtgcacggcgccctggcccccctggccatccccagcgccgccgccgccgccgccgccgccggcagaatcgccatccccggcctggccggcgccggcaacagcgtgctgctggtgagcaacctgaaccccgagagagtgaccccccagagcctgttcatcctgttcggcgtgtacggcgacgtgcagagagtgaagatcctgttcaacaagaaggagaacgccctggtgcagatggccgacggcaaccaggcccagctggccatgagccacctgaacggccacaagctgcacggcaagcccatcagaatcaccctgagcaagcaccagaacgtgcagctgcccagagagggccaggaggaccagggcctgaccaaggactacggcaacagccccctgcacagattcaagaagcccggcagcaagaacttccagaacatcttcccccccagcgccaccctgcacctgagcaacatcccccccagcgtgagcgaggaggacctgaaggtgctgttcagcagcaacggcggcgtggtgaagggcttcaagttcttccagaaggacagaaagatggccctgatccagatgggcagcgtggaggaggccgtgcaggccctgatcgacctgcacaaccacgacctgggcgagaaccaccacctgagagtgagcttcagcaagagcaccatctag

SEQ ID NO: 93910 - DNA, 594 bp, Artificial Sequence
  Description of Artificial Sequence: Synthetic coding sequence
atggacggcatcgtgcccgacatcgccgtgggcaccaagagagtgaccccccagagcctgttcatcctgttcggcgtgtacggcgacgtgcagagagtgaagatcctgttcaacaagaaggagaacgccctggtgcagatggccgacggcaaccaggcccagctggccatgagccacctgaacggccacaagctgcacggcaagcccatcagaatcaccctgagcaagcaccagaacgtgcagctgcccagagagggccaggaggaccagggcctgaccaaggactacggcaacagccccctgcacagattcaagaagcccggcagcaagaacttccagaacatcttcccccccagcgccaccctgcacctgagcaacatcccccccagcgtgagcgaggaggacctgaaggtgctgttcagcagcaacggcggcgtggtgaagggcttcaagttcttccagaaggacagaaagatggccctgatccagatgggcagcgtggaggaggccgtgcaggccctgatcgacctgcacaaccacgacctgggcgagaaccaccacctgagagtgagcttcagcaagagcaccatctag

SEQ ID NO: 93911 - DNA, 1674 bp, Artificial Sequence
  Description of Artificial Sequence: Synthetic coding sequence
atggacggcatcgtgcccgacatcgccgtgggcaccaagagaggcagcgacgagctgttcagcacctgcgtgaccaacggccccttcatcatgagcagcaacagcgccagcgccgccaacggcaacgacagcaagaagttcaagggcgacagcagaagcgccggcgtgcccagcagagtgatccacatcagaaagctgcccatcgacgtgaccgagggcgaggtgatcagcctgggcctgcccttcggcaaggtgaccaacctgctgatgctgaagggcaagaaccaggccttcatcgagatgaacaccgaggaggccgccaacaccatggtgaactactacaccagcgtgacccccgtgctgagaggccagcccatctacatccagttcagcaaccacaaggagctgaagaccgacagcagccccaaccaggccagagcccaggccgccctgcaggccgtgaacagcgtgcagagcggcaacctggccctggccgccagcgccgccgccgtggacgccggcatggccatggccggccagagccccgtgctgagaatcatcgtggagaacctgttctaccccgtgaccctggacgtgctgcaccagatcttcagcaagttcggcaccgtgctgaagatcatcaccttcaccaagaacaaccagttccaggccctgctgcagtacgccgaccccgtgagcgcccagcacgccaagctgagcctggacggccagaacatctacaacgcctgctgcaccctgagaatcgacttcagcaagctgaccagcctgaacgtgaagtacaacaacgacaagagcagagactacaccagacccgacctgcccagcggcgacagccagcccagcctggaccagaccatggccgccgccttcggcgcccccggcatcatcagcgccagcccctacgccggcgccggcttcccccccaccttcgccatcccccaggccgccggcctgagcgtgcccaacgtgcacggcgccctggcccccctggccatccccagcgccgccgccgccgccgccgccgccggcagaatcgccatccccggcctggccggcgccggcaacagcgtgctgctggtgagcaacctgaaccccgagagagtgaccccccagagcctgttcatcctgttcggcgtgtacggcgacgtgcagagagtgaagatcctgttcaacaagaaggagaacgccctggtgcagatggccgacggcaaccaggcccagctggccatgagccacctgaacggccacaagctgcacggcaagcccatcagaatcaccctgagcaagcaccagaacgtgcagctgcccagagagggccaggaggaccagggcctgaccaaggactacggcaacagccccctgcacagattcaagaagcccggcagcaagaacttccagaacatcttcccccccagcgccaccctgcacctgagcaacatcccccccagcgtgagcgaggaggacctgaaggtgctgttcagcagcaacggcggcgtggtgaagggcttcaagttcttccagaaggacagaaagatggccctgatccagatgggcagcgtggaggaggccgtgcaggccctgatcgacctgcacaaccacgacctgggcgagaaccaccacctgagagtgagcttcagcaagagcaccatctag

SEQ ID NO: 93912 - DNA, 1653 bp, Artificial Sequence
  Description of Artificial Sequence: Synthetic coding sequence
atggacggcatcgtgcccgacatcgccgtgggcaccaagagaggcagcgacgagctgttcagcacctgcgtgaccaacggccccttcatcatgagcagcaacagcgccagcgccgccaacggcaacgacagcaagaagttcaagggcgacagcagaagcgccggcgtgcccagcagagtgatccacatcagaaagctgcccatcgacgtgaccgagggcgaggtgatcagcctgggcctgcccttcggcaaggtgaccaacctgctgatgctgaagggcaagaaccaggccttcatcgagatgaacaccgaggaggccgccaacaccatggtgaactactacaccagcgtgacccccgtgctgagaggccagcccatctacatccagttcagcaaccacaaggagctgaagaccgacagcagccccaaccaggccagagcccaggccgccctgcaggccgtgaacagcgtgcagagcggcaacctggccctggccgccagcgccgccgccgtggacgccggcatggccatggccggccagagccccgtgctgagaatcatcgtggagaacctgttctaccccgtgaccctggacgtgctgcaccagatcttcagcaagttcggcaccgtgctgaagatcatcaccttcaccaagaacaaccagttccaggccctgctgcagtacgccgaccccgtgagcgcccagcacgccaagctgagcctggacggccagaacatctacaacgcctgctgcaccctgagaatcgacttcagcaagctgaccagcctgaacgtgaagtacaacaacgacaagagcagagactacaccagacccgacctgcccagcggcgacagccagcccagcctggaccagaccatggccgccgccttcgccagcccctacgccggcgccggcttcccccccaccttcgccatcccccaggccgccggcctgagcgtgcccaacgtgcacggcgccctggcccccctggccatccccagcgccgccgccgccgccgccgccgccggcagaatcgccatccccggcctggccggcgccggcaacagcgtgctgctggtgagcaacctgaaccccgagagagtgaccccccagagcctgttcatcctgttcggcgtgtacggcgacgtgcagagagtgaagatcctgttcaacaagaaggagaacgccctggtgcagatggccgacggcaaccaggcccagctggccatgagccacctgaacggccacaagctgcacggcaagcccatcagaatcaccctgagcaagcaccagaacgtgcagctgcccagagagggccaggaggaccagggcctgaccaaggactacggcaacagccccctgcacagattcaagaagcccggcagcaagaacttccagaacatcttcccccccagcgccaccctgcacctgagcaacatcccccccagcgtgagcgaggaggacctgaaggtgctgttcagcagcaacggcggcgtggtgaagggcttcaagttcttccagaaggacagaaagatggccctgatccagatgggcagcgtggaggaggccgtgcaggccctgatcgacctgcacaaccacgacctgggcgagaaccaccacctgagagtgagcttcagcaagagcaccatctag

SEQ ID NO: 93913 - DNA, 1599 bp, Artificial Sequence
  Description of Artificial Sequence: Synthetic coding sequence
atggacggcatcgtgaccgaggtggccgtgggcgtgaagagaggcagcgacgagctgctgagcggcagcgtgctgagcagccccaacagcaacatgagcagcatggtggtgaccgccaacggcaacgacagcaagaagttcaagggcgaggacaagatggacggcgcccccagcagagtgctgcacatcagaaagctgcccggcgaggtgaccgagaccgaggtgatcgccctgggcctgcccttcggcaaggtgaccaacatcctgatgctgaagggcaagaaccaggccttcctggagctggccaccgaggaggccgccatcaccatggtgaactactacagcgccgtgaccccccacctgagaaaccagcccatctacatccagtacagcaaccacaaggagctgaagaccgacaacaccctgaaccagagagcccaggccgtgctgcaggccgtgaccgccgtgcagaccgccaacacccccctgagcggcaccaccgtgagcgagagcgccgtgacccccgcccagagccccgtgctgagaatcatcatcgacaacatgtactaccccgtgaccctggacgtgctgcaccagatcttcagcaagttcggcgccgtgctgaagatcatcaccttcaccaagaacaaccagttccaggccctgctgcagtacggcgaccccgtgaacgcccagcaggccaagctggccctggacggccagaacatctacaacgcctgctgcaccctgagaatcgacttcagcaagctggtgaacctgaacgtgaagtacaacaacgacaagagcagagactacaccagacccgacctgcccagcggcgacggccagcccgccctggaccccgccatcgccgccgccttcgccaaggagaccagcctgctggccgtgcccggcgccctgagccccctggccatccccaacgccgccgccgccgccgccgccgccgccgccggcagagtgggcatgcccggcgtgagcgccggcggcaacaccgtgctgctggtgagcaacctgaacgaggagatggtgaccccccagagcctgttcaccctgttcggcgtgtacggcgacgtgcagagagtgaagatcctgtacaacaagaaggacagcgccctgatccagatggccgacggcaaccagagccagctggccatgaaccacctgaacggccagaagatgtacggcaagatcatcagagtgaccctgagcaagcaccagaccgtgcagctgcccagagagggcctggacgaccagggcctgaccaaggacttcggcaacagccccctgcacagattcaagaagcccggcagcaagaacttccagaacatcttcccccccagcgccaccctgcacctgagcaacatcccccccagcgtggccgaggaggacctgagaaccctgttcgccaacaccggcggcaccgtgaaggccttcaagttcttccagagagaccacaagatggccctgctgcagatggccaccgtggaggaggccatccaggccctgatcgacctgcacaactacaacctgggcgagaaccaccacctgagagtgagcttcagcaagagcaccatctag

SEQ ID NO: 93914 - DNA, 1614 bp, Artificial Sequence
  Description of Artificial Sequence: Synthetic coding sequence
atggacggcatcgtgaccgaggtggccgtgggcgtgaagagaggcagcgacgagctgctgagcggcagcgtgctgagcagccccaacagcaacatgagcagcatggtggtgaccgccaacggcaacgacagcaagaagttcaagggcgaggacaagatggacggcgcccccagcagagtgctgcacatcagaaagctgcccggcgaggtgaccgagaccgaggtgatcgccctgggcctgcccttcggcaaggtgaccaacatcctgatgctgaagggcaagaaccaggccttcctggagctggccaccgaggaggccgccatcaccatggtgaactactacagcgccgtgaccccccacctgagaaaccagcccatctacatccagtacagcaaccacaaggagctgaagaccgacaacaccctgaaccagagagcccaggccgtgctgcaggccgtgaccgccgtgcagaccgccaacacccccctgagcggcaccaccgtgagcgagagcgccgtgacccccgcccagagccccgtgctgagaatcatcatcgacaacatgtactaccccgtgaccctggacgtgctgcaccagatcttcagcaagttcggcgccgtgctgaagatcatcaccttcaccaagaacaaccagttccaggccctgctgcagtacggcgaccccgtgaacgcccagcaggccaagctggccctggacggccagaacatctacaacgcctgctgcaccctgagaatcgacttcagcaagctggtgaacctgaacgtgaagtacaacaacgacaagagcagagactacaccagacccgacctgcccagcggcgacggccagcccgccctggaccccgccatcgccgccgccttcgccaaggagaccagcctgctgggcctgcccgtggccgccgtgcccggcgccctgagccccctggccatccccaacgccgccgccgccgccgccgccgccgccgccggcagagtgggcatgcccggcgtgagcgccggcggcaacaccgtgctgctggtgagcaacctgaacgaggagatggtgaccccccagagcctgttcaccctgttcggcgtgtacggcgacgtgcagagagtgaagatcctgtacaacaagaaggacagcgccctgatccagatggccgacggcaaccagagccagctggccatgaaccacctgaacggccagaagatgtacggcaagatcatcagagtgaccctgagcaagcaccagaccgtgcagctgcccagagagggcctggacgaccagggcctgaccaaggacttcggcaacagccccctgcacagattcaagaagcccggcagcaagaacttccagaacatcttcccccccagcgccaccctgcacctgagcaacatcccccccagcgtggccgaggaggacctgagaaccctgttcgccaacaccggcggcaccgtgaaggccttcaagttcttccagagagaccacaagatggccctgctgcagatggccaccgtggaggaggccatccaggccctgatcgacctgcacaactacaacctgggcgagaaccaccacctgagagtgagcttcagcaagagcaccatctag

SEQ ID NO: 93915 - DNA, 1611 bp, Artificial Sequence
  Description of Artificial Sequence: Synthetic coding sequence
atggacggcatcgtgaccgaggtggccgtgggcgtgaagagaggcagcgacgagctgctgagcggcagcgtgctgagcagccccaacagcaacatgagcagcatggtggtgaccgccaacggcaacgacagcaagaagttcaagggcgaggacaagatggacggcgcccccagcagagtgctgcacatcagaaagctgcccggcgaggtgaccgagaccgaggtgatcgccctgggcctgcccttcggcaaggtgaccaacatcctgatgctgaagggcaagaaccaggccttcctggagctggccaccgaggaggccgccatcaccatggtgaactactacagcgccgtgaccccccacctgagaaaccagcccatctacatccagtacagcaaccacaaggagctgaagaccgacaacaccctgaaccagagagcccaggccgtgctgcaggccgtgaccgccgtgcagaccgccaacacccccctgagcggcaccaccgtgagcgagagcgccgtgacccccgcccagagccccgtgctgagaatcatcatcgacaacatgtactaccccgtgaccctggacgtgctgcaccagatcttcagcaagttcggcgccgtgctgaagatcatcaccttcaccaagaacaaccagttccaggccctgctgcagtacggcgaccccgtgaacgcccagcaggccaagctggccctggacggccagaacatctacaacgcctgctgcaccctgagaatcgacttcagcaagctggtgaacctgaacgtgaagtacaacaacgacaagagcagagactacaccagacccgacctgcccagcggcgacggccagcccgccctggaccccgccatcgccgccgccttcgccaaggagaccagcctgctgggcctgcccgtggccgccgtgcccggcgccctgagccccctggccatccccaacgccgccgccgccgccgccgccgccgccgccggcagagtgggcatgcccggcgtgagcgccggcggcaacaccgtgctgctggtgagcaacctgaacgaggagatggtgaccccccagagcctgttcaccctgttcggcgtgtacggcgacgtgcagagagtgaagatcctgtacaacaagaaggacagcgccctgatccagatggccgacggcaaccagagccagctggccatgaaccacctgaacggccagaagatgtacggcaagatcatcagagtgaccctgagcaagcaccagaccgtgcagctgcccagagagggcctggacgaccagggcctgaccaaggacttcggcaacagccccctgcacagattcaagaagcccggcagcaagaacttccagaacatcttcccccccagcgccaccctgcacctgagcaacatcccccccagcgtggccgaggaggacctgagaaccctgttcgccaacaccggcggcaccgtgaaggccttcaagttcttccaggaccacaagatggccctgctgcagatggccaccgtggaggaggccatccaggccctgatcgacctgcacaactacaacctgggcgagaaccaccacctgagagtgagcttcagcaagagcaccatctag

SEQ ID NO: 93916 - DNA, 1056 bp, Artificial Sequence
  Description of Artificial Sequence: Synthetic coding sequence
ggcatgaagagaggcagcgacgagctgctgagcggcagcgtgctgagcagccccaacagcaacatgagcagcatggtggtgaccgccaacggcaacgacagcaagaagttcaagggcgaggacaagatggacggcgcccccagcagagtgctgcacatcagaaagctgcccggcgaggtgaccgagaccgaggtgatcgccctgggcctgcccttcggcaaggtgaccaacatcctgatgctgaagggcaagaaccaggccttcctggagctggccaccgaggaggccgccatcaccatggtgaactactacagcgccgtgaccccccacctgagaaaccagcccatctacatccagtacagcaaccacaaggagctgaagaccgacaacaccctgaaccagagagcccaggccgtgctgcaggccgtgaccgccgtgcagaccgccaacacccccctgagcggcaccaccgtgagcgagagcgccgtgacccccgcccagagccccgtgctgagaatcatcatcgacaacatgtactaccccgtgaccctggacgtgctgcaccagatcttcagcaagttcggcgccgtgctgaagatcatcaccttcaccaagaacaaccagttccaggccctgctgcagtacggcgaccccgtgaacgcccagcaggccaagctggccctggacggccagaacatctacaacgcctgctgcaccctgagaatcgacttcagcaagctggtgaacctgaacgtgaagtacaacaacgacaagagcagagactacaccagacccgacctgcccagcggcgacggccagcccgccctggaccccgccatcgccgccgccttcgccaaggagaccagcctgctgggcctgcccgtggccgccgtgcccggcgccctgagccccctggccatccccaacgccgccgccgccgccgccgccgccgccgccggcagagtgggcatgcccggcgtgagcgccggcggcaacaccgtgctgctggtgagcaacctgaacgaggaggtgttcatggagatgtgcagcgtgtag

SEQ ID NO: 93917 - DNA, 1647 bp, Artificial Sequence
  Description of Artificial Sequence: Synthetic coding sequence
atgtggagcaacctgaccttcagcttcttcggcctgagaaccaaggccaagaagtacgtgaccgtgaacaacagaggcagcgacgagctgctgagcggcagcgtgctgagcagccccaacagcaacatgagcagcatggtggtgaccgccaacggcaacgacagcaagaagttcaagggcgaggacaagatggacggcgcccccagcagagtgctgcacatcagaaagctgcccggcgaggtgaccgagaccgaggtgatcgccctgggcctgcccttcggcaaggtgaccaacatcctgatgctgaagggcaagaaccaggccttcctggagctggccaccgaggaggccgccatcaccatggtgaactactacagcgccgtgaccccccacctgagaaaccagcccatctacatccagtacagcaaccacaaggagctgaagaccgacaacaccctgaaccagagagcccaggccgtgctgcaggccgtgaccgccgtgcagaccgccaacacccccctgagcggcaccaccgtgagcgagagcgccgtgacccccgcccagagccccgtgctgagaatcatcatcgacaacatgtactaccccgtgaccctggacgtgctgcaccagatcttcagcaagttcggcgccgtgctgaagatcatcaccttcaccaagaacaaccagttccaggccctgctgcagtacggcgaccccgtgaacgcccagcaggccaagctggccctggacggccagaacatctacaacgcctgctgcaccctgagaatcgacttcagcaagctggtgaacctgaacgtgaagtacaacaacgacaagagcagagactacaccagacccgacctgcccagcggcgacggccagcccgccctggaccccgccatcgccgccgccttcgccaaggagaccagcctgctgggcctgcccgtggccgccgtgcccggcgccctgagccccctggccatccccaacgccgccgccgccgccgccgccgccgccgccggcagagtgggcatgcccggcgtgagcgccggcggcaacaccgtgctgctggtgagcaacctgaacgaggagatggtgaccccccagagcctgttcaccctgttcggcgtgtacggcgacgtgcagagagtgaagatcctgtacaacaagaaggacagcgccctgatccagatggccgacggcaaccagagccagctggccatgaaccacctgaacggccagaagatgtacggcaagatcatcagagtgaccctgagcaagcaccagaccgtgcagctgcccagagagggcctggacgaccagggcctgaccaaggacttcggcaacagccccctgcacagattcaagaagcccggcagcaagaacttccagaacatcttcccccccagcgccaccctgcacctgagcaacatcccccccagcgtggccgaggaggacctgagaaccctgttcgccaacaccggcggcaccgtgaaggccttcaagttcttccagagagaccacaagatggccctgctgcagatggccaccgtggaggaggccatccaggccctgatcgacctgcacaactacaacctgggcgagaaccaccacctgagagtgagcttcagcaagagcaccatctag

SEQ ID NO: 93918 - DNA, 1596 bp, Artificial Sequence
  Description of Artificial Sequence: Synthetic coding sequence
atggacggcatcgtgaccgaggtggccgtgggcgtgaagagaggcagcgacgagctgctgagcggcagcgtgctgagcagccccaacagcaacatgagcagcatggtggtgaccgccaacggcaacgacagcaagaagttcaagggcgaggacaagatggacggcgcccccagcagagtgctgcacatcagaaagctgcccggcgaggtgaccgagaccgaggtgatcgccctgggcctgcccttcggcaaggtgaccaacatcctgatgctgaagggcaagaaccaggccttcctggagctggccaccgaggaggccgccatcaccatggtgaactactacagcgccgtgaccccccacctgagaaaccagcccatctacatccagtacagcaaccacaaggagctgaagaccgacaacaccctgaaccagagagcccaggccgtgctgcaggccgtgaccgccgtgcagaccgccaacacccccctgagcggcaccaccgtgagcgagagcgccgtgacccccgcccagagccccgtgctgagaatcatcatcgacaacatgtactaccccgtgaccctggacgtgctgcaccagatcttcagcaagttcggcgccgtgctgaagatcatcaccttcaccaagaacaaccagttccaggccctgctgcagtacggcgaccccgtgaacgcccagcaggccaagctggccctggacggccagaacatctacaacgcctgctgcaccctgagaatcgacttcagcaagctggtgaacctgaacgtgaagtacaacaacgacaagagcagagactacaccagacccgacctgcccagcggcgacggccagcccgccctggaccccgccatcgccgccgccttcgccaaggagaccagcctgctggccgtgcccggcgccctgagccccctggccatccccaacgccgccgccgccgccgccgccgccgccgccggcagagtgggcatgcccggcgtgagcgccggcggcaacaccgtgctgctggtgagcaacctgaacgaggagatggtgaccccccagagcctgttcaccctgttcggcgtgtacggcgacgtgcagagagtgaagatcctgtacaacaagaaggacagcgccctgatccagatggccgacggcaaccagagccagctggccatgaaccacctgaacggccagaagatgtacggcaagatcatcagagtgaccctgagcaagcaccagaccgtgcagctgcccagagagggcctggacgaccagggcctgaccaaggacttcggcaacagccccctgcacagattcaagaagcccggcagcaagaacttccagaacatcttcccccccagcgccaccctgcacctgagcaacatcccccccagcgtggccgaggaggacctgagaaccctgttcgccaacaccggcggcaccgtgaaggccttcaagttcttccaggaccacaagatggccctgctgcagatggccaccgtggaggaggccatccaggccctgatcgacctgcacaactacaacctgggcgagaaccaccacctgagagtgagcttcagcaagagcaccatctag

SEQ ID NO: 93919 - DNA, 978 bp, Artificial Sequence
  Description of Artificial Sequence: Synthetic coding sequence
atgagcagcatggtggtgaccgccaacggcaacgacagcaagaagttcaagggcgaggacaagatggacggcgcccccagcagagtgctgcacatcagaaagctgcccggcgaggtgaccgagaccgaggtgatcgccctgggcctgcccttcggcaaggtgaccaacatcctgatgctgaagggcaagaaccaggccttcctggagctggccaccgaggaggccgccatcaccatggtgaactactacagcgccgtgaccccccacctgagaaaccagcccatctacatccagtacagcaaccacaaggagctgaagaccgacaacaccctgaaccagagagcccaggccgtgctgcaggccgtgaccgccgtgcagaccgccaacacccccctgagcggcaccaccgtgagcgagagcgccgtgacccccgcccagagccccgtgctgagaatcatcatcgacaacatgtactaccccgtgaccctggacgtgctgcaccagatcttcagcaagttcggcgccgtgctgaagatcatcaccttcaccaagaacaaccagttccaggccctgctgcagtacggcgaccccgtgaacgcccagcaggccaagctggccctggacggccagaacatctacaacgcctgctgcaccctgagaatcgacttcagcaagctggtgaacctgaacgtgaagtacaacaacgacaagagcagagactacaccagacccgacctgcccagcggcgacggccagcccgccctggaccccgccatcgccgccgccttcgccaaggagaccagcctgctggccgtgcccggcgccctgagccccctggccatccccaacgccgccgccgccgccgccgccgccgccgccggcagagtgggcatgcccggcgtgagcgccggcggcaacaccgtgctgctggtgagcaacctgaacgaggaggtgttcatggagatgtgcagcgtgtag

SEQ ID NO: 93920 - DNA, 615 bp, Artificial Sequence
  Description of Artificial Sequence: Synthetic coding sequence
atgcccggcgtgagcgccggcggcaacaccgtgctgctggtgagcaacctgaacgaggagatggtgaccccccagagcctgttcaccctgttcggcgtgtacggcgacgtgcagagagtgaagatcctgtacaacaagaaggacagcgccctgatccagatggccgacggcaaccagagccagctggccatgaaccacctgaacggccagaagatgtacggcaagatcatcagagtgaccctgagcaagcaccagaccgtgcagctgcccagagagggcctggacgaccagggcctgaccaaggacttcggcaacagccccctgcacagattcaagaagcccggcagcaagaacttccagaacatcttcccccccagcgccaccctgcacctgagcaacatcccccccagcgtggccgaggaggacctgagaaccctgttcgccaacaccggcggcaccgtgaaggccttcaagttcttccagagagaccacaagatggccctgctgcagatggccaccgtggaggaggccatccaggccctgatcgacctgcacaactacaacctgggcgagaaccaccacctgagagtgagcttcagcaagagcaccatctag

SEQ ID NO: 93921 - DNA, 348 bp, Artificial Sequence
  Description of Artificial Sequence: Synthetic coding sequence
atggtgtgcagccccgtgaccctgagaatcgccccccccgacagaagattcagcagaagcgccatccccgagcagatcatcagcagcaccctgagcagccccagcagcaacgcccccgacccctgcgccaaggagaccgtgctgagcgccctgaaggagaagaagaagaagagaaccgtggaggaggaggaccagatcttcctggacggccaggagaacaagagaagctgcctggtggacggcctgaccgacgccagcagcgccttcaaggtgcccagacccggccccgacaccctgcagttcaccgtggacgtgttccacttcgccaacgacagcagaaacatgtag

SEQ ID NO: 93922 - DNA, 564 bp, Artificial Sequence
  Description of Artificial Sequence: Synthetic coding sequence
atggtgtgcagccccgtgaccctgagaatcgccccccccgacagaagattcagcagaagcgccatccccgagcagatcatcagcagcaccctgagcagccccagcagcaacgcccccgacccctgcgccaaggagaccgtgctgagcgccctgaaggagaagaagaagaagagaaccgtggaggaggaggaccagatcttcctggacggccaggagaacaagagaagctgcctggtggacggcctgaccgacgccagcagcgccttcaaggtgcccagacccggccccgacaccctgcagttcaccgtggacgtgttccacttcgccaacgacagcagaaacatgatctacatcacctgccacctgaaggtgaccctggccgagcaggaccccgacgagctgaacaaggcctgcagcttcagcaagcccagcaacagctggttccccgtggagggcctggccgacatctgccagtgctgcaacaagggcgactgcggcacccccagccacagcagaagacagcccagagtggtgagccagtggagcaccagcgccagcctgtag

SEQ ID NO: 93923 - DNA, 1095 bp, Artificial Sequence
  Description of Artificial Sequence: Synthetic coding sequence
atgagcgccaacagcagcagagtgggccagctgctgctgcagggcagcgcctgcatcagatggaagcaggacgtggagggcgccgtgtaccacctggccaactgcctgctgctgctgggcttcatgggcggcagcggcgtgtacggctgcttctacctgttcggcttcctgagcgccggctacctgtgctgcgtgctgtggggctggttcagcgcctgcggcctggacatcgtgctgtggagcttcctgctggccgtggtgtgcctgctgcagctggcccacctggtgtacagactgagagaggacaccctgcccgaggagttcgacctgctgtacaagaccctgtgcctgcccctgcaggtgcccctgcagacctacaaggagatcgtgcactgctgcgaggagcaggtgctgaccctggccaccgagcagacctacgccgtggagggcgagacccccatcaacagactgagcctgctgctgagcggcagagtgagagtgagccaggacggccagttcctgcactacatcttcccctaccagttcatggacagccccgagtgggagagcctgcagcccagcgaggagggcgtgttccaggtgaccctgaccgccgagaccagctgcagctacatcagctggcccagaaagagcctgcacctgctgctgaccaaggagagatacatcagctgcctgttcagcgccctgctgggctacgacatcagcgagaagctgtacaccctgaacgacaagctgttcgccaagttcggcctgagattcgacatcagactgcccagcctgtaccacgtgctgggccccaccgccgccgacgccggccccgagagcgagaagggcgacgaggaggtgtgcgagcccgccgtgagccccccccaggccacccccaccagcctgcagcagacccccccctgcagcaccccccccgccaccaccaacttccccgccccccccaccagagccagactgagcagacccgacagcggcatcctggccagcagaatccccctgcagagctacagccaggtgatcagcagaggccaggcccccctggcccccacccacacccccgagctgtag

SEQ ID NO: 93924 - DNA, 1083 bp, Artificial Sequence
  Description of Artificial Sequence: Synthetic coding sequence
atgagcgccaacagcagcagagtgggccagctgctgctgcagggcagcgcctgcatcagatggaagcaggacgtggagggcgccgtgtaccacctggccaactgcctgctgctgctgggcttcatgggcggcagcggcgtgtacggctgcttctacctgttcggcttcctgagcgccggctacctgtgctgcgtgctgtggggctggttcagcgcctgcggcctggacatcgtgctgtggagcttcctgctggccgtggtgtgcctgctgcagctggcccacctggtgtacagactgagagaggacaccctgcccgaggagttcgacctgctgtacaagaccctgtgcctgcccctgcaggtgcccctgcagacctacaaggagatcgtgcactgctgcgaggagcaggtgctgaccctggccaccgagcagacctacgccgtggagggcgagacccccatcaacagactgagcctgctgctgagcggcagagtgagagtgagccaggacggccagttcctgcactacatcttcccctaccagttcatggacagccccgagtgggagagcctgcagcccagcgaggagggcgtgttccaggtgaccctgaccgccgagaccagctgcagctacatcagctggcccagaaagagcctgcacctgctgctgaccaaggagagatacatcagctgcctgttcagcgccctgctgggctacgacatcagcgagaagctgtacaccctgaacgacaagctgttcgccaagttcggcctgagattcgacatcagactgcccagcctgtaccacgtgctgggccccaccgccgccgacgccggccccgagagcgagaagggcgacgaggaggtgtgcgagcccgccgtgagccccccccaggccacccccaccagcctgcagcagacccccccctgcagcaccccccccgccaccaccaacttccccgccccccccaccagagccagactgagcagacccgacagcggcatcctggagatcgacgacttccccagctacttccaccagttcggcttcagcggcaaggtggccgccggcagaatcccctag

SEQ ID NO: 93925 - DNA, 1083 bp, Artificial Sequence; identical to SEQ ID NO: 93924
  Description of Artificial Sequence: Synthetic coding sequence

SEQ ID NO: 93926 - DNA, 876 bp, Artificial Sequence
  Description of Artificial Sequence: Synthetic coding sequence
atggagagaaacagcagcctgtggaagaacctgatcgacgagcaccccgtgtgcaccacctggaagcaggaggccgagggcgccatctaccacctggccagcatcctgttcgtggtgggcttcatgggcggcagcggcttcttcggcctgctgtacgtgttcagcctgctgggcctgggcttcctgtgcagcgccgtgtgggcctgggtggacgtgtgcgccgccgacatcttcagctggaacttcgtgctgttcgtgatctgcttcatgcagttcgtgcacatcgcctaccaggtgagaagcatcaccttcgccagagagttccaggtgctgtacagcagcctgttccagcccctgggcatcagcctgcccgtgttcagaaccatcgccctgagcagcgaggtggtgaccctggagaaggagcactgctacgccatgcagggcaagaccagcatcgacaagctgagcctgctggtgagcggcagaatcagagtgaccgtggacggcgagttcctgcactacatcttccccctgcagttcctggacagccccgagtgggacagcctgagacccaccgaggagggcatcttccaggtgaccctgaccgccgagaccgactgcagatacgtgagctggagaagaaagaagctgtacctgctgttcgcccagcacagatacatcagcagactgttcagcgtgctgatcggcagcgacatcgccgacaagctgtacgccctgaacgacagagtgtacatcggcaagagataccactacgacatcagactgcccaacttctaccagatgagcacccccgagatcagaagaagccccctgacccagcacttccagaacagcagaagatactgcgacaagtag

SEQ ID NO: 93927 - DNA, 306 bp, Artificial Sequence
  Description of Artificial Sequence: Synthetic coding sequence
atgctgttcctgtgcttcgacagaatcagagtgaccgtggacggcgagttcctgcactacatcttccccctgcagttcctggacagccccgagtgggacagcctgagacccaccgaggagggcatcttccaggtgaccctgaccgccgagaccgactgcagatacgtgagctggagaagaaagaagctgtacctgctgttcgcccagcacagatacatcagcagactgttcagcgtgctgatcggcagcgacatcgccgacaagctgtacgccctgaacgacagagtgtacatcggcaagagatag

SEQ ID NO: 93928 - DNA, 1386 bp, Artificial Sequence
  Description of Artificial Sequence: Synthetic coding sequence
atggccaccttcagcagacaggagttcttccagcagctgctgcagggctgcctgctgcccaccgcccagcagggcctggaccagatctggctgctgctggccatctgcctggcctgcagactgctgtggagactgggcctgcccagctacctgaagcacgccagcaccgtggccggcggcttcttcagcctgtaccacttcttccagctgcacatggtgtgggtggtgctgctgagcctgctgtgctacctggtgctgttcctgtgcagacacagcagccacagaggcgtgttcctgagcgtgaccatcctgatctacctgctgatgggcgagatgcacatggtggacaccgtgacctggcacaagatgagaggcgcccagatgatcgtggccatgaaggccgtgagcctgggcttcgacctggacagaggcgaggtgggcaccgtgcccagccccgtggagttcatgggctacctgtacttcgtgggcaccatcgtgttcggcccctggatcagcttccacagctacctgcaggccgtgcagggcagacccctgagctgcagatggctgcagaaggtggccagaagcctggccctggccctgctgtgcctggtgctgagcacctgcgtgggcccctacctgttcccctacttcatccccctgaacggcgacagactgctgagaaacaagaagagaaaggccagaggcaccatggtgagatggctgagagcctacgagagcgccgtgagcttccacttcagcaactacttcgtgggcttcctgagcgaggccaccgccaccctggccggcgccggcttcaccgaggagaaggaccacctggagtgggacctgaccgtgagcaagcccctgaacgtggagctgcccagaagcatggtggaggtggtgaccagctggaacctgcccatgagctactggctgaacaactacgtgttcaagaacgccctgagactgggcaccttcagcgccgtgctggtgacctacgccgccagcgccctgctgcacggcttcagcttccacctggccgccgtgctgctgagcctggccttcatcacctacgtggagcacgtgctgagaaagagactggccagaatcctgagcgcctgcgtgctgagcaagagatgcccccccgactgcagccaccagcacagactgggcctgggcgtgagagccctgaacctgctgttcggcgccctggccatcttccacctggcctacctgggcagcctgttcgacgtggacgtggacgacaccaccgaggagcagggctacggcatggcctacaccgtgcacaagtggagcgagctgagctgggccagccactgggtgaccttcggctgctggatcttctacagactgatcggctag

SEQ ID NO: 93929 - DNA, 1368 bp, Artificial Sequence
  Description of Artificial Sequence: Synthetic coding sequence
atggccaccttcagcagacaggagttcttccagcagctgctgcagggctgcctgctgcccaccgcccagcagggcctggaccagatctggctgctgctggccatctgcctggcctgcagactgctgtggagactgggcctgcccagctacctgaagcacgccagcaccgtggccggcggcttcttcagcctgtaccacttcttccagctgcacatggtgtgggtggtgctgctgagcctgctgtgctacctggtgctgttcctgtgcagacacagcagccacagaggcgtgttcctgagcgtgaccatcctgatctacctgctgatgggcgagatgcacatggtggacaccgtgacctggcacaagatgagaggcgcccagatgatcgtggccatgaaggccgtgagcctgggcttcgacctggacagaggcgaggtgggcaccgtgcccagccccgtggagttcatgggctacctgtacttcgtgggcaccatcgtgttcggcccctggatcagcttccacagctacctgcaggccgtgcagggcagacccctgagctgcagatggctgcagaaggtggccagaagcctggccctggccctgctgtgcctggtgctgagcacctgcgtgggcccctacctgttcccctacttcatccccctgaacggcgacagactgctgagaaagggcaccatggtgagatggctgagagcctacgagagcgccgtgagcttccacttcagcaactacttcgtgggcttcctgagcgaggccaccgccaccctggccggcgccggcttcaccgaggagaaggaccacctggagtgggacctgaccgtgagcaagcccctgaacgtggagctgcccagaagcatggtggaggtggtgaccagctggaacctgcccatgagctactggctgaacaactacgtgttcaagaacgccctgagactgggcaccttcagcgccgtgctggtgacctacgccgccagcgccctgctgcacggcttcagcttccacctggccgccgtgctgctgagcctggccttcatcacctacgtggagcacgtgctgagaaagagactggccagaatcctgagcgcctgcgtgctgagcaagagatgcccccccgactgcagccaccagcacagactgggcctgggcgtgagagccctgaacctgctgttcggcgccctggccatcttccacctggcctacctgggcagcctgttcgacgtggacgtggacgacaccaccgaggagcagggctacggcatggcctacaccgtgcacaagtggagcgagctgagctgggccagccactgggtgaccttcggctgctggatcttctacagactgatcggctag

SEQ ID NO: 93930 - DNA, 1371 bp, Artificial Sequence
  Description of Artificial Sequence: Synthetic coding sequence
atggccaccttcagcagacaggagttcttccagcagctgctgcagggctgcctgctgcccaccgcccagcagggcctggaccagatctggctgctgctggccatctgcctggcctgcagactgctgtggagactgggcctgcccagctacctgaagcacgccagcaccgtggccggcggcttcttcagcctgtaccacttcttccagctgcacatggtgtgggtggtgctgctgagcctgctgtgctacctggtgctgttcctgtgcagacacagcagccacagaggcgtgttcctgagcgtgaccatcctgatctacctgctgatgggcgagatgcacatggtggacaccgtgacctggcacaagatgagaggcgcccagatgatcgtggccatgaaggccgtgagcctgggcttcgacctggacagaggcgaggtgggcaccgtgcccagccccgtggagttcatgggctacctgtacttcgtgggcaccatcgtgttcggcccctggatcagcttccacagctacctgcaggccgtgcagggcagacccctgagctgcagatggctgcagaaggtggccagaagcctggccctggccctgctgtgcctggtgctgagcacctgcgtgggcccctacctgttcccctacttcatccccctgaacggcgacagactgctgagaaacaagaagagaaaggccagatggctgagagcctacgagagcgccgtgagcttccacttcagcaactacttcgtgggcttcctgagcgaggccaccgccaccctggccggcgccggcttcaccgaggagaaggaccacctggagtgggacctgaccgtgagcaagcccctgaacgtggagctgcccagaagcatggtggaggtggtgaccagctggaacctgcccatgagctactggctgaacaactacgtgttcaagaacgccctgagactgggcaccttcagcgccgtgctggtgacctacgccgccagcgccctgctgcacggcttcagcttccacctggccgccgtgctgctgagcctggccttcatcacctacgtggagcacgtgctgagaaagagactggccagaatcctgagcgcctgcgtgctgagcaagagatgcccccccgactgcagccaccagcacagactgggcctgggcgtgagagccctgaacctgctgttcggcgccctggccatcttccacctggcctacctgggcagcctgttcgacgtggacgtggacgacaccaccgaggagcagggctacggcatggcctacaccgtgcacaagtggagcgagctgagctgggccagccactgggtgaccttcggctgctggatcttctacagactgatcggctag

SEQ ID NO: 93931 - DNA, 1368 bp, Artificial Sequence; identical to SEQ ID NO: 93929
  Description of Artificial Sequence: Synthetic coding sequence

SEQ ID NO: 93932 - DNA, 1353 bp, Artificial Sequence
  Description of Artificial Sequence: Synthetic coding sequence
atggccaccttcagcagacaggagttcttccagcagctgctgcagggctgcctgctgcccaccgcccagcagggcctggaccagatctggctgctgctggccatctgcctggcctgcagactgctgtggagactgggcctgcccagctacctgaagcacgccagcaccgtggccggcggcttcttcagcctgtaccacttcttccagctgcacatggtgtgggtggtgctgctgagcctgctgtgctacctggtgctgttcctgtgcagacacagcagccacagaggcgtgttcctgagcgtgaccatcctgatctacctgctgatgggcgagatgcacatggtggacaccgtgacctggcacaagatgagaggcgcccagatgatcgtggccatgaaggccgtgagcctgggcttcgacctggacagaggcgaggtgggcaccgtgcccagccccgtggagttcatgggctacctgtacttcgtgggcaccatcgtgttcggcccctggatcagcttccacagctacctgcaggccgtgcagggcagacccctgagctgcagatggctgcagaaggtggccagaagcctggccctggccctgctgtgcctggtgctgagcacctgcgtgggcccctacctgttcccctacttcatccccctgaacggcgacagactgctgagaaagtggctgagagcctacgagagcgccgtgagcttccacttcagcaactacttcgtgggcttcctgagcgaggccaccgccaccctggccggcgccggcttcaccgaggagaaggaccacctggagtgggacctgaccgtgagcaagcccctgaacgtggagctgcccagaagcatggtggaggtggtgaccagctggaacctgcccatgagctactggctgaacaactacgtgttcaagaacgccctgagactgggcaccttcagcgccgtgctggtgacctacgccgccagcgccctgctgcacggcttcagcttccacctggccgccgtgctgctgagcctggccttcatcacctacgtggagcacgtgctgagaaagagactggccagaatcctgagcgcctgcgtgctgagcaagagatgcccccccgactgcagccaccagcacagactgggcctgggcgtgagagccctgaacctgctgttcggcgccctggccatcttccacctggcctacctgggcagcctgttcgacgtggacgtggacgacaccaccgaggagcagggctacggcatggcctacaccgtgcacaagtggagcgagctgagctgggccagccactgggtgaccttcggctgctggatcttctacagactgatcggctag

SEQ ID NO: 93933 - DNA, 1140 bp, Artificial Sequence
  Description of Artificial Sequence: Synthetic coding sequence
atggtgtgggtggtgctgctgagcctgctgtgctacctggtgctgttcctgtgcagacacagcagccacagaggcgtgttcctgagcgtgaccatcctgatctacctgctgatgggcgagatgcacatggtggacaccgtgacctggcacaagatgagaggcgcccagatgatcgtggccatgaaggccgtgagcctgggcttcgacctggacagaggcgaggtgggcaccgtgcccagccccgtggagttcatgggctacctgtacttcgtgggcaccatcgtgttcggcccctggatcagcttccacagctacctgcaggccgtgcagggcagacccctgagctgcagatggctgcagaaggtggccagaagcctggccctggccctgctgtgcctggtgctgagcacctgcgtgggcccctacctgttcccctacttcatccccctgaacggcgacagactgctgagaaagtggctgagagcctacgagagcgccgtgagcttccacttcagcaactacttcgtgggcttcctgagcgaggccaccgccaccctggccggcgccggcttcaccgaggagaaggaccacctggagtgggacctgaccgtgagcaagcccctgaacgtggagctgcccagaagcatggtggaggtggtgaccagctggaacctgcccatgagctactggctgaacaactacgtgttcaagaacgccctgagactgggcaccttcagcgccgtgctggtgacctacgccgccagcgccctgctgcacggcttcagcttccacctggccgccgtgctgctgagcctggccttcatcacctacgtggagcacgtgctgagaaagagactggccagaatcctgagcgcctgcgtgctgagcaagagatgcccccccgactgcagccaccagcacagactgggcctgggcgtgagagccctgaacctgctgttcggcgccctggccatcttccacctggcctacctgggcagcctgttcgacgtggacgtggacgacaccaccgaggagcagggctacggcatggcctacaccgtgcacaagtggagcgagctgagctgggccagccactgggtgaccttcggctgctggatcttctacagactgatcggctag

SEQ ID NO: 93934 - DNA, 294 bp, Artificial Sequence
  Description of Artificial Sequence: Synthetic coding sequence
atggccaccttcagcagacaggagttcttccagcagctgctgcagggctgcctgctgcccaccgcccagcagggcctggaccagatctggctgctgctggccatctgcctggcctgcagactgctgtggagactgggcctgcccagctacctgaagcacgccagcaccgtggccggcggcttcttcagcctgtaccacttcttccagctgcacatggtgtgggtggtgctgctgagcctgctgtgctacctggtgctgttcctgtgcagacacagcagccacagaggcgtgtag

SEQ ID NO: 93935 - DNA, 1386 bp, Artificial Sequence; identical to SEQ ID NO: 93928
  Description of Artificial Sequence: Synthetic coding sequence

SEQ ID NO: 93936 - DNA, 2769 bp, Artificial Sequence
  Description of Artificial Sequence: Synthetic coding sequence
atgttcctgcacagcgtgaacctgtggaacctggccttctacgtgttcatggtgttcctggccaccctgggcctgtgggacgtgttcttcggcttcgaggagaacaagtgcagcatgagctacatgttcgagtaccccgagtaccagaagatcgagctgcccaagaagctggccaagagataccccgcctacgagctgtacctgtacggcgagggcagctacgccgaggagcacaagatcctgcccctgaccggcatccccgtgctgttcctgcccggcaacgccggcagctacaagcaggtgagaagcatcggcagcatcgccctgagaaaggccgaggacatcgacttcaagtaccacttcgacttcttcagcgtgaacttcaacgaggagctggtggccctgtacggcggcagcctgcagaagcagaccaagttcgtgcacgagtgcatcaagaccatcctgaagctgtacaagggccaggagttcgcccccaagagcgtggccatcatcggccacagcatgggcggcctggtggccagagccctgctgaccctgaagaacttcaagcacgacctgatcaacctgctgatcacccaggccaccccccacgtggcccccgtgatgcccctggacagattcatcaccgacttctacaccaccgtgaacaactactggatcctgaacgccagacacatcaacctgaccaccctgagcgtggccggcggcttcagagactaccaggtgagaagcggcctgaccttcctgcccaagctgagccaccacaccagcgccctgagcgtggtgagcagcgccgtgcccaagacctgggtgagcaccgaccacctgagcatcgtgtggtgcaagcagctgcagctgaccaccgtgagagccttcttcgacctgatcgacgccgacaccaagcagatcacccagaacagcaagaagaagctgagcgtgctgtaccaccacttcatcagacaccccagcaagcacttcgaggagaaccccgccatcatcagcgacctgaccggcaccagcatgtgggtgctggtgaaggtgagcaagtggacctacgtggcctacaacgagagcgagaagatctacttcaccttccccctggagaaccacagaaagatctacacccacgtgtactgccagagcaccatgctggacaccaacagctggatcttcgcctgcatcaacagcaccagcatgtgcctgcagggcgtggacctgagctggaaggccgagctgctgcccaccatcaagtacctgaccctgagactgcaggactaccccagcctgagccacctggtggtgtacgtgcccagcgtgagaggcagcaagttcgtggtggactgcgagttcttcaagaaggagaagagatacatccagctgcccgtgacccacctgttcagcttcggcctgagcagcagaaaggtggtgctgaacaccaacggcctgtactacaacctggagctgctgaacttcggccagatctaccaggccttcaagatcaacgtggtgagcaagtgcagcgccgtgaaggaggagatcaccagcatctacagactgcacatcccctggagctacgaggacagcctgaccatcgcccaggcccccagcagcaccgagatcagcctgaagctgcacatcgcccagcccgagaacaacacccacgtggccctgttcaagatgtacaccagcagcgactgcagatacgaggtgaccgtgaagaccagcttcagccagatcctgggccaggtggtgagattccacggcggcgccctgcccgcctacgtggtgagcaacatcctgctggcctacagaggccagctgtacagcctgttcagcaccggctgctgcctggagtacgccaccatgctggacaaggaggccaagccctacaaggtggaccccttcgtgatcatcatcaagttcctgctgggctacaagtggttcaaggagctgtgggacgtgctgctgctgcccgagctggacgccgtgatcctgacctgccagagcatgtgcttccccctgatcagcctgatcctgttcctgttcggcacctgcaccgcctactggagcggcctgctgagcagcgccagcgtgagactgctgagcagcctgtggctggccctgaagagacccagcgagctgcccaaggacatcaagatgatcagccccgacctgcccttcctgaccatcgtgctgatcatcgtgagctggaccacctgcggcgccctggccatcctgctgagctacctgtactacgtgttcaaggtggtgcacctgcaggccagcctgaccaccttcaagaacagccagcccgtgaaccccaagcacagcagaagaagcgagaagaagagcaaccaccacaaggacagcagcatccaccacctgagactgagcgccaacgacgccgaggacagcctgagaatgcacagcaccgtgatcaacctgctgacctggatcgtgctgctgagcatgcccagcctgatctactggctgaagaacctgagatactacttcaagctgaaccccgacccctgcaagcccctggccttcatcctgatccccaccatggccatcctgggcaacacctacaccgtgagcatcaagagcagcaagctgctgaagaccaccagccagttccccctgcccctggccgtgggcgtgatcgccttcggcagcgcccacctgtacagactgccctgcttcgtgttcatccccctgctgctgcacgccctgtgcaacttcatgtag

SEQ ID NO: 93937 - DNA, 915 bp, Artificial Sequence
  Description of Artificial Sequence: Synthetic coding sequence
atggaggtgctggagagcaagaagatcgagctgcccaagaagctggccaagagataccccgcctacgagctgtacctgtacggcgagggcagctacgccgaggagcacaagatcctgcccctgaccggcatccccgtgctgttcctgcccggcaacgccggcagctacaagcaggtgagaagcatcggcagcatcgccctgagaaaggccgaggacatcgacttcaagtaccacttcgacttcttcagcgtgaacttcaacgaggagctggtggccctgtacggcggcagcctgcagaagcagaccaagttcgtgcacgagtgcatcaagaccatcctgaagctgtacaagggccaggagttcgcccccaagagcgtggccatcatcggccacagcatgggcggcctggtggccagagccctgctgaccctgaagaacttcaagcacgacctgatcaacctgctgatcacccaggccaccccccacgtggcccccgtgatgcccctggacagattcatcaccgacttctacaccaccgtgaacaactactggatcctgaacgccagacacatcaacctgaccaccctgagcgtggccggcggcttcagagactaccaggtgagaagcggcctgaccttcctgcccaagctgagccaccacaccagcgccctgagcgtggtgagcagcgccgtgcccaagacctgggtgagcaccgaccacctgagcatcgtgtggtgcaagcagctgcagctgaccaccgtgagagccttcttcgacctgatcgacgccgacaccaagcagatcacccagaacagcaagaagaagctgagcgtgctgtaccaccacttcatcagacaccccagcaagcacttcgaggagaaccccgccatcatcagcgacctgaccggcatctag

SEQ ID NO: 93938 - DNA, 1779 bp, Artificial Sequence
  Description of Artificial Sequence: Synthetic coding sequence
atgttcctgcacagcgtgaacctgtggaacctggccttctacgtgttcatggtgttcctggccaccctgggcctgtgggacgtgttcttcggcttcgaggagaacaagtgcagcatgagctacatgttcgagtaccccgagtaccagaagatcgagctgcccaagaagctggccaagagataccccgcctacgagctgtacctgtacggcgagggcagctacgccgaggagcacaagatcctgcccctgaccggcatccccgtgctgttcctgcccggcaacgccggcagctacaagcaggtgagaagcatcggcagcatcgccctgagaaaggccgaggacatcgacttcaagtaccacttcgacttcttcagcgtgaacttcaacgaggagctggtggccctgtacggcggcagcctgcagaagcagaccaagttcgtgcacgagtgcatcaagaccatcctgaagctgtacaagggccaggagttcgcccccaagagcgtggccatcatcggccacagcatgggcggcctggtggccagagccctgctgaccctgaagaacttcaagcacgacctgatcaacctgctgatcacccaggccaccccccacgtggcccccgtgatgcccctggacagattcatcaccgacttctacaccaccgtgaacaactactggatcctgaacgccagacacatcaacctgaccaccctgagcgtggccggcggcttcagagactaccaggtgagaagcggcctgaccttcctgcccaagctgagccaccacaccagcgccctgagcgtggtgagcagcgccgtgcccaagacctgggtgagcaccgaccacctgagcatcgtgtggtgcaagcagctgcagctgaccaccgtgagagccttcttcgacctgatcgacgccgacaccaagcagatcacccagaacagcaagaagaagctgagcgtgctgtaccaccacttcatcagacaccccagcaagcacttcgaggagaaccccgccatcatcagcgacctgaccggcaccagcatgtgggtgctggtgaaggtgagcaagtggacctacgtggcctacaacgagagcgagaagatctacttcaccttccccctggagaaccacagaaagatctacacccacgtgtactgccagagcaccatgctggacaccaacagctggatcttcgcctgcatcaacagcaccagcatgtgcctgcagggcgtggacctgagctggaaggccgagctgctgcccaccatcaagtacctgaccctgagactgcaggactaccccagcctgagccacctggtggtgtacgtgcccagcgtgagaggcagcaagttcgtggtggactgcgagttcttcaagaaggagaagagatacatccagctgcccgtgacccacctgttcagcttcggcctgagcagcagaaaggtggtgctgaacaccaacggcctgtactacaacctggagctgctgaacttcggccagatctaccaggccttcaagatcaacgtggtgagcaagtgcagcgccgtgaaggaggagatcaccagcatctacagactgcacatcccctggagctacgaggacagcctgaccatcgcccaggcccccagcagcaccgagatcagcctgaagctgcacatcgcccagcccgagaacaacacccacgtggccctgttcaagatgtacaccagcagcgactgcagatacgaggtgaccgtgaagaccagcttcagccagatcctgggccaggtggtggcctag

SEQ ID NO: 93939 - DNA, 1293 bp, Artificial Sequence
  Description of Artificial Sequence: Synthetic coding sequence
atgttcctgcacagcgtgaacctgtggaacctggccttctacgtgttcatggtgttcctggccaccctgggcctgtgggacgtgttcttcggcttcgaggagaacaagtgcagcatgagctacatgttcgagtaccccgagtaccagagcagcgccgtgcccaagacctgggtgagcaccgaccacctgagcatcgtgtggtgcaagcagctgcagctgaccaccgtgagagccttcttcgacctgatcgacgccgacaccaagcagatcacccagaacagcaagaagaagctgagcgtgctgtaccaccacttcatcagacaccccagcaagcacttcgaggagaaccccgccatcatcagcgacctgaccggcaccagcatgtgggtgctggtgaaggtgagcaagtggacctacgtggcctacaacgagagcgagaagatctacttcaccttccccctggagaaccacagaaagatctacacccacgtgtactgccagagcaccatgctggacaccaacagctggatcttcgcctgcatcaacagcaccagcatgtgcctgcagggcgtggacctgagctggaaggccgagctgctgcccaccatcaagtacctgaccctgagactgcaggactaccccagcctgagccacctggtggtgtacgtgcccagcgtgagaggcagcaagttcgtggtggactgcgagttcttcaagaaggagaagagatacatccagctgcccgtgacccacctgttcagcttcggcctgagcagcagaaaggtggtgctgaacaccaacggcctgtactacaacctggagctgctgaacttcggccagatctaccaggccttcaagatcaacgtggtgagcaagtgcagcgccgtgaaggaggagatcaccagcatctacagactgcacatcccctggagctacgaggacagcctgaccatcgcccaggcccccagcagcaccgagatcagcctgaagctgcacatcgcccagcccgagaacaacacccacgtggccctgttcaagatgtacaccagcagcgactgcagatacgaggtgaccgtgaagaccagcttcagccagatcctgggccaggtggtgagattccacggcggcgccctgcccgcctacgtggtgagcaacatcctgctggcctacagaggccagctgtacagcctgttcagcaccggctgctgcctggagtacgccaccatgctggacaaggaggccaagccctacaaggtggaccccttcgtgatcatcatcaagttcctgctgtag

SEQ ID NO: 93940 - DNA, 774 bp, Artificial Sequence
  Description of Artificial Sequence: Synthetic coding sequence
atgagcagacccctgatcaccagaagccccgccagccccctgaacaaccagggcatccccacccccgcccagctgaccaagagcaacgcccccgtgcacatcgacgtgggcggccacatgtacaccagcagcctggccaccctgaccaagtaccccgagagcagaatcggcagactgttcgacggcaccgagcccatcgtgctggacagcctgaagcagcactacttcatcgacagagacggccagatgttcagatacatcctgaacttcctgagaaccagcaagctgctgatccccgacgacttcaaggactacaccctgctgtacgaggaggccaagtacttccagctgcagcccatgctgctggagatggagagatggaagcaggacagagagaccggcagattcagcagaccctgcgagtgcctggtggtgagagtggcccccgacctgggcgagagaatcaccctgagcggcgacaagagcctgatcgaggaggtgttccccgagatcggcgacgtgatgtgcaacagcgtgaacgccggctggaaccacgacagcacccacgtgatcagattccccctgaacggctactgccacctgaacagcgtgcaggtgctggagagactgcagcagagaggcttcgagatcgtgggcagctgcggcggcggcgtggacagcagccagttcagcgagtacgtgctgagaagagagctgagaagaacccccagagtgcccagcgtgatcagaatcaagcaggagcccctggactag

SEQ ID NO: 93941 - DNA, 774 bp, Artificial Sequence; identical to SEQ ID NO: 93940
  Description of Artificial Sequence: Synthetic coding sequence

SEQ ID NO: 93942 - DNA, 2598 bp, Artificial Sequence
  Description of Artificial Sequence: Synthetic coding sequence
atggccagaatgcccggcagcggcgactgcaacaccagcgccggcggcagcgccagcgccgccgccgccgccgccgagaacaacggcgagagaggcgagggcgagagaggcgccggcggcagaggcagaagacacagcagaccccactactgcagcgccggcgaggaggaggaggaggaggaggaggaggacgagatccaggaggtgcagatcaccggcgacgaggaggaggaggaggacggcggcggcggcctggaggaggacgaggaggaggaggaggaggaggagatgggcctggactgggacgagcccctggagcccgaggacagcgccggcgaggagctggagcccgagcccgtgcacatgatcaacatggaccagagcgccgccctggagcccgaggccccccccagactgctggcccccagagccagaggcggcccccccggcgacggcagcgagctggaccccgacgtgctgcagagacccgagagagccagactgagcgagaacaccagactggccaccagatacgccgtgagaatcttcagagagtacctgagcgagaaggcccagagccccgacttcgagaccatggacaagggcgccctgtgcagagtgctgagaagcttctacgccgaggccagaagcaagagcggccagctgtacagcaagagcagcctgatcagcatcagaagcagcctgaacagatacctgaacgagcccccctactgcagaaccctggacctgaccaaggaccccgagctgagaagcgccaacctgaccctggccgccgtgatcagaaagctggaggagcagggcgccggccccgtggtgcagaagcaggccatcaccagagccgacctgagaaagctgtacaccagcagcgtgttcagcaccaacacccccttcggcctgctgaacaaggtgtggttcgagacctgcatgtacttctgcaccagaggcagagagaaccagagagagctggaggaggacagcttcggcctggccatggacgaggacggcagaaagttcgtgtacttcaagagcctgggcccctaccacaagagcagaagcagcagctggagcaagaagagagccgagagcagcgacgaggagaacctgcccagaatgtacgagaccggcaccgagttctgcccctacgccagcttcgtgaagtacctgagcaagagaaaccccctgtgcaaggccttcttccagagacccagagaccactgcagcgagggcgacgtgacctggtacgagaacaaggccatcggcaagaacctgctgggcaccagaatgcagatgctgagcaaggccgccaagctgagcaagacctacaccaaccactgcatcggcgccgtgagcatcgccaccctgaacagcatcgccggcatcggcaccaagctgggcagccccgccccccagggctgctacgccgaggccctgaacggcgccgccagacaccacagccaccacccccccacccaccccagccaccaccacagaccccagccccccagcctgggcaacacctacatcctgcccaaggacagccaggtgggccccgacgtgaagagcgaggccgcccccaagagagccctgtacgagagcgtgttcggcagcggcgagatctgcggccccaccagccccaagagactgtgcatcagacccagcgagcccgtggacgccgtggtggtggtgagcgtgaagcacgaccccctgcccctgctgcccgaggccaacggccacagaagcaccaacagccccaccatcgtgagccccgccatcgtgagccccacccaggacagcagacccaacatgagcagacccctgatcaccagaagccccgccagccccctgaacaaccagggcatccccacccccgcccagctgaccaagagcaacgcccccgtgcacatcgacgtgggcggccacatgtacaccagcagcctggccaccctgaccaagtaccccgagagcagaatcggcagactgttcgacggcaccgagcccatcgtgctggacagcctgaagcagcactacttcatcgacagagacggccagatgttcagatacatcctgaacttcctgagaaccagcaagctgctgatccccgacgacttcaaggactacaccctgctgtacgaggaggccaagtacttccagctgcagcccatgctgctggagatggagagatggaagcaggacagagagaccggcagattcagcagaccctgcgagtgcctggtggtgagagtggcccccgacctgggcgagagaatcaccctgagcggcgacaagagcctgatcgaggaggtgttccccgagatcggcgacgtgatgtgcaacagcgtgaacgccggctggaaccacgacagcacccacgtgatcagattccccctgaacggctactgccacctgaacagcgtgcaggtgctggagagactgcagcagagaggcttcgagatcgtgggcagctgcggcggcggcgtggacagcagccagttcagcgagtacgtgctgagaagagagctgagaagaacccccagagtgcccagcgtgatcagaatcaagcaggagcccctggactag

SEQ ID NO: 93943 - DNA, 774 bp, Artificial Sequence; identical to SEQ ID NO: 93940
  Description of Artificial Sequence: Synthetic coding sequence

SEQ ID NO: 93944 - DNA, 1044 bp, Artificial Sequence
  Description of Artificial Sequence: Synthetic coding sequence
atgagagtggtggtgatcggcgccggcgtgatcggcctgagcaccgccctgtgcatccacgagagataccacagcgtgctgcagcccctggacatcaaggtgtacgccgacagattcacccccctgaccaccaccgacgtggccgccggcctgtggcagccctacctgagcgaccccaacaacccccaggaggccgactggagccagcagaccttcgactacctgctgagccacgtgcacagccccaacgccgagaacctgggcctgttcctgatcagcggctacaacctgttccacgaggccatccccgaccccagctggaaggacaccgtgctgggcttcagaaagctgacccccagagagctggacatgttccccgactacggctacggctggttccacaccagcctgatcctggagggcaagaactacctgcagtggctgaccgagagactgaccgagagaggcgtgaagttcttccagagaaaggtggagagcttcgaggaggtggccagagagggcgccgacgtgatcgtgaactgcaccggcgtgtgggccggcgccctgcagagagaccccctgctgcagcccggcagaggccagatcatgaaggtggacgccccctggatgaagcacttcatcctgacccacgaccccgagagaggcatctacaacagcccctacatcatccccggcacccagaccgtgaccctgggcggcatcttccagctgggcaactggagcgagctgaacaacatccaggaccacaacaccatctgggagggctgctgcagactggagcccaccctgaagaacgccagaatcatcggcgagagaaccggcttcagacccgtgagaccccagatcagactggagagagagcagctgagaaccggccccagcaacaccgaggtgatccacaactacggccacggcggctacggcctgaccatccactggggctgcgccctggaggccgccaagctgttcggcagaatcctggaggagaagaagctgagcagaatgccccccagccacctgtag

SEQ ID NO: 93945 - DNA, 399 bp, Artificial Sequence
  Description of Artificial Sequence: Synthetic coding sequence
atgctgaagaacatcgagctgttcgacaagctgagcctgagattcaacggcagagtgctgttcatcaaggacgtgatcggcgacgagatctgctgctggagcttctacggccagggcagaaagatcgccgaggtgtgctgcaccagcatcgtgtacgccaccgagaagaagcagaccaaggtggagttccccgaggccagaatctacgaggagaccctgaacatcctgctgtacgaggcccaggacggcagaggccccgacaacgccctgctggaggccaccggcggcgccgccggcagaagccaccacctggacgaggacgaggagagagagagaatcgagagagtgagaagaatccacatcaagagacccgacgacagagcccacctgcaccagtag

SEQ ID NO: 93946 - DNA, 840 bp, Artificial Sequence
  Description of Artificial Sequence: Synthetic coding sequence
tgaagatactgcagaagccccttctggagcggctacggcaacttctacagcctgcagaagagcggcttcctgcccaccctgggcaccgtgcagcccttcaactactgcaagagcggctggatcctgatcgacagatgcggcaagcacttcggcaccatcctgaactacctgagagacggcgccgtgcccctgcccgagagcagaagagagatcgaggagctgctggccgaggccaagtactacctggtgcagggcctggtggaggagtgccaggccgccctgcagaacaaggacacctacgagcccttctgcaaggtgcccgtgatcaccagcagcaaggaggagcagaagctgatcgccaccagcaacaagcccgccgtgaagctgctgtacaacagaagcaacaacaagtacagctacaccagcaacagcgacgacaacatgctgaagaacatcgagctgttcgacaagctgagcctgagattcaacggcagagtgctgttcatcaaggacgtgatcggcgacgagatctgctgctggagcttctacggccagggcagaaagatcgccgaggtgtgctgcaccagcatcgtgtacgccaccgagaagaagcagaccaaggtggagttccccgaggccagaatctacgaggagaccctgaacatcctgctgtacgaggcccaggacggcagaggccccgacaacgccctgctggaggccaccggcggcgccgccggcagaagccaccacctggacgaggacgaggagagagagagaatcgagagagtgagaagaatccacatcaagagacccgacgacagagcccacctgcaccagtag

SEQ ID NO: 93947 - DNA, 864 bp, Artificial Sequence
  Description of Artificial Sequence: Synthetic coding sequence
atgagcggcgagagcgtggtgagcagcgccgtgcccgccgccgccaccagaaccaccagcttcaagggcaccagccccagcagcaagtacgtgaagctgaacgtgggcggcgccctgtactacaccaccatgcagaccctgaccaagcaggacaccatgctgaaggccatgttcagcggcagaatggaggtgctgaccgacagcgagggctggatcctgatcgacagatgcggcaagcacttcggcaccatcctgaactacctgagagacggcgccgtgcccctgcccgagagcagaagagagatcgaggagctgctggccgaggccaagtactacctggtgcagggcctggtggaggagtgccaggccgccctgcagaacaaggacacctacgagcccttctgcaaggtgcccgtgatcaccagcagcaaggaggagcagaagctgatcgccaccagcaacaagcccgccgtgaagctgctgtacaacagaagcaacaacaagtacagctacaccagagtgctgttcatcaaggacgtgatcggcgacgagatctgctgctggagcttctacggccagggcagaaagatcgccgaggtgtgctgcaccagcatcgtgtacgccaccgagaagaagcagaccaaggtggagttccccgaggccagaatctacgaggagaccctgaacatcctgctgtacgaggcccaggacggcagaggccccgacaacgccctgctggaggccaccggcggcgccgccggcagaagccaccacctggacgaggacgaggagagagagagaatcgagagagtgagaagaatccacatcaagagacccgacgacagagcccacctgcaccagtag

SEQ ID NO: 93948 - DNA, 468 bp, Artificial Sequence
  Description of Artificial Sequence: Synthetic coding sequence
atgatggccgtgttcaccagcctgtggagcccctaccagatgctgttctgcagcaacagcgacgacaacatgctgaagaacatcgagctgttcgacaagctgagcctgagattcaacggcagagtgctgttcatcaaggacgtgatcggcgacgagatctgctgctggagcttctacggccagggcagaaagatcgccgaggtgtgctgcaccagcatcgtgtacgccaccgagaagaagcagaccaaggtggagttccccgaggccagaatctacgaggagaccctgaacatcctgctgtacgaggcccaggacggcagaggccccgacaacgccctgctggaggccaccggcggcgccgccggcagaagccaccacctggacgaggacgaggagagagagagaatcgagagagtgagaagaatccacatcaagagacccgacgacagagcccacctgcaccagtag

SEQ ID NO: 93949 - DNA, 990 bp, Artificial Sequence
  Description of Artificial Sequence: Synthetic coding sequence
atgagcgccgaggccagcggccccgccgccgccgccgcccccagcctggaggcccccaagcccagcggcctggagcccggccccgccgcctacggcctgaagcccctgacccccaacagcaagtacgtgaagctgaacgtgggcggcagcctgcactacaccaccctgagaaccctgaccggccaggacaccatgctgaaggccatgttcagcggcagagtggaggtgctgaccgacgccggcggctgggtgctgatcgacagaagcggcagacacttcggcaccatcctgaactacctgagagacggcagcgtgcccctgcccgagagcaccagagagctgggcgagctgctgggcgaggccagatactacctggtgcagggcctgatcgaggactgccagctggccctgcagcagaagagagagaccctgagccccctgtgcctgatccccatggtgaccagccccagagaggagcagcagctgctggccagcaccagcaagcccgtggtgaagctgctgcacaacagaagcaacaacaagtacagctacaccagcaccagcgacgacaacctgctgaagaacatcgagctgttcgacaagctggccctgagattccacggcagactgctgttcctgaaggacgtgctgggcgacgagatctgctgctggagcttctacggccagggcagaaagatcgccgaggtgtgctgcaccagcatcgtgtacgccaccgagaagaagcagaccaaggtggagttccccgaggccagaatcttcgaggagaccctgaacatcctgatctacgagacccccagaggccccgaccccgccctgctggaggccaccggcggcgccgccggcgccggcggcgccggcagaggcgaggacgaggagaacagagagcacagagtgagaagaatccacgtgagaagacacatcacccacgacgagagaccccacggccagcagatcgtgttcaaggactag

SEQ ID NO: 93950 - DNA, 990 bp, Artificial Sequence; identical to SEQ ID NO: 93949
  Description of Artificial Sequence: Synthetic coding sequence

SEQ ID NO: 93951 - DNA, 1287 bp, Artificial Sequence
  Description of Artificial Sequence: Synthetic coding sequence
atggccctgagcggcaactgcagcagatactaccccagagagcagggcagcgccgtgcccaacagcttccccgaggtggtggagctgaacgtgggcggccaggtgtacttcaccagacacagcaccctgatcagcatcccccacagcctgctgtggaagatgttcagccccaagagagacaccgccaacgacctggccaaggacagcaagggcagattcttcatcgacagagacggcttcctgttcagatacatcctggactacctgagagacagacaggtggtgctgcccgaccacttccccgagaagggcagactgaagagagaggccgagtacttccagctgcccgacctggtgaagctgctgacccccgacgagatcaagcagagccccgacgagttctgccacagcgacttcgaggacgccagccagggcagcgacaccagaatctgcccccccagcagcctgctgcccgccgacagaaagtggggcttcatcaccgtgggctacagaggcagctgcaccctgggcagagagggccaggccgacgccaagttcagaagagtgcccagaatcctggtgtgcggcagaatcagcctggccaaggaggtgttcggcgagaccctgaacgagagcagagaccccgacagagcccccgagagatacaccagcagattctacctgaagttcaagcacctggagagagccttcgacatgctgagcgagtgcggcttccacatggtggcctgcaacagcagcgtgaccgccagcttcatcaaccagtacaccgacgacaagatctggagcagctacaccgagtacgtgttctacagagagcccagcagatggagccccagccactgcgactgctgctgcaagaacggcaagggcgacaaggagggcgagagcggcaccagctgcaacgacctgagcaccagcagctgcgacagccagagcgaggccagcagcccccaggagaccgtgatctgcggccccgtgaccagacagaccaacatccagaccctggacagacccatcaagaagggccccgtgcagctgatccagcagagcgagatgagaagaaagagcgacctgctgagaaccctgaccagcggcagcagagagagcaacatgagcagcaagaagaaggccgtgaaggagaagctgagcatcgaggaggagctggagaagtgcatccaggacttcctgaagatcaagatccccgacagattccccgagagaaagcacccctggcagagcgagctgctgagaaagtaccacctgtag

SEQ ID NO: 93952 - DNA, 1287 bp, Artificial Sequence; identical to SEQ ID NO: 93951
  Description of Artificial Sequence: Synthetic coding sequence

SEQ ID NO: 93953 - DNA, 792 bp, Artificial Sequence
  Description of Artificial Sequence: Synthetic coding sequence
atggccgagctgcagctggaccccgccatggccggcctgggcggcggcggcggcagcggcgtgggcgacggcggcggccccgtgagaggcccccccagccccagacccgccggccccacccccagaggccacggcagacccgccgccgccgtggcccagcccctggagcccggccccggcccccccgagagagccggcggcggcggcgccgccagatgggtgagactgaacgtgggcggcacctacttcgtgaccaccagacagaccctgggcagagagcccaagagcttcctgtgcagactgtgctgccaggaggaccccgagctggacagcgacaaggacgagaccggcgcctacctgatcgacagagaccccacctacttcggccccatcctgaactacctgagacacggcaagctgatcatcaccaaggagctggccgaggagggcgtgctggaggaggccgagttctacaacatcgccagcctggtgagactggtgaaggagagaatcagagacaacgagaacagaaccagccagggccccgtgaagcacgtgtacagagtgctgcagtgccaggaggaggagctgacccagatggtgagcaccatgagcgacggctggaagttcgagcagctgatcagcatcggcagcagctacaactacggcaacgaggaccaggccgagttcctgtgcgtggtgagcagagagctgaacaacagcaccaacggcatcgtgatcgagcccagcgagaaggccaagatcctgcaggagagaggcagcagaatgtag

SEQ ID NO: 93954 - DNA, 738 bp, Artificial Sequence
  Description of Artificial Sequence: Synthetic coding sequence
agcctgcccagaaacggccccgccagactgagagccggcagcagcggcggcggcggcggccccagatggagaaactgcagctggaccagaagatggagaggctgggagggcgcccccggccccggcccccccgagagagccggcggcggcggcgccgccagatgggtgagactgaacgtgggcggcacctacttcgtgaccaccagacagaccctgggcagagagcccaagagcttcctgtgcagactgtgctgccaggaggaccccgagctggacagcgacaaggacgagaccggcgcctacctgatcgacagagaccccacctacttcggccccatcctgaactacctgagacacggcaagctgatcatcaccaaggagctggccgaggagggcgtgctggaggaggccgagttctacaacatcgccagcctggtgagactggtgaaggagagaatcagagacaacgagaacagaaccagccagggccccgtgaagcacgtgtacagagtgctgcagtgccaggaggaggagctgacccagatggtgagcaccatgagcgacggctggaagttcgagcagctgatcagcatcggcagcagctacaactacggcaacgaggaccaggccgagttcctgtgcgtggtgagcagagagctgaacaacagcaccaacggcatcgtgatcgagcccagcgagaaggccaagatcctgcaggagagaggcagcagaatgtag

SEQ ID NO: 93955 - DNA, 2448 bp, Artificial Sequence
  Description of Artificial Sequence: Synthetic coding sequence
atggccggcggccactgcggcagcttccccgccgccgccgccggcagcggcgagatcgtgcagctgaacgtgggcggcaccagattcagcaccagcagacagaccctgatgtggatccccgacagcttcttcagcagcctgctgagcggcagaatcagcaccctgagagacgagaccggcgccatcttcatcgacagagaccccgccgccttcgcccccatcctgaacttcctgagaaccaaggagctggacctgagaggcgtgagcatcaacgtgctgagacacgaggccgagttctacggcatcacccccctggtgagaagactgctgctgtgcgaggagctggagagaagcagctgcggcagcgtgctgttccacggctacctgcccccccccggcatccccagcagaaagatcaacaacaccgtgagaagcgccgacagcagaaacggcctgaacagcaccgagggcgaggccagaggcaacggcacccagcccgtgctgagcggcaccggcgaggagaccgtgagactgggcttccccgtggaccccagaaaggtgctgatcgtggccggccaccacaactggatcgtggccgcctacgcccacttcgccgtgtgctacagaatcaaggagagcagcggctggcagcaggtgttcaccagcccctacctggactggaccatcgagagagtggccctgaacgccaaggtggtgggcggcccccacggcgacaaggacaagatggtggccgtggccagcgagagcagcatcatcctgtggagcgtgcaggacggcggcagcggcagcgagatcggcgtgttcagcctgggcgtgcccgtggacgccctgttcttcatcggcaaccagctggtggccaccagccacaccggcaaggtgggcgtgtggaacgccgtgacccagcactggcaggtgcaggacgtggtgcccatcaccagctacgacaccgccggcagcttcctgctgctgggctgcaacaacggcagcatctactacatcgacatgcagaagttccccctgagaatgaaggacaacgacctgctggtgaccgagctgtaccacgaccccagcaacgacgccatcaccgccctgagcgtgtacctgacccccaagaccagcgtgagcggcaactggatcgagatcgcctacggcaccagcagcggcgccgtgagagtgatcgtgcagcaccccgagaccgtgggcagcggcccccagctgttccagaccttcaccgtgcacagaagccccgtgaccaagatcatgctgagcgagaagcacctggtgagcgtgtgcgccgacaacaaccacgtgagaacctggaccgtgaccagattcagaggcatgatcagcacccagcccggcagcacccccctggccagcttcaagatcctgagcctggaggagaccgagagccacggcagctacagcagcggcaacgacatcggccccttcggcgagagagacgaccagcaggtgttcatccagaaggtggtgcccatcaccaacaagctgttcgtgagactgagcagcaccggcaagagaatctgcgagatccaggccgtggactgcaccaccatcagcagcttcaccgtgagagagtgcgagggcagcagcagaatgggcagcagacccagaagatacctgttcaccggccacaccaacggcagcatccagatgtgggacctgaccaccgccatggacatggtgaacaagagcgaggacaaggacgtgggcggccccaccgaggaggagctgctgaagctgctggaccagtgcgacctgagcaccagcagatgcgccacccccaacatcagccccgccaccagcgtggtgcagcacagccacctgagagagagcaacagcagcctgcagctgcagcaccacgacaccacccacgaggccgccacctacggcagcatgagaccctacagagagagccccctgctggccagagccagaagaaccgagagcttccacagctacagagacttccagaccatcaacctgaacagaaacgtggagagagccgtgcccgagaacggcaacctgggccccatccaggccgaggtgaagggcgccaccggcgagtgcaacatcagcgagagaaagagccccggcgtggagatcaagagcctgagagagctggacagcggcctggaggtgcacaagatcgccgagggcttcagcgagagcaagaagagaagcagcgaggacgagaacgagaacaagatcgagttcagaaagaagggcggcttcgagggcggcggcttcctgggcagaaagaaggtgccctacctggccagcagccccagcaccagcgacggcggcaccgacagccccggcaccgccagccccagccccaccaagaccacccccagccccagacacaagaagagcgacagcagcggccaggagtacagcctgtag

SEQ ID NO: 93956 - DNA, 723 bp, Artificial Sequence
  Description of Artificial Sequence: Synthetic coding sequence
atggccggcggccactgcggcagcttccccgccgccgccgccggcagcggcgagatcgtgcagctgaacgtgggcggcaccagattcagcaccagcagacagaccctgatgtggatccccgacagcttcttcagcagcctgctgagcggcagaatcagcaccctgagagacgagaccggcgccatcttcatcgacagagaccccgccgccttcgcccccatcctgaacttcctgagaaccaaggagctggacctgagaggcgtgagcatcaacgtgctgagacacgaggccgagttctacggcatcacccccctggtgagaagactgctgctgtgcgaggagctggagagaagcagctgcggcagcgtgctgttccacggctacctgcccccccccggcatccccagcagaaagatcaacaacaccgtgagaagcgccgacagcagaaacggcctgaacagcaccgagggcgaggccagaggcaacggcacccagcccgtgctgagcggcaccggcgaggagaccgtgagactgggcttccccgtggaccccagaaaggtgctgatcgtggccggccaccacaactggatcgtggccgcctacgcccacttcgccgtgtgctacagagtgttctggctgggcaccgtgggccacgcctgcaaccccagcaccctgggcggcagagacggctggagcagcagaagcgccagacccacctggtag

SEQ ID NO: 93957 - DNA, 567 bp, Artificial Sequence
  Description of Artificial Sequence: Synthetic coding sequence
atgaaggacaacgacctgctggtgaccgagctgtaccacgaccccagcaacgacgccatcaccgccctgagcgtgtacctgacccccaagaccagcgtgagcggcaactggatcgagatcgcctacggcaccagcagcggcgccgtgagagtgatcgtgcagcaccccgagaccgtgggcagcggcccccagctgttccagaccttcaccgtgcacagaagccccgtgaccaagatcatgctgagcgagaagcacctggtgagcgtgtgcgccgacaacaaccacgtgagaacctggaccgtgaccagattcagaggcatgatcagcacccagcccggcagcacccccctggccagcttcaagatcctgagcctggaggagaccgagagccacggcagctacagcagcggcaacgacatcggccccttcggcgagagagacgaccagcaggtgttcatccagaaggtggtgcccatcaccaacaagctgttcgtgagactgagcagcaccggcaagagcctgtgcggcgtgagcctggtgagcagaagcagccaggagcccacctag

SEQ ID NO: 93958 - DNA, 642 bp, Artificial Sequence
  Description of Artificial Sequence: Synthetic coding sequence
tgattcagcaccagcagacagaccctgatgtggatccccgacagcttcttcagcagcctgctgagcggcagaatcagcaccctgagagacgagaccggcgccatcttcatcgacagagaccccgccgccttcgcccccatcctgaacttcctgagaaccaaggagctggacctgagaggcgtgagcatcaacgtgctgagacacgaggccgagttctacggcatcacccccctggtgagaagactgctgctgtgcgaggagctggagagaagcagctgcggcagcgtgctgttccacggctacctgcccccccccggcatccccagcagaaagatcaacaacaccgtgagaagcgccgacagcagaaacggcctgaacagcaccgagggcgaggccagaggcaacggcacccagcccgtgctgagcggcaccggcgaggagaccgtgagactgggcttccccgtggaccccagaaaggtgctgatcgtggccggccaccacaactggatcgtggccgcctacgcccacttcgccgtgtgctacagagtgttctggctgggcaccgtgggccacgcctgcaaccccagcaccctgggcggcagagacggctggagcagcagaagcgccagacccacctggtag

SEQ ID NO: 93959 - DNA, 507 bp, Artificial Sequence
  Description of Artificial Sequence: Synthetic coding sequence
tgagccctgagcgtgtacctgacccccaagaccagcgtgagcggcaactggatcgagatcgcctacggcaccagcagcggcgccgtgagagtgatcgtgcagcaccccgagaccgtgggcagcggcccccagctgttccagaccttcaccgtgcacagaagccccgtgaccaagatcatgctgagcgagaagcacctggtgagcgtgtgcgccgacaacaaccacgtgagaacctggaccgtgaccagattcagaggcatgatcagcacccagcccggcagcacccccctggccagcttcaagatcctgagcctggaggagaccgagagccacggcagctacagcagcggcaacgacatcggccccttcggcgagagagacgaccagcaggtgttcatccagaaggtggtgcccatcaccaacaagctgttcgtgagactgagcagcaccggcaagagcctgtgcggcgtgagcctggtgagcagaagcagccaggagcccacctag

SEQ ID NO: 93960 - DNA, 870 bp, Artificial Sequence
  Description of Artificial Sequence: Synthetic coding sequence
atggtggtggtgaccggcagagagcccgacagcagaagacaggacggcgccatgagcagcagcgacgccgaggacgacttcctggagcccgccacccccaccgccacccaggccggccacgccctgcccctgctgccccaggagttccccgaggtggtgcccctgaacatcggcggcgcccacttcaccaccagactgagcaccctgagatgctacgaggacaccatgctggccgccatgttcagcggcagacactacatccccaccgacagcgagggcagatacttcatcgacagagacggcacccacttcggcgacgtgctgaacttcctgagaagcggcgacctgccccccagagagagagtgagagccgtgtacaaggaggcccagtactacgccatcggccccctgctggagcagctggagaacatgcagcccctgaagggcgagaaggtgagacaggccttcctgggcctgatgccctactacaaggaccacctggagagaatcgtggagatcgccagactgagagccgtgcagagaaaggccagattcgccaagctgaaggtgtgcgtgttcaaggaggagatgcccatcaccccctacgagtgccccctgctgaacagcctgagattcgagagaagcgagagcgacggccagctgttcgagcaccactgcgaggtggacgtgagcttcggcccctgggaggccgtggccgacgtgtacgacctgctgcactgcctggtgaccgacctgagcgcccagggcctgaccgtggaccaccagtgcatcggcgtgtgcgacaagcacctggtgaaccactactactgcaagagacccatctacgagttcaagatcacctggtggtag

SEQ ID NO: 93961 - DNA, 1728 bp, Artificial Sequence
  Description of Artificial Sequence: Synthetic coding sequence
gtgagcagaaagaagatgagcctgaagagcgagagaagaggcatccacgtggaccagagcgacctgctgtgcaagaagggctgcggctactacggcaaccccgcctggcagggcttctgcagcaagtgctggagagaggagtaccacaaggccagacagaagcagatccaggaggactgggagctggccgagagagtgctgctgtgctaccccggctggagcgccatggtgcagttccagctgaccgccaccagcgccagctgggcccaggtgatcctgctgctgcagccccccaacgtgctgggcctgcaggccctgcagagagaggaggaggaggccttcgccagcagccagagcagccagggcgcccagagcctgaccttcagcaagttcgaggagaagaagaccaacgagaagaccagaaaggtgaccaccgtgaagaagttcttcagcgccagcagcagagtgggcagcaagaaggagatccaggaggccaaggcccccagccccagcatcaacagacagaccagcatcgagaccgacagagtgagcaaggagttcatcgagttcctgaagaccttccacaagaccggccaggagatctacaagcagaccaagctgttcctggagggcatgcactacaagagagacctgagcatcgaggagcagagcgagtgcgcccaggacttctaccacaacgtggccgagagaatgcagaccagaggcaaggagagaagattccaccacgtgggccaggccggcctggagctgctgaccagcggcgacccccccgccagcgccagccagagcgccggcaacaccggcgtggagcccccccaccccgccgtgccccccgagagagtggagaagatcatggaccagatcgagaagtacatcatgaccagactgtacaagtacgtgttctgccccgagaccaccgacgacgagaagaaggacctggccatccagaagagaatcagagccctgagatgggtgaccccccagatgctgtgcgtgcccgtgaacgaggacatccccgaggtgagcgacatggtggtgaaggccatcaccgacatcatcgagatggacagcaagagagtgcccagagacaagctggcctgcatcaccaagtgcagcaagcacatcttcaacgccatcaagatcaccaagaacgagcccgccagcgccgacgacttcctgcccaccctgatctacatcgtgctgaagggcaacccccccagactgcagagcaacatccagtacatcaccagattctgcaaccccagcagactgatgaccggcgaggacggctactacttcaccaacctgtgctgcgccgtggccttcatcgagaagctggacgcccagagcctgaacctgagccaggaggacttcgacagatacatgagcggccagaccagccccagaaagcaggaggccgagagctggagccccgacgcctgcctgggcgtgaagcagatgtacaagaacctggacctgctgagccagctgaacgagagacaggagagaatcatgaacgaggccaagaagctggagaaggacctgatcgactggaccgacggcatcgccagagaggtgcaggacatcgtggagaagtaccccctggagatcaagccccccaaccagcccctggccgccatcgacagcgagaacgtggagaacgacaagctgcccccccccctgcagccccaggtgtacgccggctag

SEQ ID NO: 93962 - DNA, 1596 bp, Artificial Sequence
  Description of Artificial Sequence: Synthetic coding sequence
atgagcctgaagagcgagagaagaggcatccacgtggaccagagcgacctgctgtgcaagaagggctgcggctactacggcaaccccgcctggcagggcttctgcagcaagtgctggagagaggagtaccacaaggccagacagaagcagatccaggaggactgggagctggccgagagagtgctgctgtgctaccccggctggagcgccatggtgcagttccagctgaccgccaccagcgccagctgggcccaggtgatcctgctgctgcagccccccaacgtgctgggcctgcaggccctgcagagagaggaggaggaggccttcgccagcagccagagcagccagggcgcccagagcctgaccttcagcaagttcgaggagaagaagaccaacgagaagaccagaaaggtgaccaccgtgaagaagttcttcagcgccagcagcagagtgggcagcaagaaggagatccaggaggccaaggcccccagccccagcatcaacagacagaccagcatcgagaccgacagagtgagcaaggagttcatcgagttcctgaagaccttccacaagaccggccaggagatctacaagcagaccaagctgttcctggagggcatgcactacaagagagacctgagcatcgaggagcagagcgagtgcgcccaggacttctaccacaacgtggccgagagaatgcagaccagaggcaaggtgccccccgagagagtggagaagatcatggaccagatcgagaagtacatcatgaccagactgtacaagtacgtgttctgccccgagaccaccgacgacgagaagaaggacctggccatccagaagagaatcagagccctgagatgggtgaccccccagatgctgtgcgtgcccgtgaacgaggacatccccgaggtgagcgacatggtggtgaaggccatcaccgacatcatcgagatggacagcaagagagtgcccagagacaagctggcctgcatcaccaagtgcagcaagcacatcttcaacgccatcaagatcaccaagaacgagcccgccagcgccgacgacttcctgcccaccctgatctacatcgtgctgaagggcaacccccccagactgcagagcaacatccagtacatcaccagattctgcaaccccagcagactgatgaccggcgaggacggctactacttcaccaacctgtgctgcgccgtggccttcatcgagaagctggacgcccagagcctgaacctgagccaggaggacttcgacagatacatgagcggccagaccagccccagaaagcaggaggccgagagctggagccccgacgcctgcctgggcgtgaagcagatgtacaagaacctggacctgctgagccagctgaacgagagacaggagagaatcatgaacgaggccaagaagctggagaaggacctgatcgactggaccgacggcatcgccagagaggtgcaggacatcgtggagaagtaccccctggagatcaagccccccaaccagcccctggccgccatcgacagcgagaacgtggagaacgacaagctgcccccccccctgcagccccaggtgtacgccggctag

SEQ ID NO: 93963 - DNA, 1476 bp, Artificial Sequence
  Description of Artificial Sequence: Synthetic coding sequence
atgagcctgaagagcgagagaagaggcatccacgtggaccagagcgacctgctgtgcaagaagggctgcggctactacggcaaccccgcctggcagggcttctgcagcaagtgctggagagaggagtaccacaaggccagacagaagcagatccaggaggactgggagctggccgagagactgcagagagaggaggaggaggccttcgccagcagccagagcagccagggcgcccagagcctgaccttcagcaagttcgaggagaagaagaccaacgagaagaccagaaaggtgaccaccgtgaagaagttcttcagcgccagcagcagagtgggcagcaagaaggagatccaggaggccaaggcccccagccccagcatcaacagacagaccagcatcgagaccgacagagtgagcaaggagttcatcgagttcctgaagaccttccacaagaccggccaggagatctacaagcagaccaagctgttcctggagggcatgcactacaagagagacctgagcatcgaggagcagagcgagtgcgcccaggacttctaccacaacgtggccgagagaatgcagaccagaggcaaggtgccccccgagagagtggagaagatcatggaccagatcgagaagtacatcatgaccagactgtacaagtacgtgttctgccccgagaccaccgacgacgagaagaaggacctggccatccagaagagaatcagagccctgagatgggtgaccccccagatgctgtgcgtgcccgtgaacgaggacatccccgaggtgagcgacatggtggtgaaggccatcaccgacatcatcgagatggacagcaagagagtgcccagagacaagctggcctgcatcaccaagtgcagcaagcacatcttcaacgccatcaagatcaccaagaacgagcccgccagcgccgacgacttcctgcccaccctgatctacatcgtgctgaagggcaacccccccagactgcagagcaacatccagtacatcaccagattctgcaaccccagcagactgatgaccggcgaggacggctactacttcaccaacctgtgctgcgccgtggccttcatcgagaagctggacgcccagagcctgaacctgagccaggaggacttcgacagatacatgagcggccagaccagccccagaaagcaggaggccgagagctggagccccgacgcctgcctgggcgtgaagcagatgtacaagaacctggacctgctgagccagctgaacgagagacaggagagaatcatgaacgaggccaagaagctggagaaggacctgatcgactggaccgacggcatcgccagagaggtgcaggacatcgtggagaagtaccccctggagatcaagccccccaaccagcccctggccgccatcgacagcgagaacgtggagaacgacaagctgcccccccccctgcagccccaggtgtacgccggctag

SEQ ID NO: 93964 - DNA, 1476 bp, Artificial Sequence; identical to SEQ ID NO: 93963
  Description of Artificial Sequence: Synthetic coding sequence

SEQ ID NO: 93965 - DNA, 1224 bp, Artificial Sequence
  Description of Artificial Sequence: Synthetic coding sequence
atgagcctgaagagcgagagaagaggcatccacgtggaccagagcgacctgctgtgcaagaagggctgcggctactacggcaaccccgcctggcagggcttctgcagcaagtgctggagagaggagtaccacaaggccagacagaagcagatccaggaggactgggagctggccgagagactgcagagagaggaggaggaggccttcgccagcagccagagcagccagggcgcccagagcctgaccttcagcaagttcgaggagaagaagaccaacgagaagaccagaaaggtgaccaccgtgaagaagttcttcagcgccagcagcagagtgggcagcaagaagccccccgagagagtggagaagatcatggaccagatcgagaagtacatcatgaccagactgtacaagtacgtgttctgccccgagaccaccgacgacgagaagaaggacctggccatccagaagagaatcagagccctgagatgggtgaccccccagatgctgtgcgtgcccgtgaacgaggacatccccgaggtgagcgacatggtggtgaaggccatcaccgacatcatcgagatggacagcaagagagtgcccagagacaagctggcctgcatcaccaagtgcagcaagcacatcttcaacgccatcaagatcaccaagaacgagcccgccagcgccgacgacttcctgcccaccctgatctacatcgtgctgaagggcaacccccccagactgcagagcaacatccagtacatcaccagattctgcaaccccagcagactgatgaccggcgaggacggctactacttcaccaacctgtgctgcgccgtggccttcatcgagaagctggacgcccagagcctgaacctgagccaggaggacttcgacagatacatgagcggccagaccagccccagaaagcaggaggccgagagctggagccccgacgcctgcctgggcgtgaagcagatgtacaagaacctggacctgctgagccagctgaacgagagacaggagagaatcatgaacgaggccaagaagctggagaaggacctgatcgactggaccgacggcatcgccagagaggtgcaggacatcgtggagaagtaccccctggagatcaagccccccaaccagcccctggccgccatcgacagcgagaacgtggagaacgacaagctgcccccccccctgcagccccaggtgtacgccggctag

SEQ ID NO: 93966 - DNA, 867 bp, Artificial Sequence
  Description of Artificial Sequence: Synthetic coding sequence
atggtggtggtgaccggcagagagcccgacagcagaagacaggacggcgccatgagcagcagcgacgccgaggacgacttcctggagcccgccacccccaccgccacccaggccggccacgccctgcccctgctgccccaggagttccccgaggtggtgcccctgaacatcggcggcgcccacttcaccaccagactgagcaccctgagatgctacgaggacaccatgctggccgccatgttcagcggcagacactacatccccaccgacagcgagggcagatacttcatcgacagagacggcacccacttcggcgacgtgctgaacttcctgagaagcggcgacctgccccccagagagagagtgagagccgtgtacaaggaggcccagtactacgccatcggccccctgctggagcagctggagaacatgcagcccctgaagggcgagaaggtgagacaggccttcctgggcctgatgccctactacaaggaccacctggagagaatcgtggagatcgccagactgagagccgtgcagagaaaggccagattcgccaagctgaaggtgtgcgtgttcaaggaggagatgcccatcaccccctacgagtgccccctgctgaacagcctgagattcgagagaagcgagagcgacggccagctgttcgagcaccactgcgaggtggacgtgagcttcggcccctgggaggccgtggccgacgtgtacgacctgctgcactgcctggtgaccgacctgagcgcccagggcctgaccgtggaccaccagtgcatcggcgtgtgcgacaagcacctggtgaaccactactactgcaagagacccatctacgagttcaagatcacctggtag

SEQ ID NO: 93967 - DNA, 663 bp, Artificial Sequence
  Description of Artificial Sequence: Synthetic coding sequence
atgaagggctacggccacaccgtgcccctgagcgacggcggcaaggccttctgcatcatctacagcgtgatcggcatccccttcaccctgctgttcctgaccgccgtggtgcagagaatcaccgtgcacgtgaccagaagacccgtgctgtacttccacatcagatggggcttcagcaagcaggtggtggccatcgtgcacgccgtgctgctgggcttcgtgaccgtgagctgcttcttcttcatccccgccgccgtgttcagcgtgctggaggacgactggaacttcctggagagcttctacttctgcttcatcagcctgagcaccatcggcctgggcgactacgtgcccggcgagggctacaaccagaagttcagagagctgtacaagatcggcatcacctgctacctgctgctgggcctgatcgccatgctggtggtgctggagaccttctgcgagctgcacgagctgaagaagttcagaaagatgttctacgtgaagaaggacaaggacgaggaccaggtgcacatcatcgagcacgaccagctgagcttcagcagcatcaccgaccaggccgccggcatgaaggaggaccagaagcagaacgagcccttcgtggccacccagagcagcgcctgcgtggacggccccgccaaccactag

SEQ ID NO: 93968 - DNA, 1011 bp, Artificial Sequence
  Description of Artificial Sequence: Synthetic coding sequence
atgctgcagagcctggccggcagcagctgcgtgagactggtggagagacacagaagcgcctggtgcttcggcttcctggtgctgggctacctgctgtacctggtgttcggcgccgtggtgttcagcagcgtggagctgccctacgaggacctgctgagacaggagctgagaaagctgaagagaagattcctggaggagcacgagtgcctgagcgagcagcagctggagcagttcctgggcagagtgctggaggccagcaactacggcgtgagcgtgctgagcaacgccagcggcaactggaactgggacttcaccagcgccctgttcttcgccagcaccgtgctgagcaccaccggctacggccacaccgtgcccctgagcgacggcggcaaggccttctgcatcatctacagcgtgatcggcatccccttcaccctgctgttcctgaccgccgtggtgcagagaatcaccgtgcacgtgaccagaagacccgtgctgtacttccacatcagatggggcttcagcaagcaggtggtggccatcgtgcacgccgtgctgctgggcttcgtgaccgtgagctgcttcttcttcatccccgccgccgtgttcagcgtgctggaggacgactggaacttcctggagagcttctacttctgcttcatcagcctgagcaccatcggcctgggcgactacgtgcccggcgagggctacaaccagaagttcagagagctgtacaagatcggcatcacctgctacctgctgctgggcctgatcgccatgctggtggtgctggagaccttctgcgagctgcacgagctgaagaagttcagaaagatgttctacgtgaagaaggacaaggacgaggaccaggtgcacatcatcgagcacgaccagctgagcttcagcagcatcaccgaccaggccgccggcatgaaggaggaccagaagcagaacgagcccttcgtggccacccagagcagcgcctgcgtggacggccccgccaaccactag

SEQ ID NO: 93969 - DNA, 729 bp, Artificial Sequence
  Description of Artificial Sequence: Synthetic coding sequence
gtgctgagagtgctgagccccgacctggtgagaagactgctgaacctggccgtgagagccttccaggtgcccaagggcgagagcctgaacttccccgagagcacccccggctacggccacaccgtgcccctgagcgacggcggcaaggccttctgcatcatctacagcgtgatcggcatccccttcaccctgctgttcctgaccgccgtggtgcagagaatcaccgtgcacgtgaccagaagacccgtgctgtacttccacatcagatggggcttcagcaagcaggtggtggccatcgtgcacgccgtgctgctgggcttcgtgaccgtgagctgcttcttcttcatccccgccgccgtgttcagcgtgctggaggacgactggaacttcctggagagcttctacttctgcttcatcagcctgagcaccatcggcctgggcgactacgtgcccggcgagggctacaaccagaagttcagagagctgtacaagatcggcatcacctgctacctgctgctgggcctgatcgccatgctggtggtgctggagaccttctgcgagctgcacgagctgaagaagttcagaaagatgttctacgtgaagaaggacaaggacgaggaccaggtgcacatcatcgagcacgaccagctgagcttcagcagcatcaccgaccaggccgccggcatgaaggaggaccagaagcagaacgagcccttcgtggccacctag

SEQ ID NO: 93970 - DNA, 1632 bp, Artificial Sequence
  Description of Artificial Sequence: Synthetic coding sequence
atggaggacggcttcaagggcgacagaaccgagggctgcagaagcgacagcgtggccgtgcccgccgccgcccccgtgtgccagcccaagagcgccaccaacggccagccccccgcccccgcccccacccccacccccagactgagcatcagcagcagagccaccgtggtggccagaatggagggcaccagccagggcggcctgcagaccgtgatgaagtggaagaccgtggtggccatcttcgtggtggtggtggtgtacctggtgaccggcggcctggtgttcagagccctggagcagcccttcgagagcagccagaagaacaccatcgccctggagaaggccgagttcctgagagaccacgtgtgcgtgagcccccaggagctggagaccctgatccagcacgccctggacgccgacaacgccggcgtgagccccatcggcaacagcagcaacaacagcagccactgggacctgggcagcgccttcttcttcgccggcaccgtgatcaccaccatcggctacggcaacatcgcccccagcaccgagggcggcaagatcttctgcatcctgtacgccatcttcggcatccccctgttcggcttcctgctggccggcatcggcgaccagctgggcaccatcttcggcaagagcatcgccagagtggagaaggtgttcagaaagaagcaggtgagccagaccaagatcagagtgatcagcaccatcctgttcatcctggccggctgcatcgtgttcgtgaccatccccgccgtgatcttcaagtacatcgagggctggaccgccctggagagcatctacttcgtggtggtgaccctgaccaccgtgggcttcggcgacttcgtggccggcggcaacgccggcatcaactacagagagtggtacaagcccctggtgtggttctggatcctggtgggcctggcctacttcgccgccgtgctgagcatgatcggcgactggctgagagtgctgagcaagaagaccaaggaggaggtgggcgagatcaaggcccacgccgccgagtggaaggccaacgtgaccgccgagttcagagagaccagaagaagactgagcgtggagatccacgacaagctgcagagagccgccaccatcagaagcatggagagaagaagactgggcctggaccagagagcccacagcctggacatgctgagccccgagaagagaagcgtgttcgccgccctggacaccggcagattcaaggccagcagccaggagagcatcaacaacagacccaacaacctgagactgaagggccccgagcagctgaacaagcacggccagggcgccagcgaggacaacatcatcaacaagttcggcagcaccagcagactgaccaagagaaagaacaaggacctgaagaagaccctgcccgaggacgtgcagaagatctacaagaccttcagaaactacagcctggacgaggagaagaaggaggaggagaccgagaagatgtgcaacagcgacaacagcagcaccgccatgctgaccgactgcatccagcagcacgccgagctggagaacggcatgatccccaccgacaccaaggacagagagcccgagaacaacagcctgctggaggacagaaactag

SEQ ID NO: 93971 - DNA, 1632 bp, Artificial Sequence
  Description of Artificial Sequence: Synthetic coding sequence
atgaagttccccatcgagacccccagaaagcaggtgaactgggaccccaaggtggccgtgcccgccgccgcccccgtgtgccagcccaagagcgccaccaacggccagccccccgcccccgcccccacccccacccccagactgagcatcagcagcagagccaccgtggtggccagaatggagggcaccagccagggcggcctgcagaccgtgatgaagtggaagaccgtggtggccatcttcgtggtggtggtggtgtacctggtgaccggcggcctggtgttcagagccctggagcagcccttcgagagcagccagaagaacaccatcgccctggagaaggccgagttcctgagagaccacgtgtgcgtgagcccccaggagctggagaccctgatccagcacgccctggacgccgacaacgccggcgtgagccccatcggcaacagcagcaacaacagcagccactgggacctgggcagcgccttcttcttcgccggcaccgtgatcaccaccatcggctacggcaacatcgcccccagcaccgagggcggcaagatcttctgcatcctgtacgccatcttcggcatccccctgttcggcttcctgctggccggcatcggcgaccagctgggcaccatcttcggcaagagcatcgccagagtggagaaggtgttcagaaagaagcaggtgagccagaccaagatcagagtgatcagcaccatcctgttcatcctggccggctgcatcgtgttcgtgaccatccccgccgtgatcttcaagtacatcgagggctggaccgccctggagagcatctacttcgtggtggtgaccctgaccaccgtgggcttcggcgacttcgtggccggcggcaacgccggcatcaactacagagagtggtacaagcccctggtgtggttctggatcctggtgggcctggcctacttcgccgccgtgctgagcatgatcggcgactggctgagagtgctgagcaagaagaccaaggaggaggtgggcgagatcaaggcccacgccgccgagtggaaggccaacgtgaccgccgagttcagagagaccagaagaagactgagcgtggagatccacgacaagctgcagagagccgccaccatcagaagcatggagagaagaagactgggcctggaccagagagcccacagcctggacatgctgagccccgagaagagaagcgtgttcgccgccctggacaccggcagattcaaggccagcagccaggagagcatcaacaacagacccaacaacctgagactgaagggccccgagcagctgaacaagcacggccagggcgccagcgaggacaacatcatcaacaagttcggcagcaccagcagactgaccaagagaaagaacaaggacctgaagaagaccctgcccgaggacgtgcagaagatctacaagaccttcagaaactacagcctggacgaggagaagaaggaggaggagaccgagaagatgtgcaacagcgacaacagcagcaccgccatgctgaccgactgcatccagcagcacgccgagctggagaacggcatgatccccaccgacaccaaggacagagagcccgagaacaacagcctgctggaggacagaaactag

SEQ ID NO: 93972 - DNA, 1617 bp, Artificial Sequence
  Description of Artificial Sequence: Synthetic coding sequence
atgttcttcctgtacaccgacttcttcctgagcctggtggccgtgcccgccgccgcccccgtgtgccagcccaagagcgccaccaacggccagccccccgcccccgcccccacccccacccccagactgagcatcagcagcagagccaccgtggtggccagaatggagggcaccagccagggcggcctgcagaccgtgatgaagtggaagaccgtggtggccatcttcgtggtggtggtggtgtacctggtgaccggcggcctggtgttcagagccctggagcagcccttcgagagcagccagaagaacaccatcgccctggagaaggccgagttcctgagagaccacgtgtgcgtgagcccccaggagctggagaccctgatccagcacgccctggacgccgacaacgccggcgtgagccccatcggcaacagcagcaacaacagcagccactgggacctgggcagcgccttcttcttcgccggcaccgtgatcaccaccatcggctacggcaacatcgcccccagcaccgagggcggcaagatcttctgcatcctgtacgccatcttcggcatccccctgttcggcttcctgctggccggcatcggcgaccagctgggcaccatcttcggcaagagcatcgccagagtggagaaggtgttcagaaagaagcaggtgagccagaccaagatcagagtgatcagcaccatcctgttcatcctggccggctgcatcgtgttcgtgaccatccccgccgtgatcttcaagtacatcgagggctggaccgccctggagagcatctacttcgtggtggtgaccctgaccaccgtgggcttcggcgacttcgtggccggcggcaacgccggcatcaactacagagagtggtacaagcccctggtgtggttctggatcctggtgggcctggcctacttcgccgccgtgctgagcatgatcggcgactggctgagagtgctgagcaagaagaccaaggaggaggtgggcgagatcaaggcccacgccgccgagtggaaggccaacgtgaccgccgagttcagagagaccagaagaagactgagcgtggagatccacgacaagctgcagagagccgccaccatcagaagcatggagagaagaagactgggcctggaccagagagcccacagcctggacatgctgagccccgagaagagaagcgtgttcgccgccctggacaccggcagattcaaggccagcagccaggagagcatcaacaacagacccaacaacctgagactgaagggccccgagcagctgaacaagcacggccagggcgccagcgaggacaacatcatcaacaagttcggcagcaccagcagactgaccaagagaaagaacaaggacctgaagaagaccctgcccgaggacgtgcagaagatctacaagaccttcagaaactacagcctggacgaggagaagaaggaggaggagaccgagaagatgtgcaacagcgacaacagcagcaccgccatgctgaccgactgcatccagcagcacgccgagctggagaacggcatgatccccaccgacaccaaggacagagagcccgagaacaacagcctgctggaggacagaaactag

SEQ ID NO: 93973 - DNA, 1293 bp, Artificial Sequence
  Description of Artificial Sequence: Synthetic coding sequence
atgagcagcagaagccccagacccccccccagaagaagcagaagaagactgcccagacccagctgctgctgctgctgctgcagaagaagccacctgaacgaggacaccggcagattcgtgctgctggccgccctgatcggcctgtacctggtggccggcgccaccgtgttcagcgccctggagagccccggcgaggccgaggccagagccagatggggcgccaccctgagaaacttcagcgccgcccacggcgtggccgagcccgagctgagagccttcctgagacactacgaggccgccctggccgccggcgtgagagccgacgccctgagacccagatgggacttccccggcgccttctacttcgtgggcaccgtggtgagcaccatcggcttcggcatgaccacccccgccaccgtgggcggcaaggccttcctgatcgcctacggcctgttcggctgcgccggcaccatcctgttcttcaacctgttcctggagagaatcatcagcctgctggccttcatcatgagagcctgcagagagagacagctgagaagaagcggcctgctgcccgccaccttcagaagaggcagcgccctgagcgaggccgacagcctggccggctggaagcccagcgtgtaccacgtgctgctgatcctgggcctgttcgccgtgctgctgagctgctgcgccagcgccatgtacaccagcgtggagggctgggactacgtggacagcctgtacttctgcttcgtgaccttcagcaccatcggcttcggcgacctggtgagcagccagcacgccgcctacagaaaccagggcctgtacagactgggcaacttcctgttcatcctgctgggcgtgtgctgcatctacagcctgttcaacgtgatcagcatcctgatcaagcaggtgctgaactggatgctgagaaagctgagctgcagatgctgcgccagatgctgccccgcccccggcgcccccctggccagaagaaacgccatcacccccggcagcagactgagaagaagactggccgccctgggcgccgaccccgccgccagagacagcgacgccgagggcagaagactgagcggcgagctgatcagcatgagagacctgaccgccagcaacaaggtgagcctggccctgctgcagaagcagctgagcgagaccgccaacggctaccccagaagcgtgtgcgtgaacaccagacagaacggcttcagcggcggcgtgggcgccctgggcatcatgaacaacagactggccgagaccagcgccagcagatag

SEQ ID NO: 93974 - DNA, 1227 bp, Artificial Sequence
  Description of Artificial Sequence: Synthetic coding sequence
atggccggcagaggcttcagctggggccccggccacctgaacgaggacaacgccagattcctgctgctggccgccctgatcgtgctgtacctgctgggcggcgccgccgtgttcagcgccctggagctggcccacgagagacaggccaagcagagatgggaggagagactggccaacttcagcagaggccacaacctgagcagagacgagctgagaggcttcctgagacactacgaggaggccaccagagccggcatcagagtggacaacgtgagacccagatgggacttcaccggcgccttctacttcgtgggcaccgtggtgagcaccatcggcttcggcatgaccacccccgccaccgtgggcggcaagatcttcctgatcttctacggcctggtgggctgcagcagcaccatcctgttcttcaacctgttcctggagagactgatcaccatcatcgcctacatcatgaagagctgccaccagagacagctgagaagaagaggcgccctgccccaggagagcctgaaggacgccggccagtgcgaggtggacagcctggccggctggaagcccagcgtgtactacgtgatgctgatcctgtgcaccgccagcatcctgatcagctgctgcgccagcgccatgtacacccccatcgagggctggagctacttcgacagcctgtacttctgcttcgtggccttcagcaccatcggcttcggcgacctggtgagcagccagaacgcccactacgagagccagggcctgtacagattcgccaacttcgtgttcatcctgatgggcgtgtgctgcatctacagcctgttcaacgtgatcagcatcctgatcaagcagagcctgaactggatcctgagaaagatggacagcggctgctgcccccagtgccagagaggcctgctgagaagcagaagaaacgtggtgatgcccggcagcgtgagaaacagatgcaacatcagcatcgagaccgacggcgtggccgagagcgacaccgacggcagaagactgagcggcgagatgatcagcatgaaggacctgctggccgccaacaaggccagcctggccatcctgcagaagcagctgagcgagatggccaacggctgcccccaccagaccagcaccctggccagagacaacgagttcagcggcggcgtgggcgccttcgccatcatgaacaacagactggccgagaccagcggcgacagatag

SEQ ID NO: 93975 - DNA, 993 bp, Artificial Sequence
  Description of Artificial Sequence: Synthetic coding sequence
atgagaagacccagcgtgagagccgccggcctggtgctgtgcaccctgtgctacctgctggtgggcgccgccgtgttcgacgccctggagagcgaggccgagagcggcagacagagactgctggtgcagaagagaggcgccctgagaagaaagttcggcttcagcgccgaggactacagagagctggagagactggccctgcaggccgagccccacagagccggcagacagtggaagttccccggcagcttctacttcgccatcaccgtgatcaccaccatcgagtacggccacgccgcccccggcaccgacagcggcaaggtgttctgcatgttctacgccctgctgggcatccccctgaccctggtgaccttccagagcctgggcgagagactgaacgccgtggtgagaagactgctgctggccgccaagtgctgcctgggcctgagatggacctgcgtgagcaccgagaacctggtggtggccggcctgctggcctgcgccgccaccctggccctgggcgccgtggccttcagccacttcgagggctggaccttcttccacgcctactactactgcttcatcaccctgaccaccatcggcttcggcgacttcgtggccctgcagagcggcgaggccctgcagagaaagctgccctacgtggccttcagcttcctgtacatcctgctgggcctgaccgtgatcggcgccttcctgaacctggtggtgctgagattcctggtggccagcgccgactggcccgagagagccgccagaacccccagccccagaccccccggcgcccccgagagcagaggcctgtggctgcccagaagacccgccagaagcgtgggcagcgccagcgtgttctgccacgtgcacaagctggagagatgcgccagagacaacctgggcttcagcccccccagcagccccggcgtggtgagaggcggccaggcccccagactgggcgccagatggaagagcatctag

SEQ ID NO: 93976 - DNA, 789 bp, Artificial Sequence
  Description of Artificial Sequence: Synthetic coding sequence
atgcccagcgccggcctgtgcagctgctggggcggcagagtgctgcccctgctgctggcctacgtgtgctacctgctgctgggcgccaccatcttccagctgctggagagacaggccgaggcccagagcagagaccagttccagctggagaagctgagattcctggagaactacacctgcctggaccagtgggccatggagcagttcgtgcaggtgatcatggaggcctgggtgaagggcgtgaaccccaagggcaacagcaccaaccccagcaactgggacttcggcagcagcttcttcttcgccggcaccgtggtgaccaccatcggctacggcaacctggcccccagcaccgaggccggccaggtgttctgcgtgttctacgccctgctgggcatccccctgaacgtgatcttcctgaaccacctgggcaccggcctgagagcccacctggccgccatcgagagatgggaggacagacccagaagaagccaggtgctgcaggtgctgggcctggccctgttcctgaccctgggcaccctggtgatcctgatcttcccccccatggtgttcagccacgtggagggctggagcttcagcgagggcttctacttcgccttcatcaccctgagcaccatcggcttcggcgactacgtggtgggcctgagacagggctgcggcgccaaggccgcccccggcagaagacccagaagaggcagcaccgccgccagaggcgtgcaggtgaccccccaggacttccccatcagcaagaagggcctgggcagctag

SEQ ID NO: 93977 - DNA, 930 bp, Artificial Sequence
  Description of Artificial Sequence: Synthetic coding sequence
atgcccagcgccggcctgtgcagctgctggggcggcagagtgctgcccctgctgctggcctacgtgtgctacctgctgctgggcgccaccatcttccagctgctggagagacaggccgaggcccagagcagagaccagttccagctggagaagctgagattcctggagaactacacctgcctggaccagtgggccatggagcagttcgtgcaggtgatcatggaggcctgggtgaagggcgtgaaccccaagggcaacagcaccaaccccagcaactgggacttcggcagcagcttcttcttcgccggcaccgtggtgaccaccatcggctacggcaacctggcccccagcaccgaggccggccaggtgttctgcgtgttctacgccctgctgggcatccccctgaacgtgatcttcctgaaccacctgggcaccggcctgagagcccacctggccgccatcgagagatgggaggacagacccagaagaagccaggtgctgcaggtgctgggcctggccctgttcctgaccctgggcaccctggtgatcctgatcttcccccccatggtgttcagccacgtggagggctggagcttcagcgagggcttctacttcgccttcatcaccctgagcaccatcggcttcggcgactacgtggtgggcaccgaccccagcaagcactacatcagcgtgtacagaagcctggccgccatctggatcctgctgggcctggcctggctggccctgatcctgcccctgggccccctgctgctgcacagatgctgccagctgtggctgctgagcctgagacagggctgcggcgccaaggccgcccccggcagaagacccagaagaggcagcaccgccgccagaggcgtgcaggtgaccccccaggacttccccatcagcaagaagggcctgggcagctag

SEQ ID NO: 93978 - DNA, 969 bp, Artificial Sequence
  Description of Artificial Sequence: Synthetic coding sequence
atgcccagcgccggcctgtgcagctgctggggcggcagagtgctgcccctgctgctggcctacgtgtgctacctgctgctgggcgccaccatcttccagctgctggagagacaggccgaggcccagagcagagaccagttccagctggagaagctgagattcctggagaactacacctgcctggaccagtgggccatggagcagttcgtgcaggtgatcatggaggcctgggtgaagggcgtgaaccccaagggcaacagcaccaaccccagcaactgggacttcggcagcagcttcttcttcgccggcaccgtggtgaccaccatcggctacggcaacctggcccccagcaccgaggccggccaggtgttctgcgtgttctacgccctgctgggcatccccctgaacgtgatcttcctgaaccacctgggcaccggcctgagagcccacctggccgccatcgagagatgggaggacagacccagaagaagccaggtgctgcaggtgctgggcctggccctgttcctgaccctgggcaccctggtgatcctgatcttcccccccatggtgttcagccacgtggagggctggagcttcagcgagggcttctacttcgccttcatcaccctgagcaccatcggcttcggcgactacgtggtgggccaccccctgaacttcatcacccccagcggcctgctgcccagccaggagcccttccagaccccccacggcaagcccgagagccagcagatccccggcagcttccagaaggtgagcagcatgaacgtgtggcccctgagcggcatgcacagccccggcctggccttccccctgcccgactgcaacatccccgaccaggagagattcagacccctgcaccccggcgcctggaagttctggcccctgcccctgcccagcagcaacagcaagtgggcccccatgtggctgggcagcagcgcccaggtgtag

SEQ ID NO: 93979 - DNA, 885 bp, Artificial Sequence
  Description of Artificial Sequence: Synthetic coding sequence
atgcccagcgccggcctgtgcagctgctggggcggcagagtgctgcccctgctgctggcctacgtgtgctacctgctgctgggcgccaccatcttccagctgctggagagacaggccgaggcccagagcagagaccagttccagctggagaagctgagattcctggagaactacacctgcctggaccagtgggccatggagcagttcgtgcaggtgatcatggaggcctgggtgaagggcgtgaaccccaagggcaacagcaccaaccccagcaactgggacttcggcagcagcttcttcttcgccggcaccgtggtgaccaccatcggctacggcaacctggcccccagcaccgaggccggccaggtgttctgcgtgttctacgccctgctgggcatccccctgaacgtgatcttcctgaaccacctgggcaccggcctgagagcccacctggccgccatcgagagatgggaggacagacccagaagaagccaggtgctgcaggtgctgggcctggccctgttcctgaccctgggcaccctggtgatcctgatcttcccccccatggtgttcagccacgtggagggctggagcttcagcgagggcttctacttcgccttcatcaccctgagcaccatcggcttcggcgactacgtggtgggcaccgaccccagcaagcactacatcagcgtgtacagaagcctggccgccatctggatcctgctgggcctggcctggctggccctgatcctgcccctgggccccctgctgctgcacagatgctgccagctgtggctgctgagcagaggcctgggcgtgaaggacggcgccgccagcgaccccagcggcctgcccagaccccagaagatccccatcagcgcctag

SEQ ID NO: 93980 - DNA, 594 bp, Artificial Sequence
  Description of Artificial Sequence: Synthetic coding sequence
atggagcagttcgtgcaggtgatcatggaggcctgggtgaagggcgtgaaccccaagggcaacagcaccaaccccagcaactgggacttcggcagcagcttcttcttcgccggcaccgtggtgaccaccatcggctacggcaacctggcccccagcaccgaggccggccaggtgttctgcgtgttctacgccctgctgggcatccccctgaacgtgatcttcctgaaccacctgggcaccggcctgagagcccacctggccgccatcgagagatgggaggacagacccagaagaagccaggtgctgcaggtgctgggcctggccctgttcctgaccctgggcaccctggtgatcctgatcttcccccccatggtgttcagccacgtggagggctggagcttcagcgagggcttctacttcgccttcatcaccctgagcaccatcggcttcggcgactacgtggtgggcctgagacagggctgcggcgccaaggccgcccccggcagaagacccagaagaggcagcaccgccgccagaggcgtgcaggtgaccccccaggacttccccatcagcaagaagggcctgggcagctag

SEQ ID NO: 93981 - DNA, 999 bp, Artificial Sequence
  Description of Artificial Sequence: Synthetic coding sequence
atgtacagacccagagccagagccgcccccgagggcagagtgagaggctgcgccgtgcccagcaccgtgctgctgctgctggcctacctggcctacctggccctgggcaccggcgtgttctggaccctggagggcagagccgcccaggacagcagcagaagcttccagagagacaagtgggagctgctgcagaacttcacctgcctggacagacccgccctggacagcctgatcagagacgtggtgcaggcctacaagaacggcgccagcctgctgagcaacaccaccagcatgggcagatgggagctggtgggcagcttcttcttcagcgtgagcaccatcaccaccatcggctacggcaacctgagccccaacaccatggccgccagactgttctgcatcttcttcgccctggtgggcatccccctgaacctggtggtgctgaacagactgggccacctgatgcagcagggcgtgaaccactgggccagcagactgggcggcacctggcaggaccccgacaaggccagatggctggccggcagcggcgccctgctgagcggcctgctgctgttcctgctgctgccccccctgctgttcagccacatggagggctggagctacaccgagggcttctacttcgccttcatcaccctgagcaccgtgggcttcggcgactacgtgatcggcatgaaccccagccagagataccccctgtggtacaagaacatggtgagcctgtggatcctgttcggcatggcctggctggccctgatcatcaagctgatcctgagccagctggagacccccggcagagtgtgcagctgctgccaccacagcagcaaggaggacttcaagagccagagctggagacagggccccgacagagagcccgagagccacagcccccagcagggctgctaccccgagggccccatgggcatcatccagcacctggagcccagcgcccacgccgccggctgcggcaaggacagctag

SEQ ID NO: 93982 - DNA, 816 bp, Artificial Sequence
  Description of Artificial Sequence: Synthetic coding sequence
atgtacagacccagagccagagccgcccccgagggcagagtgagaggctgcgccgtgcccagcaccgtgctgctgctgctggcctacctggcctacctggccctgggcaccggcgtgttctggaccctggagggcagagccgcccaggacagcagcagaagcttccagagagacaagtgggagctgctgcagaacttcacctgcctggacagacccgccctggacagcctgatcagagacgtggtgcaggcctacaagaacggcgccagcctgctgagcaacaccaccagcatgggcagatgggagctggtgggcagcttcttcttcagcgtgagcaccatcaccaccatcggctacggcaacctgagccccaacaccatggccgccagactgttctgcatcttcttcgccctggtgggcatccccctgaacctggtggtgctgaacagactgggccacctgatgcagcagggcgtgaaccactgggccagcagactgggcggcacctggcaggaccccgacaaggccagatggctggccggcagcggcgccctgctgagcggcctgctgctgttcctgctgctgccccccctgctgttcagccacatggagggctggagctacaccgagggcttctacttcgccttcatcaccctgagcaccgtgggcttcggcgactacgtgatcgccagctgcctgatcagcgacaccagaaagcccaacagagactggcagaccctggagagaaccagcaagagcagcggcggcctgctgaagtacagattcctggccggccacggcggcagccacctgtag

SEQ ID NO: 93983 - DNA, 1155 bp, Artificial Sequence
  Description of Artificial Sequence: Synthetic coding sequence
atggaggtgagcggccacccccaggccagaagatgctgccccgaggccctgggcaagctgttccccggcctgtgcttcctgtgcttcctggtgacctacgccctggtgggcgccgtggtgttcagcgccatcgaggacggccaggtgctggtggccgccgacgacggcgagttcgagaagttcctggaggagctgtgcagaatcctgaactgcagcgagaccgtggtggaggacagaaagcaggacctgcagggccacctgcagaaggtgaagccccagtggttcaacagaaccacccactggagcttcctgagcagcctgttcttctgctgcaccgtgttcagcaccgtgggctacggctacatctaccccgtgaccagactgggcaagtacctgtgcatgctgtacgccctgttcggcatccccctgatgttcctggtgctgaccgacaccggcgacatcctggccaccatcctgagcaccagctacaacagattcagaaagttccccttcttcaccagacccctgctgagcaagtggtgccccaagagcctgttcaagaagaagcccgaccccaagcccgccgacgaggccgtgccccagatcatcatcagcgccgaggagctgcccggccccaagctgggcacctgccccagcagacccagctgcagcatggagctgttcgagagaagccacgccctggagaagcagaacaccctgcagctgcccccccaggccatggagagaagcaacagctgccccgagctggtgctgggcagactgagctacagcatcatcagcaacctggacgaggtgggccagcaggtggagagactggacatccccctgcccatcatcgccctgatcgtgttcgcctacatcagctgcgccgccgccatcctgcccttctgggagacccagctggacttcgagaacgccttctacttctgcttcgtgaccctgaccaccatcggcttcggcgacaccgtgctggagcaccccaacttcttcctgttcttcagcatctacatcatcgtgggcatggagatcgtgttcatcgccttcaagctggtgcagaacagactgatcgacatctacaagaacgtgatgctgttcttcgccaagggcaagttctaccacctggtgaagaagtag

SEQ ID NO: 93984 - DNA, 459 bp, Artificial Sequence
  Description of Artificial Sequence: Synthetic coding sequence
atgatgaaccccagagccaagagagacttctacctggccgcccccgacctgctggaccccaagagcgccgcccagaacagcaagcccagactgagcttcagcaccaagcccaccgtgctggccagcagagtggagagcgacaccaccatcaacgtgatgaagtggaagaccgtgagcaccatcttcctggtggtggtgctgtacctgatcatcggcgccaccgtgttcaaggccctggagcagccccacgagatcagccagagaaccaccatcgtgatccagaagcagaccttcatcagccagcacagctgcgtgaacagcaccgagctggacgagctgatccaggacctggagaccagccaccacgcccagaaggccgccaagtacagcgtgagcagcatgccctactgggagttccccagcctggtgttcagctggctggagctggagatcagctag

SEQ ID NO: 93985 - DNA, 1236 bp, Artificial Sequence
  Description of Artificial Sequence: Synthetic coding sequence
atggccgcccccgacctgctggaccccaagagcgccgcccagaacagcaagcccagactgagcttcagcaccaagcccaccgtgctggccagcagagtggagagcgacaccaccatcaacgtgatgaagtggaagaccgtgagcaccatcttcctggtggtggtgctgtacctgatcatcggcgccaccgtgttcaaggccctggagcagccccacgagatcagccagagaaccaccatcgtgatccagaagcagaccttcatcagccagcacagctgcgtgaacagcaccgagctggacgagctgatccagcagatcgtggccgccatcaacgccggcatcatccccctgggcaacaccagcaaccagatcagccactgggacctgggcagcagcttcttcttcgccggcaccgtgatcaccaccatcggcttcggcaacatcagccccagaaccgagggcggcaagatcttctgcatcatctacgccctgctgggcatccccctgttcggcttcctgctggccggcgtgggcgaccagctgggcaccatcttcggcaagggcatcgccaaggtggaggacaccttcatcaagtggaacgtgagccagaccaagatcagaatcatcagcaccatcatcttcatcctgttcggctgcgtgctgttcgtggccctgcccgccatcatcttcaagcacatcgagggctggagcgccctggacgccatctacttcgtggtgatcaccctgaccaccatcggcttcggcgactacgtggccggcggcagcgacatcgagtacctggacttctacaagcccgtggtgtggttctggatcctggtgggcctggcctacttcgccgccgtgctgagcatgatcggcgactggctgagagtgatcagcaagaagaccaaggaggaggtgggcgagttcagagcccacgccgccgagtggaccgccaacgtgaccgccgagttcaaggagaccagaagaagactgagcgtggagatctacgacaagttccagagagccaccagcatcaagagaaagctgagcgccgagctggccggcaaccacaaccaggagctgaccccctgcagaagaaccctgagcgtgaaccacctgaccagcgagagagacgtgctgccccccctgctgaagaccgagagcatctacctgaacggcctgaccccccactgcgccggcgaggagatcgccgtgatcgagaacatcaagtag

SEQ ID NO: 93986 - DNA, 1269 bp, Artificial Sequence
  Description of Artificial Sequence: Synthetic coding sequence
atgatgaaccccagagccaagagagacttctacctggccgcccccgacctgctggaccccaagagcgccgcccagaacagcaagcccagactgagcttcagcaccaagcccaccgtgctggccagcagagtggagagcgacaccaccatcaacgtgatgaagtggaagaccgtgagcaccatcttcctggtggtggtgctgtacctgatcatcggcgccaccgtgttcaaggccctggagcagccccacgagatcagccagagaaccaccatcgtgatccagaagcagaccttcatcagccagcacagctgcgtgaacagcaccgagctggacgagctgatccagcagatcgtggccgccatcaacgccggcatcatccccctgggcaacaccagcaaccagatcagccactgggacctgggcagcagcttcttcttcgccggcaccgtgatcaccaccatcggcttcggcaacatcagccccagaaccgagggcggcaagatcttctgcatcatctacgccctgctgggcatccccctgttcggcttcctgctggccggcgtgggcgaccagctgggcaccatcttcggcaagggcatcgccaaggtggaggacaccttcatcaagtggaacgtgagccagaccaagatcagaatcatcagcaccatcatcttcatcctgttcggctgcgtgctgttcgtggccctgcccgccatcatcttcaagcacatcgagggctggagcgccctggacgccatctacttcgtggtgatcaccctgaccaccatcggcttcggcgactacgtggccggcggcagcgacatcgagtacctggacttctacaagcccgtggtgtggttctggatcctggtgggcctggcctacttcgccgccgtgctgagcatgatcggcgactggctgagagtgatcagcaagaagaccaaggaggaggtgggcgagttcagagcccacgccgccgagtggaccgccaacgtgaccgccgagttcaaggagaccagaagaagactgagcgtggagatctacgacaagttccagagagccaccagcatcaagagaaagctgagcgccgagctggccggcaaccacaaccaggagctgaccccctgcagaagaaccctgagcgtgaaccacctgaccagcgagagagacgtgctgccccccctgctgaagaccgagagcatctacctgaacggcctgaccccccactgcgccggcgaggagatcgccgtgatcgagaacatcaagtag

SEQ ID NO: 93987 - DNA, 1281 bp, Artificial Sequence
  Description of Artificial Sequence: Synthetic coding sequence
atgctgcccagcgccagcagagagagacccggctacagagccggcgtggccgcccccgacctgctggaccccaagagcgccgcccagaacagcaagcccagactgagcttcagcaccaagcccaccgtgctggccagcagagtggagagcgacaccaccatcaacgtgatgaagtggaagaccgtgagcaccatcttcctggtggtggtgctgtacctgatcatcggcgccaccgtgttcaaggccctggagcagccccacgagatcagccagagaaccaccatcgtgatccagaagcagaccttcatcagccagcacagctgcgtgaacagcaccgagctggacgagctgatccagcagatcgtggccgccatcaacgccggcatcatccccctgggcaacaccagcaaccagatcagccactgggacctgggcagcagcttcttcttcgccggcaccgtgatcaccaccatcggcttcggcaacatcagccccagaaccgagggcggcaagatcttctgcatcatctacgccctgctgggcatccccctgttcggcttcctgctggccggcgtgggcgaccagctgggcaccatcttcggcaagggcatcgccaaggtggaggacaccttcatcaagtggaacgtgagccagaccaagatcagaatcatcagcaccatcatcttcatcctgttcggctgcgtgctgttcgtggccctgcccgccatcatcttcaagcacatcgagggctggagcgccctggacgccatctacttcgtggtgatcaccctgaccaccatcggcttcggcgactacgtggccggcggcagcgacatcgagtacctggacttctacaagcccgtggtgtggttctggatcctggtgggcctggcctacttcgccgccgtgctgagcatgatcggcgactggctgagagtgatcagcaagaagaccaaggaggaggtgggcgagttcagagcccacgccgccgagtggaccgccaacgtgaccgccgagttcaaggagaccagaagaagactgagcgtggagatctacgacaagttccagagagccaccagcatcaagagaaagctgagcgccgagctggccggcaaccacaaccaggagctgaccccctgcagaagaaccctgagcgtgaaccacctgaccagcgagagagacgtgctgccccccctgctgaagaccgagagcatctacctgaacggcctgaccccccactgcgccggcgaggagatcgccgtgatcgagaacatcaagtag

SEQ ID NO: 93988 - DNA, 687 bp, Artificial Sequence
  Description of Artificial Sequence: Synthetic coding sequence
atgatgaaccccagagccaagagagacttctacctggccgcccccgacctgctggaccccaagagcgccgcccagaacagcaagcccagactgagcttcagcaccaagcccaccgtgctggccagcagagtggagagcgacaccaccatcaacgtgatgaagtggaagaccgtgagcaccatcttcctggtggtggtgctgtacctgatcatcggcgccaccgtgttcaaggccctggagcagccccacgagatcagccagagaaccaccatcgtgatccagaagcagaccttcatcagccagcacagctgcgtgaacagcaccgagctggacgagctgatccagcagatcgtggccgccatcaacgccggcatcatccccctgggcaacaccagcaaccagatcagccactgggacctgggcagcagcttcttcttcgccggcaccgtgatcaccaccatcggcttcggcaacatcagccccagaaccgagggcggcaagatcttctgcatcatctacgccctgctgggcatccccctgttcggcttcctgctggccggcgtgggcgaccagctgggcaccatcttcggcaagggcatcgccaaggtggaggacaccttcatcgtggaccccatcctgaacatctggaccagcatcagcctgagctgcggcagcggcagcctgtag

SEQ ID NO: 93989 - DNA, 471 bp, Artificial Sequence
  Description of Artificial Sequence: Synthetic coding sequence
atgctgcccagcgccagcagagagagacccggctacagagccggcgtggccgcccccgacctgctggaccccaagagcgccgcccagaacagcaagcccagactgagcttcagcaccaagcccaccgtgctggccagcagagtggagagcgacaccaccatcaacgtgatgaagtggaagaccgtgagcaccatcttcctggtggtggtgctgtacctgatcatcggcgccaccgtgttcaaggccctggagcagccccacgagatcagccagagaaccaccatcgtgatccagaagcagaccttcatcagccagcacagctgcgtgaacagcaccgagctggacgagctgatccaggacctggagaccagccaccacgcccagaaggccgccaagtacagcgtgagcagcatgccctactgggagttccccagcctggtgttcagctggctggagctggagatcagctag

SEQ ID NO: 93990 - DNA, 459 bp, Artificial Sequence; identical to SEQ ID NO: 93984
  Description of Artificial Sequence: Synthetic coding sequence

SEQ ID NO: 93991 - DNA, 1185 bp, Artificial Sequence
  Description of Artificial Sequence: Synthetic coding sequence
atgaagagacagaacgtgagaaccctggccctgatcgtgtgcaccttcacctacctgctggtgggcgccgccgtgttcgacgccctggagagcgagcccgagctgatcgagagacagagactggagctgagacagcaggagctgagagccagatacaacctgagccagggcggctacgaggagctggagagagtggtgctgagactgaagccccacaaggccggcgtgcagtggagattcgccggcagcttctacttcgccatcaccgtgatcaccaccatcggctacggccacgccgcccccagcaccgacggcggcaaggtgttctgcatgttctacgccctgctgggcatccccctgaccctggtgatgttccagagcctgggcgagagaatcaacaccctggtgagatacctgctgcacagagccaagaagggcctgggcatgagaagagccgacgtgagcatggccaacatggtgctgatcggcttcttcagctgcatcagcaccctgtgcatcggcgccgccgccttcagccactacgagcactggaccttcttccaggcctactactactgcttcatcaccctgaccaccatcggcttcggcgactacgtggccctgcagaaggaccaggccctgcagacccagccccagtacgtggccttcagcttcgtgtacatcctgaccggcctgaccgtgatcggcgccttcctgaacctggtggtgctgagattcatgaccatgaacgccgaggacgagaagagagacgccgagcacagagccctgctgaccagaaacggccaggccggcggcggcggcggcggcggcagcgcccacaccaccgacaccgccagcagcaccgccgccgccggcggcggcggcttcagaaacgtgtacgccgaggtgctgcacttccagagcatgtgcagctgcctgtggtacaagagcagagagaagctgcagtacagcatccccatgatcatccccagagacctgagcaccagcgacacctgcgtggagcagagccacagcagccccggcggcggcggcagatacagcgacacccccagcagaagatgcctgtgcagcggcgcccccagaagcgccatcagcagcgtgagcaccggcctgcacagcctgagcaccttcagaggcctgatgaagagaagaagcagcgtgtag

SEQ ID NO: 93992 - DNA, 816 bp, Artificial Sequence
  Description of Artificial Sequence: Synthetic coding sequence
atgttccagagcctgggcgagagaatcaacaccctggtgagatacctgctgcacagagccaagaagggcctgggcatgagaagagccgacgtgagcatggccaacatggtgctgatcggcttcttcagctgcatcagcaccctgtgcatcggcgccgccgccttcagccactacgagcactggaccttcttccaggcctactactactgcttcatcaccctgaccaccatcggcttcggcgactacgtggccctgcagaaggaccaggccctgcagacccagccccagtacgtggccttcagcttcgtgtacatcctgaccggcctgaccgtgatcggcgccttcctgaacctggtggtgctgagattcatgaccatgaacgccgaggacgagaagagagacgccgagcacagagccctgctgaccagaaacggccaggccggcggcggcggcggcggcggcagcgcccacaccaccgacaccgccagcagcaccgccgccgccggcggcggcggcttcagaaacgtgtacgccgaggtgctgcacttccagagcatgtgcagctgcctgtggtacaagagcagagagaagctgcagtacagcatccccatgatcatccccagagacctgagcaccagcgacacctgcgtggagcagagccacagcagccccggcggcggcggcagatacagcgacacccccagcagaagatgcctgtgcagcggcgcccccagaagcgccatcagcagcgtgagcaccggcctgcacagcctgagcaccttcagaggcctgatgaagagaagaagcagcgtgtag

SEQ ID NO: 93993 - DNA, 1182 bp, Artificial Sequence
  Description of Artificial Sequence: Synthetic coding sequence
atgagaagcaccaccctgctggccctgctggccctggtgctgctgtacctggtgagcggcgccctggtgttcagagccctggagcagccccacgagcagcaggcccagagagagctgggcgaggtgagagagaagttcctgagagcccacccctgcgtgagcgaccaggagctgggcctgctgatcaaggaggtggccgacgccctgggcggcggcgccgaccccgagaccaacagcaccagcaacagcagccacagcgcctgggacctgggcagcgccttcttcttcagcggcaccatcatcaccaccatcggctacggcaacgtggccctgagaaccgacgccggcagactgttctgcatcttctacgccctggtgggcatccccctgttcggcatcctgctggccggcgtgggcgacagactgggcagcagcctgagacacggcatcggccacatcgaggccatcttcctgaagtggcacgtgccccccgagctggtgagagtgctgagcgccatgctgttcctgctgatcggctgcctgctgttcgtgctgacccccaccttcgtgttctgctacatggaggactggagcaagctggaggccatctacttcgtgatcgtgaccctgaccaccgtgggcttcggcgactacgtggccggcgccgaccccagacaggacagccccgcctaccagcccctggtgtggttctggatcctgctgggcctggcctacttcgccagcgtgctgaccaccatcggcaactggctgagagtggtgagcagaagaaccagagccgagatgggcggcctgaccgcccaggccgccagctggaccggcaccgtgaccgccagagtgacccagagagccggccccgccgcccccccccccgagaaggagcagcccctgctgcccccccccccctgccccgcccagcccctgggcagacccagaagccccagcccccccgagaaggcccagccccccagcccccccaccgccagcgccctggactaccccagcgagaacctggccttcatcgacgagagcagcgacacccagagcgagagaggctgccccctgcccagagcccccagaggcagaagaagacccaacccccccagaaagcccgtgagacccagaggccccggcagacccagagacaagggcgtgcccgtgtag

SEQ ID NO: 93994 - DNA, 1182 bp, Artificial Sequence; identical to SEQ ID NO: 93993
  Description of Artificial Sequence: Synthetic coding sequence

SEQ ID NO: 93995 - DNA, 1182 bp, Artificial Sequence; identical to SEQ ID NO: 93993
  Description of Artificial Sequence: Synthetic coding sequence

SEQ ID NO: 93996 - DNA, 1257 bp, Artificial Sequence
  Description of Artificial Sequence: Synthetic coding sequence
accaccgccccccaggagccccccgccagacccctgcaggccggcagcggcgccggccccgcccccggcagagccatgagaagcaccaccctgctggccctgctggccctggtgctgctgtacctggtgagcggcgccctggtgttcagagccctggagcagccccacgagcagcaggcccagagagagctgggcgaggtgagagagaagttcctgagagcccacccctgcgtgagcgaccaggagctgggcctgctgatcaaggaggtggccgacgccctgggcggcggcgccgaccccgagaccaacagcaccagcaacagcagccacagcgcctgggacctgggcagcgccttcttcttcagcggcaccatcatcaccaccatcggctacggcaacgtggccctgagaaccgacgccggcagactgttctgcatcttctacgccctggtgggcatccccctgttcggcatcctgctggccggcgtgggcgacagactgggcagcagcctgagacacggcatcggccacatcgaggccatcttcctgaagtggcacgtgccccccgagctggtgagagtgctgagcgccatgctgttcctgctgatcggctgcctgctgttcgtgctgacccccaccttcgtgttctgctacatggaggactggagcaagctggaggccatctacttcgtgatcgtgaccctgaccaccgtgggcttcggcgactacgtggccggcgccgaccccagacaggacagccccgcctaccagcccctggtgtggttctggatcctgctgggcctggcctacttcgccagcgtgctgaccaccatcggcaactggctgagagtggtgagcagaagaaccagagccgagatgggcggcctgaccgcccaggccgccagctggaccggcaccgtgaccgccagagtgacccagagagccggccccgccgcccccccccccgagaaggagcagcccctgctgcccccccccccctgccccgcccagcccctgggcagacccagaagccccagcccccccgagaaggcccagccccccagcccccccaccgccagcgccctggactaccccagcgagaacctggccttcatcgacgagagcagcgacacccagagcgagagaggctgccccctgcccagagcccccagaggcagaagaagacccaacccccccagaaagcccgtgagacccagaggccccggcagacccagagacaagggcgtgcccgtgtag

SEQ ID NO: 93997 - DNA, 1368 bp, Artificial Sequence
  Description of Artificial Sequence: Synthetic coding sequence
gtgcacgccagcgtgcacaccagagtgagaggcctgtgggtgccctggagaggcagacacgcccacggcggcagaggctgcagaggcgtgtgcggcgagtgcagatgggtgaccaccgccccccaggagccccccgccagacccctgcaggccggcagcggcgccggccccgcccccggcagagccatgagaagcaccaccctgctggccctgctggccctggtgctgctgtacctggtgagcggcgccctggtgttcagagccctggagcagccccacgagcagcaggcccagagagagctgggcgaggtgagagagaagttcctgagagcccacccctgcgtgagcgaccaggagctgggcctgctgatcaaggaggtggccgacgccctgggcggcggcgccgaccccgagaccaacagcaccagcaacagcagccacagcgcctgggacctgggcagcgccttcttcttcagcggcaccatcatcaccaccatcggctacggcaacgtggccctgagaaccgacgccggcagactgttctgcatcttctacgccctggtgggcatccccctgttcggcatcctgctggccggcgtgggcgacagactgggcagcagcctgagacacggcatcggccacatcgaggccatcttcctgaagtggcacgtgccccccgagctggtgagagtgctgagcgccatgctgttcctgctgatcggctgcctgctgttcgtgctgacccccaccttcgtgttctgctacatggaggactggagcaagctggaggccatctacttcgtgatcgtgaccctgaccaccgtgggcttcggcgactacgtggccggcgccgaccccagacaggacagccccgcctaccagcccctggtgtggttctggatcctgctgggcctggcctacttcgccagcgtgctgaccaccatcggcaactggctgagagtggtgagcagaagaaccagagccgagatgggcggcctgaccgcccaggccgccagctggaccggcaccgtgaccgccagagtgacccagagagccggccccgccgcccccccccccgagaaggagcagcccctgctgcccccccccccctgccccgcccagcccctgggcagacccagaagccccagcccccccgagaaggcccagccccccagcccccccaccgccagcgccctggactaccccagcgagaacctggccttcatcgacgagagcagcgacacccagagcgagagaggctgccccctgcccagagcccccagaggcagaagaagacccaacccccccagaaagcccgtgagacccagaggccccggcagacccagagacaagggcgtgcccgtgtag

SEQ ID NO: 93998 - DNA, 1500 bp, Artificial Sequence
  Description of Artificial Sequence: Synthetic coding sequence
atggtggacagaggccccctgctgaccagcgccatcatcttctacctggccatcggcgccgccatcttcgaggtgctggaggagccccactggaaggaggccaagaagaactactacacccagaagctgcacctgctgaaggagttcccctgcctgggccaggagggcctggacaagatcctggaggtggtgagcgacgccgccggccagggcgtggccatcaccggcaaccagaccttcaacaactggaactggcccaacgccatgatcttcgccgccaccgtgatcaccaccatcggctacggcaacgtggcccccaagacccccgccggcagactgttctgcgtgttctacggcctgttcggcgtgcccctgtgcctgacctggatcagcgccctgggcaagttcttcggcggcagagccaagagactgggccagttcctgaccaagagaggcgtgagcctgagaaaggcccagatcacctgcaccgtgatcttcatcgtgtggggcgtgctggtgcacctggtgatcccccccttcgtgttcatggtgaccgagggctggaactacatcgagggcctgtactacagcttcatcaccatcagcaccatcggcttcggcgacttcgtggccggcgtgaaccccagcgccaactaccacgccctgtacagatacttcgtggagctgtggatctacctgggcctggcctggctgagcctgttcgtgaactggaaggtgagcatgttcgtggaggtgcacaaggccatcaagaagagaagaagaagaagaaaggagagcttcgagagcagcccccacagcagaaaggccctgcaggtgaagggcagcaccgccagcaaggacgtgaacatcttcagcttcctgagcaagaaggaggagacctacaacgacctgatcaagcagatcggcaagaaggccatgaagaccagcggcggcggcgagaccggccccggccccggcctgggcccccagggcggcggcctgcccgccctgccccccagcctggtgcccctggtggtgtacagcaagaacagagtgcccaccctggaggaggtgagccagaccctgagaagcaagggccacgtgagcagaagccccgacgaggaggccgtggccagagcccccgaggacagcagccccgcccccgaggtgttcatgaaccagctggacagaatcagcgaggagtgcgagccctgggacgcccaggactaccaccccctgatcttccaggacgccagcatcaccttcgtgaacaccgaggccggcctgagcgacgaggagaccagcaagagcagcctggaggacaacctggccggcgaggagagcccccagcagggcgccgaggccaaggcccccctgaacatgggcgagttccccagcagcagcgagagcaccttcaccagcaccgagagcgagctgagcgtgccctacgagcagctgatgaacgagtacaacaaggccaacagccccaagggcacctag

SEQ ID NO: 93999 - DNA, 942 bp, Artificial Sequence
  Description of Artificial Sequence: Synthetic coding sequence
atgagaagaggcgccctgctggccggcgccctggccgcctacgccgcctacctggtgctgggcgccctgctggtggccagactggagggcccccacgaggccagactgagagccgagctggagaccctgagagcccagctgctgcagagaagcccctgcgtggccgcccccgccctggacgccttcgtggagagagtgctggccgccggcagactgggcagagtggtgctggccaacgccagcggcagcgccaacgccagcgaccccgcctgggacttcgccagcgccctgttcttcgccagcaccctgatcaccaccgtgggctacggctacaccacccccctgaccgacgccggcaaggccttcagcatcgccttcgccctgctgggcgtgcccaccaccatgctgctgctgaccgccagcgcccagagactgagcctgctgctgacccacgtgcccctgagctggctgagcatgagatggggctgggaccccagaagagccgcctgctggcacctggtggccctgctgggcgtggtggtgaccgtgtgcttcctggtgcccgccgtgatcttcgcccacctggaggaggcctggagcttcctggacgccttctacttctgcttcatcagcctgagcaccatcggcctgggcgactacgtgcccggcgaggcccccggccagccctacagagccctgtacaaggtgctggtgaccgtgtacctgttcctgggcctggtggccatggtgctggtgctgcagaccttcagacacgtgagcgacctgcacggcctgaccgagctgatcctgctgccccccccctgccccgccagcttcaacgccgacgaggacgacagagtggacatcctgggcccccagcccgagagccaccagcagctgagcgccagcagccacaccgactacgccagcatccccagatag

SEQ ID NO: 94000 - DNA, 924 bp, Artificial Sequence
  Description of Artificial Sequence: Synthetic coding sequence
atgggcggcctgagaccctggagcagatacggcctgctggtggtggcccacctgctggccctgggcctgggcgccgtggtgttccaggccctggagggcccccccgcctgcagactgcaggccgagctgagagccgagctggccgccttccaggccgagcacagagcctgcctgccccccggcgccctggaggagctgctgggcaccgccctggccacccaggcccacggcgtgagcaccctgggcaacagcagcgagggcagaacctgggacctgcccagcgccctgctgttcgccgccagcatcctgaccaccaccggctacggccacatggcccccctgagccccggcggcaaggccttctgcatggtgtacgccgccctgggcctgcccgccagcctggccctggtggccaccctgagacactgcctgctgcccgtgctgagcagacccagagcctgggtggccgtgcactggcagctgagccccgccagagccgccctgctgcaggccgtggccctgggcctgctggtggccagcagcttcgtgctgctgcccgccctggtgctgtggggcctgcagggcgactgcagcctgctgggcgccgtgtacttctgcttcagcagcctgagcaccatcggcctggaggacctgctgcccggcagaggcagaagcctgcaccccgtgatctaccacctgggccagctggccctgctgggctacctgctgctgggcctgctggccatgctgctggccgtggagaccttcagcgagctgccccaggtgagagccatgggcaagttcttcagacccagcggccccgtgaccgccgaggaccagggcggcatcctgggccaggacgagctggccctgagcaccctgccccccgccgcccccgccagcggccaggcccccgcctgctag

SEQ ID NO: 94001 - DNA, 759 bp, Artificial Sequence
  Description of Artificial Sequence: Synthetic coding sequence
atgggcggcctgagaccctggagcagatacggcctgctggtggtggcccacctgctggccctgggcctgggcgccgtggtgttccaggccctggagggcccccccgcctgcagactgcaggccgagctgagagccgagctggccgccttccaggccgagcacagagcctgcctgccccccggcgccctggaggagctgctgggcaccgccctggccacccaggcccacggcgtgagcaccctgggcaacagcagcgagggcagaacctgggacctgcccagcgccctgctgttcgccgccagcatcctgaccaccaccggctacggccacatggcccccctgagccccggcggcaaggccttctgcatggtgtacgccgccctgggcctgcccgccagcctggccctggtggccaccctgagacactgcctgctgcccgtgctgagcagacccagagcctgggtggccgtgcactggcagctgagccccgccagagccgccctgctgcaggccgtggccctgggcctgctggtggccagcagcttcgtgctgctgcccgccctggtgctgtggggcctgcagggcgactgcagcctgctgggcgccgtgtacttctgcttcagcagcctgagcaccatcggcctggaggacctgctgcccggcagaggcagaagcctgcaccccgtgatctaccacctgggccagctggccctgctgggcggcggcaccagcctgcagggcaccgcctgggagggctag

SEQ ID NO: 94002 - DNA, 774 bp, Artificial Sequence
  Description of Artificial Sequence: Synthetic coding sequence
atgggcggcctgagaccctggagcagatacggcctgctggtggtggcccacctgctggccctgggcctgggcgccgtggtgttccaggccctggagggcccccccgcctgcagactgcaggccgagctgagagccgagctggccgccttccaggccgagcacagagcctgcctgccccccggcgccctggaggagctgctgggcaccgccctggccacccaggcccacggcgtgagcaccctgggcaacagcagcgagggcagaacctgggacctgcccagcgccctgctgttcgccgccagcatcctgaccaccaccggctacggccacatggcccccctgagccccggcggcaaggccttctgcatggtgtacgccgccctgggcctgcccgccagcctggccctggtggccaccctgagacactgcctgctgcccgtgctgagcagacccagagcctgggtggccgtgcactggcagctgagccccgccagagccgccctgctgcaggccgtggccctgggcctgctggtggccagcagcttcgtgctgctgcccgccctggtgctgtggggcctgcagggcgactgcagcctgctgggcgccgtgtacttctgcttcagcagcctgagcaccatcggcctggaggacctgctgcccggcagaggcagaagcctgcaccccgtgatctaccacctgggccagctggccctgctgggcaagagcagccacctgaccgcctgcggcggcagaggcaagagaagcctggactag

SEQ ID NO: 94003 - DNA, 759 bp, Artificial Sequence; identical to SEQ ID NO: 94001
  Description of Artificial Sequence: Synthetic coding sequence

SEQ ID NO: 94004 - DNA, 87 bp, Artificial Sequence
  Description of Artificial Sequence: Synthetic coding sequence
tgactgcaccccgtgatctaccacctgggccagctggccctgctgggcggcggcaccagcctgcagggcaccgcctgggagggctag

SEQ ID NO: 94005 - DNA, 1125 bp, Artificial Sequence
  Description of Artificial Sequence: Synthetic coding sequence
atgaagagacagaacgtgagaaccctgagcctgatcgtgtgcaccttcacctacctgctggtgggcgccgccgtgttcgacgccctggagagcgaccacgagatgagagaggaggagaagctgaaggccgaggagatcagaatcaagggcaagtacaacatcagcagcgaggactacagacagctggagctggtgatcctgcagagcgagccccacagagccggcgtgcagtggaagttcgccggcagcttctacttcgccatcaccgtgatcaccaccatcggctacggccacgccgcccccggcaccgacgccggcaaggccttctgcatgttctacgccgtgctgggcatccccctgaccctggtgatgttccagagcctgggcgagagaatgaacaccttcgtgagatacctgctgaagagaatcaagaagtgctgcggcatgagaaacaccgacgtgagcatggagaacatggtgaccgtgggcttcttcagctgcatgggcaccctgtgcatcggcgccgccgccttcagccagtgcgaggagtggagcttcttccacgcctactactactgcttcatcaccctgaccaccatcggcttcggcgactacgtggccctgcagaccaagggcgccctgcagaagaagcccctgtacgtggccttcagcttcatgtacatcctggtgggcctgaccgtgatcggcgccttcctgaacctggtggtgctgagattcctgaccatgaacagcgaggacgagagaagagacgccgaggagagagccagcctggccggcaacagaaacagcatggtgatccacatccccgaggagcccagacccagcagacccagatacaaggccgacgtgcccgacctgcagagcgtgtgcagctgcacctgctacagaagccaggactacggcggcagaagcgtggccccccagaacagcttcagcgccaagctggccccccactacttccacagcatcagctacaagatcgaggagatcagccccagcaccctgaagaacagcctgttccccagccccatcagcagcatcagccccggcctgcacagcttcaccgaccaccagagactgatgaagagaagaaagagcgtgtag

SEQ ID NO: 94006 - DNA, 1125 bp, Artificial Sequence; identical to SEQ ID NO: 94005
  Description of Artificial Sequence: Synthetic coding sequence

SEQ ID NO: 94007 - DNA, 1125 bp, Artificial Sequence; identical to SEQ ID NO: 94005
  Description of Artificial Sequence: Synthetic coding sequence

SEQ ID NO: 94008 - DNA, 3693 bp, Artificial Sequence
  Description of Artificial Sequence: Synthetic coding sequence
atggccagagccaagctgcccagaagccccagcgagggcaaggccggccccggcggcgcccccgccggcgccgccgcccccgaggagccccacggcctgagccccctgctgcccgccagaggcggcggcagcgtgggcagcgacgtgggccagagactgcccgtggaggacttcagcctggacagcagcctgagccaggtgcaggtggagttctacgtgaacgagaacaccttcaaggagagactgaagctgttcttcatcaagaaccagagaagcagcctgagaatcagactgttcaacttcagcctgaagctgctgacctgcctgctgtacatcgtgagagtgctgctggacgaccccgccctgggcatcggctgctggggctgccccaagcagaactacagcttcaacgacagcagcagcgagatcaactgggcccccatcctgtgggtggagagaaagatgaccctgtgggccatccaggtgatcgtggccatcatcagcttcctggagaccatgctgctgatctacctgagctacaagggcaacatctgggagcagatcttcagagtgagcttcgtgctggagatgatcaacaccctgcccttcatcatcaccatcttctggccccccctgagaaacctgttcatccccgtgttcctgaactgctggctggccaagcacgccctggagaacatgatcaacgacttccacagagccatcctgagaacccagagcgccatgttcaaccaggtgctgatcctgttctgcaccctgctgtgcctggtgttcaccggcacctgcggcatccagcacctggagagagccggcgagaacctgagcctgctgaccagcttctacttctgcatcgtgaccttcagcaccgtgggctacggcgacgtgacccccaagatctggcccagccagctgctggtggtgatcatgatctgcgtggccctggtggtgctgcccctgcagttcgaggagctggtgtacctgtggatggagagacagaagagcggcggcaactacagcagacacagagcccagaccgagaagcacgtggtgctgtgcgtgagcagcctgaagatcgacctgctgatggacttcctgaacgagttctacgcccaccccagactgcaggactactacgtggtgatcctgtgccccaccgagatggacgtgcaggtgagaagagtgctgcagatccccctgtggagccagagagtgatctacctgcagggcagcgccctgaaggaccaggacctgatgagagccaagatggacaacggcgaggcctgcttcatcctgagcagcagaaacgaggtggacagaaccgccgccgaccaccagaccatcctgagagcctgggccgtgaaggacttcgcccccaactgccccctgtacgtgcagatcctgaagcccgagaacaagttccacgtgaagttcgccgaccacgtggtgtgcgaggaggagtgcaagtacgccatgctggccctgaactgcatctgccccgccaccagcaccctgatcaccctgctggtgcacaccagcagaggccaggagggccaggagagccccgagcagtggcagagaatgtacggcagatgcagcggcaacgaggtgtaccacatcagaatgggcgacagcaagttcttcagagagtacgagggcaagagcttcacctacgccgccttccacgcccacaagaagtacggcgtgtgcctgatcggcctgaagagagaggacaacaagagcatcctgctgaaccccggccccagacacatcctggccgccagcgacacctgcttctacatcaacatcaccaaggaggagaacagcgccttcatcttcaagcaggaggagaagagaaagaagagagccttcagcggccagggcctgcacgagggccccgccagactgcccgtgcacagcatcatcgccagcatgggcaccgtggccatggacctgcagggcaccgagcacagacccacccagagcggcggcggcggcggcggcagcaagctggccctgcccaccgagaacggcagcggcagcagaagacccagcatcgcccccgtgctggagctggccgacagcagcgccctgctgccctgcgacctgctgagcgaccagagcgaggacgaggtgacccccagcgacgacgagggcctgagcgtggtggagtacgtgaagggctacccccccaacagcccctacatcggcagcagccccaccctgtgccacctgctgcccgtgaaggcccccttctgctgcctgagactggacaagggctgcaagcacaacagctacgaggacgccaaggcctacggcttcaagaacaagctgatcatcgtgagcgccgagaccgccggcaacggcctgtacaacttcatcgtgcccctgagagcctactacagaagcagaaaggagctgaaccccatcgtgctgctgctggacaacaagcccgaccaccacttcctggaggccatctgctgcttccccatggtgtactacatggagggcagcgtggacaacctggacagcctgctgcagtgcggcatcatctacgccgacaacctggtggtggtggacaaggagagcaccatgagcgccgaggaggactacatggccgacgccaagaccatcgtgaacgtgcagaccatgttcagactgttccccagcctgagcatcaccaccgagctgacccaccccagcaacatgagattcatgcagttcagagccaaggacagctacagcctggccctgagcaagctggagaagagagagagagagaacggcagcaacctggccttcatgttcagactgcccttcgccgccggcagagtgttcagcatcagcatgctggacaccctgctgtaccagagcttcgtgaaggactacatgatcaccatcaccagactgctgctgggcctggacaccacccccggcagcggctacctgtgcgccatgaagatcaccgagggcgacctgtggatcagaacctacggcagactgttccagaagctgtgcagcagcagcgccgagatccccatcggcatctacagaaccgagagccacgtgttcagcaccagcgagagccagatcagcgtgaacgtggaggactgcgaggacaccagagaggtgaagggcccctggggcagcagagccggcaccggcggcagcagccagggcagacacaccggcggcggcgaccccgccgagcaccccctgctgagaagaaagagcctgcagtgggccagaagactgagcagaaaggcccccaagcaggccggcagagccgccgccgccgagtggatcagccagcagagactgagcctgtacagaagaagcgagagacaggagctgagcgagctggtgaagaacagaatgaagcacctgggcctgcccaccaccggctacgaggacgtggccaacctgaccgccagcgacgtgatgaacagagtgaacctgggctacctgcaggacgagatgaacgaccaccagaacaccctgagctacgtgctgatcaaccccccccccgacaccagactggagcccagcgacatcgtgtacctgatcagaagcgaccccctggcccacgtggccagcagcagccagagcagaaagagcagctgcagccacaagctgagcagctgcaaccccgagaccagagacgagacccagctgtag

SEQ ID NO: 94009 - DNA, 3771 bp, Artificial Sequence
  Description of Artificial Sequence: Synthetic coding sequence
atgcccctgcccgacggcgccagaacccccggcggcgtgtgcagagaggccagaggcggcggctacaccaacagaaccttcgagttcgacgacggccagtgcgcccccagaagaccctgcgccggcgacggcgccctgctggacaccgccggcttcaagatgagcgacctggacagcgaggtgctgcccctgccccccagatacagattcagagacctgctgctgggcgaccccagcttccagaacgacgacagagtgcaggtggagttctacgtgaacgagaacaccttcaaggagagactgaagctgttcttcatcaagaaccagagaagcagcctgagaatcagactgttcaacttcagcctgaagctgctgacctgcctgctgtacatcgtgagagtgctgctggacgaccccgccctgggcatcggctgctggggctgccccaagcagaactacagcttcaacgacagcagcagcgagatcaactgggcccccatcctgtgggtggagagaaagatgaccctgtgggccatccaggtgatcgtggccatcatcagcttcctggagaccatgctgctgatctacctgagctacaagggcaacatctgggagcagatcttcagagtgagcttcgtgctggagatgatcaacaccctgcccttcatcatcaccatcttctggccccccctgagaaacctgttcatccccgtgttcctgaactgctggctggccaagcacgccctggagaacatgatcaacgacttccacagagccatcctgagaacccagagcgccatgttcaaccaggtgctgatcctgttctgcaccctgctgtgcctggtgttcaccggcacctgcggcatccagcacctggagagagccggcgagaacctgagcctgctgaccagcttctacttctgcatcgtgaccttcagcaccgtgggctacggcgacgtgacccccaagatctggcccagccagctgctggtggtgatcatgatctgcgtggccctggtggtgctgcccctgcagttcgaggagctggtgtacctgtggatggagagacagaagagcggcggcaactacagcagacacagagcccagaccgagaagcacgtggtgctgtgcgtgagcagcctgaagatcgacctgctgatggacttcctgaacgagttctacgcccaccccagactgcaggactactacgtggtgatcctgtgccccaccgagatggacgtgcaggtgagaagagtgctgcagatccccctgtggagccagagagtgatctacctgcagggcagcgccctgaaggaccaggacctgatgagagccaagatggacaacggcgaggcctgcttcatcctgagcagcagaaacgaggtggacagaaccgccgccgaccaccagaccatcctgagagcctgggccgtgaaggacttcgcccccaactgccccctgtacgtgcagatcctgaagcccgagaacaagttccacgtgaagttcgccgaccacgtggtgtgcgaggaggagtgcaagtacgccatgctggccctgaactgcatctgccccgccaccagcaccctgatcaccctgctggtgcacaccagcagaggccaggagggccaggagagccccgagcagtggcagagaatgtacggcagatgcagcggcaacgaggtgtaccacatcagaatgggcgacagcaagttcttcagagagtacgagggcaagagcttcacctacgccgccttccacgcccacaagaagtacggcgtgtgcctgatcggcctgaagagagaggacaacaagagcatcctgctgaaccccggccccagacacatcctggccgccagcgacacctgcttctacatcaacatcaccaaggaggagaacagcgccttcatcttcaagcaggaggagaagagaaagaagagagccttcagcggccagggcctgcacgagggccccgccagactgcccgtgcacagcatcatcgccagcatgggcaccgtggccatggacctgcagggcaccgagcacagacccacccagagcggcggcggcggcggcggcagcaagctggccctgcccaccgagaacggcagcggcagcagaagacccagcatcgcccccgtgctggagctggccgacagcagcgccctgctgccctgcgacctgctgagcgaccagagcgaggacgaggtgacccccagcgacgacgagggcctgagcgtggtggagtacgtgaagggctacccccccaacagcccctacatcggcagcagccccaccctgtgccacctgctgcccgtgaaggcccccttctgctgcctgagactggacaagggctgcaagcacaacagctacgaggacgccaaggcctacggcttcaagaacaagctgatcatcgtgagcgccgagaccgccggcaacggcctgtacaacttcatcgtgcccctgagagcctactacagaagcagaaaggagctgaaccccatcgtgctgctgctggacaacaagcccgaccaccacttcctggaggccatctgctgcttccccatggtgtactacatggagggcagcgtggacaacctggacagcctgctgcagtgcggcatcatctacgccgacaacctggtggtggtggacaaggagagcaccatgagcgccgaggaggactacatggccgacgccaagaccatcgtgaacgtgcagaccatgttcagactgttccccagcctgagcatcaccaccgagctgacccaccccagcaacatgagattcatgcagttcagagccaaggacagctacagcctggccctgagcaagctggagaagagagagagagagaacggcagcaacctggccttcatgttcagactgcccttcgccgccggcagagtgttcagcatcagcatgctggacaccctgctgtaccagagcttcgtgaaggactacatgatcaccatcaccagactgctgctgggcctggacaccacccccggcagcggctacctgtgcgccatgaagatcaccgagggcgacctgtggatcagaacctacggcagactgttccagaagctgtgcagcagcagcgccgagatccccatcggcatctacagaaccgagagccacgtgttcagcaccagcgagccccacgacctgagagcccagagccagatcagcgtgaacgtggaggactgcgaggacaccagagaggtgaagggcccctggggcagcagagccggcaccggcggcagcagccagggcagacacaccggcggcggcgaccccgccgagcaccccctgctgagaagaaagagcctgcagtgggccagaagactgagcagaaaggcccccaagcaggccggcagagccgccgccgccgagtggatcagccagcagagactgagcctgtacagaagaagcgagagacaggagctgagcgagctggtgaagaacagaatgaagcacctgggcctgcccaccaccggctacgaggacgtggccaacctgaccgccagcgacgtgatgaacagagtgaacctgggctacctgcaggacgagatgaacgaccaccagaacaccctgagctacgtgctgatcaaccccccccccgacaccagactggagcccagcgacatcgtgtacctgatcagaagcgaccccctggcccacgtggccagcagcagccagagcagaaagagcagctgcagccacaagctgagcagctgcaaccccgagaccagagacgagacccagctgtag

SEQ ID NO: 94010 - DNA, 3708 bp, Artificial Sequence
  Description of Artificial Sequence: Synthetic coding sequence
atgcccctgcccgacggcgccagaacccccggcggcgtgtgcagagaggccagaggcggcggctacaccaacagaaccttcgagttcgacgacggccagtgcgcccccagaagaccctgcgccggcgacggcgccctgctggacaccgccggcttcaagatgagcgacctggacagcgaggtgctgcccctgccccccagatacagattcagagacctgctgctgggcgaccccagcttccagaacgacgacagagtgcaggtggagttctacgtgaacgagaacaccttcaaggagagactgaagctgttcttcatcaagaaccagagaagcagcctgagaatcagactgttcaacttcagcctgaagctgctgacctgcctgctgtacatcgtgagagtgctgctggacgaccccgccctgggcatcggctgctggggctgccccaagcagaactacagcttcaacgacagcagcagcgagatcaactgggcccccatcctgtgggtggagagaaagatgaccctgtgggccatccaggtgatcgtggccatcatcagcttcctggagaccatgctgctgatctacctgagctacaagggcaacatctgggagcagatcttcagagtgagcttcgtgctggagatgatcaacaccctgcccttcatcatcaccatcttctggccccccctgagaaacctgttcatccccgtgttcctgaactgctggctggccaagcacgccctggagaacatgatcaacgacttccacagagccatcctgagaacccagagcgccatgttcaaccaggtgctgatcctgttctgcaccctgctgtgcctggtgttcaccggcacctgcggcatccagcacctggagagagccggcgagaacctgagcctgctgaccagcttctacttctgcatcgtgaccttcagcaccgtgggctacggcgacgtgacccccaagatctggcccagccagctgctggtggtgatcatgatctgcgtggccctggtggtgctgcccctgcagttcgaggagctggtgtacctgtggatggagagacagaagagcggcggcaactacagcagacacagagcccagaccgagaagcacgtggtgctgtgcgtgagcagcctgaagatcgacctgctgatggacttcctgaacgagttctacgcccaccccagactgcaggactactacgtggtgatcctgtgccccaccgagatggacgtgcaggtgagaagagtgctgcagatccccctgtggagccagagagtgatctacctgcagggcagcgccctgaaggaccaggacctgatgagagccaagatggacaacggcgaggcctgcttcatcctgagcagcagaaacgaggtggacagaaccgccgccgaccaccagaccatcctgagagcctgggccgtgaaggacttcgcccccaactgccccctgtacgtgcagatcctgaagcccgagaacaagttccacgtgaagttcgccgaccacgtggtgtgcgaggaggagtgcaagtacgccatgctggccctgaactgcatctgccccgccaccagcaccctgatcaccctgctggtgcacaccagcagaggccaggagggccaggagagccccgagcagtggcagagaatgtacggcagatgcagcggcaacgaggtgtaccacatcagaatgggcgacagcaagttcttcagagagtacgagggcaagagcttcacctacgccgccttccacgcccacaagaagtacggcgtgtgcctgatcggcctgaagagagaggacaacaagagcatcctgctgaaccccggccccagacacatcctggccgccagcgacacctgcttctacatcaacatcaccaaggaggagaacagcgccttcatcttcaagcaggaggagaagagaaagaagagagccttcagcggccagggcctgcacgagggccccgccagactgcccgtgcacagcatcatcgccagcatgggcaccgtggccatggacctgcagggcaccgagcacagacccacccagagcggcggcggcggcggcggcagcaagctggccctgcccaccgagaacggcagcggcagcagaagacccagcatcgcccccgtgctggagctggccgacagcagcgccctgctgccctgcgacctgctgagcgaccagagcgaggacgaggtgacccccagcgacgacgagggcctgagcgtggtggagtacgtgaagggctacccccccaacagcccctacatcggcagcagccccaccctgtgccacctgctgcccgtgaaggcccccttctgctgcctgagactggacaagggctgcaagcacaacagctacgaggacgccaaggcctacggcttcaagaacaagctgatcatcgtgagcgccgagaccgccggcaacggcctgtacaacttcatcgtgcccctgagagcctactacagaagcagaaaggagctgaaccccatcgtgctgctgctggacaacaagcccgaccaccacttcctggaggccatctgctgcttccccatggtgtactacatggagggcagcgtggacaacctggacagcctgctgcagtgcggcatcatctacgccgacaacctggtggtggtggacaaggagagcaccatgagcgccgaggaggactacatggccgacgccaagaccatcgtgaacgtgcagaccatgttcagactgttccccagcctgagcatcaccaccgagctgacccaccccagcaacatgagattcatgcagttcagagccaaggacagctacagcctggccctgagcaagctggagaagagagagagagagaacggcagcaacctggccttcatgttcagactgcccttcgccgccggcagagtgttcagcatcagcatgctggacaccctgctgtaccagagcttcgtgaaggactacatgatcaccatcaccagactgctgctgggcctggacaccacccccggcagcggctacctgtgcgccatgaagatcaccgagggcgacctgtggatcagaacctacggcagactgttccagaagctgtgcagcagcagcgccgagatccccatcggcatctacagaaccgagagccacgtgttcagcaccagcgagccccacgacctgagagcccagagccagatcagcgtgaacgtggaggactgcgaggacaccagagaggtgaagggcccctggggcagcagagccggcaccggcggcagcagccagggcagacacaccggcggcggcgaccccgccgagcaccccctgctgagaagaaagagcctgcagtgggccagaagactgagcagaaaggcccccaagcaggccggcagagccgccgccgccgagtggatcagccagcagagactgagcctgtacagaagaagcgagagacaggagctgagcgagctggtgaagaacagaatgaagcacctgggcctgcccaccaccggctacgacgagatgaacgaccaccagaacaccctgagctacgtgctgatcaaccccccccccgacaccagactggagcccagcgacatcgtgtacctgatcagaagcgaccccctggcccacgtggccagcagcagccagagcagaaagagcagctgcagccacaagctgagcagctgcaaccccgagaccagagacgagacccagctgtag

SEQ ID NO: 94011 - DNA, 3408 bp, Artificial Sequence
  Description of Artificial Sequence: Synthetic coding sequence
atggtggacctggagagcgaggtgccccccctgccccccagatacagattcagagacctgctgctgggcgaccagggctggcagaacgacgacagagtgcaggtggagttctacatgaacgagaacaccttcaaggagagactgaagctgttcttcatcaagaaccagagaagcagcctgagaatcagactgttcaacttcagcctgaagctgctgagctgcctgctgtacatcatcagagtgctgctggagaaccccagccagggcaacgagtggagccacatcttctgggtgaacagaagcctgcccctgtggggcctgcaggtgagcgtggccctgatcagcctgttcgagaccatcctgctgggctacctgagctacaagggcaacatctgggagcagatcctgagaatccccttcatcctggagatcatcaacgccgtgcccttcatcatcagcatcttctggcccagcctgagaaacctgttcgtgcccgtgttcctgaactgctggctggccaagcacgccctggagaacatgatcaacgacctgcacagagccatccagagaacccagagcgccatgttcaaccaggtgctgatcctgatcagcaccctgctgtgcctgatcttcacctgcatctgcggcatccagcacctggagagaatcggcaagaagctgaacctgttcgacagcctgtacttctgcatcgtgaccttcagcaccgtgggcttcggcgacgtgacccccgagacctggagcagcaagctgttcgtggtggccatgatctgcgtggccctggtggtgctgcccatccagttcgagcagctggcctacctgtggatggagagacagaagagcggcggcaactacagcagacacagagcccagaccgagaagcacgtggtgctgtgcgtgagcagcctgaagatcgacctgctgatggacttcctgaacgagttctacgcccaccccagactgcaggactactacgtggtgatcctgtgccccaccgagatggacgtgcaggtgagaagagtgctgcagatccccatgtggagccagagagtgatctacctgcagggcagcgccctgaaggaccaggacctgctgagagccaagatggacgacgccgaggcctgcttcatcctgagcagcagatgcgaggtggacagaaccagcagcgaccaccagaccatcctgagagcctgggccgtgaaggacttcgcccccaactgccccctgtacgtgcagatcctgaagcccgagaacaagttccacatcaagttcgccgaccacgtggtgtgcgaggaggagttcaagtacgccatgctggccctgaactgcatctgccccgccaccagcaccctgatcaccctgctggtgcacaccagcagaggccaggagggccagcagagccccgagcagtggcagaagatgtacggcagatgcagcggcaacgaggtgtaccacatcgtgctggaggagagcaccttcttcgccgagtacgagggcaagagcttcacctacgccagcttccacgcccacaagaagttcggcgtgtgcctgatcggcgtgagaagagaggacaacaagaacatcctgctgaaccccggccccagatacatcatgaacagcaccgacatctgcttctacatcaacatcaccaaggaggagaacagcgccttcaagaaccaggaccagcagagaaagagcaacgtgagcagaagcttctaccacggccccagcagactgcccgtgcacagcatcatcgccagcatgggcaccgtggccatcgacctgcaggacaccagctgcagaagcgccagcggccccaccctgagcctgcccaccgagggcagcaaggagatcagaagacccagcatcgcccccgtgctggaggtggccgacaccagcagcatccagacctgcgacctgctgagcgaccagagcgaggacgagaccacccccgacgaggagatgagcagcaacctggagtacgccaagggctaccccccctacagcccctacatcggcagcagccccaccttctgccacctgctgcacgagaaggtgcccttctgctgcctgagactggacaagagctgccagcacaactactacgaggacgccaaggcctacggcttcaagaacaagctgatcatcgtggccgccgagaccgccggcaacggcctgtacaacttcatcgtgcccctgagagcctactacagacccaagaaggagctgaaccccatcgtgctgctgctggacaacccccccgacatgcacttcctggacgccatctgctggttccccatggtgtactacatggtgggcagcatcgacaacctggacgacctgctgagatgcggcgtgaccttcgccgccaacatggtggtggtggacaaggagagcaccatgagcgccgaggaggactacatggccgacgccaagaccatcgtgaacgtgcagaccctgttcagactgttcagcagcctgagcatcatcaccgagctgacccaccccgccaacatgagattcatgcagttcagagccaaggactgctacagcctggccctgagcaagctggagaagaaggagagagagagaggcagcaacctggccttcatgttcagactgcccttcgccgccggcagagtgttcagcatcagcatgctggacaccctgctgtaccagagcttcgtgaaggactacatgatcagcatcaccagactgctgctgggcctggacaccacccccggcagcggcttcctgtgcagcatgaagatcaccgccgacgacctgtggatcagaacctacgccagactgtaccagaagctgtgcagcagcaccggcgacgtgcccatcggcatctacagaaccgagagccagaagctgaccaccagcgagagccagatcagcatcagcgtggaggagtgggaggacaccaaggacagcaaggagcagggccaccacagaagcaaccacagaaacagcaccagcagcgaccagagcgaccaccccctgctgagaagaaagagcatgcagtgggccagaagactgagcagaaagggccccaagcacagcggcaagaccgccgagaagatcacccagcagagactgaacctgtacagaagaagcgagagacaggagctggccgagctggtgaagaacagaatgaagcacctgggcctgagcaccgtgggctacgacgagatgaacgaccaccagagcaccctgagctacatcctgatcaaccccagccccgacaccagaatcgagctgaacgacgtggtgtacctgatcagacccgaccccctggcctacctgcccaacagcgagcccagcagaagaaacagcatctgcaacgtgaccggccaggacagcagagaggagacccagctgtag

SEQ ID NO: 94012 - DNA, 3210 bp, Artificial Sequence
  Description of Artificial Sequence: Synthetic coding sequence
atggtggacctggagagcgaggtgccccccctgccccccagatacagattcagagacctgctgctgggcgaccagggctggcagaacgacgacagagtgcaggtggagttctacatgaacgagaacaccttcaaggagagactgaagctgttcttcatcaagaaccagagaagcagcctgagaatcagactgttcaacttcagcctgaagctgctgagctgcctgctgtacatcatcagagtgctgctggagaaccccagccagggcaacgagtggagccacatcttctgggtgaacagaagcctgcccctgtggggcctgcaggtgagcgtggccctgatcagcctgttcgagaccatcctgctgggctacctgagctacaagggcaacatctgggagcagatcctgagaatccccttcatcctggagatcatcaacgccgtgcccttcatcatcagcatcttctggcccagcctgagaaacctgttcgtgcccgtgttcctgaactgctggctggccaagcacgccctggagaacatgatcaacgacctgcacagagccatccagagaacccagagcgccatgttcaaccaggtgctgatcctgatcagcaccctgctgtgcctgatcttcacctgcatctgcggcatccagcacctggagagaatcggcaagaagctgaacctgttcgacagcctgtacttctgcatcgtgaccttcagcaccgtgggcttcggcgacgtgacccccgagacctggagcagcaagctgttcgtggtggccatgatctgcgtggccctggtggtgctgcccatccagttcgagcagctggcctacctgtggatggagagacagaagagcggcggcaactacagcagacacagagcccagaccgagaagcacgtggtgctgtgcgtgagcagcctgaagatcgacctgctgatggacttcctgaacgagttctacgcccaccccagactgcaggactactacgtggtgatcctgtgccccaccgagatggacgtgcaggtgagaagagtgctgcagatccccatgtggagccagagagtgatctacctgcagggcagcgccctgaaggaccaggacctgctgagagccaagatggacgacgccgaggcctgcttcatcctgagcagcagatgcgaggtggacagaaccagcagcgaccaccagaccatcctgagagcctgggccgtgaaggacttcgcccccaactgccccctgtacgtgcagatcctgaagcccgagaacaagttccacatcaagttcgccgaccacgtggtgtgcgaggaggagttcaagtacgccatgctggccctgaactgcatctgccccgccaccagcaccctgatcaccctgctggtgcacaccagcagaggccagttcggcgtgtgcctgatcggcgtgagaagagaggacaacaagaacatcctgctgaaccccggccccagatacatcatgaacagcaccgacatctgcttctacatcaacatcaccaaggaggagaacagcgccttcaagaaccaggaccagcagagaaagagcaacgtgagcagaagcttctaccacggccccagcagactgcccgtgcacagcatcatcgccagcatgggcaccgtggccatcgacctgcaggacaccagctgcagaagcgccagcggccccaccctgagcctgcccaccgagggcagcaaggagatcagaagacccagcatcgcccccgtgctggaggtggccgacaccagcagcatccagacctgcgacctgctgagcgaccagagcgaggacgagaccacccccgacgaggagatgagcagcaacctggagtacgccaagggctaccccccctacagcccctacatcggcagcagccccaccttctgccacctgctgcacgagaaggtgcccttctgctgcctgagactggacaagagctgccagcacaactactacgaggacgccaaggcctacggcttcaagaacaagctgatcatcgtggccgccgagaccgccggcaacggcctgtacaacttcatcgtgcccctgagagcctactacagacccaagaaggagctgaaccccatcgtgctgctgctggacaaccccctggacgacctgctgagatgcggcgtgaccttcgccgccaacatggtggtggtggacaaggagagcaccatgagcgccgaggaggactacatggccgacgccaagaccatcgtgaacgtgcagaccctgttcagactgttcagcagcctgagcatcatcaccgagctgacccaccccgccaacatgagattcatgcagttcagagccaaggactgctacagcctggccctgagcaagctggagaagaaggagagagagagaggcagcaacctggccttcatgttcagactgcccttcgccgccggcagagtgttcagcatcagcatgctggacaccctgctgtaccagagcttcgtgaaggactacatgatcagcatcaccagactgctgctgggcctggacaccacccccggcagcggcttcctgtgcagcatgaagatcaccgccgacgacctgtggatcagaacctacgccagactgtaccagaagctgtgcagcagcaccggcgacgtgcccatcggcatctacagaaccgagagccagaagctgaccaccagcgaggagacctacatcctgatcttcctgagccagatcagcatcagcgtggaggagtgggaggacaccaaggacagcaaggagcagggccaccacagaagcaaccacagaaacagcaccagcagcgaccagagcgaccaccccctgctgagaagaaagagcatgcagtgggccagaagactgagcagaaagggccccaagcacagcggcaagaccgccgagaagatcacccagcagagactgaacctgtacagaagaagcgagagacaggagctggccgagctggtgaagaacagaatgaagcacctgggcctgagcaccgtgggctacgacgagatgaacgaccaccagagcaccctgagctacatcctgatcaaccccagccccgacaccagaatcgagctgaacgacgtggtgtacctgatcagacccgaccccctggcctacctgcccaacagcgagcccagcagaagaaacagcatctgcaacgtgaccggccaggacagcagagaggagacccagctgtag

SEQ ID NO: 94013 - DNA, 3336 bp, Artificial Sequence
  Description of Artificial Sequence: Synthetic coding sequence
atggtggacctggagagcgaggtgccccccctgccccccagatacagattcagagacctgctgctgggcgaccagggctggcagaacgacgacagagtgcaggtggagttctacatgaacgagaacaccttcaaggagagactgaagctgttcttcatcaagaaccagagaagcagcctgagaatcagactgttcaacttcagcctgaagctgctgagctgcctgctgtacatcatcagagtgctgctggagaaccccagccagggcaacgagtggagccacatcttctgggtgaacagaagcctgcccctgtggggcctgcaggtgagcgtggccctgatcagcctgttcgagaccatcctgctgggctacctgagctacaagggcaacatctgggagcagatcctgagaatccccttcatcctggagatcatcaacgccgtgcccttcatcatcagcatcttctggcccagcctgagaaacctgttcgtgcccgtgttcctgaactgctggctggccaagcacgccctggagaacatgatcaacgacctgcacagagccatccagagaacccagagcgccatgttcaaccaggtgctgatcctgatcagcaccctgctgtgcctgatcttcacctgcatctgcggcatccagcacctggagagaatcggcaagaagctgaacctgttcgacagcctgtacttctgcatcgtgaccttcagcaccgtgggcttcggcgacgtgacccccgagacctggagcagcaagctgttcgtggtggccatgatctgcgtggccctggtggtgctgcccatccagttcgagcagctggcctacctgtggatggagagacagaagagcggcggcaactacagcagacacagagcccagaccgagaagcacgtggtgctgtgcgtgagcagcctgaagatcgacctgctgatggacttcctgaacgagttctacgcccaccccagactgcaggactactacgtggtgatcctgtgccccaccgagatggacgtgcaggtgagaagagtgctgcagatccccatgtggagccagagagtgatctacctgcagggcagcgccctgaaggaccaggacctgctgagagccaagatggacgacgccgaggcctgcttcatcctgagcagcagatgcgaggtggacagaaccagcagcgaccaccagaccatcctgagagcctgggccgtgaaggacttcgcccccaactgccccctgtacgtgcagatcctgaagcccgagaacaagttccacatcaagttcgccgaccacgtggtgtgcgaggaggagttcaagtacgccatgctggccctgaactgcatctgccccgccaccagcaccctgatcaccctgctggtgcacaccagcagaggccaggagggccagcagagccccgagcagtggcagaagatgtacggcagatgcagcggcaacgaggtgtaccacatcgtgctggaggagagcaccttcttcgccgagtacgagggcaagagcttcacctacgccagcttccacgcccacaagaagttcggcgtgtgcctgatcggcgtgagaagagaggacaacaagaacatcctgctgaaccccggccccagatacatcatgaacagcaccgacatctgcttctacatcaacatcaccaaggaggagaacagcgccttcaagaaccaggaccagcagagaaagagcaacgtgagcagaagcttctaccacggccccagcagactgcccgtgcacagcatcatcgccagcatgggcaccgtggccatcgacctgcaggacaccagctgcagaagcgccagcggccccaccctgagcctgcccaccgagggcagcaaggagatcagaagacccagcatcgcccccgtgctggaggtggccgacaccagcagcatccagacctgcgacctgctgagcgaccagagcgaggacgagaccacccccgacgaggagatgagcagcaacctggagtacgccaagggctaccccccctacagcccctacatcggcagcagccccaccttctgccacctgctgcacgagaaggtgcccttctgctgcctgagactggacaagagctgccagcacaactactacgaggacgccaaggcctacggcttcaagaacaagctgatcatcgtggccgccgagaccgccggcaacggcctgtacaacttcatcgtgcccctgagagcctactacagacccaagaaggagctgaaccccatcgtgctgctgctggacaaccccctggacgacctgctgagatgcggcgtgaccttcgccgccaacatggtggtggtggacaaggagagcaccatgagcgccgaggaggactacatggccgacgccaagaccatcgtgaacgtgcagaccctgttcagactgttcagcagcctgagcatcatcaccgagctgacccaccccgccaacatgagattcatgcagttcagagccaaggactgctacagcctggccctgagcaagctggagaagaaggagagagagagaggcagcaacctggccttcatgttcagactgcccttcgccgccggcagagtgttcagcatcagcatgctggacaccctgctgtaccagagcttcgtgaaggactacatgatcagcatcaccagactgctgctgggcctggacaccacccccggcagcggcttcctgtgcagcatgaagatcaccgccgacgacctgtggatcagaacctacgccagactgtaccagaagctgtgcagcagcaccggcgacgtgcccatcggcatctacagaaccgagagccagaagctgaccaccagcgagagccagatcagcatcagcgtggaggagtgggaggacaccaaggacagcaaggagcagggccaccacagaagcaaccacagaaacagcaccagcagcgaccagagcgaccaccccctgctgagaagaaagagcatgcagtgggccagaagactgagcagaaagggccccaagcacagcggcaagaccgccgagaagatcacccagcagagactgaacctgtacagaagaagcgagagacaggagctggccgagctggtgaagaacagaatgaagcacctgggcctgagcaccgtgggctacgacgagatgaacgaccaccagagcaccctgagctacatcctgatcaaccccagccccgacaccagaatcgagctgaacgacgtggtgtacctgatcagacccgaccccctggcctacctgcccaacagcgagcccagcagaagaaacagcatctgcaacgtgaccggccaggacagcagagaggagacccagctgtag

SEQ ID NO: 94014 - DNA, 1113 bp, Artificial Sequence
  Description of Artificial Sequence: Synthetic coding sequence
atgccctacctgcacctggaccaccagaccatcctgagagcctgggccgtgaaggacttcgcccccaactgccccctgtacgtgcagatcctgaagcccgagaacaagttccacatcaagttcgccgaccacgtggtgtgcgaggaggagttcaagtacgccatgctggccctgaactgcatctgccccgccaccagcaccctgatcaccctgctggtgcacaccagcagaggccaggagggccagcagagccccgagcagtggcagaagatgtacggcagatgcagcggcaacgaggtgtaccacatcgtgctggaggagagcaccttcttcgccgagtacgagggcaagagcttcacctacgccagcttccacgcccacaagaagttcggcgtgtgcctgatcggcgtgagaagagaggacaacaagaacatcctgctgaaccccggccccagatacatcatgaacagcaccgacatctgcttctacatcaacatcaccaaggaggagaacagcgccttcaagaaccaggaccagcagagaaagagcaacgtgagcagaagcttctaccacggccccagcagactgcccgtgcacagcatcatcgccagcatgggcaccgtggccatcgacctgcaggacaccagctgcagaagcgccagcggccccaccctgagcctgcccaccgagggcagcaaggagatcagaagacccagcatcgcccccgtgctggaggtggccgacaccagcagcatccagacctgcgacctgctgagcgaccagagcgaggacgagaccacccccgacgaggagatgagcagcaacctggagtacgccaagggctaccccccctacagcccctacatcggcagcagccccaccttctgccacctgctgcacgagaaggtgcccttctgctgcctgagactggacaagagctgccagcacaactactacgaggacgccaaggcctacggcttcaagaacaagctgatcatcgtggccgccgagaccgccggcaacggcctgtacaacttcatcgtgcccctgagagcctactacagacccaagaaggagctgaaccccatcgtgctgctgctggacaacccctag

SEQ ID NO: 94015 - DNA, 1572 bp, Artificial Sequence
  Description of Artificial Sequence: Synthetic coding sequence
atcatcaacgacctgcacagagccatccagagaacccagagcgccatgttcaaccaggtgctgatcctgatcagcaccctgctgtgcctgatcttcacctgcatctgcggcatccagcacctggagagaatcggcaagaagctgaacctgttcgacagcctgtacttctgcatcgtgaccttcagcaccgtgggcttcggcgacgtgacccccgagacctggagcagcaagctgttcgtggtggccatgatctgcgtggccctggtggtgctgcccatccagttcgagcagctggcctacctgtggatggagagacagaagagcggcggcaactacagcagacacagagcccagaccgagaagcacgtggtgctgtgcgtgagcagcctgaagatcgacctgctgatggacttcctgaacgagttctacgcccaccccagactgcaggactactacgtggtgatcctgtgccccaccgagatggacgtgcaggtgagaagagtgctgcagatccccatgtggagccagagagtgatctacctgcagggcagcgccctgaaggaccaggacctgctgagagccaagatggacgacgccgaggcctgcttcatcctgagcagcagatgcgaggtggacagaaccagcagcgaccaccagaccatcctgagagcctgggccgtgaaggacttcgcccccaactgccccctgtacgtgcagatcctgaagcccgagaacaagttccacatcaagttcgccgaccacgtggtgtgcgaggaggagttcaagtacgccatgctggccctgaactgcatctgccccgccaccagcaccctgatcaccctgctggtgcacaccagcagaggccaggagggccagcagagccccgagcagtggcagaagatgtacggcagatgcagcggcaacgaggtgtaccacatcgtgctggaggagagcaccttcttcgccgagtacgagggcaagagcttcacctacgccagcttccacgcccacaagaagttcggcgtgtgcctgatcggcgtgagaagagaggacaacaagaacatcctgctgaaccccggccccagatacatcatgaacagcaccgacatctgcttctacatcaacatcaccaaggaggagaacagcgccttcaagaaccaggaccagcagagaaagagcaacgtgagcagaagcttctaccacggccccagcagactgcccgtgcacagcatcatcgccagcatgggcaccgtggccatcgacctgcaggacaccagctgcagaagcgccagcggccccaccctgagcctgcccaccgagggcagcaaggagatcagaagacccagcatcgcccccgtgctggaggtggccgacaccagcagcatccagacctgcgacctgctgagcgaccagagcgaggacgagaccacccccgacgaggagatgagcagcaacctggagtacgccaagggctaccccccctacagcccctacatcggcagcagccccaccttctgccacctgctgcacgagaaggtgcccttctgctgcctgagactggacaagttctag

SEQ ID NO: 94016 - DNA, 1503 bp, Artificial Sequence
  Description of Artificial Sequence: Synthetic coding sequence
atgcccagcagcggcagagccctgctggacagccccctggacagcggcagcctgaccagcctggacagcagcgtgttctgcagcgagggcgagggcgagcccctggccctgggcgactgcttcaccgtgaacgtgggcggcagcagattcgtgctgagccagcaggccctgagctgcttcccccacaccagactgggcaagctggccgtggtggtggccagctacagaagacccggcgccctggccgccgtgcccagccccctggagctgtgcgacgacgccaaccccgtggacaacgagtacttcttcgacagaagcagccaggccttcagatacgtgctgcactactacagaaccggcagactgcacgtgatggagcagctgtgcgccctgagcttcctgcaggagatccagtactggggcatcgacgagctgagcatcgacagctgctgcagagacagatacttcagaagaaaggagctgagcgagaccctggacttcaagaaggacaccgaggaccaggagagccagcacgagagcgagcaggacttcagccagggcccctgccccaccgtgagacagaagctgtggaacatcctggagaagcccggcagcagcaccgccgccagaatcttcggcgtgatcagcatcatcttcgtggtggtgagcatcatcaacatggccctgatgagcgccgagctgagctggctggacctgcagctgctggagatcctggagtacgtgtgcatcagctggttcaccggcgagttcgtgctgagattcctgtgcgtgagagacagatgcagattcctgagaaaggtgcccaacatcatcgacctgctggccatcctgcccttctacatcaccctgctggtggagagcctgagcggcagccagaccacccaggagctggagaacgtgggcagaatcgtgcaggtgctgagactgctgagagccctgagaatgctgaagctgggcagacacagcaccggcctgagaagcctgggcatgaccatcacccagtgctacgaggaggtgggcctgctgctgctgttcctgagcgtgggcatcagcatcttcagcaccgtggagtacttcgccgagcagagcatccccgacaccaccttcaccagcgtgccctgcgcctggtggtgggccaccaccagcatgaccaccgtgggctacggcgacatcagacccgacaccaccaccggcaagatcgtggccttcatgtgcatcctgagcggcatcctggtgctggccctgcccatcgccatcatcaacgacagattcagcgcctgctacttcaccctgaagctgaaggaggccgccgtgagacagagagaggccctgaagaagctgaccaagaacatcgccaccgacagctacatcagcgtgaacctgagagacgtgtacgccagaagcatcatggagatgctgagactgaagggcagagagagagccagcaccagaagcagcggcggcgacgacttctggttctag

SEQ ID NO: 94017 - DNA, 1503 bp, Artificial Sequence; identical to SEQ ID NO: 94016
  Description of Artificial Sequence: Synthetic coding sequence

SEQ ID NO: 94018 - DNA, 1131 bp, Artificial Sequence
  Description of Artificial Sequence: Synthetic coding sequence
atggagcagctgtgcgccctgagcttcctgcaggagatccagtactggggcatcgacgagctgagcatcgacagctgctgcagagacagatacttcagaagaaaggagctgagcgagaccctggacttcaagaaggacaccgaggaccaggagagccagcacgagagcgagcaggacttcagccagggcccctgccccaccgtgagacagaagctgtggaacatcctggagaagcccggcagcagcaccgccgccagaatcttcggcgtgatcagcatcatcttcgtggtggtgagcatcatcaacatggccctgatgagcgccgagctgagctggctggacctgcagctgctggagatcctggagtacgtgtgcatcagctggttcaccggcgagttcgtgctgagattcctgtgcgtgagagacagatgcagattcctgagaaaggtgcccaacatcatcgacctgctggccatcctgcccttctacatcaccctgctggtggagagcctgagcggcagccagaccacccaggagctggagaacgtgggcagaatcgtgcaggtgctgagactgctgagagccctgagaatgctgaagctgggcagacacagcaccggcctgagaagcctgggcatgaccatcacccagtgctacgaggaggtgggcctgctgctgctgttcctgagcgtgggcatcagcatcttcagcaccgtggagtacttcgccgagcagagcatccccgacaccaccttcaccagcgtgccctgcgcctggtggtgggccaccaccagcatgaccaccgtgggctacggcgacatcagacccgacaccaccaccggcaagatcgtggccttcatgtgcatcctgagcggcatcctggtgctggccctgcccatcgccatcatcaacgacagattcagcgcctgctacttcaccctgaagctgaaggaggccgccgtgagacagagagaggccctgaagaagctgaccaagaacatcgccaccgacagctacatcagcgtgaacctgagagacgtgtacgccagaagcatcatggagatgctgagactgaagggcagagagagagccagcaccagaagcagcggcggcgacgacttctggttctag

SEQ ID NO: 94019 - DNA, 1638 bp, Artificial Sequence
  Description of Artificial Sequence: Synthetic coding sequence
atgctgaagcagagcgagagaagaagaagctggagctacagaccctggaacaccaccgagaacgagggcagccagcacagaagaagcatctgcagcctgggcgccagaagcggcagccaggccagcatccacggctggaccgagggcaactacaactactacatcgaggaggacgaggacggcgaggaggaggaccagtggaaggacgacctggccgaggaggaccagcaggccggcgaggtgaccaccgccaagcccgagggccccagcgacccccccgccctgctgagcaccctgaacgtgaacgtgggcggccacagctaccagctggactactgcgagctggccggcttccccaagaccagactgggcagactggccaccagcaccagcagaagcagacagctgagcctgtgcgacgactacgaggagcagaccgacgagtacttcttcgacagagaccccgccgtgttccagctggtgtacaacttctacctgagcggcgtgctgctggtgctggacggcctgtgccccagaagattcctggaggagctgggctactggggcgtgagactgaagtacacccccagatgctgcagaatctgcttcgaggagagaagagacgagctgagcgagagactgaagatccagcacgagctgagagcccaggcccaggtggaggaggccgaggagctgttcagagacatgagattctacggcccccagagaagaagactgtggaacctgatggagaagcccttcagcagcgtggccgccaaggccatcggcgtggccagcagcaccttcgtgctggtgagcgtggtggccctggccctgaacaccgtggaggagatgcagcagcacagcggccagggcgagggcggccccgacctgagacccatcctggagcacgtggagatgctgtgcatgggcttcttcaccctggagtacctgctgagactggccagcacccccgacctgagaagattcgccagaagcgccctgaacctggtggacctggtggccatcctgcccctgtacctgcagctgctgctggagtgcttcaccggcgagggccaccagagaggccagaccgtgggcagcgtgggcaaggtgggccaggtgctgagagtgatgagactgatgagaatcttcagaatcctgaagctggccagacacagcaccggcctgagagccttcggcttcaccctgagacagtgctaccagcaggtgggctgcctgctgctgttcatcgccatgggcatcttcaccttcagcgccgccgtgtacagcgtggagcacgacgtgcccagcaccaacttcaccaccatcccccacagctggtggtgggccgccgtgagcatcagcaccgtgggctacggcgacatgtaccccgagacccacctgggcagattcttcgccttcctgtgcatcgccttcggcatcatcctgaacggcatgcccatcagcatcctgtacaacaagttcagcgactactacagcaagctgaaggcctacgagtacaccaccatcagaagagagagaggcgaggtgaacttcatgcagagagccagaaagaagatcgccgagtgcctgctgggcagcaacccccagctgacccccagacaggagaactag

SEQ ID NO: 94020 - DNA, 963 bp, Artificial Sequence
  Description of Artificial Sequence: Synthetic coding sequence
atgctgaagcagagcgagagaagaagaagctggagctacagaccctggaacaccaccgagaacgagggcagccagcacagaagaagcatctgcagcctgggcgccagaagcggcagccaggccagcatccacggctggaccgagggcaactacaactactacatcgaggaggacgaggacggcgaggaggaggaccagtggaaggacgacctggccgaggaggaccagcaggccggcgaggtgaccaccgccaagcccgagggccccagcgacccccccgccctgctgagcaccctgaacgtgaacgtgggcggccacagctaccagctggactactgcgagctggccggcttccccaagaccagactgggcagactggccaccagcaccagcagaagcagacagctgagcctgtgcgacgactacgaggagcagaccgacgagtacttcttcgacagagaccccgccgtgttccagctggtgtacaacttctacctgagcggcgtgctgctggtgctggacggcctgtgccccagaagattcctggaggagctgggctactggggcgtgagactgaagtacacccccagatgctgcagaatctgcttcgaggagagaagagacgagctgagcgagagactgaagatccagcacctgagagccagactgagaggcggcgccggcgcccagcacagaggcggcgacgccgccgccctgggcgccggcagaggcagacccagacccgccgcccaccccggcgccagaggcgacgccgtgcacggcctgctgcacgccagagtgcccgccgcccccagcctgcacgccagacccgaggccctgagagcccagagaccccagcccggcggccccggcggccaccccgccgccctgcccagcgccgccgccagagtgctgcacggcagaggcccccccaccagacccgacggcggccagagaggctag

SEQ ID NO: 94021 - DNA, 1740 bp, Artificial Sequence
  Description of Artificial Sequence: Synthetic coding sequence
atgagcagctgcagatacaacggcggcgtgatgagacccctgagcaacctgagcgccagcagaagaaacctgcacgagatggacagcgaggcccagcccctgcagccccccgccagcgtgggcggcggcggcggcgccagcagccccagcgccgccgccgccgccgccgccgccgtgagcagcagcgcccccgagatcgtggtgagcaagcccgagcacaacaacagcaacaacctggccctgtacggcaccggcggcggcggcagcaccggcggcggcggcggcggcggcggcagcggccacggcagcagcagcggcaccaagagcagcaagaagaagaaccagaacatcggctacaagctgggccacagaagagccctgttcgagaagagaaagagactgagcgactacgccctgatcttcggcatgttcggcatcgtggtgatggtgatcgagaccgagctgagctggggcgcctacgacaaggccagcctgtacagcctggccctgaagtgcctgatcagcctgagcaccatcatcctgctgggcctgatcatcgtgtaccacgccagagagatccagctgttcatggtggacaacggcgccgacgactggagaatcgccatgacctacgagagaatcttcttcatctgcctggagatcctggtgtgcgccatccaccccatccccggcaactacaccttcacctggaccgccagactggccttcagctacgcccccagcaccaccaccgccgacgtggacatcatcctgagcatccccatgttcctgagactgtacctgatcgccagagtgatgctgctgcacagcaagctgttcaccgacgccagcagcagaagcatcggcgccctgaacaagatcaacttcaacaccagattcgtgatgaagaccctgatgaccatctgccccggcaccgtgctgctggtgttcagcatcagcctgtggatcatcgccgcctggaccgtgagagcctgcgagagataccacgaccagcaggacgtgaccagcaacttcctgggcgccatgtggctgatcagcatcaccttcctgagcatcggctacggcgacatggtgcccaacacctactgcggcaagggcgtgtgcctgctgaccggcatcatgggcgccggctgcaccgccctggtggtggccgtggtggccagaaagctggagctgaccaaggccgagaagcacgtgcacaacttcatgatggacacccagctgaccaagagagtgaagaacgccgccgccaacgtgctgagagagacctggctgatctacaagaacaccaagctggtgaagaagatcgaccacgccaaggtgagaaagcaccagagaaagttcctgcaggccatccaccagctgagaagcgtgaagatggagcagagaaagctgaacgaccaggccaacaccctggtggacctggccaagacccagaacatcatgtacgacatgatcagcgacctgaacgagagaagcgaggacttcgagaagagaatcgtgaccctggagaccaagctggagaccctgatcggcagcatccacgccctgcccggcctgatcagccagaccatcagacagcagcagagagacttcatcgaggcccagatggagagctacgacaagcacgtgacctacaacgccgagagaagcagaagcagcagcagaagaagaagaagcagcagcaccgccccccccaccagcagcgagagcagctag

SEQ ID NO: 94022 - DNA, 696 bp, Artificial Sequence
  Description of Artificial Sequence: Synthetic coding sequence
atgtggctgatcagcatcaccttcctgagcatcggctacggcgacatggtgcccaacacctactgcggcaagggcgtgtgcctgctgaccggcatcatgggcgccggctgcaccgccctggtggtggccgtggtggccagaaagctggagctgaccaaggccgagaagcacgtgcacaacttcatgatggacacccagctgaccaagagagtgaagaacgccgccgccaacgtgctgagagagacctggctgatctacaagaacaccaagctggtgaagaagatcgaccacgccaaggtgagaaagcaccagagaaagttcctgcaggccatccaccagctgagaagcgtgaagatggagcagagaaagctgaacgaccaggccaacaccctggtggacctggccaagacccagaacatcatgtacgacatgatcagcgacctgaacgagagaagcgaggacttcgagaagagaatcgtgaccctggagaccaagctggagaccctgatcggcagcatccacgccctgcccggcctgatcagccagaccatcagacagcagcagagagacttcatcgaggcccagatggagagctacgacaagcacgtgacctacaacgccgagagaagcagaagcagcagcagaagaagaagaagcagcagcaccgccccccccaccagcagcgagagcagctag

SEQ ID NO: 94023 - DNA, 1326 bp, Artificial Sequence
  Description of Artificial Sequence: Synthetic coding sequence
atgagcagctgcagatacaacggcggcgtgatgagacccctgagcaacctgagcgccagcagaagaaacctgcacgagatggacagcgaggcccagcccctgcagccccccgccagcgtgggcggcggcggcggcgccagcagccccagcgccgccgccgccgccgccgccgccgtgagcagcagcgcccccgagatcgtggtgagcaagcccgagcacaacaacagcaacaacctggccctgtacggcaccggcggcggcggcagcaccggcggcggcggcggcggcggcggcagcggccacggcagcagcagcggcaccaagagcagcaagaagaagaaccagaacatcggctacaagctgggccacagaagagccctgttcgagaagagaaagagactgagcgactacgccctgatcttcggcatgttcggcatcgtggtgatggtgatcgagaccgagctgagctggggcgcctacgacaaggccagcctgtacagcctggccctgaagtgcctgatcagcctgagcaccatcatcctgctgggcctgatcatcgtgtaccacgccagagagatccagctgttcatggtggacaacggcgccgacgactggagaatcgccatgacctacgagagaatcttcttcatctgcctggagatcctggtgtgcgccatccaccccatccccggcaactacaccttcacctggaccgccagactggccttcagctacgcccccagcaccaccaccgccgacgtggacatcatcctgagcatccccatgttcctgagactgtacctgatcgccagagtgatgctgctgcacagcaagctgttcaccgacgccagcagcagaagcatcggcgccctgaacaagatcaacttcaacaccagattcgtgatgaagaccctgatgaccatctgccccggcaccgtgctgctggtgttcagcatcagcctgtggatcatcgccgcctggaccgtgagagcctgcgagagataccacgaccagcaggacgtgaccagcaacttcctgggcgccatgtggctgatcagcatcaccttcctgagcatcggctacggcgacatggtgcccaacacctactgcggcaagggcgtgtgcctgctgaccggcatcatgggcgccggctgcaccgccctggtggtggccgtggtggccagaaagctggagctgaccaaggccgagaagcacgtgcacaacttcatgatggacacccagctgaccaagagagtgagctactacccctacatcttcaaggagaacatcatcgtgatcttcagcgtgctgggcaacatggcctag

SEQ ID NO: 94024 - DNA, 2196 bp, Artificial Sequence
  Description of Artificial Sequence: Synthetic coding sequence
atggacaccagcggccacttccacgacagcggcgtgggcgacctggacgaggaccccaagtgcccctgccccagcagcggcgacgagcagcagcagcagcagcagcagcagcagcagcagcagccccccccccccgccccccccgccgccccccagcagcccctgggccccagcctgcagccccagcccccccagctgcagcagcagcagcagcagcagcagcagcagcagcagcagcagcccccccaccccctgagccagctggcccagctgcagagccagcccgtgcaccccggcctgctgcacagcagccccaccgccttcagagccccccccagcagcaacagcaccgccatcctgcaccccagcagcagacagggcagccagctgaacctgaacgaccacctgctgggccacagccccagcagcaccgccaccagcggccccggcggcggcagcagacacagacaggccagccccctggtgcacagaagagacagcaaccccttcaccgagatcgccatgagcagctgcaagtacagcggcggcgtgatgaagcccctgagcagactgagcgccagcagaagaaacctgatcgaggccgagaccgagggccagcccctgcagctgttcagccccagcaacccccccgagatcgtgatcagcagcagagaggacaaccacgcccaccagaccctgctgcaccaccccaacgccacccacaaccaccagcacgccggcaccaccgccagcagcaccaccttccccaaggccaacaagagaaagaaccagaacatcggctacaagctgggccacagaagagccctgttcgagaagagaaagagactgagcgactacgccctgatcttcggcatgttcggcatcgtggtgatggtgatcgagaccgagctgagctggggcctgtacagcaaggacagcatgttcagcctggccctgaagtgcctgatcagcctgagcaccatcatcctgctgggcctgatcatcgcctaccacaccagagaggtgcagctgttcgtgatcgacaacggcgccgacgactggagaatcgccatgacctacgagagaatcctgtacatcagcctggagatgctggtgtgcgccatccaccccatccccggcgagtacaagttcttctggaccgccagactggccttcagctacacccccagcagagccgaggccgacgtggacatcatcctgagcatccccatgttcctgagactgtacctgatcgccagagtgatgctgctgcacagcaagctgttcaccgacgccagcagcagaagcatcggcgccctgaacaagatcaacttcaacaccagattcgtgatgaagaccctgatgaccatctgccccggcaccgtgctgctggtgttcagcatcagcctgtggatcatcgccgcctggaccgtgagagtgtgcgagagataccacgaccagcaggacgtgaccagcaacttcctgggcgccatgtggctgatcagcatcaccttcctgagcatcggctacggcgacatggtgccccacacctactgcggcaagggcgtgtgcctgctgaccggcatcatgggcgccggctgcaccgccctggtggtggccgtggtggccagaaagctggagctgaccaaggccgagaagcacgtgcacaacttcatgatggacacccagctgaccaagagaatcaagaacgccgccgccaacgtgctgagagagacctggctgatctacaagcacaccaagctgctgaagaagatcgaccacgccaaggtgagaaagcaccagagaaagttcctgcaggccatccaccagctgagaagcgtgaagatggagcagagaaagctgagcgaccaggccaacaccctggtggacctgagcaagatgcagaacgtgatgtacgacctgatcaccgagctgaacgacagaagcgaggacctggagaagcagatcggcagcctggagagcaagctggagcacctgaccgccagcttcaacagcctgcccctgctgatcgccgacaccctgagacagcagcagcagcagctgctgagcgccatcatcgaggccagaggcgtgagcgtggccgtgggcaccacccacacccccatcagcgacagccccatcggcgtgagcagcaccagcttccccaccccctacaccagcagcagcagctgctag

SEQ ID NO: 94025 - DNA, 1257 bp, Artificial Sequence
  Description of Artificial Sequence: Synthetic coding sequence
atgttcagcctggccctgaagtgcctgatcagcctgagcaccatcatcctgctgggcctgatcatcgcctaccacaccagagaggtgcagctgttcgtgatcgacaacggcgccgacgactggagaatcgccatgacctacgagagaatcctgtacatcagcctggagatgctggtgtgcgccatccaccccatccccggcgagtacaagttcttctggaccgccagactggccttcagctacacccccagcagagccgaggccgacgtggacatcatcctgagcatccccatgttcctgagactgtacctgatcgccagagtgatgctgctgcacagcaagctgttcaccgacgccagcagcagaagcatcggcgccctgaacaagatcaacttcaacaccagattcgtgatgaagaccctgatgaccatctgccccggcaccgtgctgctggtgttcagcatcagcctgtggatcatcgccgcctggaccgtgagagtgtgcgagagataccacgaccagcaggacgtgaccagcaacttcctgggcgccatgtggctgatcagcatcaccttcctgagcatcggctacggcgacatggtgccccacacctactgcggcaagggcgtgtgcctgctgaccggcatcatgggcgccggctgcaccgccctggtggtggccgtggtggccagaaagctggagctgaccaaggccgagaagcacgtgcacaacttcatgatggacacccagctgaccaagagaatcaagaacgccgccgccaacgtgctgagagagacctggctgatctacaagcacaccaagctgctgaagaagatcgaccacgccaaggtgagaaagcaccagagaaagttcctgcaggccatccaccagctgagaagcgtgaagatggagcagagaaagctgagcgaccaggccaacaccctggtggacctgagcaagatgcagaacgtgatgtacgacctgatcaccgagctgaacgacagaagcgaggacctggagaagcagatcggcagcctggagagcaagctggagcacctgaccgccagcttcaacagcctgcccctgctgatcgccgacaccctgagacagcagcagcagcagctgctgagcgccatcatcgaggccagaggcgtgagcgtggccgtgggcaccacccacacccccatcagcgacagccccatcggcgtgagcagcaccagcttccccaccccctacaccagcagcagcagctgctag

SEQ ID NO: 94026 - DNA, 1281 bp, Artificial Sequence
  Description of Artificial Sequence: Synthetic coding sequence
atggagagacccatcaaggacagcatgttcagcctggccctgaagtgcctgatcagcctgagcaccatcatcctgctgggcctgatcatcgcctaccacaccagagaggtgcagctgttcgtgatcgacaacggcgccgacgactggagaatcgccatgacctacgagagaatcctgtacatcagcctggagatgctggtgtgcgccatccaccccatccccggcgagtacaagttcttctggaccgccagactggccttcagctacacccccagcagagccgaggccgacgtggacatcatcctgagcatccccatgttcctgagactgtacctgatcgccagagtgatgctgctgcacagcaagctgttcaccgacgccagcagcagaagcatcggcgccctgaacaagatcaacttcaacaccagattcgtgatgaagaccctgatgaccatctgccccggcaccgtgctgctggtgttcagcatcagcctgtggatcatcgccgcctggaccgtgagagtgtgcgagagataccacgaccagcaggacgtgaccagcaacttcctgggcgccatgtggctgatcagcatcaccttcctgagcatcggctacggcgacatggtgccccacacctactgcggcaagggcgtgtgcctgctgaccggcatcatgggcgccggctgcaccgccctggtggtggccgtggtggccagaaagctggagctgaccaaggccgagaagcacgtgcacaacttcatgatggacacccagctgaccaagagaatcaagaacgccgccgccaacgtgctgagagagacctggctgatctacaagcacaccaagctgctgaagaagatcgaccacgccaaggtgagaaagcaccagagaaagttcctgcaggccatccaccagctgagaagcgtgaagatggagcagagaaagctgagcgaccaggccaacaccctggtggacctgagcaagatgcagaacgtgatgtacgacctgatcaccgagctgaacgacagaagcgaggacctggagaagcagatcggcagcctggagagcaagctggagcacctgaccgccagcttcaacagcctgcccctgctgatcgccgacaccctgagacagcagcagcagcagctgctgagcgccatcatcgaggccagaggcgtgagcgtggccgtgggcaccacccacacccccatcagcgacagccccatcggcgtgagcagcaccagcttccccaccccctacaccagcagcagcagctgctag

SEQ ID NO: 94027 - DNA, 684 bp, Artificial Sequence
  Description of Artificial Sequence: Synthetic coding sequence
ccccacaccctgctggaggaccacctgctgagagagttcttccaccccctgttcttcctgcaggcccccctgctgctgagcctgcccgcccagtacaacgccttcctgagcggcagcgtgtggacccccggcagccccagagagcccaagcaggccaaggagagaaccggcgccaagatcctggtgggcgagatcggctgcctggccttcttcgaggacatcttcggcgccagagtggccctgggctggggcctggtgctgcagggcatccagcccggccccaagatggacaccagcggccacttccacgacagcggcgtgggcgacctggacgaggaccccaagtgcccctgccccagcagcggcgacgagcagcagcagcagcagcagcagcagcagcagcagcagccccccccccccgccccccccgccgccccccagcagcccctgggccccagcctgcagccccagcccccccagctgcagcagcagcagcagcagcagcagcagcagcagcagcagcagcccccccaccccctgagccagctggcccagctgcagagccagcccgtgcaccccggcctgctgcacagcagccccaccgccttcagaccccccttcgtgcagctgcacagacaccccccccccttcctgcaggccagacagcccgcccagagccagtag

SEQ ID NO: 94028 - DNA, 1284 bp, Artificial Sequence
  Description of Artificial Sequence: Synthetic coding sequence
atgggcggcgacctggtgctgggcctgggcgccctgagaagaagaaagagactgctggagcaggagaagagcctggccggctgggccctggtgctggccggcaccggcatcggcctgatggtgctgcacgccgagatgctgtggttcggcggctgcagctgggccctgtacctgttcctggtgaagtgcaccatcagcatcagcaccttcctgctgctgtgcctgatcgtggccttccacgccaaggaggtgcagctgttcatgaccgacaacggcctgagagactggagagtggccctgaccggcagacaggccgcccagatcgtgctggagctggtggtgtgcggcctgcaccccgcccccgtgagaggccccccctgcgtgcaggacctgggcgcccccctgaccagcccccagccctggcccggcttcctgggccagggcgaggccctgctgagcctggccatgctgctgagactgtacctggtgcccagagccgtgctgctgagaagcggcgtgctgctgaacgccagctacagaagcatcggcgccctgaaccaggtgagattcagacactggttcgtggccaagctgtacatgaacacccaccccggcagactgctgctgggcctgaccctgggcctgtggctgaccaccgcctgggtgctgagcgtggccgagagacaggccgtgaacgccaccggccacctgagcgacaccctgtggctgatccccatcaccttcctgaccatcggctacggcgacgtggtgcccggcaccatgtggggcaagatcgtgtgcctgtgcaccggcgtgatgggcgtgtgctgcaccgccctgctggtggccgtggtggccagaaagctggagttcaacaaggccgagaagcacgtgcacaacttcatgatggacatccagtacaccaaggagatgaaggagagcgccgccagagtgctgcaggaggcctggatgttctacaagcacaccagaagaaaggagagccacgccgccagaagacaccagagaaagctgctggccgccatcaacgccttcagacaggtgagactgaagcacagaaagctgagagagcaggtgaacagcatggtggacatcagcaagatgcacatgatcctgtacgacctgcagcagaacctgagcagcagccacagagccctggagaagcagatcgacaccctggccggcaagctggacgccctgaccgagctgctgagcaccgccctgggccccagacagctgcccgagcccagccagcagagcaagtag

SEQ ID NO: 94029 - DNA, 888 bp, Artificial Sequence
  Description of Artificial Sequence: Synthetic coding sequence
atgcacgaccagcacttccacctgctgacccccctgccccacagaggcctgagctgccagagaggccccgccgtgcacgacagacagagagccgccggcctggccagaggcgccgacagagccgccggcaacgccagctacagaagcatcggcgccctgaaccaggtgagattcagacactggttcgtggccaagctgtacatgaacacccaccccggcagactgctgctgggcctgaccctgggcctgtggctgaccaccgcctgggtgctgagcgtggccgagagacaggccgtgaacgccaccggccacctgagcgacaccctgtggctgatccccatcaccttcctgaccatcggctacggcgacgtggtgcccggcaccatgtggggcaagatcgtgtgcctgtgcaccggcgtgatgggcgtgtgctgcaccgccctgctggtggccgtggtggccagaaagctggagttcaacaaggccgagaagcacgtgcacaacttcatgatggacatccagtacaccaaggagatgaaggagagcgccgccagagtgctgcaggaggcctggatgttctacaagcacaccagaagaaaggagagccacgccgccagaagacaccagagaaagctgctggccgccatcaacgccttcagacaggtgagactgaagcacagaaagctgagagagcaggtgaacagcatggtggacatcagcaagatgcacatgatcctgtacgacctgcagcagaacctgagcagcagccacagagccctggagaagcagatcgacaccctggccggcaagctggacgccctgaccgagctgctgagcaccgccctgggccccagacagctgcccgagcccagccagcagagcaagtag

SEQ ID NO: 94030 - DNA, 1119 bp, Artificial Sequence
  Description of Artificial Sequence: Synthetic coding sequence
atgttcaagcacctgagaaagtgggtggtgaccagattcttcggccacagcagacagagagccagactggtgagcaaggacggcagatgcaacatcgagttcggcaacgtggaggcccagagcagattcatcttcttcgtggacatctggaccaccgtgctggacctgaagtggagatacaagatgaccatcttcatcaccgccttcctgggcagctggttcttcttcggcctgctgtggtacgccgtggcctacatccacaaggacctgcccgagttccaccccagcgccaaccacaccccctgcgtggagaacatcaacggcctgaccagcgccttcctgttcagcctggagacccaggtgaccatcggctacggcttcagatgcgtgaccgagcagtgcgccaccgccatcttcctgctgatcttccagagcatcctgggcgtgatcatcaacagcttcatgtgcggcgccatcctggccaagatcagcagacccaagaagagagccaagaccatcaccttcagcaagaacgccgtgatcagcaagagaggcggcaagctgtgcctgctgatcagagtggccaacctgagaaagagcctgctgatcggcagccacatctacggcaagctgctgaagaccaccgtgacccccgagggcgagaccatcatcctggaccagatcaacatcaacttcgtggtggacgccggcaacgagaacctgttcttcatcagccccctgaccatctaccacgtgatcgaccacaacagccccttcttccacatggccgccgagaccctgctgcagcaggacttcgagctggtggtgttcctggacggcaccgtggagagcaccagcgccacctgccaggtgagaaccagctacgtgcccgaggaggtgctgtggggctacagattcgcccccatcgtgagcaagaccaaggagggcaagtacagagtggacttccacaacttcagcaagaccgtggaggtggagaccccccactgcgccatgtgcctgtacaacgagaaggacgtgagagccagaatgaagagaggctacgacaaccccaacttcatcctgagcgaggtgaacgagaccgacgacaccaagatgtag

SEQ ID NO: 94031 - DNA, 1119 bp, Artificial Sequence; identical to SEQ ID NO: 94030
  Description of Artificial Sequence: Synthetic coding sequence

SEQ ID NO: 94032 - DNA, 912 bp, Artificial Sequence
  Description of Artificial Sequence: Synthetic coding sequence
atggcctggtggctgatcgccttcgcccacggcgacctggcccccagcgagggcaccgccgagccctgcgtgaccagcatccacagcttcagcagcgccttcctgttcagcatcgaggtgcaggtgaccatcggcttcggcggcagaatggtgaccgaggagtgccccctggccatcctgatcctgatcgtgcagaacatcgtgggcctgatgatcaacgccatcatgctgggctgcatcttcatgaagaccgcccaggcccacagaagagccgagaccctgatcttcagcaagcacgccgtgatcgccctgagacacggcagactgtgcttcatgctgagagtgggcgacctgagaaagagcatgatcatcagcgccaccatccacatgcaggtggtgagaaagaccaccagccccgagggcgaggtggtgcccctgcaccaggtggacatccccatggagaacggcgtgggcggcaacagcatcttcctggtggcccccctgatcatctaccacgtgatcgacgccaacagccccctgtacgacctggcccccagcgacctgcaccaccaccaggacctggagatcatcgtgatcctggagggcgtggtggagaccaccggcatcaccacccaggccagaaccagctacctggccgacgagatcctgtggggccagagattcgtgcccatcgtggccgaggaggacggcagatacagcgtggactacagcaagttcggcaacaccgtgaaggtgcccacccccctgtgcaccgccagacagctggacgaggaccacagcctgctggaggccctgaccctggccagcgccagaggccccctgagaaagagaagcgtgcccatggccaaggccaagcccaagttcagcatcagccccgacagcctgagctag

SEQ ID NO: 94033 - DNA, 1302 bp, Artificial Sequence
  Description of Artificial Sequence: Synthetic coding sequence
atgaccgccgccagcagagccaacccctacagcatcgtgagcagcgaggaggacggcctgcacctggtgaccatgagcggcgccaacggcttcggcaacggcaaggtgcacaccagaagaagatgcagaaacagattcgtgaagaagaacggccagtgcaacatcgagttcgccaacatggacgagaagagccagagatacctggccgacatgttcaccacctgcgtggacatcagatggagatacatgctgctgatcttcagcctggccttcctggccagctggctgctgttcggcatcatcttctgggtgatcgccgtggcccacggcgacctggagcccgccgagggcagaggcagaaccccctgcgtgatgcaggtgcacggcttcatggccgccttcctgttcagcatcgagacccagaccaccatcggctacggcctgagatgcgtgaccgaggagtgccccgtggccgtgttcatggtggtggcccagagcatcgtgggctgcatcatcgacagcttcatgatcggcgccatcatggccaagatggccagacccaagaagagagcccagaccctgctgttcagccacaacgccgtggtggccctgagagacggcaagctgtgcctgatgtggagagtgggcaacctgagaaagagccacatcgtggaggcccacgtgagagcccagctgatcaagcccagagtgaccgaggagggcgagtacatccccctggaccagatcgacatcgacgtgggcttcgacaagggcctggacagaatcttcctggtgagccccatcaccatcctgcacgagatcgacgaggccagccccctgttcggcatcagcagacaggacctggagaccgacgacttcgagatcgtggtgatcctggagggcatggtggaggccaccgccatgaccacccaggccagaagcagctacctggccaacgagatcctgtggggccacagattcgagcccgtgctgttcgaggagaagaaccagtacaagatcgactacagccacttccacaagacctacgaggtgcccagcacccccagatgcagcgccaaggacctggtggagaacaagttcctgctgcccagcgccaacagcttctgctacgagaacgagctggccttcctgagcagagacgaggaggacgaggccgacggcgaccaggacggcagaagcagagacggcctgagcccccaggccagacacgacttcgacagactgcaggccggcggcggcgtgctggagcagagaccctacagaagagagagcgagatctag

SEQ ID NO: 94034 - DNA, 1257 bp, Artificial Sequence
  Description of Artificial Sequence: Synthetic coding sequence
atgagctactacggcagcagctaccacatcatcaacgccgacgccaagtaccccggctacccccccgagcacatcatcgccgagaagagaagagccagaagaagactgctgcacaaggacggcagctgcaacgtgtacttcaagcacatcttcggcgagtggggcagctacgtggtggacatcttcaccaccctggtggacaccaagtggagacacatgttcgtgatcttcagcctgagctacatcctgagctggctgatcttcggcagcgtgttctggctgatcgccttccaccacggcgacctgctgaacgaccccgacatcaccccctgcgtggacaacgtgcacagcttcaccggcgccttcctgttcagcctggagacccagaccaccatcggctacggctacagatgcgtgaccgaggagtgcagcgtggccgtgctgatggtgatcctgcagagcatcctgagctgcatcatcaacaccttcatcatcggcgccgccctggccaagatggccaccgccagaaagagagcccagaccatcagattcagctacttcgccctgatcggcatgagagacggcaagctgtgcctgatgtggagaatcggcgacttcagacccaaccacgtggtggagggcaccgtgagagcccagctgctgagatacaccgaggacagcgagggcagaatgaccatggccttcaaggacctgaagctggtgaacgaccagatcatcctggtgacccccgtgaccatcgtgcacgagatcgaccacgagagccccctgtacgccctggacagaaaggccgtggccaaggacaacttcgagatcctggtgaccttcatctacaccggcgacagcaccggcaccagccaccagagcagaagcagctacgtgcccagagagatcctgtggggccacagattcaacgacgtgctggaggtgaagagaaagtactacaaggtgaactgcctgcagttcgagggcagcgtggaggtgtacgcccccttctgcagcgccaagcagctggactggaaggaccagcagctgcacatcgagaaggccccccccgtgagagagagctgcaccagcgacaccaaggccagaagaagaagcttcagcgccgtggccatcgtgagcagctgcgagaaccccgaggagaccaccaccagcgccacccacgagtacagagagaccccctaccagaaggccctgctgaccctgaacagaatcagcgtggagagccagatgtag

SEQ ID NO: 94035 - DNA, 1119 bp, Artificial Sequence; identical to SEQ ID NO: 94030
  Description of Artificial Sequence: Synthetic coding sequence

SEQ ID NO: 94036 - DNA, 1176 bp, Artificial Sequence
  Description of Artificial Sequence: Synthetic coding sequence
atgaacgccagcagcagaaacgtgttcgacaccctgatcagagtgctgaccgagagcatgttcaagcacctgagaaagtgggtggtgaccagattcttcggccacagcagacagagagccagactggtgagcaaggacggcagatgcaacatcgagttcggcaacgtggaggcccagagcagattcatcttcttcgtggacatctggaccaccgtgctggacctgaagtggagatacaagatgaccatcttcatcaccgccttcctgggcagctggttcttcttcggcctgctgtggtacgccgtggcctacatccacaaggacctgcccgagttccaccccagcgccaaccacaccccctgcgtggagaacatcaacggcctgaccagcgccttcctgttcagcctggagacccaggtgaccatcggctacggcttcagatgcgtgaccgagcagtgcgccaccgccatcttcctgctgatcttccagagcatcctgggcgtgatcatcaacagcttcatgtgcggcgccatcctggccaagatcagcagacccaagaagagagccaagaccatcaccttcagcaagaacgccgtgatcagcaagagaggcggcaagctgtgcctgctgatcagagtggccaacctgagaaagagcctgctgatcggcagccacatctacggcaagctgctgaagaccaccgtgacccccgagggcgagaccatcatcctggaccagatcaacatcaacttcgtggtggacgccggcaacgagaacctgttcttcatcagccccctgaccatctaccacgtgatcgaccacaacagccccttcttccacatggccgccgagaccctgctgcagcaggacttcgagctggtggtgttcctggacggcaccgtggagagcaccagcgccacctgccaggtgagaaccagctacgtgcccgaggaggtgctgtggggctacagattcgcccccatcgtgagcaagaccaaggagggcaagtacagagtggacttccacaacttcagcaagaccgtggaggtggagaccccccactgcgccatgtgcctgtacaacgagaaggacgtgagagccagaatgaagagaggctacgacaaccccaacttcatcctgagcgaggtgaacgagaccgacgacaccaagatgtag

SEQ ID NO: 94037 - DNA, 1119 bp, Artificial Sequence; identical to SEQ ID NO: 94030
  Description of Artificial Sequence: Synthetic coding sequence

SEQ ID NO: 94038 - DNA, 1140 bp, Artificial Sequence
  Description of Artificial Sequence: Synthetic coding sequence
atgaccagcgtggccaaggtgtactacagccagaccacccagaccgagagcagacccctgatgggccccggcatcagaagaagaagagtgctgaccaaggacggcagaagcaacgtgagaatggagcacatcgccgacaagagattcctgtacctgaaggacctgtggaccaccttcatcgacatgcagtggagatacaagctgctgctgttcagcgccaccttcgccggcacctggttcctgttcggcgtggtgtggtacctggtggccgtggcccacggcgacctgctggagctggacccccccgccaaccacaccccctgcgtggtgcaggtgcacaccctgaccggcgccttcctgttcagcctggagagccagaccaccatcggctacggcttcagatacatcagcgaggagtgccccctggccatcgtgctgctgatcgcccagctggtgctgaccaccatcctggagatcttcatcaccggcaccttcctggccaagatcgccagacccaagaagagagccgagaccatcagattcagccagcacgccgtggtggccagccacaacggcaagccctgcctgatgatcagagtggccaacatgagaaagagcctgctgatcggctgccaggtgaccggcaagctgctgcagacccaccagaccaaggagggcgagaacatcagactgaaccaggtgaacgtgaccttccaggtggacaccgccagcgacagccccttcctgatcctgcccctgaccttctaccacgtggtggacgagaccagccccctgaaggacctgcccctgagaagcggcgagggcgacttcgagctggtgctgatcctgagcggcaccgtggagagcaccagcgccacctgccaggtgagaaccagctacctgcccgaggagatcctgtggggctacgagttcacccccgccatcagcctgagcgccagcggcaagtacatcgccgacttcagcctgttcgaccaggtggtgaaggtggccagccccagcggcctgagagacagcaccgtgagatacggcgaccccgagaagctgaagctggaggagagcctgagagagcaggccgagaaggagggcagcgccctgagcgtgagaatcagcaacgtgtag

SEQ ID NO: 94039 - DNA, 1173 bp, Artificial Sequence
  Description of Artificial Sequence: Synthetic coding sequence
atgctgagcagaaagggcatcatccccgaggagtacgtgctgaccagactggccgaggaccccgccaagcccagatacagagccagacagagaagagccagattcgtgagcaagaagggcaactgcaacgtggcccacaagaacatcagagagcagggcagattcctgcaggacgtgttcaccaccctggtggacctgaagtggccccacaccctgctgatcttcaccatgagcttcctgtgcagctggctgctgttcgccatggcctggtggctgatcgccttcgcccacggcgacctggcccccagcgagggcaccgccgagccctgcgtgaccagcatccacagcttcagcagcgccttcctgttcagcatcgaggtgcaggtgaccatcggcttcggcggcagaatggtgaccgaggagtgccccctggccatcctgatcctgatcgtgcagaacatcgtgggcctgatgatcaacgccatcatgctgggctgcatcttcatgaagaccgcccaggcccacagaagagccgagaccctgatcttcagcaagcacgccgtgatcgccctgagacacggcagactgtgcttcatgctgagagtgggcgacctgagaaagagcatgatcatcagcgccaccatccacatgcaggtggtgagaaagaccaccagccccgagggcgaggtggtgcccctgcaccaggtggacatccccatggagaacggcgtgggcggcaacagcatcttcctggtggcccccctgatcatctaccacgtgatcgacgccaacagccccctgtacgacctggcccccagcgacctgcaccaccaccaggacctggagatcatcgtgatcctggagggcgtggtggagaccaccggcatcaccacccaggccagaaccagctacctggccgacgagatcctgtggggccagagattcgtgcccatcgtggccgaggaggacggcagatacagcgtggactacagcaagttcggcaacaccgtgaaggtgcccacccccctgtgcaccgccagacagctggacgaggaccacagcctgctggaggccctgaccctggccagcgccagaggccccctgagaaagagaagcgtgcccatggccaaggccaagcccaagttcagcatcagccccgacagcctgagctag

SEQ ID NO: 94040 - DNA, 1302 bp, Artificial Sequence; identical to SEQ ID NO: 94033
  Description of Artificial Sequence: Synthetic coding sequence

SEQ ID NO: 94041 - DNA, 819 bp, Artificial Sequence
  Description of Artificial Sequence: Synthetic coding sequence
atggtgctgctgaccgccgtgctgctgctgctggccgcctacgccggccccgcccagagcctgggcagcttcgtgcactgcgagccctgcgacgagaaggccctgagcatgtgcccccccagccccctgggctgcgagctggtgaaggagcccggctgcggctgctgcatgacctgcgccctggccgagggccagagctgcggcgtgtacaccgagagatgcgcccagggcctgagatgcctgcccagacaggacgaggagaagcccctgcacgccctgctgcacggcagaggcgtgtgcctgaacgagaagagctacagagagcaggtgaagatcgagagagacagcagagagcacgaggagcccaccaccagcgagatggccgaggagacctacagccccaagatcttcagacccaagcacaccagaatcagcgagctgaaggccgaggccgtgaagaaggacagaagaaagaagctgacccagagcaagttcgtgggcggcgccgagaacaccgcccaccccagaatcatcagcgcccccgagatgagacaggagagcgagcagggcccctgcagaagacacatggaggccagcctgcaggagctgaaggccagccccagaatggtgcccagagccgtgtacctgcccaactgcgacagaaagggcttctacaagagaaagcagtgcaagcccagcagaggcagaaagagaggcatctgctggtgcgtggacaagtacggcatgaagctgcccggcatggagtacgtggacggcgacttccagtgccacaccttcgacagcagcaacgtggagtag

SEQ ID NO: 94042 - DNA, 285 bp, Artificial Sequence
  Description of Artificial Sequence: Synthetic coding sequence
atggacagcagcaactgcaaggtgatcgcccccctgctgagccagagatacagaagaatggtgaccaaggacggccacagcaccctgcagatggacggcgcccagagaggcctggcctacctgagagacgcctggggcatcctgatggacatgagatggagatggatgatgctggtgttcagcgccagcttcgtggtgcactggctggtgttcgccgtgctgtggtgcttctgcggcgaggactgccccgccaagaagagcagcttcttcaacagcctgtactag

SEQ ID NO: 94043 - DNA, 1083 bp, Artificial Sequence; identical to SEQ ID NO: 82685
  Description of Artificial Sequence: Synthetic coding sequence

SEQ ID NO: 94044 - DNA, 1128 bp, Artificial Sequence
  Description of Artificial Sequence: Synthetic coding sequence
atggacgccatccacatcggcatgagcagcacccccctggtgaagcacaccgccggcgccggcctgaaggccaacagacccagagtgatgagcaagagcggccacagcaacgtgagaatcgacaaggtggacggcatctacctgctgtacctgcaggacctgtggaccaccgtgatcgacatgaagtggagatacaagctgaccctgttcgccgccaccttcgtgatgacctggttcctgttcggcgtgatctactacgccatcgccttcatccacggcgacctggagcccggcgagcccatcagcaaccacaccccctgcatcatgaaggtggacagcctgaccggcgccttcctgttcagcctggagagccagaccaccatcggctacggcgtgagaagcatcaccgaggagtgcccccacgccatcttcctgctggtggcccagctggtgatcaccaccctgatcgagatcttcatcaccggcaccttcctggccaagatcgccagacccaagaagagagccgagaccatcaagttcagccactgcgccgtgatcaccaagcagaacggcaagctgtgcctggtgatccaggtggccaacatgagaaagagcctgctgatccagtgccagctgagcggcaagctgctgcagacccacgtgaccaaggagggcgagagaatcctgctgaaccaggccaccgtgaagttccacgtggacagcagcagcgagagccccttcctgatcctgcccatgaccttctaccacgtgctggacgagaccagccccctgagagacctgaccccccagaacctgaaggagaaggagttcgagctggtggtgctgctgaacgccaccgtggagagcaccagcgccgtgtgccagagcagaaccagctacatccccgaggagatctactggggcttcgagttcgtgcccgtggtgagcctgagcaagaacggcaagtacgtggccgacttcagccagttcgagcagatcagaaagagccccgactgcaccttctactgcgccgacagcgagaagcagcagctggaggagaagtacagacaggaggaccagagagagagagagctgagaaccctgctgctgcagcagagcaacgtgtag

SEQ ID NO: 94045 - DNA, 186 bp, Artificial Sequence
  Description of Artificial Sequence: Synthetic coding sequence
atggacgccatccacatcggcatgagcagcacccccctggtgaagcacaccgccggcgccggcctgaaggccaacagacccagagtgatgagcaagagcggccacagcaacgtgagaatcgacaaggtggacggcatctacctgctgtacctgcaggacctgtggaccaccgtgatcgacatgtag

SEQ ID NO: 94046 - DNA, 471 bp, Artificial Sequence
  Description of Artificial Sequence: Synthetic coding sequence
atggacgccatccacatcggcatgagcagcacccccctggtgaagcacaccgccggcgccggcctgaaggccaacagacccagagtgatgagcaagagcggccacagcaacgtgagaatcgacaaggtggacggcatctacctgctgtacctgcaggacctgtggaccaccgtgatcgacatgaagtggagatacaagctgaccctgttcgccgccaccttcgtgatgacctggttcctgttcggcgtgatctactacgccatcgccttcatccacggcgacctggagcccggcgagcccatcagcaaccacaccccctgcatcatgaaggtggacagcctgaccggcgccttcctgttcagcctggagagccagaccaccatcggctacggcgtgagaagcatcaccgaggagtgcccccacgccatcttcctgctggtggcccagctggtgatcaccaccctgatctag

SEQ ID NO: 94047 - DNA, 471 bp, Artificial Sequence; identical to SEQ ID NO: 94046
  Description of Artificial Sequence: Synthetic coding sequence

SEQ ID NO: 94048 - DNA, 1128 bp, Artificial Sequence; identical to SEQ ID NO: 94044
  Description of Artificial Sequence: Synthetic coding sequence

SEQ ID NO: 94049 - DNA, 1128 bp, Artificial Sequence; identical to SEQ ID NO: 94044
  Description of Artificial Sequence: Synthetic coding sequence

SEQ ID NO: 94050 - DNA, 1128 bp, Artificial Sequence; identical to SEQ ID NO: 94044
  Description of Artificial Sequence: Synthetic coding sequence

SEQ ID NO: 94051 - DNA, 1128 bp, Artificial Sequence; identical to SEQ ID NO: 94044
  Description of Artificial Sequence: Synthetic coding sequence

SEQ ID NO: 94052 - DNA, 60 bp, Artificial Sequence
  Description of Artificial Sequence: Synthetic coding sequence
atggacgccatccacatcggcatgagcagcacccccctggtgaagcacaccgccggctag

SEQ ID NO: 94053 - DNA, 420 bp, Artificial Sequence
  Description of Artificial Sequence: Synthetic coding sequence
atggacgccatccacatcggcatgagcagcacccccctggtgaagcacaccgccggcgccggcctgaaggccaacagacccagagtgatgagcaagagcggccacagcaacgtgagaatcgacaaggtggacggcatctacctgctgtacctgcaggacctgtggaccaccgtgatcgacatgaagtggagatacaagctgaccctgttcgccgccaccttcgtgatgacctggttcctgttcggcgtgatctactacgccatcgccttcatccacggcgacctggagcccggcgagcccatcagcaaccacaccccctgcatcatgaaggtggacagcctgaccggcgccttcctgttcagcctggagagccagaccaccatcggctacggcgtgagaagcatcaccgaggagtgctag

SEQ ID NO: 94054 - DNA, 738 bp, Artificial Sequence
  Description of Artificial Sequence: Synthetic coding sequence
atggacgccatccacatcggcatgagcagcacccccctggtgaagcacaccgccggcgccggcctgaaggccaacagacccagagtgatgagcaagagcggccacagcaacgtgagaatcgacaaggtggacggcatctacctgctgtacctgcaggacctgtggaccaccgtgatcgacatgaagtggagatacaagctgaccctgttcgccgccaccttcgtgatgacctggttcctgttcggcgtgatctactacgccatcgccttcatccacggcgacctggagcccggcgagcccatcagcaaccacaccccctgcatcatgaaggtggacagcctgaccggcgccttcctgttcagcctggagagccagaccaccatcggctacggcgtgagaagcatcaccgaggagtgcccccacgccatcttcctgctggtggcccagctggtgatcaccaccctgatcgagatcttcatcaccggcaccttcctggccaagatcgccagacccaagaagagagccgagaccatcaagttcagccactgcgccgtgatcaccaagcagaacggcaagctgtgcctggtgatccaggtggccaacatgagaaagagcctgctgatccagtgccagctgagcggcaagctgctgcagacccacgtgaccaaggagggcgagagaatcctgctgaaccaggccaccgtgaagttccacgtggacagcagcagcgagagctag

SEQ ID NO: 94055 - DNA, 120 bp, Artificial Sequence
  Description of Artificial Sequence: Synthetic coding sequence
atggacgccatccacatcggcatgagcagcacccccctggtgaagcacaccgccggcgccggcctgaaggccaacagacccagagtgatgagcaagagcggccacagcaacgtgagatag

SEQ ID NO: 94056 - DNA, 147 bp, Artificial Sequence
  Description of Artificial Sequence: Synthetic coding sequence
atggacgccatccacatcggcatgagcagcacccccctggtgaagcacaccgccggcgccggcctgaaggccaacagacccagagtgatgagcaagagcggccacagcaacgtgagaatcgacaaggtggacggcatctacctgtag

SEQ ID NO: 94057 - DNA, 147 bp, Artificial Sequence; identical to SEQ ID NO: 94056
  Description of Artificial Sequence: Synthetic coding sequence

SEQ ID NO: 94058 - DNA, 147 bp, Artificial Sequence; identical to SEQ ID NO: 94056
  Description of Artificial Sequence: Synthetic coding sequence

SEQ ID NO: 94059 - DNA, 78 bp, Artificial Sequence
  Description of Artificial Sequence: Synthetic coding sequence
atggacgccatccacatcggcatgagcagcacccccctggtgaagcacaccgccggcgccggcctgaaggccaactag

SEQ ID NO: 94060 - DNA, 147 bp, Artificial Sequence; identical to SEQ ID NO: 94056
  Description of Artificial Sequence: Synthetic coding sequence

SEQ ID NO: 94061 - DNA, 147 bp, Artificial Sequence; identical to SEQ ID NO: 94056
  Description of Artificial Sequence: Synthetic coding sequence

SEQ ID NO: 94062 - DNA, 147 bp, Artificial Sequence; identical to SEQ ID NO: 94056
  Description of Artificial Sequence: Synthetic coding sequence

SEQ ID NO: 94063 - DNA, 1257 bp, Artificial Sequence; identical to SEQ ID NO: 94034
  Description of Artificial Sequence: Synthetic coding sequence

SEQ ID NO: 94064 - DNA, 1257 bp, Artificial Sequence; identical to SEQ ID NO: 94034
  Description of Artificial Sequence: Synthetic coding sequence

SEQ ID NO: 94065 - DNA, 1257 bp, Artificial Sequence; identical to SEQ ID NO: 94034
  Description of Artificial Sequence: Synthetic coding sequence

SEQ ID NO: 94066 - DNA, 1284 bp, Artificial Sequence
  Description of Artificial Sequence: Synthetic coding sequence
atgggcagcgtgagaaccaacagatacagcatcgtgagcagcgaggaggacggcatgaagctggccaccatggccgtggccaacggcttcggcaacggcaagagcaaggtgcacaccagacagcagtgcagaagcagattcgtgaagaaggacggccactgcaacgtgcagttcatcaacgtgggcgagaagggccagagatacctggccgacatcttcaccacctgcgtggacatcagatggagatggatgctggtgatcttctgcctggccttcgtgctgagctggctgttcttcggctgcgtgttctggctgatcgccctgctgcacggcgacctggacgccagcaaggagggcaaggcctgcgtgagcgaggtgaacagcttcaccgccgccttcctgttcagcatcgagacccagaccaccatcggctacggcttcagatgcgtgaccgacgagtgccccatcgccgtgttcatggtggtgttccagagcatcgtgggctgcatcatcgacgccttcatcatcggcgccgtgatggccaagatggccaagcccaagaagagaaacgagaccctggtgttcagccacaacgccgtgatcgccatgagagacggcaagctgtgcctgatgtggagagtgggcaacctgagaaagagccacctggtggaggcccacgtgagagcccagctgctgaagagcagaatcaccagcgagggcgagtacatccccctggaccagatcgacatcaacgtgggcttcgacagcggcatcgacagaatcttcctggtgagccccatcaccatcgtgcacgagatcgacgaggacagccccctgtacgacctgagcaagcaggacatcgacaacgccgacttcgagatcgtggtgatcctggagggcatggtggaggccaccgccatgaccacccagtgcagaagcagctacctggccaacgagatcctgtggggccacagatacgagcccgtgctgttcgaggagaagcactactacaaggtggactacagcagattccacaagacctacgaggtgcccaacacccccctgtgcagcgccagagacctggccgagaagaagtacatcctgagcaacgccaacagcttctgctacgagaacgaggtggccctgaccagcaaggaggaggacgacagcgagaacggcgtgcccgagagcaccagcaccgacaccccccccgacatcgacctgcacaaccaggccagcgtgcccctggagcccagacccctgagaagagagagcgagatctag

SEQ ID NO: 94067 - DNA, 1284 bp, Artificial Sequence; identical to SEQ ID NO: 94066
  Description of Artificial Sequence: Synthetic coding sequence

SEQ ID NO: 94068 - DNA, 1506 bp, Artificial Sequence
  Description of Artificial Sequence: Synthetic coding sequence
atgagcgccctgagaagaaagttcggcgacgactaccaggtggtgaccaccagcagcagcggcagcggcctgcagccccagggccccggccaggacccccagcagcagctggtgcccaagaagaagagacagagattcgtggacaagaacggcagatgcaacgtgcagcacggcaacctgggcagcgagaccagcagatacctgagcgacctgttcaccaccctggtggacctgaagtggagatggaacctgttcatcttcatcctgacctacaccgtggcctggctgttcatggccagcatgtggtgggtgatcgcctacaccagaggcgacctgaacaaggcccacgtgggcaactacaccccctgcgtggccaacgtgtacaacttccccagcgccttcctgttcttcatcgagaccgaggccaccatcggctacggctacagatacatcaccgacaagtgccccgagggcatcatcctgttcctgttccagagcatcctgggcagcatcgtggacgccttcctgatcggctgcatgttcatcaagatgagccagcccaagaagagagccgagaccctgatgttcagcgagcacgccgtgatcagcatgagagacggcaagctgaccctgatgttcagagtgggcaacctgagaaacagccacatggtgagcgcccagatcagatgcaagctgctgaagagcagacagacccccgagggcgagttcctgcccctggaccagctggagctggacgtgggcttcagcaccggcgccgaccagctgttcctggtgagccccctgaccatctgccacgtgatcgacgccaagagccccttctacgacctgagccagagaagcatgcagaccgagcagttcgagatcgtggtgatcctggagggcatcgtggagaccaccggcatgacctgccaggccagaaccagctacaccgaggacgaggtgctgtggggccacagattcttccccgtgatcagcctggaggagggcttcttcaaggtggactacagccagttccacgccaccttcgaggtgcccacccccccctacagcgtgaaggagcaggaggagatgctgctgatgagcagccccctgatcgcccccgccatcaccaacagcaaggagagacacaacagcgtggagtgcctggacggcctggacgacatcaccaccaagctgcccagcaagctgcagaagatcaccggcagagaggacttccccaagaagctgctgagaatgagcagcaccaccagcgagaaggcctacagcctgggcgacctgcccatgaagctgcagagaatcagcagcgtgcccggcaacagcgaggagaagctggtgagcaagaccaccaagatgctgagcgaccccatgagccagagcgtggccgacctgccccccaagctgcagaagatggccggcggcgccgccagaatggagggcaacctgcccgccaagctgagaaagatgaacagcgacagattcacctag

SEQ ID NO: 94069 - DNA, 708 bp, Artificial Sequence
  Description of Artificial Sequence: Synthetic coding sequence
atgagcgccctgagaagaaagttcggcgacgactaccaggtggtgaccaccagcagcagcggcagcggcctgcagccccagggccccggccaggacccccagcagcagctggtgcccaagaagaagagacagagattcgtggacaagaacggcagatgcaacgtgcagcacggcaacctgggcagcgagaccagcagatacctgagcgacctgttcaccaccctggtggacctgaagtggagatggaacctgttcatcttcatcctgacctacaccgtggcctggctgttcatggccagcatgtggtgggtgatcgcctacaccagaggcgacctgaacaaggcccacgtgggcaactacaccccctgcgtggccaacgtgtacaacttccccagcgccttcctgttcttcatcgagaccgaggccaccatcggctacggctacagatacatcaccgacaagtgccccgagggcatcatcctgttcctgttccagagcatcctgggcagcatcgtggacgccttcctgatcggctgcatgttcatcaagatgagccagcccaagaagagagccgagaccctgatgttcagcgagcacgccgtgatcagcatgagagacggcaagctgaccctgatgttcagagtgggcaacctgagaaacagccacatggtgagcgcccagatcagatgcaagctgctgaagggctag

SEQ ID NO: 94070 - DNA, 1338 bp, Artificial Sequence
  Description of Artificial Sequence: Synthetic coding sequence
atgcacggccacagcagaaacggccaggcccacgtgcccagaagaaagagaagaaacagattcgtgaagaagaacggccagtgcaacgtgtacttcgccaacctgagcaacaagagccagagatacatggccgacatcttcaccacctgcgtggacaccagatggagatacatgctgatgatcttcagcgccgccttcctggtgagctggctgttcttcggcctgctgttctggtgcatcgccttcttccacggcgacctggaggccagccccggcgtgcccgccgccggcggccccgccgccggcggcggcggcgccgcccccgtggcccccaagccctgcatcatgcacgtgaacggcttcctgggcgccttcctgttcagcgtggagacccagaccaccatcggctacggcttcagatgcgtgaccgaggagtgccccctggccgtgatcgccgtggtggtgcagagcatcgtgggctgcgtgatcgacagcttcatgatcggcaccatcatggccaagatggccagacccaagaagagagcccagaccctgctgttcagccaccacgccgtgatcagcgtgagagacggcaagctgtgcctgatgtggagagtgggcaacctgagaaagagccacatcgtggaggcccacgtgagagcccagctgatcaagccctacatgacccaggagggcgagtacctgcccctggaccagagagacctgaacgtgggctacgacatcggcctggacagaatcttcctggtgagccccatcatcatcgtgcacgagatcgacgaggacagccccctgtacggcatgggcaaggaggagctggagagcgaggacttcgagatcgtggtgatcctggagggcatggtggaggccaccgccatgaccacccaggccagaagcagctacctggccagcgagatcctgtggggccacagattcgagcccgtggtgttcgaggagaagagccactacaaggtggactacagcagattccacaagacctacgaggtggccggcaccccctgctgcagcgccagagagctgcaggagagcaagatcaccgtgctgcccgcccccccccccccccccagcgccttctgctacgagaacgagctggccctgatgagccaggaggaggaggagatggaggaggaggccgccgccgccgccgccgtggccgccggcctgggcctggaggccggcagcaaggaggaggccggcatcatcagaatgctggagttcggcagccacctggacctggagagaatgcaggccagcctgcccctggacaacatcagctacagaagagagagcgccatctag

SEQ ID NO: 94071 - DNA, 1260 bp, Artificial Sequence
  Description of Artificial Sequence: Synthetic coding sequence
atggccggcgacagcagaaacgccatgaaccaggacatggagatcggcgtgaccccctgggaccccaagaagatccccaagcaggccagagactacgtgcccatcgccaccgacagaaccagactgctggccgagggcaagaagcccagacagagatacatggagaagagcggcaagtgcaacgtgcaccacggcaacgtgcaggagacctacagatacctgagcgacctgttcaccaccctggtggacctgaagtggagattcaacctgctggtgttcaccatggtgtacaccgtgacctggctgttcttcggcttcatctggtggctgatcgcctacatcagaggcgacctggaccacgtgggcgaccaggagtggatcccctgcgtggagaacctgagcggcttcgtgagcgccttcctgttcagcatcgagaccgagaccaccatcggctacggcttcagagtgatcaccgagaagtgccccgagggcatcatcctgctgctggtgcaggccatcctgggcagcatcgtgaacgccttcatggtgggctgcatgttcgtgaagatcagccagcccaagaagagagccgagaccctgatgttcagcaacaacgccgtgatcagcatgagagacgagaagctgtgcctgatgttcagagtgggcgacctgagaaacagccacatcgtggaggccagcatcagagccaagctgatcaagagcagacagaccaaggagggcgagttcatccccctgaaccagaccgacatcaacgtgggcttcgacaccggcgacgacagactgttcctggtgagccccctgatcatcagccacgagatcaaccagaagagccccttctgggagatgagccaggcccagctgcaccaggaggagttcgaggtggtggtgatcctggagggcatggtggaggccaccggcatgacctgccaggccagaagcagctacatggacaccgaggtgctgtggggccacagattcacccccgtgctgaccctggagaagggcttctacgaggtggactacaacaccttccacgacacctacgagaccaacacccccagctgctgcgccaaggagctggccgagatgaagagagagggcagactgctgcagtacctgcccagcccccccctgctgggcggctgcgccgaggccggcctggacgccgaggccgagcagaacgaggaggacgagcccaagggcctgggcggcagcagagaggccagaggcagcgtgtag

SEQ ID NO: 94072 - DNA, 1260 bp, Artificial Sequence; identical to SEQ ID NO: 94071
  Description of Artificial Sequence: Synthetic coding sequence

SEQ ID NO: 94073 - DNA, 1260 bp, Artificial Sequence; identical to SEQ ID NO: 94071
  Description of Artificial Sequence: Synthetic coding sequence

SEQ ID NO: 94074 - DNA, 1272 bp, Artificial Sequence
  Description of Artificial Sequence: Synthetic coding sequence
atggccaagctgaccgagagcatgaccaacgtgctggagggcgacagcatggaccaggacgtggagagccccgtggccatccaccagcccaagctgcccaagcaggccagagacgacctgcccagacacatcagcagagacagaaccaagagaaagatccagagatacgtgagaaaggacggcaagtgcaacgtgcaccacggcaacgtgagagagacctacagatacctgaccgacatcttcaccaccctggtggacctgaagtggagattcaacctgctgatcttcgtgatggtgtacaccgtgacctggctgttcttcggcatgatctggtggctgatcgcctacatcagaggcgacatggaccacatcgaggaccccagctggaccccctgcgtgaccaacctgaacggcttcgtgagcgccttcctgttcagcatcgagaccgagaccaccatcggctacggctacagagtgatcaccgacaagtgccccgagggcatcatcctgctgctgatccagagcgtgctgggcagcatcgtgaacgccttcatggtgggctgcatgttcgtgaagatcagccagcccaagaagagagccgagaccctggtgttcagcacccacgccgtgatcagcatgagagacggcaagctgtgcctgatgttcagagtgggcgacctgagaaacagccacatcgtggaggccagcatcagagccaagctgatcaagagcaagcagaccagcgagggcgagttcatccccctgaaccagaccgacatcaacgtgggctactacaccggcgacgacagactgttcctggtgagccccctgatcatcagccacgagatcaaccagcagagccccttctgggagatcagcaaggcccagctgcccaaggaggagctggagatcgtggtgatcctggagggcatggtggaggccaccggcatgacctgccaggccagaagcagctacatcaccagcgagatcctgtggggctacagattcacccccgtgctgaccctggaggacggcttctacgaggtggactacaacagcttccacgagacctacgagaccagcacccccagcctgagcgccaaggagctggccgagctggccagcagagccgagctgcccctgagctggagcgtgagcagcaagctgaaccagcacgccgagctggagaccgaggaggaggagaagaacctggaggagcagaccgagagaaacggcgacgtggccaacctggagaacgagagcaaggtgtag

SEQ ID NO: 94075 - DNA, 1272 bp, Artificial Sequence; identical to SEQ ID NO: 94074
  Description of Artificial Sequence: Synthetic coding sequence

SEQ ID NO: 94076 - DNA, 1275 bp, Artificial Sequence
  Description of Artificial Sequence: Synthetic coding sequence
atgctggccagaaagagcatcatccccgaggagtacgtgctggccagaatcgccgccgagaacctgagaaagcccagaatcagagacagactgcccaaggccagattcatcgccaagagcggcgcctgcaacctggcccacaagaacatcagagagcagggcagattcctgcaggacatcttcaccaccctggtggacctgaagtggagacacaccctggtgatcttcaccatgagcttcctgtgcagctggctgctgttcgccatcatgtggtggctggtggccttcgcccacggcgacatctacgcctacatggagaagagcggcatggagaagagcggcctggagagcaccgtgtgcgtgaccaacgtgagaagcttcaccagcgccttcctgttcagcatcgaggtgcaggtgaccatcggcttcggcggcagaatgatgaccgaggagtgccccctggccatcaccgtgctgatcctgcagaacatcgtgggcctgatcatcaacgccgtgatgctgggctgcatcttcatgaagaccgcccaggcccacagaagagccgagaccctgatcttcagcagacacgccgtgatcgccgtgagaaacggcaagctgtgcttcatgttcagagtgggcgacctgagaaagagcatgatcatcagcgccagcgtgagaatccaggtggtgaagaagaccaccacccccgagggcgaggtggtgcccatccaccagctggacatccccgtggacaaccccatcgagagcaacaacatcttcctggtggcccccctgatcatctgccacgtgatcgacaagagaagccccctgtacgacatcagcgccaccgacctggccaaccaggacctggaggtgatcgtgatcctggagggcgtggtggagaccaccggcatcaccacccaggccagaaccagctacatcgccgaggagatccagtggggccacagattcgtgagcatcgtgaccgaggaggagggcgtgtacagcgtggactacagcaagttcggcaacaccgtgaaggtggccgcccccagatgcagcgccagagagctggacgagaagcccagcatcctgatccagaccctgcagaagagcgagctgagccaccagaacagcctgagaaagagaaacagcatgagaagaaacaacagcatgagaagaaacaacagcatcagaagaaacaacagcagcctgatggtgcccaaggtgcagttcatgacccccgagggcaaccagaacaccagcgagagctag

SEQ ID NO: 94077 - DNA, 345 bp, Artificial Sequence
  Description of Artificial Sequence: Synthetic coding sequence
atgctggccagaaagagcatcatccccgaggagtacgtgctggccagaatcgccgccgagaacctgagaaagcccagaatcagagacagactgcccaaggccagattcatcgccaagagcggcgcctgcaacctggcccacaagaacatcagagagcagggcagattcctgcaggacatcttcaccaccctggtggacctgaagtggagacacaccctggtgatcttcaccatgagcttcctgtgcagctggctgctgttcgccatcatgtggtggctggtggccttcgcccacggcgacatctacgcctacatggagaagagcggcatggagaagagcggctag

SEQ ID NO: 94078 - DNA, 1275 bp, Artificial Sequence; identical to SEQ ID NO: 94076
  Description of Artificial Sequence: Synthetic coding sequence

SEQ ID NO: 94079 - DNA, 774 bp, Artificial Sequence
  Description of Artificial Sequence: Synthetic coding sequence
atgaccgccttccccgccagcggcaagaagagagagaccgactacagcgacggcgaccccctggacgtgcacaagagactgcccagcagcgccggcgaggacagagccgtgatgctgggcttcgccatgatgggcttcagcgtgctgatgttcttcctgctgggcaccaccatcctgaagcccttcatgctgagcatccagagagaggagagcacctgcaccgccatccacaccgacatcatggacgactggctggactgcgccttcacctgcggcgtgcactgccacggccagggcaagtacccctgcctgcaggtgttcgtgaacctgagccaccccggccagaaggccctgctgcactacaacgaggaggccgtgcagatcaaccccaagtgcttctacacccccaagtgccaccaggacagaaacgacctgctgaacagcgccctggacatcaaggagttcttcgaccacaagaacggcacccccttcagctgcttctacagccccgccagccagagcgaggacgtgatcctgatcaagaagtacgaccagatggccatcttccactgcctgttctggcccagcctgaccctgctgggcggcgccctgatcgtgggcatggtgagactgacccagcacctgagcctgctgtgcgagaagtacagcaccgtggtgagagacgaggtgggcggcaaggtgccctacatcgagcagcaccagttcaagctgtgcatcatgagaagaagcaagggcagagccgagaagagctag

SEQ ID NO: 94080 - DNA, 522 bp, Artificial Sequence
  Description of Artificial Sequence: Synthetic coding sequence
atgcagcccttcagcatccccgtgcagatcaccctgcagggcagcagaagaagacagggcagaaccgccttccccgccagcggcaagaagagagagaccgactacagcgacggcgaccccctggacgtgcacaagagactgcccagcagcgccggcgaggacagagccgtgatgctgggcttcgccatgatgggcttcagcgtgctgatgttcttcctgctgggcaccaccatcctgaagcccttcatgctgagcatccagagagaggagagcacctgcaccgccatccacaccgacatcatggacgactggctggactgcgccttcacctgcggcgtgcactgccacggccagggcaagtacccctgcctgcaggtgttcgtgaacctgagccaccccggccagaaggccctgctgcactacaacgaggaggccgtgcagatcaaccccaagagagacgtgaccgactgcagagtgaaggagaagcagaccctgaccgtgagcgacgagcacaagcagtag

SEQ ID NO: 94081 - DNA, 840 bp, Artificial Sequence
  Description of Artificial Sequence: Synthetic coding sequence
atggacttcagccccagcagcgagctgggcttccacttcgtggccttcatcctgctgaccagacacagaaccgccttccccgccagcggcaagaagagagagaccgactacagcgacggcgaccccctggacgtgcacaagagactgcccagcagcgccggcgaggacagagccgtgatgctgggcttcgccatgatgggcttcagcgtgctgatgttcttcctgctgggcaccaccatcctgaagcccttcatgctgagcatccagagagaggagagcacctgcaccgccatccacaccgacatcatggacgactggctggactgcgccttcacctgcggcgtgcactgccacggccagggcaagtacccctgcctgcaggtgttcgtgaacctgagccaccccggccagaaggccctgctgcactacaacgaggaggccgtgcagatcaaccccaagtgcttctacacccccaagtgccaccaggacagaaacgacctgctgaacagcgccctggacatcaaggagttcttcgaccacaagaacggcacccccttcagctgcttctacagccccgccagccagagcgaggacgtgatcctgatcaagaagtacgaccagatggccatcttccactgcctgttctggcccagcctgaccctgctgggcggcgccctgatcgtgggcatggtgagactgacccagcacctgagcctgctgtgcgagaagtacagcaccgtggtgagagacgaggtgggcggcaaggtgccctacatcgagcagcaccagttcaagctgtgcatcatgagaagaagcaagggcagagccgagaagagctag

SEQ ID NO: 94082 - DNA, 834 bp, Artificial Sequence
  Description of Artificial Sequence: Synthetic coding sequence
atgcagcccttcagcatccccgtgcagatcaccctgcagggcagcagaagaagacagggcagaaccgccttccccgccagcggcaagaagagagagaccgactacagcgacggcgaccccctggacgtgcacaagagactgcccagcagcgccggcgaggacagagccgtgatgctgggcttcgccatgatgggcttcagcgtgctgatgttcttcctgctgggcaccaccatcctgaagcccttcatgctgagcatccagagagaggagagcacctgcaccgccatccacaccgacatcatggacgactggctggactgcgccttcacctgcggcgtgcactgccacggccagggcaagtacccctgcctgcaggtgttcgtgaacctgagccaccccggccagaaggccctgctgcactacaacgaggaggccgtgcagatcaaccccaagtgcttctacacccccaagtgccaccaggacagaaacgacctgctgaacagcgccctggacatcaaggagttcttcgaccacaagaacggcacccccttcagctgcttctacagccccgccagccagagcgaggacgtgatcctgatcaagaagtacgaccagatggccatcttccactgcctgttctggcccagcctgaccctgctgggcggcgccctgatcgtgggcatggtgagactgacccagcacctgagcctgctgtgcgagaagtacagcaccgtggtgagagacgaggtgggcggcaaggtgccctacatcgagcagcaccagttcaagctgtgcatcatgagaagaagcaagggcagagccgagaagagctag

SEQ ID NO: 94083 - DNA, 828 bp, Artificial Sequence
  Description of Artificial Sequence: Synthetic coding sequence
atgttccccctgctgtacgagctgaccgccgtgagccccagccccttcccccagagaaccgccttccccgccagcggcaagaagagagagaccgactacagcgacggcgaccccctggacgtgcacaagagactgcccagcagcgccggcgaggacagagccgtgatgctgggcttcgccatgatgggcttcagcgtgctgatgttcttcctgctgggcaccaccatcctgaagcccttcatgctgagcatccagagagaggagagcacctgcaccgccatccacaccgacatcatggacgactggctggactgcgccttcacctgcggcgtgcactgccacggccagggcaagtacccctgcctgcaggtgttcgtgaacctgagccaccccggccagaaggccctgctgcactacaacgaggaggccgtgcagatcaaccccaagtgcttctacacccccaagtgccaccaggacagaaacgacctgctgaacagcgccctggacatcaaggagttcttcgaccacaagaacggcacccccttcagctgcttctacagccccgccagccagagcgaggacgtgatcctgatcaagaagtacgaccagatggccatcttccactgcctgttctggcccagcctgaccctgctgggcggcgccctgatcgtgggcatggtgagactgacccagcacctgagcctgctgtgcgagaagtacagcaccgtggtgagagacgaggtgggcggcaaggtgccctacatcgagcagcaccagttcaagctgtgcatcatgagaagaagcaagggcagagccgagaagagctag

SEQ ID NO: 94084 - DNA, 774 bp, Artificial Sequence; identical to SEQ ID NO: 94079
  Description of Artificial Sequence: Synthetic coding sequence

SEQ ID NO: 94085 - DNA, 3537 bp, Artificial Sequence
  Description of Artificial Sequence: Synthetic coding sequence
atggccaacggcggcggcggcggcggcggcagcagcggcggcggcggcggcggcggcggcagcagcctgagaatgagcagcaacatccacgccaaccacctgagcctggacgccagcagcagcagcagcagcagcagcagcagcagcagcagcagcagcagcagcagcagcagcagcagcgtgcacgagcccaagatggacgccctgatcatccccgtgaccatggaggtgccctgcgacagcagaggccagagaatgtggtgggccttcctggccagcagcatggtgaccttcttcggcggcctgttcatcatcctgctgtggagaaccctgaagtacctgtggaccgtgtgctgccactgcggcggcaagaccaaggaggcccagaagatcaacaacggcagcagccaggccgacggcaccctgaagcccgtggacgagaaggaggaggccgtggccgccgaggtgggctggatgaccagcgtgaaggactgggccggcgtgatgatcagcgcccagaccctgaccggcagagtgctggtggtgctggtgttcgccctgagcatcggcgccctggtgatctacttcatcgacagcagcaaccccatcgagagctgccagaacttctacaaggacttcaccctgcagatcgacatggccttcaacgtgttcttcctgctgtacttcggcctgagattcatcgccgccaacgacaagctgtggttctggctggaggtgaacagcgtggtggacttcttcaccgtgccccccgtgttcgtgagcgtgtacctgaacagaagctggctgggcctgagattcctgagagccctgagactgatccagttcagcgagatcctgcagttcctgaacatcctgaagaccagcaacagcatcaagctggtgaacctgctgagcatcttcatcagcacctggctgaccgccgccggcttcatccacctggtggagaacagcggcgacccctgggagaacttccagaacaaccaggccctgacctactgggagtgcgtgtacctgctgatggtgaccatgagcaccgtgggctacggcgacgtgtacgccaagaccaccctgggcagactgttcatggtgttcttcatcctgggcggcctggccatgttcgccagctacgtgcccgagatcatcgagctgatcggcaacagaaagaagtacggcggcagctacagcgccgtgagcggcagaaagcacatcgtggtgtgcggccacatcaccctggagagcgtgagcaacttcctgaaggacttcctgcacaaggacagagacgacgtgaacgtggagatcgtgttcctgcacaacatcagccccaacctggagctggaggccctgttcaagagacacttcacccaggtggagttctaccagggcagcgtgctgaacccccacgacctggccagagtgaagatcgagagcgccgacgcctgcctgatcctggccaacaagtactgcgccgaccccgacgccgaggacgccagcaacatcatgagagtgatcagcatcaagaactaccaccccaagatcagaatcatcacccagatgctgcagtaccacaacaaggcccacctgctgaacatccccagctggaactggaaggagggcgacgacgccatctgcctggccgagctgaagctgggcttcatcgcccagagctgcctggcccagggcctgagcaccatgctggccaacctgttcagcatgagaagcttcatcaagatcgaggaggacacctggcagaagtactacctggagggcgtgagcaacgagatgtacaccgagtacctgagcagcgccttcgtgggcctgagcttccccaccgtgtgcgagctgtgcttcgtgaagctgaagctgctgatgatcgccatcgagtacaagagcgccaacagagagagcagaatcctgatcaaccccggcaaccacctgaagatccaggagggcaccctgggcttcttcatcgccagcgacgccaaggaggtgaagagagccttcttctactgcaaggcctgccacgacgacatcaccgaccccaagagaatcaagaagtgcggctgcaagagactggaggacgagcagcccagcaccctgagccccaagaagaagcagagaaacggcggcatgagaaacagccccaacaccagccccaagctgatgagacacgaccccctgctgatccccggcaacgaccagatcgacaacatggacagcaacgtgaagaagtacgacagcaccggcatgttccactggtgcgcccccaaggagatcgagaaggtgatcctgaccagaagcgaggccgccatgaccgtgctgagcggccacgtggtggtgtgcatcttcggcgacgtgagcagcgccctgatcggcctgagaaacctggtgatgcccctgagagccagcaacttccactaccacgagctgaagcacatcgtgttcgtgggcagcatcgagtacctgaagagagagtgggagaccctgcacaacttccccaaggtgagcatcctgcccggcacccccctgagcagagccgacctgagagccgtgaacatcaacctgtgcgacatgtgcgtgatcctgagcgccaaccagaacaacatcgacgacaccagcctgcaggacaaggagtgcatcctggccagcctgaacatcaagagcatgcagttcgacgacagcatcggcgtgctgcaggccaacagccagggcttcaccccccccggcatggacagaagcagccccgacaacagccccgtgcacggcatgctgagacagcccagcatcaccaccggcgtgaacatccccatcatcaccgagctggtgaacgacaccaacgtgcagttcctggaccaggacgacgacgacgaccccgacaccgagctgtacctgacccagcccttcgcctgcggcaccgccttcgccgtgagcgtgctggacagcctgatgagcgccacctacttcaacgacaacatcctgaccctgatcagaaccctggtgaccggcggcgccacccccgagctggaggccctgatcgccgaggagaacgccctgagaggcggctacagcaccccccagaccctggccaacagagacagatgcagagtggcccagctggccctgctggacggccccttcgccgacctgggcgacggcggctgctacggcgacctgttctgcaaggccctgaagacctacaacatgctgtgcttcggcatctacagactgagagacgcccacctgagcacccccagccagtgcaccaagagatacgtgatcaccaaccccccctacgagttcgagctggtgcccaccgacctgatcttctgcctgatgcagttcgaccacaacgccggccagagcagagccagcctgagccacagcagccacagcagccagagcagcagcaagaagagcagcagcgtgcacagcatccccagcaccgccaacagacagaacagacccaagagcagagagagcagagacaagcagaagtacgtgcaggaggagagactgtag

SEQ ID NO: 94086 - DNA, 3633 bp, Artificial Sequence
  Description of Artificial Sequence: Synthetic coding sequence
agcaacatccacgccaaccacctgagcctggacgccagcagcagcagcagcagcagcagcagcagcagcagcagcagcagcagcagcagcagcagcagcagcgtgcacgagcccaagatggacgccctgatcatccccgtgaccatggaggtgccctgcgacagcagaggccagagaatgtggtgggccttcctggccagcagcatggtgaccttcttcggcggcctgttcatcatcctgctgtggagaaccctgaagtacctgtggaccgtgtgctgccactgcggcggcaagaccaaggaggcccagaagatcaacaacggcagcagccaggccgacggcaccctgaagcccgtggacgagaaggaggaggccgtggccgccgaggtgggctggatgaccagcgtgaaggactgggccggcgtgatgatcagcgcccagaccctgaccggcagagtgctggtggtgctggtgttcgccctgagcatcggcgccctggtgatctacttcatcgacagcagcaaccccatcgagagctgccagaacttctacaaggacttcaccctgcagatcgacatggccttcaacgtgttcttcctgctgtacttcggcctgagattcatcgccgccaacgacaagctgtggttctggctggaggtgaacagcgtggtggacttcttcaccgtgccccccgtgttcgtgagcgtgtacctgaacagaagctggctgggcctgagattcctgagagccctgagactgatccagttcagcgagatcctgcagttcctgaacatcctgaagaccagcaacagcatcaagctggtgaacctgctgagcatcttcatcagcacctggctgaccgccgccggcttcatccacctggtggagaacagcggcgacccctgggagaacttccagaacaaccaggccctgacctactgggagtgcgtgtacctgctgatggtgaccatgagcaccgtgggctacggcgacgtgtacgccaagaccaccctgggcagactgttcatggtgttcttcatcctgggcggcctggccatgttcgccagctacgtgcccgagatcatcgagctgatcggcaacagaaagaagtacggcggcagctacagcgccgtgagcggcagaaagcacatcgtggtgtgcggccacatcaccctggagagcgtgagcaacttcctgaaggacttcctgcacaaggacagagacgacgtgaacgtggagatcgtgttcctgcacaacatcagccccaacctggagctggaggccctgttcaagagacacttcacccaggtggagttctaccagggcagcgtgctgaacccccacgacctggccagagtgaagatcgagagcgccgacgcctgcctgatcctggccaacaagtactgcgccgaccccgacgccgaggacgccagcaacatcatgagagtgatcagcatcaagaactaccaccccaagatcagaatcatcacccagatgctgcagtaccacaacaaggcccacctgctgaacatccccagctggaactggaaggagggcgacgacgccatctgcctggccgagctgaagctgggcttcatcgcccagagctgcctggcccagggcctgagcaccatgctggccaacctgttcagcatgagaagcttcatcaagatcgaggaggacacctggcagaagtactacctggagggcgtgagcaacgagatgtacaccgagtacctgagcagcgccttcgtgggcctgagcttccccaccgtgtgcgagctgtgcttcgtgaagctgaagctgctgatgatcgccatcgagtacaagagcgccaacagagagagcagaatcctgatcaaccccggcaaccacctgaagatccaggagggcaccctgggcttcttcatcgccagcgacgccaaggaggtgaagagagccttcttctactgcaaggcctgccacgacgacatcaccgaccccaagagaatcaagaagtgcggctgcaagagacccaagatgagcatctacaagagaatgagaagagcctgctgcttcgactgcggcagaagcgagagagactgcagctgcatgagcggcagagtgagaggcaacgtggacaccctggagagagccttccccctgagcagcgtgagcgtgaacgactgcagcaccagcttcagagccttcgaggacgagcagcccagcaccctgagccccaagaagaagcagagaaacggcggcatgagaaacagccccaacaccagccccaagctgatgagacacgaccccctgctgatccccggcaacgaccagatcgacaacatggacagcaacgtgaagaagtacgacagcaccggcatgttccactggtgcgcccccaaggagatcgagaaggtgatcctgaccagaagcgaggccgccatgaccgtgctgagcggccacgtggtggtgtgcatcttcggcgacgtgagcagcgccctgatcggcctgagaaacctggtgatgcccctgagagccagcaacttccactaccacgagctgaagcacatcgtgttcgtgggcagcatcgagtacctgaagagagagtgggagaccctgcacaacttccccaaggtgagcatcctgcccggcacccccctgagcagagccgacctgagagccgtgaacatcaacctgtgcgacatgtgcgtgatcctgagcgccaaccagaacaacatcgacgacaccagcctgcaggacaaggagtgcatcctggccagcctgaacatcaagagcatgcagttcgacgacagcatcggcgtgctgcaggccaacagccagggcttcaccccccccggcatggacagaagcagccccgacaacagccccgtgcacggcatgctgagacagcccagcatcaccaccggcgtgaacatccccatcatcaccgagctggtgaacgacaccaacgtgcagttcctggaccaggacgacgacgacgaccccgacaccgagctgtacctgacccagcccttcgcctgcggcaccgccttcgccgtgagcgtgctggacagcctgatgagcgccacctacttcaacgacaacatcctgaccctgatcagaaccctggtgaccggcggcgccacccccgagctggaggccctgatcgccgaggagaacgccctgagaggcggctacagcaccccccagaccctggccaacagagacagatgcagagtggcccagctggccctgctggacggccccttcgccgacctgggcgacggcggctgctacggcgacctgttctgcaaggccctgaagacctacaacatgctgtgcttcggcatctacagactgagagacgcccacctgagcacccccagccagtgcaccaagagatacgtgatcaccaaccccccctacgagttcgagctggtgcccaccgacctgatcttctgcctgatgcagttcgaccacaacgccggccagagcagagccagcctgagccacagcagccacagcagccagagcagcagcaagaagagcagcagcgtgcacagcatccccagcaccgccaacagacagaacagacccaagagcagagagagcagagacaagcagaagtacgtgcaggaggagagactgtag

SEQ ID NO: 94087 - DNA, 3720 bp, Artificial Sequence
  Description of Artificial Sequence: Synthetic coding sequence
atggccaacggcggcggcggcggcggcggcagcagcggcggcggcggcggcggcggcggcagcagcctgagaatgagcagcaacatccacgccaaccacctgagcctggacgccagcagcagcagcagcagcagcagcagcagcagcagcagcagcagcagcagcagcagcagcagcagcgtgcacgagcccaagatggacgccctgatcatccccgtgaccatggaggtgccctgcgacagcagaggccagagaatgtggtgggccttcctggccagcagcatggtgaccttcttcggcggcctgttcatcatcctgctgtggagaaccctgaagtacctgtggaccgtgtgctgccactgcggcggcaagaccaaggaggcccagaagatcaacaacggcagcagccaggccgacggcaccctgaagcccgtggacgagaaggaggaggccgtggccgccgaggtgggctggatgaccagcgtgaaggactgggccggcgtgatgatcagcgcccagaccctgaccggcagagtgctggtggtgctggtgttcgccctgagcatcggcgccctggtgatctacttcatcgacagcagcaaccccatcgagagctgccagaacttctacaaggacttcaccctgcagatcgacatggccttcaacgtgttcttcctgctgtacttcggcctgagattcatcgccgccaacgacaagctgtggttctggctggaggtgaacagcgtggtggacttcttcaccgtgccccccgtgttcgtgagcgtgtacctgaacagaagctggctgggcctgagattcctgagagccctgagactgatccagttcagcgagatcctgcagttcctgaacatcctgaagaccagcaacagcatcaagctggtgaacctgctgagcatcttcatcagcacctggctgaccgccgccggcttcatccacctggtggagaacagcggcgacccctgggagaacttccagaacaaccaggccctgacctactgggagtgcgtgtacctgctgatggtgaccatgagcaccgtgggctacggcgacgtgtacgccaagaccaccctgggcagactgttcatggtgttcttcatcctgggcggcctggccatgttcgccagctacgtgcccgagatcatcgagctgatcggcaacagaaagaagtacggcggcagctacagcgccgtgagcggcagaaagcacatcgtggtgtgcggccacatcaccctggagagcgtgagcaacttcctgaaggacttcctgcacaaggacagagacgacgtgaacgtggagatcgtgttcctgcacaacatcagccccaacctggagctggaggccctgttcaagagacacttcacccaggtggagttctaccagggcagcgtgctgaacccccacgacctggccagagtgaagatcgagagcgccgacgcctgcctgatcctggccaacaagtactgcgccgaccccgacgccgaggacgccagcaacatcatgagagtgatcagcatcaagaactaccaccccaagatcagaatcatcacccagatgctgcagtaccacaacaaggcccacctgctgaacatccccagctggaactggaaggagggcgacgacgccatctgcctggccgagctgaagctgggcttcatcgcccagagctgcctggcccagggcctgagcaccatgctggccaacctgttcagcatgagaagcttcatcaagatcgaggaggacacctggcagaagtactacctggagggcgtgagcaacgagatgtacaccgagtacctgagcagcgccttcgtgggcctgagcttccccaccgtgtgcgagctgtgcttcgtgaagctgaagctgctgatgatcgccatcgagtacaagagcgccaacagagagagcagaatcctgatcaaccccggcaaccacctgaagatccaggagggcaccctgggcttcttcatcgccagcgacgccaaggaggtgaagagagccttcttctactgcaaggcctgccacgacgacatcaccgaccccaagagaatcaagaagtgcggctgcaagagaagatgggaggagcactgcagcctgtggagactggagagcaagggcaacgtgagaagactgaactactgcagaggccagcagaccttcagcgtgaaggtgaaggtggccgccagaagcagatacagcaaggaccccttcgagttcaagaaggagacccccaacagcagactggtgaccgagcccgtggaggacgagcagcccagcaccctgagccccaagaagaagcagagaaacggcggcatgagaaacagccccaacaccagccccaagctgatgagacacgaccccctgctgatccccggcaacgaccagatcgacaacatggacagcaacgtgaagaagtacgacagcaccggcatgttccactggtgcgcccccaaggagatcgagaaggtgatcctgaccagaagcgaggccgccatgaccgtgctgagcggccacgtggtggtgtgcatcttcggcgacgtgagcagcgccctgatcggcctgagaaacctggtgatgcccctgagagccagcaacttccactaccacgagctgaagcacatcgtgttcgtgggcagcatcgagtacctgaagagagagtgggagaccctgcacaacttccccaaggtgagcatcctgcccggcacccccctgagcagagccgacctgagagccgtgaacatcaacctgtgcgacatgtgcgtgatcctgagcgccaaccagaacaacatcgacgacaccagcctgcaggacaaggagtgcatcctggccagcctgaacatcaagagcatgcagttcgacgacagcatcggcgtgctgcaggccaacagccagggcttcaccccccccggcatggacagaagcagccccgacaacagccccgtgcacggcatgctgagacagcccagcatcaccaccggcgtgaacatccccatcatcaccgagctggtgaacgacaccaacgtgcagttcctggaccaggacgacgacgacgaccccgacaccgagctgtacctgacccagcccttcgcctgcggcaccgccttcgccgtgagcgtgctggacagcctgatgagcgccacctacttcaacgacaacatcctgaccctgatcagaaccctggtgaccggcggcgccacccccgagctggaggccctgatcgccgaggagaacgccctgagaggcggctacagcaccccccagaccctggccaacagagacagatgcagagtggcccagctggccctgctggacggccccttcgccgacctgggcgacggcggctgctacggcgacctgttctgcaaggccctgaagacctacaacatgctgtgcttcggcatctacagactgagagacgcccacctgagcacccccagccagtgcaccaagagatacgtgatcaccaaccccccctacgagttcgagctggtgcccaccgacctgatcttctgcctgatgcagttcgaccacaacgccggccagagcagagccagcctgagccacagcagccacagcagccagagcagcagcaagaagagcagcagcgtgcacagcatccccagcaccgccaacagacagaacagacccaagagcagagagagcagagacaagcagaagtacgtgcaggaggagagactgtag

SEQ ID NO: 94088 - DNA, 3549 bp, Artificial Sequence
  Description of Artificial Sequence: Synthetic coding sequence
tgaagcagcagcagcagcagcagcagcagcagcgtgcacgagcccaagatggacgccctgatcatccccgtgaccatggaggtgccctgcgacagcagaggccagagaatgtggtgggccttcctggccagcagcatggtgaccttcttcggcggcctgttcatcatcctgctgtggagaaccctgaagtacctgtggaccgtgtgctgccactgcggcggcaagaccaaggaggcccagaagatcaacaacggcagcagccaggccgacggcaccctgaagcccgtggacgagaaggaggaggccgtggccgccgaggtgggctggatgaccagcgtgaaggactgggccggcgtgatgatcagcgcccagaccctgaccggcagagtgctggtggtgctggtgttcgccctgagcatcggcgccctggtgatctacttcatcgacagcagcaaccccatcgagagctgccagaacttctacaaggacttcaccctgcagatcgacatggccttcaacgtgttcttcctgctgtacttcggcctgagattcatcgccgccaacgacaagctgtggttctggctggaggtgaacagcgtggtggacttcttcaccgtgccccccgtgttcgtgagcgtgtacctgaacagaagctggctgggcctgagattcctgagagccctgagactgatccagttcagcgagatcctgcagttcctgaacatcctgaagaccagcaacagcatcaagctggtgaacctgctgagcatcttcatcagcacctggctgaccgccgccggcttcatccacctggtggagaacagcggcgacccctgggagaacttccagaacaaccaggccctgacctactgggagtgcgtgtacctgctgatggtgaccatgagcaccgtgggctacggcgacgtgtacgccaagaccaccctgggcagactgttcatggtgttcttcatcctgggcggcctggccatgttcgccagctacgtgcccgagatcatcgagctgatcggcaacagaaagaagtacggcggcagctacagcgccgtgagcggcagaaagcacatcgtggtgtgcggccacatcaccctggagagcgtgagcaacttcctgaaggacttcctgcacaaggacagagacgacgtgaacgtggagatcgtgttcctgcacaacatcagccccaacctggagctggaggccctgttcaagagacacttcacccaggtggagttctaccagggcagcgtgctgaacccccacgacctggccagagtgaagatcgagagcgccgacgcctgcctgatcctggccaacaagtactgcgccgaccccgacgccgaggacgccagcaacatcatgagagtgatcagcatcaagaactaccaccccaagatcagaatcatcacccagatgctgcagtaccacaacaaggcccacctgctgaacatccccagctggaactggaaggagggcgacgacgccatctgcctggccgagctgaagctgggcttcatcgcccagagctgcctggcccagggcctgagcaccatgctggccaacctgttcagcatgagaagcttcatcaagatcgaggaggacacctggcagaagtactacctggagggcgtgagcaacgagatgtacaccgagtacctgagcagcgccttcgtgggcctgagcttccccaccgtgtgcgagctgtgcttcgtgaagctgaagctgctgatgatcgccatcgagtacaagagcgccaacagagagagcagaatcctgatcaaccccggcaaccacctgaagatccaggagggcaccctgggcttcttcatcgccagcgacgccaaggaggtgaagagagccttcttctactgcaaggcctgccacgacgacatcaccgaccccaagagaatcaagaagtgcggctgcaagagactggaggacgagcagcccagcaccctgagccccaagaagaagcagagaaacggcggcatgagaaacagccccaacaccagccccaagctgatgagacacgaccccctgctgatccccggcaacgaccagatcgacaacatggacagcaacgtgaagaagtacgacagcaccggcatgttccactggtgcgcccccaaggagatcgagaaggtgatcctgaccagaagcgaggccgccatgaccgtgctgagcggccacgtggtggtgtgcatcttcggcgacgtgagcagcgccctgatcggcctgagaaacctggtgatgcccctgagagccagcaacttccactaccacgagctgaagcacatcgtgttcgtgggcagcatcgagtacctgaagagagagtgggagaccctgcacaacttccccaaggtgagcatcctgcccggcacccccctgagcagagccgacctgagagccgtgaacatcaacctgtgcgacatgtgcgtgatcctgagcgccaaccagaacaacatcgacgacaccagcctgcaggacaaggagtgcatcctggccagcctgaacatcaagagcatgcagttcgacgacagcatcggcgtgctgcaggccaacagccagggcttcaccccccccggcatggacagaagcagccccgacaacagccccgtgcacggcatgctgagacagcccagcatcaccaccggcgtgaacatccccatcatcaccgagctggtgaacgacaccaacgtgcagttcctggaccaggacgacgacgacgaccccgacaccgagctgtacctgacccagcccttcgcctgcggcaccgccttcgccgtgagcgtgctggacagcctgatgagcgccacctacttcaacgacaacatcctgaccctgatcagaaccctggtgaccggcggcgccacccccgagctggaggccctgatcgccgaggagaacgccctgagaggcggctacagcaccccccagaccctggccaacagagacagatgcagagtggcccagctggccctgctggacggccccttcgccgacctgggcgacggcggctgctacggcgacctgttctgcaaggccctgaagacctacaacatgctgtgcttcggcatctacagactgagagacgcccacctgagcacccccagccagtgcaccaagagatacgtgatcaccaaccccccctacgagttcgagctggtgcccaccgacctgatcttctgcctgatgcagttcgaccacaacgccggccagagcagagccagcctgagccacagcagccacagcagccagagcagcagcaagaagagcagcagcgtgcacagcatccccagcaccgccaacagacagaacagacccaagagcagagagagcagagacaagcagaacgccaccagaatgaacagaatgggccaggccgagaagaagtggttcaccgacgagcccgacaacgcctaccccagaaacatccagatcaagcccatgagcacccacatggccaaccagatcaaccagtacaagagcaccagcagcctgatcccccccatcagagaggtggaggacgagtgctag

SEQ ID NO: 94089 - DNA, 3504 bp, Artificial Sequence
  Description of Artificial Sequence: Synthetic coding sequence
cccaagatggacgccctgatcatccccgtgaccatggaggtgccctgcgacagcagaggccagagaatgtggtgggccttcctggccagcagcatggtgaccttcttcggcggcctgttcatcatcctgctgtggagaaccctgaagtacctgtggaccgtgtgctgccactgcggcggcaagaccaaggaggcccagaagatcaacaacggcagcagccaggccgacggcaccctgaagcccgtggacgagaaggaggaggccgtggccgccgaggtgggctggatgaccagcgtgaaggactgggccggcgtgatgatcagcgcccagaccctgaccggcagagtgctggtggtgctggtgttcgccctgagcatcggcgccctggtgatctacttcatcgacagcagcaaccccatcgagagctgccagaacttctacaaggacttcaccctgcagatcgacatggccttcaacgtgttcttcctgctgtacttcggcctgagattcatcgccgccaacgacaagctgtggttctggctggaggtgaacagcgtggtggacttcttcaccgtgccccccgtgttcgtgagcgtgtacctgaacagaagctggctgggcctgagattcctgagagccctgagactgatccagttcagcgagatcctgcagttcctgaacatcctgaagaccagcaacagcatcaagctggtgaacctgctgagcatcttcatcagcacctggctgaccgccgccggcttcatccacctggtggagaacagcggcgacccctgggagaacttccagaacaaccaggccctgacctactgggagtgcgtgtacctgctgatggtgaccatgagcaccgtgggctacggcgacgtgtacgccaagaccaccctgggcagactgttcatggtgttcttcatcctgggcggcctggccatgttcgccagctacgtgcccgagatcatcgagctgatcggcaacagaaagaagtacggcggcagctacagcgccgtgagcggcagaaagcacatcgtggtgtgcggccacatcaccctggagagcgtgagcaacttcctgaaggacttcctgcacaaggacagagacgacgtgaacgtggagatcgtgttcctgcacaacatcagccccaacctggagctggaggccctgttcaagagacacttcacccaggtggagttctaccagggcagcgtgctgaacccccacgacctggccagagtgaagatcgagagcgccgacgcctgcctgatcctggccaacaagtactgcgccgaccccgacgccgaggacgccagcaacatcatgagagtgatcagcatcaagaactaccaccccaagatcagaatcatcacccagatgctgcagtaccacaacaaggcccacctgctgaacatccccagctggaactggaaggagggcgacgacgccatctgcctggccgagctgaagctgggcttcatcgcccagagctgcctggcccagggcctgagcaccatgctggccaacctgttcagcatgagaagcttcatcaagatcgaggaggacacctggcagaagtactacctggagggcgtgagcaacgagatgtacaccgagtacctgagcagcgccttcgtgggcctgagcttccccaccgtgtgcgagctgtgcttcgtgaagctgaagctgctgatgatcgccatcgagtacaagagcgccaacagagagagcagaatcctgatcaaccccggcaaccacctgaagatccaggagggcaccctgggcttcttcatcgccagcgacgccaaggaggtgaagagagccttcttctactgcaaggcctgccacgacgacatcaccgaccccaagagaatcaagaagtgcggctgcaagagactggaggacgagcagcccagcaccctgagccccaagaagaagcagagaaacggcggcatgagaaacagccccaacaccagccccaagctgatgagacacgaccccctgctgatccccggcaacgaccagatcgacaacatggacagcaacgtgaagaagtacgacagcaccggcatgttccactggtgcgcccccaaggagatcgagaaggtgatcctgaccagaagcgaggccgccatgaccgtgctgagcggccacgtggtggtgtgcatcttcggcgacgtgagcagcgccctgatcggcctgagaaacctggtgatgcccctgagagccagcaacttccactaccacgagctgaagcacatcgtgttcgtgggcagcatcgagtacctgaagagagagtgggagaccctgcacaacttccccaaggtgagcatcctgcccggcacccccctgagcagagccgacctgagagccgtgaacatcaacctgtgcgacatgtgcgtgatcctgagcgccaaccagaacaacatcgacgacaccagcctgcaggacaaggagtgcatcctggccagcctgaacatcaagagcatgcagttcgacgacagcatcggcgtgctgcaggccaacagccagggcttcaccccccccggcatggacagaagcagccccgacaacagccccgtgcacggcatgctgagacagcccagcatcaccaccggcgtgaacatccccatcatcaccgagctggtgaacgacaccaacgtgcagttcctggaccaggacgacgacgacgaccccgacaccgagctgtacctgacccagcccttcgcctgcggcaccgccttcgccgtgagcgtgctggacagcctgatgagcgccacctacttcaacgacaacatcctgaccctgatcagaaccctggtgaccggcggcgccacccccgagctggaggccctgatcgccgaggagaacgccctgagaggcggctacagcaccccccagaccctggccaacagagacagatgcagagtggcccagctggccctgctggacggccccttcgccgacctgggcgacggcggctgctacggcgacctgttctgcaaggccctgaagacctacaacatgctgtgcttcggcatctacagactgagagacgcccacctgagcacccccagccagtgcaccaagagatacgtgatcaccaaccccccctacgagttcgagctggtgcccaccgacctgatcttctgcctgatgcagttcgaccacaacgccggccagagcagagccagcctgagccacagcagccacagcagccagagcagcagcaagaagagcagcagcgtgcacagcatccccagcaccgccaacagacagaacagacccaagagcagagagagcagagacaagcagaacgccaccagaatgaacagaatgggccaggagaagaagtggttcaccgacgagcccgacaacgcctaccccagaaacatccagatcaagcccatgagcacccacatggccaaccagatcaaccagtacaagagcaccagcagcctgatcccccccatcagagaggtggaggacgagtgctag

SEQ ID NO: 94090 - DNA, 3504 bp, Artificial Sequence
  Description of Artificial Sequence: Synthetic coding sequence
tgaggcggcggcggcggcggcggcggcagcagcctgagaatgagcagcaacatccacgccaaccacctgagcctggacgccagcagcagcagcagcagcagcagcagcagcagcagcagcagcagcagcagcagcagcagcagcagcgtgcacgagcccaagatggacgccctgatcatccccgtgaccatggaggtgccctgcgacagcagaggccagagaatgtggtgggccttcctggccagcagcatggtgaccttcttcggcggcctgttcatcatcctgctgtggagaaccctgaagtacctgtggaccgtgtgctgccactgcggcggcaagaccaaggaggcccagaagatcaacaacggcagcagccaggccgacggcaccctgaagcccgtggacgagaaggaggaggccgtggccgccgaggtgggctggatgaccagcgtgaaggactgggccggcgtgatgatcagcgcccagaccctgaccggcagagtgctggtggtgctggtgttcgccctgagcatcggcgccctggtgatctacttcatcgacagcagcaaccccatcgagagctgccagaacttctacaaggacttcaccctgcagatcgacatggccttcaacgtgttcttcctgctgtacttcggcctgagattcatcgccgccaacgacaagctgtggttctggctggaggtgaacagcgtggtggacttcttcaccgtgccccccgtgttcgtgagcgtgtacctgaacagaagctggctgggcctgagattcctgagagccctgagactgatccagttcagcgagatcctgcagttcctgaacatcctgaagaccagcaacagcatcaagctggtgaacctgctgagcatcttcatcagcacctggctgaccgccgccggcttcatccacctggtggagaacagcggcgacccctgggagaacttccagaacaaccaggccctgacctactgggagtgcgtgtacctgctgatggtgaccatgagcaccgtgggctacggcgacgtgtacgccaagaccaccctgggcagactgttcatggtgttcttcatcctgggcggcctggccatgttcgccagctacgtgcccgagatcatcgagctgatcggcaacagaaagaagtacggcggcagctacagcgccgtgagcggcagaaagcacatcgtggtgtgcggccacatcaccctggagagcgtgagcaacttcctgaaggacttcctgcacaaggacagagacgacgtgaacgtggagatcgtgttcctgcacaacatcagccccaacctggagctggaggccctgttcaagagacacttcacccaggtggagttctaccagggcagcgtgctgaacccccacgacctggccagagtgaagatcgagagcgccgacgcctgcctgatcctggccaacaagtactgcgccgaccccgacgccgaggacgccagcaacatcatgagagtgatcagcatcaagaactaccaccccaagatcagaatcatcacccagatgctgcagtaccacaacaaggcccacctgctgaacatccccagctggaactggaaggagggcgacgacgccatctgcctggccgagctgaagctgggcttcatcgcccagagctgcctggcccagggcctgagcaccatgctggccaacctgttcagcatgagaagcttcatcaagatcgaggaggacacctggcagaagtactacctggagggcgtgagcaacgagatgtacaccgagtacctgagcagcgccttcgtgggcctgagcttccccaccgtgtgcgagctgtgcttcgtgaagctgaagctgctgatgatcgccatcgagtacaagagcgccaacagagagagcagaatcctgatcaaccccggcaaccacctgaagatccaggagggcaccctgggcttcttcatcgccagcgacgccaaggaggtgaagagagccttcttctactgcaaggcctgccacgacgacatcaccgaccccaagagaatcaagaagtgcggctgcaagagactggaggacgagcagcccagcaccctgagccccaagaagaagcagagaaacggcggcatgagaaacagccccaacaccagccccaagctgatgagacacgaccccctgctgatccccggcaacgaccagatcgacaacatggacagcaacgtgaagaagtacgacagcaccggcatgttccactggtgcgcccccaaggagatcgagaaggtgatcctgaccagaagcgaggccgccatgaccgtgctgagcggccacgtggtggtgtgcatcttcggcgacgtgagcagcgccctgatcggcctgagaaacctggtgatgcccctgagagccagcaacttccactaccacgagctgaagcacatcgtgttcgtgggcagcatcgagtacctgaagagagagtgggagaccctgcacaacttccccaaggtgagcatcctgcccggcacccccctgagcagagccgacctgagagccgtgaacatcaacctgtgcgacatgtgcgtgatcctgagcgccaaccagaacaacatcgacgacaccagcctgcaggacaaggagtgcatcctggccagcctgaacatcaagagcatgcagttcgacgacagcatcggcgtgctgcaggccaacagccagggcttcaccccccccggcatggacagaagcagccccgacaacagccccgtgcacggcatgctgagacagcccagcatcaccaccggcgtgaacatccccatcatcaccgagctggtgaacgacaccaacgtgcagttcctggaccaggacgacgacgacgaccccgacaccgagctgtacctgacccagcccttcgcctgcggcaccgccttcgccgtgagcgtgctggacagcctgatgagcgccacctacttcaacgacaacatcctgaccctgatcagaaccctggtgaccggcggcgccacccccgagctggaggccctgatcgccgaggagaacgccctgagaggcggctacagcaccccccagaccctggccaacagagacagatgcagagtggcccagctggccctgctggacggccccttcgccgacctgggcgacggcggctgctacggcgacctgttctgcaaggccctgaagacctacaacatgctgtgcttcggcatctacagactgagagacgcccacctgagcacccccagccagtgcaccaagagatacgtgatcaccaaccccccctacgagttcgagctggtgcccaccgacctgatcttctgcctgatgcagttcgaccacaacgccggccagagcagagccagcctgagccacagcagccacagcagccagagcagcagcaagaagagcagcagcgtgcacagcatccccagcaccgccaacagacagaacagacccaagagcagagagagcagagacaagcagaacagaaaggagatggtgtacagatag

SEQ ID NO: 94091 - DNA, 3516 bp, Artificial Sequence
  Description of Artificial Sequence: Synthetic coding sequence
atggacgccctgatcatccccgtgaccatggaggtgccctgcgacagcagaggccagagaatgtggtgggccttcctggccagcagcatggtgaccttcttcggcggcctgttcatcatcctgctgtggagaaccctgaagtacctgtggaccgtgtgctgccactgcggcggcaagaccaaggaggcccagaagatcaacaacggcagcagccaggccgacggcaccctgaagcccgtggacgagaaggaggaggccgtggccgccgaggtgggctggatgaccagcgtgaaggactgggccggcgtgatgatcagcgcccagaccctgaccggcagagtgctggtggtgctggtgttcgccctgagcatcggcgccctggtgatctacttcatcgacagcagcaaccccatcgagagctgccagaacttctacaaggacttcaccctgcagatcgacatggccttcaacgtgttcttcctgctgtacttcggcctgagattcatcgccgccaacgacaagctgtggttctggctggaggtgaacagcgtggtggacttcttcaccgtgccccccgtgttcgtgagcgtgtacctgaacagaagctggctgggcctgagattcctgagagccctgagactgatccagttcagcgagatcctgcagttcctgaacatcctgaagaccagcaacagcatcaagctggtgaacctgctgagcatcttcatcagcacctggctgaccgccgccggcttcatccacctggtggagaacagcggcgacccctgggagaacttccagaacaaccaggccctgacctactgggagtgcgtgtacctgctgatggtgaccatgagcaccgtgggctacggcgacgtgtacgccaagaccaccctgggcagactgttcatggtgttcttcatcctgggcggcctggccatgttcgccagctacgtgcccgagatcatcgagctgatcggcaacagaaagaagtacggcggcagctacagcgccgtgagcggcagaaagcacatcgtggtgtgcggccacatcaccctggagagcgtgagcaacttcctgaaggacttcctgcacaaggacagagacgacgtgaacgtggagatcgtgttcctgcacaacatcagccccaacctggagctggaggccctgttcaagagacacttcacccaggtggagttctaccagggcagcgtgctgaacccccacgacctggccagagtgaagatcgagagcgccgacgcctgcctgatcctggccaacaagtactgcgccgaccccgacgccgaggacgccagcaacatcatgagagtgatcagcatcaagaactaccaccccaagatcagaatcatcacccagatgctgcagtaccacaacaaggcccacctgctgaacatccccagctggaactggaaggagggcgacgacgccatctgcctggccgagctgaagctgggcttcatcgcccagagctgcctggcccagggcctgagcaccatgctggccaacctgttcagcatgagaagcttcatcaagatcgaggaggacacctggcagaagtactacctggagggcgtgagcaacgagatgtacaccgagtacctgagcagcgccttcgtgggcctgagcttccccaccgtgtgcgagctgtgcttcgtgaagctgaagctgctgatgatcgccatcgagtacaagagcgccaacagagagagcagaatcctgatcaaccccggcaaccacctgaagatccaggagggcaccctgggcttcttcatcgccagcgacgccaaggaggtgaagagagccttcttctactgcaaggcctgccacgacgacatcaccgaccccaagagaatcaagaagtgcggctgcaagagacccaagatgagcatctacaagagaatgagaagagcctgctgcttcgactgcggcagaagcgagagagactgcagctgcatgagcggcagagtgagaggcaacgtggacaccctggagagagccttccccctgagcagcgtgagcgtgaacgactgcagcaccagcttcagagccttcgaggacgagcagcccagcaccctgagccccaagaagaagcagagaaacggcggcatgagaaacagccccaacaccagccccaagctgatgagacacgaccccctgctgatccccggcaacgaccagatcgacaacatggacagcaacgtgaagaagtacgacagcaccggcatgttccactggtgcgcccccaaggagatcgagaaggtgatcctgaccagaagcgaggccgccatgaccgtgctgagcggccacgtggtggtgtgcatcttcggcgacgtgagcagcgccctgatcggcctgagaaacctggtgatgcccctgagagccagcaacttccactaccacgagctgaagcacatcgtgttcgtgggcagcatcgagtacctgaagagagagtgggagaccctgcacaacttccccaaggtgagcatcctgcccggcacccccctgagcagagccgacctgagagccgtgaacatcaacctgtgcgacatgtgcgtgatcctgagcgccaaccagaacaacatcgacgacaccagcctgcaggacaaggagtgcatcctggccagcctgaacatcaagagcatgcagttcgacgacagcatcggcgtgctgcaggccaacagccagggcttcaccccccccggcatggacagaagcagccccgacaacagccccgtgcacggcatgctgagacagcccagcatcaccaccggcgtgaacatccccatcatcaccgagctggtgaacgacaccaacgtgcagttcctggaccaggacgacgacgacgaccccgacaccgagctgtacctgacccagcccttcgcctgcggcaccgccttcgccgtgagcgtgctggacagcctgatgagcgccacctacttcaacgacaacatcctgaccctgatcagaaccctggtgaccggcggcgccacccccgagctggaggccctgatcgccgaggagaacgccctgagaggcggctacagcaccccccagaccctggccaacagagacagatgcagagtggcccagctggccctgctggacggccccttcgccgacctgggcgacggcggctgctacggcgacctgttctgcaaggccctgaagacctacaacatgctgtgcttcggcatctacagactgagagacgcccacctgagcacccccagccagtgcaccaagagatacgtgatcaccaaccccccctacgagttcgagctggtgcccaccgacctgatcttctgcctgatgcagttcgaccacaacgccggccagagcagagccagcctgagccacagcagccacagcagccagagcagcagcaagaagagcagcagcgtgcacagcatccccagcaccgccaacagacagaacagacccaagagcagagagagcagagacaagcagaacagaaaggagatggtgtacagatag

SEQ ID NO: 94092 - DNA, 3534 bp, Artificial Sequence
  Description of Artificial Sequence: Synthetic coding sequence
atggccaacggcggcggcggcggcggcggcagcagcggcggcggcggcggcggcggcggcagcagcctgagaatgagcagcaacatccacgccaaccacctgagcctggacgccagcagcagcagcagcagcagcagcagcagcagcagcagcagcagcagcagcagcagcagcagcagcgtgcacgagcccaagatggacgccctgatcatccccgtgaccatggaggtgccctgcgacagcagaggccagagaatgtggtgggccttcctggccagcagcatggtgaccttcttcggcggcctgttcatcatcctgctgtggagaaccctgaagtacctgtggaccgtgtgctgccactgcggcggcaagaccaaggaggcccagaagatcaacaacggcagcagccaggccgacggcaccctgaagcccgtggacgagaaggaggaggccgtggccgccgaggtgggctggatgaccagcgtgaaggactgggccggcgtgatgatcagcgcccagaccctgaccggcagagtgctggtggtgctggtgttcgccctgagcatcggcgccctggtgatctacttcatcgacagcagcaaccccatcgagagctgccagaacttctacaaggacttcaccctgcagatcgacatggccttcaacgtgttcttcctgctgtacttcggcctgagattcatcgccgccaacgacaagctgtggttctggctggaggtgaacagcgtggtggacttcttcaccgtgccccccgtgttcgtgagcgtgtacctgaacagaagctggctgggcctgagattcctgagagccctgagactgatccagttcagcgagatcctgcagttcctgaacatcctgaagaccagcaacagcatcaagctggtgaacctgctgagcatcttcatcagcacctggctgaccgccgccggcttcatccacctggtggagaacagcggcgacccctgggagaacttccagaacaaccaggccctgacctactgggagtgcgtgtacctgctgatggtgaccatgagcaccgtgggctacggcgacgtgtacgccaagaccaccctgggcagactgttcatggtgttcttcatcctgggcggcctggccatgttcgccagctacgtgcccgagatcatcgagctgatcggcaacagaaagaagtacggcggcagctacagcgccgtgagcggcagaaagcacatcgtggtgtgcggccacatcaccctggagagcgtgagcaacttcctgaaggacttcctgcacaaggacagagacgacgtgaacgtggagatcgtgttcctgcacaacatcagccccaacctggagctggaggccctgttcaagagacacttcacccaggtggagttctaccagggcagcgtgctgaacccccacgacctggccagagtgaagatcgagagcgccgacgcctgcctgatcctggccaacaagtactgcgccgaccccgacgccgaggacgccagcaacatcatgagagtgatcagcatcaagaactaccaccccaagatcagaatcatcacccagatgctgcagtaccacaacaaggcccacctgctgaacatccccagctggaactggaaggagggcgacgacgccatctgcctggccgagctgaagctgggcttcatcgcccagagctgcctggcccagggcctgagcaccatgctggccaacctgttcagcatgagaagcttcatcaagatcgaggaggacacctggcagaagtactacctggagggcgtgagcaacgagatgtacaccgagtacctgagcagcgccttcgtgggcctgagcttccccaccgtgtgcgagctgtgcttcgtgaagctgaagctgctgatgatcgccatcgagtacaagagcgccaacagagagagcagaatcctgatcaaccccggcaaccacctgaagatccaggagggcaccctgggcttcttcatcgccagcgacgccaaggaggtgaagagagccttcttctactgcaaggcctgccacgacgacatcaccgaccccaagagaatcaagaagtgcggctgcaagagactggaggacgagcagcccagcaccctgagccccaagaagaagcagagaaacggcggcatgagaaacagccccaacaccagccccaagctgatgagacacgaccccctgctgatccccggcaacgaccagatcgacaacatggacagcaacgtgaagaagtacgacagcaccggcatgttccactggtgcgcccccaaggagatcgagaaggtgatcctgaccagaagcgaggccgccatgaccgtgctgagcggccacgtggtggtgtgcatcttcggcgacgtgagcagcgccctgatcggcctgagaaacctggtgatgcccctgagagccagcaacttccactaccacgagctgaagcacatcgtgttcgtgggcagcatcgagtacctgaagagagagtgggagaccctgcacaacttccccaaggtgagcatcctgcccggcacccccctgagcagagccgacctgagagccgtgaacatcaacctgtgcgacatgtgcgtgatcctgagcgccaaccagaacaacatcgacgacaccagcctgcaggacaaggagtgcatcctggccagcctgaacatcaagagcatgcagttcgacgacagcatcggcgtgctgcaggccaacagccagggcttcaccccccccggcatggacagaagcagccccgacaacagccccgtgcacggcatgctgagacagcccagcatcaccaccggcgtgaacatccccatcatcaccgagctggtgaacgacaccaacgtgcagttcctggaccaggacgacgacgacgaccccgacaccgagctgtacctgacccagcccttcgcctgcggcaccgccttcgccgtgagcgtgctggacagcctgatgagcgccacctacttcaacgacaacatcctgaccctgatcagaaccctggtgaccggcggcgccacccccgagctggaggccctgatcgccgaggagaacgccctgagaggcggctacagcaccccccagaccctggccaacagagacagatgcagagtggcccagctggccctgctggacggccccttcgccgacctgggcgacggcggctgctacggcgacctgttctgcaaggccctgaagacctacaacatgctgtgcttcggcatctacagactgagagacgcccacctgagcacccccagccagtgcaccaagagatacgtgatcaccaaccccccctacgagttcgagctggtgcccaccgacctgatcttctgcctgatgcagttcgaccacaacgccggccagagcagagccagcctgagccacagcagccacagcagccagagcagcagcaagaagagcagcagcgtgcacagcatccccagcaccgccaacagacagaacagacccaagagcagagagagcagagacaagcagaagaaggagatggtgtacagatag

SEQ ID NO: 94093 - DNA, 3618 bp, Artificial Sequence
  Description of Artificial Sequence: Synthetic coding sequence
atggccaacggcggcggcggcggcggcggcagcagcggcggcggcggcggcggcggcggcagcagcctgagaatgagcagcaacatccacgccaaccacctgagcctggacgccagcagcagcagcagcagcagcagcagcagcagcagcagcagcagcagcagcagcagcagcagcagcgtgcacgagcccaagatggacgccctgatcatccccgtgaccatggaggtgccctgcgacagcagaggccagagaatgtggtgggccttcctggccagcagcatggtgaccttcttcggcggcctgttcatcatcctgctgtggagaaccctgaagtacctgtggaccgtgtgctgccactgcggcggcaagaccaaggaggcccagaagatcaacaacggcagcagccaggccgacggcaccctgaagcccgtggacgagaaggaggaggccgtggccgccgaggtgggctggatgaccagcgtgaaggactgggccggcgtgatgatcagcgcccagaccctgaccggcagagtgctggtggtgctggtgttcgccctgagcatcggcgccctggtgatctacttcatcgacagcagcaaccccatcgagagctgccagaacttctacaaggacttcaccctgcagatcgacatggccttcaacgtgttcttcctgctgtacttcggcctgagattcatcgccgccaacgacaagctgtggttctggctggaggtgaacagcgtggtggacttcttcaccgtgccccccgtgttcgtgagcgtgtacctgaacagaagctggctgggcctgagattcctgagagccctgagactgatccagttcagcgagatcctgcagttcctgaacatcctgaagaccagcaacagcatcaagctggtgaacctgctgagcatcttcatcagcacctggctgaccgccgccggcttcatccacctggtggagaacagcggcgacccctgggagaacttccagaacaaccaggccctgacctactgggagtgcgtgtacctgctgatggtgaccatgagcaccgtgggctacggcgacgtgtacgccaagaccaccctgggcagactgttcatggtgttcttcatcctgggcggcctggccatgttcgccagctacgtgcccgagatcatcgagctgatcggcaacagaaagaagtacggcggcagctacagcgccgtgagcggcagaaagcacatcgtggtgtgcggccacatcaccctggagagcgtgagcaacttcctgaaggacttcctgcacaaggacagagacgacgtgaacgtggagatcgtgttcctgcacaacatcagccccaacctggagctggaggccctgttcaagagacacttcacccaggtggagttctaccagggcagcgtgctgaacccccacgacctggccagagtgaagatcgagagcgccgacgcctgcctgatcctggccaacaagtactgcgccgaccccgacgccgaggacgccagcaacatcatgagagtgatcagcatcaagaactaccaccccaagatcagaatcatcacccagatgctgcagtaccacaacaaggcccacctgctgaacatccccagctggaactggaaggagggcgacgacgccatctgcctggccgagctgaagctgggcttcatcgcccagagctgcctggcccagggcctgagcaccatgctggccaacctgttcagcatgagaagcttcatcaagatcgaggaggacacctggcagaagtactacctggagggcgtgagcaacgagatgtacaccgagtacctgagcagcgccttcgtgggcctgagcttccccaccgtgtgcgagctgtgcttcgtgaagctgaagctgctgatgatcgccatcgagtacaagagcgccaacagagagagcagaatcctgatcaaccccggcaaccacctgaagatccaggagggcaccctgggcttcttcatcgccagcgacgccaaggaggtgaagagagccttcttctactgcaaggcctgccacgacgacatcaccgaccccaagagaatcaagaagtgcggctgcaagagactggaggacgagcagcccagcaccctgagccccaagaagaagcagagaaacggcggcatgagaaacagccccaacaccagccccaagctgatgagacacgaccccctgctgatccccggcaacgaccagatcgacaacatggacagcaacgtgaagaagtacgacagcaccggcatgttccactggtgcgcccccaaggagatcgagaaggtgatcctgaccagaagcgaggccgccatgaccgtgctgagcggccacgtggtggtgtgcatcttcggcgacgtgagcagcgccctgatcggcctgagaaacctggtgatgcccctgagagccagcaacttccactaccacgagctgaagcacatcgtgttcgtgggcagcatcgagtacctgaagagagagtgggagaccctgcacaacttccccaaggtgagcatcctgcccggcacccccctgagcagagccgacctgagagccgtgaacatcaacctgtgcgacatgtgcgtgatcctgagcgccaaccagaacaacatcgacgacaccagcctgcaggacaaggagtgcatcctggccagcctgaacatcaagagcatgcagttcgacgacagcatcggcgtgctgcaggccaacagccagggcttcaccccccccggcatggacagaagcagccccgacaacagccccgtgcacggcatgctgagacagcccagcatcaccaccggcgtgaacatccccatcatcaccgagctggccaagcccggcaagctgcccctggtgagcgtgaaccaggagaagaacagcggcacccacatcctgatgatcaccgagctggtgaacgacaccaacgtgcagttcctggaccaggacgacgacgacgaccccgacaccgagctgtacctgacccagcccttcgcctgcggcaccgccttcgccgtgagcgtgctggacagcctgatgagcgccacctacttcaacgacaacatcctgaccctgatcagaaccctggtgaccggcggcgccacccccgagctggaggccctgatcgccgaggagaacgccctgagaggcggctacagcaccccccagaccctggccaacagagacagatgcagagtggcccagctggccctgctggacggccccttcgccgacctgggcgacggcggctgctacggcgacctgttctgcaaggccctgaagacctacaacatgctgtgcttcggcatctacagactgagagacgcccacctgagcacccccagccagtgcaccaagagatacgtgatcaccaaccccccctacgagttcgagctggtgcccaccgacctgatcttctgcctgatgcagttcgaccacaacgccggccagagcagagccagcctgagccacagcagccacagcagccagagcagcagcaagaagagcagcagcgtgcacagcatccccagcaccgccaacagacagaacagacccaagagcagagagagcagagacaagcagaacagaaaggagatggtgtacagatag

SEQ ID NO: 94094 - DNA, 3678 bp, Artificial Sequence
  Description of Artificial Sequence: Synthetic coding sequence
cccaagatggacgccctgatcatccccgtgaccatggaggtgccctgcgacagcagaggccagagaatgtggtgggccttcctggccagcagcatggtgaccttcttcggcggcctgttcatcatcctgctgtggagaaccctgaagtacctgtggaccgtgtgctgccactgcggcggcaagaccaaggaggcccagaagatcaacaacggcagcagccaggccgacggcaccctgaagcccgtggacgagaaggaggaggccgtggccgccgaggtgggctggatgaccagcgtgaaggactgggccggcgtgatgatcagcgcccagaccctgaccggcagagtgctggtggtgctggtgttcgccctgagcatcggcgccctggtgatctacttcatcgacagcagcaaccccatcgagagctgccagaacttctacaaggacttcaccctgcagatcgacatggccttcaacgtgttcttcctgctgtacttcggcctgagattcatcgccgccaacgacaagctgtggttctggctggaggtgaacagcgtggtggacttcttcaccgtgccccccgtgttcgtgagcgtgtacctgaacagaagctggctgggcctgagattcctgagagccctgagactgatccagttcagcgagatcctgcagttcctgaacatcctgaagaccagcaacagcatcaagctggtgaacctgctgagcatcttcatcagcacctggctgaccgccgccggcttcatccacctggtggagaacagcggcgacccctgggagaacttccagaacaaccaggccctgacctactgggagtgcgtgtacctgctgatggtgaccatgagcaccgtgggctacggcgacgtgtacgccaagaccaccctgggcagactgttcatggtgttcttcatcctgggcggcctggccatgttcgccagctacgtgcccgagatcatcgagctgatcggcaacagaaagaagtacggcggcagctacagcgccgtgagcggcagaaagcacatcgtggtgtgcggccacatcaccctggagagcgtgagcaacttcctgaaggacttcctgcacaaggacagagacgacgtgaacgtggagatcgtgttcctgcacaacatcagccccaacctggagctggaggccctgttcaagagacacttcacccaggtggagttctaccagggcagcgtgctgaacccccacgacctggccagagtgaagatcgagagcgccgacgcctgcctgatcctggccaacaagtactgcgccgaccccgacgccgaggacgccagcaacatcatgagagtgatcagcatcaagaactaccaccccaagatcagaatcatcacccagatgctgcagtaccacaacaaggcccacctgctgaacatccccagctggaactggaaggagggcgacgacgccatctgcctggccgagctgaagctgggcttcatcgcccagagctgcctggcccagggcctgagcaccatgctggccaacctgttcagcatgagaagcttcatcaagatcgaggaggacacctggcagaagtactacctggagggcgtgagcaacgagatgtacaccgagtacctgagcagcgccttcgtgggcctgagcttccccaccgtgtgcgagctgtgcttcgtgaagctgaagctgctgatgatcgccatcgagtacaagagcgccaacagagagagcagaatcctgatcaaccccggcaaccacctgaagatccaggagggcaccctgggcttcttcatcgccagcgacgccaaggaggtgaagagagccttcttctactgcaaggcctgccacgacgacatcaccgaccccaagagaatcaagaagtgcggctgcaagagacccaagatgagcatctacaagagaatgagaagagcctgctgcttcgactgcggcagaagcgagagagactgcagctgcatgagcggcagagtgagaggcaacgtggacaccctggagagagccttccccctgagcagcgtgagcgtgaacgactgcagcaccagcttcagagccttcgaggacgagcagcccagcaccctgagccccaagaagaagcagagaaacggcggcatgagaaacagccccaacaccagccccaagctgatgagacacgaccccctgctgatccccggcaacgaccagatcgacaacatggacagcaacgtgaagaagtacgacagcaccggcatgttccactggtgcgcccccaaggagatcgagaaggtgatcctgaccagaagcgaggccgccatgaccgtgctgagcggccacgtggtggtgtgcatcttcggcgacgtgagcagcgccctgatcggcctgagaaacctggtgatgcccctgagagccagcaacttccactaccacgagctgaagcacatcgtgttcgtgggcagcatcgagtacctgaagagagagtgggagaccctgcacaacttccccaaggtgagcatcctgcccggcacccccctgagcagagccgacctgagagccgtgaacatcaacctgtgcgacatgtgcgtgatcctgagcgccaaccagaacaacatcgacgacaccagcctgcaggacaaggagtgcatcctggccagcctgaacatcaagagcatgcagttcgacgacagcatcggcgtgctgcaggccaacagccagggcttcaccccccccggcatggacagaagcagccccgacaacagccccgtgcacggcatgctgagacagcccagcatcaccaccggcgtgaacatccccatcatcaccgagctggtgaacgacaccaacgtgcagttcctggaccaggacgacgacgacgaccccgacaccgagctgtacctgacccagcccttcgcctgcggcaccgccttcgccgtgagcgtgctggacagcctgatgagcgccacctacttcaacgacaacatcctgaccctgatcagaaccctggtgaccggcggcgccacccccgagctggaggccctgatcgccgaggagaacgccctgagaggcggctacagcaccccccagaccctggccaacagagacagatgcagagtggcccagctggccctgctggacggccccttcgccgacctgggcgacggcggctgctacggcgacctgttctgcaaggccctgaagacctacaacatgctgtgcttcggcatctacagactgagagacgcccacctgagcacccccagccagtgcaccaagagatacgtgatcaccaaccccccctacgagttcgagctggtgcccaccgacctgatcttctgcctgatgcagttcgaccacaacgccggccagagcagagccagcctgagccacagcagccacagcagccagagcagcagcaagaagagcagcagcgtgcacagcatccccagcaccgccaacagacagaacagacccaagagcagagagagcagagacaagcagaacgccaccagaatgaacagaatgggccaggagaagaagtggttcaccgacgagcccgacaacgcctaccccagaaacatccagatcaagcccatgagcacccacatggccaaccagatcaaccagtacaagagcaccagcagcctgatcccccccatcagagaggtggaggacgagtgctag

SEQ ID NO: 94095 - DNA, 3660 bp, Artificial Sequence
  Description of Artificial Sequence: Synthetic coding sequence
atggccaacggcggcggcggcggcggcggcagcagcggcggcggcggcggcggcggcggcagcagcctgagaatgagcagcaacatccacgccaaccacctgagcctggacgccagcagcagcagcagcagcagcagcagcagcagcagcagcagcagcagcagcagcagcagcagcagcgtgcacgagcccaagatggacgccctgatcatccccgtgaccatggaggtgccctgcgacagcagaggccagagaatgtggtgggccttcctggccagcagcatggtgaccttcttcggcggcctgttcatcatcctgctgtggagaaccctgaagtacctgtggaccgtgtgctgccactgcggcggcaagaccaaggaggcccagaagatcaacaacggcagcagccaggccgacggcaccctgaagcccgtggacgagaaggaggaggccgtggccgccgaggtgggctggatgaccagcgtgaaggactgggccggcgtgatgatcagcgcccagaccctgaccggcagagtgctggtggtgctggtgttcgccctgagcatcggcgccctggtgatctacttcatcgacagcagcaaccccatcgagagctgccagaacttctacaaggacttcaccctgcagatcgacatggccttcaacgtgttcttcctgctgtacttcggcctgagattcatcgccgccaacgacaagctgtggttctggctggaggtgaacagcgtggtggacttcttcaccgtgccccccgtgttcgtgagcgtgtacctgaacagaagctggctgggcctgagattcctgagagccctgagactgatccagttcagcgagatcctgcagttcctgaacatcctgaagaccagcaacagcatcaagctggtgaacctgctgagcatcttcatcagcacctggctgaccgccgccggcttcatccacctggtggagaacagcggcgacccctgggagaacttccagaacaaccaggccctgacctactgggagtgcgtgtacctgctgatggtgaccatgagcaccgtgggctacggcgacgtgtacgccaagaccaccctgggcagactgttcatggtgttcttcatcctgggcggcctggccatgttcgccagctacgtgcccgagatcatcgagctgatcggcaacagaaagaagtacggcggcagctacagcgccgtgagcggcagaaagcacatcgtggtgtgcggccacatcaccctggagagcgtgagcaacttcctgaaggacttcctgcacaaggacagagacgacgtgaacgtggagatcgtgttcctgcacaacatcagccccaacctggagctggaggccctgttcaagagacacttcacccaggtggagttctaccagggcagcgtgctgaacccccacgacctggccagagtgaagatcgagagcgccgacgcctgcctgatcctggccaacaagtactgcgccgaccccgacgccgaggacgccagcaacatcatgagagtgatcagcatcaagaactaccaccccaagatcagaatcatcacccagatgctgcagtaccacaacaaggcccacctgctgaacatccccagctggaactggaaggagggcgacgacgccatctgcctggccgagctgaagctgggcttcatcgcccagagctgcctggcccagggcctgagcaccatgctggccaacctgttcagcatgagaagcttcatcaagatcgaggaggacacctggcagaagtactacctggagggcgtgagcaacgagatgtacaccgagtacctgagcagcgccttcgtgggcctgagcttccccaccgtgtgcgagctgtgcttcgtgaagctgaagctgctgatgatcgccatcgagtacaagagcgccaacagagagagcagaatcctgatcaaccccggcaaccacctgaagatccaggagggcaccctgggcttcttcatcgccagcgacgccaaggaggtgaagagagccttcttctactgcaaggcctgccacgacgacatcaccgaccccaagagaatcaagaagtgcggctgcaagagactggaggacgagcagcccagcaccctgagccccaagaagaagcagagaaacggcggcatgagaaacagccccaacaccagccccaagctgatgagacacgaccccctgctgatccccggcaacgaccagatcgacaacatggacagcaacgtgaagaagtacgacagcaccggcatgttccactggtgcgcccccaaggagatcgagaaggtgatcctggtgaccggctggatgccctacctgggccccagagtgctgatgacctgcctggacatcggcgtggtgtgcatgcccaccgacatccagagcaccagccccgccagcatcaagaagttcaaggagaccagaagcgaggccgccatgaccgtgctgagcggccacgtggtggtgtgcatcttcggcgacgtgagcagcgccctgatcggcctgagaaacctggtgatgcccctgagagccagcaacttccactaccacgagctgaagcacatcgtgttcgtgggcagcatcgagtacctgaagagagagtgggagaccctgcacaacttccccaaggtgagcatcctgcccggcacccccctgagcagagccgacctgagagccgtgaacatcaacctgtgcgacatgtgcgtgatcctgagcgccaaccagaacaacatcgacgacaccagcctgcaggacaaggagtgcatcctggccagcctgaacatcaagagcatgcagttcgacgacagcatcggcgtgctgcaggccaacagccagggcttcaccccccccggcatggacagaagcagccccgacaacagccccgtgcacggcatgctgagacagcccagcatcaccaccggcgtgaacatccccatcatcaccgagctggtgaacgacaccaacgtgcagttcctggaccaggacgacgacgacgaccccgacaccgagctgtacctgacccagcccttcgcctgcggcaccgccttcgccgtgagcgtgctggacagcctgatgagcgccacctacttcaacgacaacatcctgaccctgatcagaaccctggtgaccggcggcgccacccccgagctggaggccctgatcgccgaggagaacgccctgagaggcggctacagcaccccccagaccctggccaacagagacagatgcagagtggcccagctggccctgctggacggccccttcgccgacctgggcgacggcggctgctacggcgacctgttctgcaaggccctgaagacctacaacatgctgtgcttcggcatctacagactgagagacgcccacctgagcacccccagccagtgcaccaagagatacgtgatcaccaaccccccctacgagttcgagctggtgcccaccgacctgatcttctgcctgatgcagttcgaccacaacgccggccagagcagagccagcctgagccacagcagccacagcagccagagcagcagcaagaagagcagcagcgtgcacagcatccccagcaccgccaacagacagaacagacccaagagcagagagagcagagacaagcagaagtacgtgcaggaggagagactgtag

SEQ ID NO: 94096 - DNA, 3723 bp, Artificial Sequence
  Description of Artificial Sequence: Synthetic coding sequence
atggccaacggcggcggcggcggcggcggcagcagcggcggcggcggcggcggcggcggcagcagcctgagaatgagcagcaacatccacgccaaccacctgagcctggacgccagcagcagcagcagcagcagcagcagcagcagcagcagcagcagcagcagcagcagcagcagcagcgtgcacgagcccaagatggacgccctgatcatccccgtgaccatggaggtgccctgcgacagcagaggccagagaatgtggtgggccttcctggccagcagcatggtgaccttcttcggcggcctgttcatcatcctgctgtggagaaccctgaagtacctgtggaccgtgtgctgccactgcggcggcaagaccaaggaggcccagaagatcaacaacggcagcagccaggccgacggcaccctgaagcccgtggacgagaaggaggaggccgtggccgccgaggtgggctggatgaccagcgtgaaggactgggccggcgtgatgatcagcgcccagaccctgaccggcagagtgctggtggtgctggtgttcgccctgagcatcggcgccctggtgatctacttcatcgacagcagcaaccccatcgagagctgccagaacttctacaaggacttcaccctgcagatcgacatggccttcaacgtgttcttcctgctgtacttcggcctgagattcatcgccgccaacgacaagctgtggttctggctggaggtgaacagcgtggtggacttcttcaccgtgccccccgtgttcgtgagcgtgtacctgaacagaagctggctgggcctgagattcctgagagccctgagactgatccagttcagcgagatcctgcagttcctgaacatcctgaagaccagcaacagcatcaagctggtgaacctgctgagcatcttcatcagcacctggctgaccgccgccggcttcatccacctggtggagaacagcggcgacccctgggagaacttccagaacaaccaggccctgacctactgggagtgcgtgtacctgctgatggtgaccatgagcaccgtgggctacggcgacgtgtacgccaagaccaccctgggcagactgttcatggtgttcttcatcctgggcggcctggccatgttcgccagctacgtgcccgagatcatcgagctgatcggcaacagaaagaagtacggcggcagctacagcgccgtgagcggcagaaagcacatcgtggtgtgcggccacatcaccctggagagcgtgagcaacttcctgaaggacttcctgcacaaggacagagacgacgtgaacgtggagatcgtgttcctgcacaacatcagccccaacctggagctggaggccctgttcaagagacacttcacccaggtggagttctaccagggcagcgtgctgaacccccacgacctggccagagtgaagatcgagagcgccgacgcctgcctgatcctggccaacaagtactgcgccgaccccgacgccgaggacgccagcaacatcatgagagtgatcagcatcaagaactaccaccccaagatcagaatcatcacccagatgctgcagtaccacaacaaggcccacctgctgaacatccccagctggaactggaaggagggcgacgacgccatctgcctggccgagctgaagctgggcttcatcgcccagagctgcctggcccagggcctgagcaccatgctggccaacctgttcagcatgagaagcttcatcaagatcgaggaggacacctggcagaagtactacctggagggcgtgagcaacgagatgtacaccgagtacctgagcagcgccttcgtgggcctgagcttccccaccgtgtgcgagctgtgcttcgtgaagctgaagctgctgatgatcgccatcgagtacaagagcgccaacagagagagcagaggcagactgagcatcctgatcaaccccggcaaccacctgaagatccaggagggcaccctgggcttcttcatcgccagcgacgccaaggaggtgaagagagccttcttctactgcaaggcctgccacgacgacatcaccgaccccaagagaatcaagaagtgcggctgcaagagacccaagatgagcatctacaagagaatgagaagagcctgctgcttcgactgcggcagaagcgagagagactgcagctgcatgagcggcagagtgagaggcaacgtggacaccctggagagagccttccccctgagcagcgtgagcgtgaacgactgcagcaccagcttcagagccttcgaggacgagcagcccagcaccctgagccccaagaagaagcagagaaacggcggcatgagaaacagccccaacaccagccccaagctgatgagacacgaccccctgctgatccccggcaacgaccagatcgacaacatggacagcaacgtgaagaagtacgacagcaccggcatgttccactggtgcgcccccaaggagatcgagaaggtgatcctgaccagaagcgaggccgccatgaccgtgctgagcggccacgtggtggtgtgcatcttcggcgacgtgagcagcgccctgatcggcctgagaaacctggtgatgcccctgagagccagcaacttccactaccacgagctgaagcacatcgtgttcgtgggcagcatcgagtacctgaagagagagtgggagaccctgcacaacttccccaaggtgagcatcctgcccggcacccccctgagcagagccgacctgagagccgtgaacatcaacctgtgcgacatgtgcgtgatcctgagcgccaaccagaacaacatcgacgacaccagcctgcaggacaaggagtgcatcctggccagcctgaacatcaagagcatgcagttcgacgacagcatcggcgtgctgcaggccaacagccagggcttcaccccccccggcatggacagaagcagccccgacaacagccccgtgcacggcatgctgagacagcccagcatcaccaccggcgtgaacatccccatcatcaccgagctggtgaacgacaccaacgtgcagttcctggaccaggacgacgacgacgaccccgacaccgagctgtacctgacccagcccttcgcctgcggcaccgccttcgccgtgagcgtgctggacagcctgatgagcgccacctacttcaacgacaacatcctgaccctgatcagaaccctggtgaccggcggcgccacccccgagctggaggccctgatcgccgaggagaacgccctgagaggcggctacagcaccccccagaccctggccaacagagacagatgcagagtggcccagctggccctgctggacggccccttcgccgacctgggcgacggcggctgctacggcgacctgttctgcaaggccctgaagacctacaacatgctgtgcttcggcatctacagactgagagacgcccacctgagcacccccagccagtgcaccaagagatacgtgatcaccaaccccccctacgagttcgagctggtgcccaccgacctgatcttctgcctgatgcagttcgaccacaacgccggccagagcagagccagcctgagccacagcagccacagcagccagagcagcagcaagaagagcagcagcgtgcacagcatccccagcaccgccaacagacagaacagacccaagagcagagagagcagagacaagcagaagtacgtgcaggaggagagactgtag

SEQ ID NO: 94097 - DNA, 2970 bp, Artificial Sequence
  Description of Artificial Sequence: Synthetic coding sequence
atggccttcaacgtgttcttcctgctgtacttcggcctgagattcatcgccgccaacgacaagctgtggttctggctggaggtgaacagcgtggtggacttcttcaccgtgccccccgtgttcgtgagcgtgtacctgaacagaagctggctgggcctgagattcctgagagccctgagactgatccagttcagcgagatcctgcagttcctgaacatcctgaagaccagcaacagcatcaagctggtgaacctgctgagcatcttcatcagcacctggctgaccgccgccggcttcatccacctggtggagaacagcggcgacccctgggagaacttccagaacaaccaggccctgacctactgggagtgcgtgtacctgctgatggtgaccatgagcaccgtgggctacggcgacgtgtacgccaagaccaccctgggcagactgttcatggtgttcttcatcctgggcggcctggccatgttcgccagctacgtgcccgagatcatcgagctgatcggcaacagaaagaagtacggcggcagctacagcgccgtgagcggcagaaagcacatcgtggtgtgcggccacatcaccctggagagcgtgagcaacttcctgaaggacttcctgcacaaggacagagacgacgtgaacgtggagatcgtgttcctgcacaacatcagccccaacctggagctggaggccctgttcaagagacacttcacccaggtggagttctaccagggcagcgtgctgaacccccacgacctggccagagtgaagatcgagagcgccgacgcctgcctgatcctggccaacaagtactgcgccgaccccgacgccgaggacgccagcaacatcatgagagtgatcagcatcaagaactaccaccccaagatcagaatcatcacccagatgctgcagtaccacaacaaggcccacctgctgaacatccccagctggaactggaaggagggcgacgacgccatctgcctggccgagctgaagctgggcttcatcgcccagagctgcctggcccagggcctgagcaccatgctggccaacctgttcagcatgagaagcttcatcaagatcgaggaggacacctggcagaagtactacctggagggcgtgagcaacgagatgtacaccgagtacctgagcagcgccttcgtgggcctgagcttccccaccgtgtgcgagctgtgcttcgtgaagctgaagctgctgatgatcgccatcgagtacaagagcgccaacagagagagcagaatcctgatcaaccccggcaaccacctgaagatccaggagggcaccctgggcttcttcatcgccagcgacgccaaggaggtgaagagagccttcttctactgcaaggcctgccacgacgacatcaccgaccccaagagaatcaagaagtgcggctgcaagagactgaaggtggccgccagaagcagatacagcaaggaccccttcgagttcaagaaggagacccccaacagcagactggtgaccgagcccgtggaggacgagcagcccagcaccctgagccccaagaagaagcagagaaacggcggcatgagaaacagccccaacaccagccccaagctgatgagacacgaccccctgctgatccccggcaacgaccagatcgacaacatggacagcaacgtgaagaagtacgacagcaccggcatgttccactggtgcgcccccaaggagatcgagaaggtgatcctgaccagaagcgaggccgccatgaccgtgctgagcggccacgtggtggtgtgcatcttcggcgacgtgagcagcgccctgatcggcctgagaaacctggtgatgcccctgagagccagcaacttccactaccacgagctgaagcacatcgtgttcgtgggcagcatcgagtacctgaagagagagtgggagaccctgcacaacttccccaaggtgagcatcctgcccggcacccccctgagcagagccgacctgagagccgtgaacatcaacctgtgcgacatgtgcgtgatcctgagcgccaaccagaacaacatcgacgacaccagcctgcaggacaaggagtgcatcctggccagcctgaacatcaagagcatgcagttcgacgacagcatcggcgtgctgcaggccaacagccagggcttcaccccccccggcatggacagaagcagccccgacaacagccccgtgcacggcatgctgagacagcccagcatcaccaccggcgtgaacatccccatcatcaccgagctggtgaacgacaccaacgtgcagttcctggaccaggacgacgacgacgaccccgacaccgagctgtacctgacccagcccttcgcctgcggcaccgccttcgccgtgagcgtgctggacagcctgatgagcgccacctacttcaacgacaacatcctgaccctgatcagaaccctggtgaccggcggcgccacccccgagctggaggccctgatcgccgaggagaacgccctgagaggcggctacagcaccccccagaccctggccaacagagacagatgcagagtggcccagctggccctgctggacggccccttcgccgacctgggcgacggcggctgctacggcgacctgttctgcaaggccctgaagacctacaacatgctgtgcttcggcatctacagactgagagacgcccacctgagcacccccagccagtgcaccaagagatacgtgatcaccaaccccccctacgagttcgagctggtgcccaccgacctgatcttctgcctgatgcagttcgaccacaacgccggccagagcagagccagcctgagccacagcagccacagcagccagagcagcagcaagaagagcagcagcgtgcacagcatccccagcaccgccaacagacagaacagacccaagagcagagagagcagagacaagcagaagtacgtgcaggaggagagactgtag

SEQ ID NO: 94098 - DNA, 543 bp, Artificial Sequence
  Description of Artificial Sequence: Synthetic coding sequence
tgaaagatcagaatcatcacccagatgctgcagtaccacaacaaggcccacctgctgaacatccccagctggaactggaaggagggcgacgacgccatctgcctggccgagctgaagctgggcttcatcgcccagagctgcctggcccagggcctgagcaccatgctggccaacctgttcagcatgagaagcttcatcaagatcgaggaggacacctggcagaagtactacctggagggcgtgagcaacgagatgtacaccgagtacctgagcagcgccttcgtgggcctgagcttccccaccgtgtgcgagctgtgcttcgtgaagctgaagctgctgatgatcgccatcgagtacaagagcgccaacagagagagcagaatcctgatcaaccccggcaaccacctgaagatccaggagggcaccctgggcttcttcatcgccagcgacgccaaggaggtgaagagacccccccagctgtgcctgcccctggccgcccagaagagatgcttccagagcgacaagctggacatcttcatctag

SEQ ID NO: 94099 - DNA, 2661 bp, Artificial Sequence
  Description of Artificial Sequence: Synthetic coding sequence
tgaaacagcggcgacccctgggagaacttccagaacaaccaggccctgacctactgggagtgcgtgtacctgctgatggtgaccatgagcaccgtgggctacggcgacgtgtacgccaagaccaccctgggcagactgttcatggtgttcttcatcctgggcggcctggccatgttcgccagctacgtgcccgagatcatcgagctgatcggcaacagaaagaagtacggcggcagctacagcgccgtgagcggcagaaagcacatcgtggtgtgcggccacatcaccctggagagcgtgagcaacttcctgaaggacttcctgcacaaggacagagacgacgtgaacgtggagatcgtgttcctgcacaacatcagccccaacctggagctggaggccctgttcaagagacacttcacccaggtggagttctaccagggcagcgtgctgaacccccacgacctggccagagtgaagatcgagagcgccgacgcctgcctgatcctggccaacaagtactgcgccgaccccgacgccgaggacgccagcaacatcatgagagtgatcagcatcaagaactaccaccccaagatcagaatcatcacccagatgctgcagtaccacaacaaggcccacctgctgaacatccccagctggaactggaaggagggcgacgacgccatctgcctggccgagctgaagctgggcttcatcgcccagagctgcctggcccagggcctgagcaccatgctggccaacctgttcagcatgagaagcttcatcaagatcgaggaggacacctggcagaagtactacctggagggcgtgagcaacgagatgtacaccgagtacctgagcagcgccttcgtgggcctgagcttccccaccgtgtgcgagctgtgcttcgtgaagctgaagctgctgatgatcgccatcgagtacaagagcgccaacagagagagcagaatcctgatcaaccccggcaaccacctgaagatccaggagggcaccctgggcttcttcatcgccagcgacgccaaggaggtgaagagagccttcttctactgcaaggcctgccacgacgacatcaccgaccccaagagaatcaagaagtgcggctgcaagagactgaaggtggccgccagaagcagatacagcaaggaccccttcgagttcaagaaggagacccccaacagcagactggtgaccgagcccgtggaggacgagcagcccagcaccctgagccccaagaagaagcagagaaacggcggcatgagaaacagccccaacaccagccccaagctgatgagacacgaccccctgctgatccccggcaacgaccagatcgacaacatggacagcaacgtgaagaagtacgacagcaccggcatgttccactggtgcgcccccaaggagatcgagaaggtgatcctgaccagaagcgaggccgccatgaccgtgctgagcggccacgtggtggtgtgcatcttcggcgacgtgagcagcgccctgatcggcctgagaaacctggtgatgcccctgagagccagcaacttccactaccacgagctgaagcacatcgtgttcgtgggcagcatcgagtacctgaagagagagtgggagaccctgcacaacttccccaaggtgagcatcctgcccggcacccccctgagcagagccgacctgagagccgtgaacatcaacctgtgcgacatgtgcgtgatcctgagcgccaaccagaacaacatcgacgacaccagcctgcaggacaaggagtgcatcctggccagcctgaacatcaagagcatgcagttcgacgacagcatcggcgtgctgcaggccaacagccagggcttcaccccccccggcatggacagaagcagccccgacaacagccccgtgcacggcatgctgagacagcccagcatcaccaccggcgtgaacatccccatcatcaccgagctggtgaacgacaccaacgtgcagttcctggaccaggacgacgacgacgaccccgacaccgagctgtacctgacccagcccttcgcctgcggcaccgccttcgccgtgagcgtgctggacagcctgatgagcgccacctacttcaacgacaacatcctgaccctgatcagaaccctggtgaccggcggcgccacccccgagctggaggccctgatcgccgaggagaacgccctgagaggcggctacagcaccccccagaccctggccaacagagacagatgcagagtggcccagctggccctgctggacggccccttcgccgacctgggcgacggcggctgctacggcgacctgttctgcaaggccctgaagacctacaacatgctgtgcttcggcatctacagactgagagacgcccacctgagcacccccagccagtgcaccaagagatacgtgatcaccaaccccccctacgagttcgagctggtgcccaccgacctgatcttctgcctgatgcagttcgaccacaacgccggccagagcagagccagcctgagccacagcagccacagcagccagagcagcagcaagaagagcagcagcgtgcacagcatccccagcaccgccaacagacagaacagacccaagagcagagagagcagagacaagcagaagtacgtgcaggaggagagactgtag

SEQ ID NO: 94100 - DNA, 795 bp, Artificial Sequence
  Description of Artificial Sequence: Synthetic coding sequence
tgagtgatcagcatcaagaactaccaccccaagatcagaatcatcacccagatgctgcagtaccacaacaaggcccacctgctgaacatccccagctggaactggaaggagggcgacgacgccatctgcctggccgagctgaagctgggcttcatcgcccagagctgcctggcccagggcctgagcaccatgctggccaacctgttcagcatgagaagcttcatcaagatcgaggaggacacctggcagaagtactacctggagggcgtgagcaacgagatgtacaccgagtacctgagcagcgccttcgtgggcctgagcttccccaccgtgtgcgagctgtgcttcgtgaagctgaagctgctgatgatcgccatcgagtacaagagcgccaacagagagagcagaatcctgatcaaccccggcaaccacctgaagatccaggagggcaccctgggcttcttcatcgccagcgacgccaaggaggtgaagagagccttcttctactgcaaggcctgccacgacgacatcaccgaccccaagagaatcaagaagtgcggctgcaagagactggccggcagccaggacacccaccccgacagcttctaccaccaggccgtgaacgccagcagctacctgcacggcggcggccagatgtggcccgtgagcagcagcagcagcatcctgctgcactacctgagaagacagatgcccggccccgccagactgcccctggagctgagctgccagggcagcgccctgagccccaaccccgacctgtactgcatgaagtag

SEQ ID NO: 94101 - DNA, 3630 bp, Artificial Sequence
  Description of Artificial Sequence: Synthetic coding sequence
agcaacatccacgccaaccacctgagcctggacgccagcagcagcagcagcagcagcagcagcagcagcagcagcagcagcagcagcagcagcagcagcagcgtgcacgagcccaagatggacgccctgatcatccccgtgaccatggaggtgccctgcgacagcagaggccagagaatgtggtgggccttcctggccagcagcatggtgaccttcttcggcggcctgttcatcatcctgctgtggagaaccctgaagtacctgtggaccgtgtgctgccactgcggcggcaagaccaaggaggcccagaagatcaacaacggcagcagccaggccgacggcaccctgaagcccgtggacgagaaggaggaggccgtggccgccgaggtgggctggatgaccagcgtgaaggactgggccggcgtgatgatcagcgcccagaccctgaccggcagagtgctggtggtgctggtgttcgccctgagcatcggcgccctggtgatctacttcatcgacagcagcaaccccatcgagagctgccagaacttctacaaggacttcaccctgcagatcgacatggccttcaacgtgttcttcctgctgtacttcggcctgagattcatcgccgccaacgacaagctgtggttctggctggaggtgaacagcgtggtggacttcttcaccgtgccccccgtgttcgtgagcgtgtacctgaacagaagctggctgggcctgagattcctgagagccctgagactgatccagttcagcgagatcctgcagttcctgaacatcctgaagaccagcaacagcatcaagctggtgaacctgctgagcatcttcatcagcacctggctgaccgccgccggcttcatccacctggtggagaacagcggcgacccctgggagaacttccagaacaaccaggccctgacctactgggagtgcgtgtacctgctgatggtgaccatgagcaccgtgggctacggcgacgtgtacgccaagaccaccctgggcagactgttcatggtgttcttcatcctgggcggcctggccatgttcgccagctacgtgcccgagatcatcgagctgatcggcaacagaaagaagtacggcggcagctacagcgccgtgagcggcagaaagcacatcgtggtgtgcggccacatcaccctggagagcgtgagcaacttcctgaaggacttcctgcacaaggacagagacgacgtgaacgtggagatcgtgttcctgcacaacatcagccccaacctggagctggaggccctgttcaagagacacttcacccaggtggagttctaccagggcagcgtgctgaacccccacgacctggccagagtgaagatcgagagcgccgacgcctgcctgatcctggccaacaagtactgcgccgaccccgacgccgaggacgccagcaacatcatgagagtgatcagcatcaagaactaccaccccaagatcagaatcatcacccagatgctgcagtaccacaacaaggcccacctgctgaacatccccagctggaactggaaggagggcgacgacgccatctgcctggccgagctgaagctgggcttcatcgcccagagctgcctggcccagggcctgagcaccatgctggccaacctgttcagcatgagaagcttcatcaagatcgaggaggacacctggcagaagtactacctggagggcgtgagcaacgagatgtacaccgagtacctgagcagcgccttcgtgggcctgagcttccccaccgtgtgcgagctgtgcttcgtgaagctgaagctgctgatgatcgccatcgagtacaagagcgccaacagagagagcagaatcctgatcaaccccggcaaccacctgaagatccaggagggcaccctgggcttcttcatcgccagcgacgccaaggaggtgaagagagccttcttctactgcaaggcctgccacgacgacatcaccgaccccaagagaatcaagaagtgcggctgcaagagacccaagatgagcatctacaagagaatgagaagagcctgctgcttcgactgcggcagaagcgagagagactgcagctgcatgagcggcagagtgagaggcaacgtggacaccctggagagagccttccccctgagcagcgtgagcgtgaacgactgcagcaccagcttcagagccttcgaggacgagcagcccagcaccctgagccccaagaagaagcagagaaacggcggcatgagaaacagccccaacaccagccccaagctgatgagacacgaccccctgctgatccccggcaacgaccagatcgacaacatggacagcaacgtgaagaagtacgacagcaccggcatgttccactggtgcgcccccaaggagatcgagaaggtgatcctgaccagaagcgaggccgccatgaccgtgctgagcggccacgtggtggtgtgcatcttcggcgacgtgagcagcgccctgatcggcctgagaaacctggtgatgcccctgagagccagcaacttccactaccacgagctgaagcacatcgtgttcgtgggcagcatcgagtacctgaagagagagtgggagaccctgcacaacttccccaaggtgagcatcctgcccggcacccccctgagcagagccgacctgagagccgtgaacatcaacctgtgcgacatgtgcgtgatcctgagcgccaaccagaacaacatcgacgacaccagcctgcaggacaaggagtgcatcctggccagcctgaacatcaagagcatgcagttcgacgacagcatcggcgtgctgcaggccaacagccagggcttcaccccccccggcatggacagaagcagccccgacaacagccccgtgcacggcatgctgagacagcccagcatcaccaccggcgtgaacatccccatcatcaccgagctggtgaacgacaccaacgtgcagttcctggaccaggacgacgacgacgaccccgacaccgagctgtacctgacccagcccttcgcctgcggcaccgccttcgccgtgagcgtgctggacagcctgatgagcgccacctacttcaacgacaacatcctgaccctgatcagaaccctggtgaccggcggcgccacccccgagctggaggccctgatcgccgaggagaacgccctgagaggcggctacagcaccccccagaccctggccaacagagacagatgcagagtggcccagctggccctgctggacggccccttcgccgacctgggcgacggcggctgctacggcgacctgttctgcaaggccctgaagacctacaacatgctgtgcttcggcatctacagactgagagacgcccacctgagcacccccagccagtgcaccaagagatacgtgatcaccaaccccccctacgagttcgagctggtgcccaccgacctgatcttctgcctgatgcagttcgaccacaacgccggccagagcagagccagcctgagccacagcagccacagcagccagagcagcagcaagaagagcagcagcgtgcacagcatccccagcaccgccaacagacagaacagacccaagagcagagagagcagagacaagcagaagaaggagatggtgtacagatag

SEQ ID NO: 94102 - DNA, 576 bp, Artificial Sequence
  Description of Artificial Sequence: Synthetic coding sequence
atggtgaagaagctggtgatggcccagaagagaggcgagaccagagccctgtgcctgggcgtgaccatggtggtgtgcgccgtgatcacctactacatcctggtgaccaccgtgctgcccctgtaccagaagagcgtgtggacccaggagagcaagtgccacctgatcgagaccaacatcagagaccaggaggagctgaagggcaagaaggtgccccagtacccctgcctgtgggtgaacgtgagcgccgccggcagatgggccgtgctgtaccacaccgaggacaccagagaccagaaccagcagtgcagctacatccccggcagcgtggacaactaccagaccgccagagccgacgtggagaaggtgagagccaagttccaggagcagcaggtgttctactgcttcagcgcccccagaggcaacgagaccagcgtgctgttccagagactgtacggcccccaggccctgctgttcagcctgttctggcccaccttcctgctgaccggcggcctgctgatcatcgccatggtgaagagcaaccagtacctgagcatcctggccgcccagaagtag

SEQ ID NO: 94103 - DNA, 393 bp, Artificial Sequence
  Description of Artificial Sequence: Synthetic coding sequence
atggtgaagaagctggtgatggcccagaagagaggcgagaccagagccctgtgcctgggcgtgaccatggtggtgtgcgccgtgatcacctactacatcctggtgaccaccgtgctgcccctgtaccagaagagcgtgtggacccaggagagcaagtgccacctgatcgagaccaacatcagagaccaggaggagctgaagggcaagaaggtgccccagtacccctgcctgtgggtgaacgtgagcgccgccggcagatgggccgtgctgtaccacaccgaggacaccagagaccagaaccagcaggtgctgaactggagagacggcgacaccagcctgtacccctgccaggtgtgcgagcccgtgcccaactgcccctgccccagaggctag

SEQ ID NO: 94104 - DNA, 633 bp, Artificial Sequence
  Description of Artificial Sequence: Synthetic coding sequence
atggccaagctgagagtggcctacgagtacaccgaggccgaggacaagagcatcagactgggcctgttcctgatcatcagcggcgtggtgagcctgttcatcttcggcttctgctggctgagccccgccctgcaggacctgcaggccaccgaggccaactgcaccgtgctgagcgtgcagcagatcggcgaggtgttcgagtgcaccttcacctgcggcgccgactgcagaggcaccagccagtacccctgcgtgcaggtgtacgtgaacaacagcgagagcaacagcagagccctgctgcacagcgacgagcaccagctgctgaccaaccccaagtgcagctacatccccccctgcaagagagagaaccagaagaacctggagagcgtgatgaactggcagcagtactggaaggacgagatcggcagccagcccttcacctgctacttcaaccagcaccagagacccgacgacgtgctgctgcacagaacccacgacgagatcgtgctgctgcactgcttcctgtggcccctggtgaccttcgtggtgggcgtgctgatcgtggtgctgaccatctgcgccaagagcctggccgtgaaggccgaggccatgaagaagagaaagttcagctag

SEQ ID NO: 94105 - DNA, 2259 bp, Artificial Sequence
  Description of Artificial Sequence: Synthetic coding sequence
atgaagcccgccgagcacgccaccatgttcctgatcgtgctgggctgcctgatcctggccgtgctgaccaccttcaaggagtacgagaccgtgagcggcgactggctgctgctgctggagaccttcgccatcttcatcttcggcgccgagttcgccctgagaatctgggccgccggctgctgctgcagatacaagggctggagaggcagactgaagttcgccagaaagcccctgtgcatgctggacatcttcgtgctgatcgccagcgtgcccgtggtggccgtgggcaaccagggcaacgtgctggccaccagcctgagaagcctgagattcctgcagatcctgagaatgctgagaatggacagaagaggcggcacctggaagctgctgggcagcgccatctgcgcccacagcaaggagctgatcaccgcctggtacatcggcttcctgaccctgatcctgagcagcttcctggtgtacctggtggagaaggacgtgcccgaggtggacgcccagggcgaggagatgaaggaggagttcgagacctacgccgacgccctgtggtggggcctgatcaccctggccaccatcggctacggcgacaagacccccaagacctgggagggcagactgatcgccgccaccttcagcctgatcggcgtgagcttcttcgccctgcccgccggcatcctgggcagcggcctggccctgaaggtgcaggagcagcacagacagaagcacttcgagaagagaagaaagcccgccgccgagctgatccaggccgcctggagatactacgccaccaaccccaacagaatcgacctggtggccacctggagattctacgagagcgtggtgagcttccccttcttcagaaaggagcagctggaggccgccagcagccagaagctgggcctgctggacagagtgagactgagcaaccccagaggcagcaacaccaagggcaagctgttcacccccctgaacgtggacgccatcgaggagagccccagcaaggagcccaagcccgtgggcctgaacaacaaggagagattcagaaccgccttcagaatgaaggcctacgccttctggcagagcagcgaggacgccggcaccggcgaccccatggccgaggacagaggctacggcaacgacttccccatcgaggacatgatccccaccctgaaggccgccatcagagccgtgagaatcctgcagttcagactgtacaagaagaagttcaaggagaccctgagaccctacgacgtgaaggacgtgatcgagcagtacagcgccggccacctggacatgctgagcagaatcaagtacctgcagaccagaatcgacatgatcttcacccccggcccccccagcacccccaagcacaagaagagccagaagggcagcgccttcaccttccccagccagcagagccccagaaacgagccctacgtggccagacccagcaccagcgagatcgaggaccagagcatgatgggcaagttcgtgaaggtggagagacaggtgcaggacatgggcaagaagctggacttcctggtggacatgcacatgcagcacatggagagactgcaggtgcaggtgaccgagtactaccccaccaagggcaccagcagccccgccgaggccgagaagaaggaggacaacagatacagcgacctgaagaccatcatctgcaactacagcgagaccggcccccccgagcccccctacagcttccaccaggtgaccatcgacaaggtgagcccctacggcttcttcgcccacgaccccgtgaacctgcccagaggcggccccagcagcggcaaggtgcaggccaccccccccagcagcgccaccacctacgtggagagacccaccgtgctgcccatcctgaccctgctggacagcagagtgagctgccacagccaggccgacctgcagggcccctacagcgacagaatcagccccagacagagaagaagcatcaccagagacagcgacacccccctgagcctgatgagcgtgaaccacgaggagctggagagaagccccagcggcttcagcatcagccaggacagagacgactacgtgttcggccccaacggcggcagcagctggatgagagagaagagatacctggccgagggcgagaccgacaccgacaccgaccccttcacccccagcggcagcatgcccctgagcagcaccggcgacggcatcagcgacagcgtgtggacccccagcaacaagcccatctag

SEQ ID NO: 94106 - DNA, 1434 bp, Artificial Sequence
  Description of Artificial Sequence: Synthetic coding sequence
atgaccggccagagcctgtgggacgtgagcgaggccaacgtggaggacggcgagatcagaatcaacgtgggcggcttcaagagaagactgagaagccacaccctgctgagattccccgagaccagactgggcagactgctgctgtgccacagcagagaggccatcctggagctgtgcgacgactacgacgacgtgcagagagagttctacttcgacagaaaccccgagctgttcccctacgtgctgcacttctaccacaccggcaagctgcacgtgatggccgagctgtgcgtgttcagcttcagccaggagatcgagtactggggcatcaacgagttcttcatcgacagctgctgcagctacagctaccacggcagaaaggtggagcccgagcaggagaagtgggacgagcagagcgaccaggagagcaccaccagcagcttcgacgagatcctggccttctacaacgacgccagcaagttcgacggccagcccctgggcaacttcagaagacagctgtggctggccctggacaaccccggctacagcgtgctgagcagagtgttcagcatcctgagcatcctggtggtgatgggcagcatcatcaccatgtgcctgaacagcctgcccgacttccagatccccgacagccagggcaaccccggcgaggaccccagattcgagatcgtggagcacttcggcatcgcctggttcaccttcgagctggtggccagattcgccgtggcccccgacttcctgaagttcttcaagaacgccctgaacctgatcgacctgatgagcatcgtgcccttctacatcaccctggtggtgaacctggtggtggagagcacccccaccctggccaacctgggcagagtggcccaggtgctgagactgatgagaatcttcagaatcctgaagctggccagacacagcaccggcctgagaagcctgggcgccaccctgaagtacagctacaaggaggtgggcctgctgctgctgtacctgagcgtgggcatcagcatcttcagcgtggtggcctacaccatcgagaaggaggagaacgagggcctggccaccatccccgcctgctggtggtgggccaccgtgagcatgaccaccgtgggctacggcgacgtggtgcccggcaccaccgccggcaagctgaccgccagcgcctgcatcctggccggcatcctggtggtggtgctgcccatcaccctgatcttcaacaagttcagccacttctacagaagacagaagcagctggagagcgccatgagaagctgcgacttcggcgacggcatgaaggaggtgcccagcgtgaacctgagagactactacgcccacaaggtgaagagcctgatggccagcctgaccaacatgagcagaagcagccccagcgagctgagcctgaacgacagcctgagatag

SEQ ID NO: 94107 - DNA, 1434 bp, Artificial Sequence; identical to SEQ ID NO: 94106
  Description of Artificial Sequence: Synthetic coding sequence

SEQ ID NO: 94108 - DNA, 1476 bp, Artificial Sequence
  Description of Artificial Sequence: Synthetic coding sequence
atggtgttcggcgagttcttccacagacccggccaggacgaggagctggtgaacctgaacgtgggcggcttcaagcagagcgtggaccagagcaccctgctgagattcccccacaccagactgggcaagctgctgacctgccacagcgaggaggccatcctggagctgtgcgacgactacagcgtggccgacaaggagtactacttcgacagaaaccccagcctgttcagatacgtgctgaacttctactacaccggcaagctgcacgtgatggaggagctgtgcgtgttcagcttctgccaggagatcgagtactggggcatcaacgagctgttcatcgacagctgctgcagcaacagataccaggagagaaaggaggagaaccacgagaaggactgggaccagaagagccacgacgtgagcaccgacagcagcttcgaggagagcagcctgttcgagaaggagctggagaagttcgacaccctgagattcggccagctgagaaagaagatctggatcagaatggagaaccccgcctactgcctgagcgccaagctgatcgccatcagcagcctgagcgtggtgctggccagcatcgtggccatgtgcgtgcacagcatgagcgagttccagaacgaggacggcgaggtggacgaccccgtgctggagggcgtggagatcgcctgcatcgcctggttcaccggcgagctggccgtgagactggccgccgccccctgccagaagaagttctggaagaaccccctgaacatcatcgacttcgtgagcatcatccccttctacgccaccctggccgtggacaccaaggaggaggagagcgaggacatcgagaacatgggcaaggtggtgcagatcctgagactgatgagaatcttcagaatcctgaagctggccagacacagcgtgggcctgagaagcctgggcgccaccctgagacacagctaccacgaggtgggcctgctgctgctgttcctgagcgtgggcatcagcatcttcagcgtgctgatctacagcgtggagaaggacgaccacaccagcagcctgaccagcatccccatctgctggtggtgggccaccatcagcatgaccaccgtgggctacggcgacacccaccccgtgaccctggccggcaagctgatcgccagcacctgcatcatctgcggcatcctggtggtggccctgcccatcaccatcatcttcaacaagttcagcaagtactaccagaagcagaaggacatcgacgtggaccagtgcagcgaggacgcccccgagaagtgccacgagctgccctacttcaacatcagagacatctacgcccagagaatgcacaccttcatcaccagcctgagcagcgtgggcatcgtggtgagcgaccccgacagcaccgacgccagcagcatcgaggacaacgaggacatctgcaacaccaccagcctggagaactgcaccgccaagtag

SEQ ID NO: 94109 - DNA, 1476 bp, Artificial Sequence; identical to SEQ ID NO: 94108
  Description of Artificial Sequence: Synthetic coding sequence

SEQ ID NO: 94110 - DNA, 225 bp, Artificial Sequence
  Description of Artificial Sequence: Synthetic coding sequence
atggtgttcggcgagttcttccacagacccggccaggacgaggagctggtgaacctgaacgtgggcggcttcaagcagagcgtggaccagagcaccctgctgagattcccccacaccagactgggcaagctgctgacctgccacagcgaggaggccatcctggagctgtgcgacgactacagcgtggccgacaaggagtactacttcgacagaaaccccagctag

SEQ ID NO: 94111 - DNA, 390 bp, Artificial Sequence
  Description of Artificial Sequence: Synthetic coding sequence
atgatcctgagcaacaccaccgccgtgacccccttcctgaccaagctgtggcaggagaccgtgcagcagggcggcaacatgagcggcctggccagaagaagccccagaagcagcgacggcaagctggaggccctgtacgtgctgatggtgctgggcttcttcggcttcttcaccctgggcatcatgctgagctacatcagaagcaagaagctggagcacagcaacgaccccttcaacgtgtacatcgagagcgacgcctggcaggagaaggacaaggcctacgtgcaggccagagtgctggagagctacagaagctgctacgtggtggagaaccacctggccatcgagcagcccaacacccacctgcccgagaccaagcccagcccctag

SEQ ID NO: 94112 - DNA, 390 bp, Artificial Sequence; identical to SEQ ID NO: 94111
  Description of Artificial Sequence: Synthetic coding sequence

SEQ ID NO: 94113 - DNA, 390 bp, Artificial Sequence; identical to SEQ ID NO: 94111
  Description of Artificial Sequence: Synthetic coding sequence

SEQ ID NO: 94114 - DNA, 390 bp, Artificial Sequence; identical to SEQ ID NO: 94111
  Description of Artificial Sequence: Synthetic coding sequence

SEQ ID NO: 94115 - DNA, 390 bp, Artificial Sequence; identical to SEQ ID NO: 94111
  Description of Artificial Sequence: Synthetic coding sequence

SEQ ID NO: 94116 - DNA, 390 bp, Artificial Sequence; identical to SEQ ID NO: 94111
  Description of Artificial Sequence: Synthetic coding sequence

SEQ ID NO: 94117 - DNA, 372 bp, Artificial Sequence
  Description of Artificial Sequence: Synthetic coding sequence
atgagcaccctgagcaacttcacccagaccctggaggacgtgttcagaagaatcttcatcacctacatggacaactggagacagaacaccaccgccgagcaggaggccctgcaggccaaggtggacgccgagaacttctactacgtgatcctgtacctgatggtgatgatcggcatgttcagcttcatcatcgtggccatcctggtgagcaccgtgaagagcaagagaagagagcacagcaacgacccctaccaccagtacatcgtggaggactggcaggagaagtacaagagccagatcctgaacctggaggagagcaaggccaccatccacgagaacatcggcgccgccggcttcaagatgagcccctag

SEQ ID NO: 94118 - DNA, 312 bp, Artificial Sequence
  Description of Artificial Sequence: Synthetic coding sequence
atggagaccaccaacggcaccgagacctggtacgagagcctgcacgccgtgctgaaggccctgaacgccaccctgcacagcaacctgctgtgcagacccggccccggcctgggccccgacaaccagaccgaggagagaagagccagcctgcccggcagagacgacaacagctacatgtacatcctgttcgtgatgttcctgttcgccgtgaccgtgggcagcctgatcctgggctacaccagaagcagaaaggtggacaagagaagcgacccctaccacgtgtacatcaagaacagagtgagcatgatctag

SEQ ID NO: 94119 - DNA, 312 bp, Artificial Sequence; identical to SEQ ID NO: 94118
  Description of Artificial Sequence: Synthetic coding sequence

SEQ ID NO: 94120 - DNA, 39 bp, Artificial Sequence
  Description of Artificial Sequence: Synthetic coding sequence
atggagaccaccaacggcaccgagacctggtacgagtag

SEQ ID NO: 94121 - DNA, 153 bp, Artificial Sequence
  Description of Artificial Sequence: Synthetic coding sequence
atggagaccaccaacggcaccgagacctggtacgagagcctgcacgccgtgctgaaggccctgaacgccaccctgcacagcaacctgctgtgcagacccggccccggcctgggccccgacaaccagaccgaggagagaagagccagcctgtag

SEQ ID NO: 94122 - DNA, 162 bp, Artificial Sequence
  Description of Artificial Sequence: Synthetic coding sequence
atggagaccaccaacggcaccgagacctggtacgagagcctgcacgccgtgctgaaggccctgaacgccaccctgcacagcaacctgctgtgcagacccggccccggcctgggccccgacaaccagaccgaggagagaagagccagcctgcccggcagatag

SEQ ID NO: 94123 - DNA, 300 bp, Artificial Sequence
  Description of Artificial Sequence: Synthetic coding sequence
atggagaccaccaacggcaccgagacctggtacgagagcctgcacgccgtgctgaaggccctgaacgccaccctgcacagcaacctgctgtgcagacccggccccggcctgggccccgacaaccagaccgaggagagaagagccagcctgcccggcagagacgacaacagctacatgtacatcctgttcgtgatgttcctgttcgccgtgaccgtgggcagcctgatcctgggctacaccagaagcagaaaggtggacaagagaagcgacccctaccacgtgtacatcaagaacagatag

SEQ ID NO: 94124 - DNA, 513 bp, Artificial Sequence
  Description of Artificial Sequence: Synthetic coding sequence
atgctgaagatggagcccctgaacagcacccaccccggcaccgccgccagcagcagccccctggagagcagagccgccggcggcggcagcggcaacggcaacgagtacttctacatcctggtggtgatgagcttctacggcatcttcctgatcggcatcatgctgggctacatgaagagcaagagaagagagaagaagagcagcctgctgctgctgtacaaggacgaggagagactgtggggcgaggccatgaagcccctgcccgtggtgagcggcctgagaagcgtgcaggtgcccctgatgctgaacatgctgcaggagagcgtggcccccgccctgagctgcaccctgtgcagcatggagggcgacagcgtgagcagcgagagcagcagccccgacgtgcacctgaccatccaggaggagggcgccgacgacgagctggaggagaccagcgagacccccctgaacgagagcagcgagggcagcagcgagaacatccaccagaacagctag

SEQ ID NO: 94125 - DNA, 2031 bp, Artificial Sequence
  Description of Artificial Sequence: Synthetic coding sequence
atggccgccgccagcagcccccccagagccgagagaaagagatggggctggggcagactgcccggcgccagaagaggcagcgccggcctggccaagaagtgccccttcagcctggagctggccgagggcggccccgccggcggcgccctgtacgcccccatcgcccccggcgcccccggccccgccccccccgccagccccgccgcccccgccgccccccccgtggccagcgacctgggccccagaccccccgtgagcctggaccccagagtgagcatctacagcaccagaagacccgtgctggccagaacccacgtgcagggcagagtgtacaacttcctggagagacccaccggctggaagtgcttcgtgtaccacttcgccgtgttcctgatcgtgctggtgtgcctgatcttcagcgtgctgagcaccatcgagcagtacgccgccctggccaccggcaccctgttctggatggagatcgtgctggtggtgttcttcggcaccgagtacgtggtgagactgtggagcgccggctgcagaagcaagtacgtgggcctgtggggcagactgagattcgccagaaagcccatcagcatcatcgacctgatcgtggtggtggccagcatggtggtgctgtgcgtgggcagcaagggccaggtgttcgccaccagcgccatcagaggcatcagattcctgcagatcctgagaatgctgcacgtggacagacagggcggcacctggagactgctgggcagcgtggtgttcatccacagacaggagctgatcaccaccctgtacatcggcttcctgggcctgatcttcagcagctacttcgtgtacctggccgagaaggacgccgtgaacgagagcggcagagtggagttcggcagctacgccgacgccctgtggtggggcgtggtgaccgtgaccaccatcggctacggcgacaaggtgccccagacctgggtgggcaagaccatcgccagctgcttcagcgtgttcgccatcagcttcttcgccctgcccgccggcatcctgggcagcggcttcgccctgaaggtgcagcagaagcagagacagaagcacttcaacagacagatccccgccgccgccagcctgatccagaccgcctggagatgctacgccgccgagaaccccgacagcagcacctggaagatctacatcagaaaggcccccagaagccacaccctgctgagccccagccccaagcccaagaagagcgtggtggtgaagaagaagaagttcaagctggacaaggacaacggcgtgacccccggcgagaagatgctgaccgtgccccacatcacctgcgacccccccgaggagagaagactggaccacttcagcgtggacggctacgacagcagcgtgagaaagagccccaccctgctggaggtgagcatgccccacttcatgagaaccaacagcttcgccgaggacctggacctggagggcgagaccctgctgacccccatcacccacatcagccagctgagagagcaccacagagccaccatcaaggtgatcagaagaatgcagtacttcgtggccaagaagaagttccagcaggccagaaagccctacgacgtgagagacgtgatcgagcagtacagccagggccacctgaacctgatggtgagaatcaaggagctgcagagaagactggaccagagcatcggcaagcccagcctgttcatcagcgtgagcgagaagagcaaggacagaggcagcaacaccatcggcgccagactgaacagagtggaggacaaggtgacccagctggaccagagactggccctgatcaccgacatgctgcaccagctgctgagcctgcacggcggcagcacccccggcagcggcggcccccccagagagggcggcgcccacatcacccagccctgcggcagcggcggcagcgtggaccccgagctgttcctgcccagcaacaccctgcccacctacgagcagctgaccgtgcccagaagaggccccgacgagggcagctag

SEQ ID NO: 94126 - DNA, 1650 bp, Artificial Sequence
  Description of Artificial Sequence: Synthetic coding sequence
atggacttcctgatcgtgctggtgtgcctgatcttcagcgtgctgagcaccatcgagcagtacgccgccctggccaccggcaccctgttctggatggagatcgtgctggtggtgttcttcggcaccgagtacgtggtgagactgtggagcgccggctgcagaagcaagtacgtgggcctgtggggcagactgagattcgccagaaagcccatcagcatcatcgacctgatcgtggtggtggccagcatggtggtgctgtgcgtgggcagcaagggccaggtgttcgccaccagcgccatcagaggcatcagattcctgcagatcctgagaatgctgcacgtggacagacagggcggcacctggagactgctgggcagcgtggtgttcatccacagacaggagctgatcaccaccctgtacatcggcttcctgggcctgatcttcagcagctacttcgtgtacctggccgagaaggacgccgtgaacgagagcggcagagtggagttcggcagctacgccgacgccctgtggtggggcgtggtgaccgtgaccaccatcggctacggcgacaaggtgccccagacctgggtgggcaagaccatcgccagctgcttcagcgtgttcgccatcagcttcttcgccctgcccgccggcatcctgggcagcggcttcgccctgaaggtgcagcagaagcagagacagaagcacttcaacagacagatccccgccgccgccagcctgatccagaccgcctggagatgctacgccgccgagaaccccgacagcagcacctggaagatctacatcagaaaggcccccagaagccacaccctgctgagccccagccccaagcccaagaagagcgtggtggtgaagaagaagaagttcaagctggacaaggacaacggcgtgacccccggcgagaagatgctgaccgtgccccacatcacctgcgacccccccgaggagagaagactggaccacttcagcgtggacggctacgacagcagcgtgagaaagagccccaccctgctggaggtgagcatgccccacttcatgagaaccaacagcttcgccgaggacctggacctggagggcgagaccctgctgacccccatcacccacatcagccagctgagagagcaccacagagccaccatcaaggtgatcagaagaatgcagtacttcgtggccaagaagaagttccagcaggccagaaagccctacgacgtgagagacgtgatcgagcagtacagccagggccacctgaacctgatggtgagaatcaaggagctgcagagaagactggaccagagcatcggcaagcccagcctgttcatcagcgtgagcgagaagagcaaggacagaggcagcaacaccatcggcgccagactgaacagagtggaggacaaggtgacccagctggaccagagactggccctgatcaccgacatgctgcaccagctgctgagcctgcacggcggcagcacccccggcagcggcggcccccccagagagggcggcgcccacatcacccagccctgcggcagcggcggcagcgtggaccccgagctgttcctgcccagcaacaccctgcccacctacgagcagctgaccgtgcccagaagaggccccgacgagggcagctag

SEQ ID NO: 94127 - DNA, 1182 bp, Artificial Sequence
  Description of Artificial Sequence: Synthetic coding sequence
atggtgcagaagagcagaaacggcggcgtgtaccccggccccagcggcgagaagaagctgaaggtgggcttcgtgggcctggaccccggcgcccccgacagcaccagagacggcgccctgctgatcgccggcagcgaggcccccaagagaggcagcatcctgagcaagcccagagccggcggcgccggcgccggcaagccccccaagagaaacgccttctacagaaagctgcagaacttcctgtacaacgtgctggagagacccagaggctgggccttcatctaccacgcctacgtgttcctgctggtgttcagctgcctggtgctgagcgtgttcagcaccatcaaggagtacgagaagagcagcgagggcgccctgtacatcctggagatcgtgaccatcgtggtgttcggcgtggagtacttcgtgagaatctgggccgccggctgctgctgcagatacagaggctggagaggcagactgaagttcgccagaaagcccttctgcgtgatcgacatcatggtgctgatcgccagcatcgccgtgctggccgccggcagccagggcaacgtgttcgccaccagcgccctgagaagcctgagattcctgcagatcctgagaatgatcagaatggacagaagaggcggcacctggaagctgctgggcagcgtggtgtacgcccacagcaaggagctggtgaccgcctggtacatcggcttcctgtgcctgatcctggccagcttcctggtgtacctggccgagaagggcgagaacgaccacttcgacacctacgccgacgccctgtggtggggcctgatcaccctgaccaccatcggctacggcgacaagtacccccagacctggaacggcagactgctggccgccaccttcaccctgatcggcgtgagcttcttcgccctgcccgccggcatcctgggcagcggcttcgccctgaaggtgcaggagcagcacagacagaagcacttcgagaagagaagaaaccccgccgccggcctgatccagagcgcctggagattctacgccaccaacctgagcagaaccgacctgcacagcacctggcagtactacgagagaaccgtgaccgtgcccatgtacagatacagaagaagagcccccgccaccaagcagctgttccacttcctgttcagcatctgcagctag

SEQ ID NO: 94128 - DNA, 2607 bp, Artificial Sequence
  Description of Artificial Sequence: Synthetic coding sequence
atggtgcagaagagcagaaacggcggcgtgtaccccggccccagcggcgagaagaagctgaaggtgggcttcgtgggcctggaccccggcgcccccgacagcaccagagacggcgccctgctgatcgccggcagcgaggcccccaagagaggcagcatcctgagcaagcccagagccggcggcgccggcgccggcaagccccccaagagaaacgccttctacagaaagctgcagaacttcctgtacaacgtgctggagagacccagaggctgggccttcatctaccacgcctacgtgttcctgctggtgttcagctgcctggtgctgagcgtgttcagcaccatcaaggagtacgagaagagcagcgagggcgccctgtacatcctggagatcgtgaccatcgtggtgttcggcgtggagtacttcgtgagaatctgggccgccggctgctgctgcagatacagaggctggagaggcagactgaagttcgccagaaagcccttctgcgtgatcgacatcatggtgctgatcgccagcatcgccgtgctggccgccggcagccagggcaacgtgttcgccaccagcgccctgagaagcctgagattcctgcagatcctgagaatgatcagaatggacagaagaggcggcacctggaagctgctgggcagcgtggtgtacgcccacagcaaggagctggtgaccgcctggtacatcggcttcctgtgcctgatcctggccagcttcctggtgtacctggccgagaagggcgagaacgaccacttcgacacctacgccgacgccctgtggtggggcctgatcaccctgaccaccatcggctacggcgacaagtacccccagacctggaacggcagactgctggccgccaccttcaccctgatcggcgtgagcttcttcgccctgcccgccggcatcctgggcagcggcttcgccctgaaggtgcaggagcagcacagacagaagcacttcgagaagagaagaaaccccgccgccggcctgatccagagcgcctggagattctacgccaccaacctgagcagaaccgacctgcacagcacctggcagtactacgagagaaccgtgaccgtgcccatgtacagactgatcccccccctgaaccagctggagctgctgagaaacctgaagagcaagagcggcctggccttcagaaaggaccccccccccgagcccagccccagccccagaggcgtggccgccaagggcaagggcagcccccaggcccagaccgtgagaagaagccccagcgccgaccagagcctggaggacagccccagcaaggtgcccaagagctggagcttcggcgacagaagcagagccagacaggccttcagaatcaagggcgccgccagcagacagaacagcgaggaggccagcctgcccggcgaggacatcgtggacgacaagagctgcccctgcgagttcgtgaccgaggacctgacccccggcctgaaggtgagcatcagagccgtgtgcgtgatgagattcctggtgagcaagagaaagttcaaggagagcctgagaccctacgacgtgatggacgtgatcgagcagtacagcgccggccacctggacatgctgagcagaatcaagagcctgcagagcagaatcgacatgatcgtgggcccccccccccccagcacccccagacacaagaagtaccccaccaagggccccaccgccccccccagagagagcccccagtacagccccagagtggaccagatcgtgggcagaggccccgccatcaccgacaaggacagaaccaagggccccgccgaggccgagctgcccgaggaccccagcatgatgggcagactgggcaaggtggagaagcaggtgctgagcatggagaagaagctggacttcctggtgaacatctacatgcagagaatgggcatcccccccaccgagaccgaggcctacttcggcgccaaggagcccgagcccgcccccccctaccacagccccgaggacagcagagagcacgtggacagacacggctgcatcgtgaagatcgtgagaagcagcagcagcaccggccagaagaacttcagcgccccccccgccgccccccccgtgcagtgcccccccagcaccagctggcagccccagagccaccccagacagggccacggcaccagccccgtgggcgaccacggcagcctggtgagaatcccccccccccccgcccacgagagaagcctgagcgcctacggcggcggcaacagagccagcatggagttcctgagacaggaggacacccccggctgcagaccccccgagggcaacctgagagacagcgacaccagcatcagcatccccagcgtggaccacgaggagctggagagaagcttcagcggcttcagcatcagccagagcaaggagaacctggacgccctgaacagctgctacgccgccgtggccccctgcgccaaggtgagaccctacatcgccgagggcgagagcgacaccgacagcgacctgtgcaccccctgcggccccccccccagaagcgccaccggcgagggccccttcggcgacgtgggctgggccggccccagaaagtag

SEQ ID NO: 94129 - DNA, 2643 bp, Artificial Sequence
  Description of Artificial Sequence: Synthetic coding sequence
atggtgcagaagagcagaaacggcggcgtgtaccccggccccagcggcgagaagaagctgaaggtgggcttcgtgggcctggaccccggcgcccccgacagcaccagagacggcgccctgctgatcgccggcagcgaggcccccaagagaggcagcatcctgagcaagcccagagccggcggcgccggcgccggcaagccccccaagagaaacgccttctacagaaagctgcagaacttcctgtacaacgtgctggagagacccagaggctgggccttcatctaccacgcctacgtgttcctgctggtgttcagctgcctggtgctgagcgtgttcagcaccatcaaggagtacgagaagagcagcgagggcgccctgtacatcctggagatcgtgaccatcgtggtgttcggcgtggagtacttcgtgagaatctgggccgccggctgctgctgcagatacagaggctggagaggcagactgaagttcgccagaaagcccttctgcgtgatcgacatcatggtgctgatcgccagcatcgccgtgctggccgccggcagccagggcaacgtgttcgccaccagcgccctgagaagcctgagattcctgcagatcctgagaatgatcagaatggacagaagaggcggcacctggaagctgctgggcagcgtggtgtacgcccacagcaaggagctggtgaccgcctggtacatcggcttcctgtgcctgatcctggccagcttcctggtgtacctggccgagaagggcgagaacgaccacttcgacacctacgccgacgccctgtggtggggcctgatcaccctgaccaccatcggctacggcgacaagtacccccagacctggaacggcagactgctggccgccaccttcaccctgatcggcgtgagcttcttcgccctgcccgccggcatcctgggcagcggcttcgccctgaaggtgcaggagcagcacagacagaagcacttcgagaagagaagaaaccccgccgccggcctgatccagagcgcctggagattctacgccaccaacctgagcagaaccgacctgcacagcacctggcagtactacgagagaaccgtgaccgtgcccatgtacagactgatcccccccctgaaccagctggagctgctgagaaacctgaagagcaagagcggcctggccttcagaaaggaccccccccccgagcccagccccagccagaaggtgagcctgaaggacagagtgttcagcagccccagaggcgtggccgccaagggcaagggcagcccccaggcccagaccgtgagaagaagccccagcgccgaccagagcctggaggacagccccagcaaggtgcccaagagctggagcttcggcgacagaagcagagccagacaggccttcagaatcaagggcgccgccagcagacagaacagcgaggaggccagcctgcccggcgaggacatcgtggacgacaagagctgcccctgcgagttcgtgaccgaggacctgacccccggcctgaaggtgagcatcagagccgtgtgcgtgatgagattcctggtgagcaagagaaagttcaaggagagcctgagaccctacgacgtgatggacgtgatcgagcagtacagcgccggccacctggacatgctgagcagaatcaagagcctgcagaccggcatcgacatgatcgtgggcccccccccccccagcacccccagacacaagaagtaccccaccaagggccccaccgccccccccagagagagcccccagtacagccccagagtggaccagatcgtgggcagaggccccgccatcaccgacaaggacagaaccaagggccccgccgaggccgagctgcccgaggaccccagcatgatgggcagactgggcaaggtggagaagcaggtgctgagcatggagaagaagctggacttcctggtgaacatctacatgcagagaatgggcatcccccccaccgagaccgaggcctacttcggcgccaaggagcccgagcccgcccccccctaccacagccccgaggacagcagagagcacgtggacagacacggctgcatcgtgaagatcgtgagaagcagcagcagcaccggccagaagaacttcagcgccccccccgccgccccccccgtgcagtgcccccccagcaccagctggcagccccagagccaccccagacagggccacggcaccagccccgtgggcgaccacggcagcctggtgagaatcccccccccccccgcccacgagagaagcctgagcgcctacggcggcggcaacagagccagcatggagttcctgagacaggaggacacccccggctgcagaccccccgagggcaacctgagagacagcgacaccagcatcagcatccccagcgtggaccacgaggagctggagagaagcttcagcggcttcagcatcagccagagcaaggagaacctggacgccctgaacagctgctacgccgccgtggccccctgcgccaaggtgagaccctacatcgccgagggcgagagcgacaccgacagcgacctgtgcaccccctgcggccccccccccagaagcgccaccggcgagggccccttcggcgacgtgggctgggccggccccagaaagtag

SEQ ID NO: 94130 - DNA, 2565 bp, Artificial Sequence
  Description of Artificial Sequence: Synthetic coding sequence
atggtgcagaagagcagaaacggcggcgtgtaccccggccccagcggcgagaagaagctgaaggtgggcttcgtgggcctggaccccggcgcccccgacagcaccagagacggcgccctgctgatcgccggcagcgaggcccccaagagaggcagcatcctgagcaagcccagagccggcggcgccggcgccggcaagccccccaagagaaacgccttctacagaaagctgcagaacttcctgtacaacgtgctggagagacccagaggctgggccttcatctaccacgcctacgtgttcctgctggtgttcagctgcctggtgctgagcgtgttcagcaccatcaaggagtacgagaagagcagcgagggcgccctgtacatcctggagatcgtgaccatcgtggtgttcggcgtggagtacttcgtgagaatctgggccgccggctgctgctgcagatacagaggctggagaggcagactgaagttcgccagaaagcccttctgcgtgatcgacatcatggtgctgatcgccagcatcgccgtgctggccgccggcagccagggcaacgtgttcgccaccagcgccctgagaagcctgagattcctgcagatcctgagaatgatcagaatggacagaagaggcggcacctggaagctgctgggcagcgtggtgtacgcccacagcaaggagctggtgaccgcctggtacatcggcttcctgtgcctgatcctggccagcttcctggtgtacctggccgagaagggcgagaacgaccacttcgacacctacgccgacgccctgtggtggggcctgatcaccctgaccaccatcggctacggcgacaagtacccccagacctggaacggcagactgctggccgccaccttcaccctgatcggcgtgagcttcttcgccctgcccgccggcatcctgggcagcggcttcgccctgaaggtgcaggagcagcacagacagaagcacttcgagaagagaagaaaccccgccgccggcctgatccagagcgcctggagattctacgccaccaacctgagcagaaccgacctgcacagcacctggcagtactacgagagaaccgtgaccgtgcccatgtacagcagccagacccagacctacggcgccagcagactgatcccccccctgaaccagctggagctgctgagaaacctgaagagcaagagcggcctggccttcagaaaggaccccccccccgagcccagccccagccagaaggtgagcctgaaggacagagtgttcagcagccccagaggcgtggccgccaagggcaagggcagcccccaggcccagaccgtgagaagaagccccagcgccgaccagagcctggaggacagccccagcaaggtgcccaagagctggagcttcggcgacagaagcagagccagacaggccttcagaatcaagggcgccgccagcagacagaacagcgaggaggccagcctgcccggcgaggacatcgtggacgacaagagctgcccctgcgagttcgtgaccgaggacctgacccccggcctgaaggtgagcatcagagccgtgtgcgtgatgagattcctggtgagcaagagaaagttcaaggagagcctgagaccctacgacgtgatggacgtgatcgagcagtacagcgccggccacctggacatgctgagcagaatcaagagcctgcagagcagagtggaccagatcgtgggcagaggccccgccatcaccgacaaggacagaaccaagggccccgccgaggccgagctgcccgaggaccccagcatgatgggcagactgggcaaggtggagaagcaggtgctgagcatggagaagaagctggacttcctggtgaacatctacatgcagagaatgggcatcccccccaccgagaccgaggcctacttcggcgccaaggagcccgagcccgcccccccctaccacagccccgaggacagcagagagcacgtggacagacacggctgcatcgtgaagatcgtgagaagcagcagcagcaccggccagaagaacttcagcgccccccccgccgccccccccgtgcagtgcccccccagcaccagctggcagccccagagccaccccagacagggccacggcaccagccccgtgggcgaccacggcagcctggtgagaatcccccccccccccgcccacgagagaagcctgagcgcctacggcggcggcaacagagccagcatggagttcctgagacaggaggacacccccggctgcagaccccccgagggcaacctgagagacagcgacaccagcatcagcatccccagcgtggaccacgaggagctggagagaagcttcagcggcttcagcatcagccagagcaaggagaacctggacgccctgaacagctgctacgccgccgtggccccctgcgccaaggtgagaccctacatcgccgagggcgagagcgacaccgacagcgacctgtgcaccccctgcggccccccccccagaagcgccaccggcgagggccccttcggcgacgtgggctgggccggccccagaaagtag

SEQ ID NO: 94131 - DNA, 2619 bp, Artificial Sequence
  Description of Artificial Sequence: Synthetic coding sequence
atggtgcagaagagcagaaacggcggcgtgtaccccggccccagcggcgagaagaagctgaaggtgggcttcgtgggcctggaccccggcgcccccgacagcaccagagacggcgccctgctgatcgccggcagcgaggcccccaagagaggcagcatcctgagcaagcccagagccggcggcgccggcgccggcaagccccccaagagaaacgccttctacagaaagctgcagaacttcctgtacaacgtgctggagagacccagaggctgggccttcatctaccacgcctacgtgttcctgctggtgttcagctgcctggtgctgagcgtgttcagcaccatcaaggagtacgagaagagcagcgagggcgccctgtacatcctggagatcgtgaccatcgtggtgttcggcgtggagtacttcgtgagaatctgggccgccggctgctgctgcagatacagaggctggagaggcagactgaagttcgccagaaagcccttctgcgtgatcgacatcatggtgctgatcgccagcatcgccgtgctggccgccggcagccagggcaacgtgttcgccaccagcgccctgagaagcctgagattcctgcagatcctgagaatgatcagaatggacagaagaggcggcacctggaagctgctgggcagcgtggtgtacgcccacagcaaggagctggtgaccgcctggtacatcggcttcctgtgcctgatcctggccagcttcctggtgtacctggccgagaagggcgagaacgaccacttcgacacctacgccgacgccctgtggtggggcctgatcaccctgaccaccatcggctacggcgacaagtacccccagacctggaacggcagactgctggccgccaccttcaccctgatcggcgtgagcttcttcgccctgcccgccggcatcctgggcagcggcttcgccctgaaggtgcaggagcagcacagacagaagcacttcgagaagagaagaaaccccgccgccggcctgatccagagcgcctggagattctacgccaccaacctgagcagaaccgacctgcacagcacctggcagtactacgagagaaccgtgaccgtgcccatgtacagcagccagacccagacctacggcgccagcagactgatcccccccctgaaccagctggagctgctgagaaacctgaagagcaagagcggcctggccttcagaaaggaccccccccccgagcccagccccagcaagggcagcccctgcagaggccccctgtgcggctgctgccccggcagaagcagccagaaggtgagcctgaaggacagagtgttcagcagccccagaggcgtggccgccaagggcaagggcagcccccaggcccagaccgtgagaagaagccccagcgccgaccagagcctggaggacagccccagcaaggtgcccaagagctggagcttcggcgacagaagcagagccagacaggccttcagaatcaagggcgccgccagcagacagaacagcgaggaggccagcctgcccggcgaggacatcgtggacgacaagagctgcccctgcgagttcgtgaccgaggacctgacccccggcctgaaggtgagcatcagagccgtgtgcgtgatgagattcctggtgagcaagagaaagttcaaggagagcctgagaccctacgacgtgatggacgtgatcgagcagtacagcgccggccacctggacatgctgagcagaatcaagagcctgcagagcagagtggaccagatcgtgggcagaggccccgccatcaccgacaaggacagaaccaagggccccgccgaggccgagctgcccgaggaccccagcatgatgggcagactgggcaaggtggagaagcaggtgctgagcatggagaagaagctggacttcctggtgaacatctacatgcagagaatgggcatcccccccaccgagaccgaggcctacttcggcgccaaggagcccgagcccgcccccccctaccacagccccgaggacagcagagagcacgtggacagacacggctgcatcgtgaagatcgtgagaagcagcagcagcaccggccagaagaacttcagcgccccccccgccgccccccccgtgcagtgcccccccagcaccagctggcagccccagagccaccccagacagggccacggcaccagccccgtgggcgaccacggcagcctggtgagaatcccccccccccccgcccacgagagaagcctgagcgcctacggcggcggcaacagagccagcatggagttcctgagacaggaggacacccccggctgcagaccccccgagggcaacctgagagacagcgacaccagcatcagcatccccagcgtggaccacgaggagctggagagaagcttcagcggcttcagcatcagccagagcaaggagaacctggacgccctgaacagctgctacgccgccgtggccccctgcgccaaggtgagaccctacatcgccgagggcgagagcgacaccgacagcgacctgtgcaccccctgcggccccccccccagaagcgccaccggcgagggccccttcggcgacgtgggctgggccggccccagaaagtag

SEQ ID NO: 94132 - DNA, 2619 bp, Artificial Sequence
  Description of Artificial Sequence: Synthetic coding sequence
atggtgcagaagagcagaaacggcggcgtgtaccccggccccagcggcgagaagaagctgaaggtgggcttcgtgggcctggaccccggcgcccccgacagcaccagagacggcgccctgctgatcgccggcagcgaggcccccaagagaggcagcatcctgagcaagcccagagccggcggcgccggcgccggcaagccccccaagagaaacgccttctacagaaagctgcagaacttcctgtacaacgtgctggagagacccagaggctgggccttcatctaccacgcctacgtgttcctgctggtgttcagctgcctggtgctgagcgtgttcagcaccatcaaggagtacgagaagagcagcgagggcgccctgtacatcctggagatcgtgaccatcgtggtgttcggcgtggagtacttcgtgagaatctgggccgccggctgctgctgcagatacagaggctggagaggcagactgaagttcgccagaaagcccttctgcgtgatcgacatcatggtgctgatcgccagcatcgccgtgctggccgccggcagccagggcaacgtgttcgccaccagcgccctgagaagcctgagattcctgcagatcctgagaatgatcagaatggacagaagaggcggcacctggaagctgctgggcagcgtggtgtacgcccacagcaaggagctggtgaccgcctggtacatcggcttcctgtgcctgatcctggccagcttcctggtgtacctggccgagaagggcgagaacgaccacttcgacacctacgccgacgccctgtggtggggcctgatcaccctgaccaccatcggctacggcgacaagtacccccagacctggaacggcagactgctggccgccaccttcaccctgatcggcgtgagcttcttcgccctgcccgccggcatcctgggcagcggcttcgccctgaaggtgcaggagcagcacagacagaagcacttcgagaagagaagaaaccccgccgccggcctgatccagagcgcctggagattctacgccaccaacctgagcagaaccgacctgcacagcacctggcagtactacgagagaaccgtgaccgtgcccatgtacagcagccagacccagacctacggcgccagcagactgatcccccccctgaaccagctggagctgctgagaaacctgaagagcaagagcggcctggccttcagaaaggaccccccccccgagcccagccccagcaagggcagcccctgcagaggccccctgtgcggctgctgccccggcagaagcagccagaaggtgagcctgaaggacagagtgttcagcagccccagaggcgtggccgccaagggcaagggcagcccccaggcccagaccgtgagaagaagccccagcgccgaccagagcctggaggacagccccagcaaggtgcccaagagctggagcttcggcgacagaagcagagccagacaggccttcagaatcaagggcgccgccagcagacagaacagcgaggaggccagcctgcccggcgaggacatcgtggacgacaagagctgcccctgcgagttcgtgaccgaggacctgacccccggcctgaaggtgagcatcagagccgtgtgcgtgatgagattcctggtgagcaagagaaagttcaaggagagcctgagaccctacgacgtgatggacgtgatcgagcagtacagcgccggccacctggacatgctgagcagaatcaagagcctgcagagccaggtggaccagatcgtgggcagaggccccgccatcaccgacaaggacagaaccaagggccccgccgaggccgagctgcccgaggaccccagcatgatgggcagactgggcaaggtggagaagcaggtgctgagcatggagaagaagctggacttcctggtgaacatctacatgcagagaatgggcatcccccccaccgagaccgaggcctacttcggcgccaaggagcccgagcccgcccccccctaccacagccccgaggacagcagagagcacgtggacagacacggctgcatcgtgaagatcgtgagaagcagcagcagcaccggccagaagaacttcagcgccccccccgccgccccccccgtgcagtgcccccccagcaccagctggcagccccagagccaccccagacagggccacggcaccagccccgtgggcgaccacggcagcctggtgagaatcccccccccccccgcccacgagagaagcctgagcgcctacggcggcggcaacagagccagcatggagttcctgagacaggaggacacccccggctgcagaccccccgagggcaacctgagagacagcgacaccagcatcagcatccccagcgtggaccacgaggagctggagagaagcttcagcggcttcagcatcagccagagcaaggagaacctggacgccctgaacagctgctacgccgccgtggccccctgcgccaaggtgagaccctacatcgccgagggcgagagcgacaccgacagcgacctgtgcaccccctgcggccccccccccagaagcgccaccggcgagggccccttcggcgacgtgggctgggccggccccagaaagtag

SEQ ID NO: 94133 - DNA, 2535 bp, Artificial Sequence
  Description of Artificial Sequence: Synthetic coding sequence
atggtgcagaagagcagaaacggcggcgtgtaccccggccccagcggcgagaagaagctgaaggtgggcttcgtgggcctggaccccggcgcccccgacagcaccagagacggcgccctgctgatcgccggcagcgaggcccccaagagaggcagcatcctgagcaagcccagagccggcggcgccggcgccggcaagccccccaagagaaacgccttctacagaaagctgcagaacttcctgtacaacgtgctggagagacccagaggctgggccttcatctaccacgcctacgtgttcctgctggtgttcagctgcctggtgctgagcgtgttcagcaccatcaaggagtacgagaagagcagcgagggcgccctgtacatcctggagatcgtgaccatcgtggtgttcggcgtggagtacttcgtgagaatctgggccgccggctgctgctgcagatacagaggctggagaggcagactgaagttcgccagaaagcccttctgcgtgatcgacatcatggtgctgatcgccagcatcgccgtgctggccgccggcagccagggcaacgtgttcgccaccagcgccctgagaagcctgagattcctgcagatcctgagaatgatcagaatggacagaagaggcggcacctggaagctgctgggcagcgtggtgtacgcccacagcaaggagctggtgaccgcctggtacatcggcttcctgtgcctgatcctggccagcttcctggtgtacctggccgagaagggcgagaacgaccacttcgacacctacgccgacgccctgtggtggggcctgatcaccctgaccaccatcggctacggcgacaagtacccccagacctggaacggcagactgctggccgccaccttcaccctgatcggcgtgagcttcttcgccctgcccgccggcatcctgggcagcggcttcgccctgaaggtgcaggagcagcacagacagaagcacttcgagaagagaagaaaccccgccgccggcctgatccagagcgcctggagattctacgccaccaacctgagcagaaccgacctgcacagcacctggcagtactacgagagaaccgtgaccgtgcccatgtacagactgatcccccccctgaaccagctggagctgctgagaaacctgaagagcaagagcggcctggccttcagaaaggaccccccccccgagcccagccccagccagaaggtgagcctgaaggacagagtgttcagcagccccagaggcgtggccgccaagggcaagggcagcccccaggcccagaccgtgagaagaagccccagcgccgaccagagcctggaggacagccccagcaaggtgcccaagagctggagcttcggcgacagaagcagagccagacaggccttcagaatcaagggcgccgccagcagacagaacagcgaggaggccagcctgcccggcgaggacatcgtggacgacaagagctgcccctgcgagttcgtgaccgaggacctgacccccggcctgaaggtgagcatcagagccgtgtgcgtgatgagattcctggtgagcaagagaaagttcaaggagagcctgagaccctacgacgtgatggacgtgatcgagcagtacagcgccggccacctggacatgctgagcagaatcaagagcctgcagagcagagtggaccagatcgtgggcagaggccccgccatcaccgacaaggacagaaccaagggccccgccgaggccgagctgcccgaggaccccagcatgatgggcagactgggcaaggtggagaagcaggtgctgagcatggagaagaagctggacttcctggtgaacatctacatgcagagaatgggcatcccccccaccgagaccgaggcctacttcggcgccaaggagcccgagcccgcccccccctaccacagccccgaggacagcagagagcacgtggacagacacggctgcatcgtgaagatcgtgagaagcagcagcagcaccggccagaagaacttcagcgccccccccgccgccccccccgtgcagtgcccccccagcaccagctggcagccccagagccaccccagacagggccacggcaccagccccgtgggcgaccacggcagcctggtgagaatcccccccccccccgcccacgagagaagcctgagcgcctacggcggcggcaacagagccagcatggagttcctgagacaggaggacacccccggctgcagaccccccgagggcaacctgagagacagcgacaccagcatcagcatccccagcgtggaccacgaggagctggagagaagcttcagcggcttcagcatcagccagagcaaggagaacctggacgccctgaacagctgctacgccgccgtggccccctgcgccaaggtgagaccctacatcgccgagggcgagagcgacaccgacagcgacctgtgcaccccctgcggccccccccccagaagcgccaccggcgagggccccttcggcgacgtgggctgggccggccccagaaagtag

SEQ ID NO: 94134 - DNA, 1311 bp, Artificial Sequence
  Description of Artificial Sequence: Synthetic coding sequence
atggtgcagaagagcagaaacggcggcgtgtaccccggccccagcggcgagaagaagctgaaggtgggcttcgtgggcctggaccccggcgcccccgacagcaccagagacggcgccctgctgatcgccggcagcgaggcccccaagagaggcagcatcctgagcaagcccagagccggcggcgccggcgccggcaagccccccaagagaaacgccttctacagaaagctgcagaacttcctgtacaacgtgctggagagacccagaggctgggccttcatctaccacgcctacgtgttcctgctggtgttcagctgcctggtgctgagcgtgttcagcaccatcaaggagtacgagaagagcagcgagggcgccctgtacatcctggagatcgtgaccatcgtggtgttcggcgtggagtacttcgtgagaatctgggccgccggctgctgctgcagatacagaggctggagaggcagactgaagttcgccagaaagcccttctgcgtgatcgacatcatggtgctgatcgccagcatcgccgtgctggccgccggcagccagggcaacgtgttcgccaccagcgccctgagaagcctgagattcctgcagatcctgagaatgatcagaatggacagaagaggcggcacctggaagctgctgggcagcgtggtgtacgcccacagcaaggagctggtgaccgcctggtacatcggcttcctgtgcctgatcctggccagcttcctggtgtacctggccgagaagggcgagaacgaccacttcgacacctacgccgacgccctgtggtggggcctgatcaccctgaccaccatcggctacggcgacaagtacccccagacctggaacggcagactgctggccgccaccttcaccctgatcggcgtgagcttcttcgccctgcccgccggcatcctgggcagcggcttcgccctgaaggtgcaggagcagcacagacagaagcacttcgagaagagaagaaaccccgccgccggcctgatccagagcgcctggagattctacgccaccaacctgagcagaaccgacctgcacagcacctggcagtactacgagagaaccgtgaccgtgcccatgtacagactgatcccccccctgaaccagctggagctgctgagaaacctgaagagcaagagcggcctggccttcagaaaggaccccccccccgagcccagccccagaagcgtgccccccgccgccaccctggtgagcgccgtgtgcaccgccgtgtggagcctgagccacacctgcgcccagcccgtgatggagatgtag

SEQ ID NO: 94135 - DNA, 1848 bp, Artificial Sequence
  Description of Artificial Sequence: Synthetic coding sequence
atggtgcagaagagcagaaacggcggcgtgtaccccggccccagcggcgagaagaagctgaaggtgggcttcgtgggcctggaccccggcgcccccgacagcaccagagacggcgccctgctgatcgccggcagcgaggcccccaagagaggcagcatcctgagcaagcccagagccggcggcgccggcgccggcaagccccccaagagaaacgccttctacagaaagctgcagaacttcctgtacaacgtgctggagagacccagaggctgggccttcatctaccacgcctacgtgttcctgctggtgttcagctgcctggtgctgagcgtgttcagcaccatcaaggagtacgagaagagcagcgagggcgccctgtacatcctggagatcgtgaccatcgtggtgttcggcgtggagtacttcgtgagaatctgggccgccggctgctgctgcagatacagaggctggagaggcagactgaagttcgccagaaagcccttctgcgtgatcgacatcatggtgctgatcgccagcatcgccgtgctggccgccggcagccagggcaacgtgttcgccaccagcgccctgagaagcctgagattcctgcagatcctgagaatgatcagaatggacagaagaggcggcacctggaagctgctgggcagcgtggtgtacgcccacagcaaggagctggtgaccgcctggtacatcggcttcctgtgcctgatcctggccagcttcctggtgtacctggccgagaagggcgagaacgaccacttcgacacctacgccgacgccctgtggtggggcctgatcaccctgaccaccatcggctacggcgacaagtacccccagacctggaacggcagactgctggccgccaccttcaccctgatcggcgtgagcttcttcgccctgcccgccggcatcctgggcagcggcttcgccctgaaggtgcaggagcagcacagacagaagcacttcgagaagagaagaaaccccgccgccggcctgatccagagcgcctggagattctacgccaccaacctgagcagaaccgacctgcacagcacctggcagtactacgagagaaccgtgaccgtgcccatgtacagactgatcccccccctgaaccagctggagctgctgagaaacctgaagagcaagagcggcctggccttcagaaaggaccccccccccgagcccagccccagccagaaggtgagcctgaaggacagagtgttcagcagccccagaggcgtggccgccaagggcaagggcagcccccaggcccagaccgtgagaagaagccccagcgccgaccagagcctggaggacagccccagcaaggtgcccaagagctggagcttcggcgacagaagcagagccagacaggccttcagaatcaagggcgccgccagcagacagaacagcgaggaggccagcctgcccggcgaggacatcgtggacgacaagagctgcccctgcgagttcgtgaccgaggacctgacccccggcctgaaggtgagcatcagagccgtgtgcgtgatgagattcctggtgagcaagagaaagttcaaggagagcctgagaccctacgacgtgatggacgtgatcgagcagtacagcgccggccacctggacatgctgagcagaatcaagagcctgcagagcagacaggagcccagactgcccgtgcagcagggcaccagaaccggctgggccagcggcaccaagcccaccgtggcccacggcggcagcgccggcggcgtgtgggccggcccccccccccaccccagaagacccctgagcgccagcgtggtgagcagccagagcctgttctag

SEQ ID NO: 94136 - DNA, 2643 bp, Artificial Sequence
  Description of Artificial Sequence: Synthetic coding sequence
atggtgcagaagagcagaaacggcggcgtgtaccccggccccagcggcgagaagaagctgaaggtgggcttcgtgggcctggaccccggcgcccccgacagcaccagagacggcgccctgctgatcgccggcagcgaggcccccaagagaggcagcatcctgagcaagcccagagccggcggcgccggcgccggcaagccccccaagagaaacgccttctacagaaagctgcagaacttcctgtacaacgtgctggagagacccagaggctgggccttcatctaccacgcctacgtgttcctgctggtgttcagctgcctggtgctgagcgtgttcagcaccatcaaggagtacgagaagagcagcgagggcgccctgtacatcctggagatcgtgaccatcgtggtgttcggcgtggagtacttcgtgagaatctgggccgccggctgctgctgcagatacagaggctggagaggcagactgaagttcgccagaaagcccttctgcgtgatcgacatcatggtgctgatcgccagcatcgccgtgctggccgccggcagccagggcaacgtgttcgccaccagcgccctgagaagcctgagattcctgcagatcctgagaatgatcagaatggacagaagaggcggcacctggaagctgctgggcagcgtggtgtacgcccacagcaaggagctggtgaccgcctggtacatcggcttcctgtgcctgatcctggccagcttcctggtgtacctggccgagaagggcgagaacgaccacttcgacacctacgccgacgccctgtggtggggcctgatcaccctgaccaccatcggctacggcgacaagtacccccagacctggaacggcagactgctggccgccaccttcaccctgatcggcgtgagcttcttcgccctgcccgccggcatcctgggcagcggcttcgccctgaaggtgcaggagcagcacagacagaagcacttcgagaagagaagaaaccccgccgccggcctgatccagagcgcctggagattctacgccaccaacctgagcagaaccgacctgcacagcacctggcagtactacgagagaaccgtgaccgtgcccatgtacagactgatcccccccctgaaccagctggagctgctgagaaacctgaagagcaagagcggcctggccttcagaaaggaccccccccccgagcccagccccagccagaaggtgagcctgaaggacagagtgttcagcagccccagaggcgtggccgccaagggcaagggcagcccccaggcccagaccgtgagaagaagccccagcgccgaccagagcctggaggacagccccagcaaggtgcccaagagctggagcttcggcgacagaagcagagccagacaggccttcagaatcaagggcgccgccagcagacagaacagcgaggaggccagcctgcccggcgaggacatcgtggacgacaagagctgcccctgcgagttcgtgaccgaggacctgacccccggcctgaaggtgagcatcagagccgtgtgcgtgatgagattcctggtgagcaagagaaagttcaaggagagcctgagaccctacgacgtgatggacgtgatcgagcagtacagcgccggccacctggacatgctgagcagaatcaagagcctgcagagcagaatcgacatgatcgtgggcccccccccccccagcacccccagacacaagaagtaccccaccaagggccccaccgccccccccagagagagcccccagtacagccccagagtggaccagatcgtgggcagaggccccgccatcaccgacaaggacagaaccaagggccccgccgaggccgagctgcccgaggaccccagcatgatgggcagactgggcaaggtggagaagcaggtgctgagcatggagaagaagctggacttcctggtgaacatctacatgcagagaatgggcatcccccccaccgagaccgaggcctacttcggcgccaaggagcccgagcccgcccccccctaccacagccccgaggacagcagagagcacgtggacagacacggctgcatcgtgaagatcgtgagaagcagcagcagcaccggccagaagaacttcagcgccccccccgccgccccccccgtgcagtgcccccccagcaccagctggcagccccagagccaccccagacagggccacggcaccagccccgtgggcgaccacggcagcctggtgagaatcccccccccccccgcccacgagagaagcctgagcgcctacggcggcggcaacagagccagcatggagttcctgagacaggaggacacccccggctgcagaccccccgagggcaacctgagagacagcgacaccagcatcagcatccccagcgtggaccacgaggagctggagagaagcttcagcggcttcagcatcagccagagcaaggagaacctggacgccctgaacagctgctacgccgccgtggccccctgcgccaaggtgagaccctacatcgccgagggcgagagcgacaccgacagcgacctgtgcaccccctgcggccccccccccagaagcgccaccggcgagggccccttcggcgacgtgggctgggccggccccagaaagtag

SEQ ID NO: 94137 - DNA, 2529 bp, Artificial Sequence
  Description of Artificial Sequence: Synthetic coding sequence
atggtgcagaagagcagaaacggcggcgtgtaccccggccccagcggcgagaagaagctgaaggtgggcttcgtgggcctggaccccggcgcccccgacagcaccagagacggcgccctgctgatcgccggcagcgaggcccccaagagaggcagcatcctgagcaagcccagagccggcggcgccggcgccggcaagccccccaagagaaacgccttctacagaaagctgcagaacttcctgtacaacgtgctggagagacccagaggctgggccttcatctaccacgcctacgtgttcctgctggtgttcagctgcctggtgctgagcgtgttcagcaccatcaaggagtacgagaagagcagcgagggcgccctgtacatcctggagatcgtgaccatcgtggtgttcggcgtggagtacttcgtgagaatctgggccgccggctgctgctgcagatacagaggctggagaggcagactgaagttcgccagaaagcccttctgcgtgatcgacatcatggtgctgatcgccagcatcgccgtgctggccgccggcagccagggcaacgtgttcgccaccagcgccctgagaagcctgagattcctgcagatcctgagaatgatcagaatggacagaagaggcggcacctggaagctgctgggcagcgtggtgtacgcccacagcaaggagctggtgaccgcctggtacatcggcttcctgtgcctgatcctggccagcttcctggtgtacctggccgagaagggcgagaacgaccacttcgacacctacgccgacgccctgtggtggggcctgatcaccctgaccaccatcggctacggcgacaagtacccccagacctggaacggcagactgctggccgccaccttcaccctgatcggcgtgagcttcttcgccctgcccgccggcatcctgggcagcggcttcgccctgaaggtgcaggagcagcacagacagaagcacttcgagaagagaagaaaccccgccgccggcctgatccagagcgcctggagattctacgccaccaacctgagcagaaccgacctgcacagcacctggcagtactacgagagaaccgtgaccgtgcccatgtacagcagccagacccagacctacggcgccagcagactgatcccccccctgaaccagctggagctgctgagaaacctgaagagcaagagcggcctggccttcagaaaggaccccccccccgagcccagccccagccccagaggcgtggccgccaagggcaagggcagcccccaggcccagaccgtgagaagaagccccagcgccgaccagagcctggaggacagccccagcaaggtgcccaagagctggagcttcggcgacagaagcagagccagacaggccttcagaatcaagggcgccgccagcagacagaacagcgaggaggccagcctgcccggcgaggacatcgtggacgacaagagctgcccctgcgagttcgtgaccgaggacctgacccccggcctgaaggtgagcatcagagccgtgtgcgtgatgagattcctggtgagcaagagaaagttcaaggagagcctgagaccctacgacgtgatggacgtgatcgagcagtacagcgccggccacctggacatgctgagcagaatcaagagcctgcagagcagagtggaccagatcgtgggcagaggccccgccatcaccgacaaggacagaaccaagggccccgccgaggccgagctgcccgaggaccccagcatgatgggcagactgggcaaggtggagaagcaggtgctgagcatggagaagaagctggacttcctggtgaacatctacatgcagagaatgggcatcccccccaccgagaccgaggcctacttcggcgccaaggagcccgagcccgcccccccctaccacagccccgaggacagcagagagcacgtggacagacacggctgcatcgtgaagatcgtgagaagcagcagcagcaccggccagaagaacttcagcgccccccccgccgccccccccgtgcagtgcccccccagcaccagctggcagccccagagccaccccagacagggccacggcaccagccccgtgggcgaccacggcagcctggtgagaatcccccccccccccgcccacgagagaagcctgagcgcctacggcggcggcaacagagccagcatggagttcctgagacaggaggacacccccggctgcagaccccccgagggcaacctgagagacagcgacaccagcatcagcatccccagcgtggaccacgaggagctggagagaagcttcagcggcttcagcatcagccagagcaaggagaacctggacgccctgaacagctgctacgccgccgtggccccctgcgccaaggtgagaccctacatcgccgagggcgagagcgacaccgacagcgacctgtgcaccccctgcggccccccccccagaagcgccaccggcgagggccccttcggcgacgtgggctgggccggccccagaaagtag

SEQ ID NO: 94138 - DNA, 2526 bp, Artificial Sequence
  Description of Artificial Sequence: Synthetic coding sequence
atggtgcagaagagcagaaacggcggcgtgtaccccggccccagcggcgagaagaagctgaaggtgggcttcgtgggcctggaccccggcgcccccgacagcaccagagacggcgccctgctgatcgccggcagcgaggcccccaagagaggcagcatcctgagcaagcccagagccggcggcgccggcgccggcaagccccccaagagaaacgccttctacagaaagctgcagaacttcctgtacaacgtgctggagagacccagaggctgggccttcatctaccacgcctacgtgttcctgctggtgttcagctgcctggtgctgagcgtgttcagcaccatcaaggagtacgagaagagcagcgagggcgccctgtacatcctggagatcgtgaccatcgtggtgttcggcgtggagtacttcgtgagaatctgggccgccggctgctgctgcagatacagaggctggagaggcagactgaagttcgccagaaagcccttctgcgtgatcgacatcatggtgctgatcgccagcatcgccgtgctggccgccggcagccagggcaacgtgttcgccaccagcgccctgagaagcctgagattcctgcagatcctgagaatgatcagaatggacagaagaggcggcacctggaagctgctgggcagcgtggtgtacgcccacagcaaggagctggtgaccgcctggtacatcggcttcctgtgcctgatcctggccagcttcctggtgtacctggccgagaagggcgagaacgaccacttcgacacctacgccgacgccctgtggtggggcctgatcaccctgaccaccatcggctacggcgacaagtacccccagacctggaacggcagactgctggccgccaccttcaccctgatcggcgtgagcttcttcgccctgcccgccggcatcctgggcagcggcttcgccctgaaggtgcaggagcagcacagacagaagcacttcgagaagagaagaaaccccgccgccggcctgatccagagcgcctggagattctacgccaccaacctgagcagaaccgacctgcacagcacctggcagtactacgagagaaccgtgaccgtgcccatgtacagcagccagacccagacctacggcgccagcagactgatcccccccctgaaccagctggagctgctgagaaacctgaagagcaagagcggcctggccttcagaaaggaccccccccccgagcccagccccagccccagaggcgtggccgccaagggcaagggcagcccccaggcccagaccgtgagaagaagccccagcgccgaccagagcctggaggacagccccagcaaggtgcccaagagctggagcttcggcgacagaagcagagccagacaggccttcagaatcaagggcgccgccagcagacagaacagcgaggccagcctgcccggcgaggacatcgtggacgacaagagctgcccctgcgagttcgtgaccgaggacctgacccccggcctgaaggtgagcatcagagccgtgtgcgtgatgagattcctggtgagcaagagaaagttcaaggagagcctgagaccctacgacgtgatggacgtgatcgagcagtacagcgccggccacctggacatgctgagcagaatcaagagcctgcagagcagagtggaccagatcgtgggcagaggccccgccatcaccgacaaggacagaaccaagggccccgccgaggccgagctgcccgaggaccccagcatgatgggcagactgggcaaggtggagaagcaggtgctgagcatggagaagaagctggacttcctggtgaacatctacatgcagagaatgggcatcccccccaccgagaccgaggcctacttcggcgccaaggagcccgagcccgcccccccctaccacagccccgaggacagcagagagcacgtggacagacacggctgcatcgtgaagatcgtgagaagcagcagcagcaccggccagaagaacttcagcgccccccccgccgccccccccgtgcagtgcccccccagcaccagctggcagccccagagccaccccagacagggccacggcaccagccccgtgggcgaccacggcagcctggtgagaatcccccccccccccgcccacgagagaagcctgagcgcctacggcggcggcaacagagccagcatggagttcctgagacaggaggacacccccggctgcagaccccccgagggcaacctgagagacagcgacaccagcatcagcatccccagcgtggaccacgaggagctggagagaagcttcagcggcttcagcatcagccagagcaaggagaacctggacgccctgaacagctgctacgccgccgtggccccctgcgccaaggtgagaccctacatcgccgagggcgagagcgacaccgacagcgacctgtgcaccccctgcggccccccccccagaagcgccaccggcgagggccccttcggcgacgtgggctgggccggccccagaaagtag

SEQ ID NO: 94139 - DNA, 2619 bp, Artificial Sequence
  Description of Artificial Sequence: Synthetic coding sequence
atgggcctgaaggccagaagagccgccggcgccgccggcggcggcggcgacggcggcggcggcggcggcggcgccgccaaccccgccggcggcgacgccgccgccgccggcgacgaggagagaaaggtgggcctggcccccggcgacgtggagcaggtgaccctggccctgggcgccggcgccgacaaggacggcaccctgctgctggagggcggcggcagagacgagggccagagaagaaccccccagggcatcggcctgctggccaagacccccctgagcagacccgtgaagagaaacaacgccaagtacagaagaatccagaccctgatctacgacgccctggagagacccagaggctgggccctgctgtaccacgccctggtgttcctgatcgtgctgggctgcctgatcctggccgtgctgaccaccttcaaggagtacgagaccgtgagcggcgactggctgctgctgctggagaccttcgccatcttcatcttcggcgccgagttcgccctgagaatctgggccgccggctgctgctgcagatacaagggctggagaggcagactgaagttcgccagaaagcccctgtgcatgctggacatcttcgtgctgatcgccagcgtgcccgtggtggccgtgggcaaccagggcaacgtgctggccaccagcctgagaagcctgagattcctgcagatcctgagaatgctgagaatggacagaagaggcggcacctggaagctgctgggcagcgccatctgcgcccacagcaaggagctgatcaccgcctggtacatcggcttcctgaccctgatcctgagcagcttcctggtgtacctggtggagaaggacgtgcccgaggtggacgcccagggcgaggagatgaaggaggagttcgagacctacgccgacgccctgtggtggggcctgatcaccctggccaccatcggctacggcgacaagacccccaagacctgggagggcagactgatcgccgccaccttcagcctgatcggcgtgagcttcttcgccctgcccgccggcatcctgggcagcggcctggccctgaaggtgcaggagcagcacagacagaagcacttcgagaagagaagaaagcccgccgccgagctgatccaggccgcctggagatactacgccaccaaccccaacagaatcgacctggtggccacctggagattctacgagagcgtggtgagcttccccttcttcagaaaggagcagctggaggccgccagcagccagaagctgggcctgctggacagagtgagactgagcaaccccagaggcagcaacaccaagggcaagctgttcacccccctgaacgtggacgccatcgaggagagccccagcaaggagcccaagcccgtgggcctgaacaacaaggagagattcagaaccgccttcagaatgaaggcctacgccttctggcagagcagcgaggacgccggcaccggcgaccccatggccgaggacagaggctacggcaacgacttccccatcgaggacatgatccccaccctgaaggccgccatcagagccgtgagaatcctgcagttcagactgtacaagaagaagttcaaggagaccctgagaccctacgacgtgaaggacgtgatcgagcagtacagcgccggccacctggacatgctgagcagaatcaagtacctgcagaccagaatcgacatgatcttcacccccggcccccccagcacccccaagcacaagaagagccagaagggcagcgccttcaccttccccagccagcagagccccagaaacgagccctacgtggccagacccagcaccagcgagatcgaggaccagagcatgatgggcaagttcgtgaaggtggagagacaggtgcaggacatgggcaagaagctggacttcctggtggacatgcacatgcagcacatggagagactgcaggtgcaggtgaccgagtactaccccaccaagggcaccagcagccccgccgaggccgagaagaaggaggacaacagatacagcgacctgaagaccatcatctgcaactacagcgagaccggcccccccgagcccccctacagcttccaccaggtgaccatcgacaaggtgagcccctacggcttcttcgcccacgaccccgtgaacctgcccagaggcggccccagcagcggcaaggtgcaggccaccccccccagcagcgccaccacctacgtggagagacccaccgtgctgcccatcctgaccctgctggacagcagagtgagctgccacagccaggccgacctgcagggcccctacagcgacagaatcagccccagacagagaagaagcatcaccagagacagcgacacccccctgagcctgatgagcgtgaaccacgaggagctggagagaagccccagcggcttcagcatcagccaggacagagacgactacgtgttcggccccaacggcggcagcagctggatgagagagaagagatacctggccgagggcgagaccgacaccgacaccgaccccttcacccccagcggcagcatgcccctgagcagcaccggcgacggcatcagcgacagcgtgtggacccccagcaacaagcccatctag

SEQ ID NO: 94140 - DNA, 2256 bp, Artificial Sequence
  Description of Artificial Sequence: Synthetic coding sequence
aagcccaagaagcacggccccatgttcctgatcgtgctgggctgcctgatcctggccgtgctgaccaccttcaaggagtacgagaccgtgagcggcgactggctgctgctgctggagaccttcgccatcttcatcttcggcgccgagttcgccctgagaatctgggccgccggctgctgctgcagatacaagggctggagaggcagactgaagttcgccagaaagcccctgtgcatgctggacatcttcgtgctgatcgccagcgtgcccgtggtggccgtgggcaaccagggcaacgtgctggccaccagcctgagaagcctgagattcctgcagatcctgagaatgctgagaatggacagaagaggcggcacctggaagctgctgggcagcgccatctgcgcccacagcaaggagctgatcaccgcctggtacatcggcttcctgaccctgatcctgagcagcttcctggtgtacctggtggagaaggacgtgcccgaggtggacgcccagggcgaggagatgaaggaggagttcgagacctacgccgacgccctgtggtggggcctgatcaccctggccaccatcggctacggcgacaagacccccaagacctgggagggcagactgatcgccgccaccttcagcctgatcggcgtgagcttcttcgccctgcccgccggcatcctgggcagcggcctggccctgaaggtgcaggagcagcacagacagaagcacttcgagaagagaagaaagcccgccgccgagctgatccaggccgcctggagatactacgccaccaaccccaacagaatcgacctggtggccacctggagattctacgagagcgtggtgagcttccccttcttcagaaaggagcagctggaggccgccagcagccagaagctgggcctgctggacagagtgagactgagcaaccccagaggcagcaacaccaagggcaagctgttcacccccctgaacgtggacgccatcgaggagagccccagcaaggagcccaagcccgtgggcctgaacaacaaggagagattcagaaccgccttcagaatgaaggcctacgccttctggcagagcagcgaggacgccggcaccggcgaccccatggccgaggacagaggctacggcaacgacttccccatcgaggacatgatccccaccctgaaggccgccatcagagccgtgagaatcctgcagttcagactgtacaagaagaagttcaaggagaccctgagaccctacgacgtgaaggacgtgatcgagcagtacagcgccggccacctggacatgctgagcagaatcaagtacctgcagaccagaatcgacatgatcttcacccccggcccccccagcacccccaagcacaagaagagccagaagggcagcgccttcaccttccccagccagcagagccccagaaacgagccctacgtggccagacccagcaccagcgagatcgaggaccagagcatgatgggcaagttcgtgaaggtggagagacaggtgcaggacatgggcaagaagctggacttcctggtggacatgcacatgcagcacatggagagactgcaggtgcaggtgaccgagtactaccccaccaagggcaccagcagccccgccgaggccgagaagaaggaggacaacagatacagcgacctgaagaccatcatctgcaactacagcgagaccggcccccccgagcccccctacagcttccaccaggtgaccatcgacaaggtgagcccctacggcttcttcgcccacgaccccgtgaacctgcccagaggcggccccagcagcggcaaggtgcaggccaccccccccagcagcgccaccacctacgtggagagacccaccgtgctgcccatcctgaccctgctggacagcagagtgagctgccacagccaggccgacctgcagggcccctacagcgacagaatcagccccagacagagaagaagcatcaccagagacagcgacacccccctgagcctgatgagcgtgaaccacgaggagctggagagaagccccagcggcttcagcatcagccaggacagagacgactacgtgttcggccccaacggcggcagcagctggatgagagagaagagatacctggccgagggcgagaccgacaccgacaccgaccccttcacccccagcggcagcatgcccctgagcagcaccggcgacggcatcagcgacagcgtgtggacccccagcaacaagcccatctag

SEQ ID NO: 94141 - DNA, 2550 bp, Artificial Sequence
  Description of Artificial Sequence: Synthetic coding sequence
agagccgccgccgagaaggccaagagacccgccggcgccagacagatgggcctgaaggccagaagagccgccgccggcgacgaggagagaaaggtgggcctggcccccggcgacgtggagcaggtgaccctggccctgggcgccggcgccgacaaggacggcaccctgctgctggagggcggcggcagagacgagggccagagaagaaccccccagggcatcggcctgctggccaagacccccctgagcagacccgtgaagagaaacaacgccaagtacagaagaatccagaccctgatctacgacgccctggagagacccagaggctgggccctgctgtaccacgccctggtgttcctgatcgtgctgggctgcctgatcctggccgtgctgaccaccttcaaggagtacgagaccgtgagcggcgactggctgctgctgctggagaccttcgccatcttcatcttcggcgccgagttcgccctgagaatctgggccgccggctgctgctgcagatacaagggctggagaggcagactgaagttcgccagaaagcccctgtgcatgctggacatcttcgtgctgatcgccagcgtgcccgtggtggccgtgggcaaccagggcaacgtgctggccaccagcctgagaagcctgagattcctgcagatcctgagaatgctgagaatggacagaagaggcggcacctggaagctgctgggcagcgccatctgcgcccacagcaaggagctgatcaccgcctggtacatcggcttcctgaccctgatcctgagcagcttcctggtgtacctggtggagaaggacgtgcccgaggtggacgcccagggcgaggagatgaaggaggagttcgagacctacgccgacgccctgtggtggggcctgatcaccctggccaccatcggctacggcgacaagacccccaagacctgggagggcagactgatcgccgccaccttcagcctgatcggcgtgagcttcttcgccctgcccgccggcatcctgggcagcggcctggccctgaaggtgcaggagcagcacagacagaagcacttcgagaagagaagaaagcccgccgccgagctgatccaggccgcctggagatactacgccaccaaccccaacagaatcgacctggtggccacctggagattctacgagagcgtggtgagcttccccttcttcagaaaggagcagctggaggccgccagcagccagaagctgggcctgctggacagagtgagactgagcaaccccagaggcagcaacaccaagggcaagctgttcacccccctgaacgtggacgccatcgaggagagccccagcaaggagcccaagcccgtgggcctgaacaacaaggagagattcagaaccgccttcagaatgaaggcctacgccttctggcagagcagcgaggacgccggcaccggcgaccccatggccgaggacagaggctacggcaacgacttccccatcgaggacatgatccccaccctgaaggccgccatcagagccgtgagaatcctgcagttcagactgtacaagaagaagttcaaggagaccctgagaccctacgacgtgaaggacgtgatcgagcagtacagcgccggccacctggacatgctgagcagaatcaagtacctgcagaccagaatcgacatgatcttcacccccggcccccccagcacccccaagcacaagaagagccagaagggcaacgagccctacgtggccagacccagcaccagcgagatcgaggaccagagcatgatgggcaagttcgtgaaggtggagagacaggtgcaggacatgggcaagaagctggacttcctggtggacatgcacatgcagcacatggagagactgcaggtgcaggtgaccgagtactaccccaccaagggcaccagcagccccgccgaggccgagaagaaggaggacaacagatacagcgacctgaagaccatcatctgcaactacagcgagaccggcccccccgagcccccctacagcttccaccaggtgaccatcgacaaggtgagcccctacggcttcttcgcccacgaccccgtgaacctgcccagaggcggccccagcagcggcaaggtgcaggccaccccccccagcagcgccaccacctacgtggagagacccaccgtgctgcccatcctgaccctgctggacagcagagtgagctgccacagccaggccgacctgcagggcccctacagcgacagaatcagccccagacagagaagaagcatcaccagagacagcgacacccccctgagcctgatgagcgtgaaccacgaggagctggagagaagccccagcggcttcagcatcagccaggacagagacgactacgtgttcggccccaacggcggcagcagctggatgagagagaagagatacctggccgagggcgagaccgacaccgacaccgaccccttcacccccagcggcagcatgcccctgagcagcaccggcgacggcatcagcgacagcgtgtggacccccagcaacaagcccatctag

SEQ ID NO: 94142 - DNA, 2088 bp, Artificial Sequence
  Description of Artificial Sequence: Synthetic coding sequence
atggccgaggccccccccagaagactgggcctgggccccccccccggcgacgcccccagagccgagctggtggccctgaccgccgtgcagagcgagcagggcgaggccggcggcggcggcagccccagaagactgggcctgctgggcagccccctgccccccggcgcccccctgcccggccccggcagcggcagcggcagcgcctgcggccagagaagcagcgccgcccacaagagatacagaagactgcagaactgggtgtacaacgtgctggagagacccagaggctgggccttcgtgtaccacgtgttcatcttcctgctggtgttcagctgcctggtgctgagcgtgctgagcaccatccaggagcaccaggagctggccaacgagtgcctgctgatcctggagttcgtgatgatcgtggtgttcggcctggagtacatcgtgagagtgtggagcgccggctgctgctgcagatacagaggctggcagggcagattcagattcgccagaaagcccttctgcgtgatcgacttcatcgtgttcgtggccagcgtggccgtgatcgccgccggcacccagggcaacatcttcgccaccagcgccctgagaagcatgagattcctgcagatcctgagaatggtgagaatggacagaagaggcggcacctggaagctgctgggcagcgtggtgtacgcccacagcaaggagctgatcaccgcctggtacatcggcttcctggtgctgatcttcgccagcttcctggtgtacctggccgagaaggacgccaacagcgacttcagcagctacgccgacagcctgtggtggggcaccatcaccctgaccaccatcggctacggcgacaagaccccccacacctggctgggcagagtgctggccgccggcttcgccctgctgggcatcagcttcttcgccctgcccgccggcatcctgggcagcggcttcgccctgaaggtgcaggagcagcacagacagaagcacttcgagaagagaagaatgcccgccgccaacctgatccaggccgcctggagactgtacagcaccgacatgagcagagcctacctgaccgccacctggtactactacgacagcatcctgcccagcttcagagagctggccctgctgttcgagcacgtgcagagagccagaaacggcggcctgagacccctggaggtgagaagagcccccgtgcccgacggcgcccccagcagatacccccccgtggccacctgccacagacccggcagcaccagcttctgccccggcgagagcagcagaatgggcatcaaggacagaatcagaatgggcagcagccagagaagaaccggccccagcaagcagcacctggccccccccaccatgcccaccagccccagcagcgagcaggtgggcgaggccaccagccccaccaaggtgcagaagagctggagcttcaacgacagaaccagattcagagccagcctgagactgaagcccagaaccagcgccgaggacgcccccagcgaggaggtggccgaggagaagagctaccagtgcgagctgaccgtggacgacatcatgcccgccgtgaagaccgtgatcagaagcatcagaatcctgaagttcctggtggccaagagaaagttcaaggagaccctgagaccctacgacgtgaaggacgtgatcgagcagtacagcgccggccacctggacatgctgggcagaatcaagagcctgcagaccagagtggaccagatcgtgggcagaggccccggcgacagaaaggccagagagaagggcgacaagggccccagcgacgccgaggtggtggacgagatcagcatgatgggcagagtggtgaaggtggagaagcaggtgcagagcatcgagcacaagctggacctgctgctgggcttctacagcagatgcctgagaagcggcaccagcgccagcctgggcgccgtgcaggtgcccctgttcgaccccgacatcaccagcgactaccacagccccgtggaccacgaggacatcagcgtgagcgcccagaccctgagcatcagcagaagcgtgagcaccaacatggactag

SEQ ID NO: 94143 - DNA, 2856 bp, Artificial Sequence
  Description of Artificial Sequence: Synthetic coding sequence
atgcccagacaccacgccggcggcgaggagggcggcgccgccggcctgtgggtgaagagcggcgccgccgccgccgccgccggcggcggcagactgggcagcggcatgaaggacgtggagagcggcagaggcagagtgctgctgaacagcgccgccgccagaggcgacggcctgctgctgctgggcaccagagccgccaccctgggcggcggcggcggcggcctgagagagagcagaagaggcaagcagggcgccagaatgagcctgctgggcaagcccctgagctacaccagcagccagagctgcagaagaaacgtgaagtacagaagagtgcagaactacctgtacaacgtgctggagagacccagaggctgggccttcatctaccacgccttcgtgttcctgctggtgttcggctgcctgatcctgagcgtgttcagcaccatccccgagcacaccaagctggccagcagctgcctgctgatcctggagttcgtgatgatcgtggtgttcggcctggagttcatcatcagaatctggagcgccggctgctgctgcagatacagaggctggcagggcagactgagattcgccagaaagcccttctgcgtgatcgacaccatcgtgctgatcgccagcatcgccgtggtgagcgccaagacccagggcaacatcttcgccaccagcgccctgagaagcctgagattcctgcagatcctgagaatggtgagaatggacagaagaggcggcacctggaagctgctgggcagcgtggtgtacgcccacagcaaggagctgatcaccgcctggtacatcggcttcctggtgctgatcttcagcagcttcctggtgtacctggtggagaaggacgccaacaaggagttcagcacctacgccgacgccctgtggtggggcaccatcaccctgaccaccatcggctacggcgacaagacccccctgacctggctgggcagactgctgagcgccggcttcgccctgctgggcatcagcttcttcgccctgcccgccggcatcctgggcagcggcttcgccctgaaggtgcaggagcagcacagacagaagcacttcgagaagagaagaaaccccgccgccaacctgatccagtgcgtgtggagaagctacgccgccgacgagaagagcgtgagcatcgccacctggaagccccacctgaaggccctgcacacctgcagccccaccaagaaggagcagggcgaggccagcagcagcaagttctgcagcaacaagcagaagctgttcagaatgtacaccagcagaaagcagagccagaagctgagcttcaaggagagagtgagaatggccagccccagaggccagagcatcaagagcagacaggccagcgtgggcgacagaagaagccccagcaccgacatcaccgccgagggcagccccaccaaggtgcagaagagctggagcttcaacgacagaaccagattcagacccagcctgagactgaagagcagccagcccaagcccgtgatcgacgccgacaccgccctgggcaccgacgacgtgtacgacgagaagggctgccagtgcgacgtgagcgtggaggacctgaccccccccctgaagaccgtgatcagagccatcagaatcatgaagttccacgtggccaagagaaagttcaaggagaccctgagaccctacgacgtgaaggacgtgatcgagcagtacagcgccggccacctggacatgctgtgcagaatcaagagcctgcagaccagagtggaccagatcctgggcaagggccagatcaccagcgacaagaagagcagagagaagatcaccgccgagcacgagaccaccgacgacctgagcatgctgggcagagtggtgaaggtggagaagcaggtgcagagcatcgagagcaagctggactgcctgctggacatctaccagcaggtgctgagaaagggcagcgccagcgccctggccctggccagcttccagatcccccccttcgagtgcgagcagaccagcgactaccagagccccgtggacagcaaggacctgagcggcagcgcccagaacagcggctgcctgagcagaagcaccagcgccaacatcagcagaggcctgcagttcatcctgacccccaacgagttcagcgcccagaccttctacgccctgagccccaccatgcacagccaggccacccaggtgcccatcagccagagcgacggcagcgccgtggccgccaccaacaccatcgccaaccagatcaacaccgcccccaagcccgccgcccccaccaccctgcagatccccccccccctgcccgccatcaagcacctgcccagacccgagaccctgcaccccaaccccgccggcctgcaggagagcatcagcgacgtgaccacctgcctggtggccagcaaggagaacgtgcaggtggcccagagcaacctgaccaaggacagaagcatgagaaagagcttcgacatgggcggcgagaccctgctgagcgtgtgccccatggtgcccaaggacctgggcaagagcctgagcgtgcagaacctgatcagaagcaccgaggagctgaacatccagctgagcggcagcgagagcagcggcagcagaggcagccaggacttctaccccaagtggagagagagcaagctgttcatcaccgacgaggaggtgggccccgaggagaccgagaccgacaccttcgacgccgccccccagcccgccagagaggccgccttcgccagcgacagcctgagaaccggcagaagcagaagcagccagagcatctgcaaggccggcgagagcaccgacgccctgagcctgccccacgtgaagctgaagtag

SEQ ID NO: 94144 - DNA, 2799 bp, Artificial Sequence
  Description of Artificial Sequence: Synthetic coding sequence
atgcccagacaccacgccggcggcgaggagggcggcgccgccggcctgtgggtgaagagcggcgccgccgccgccgccgccggcggcggcagactgggcagcggcatgaaggacgtggagagcggcagaggcagagtgctgctgaacagcgccgccgccagaggcgacggcctgctgctgctgggcaccagagccgccaccctgggcggcggcggcggcggcctgagagagagcagaagaggcaagcagggcgccagaatgagcctgctgggcaagcccctgagctacaccagcagccagagctgcagaagaaacgtgaagtacagaagagtgcagaactacctgtacaacgtgctggagagacccagaggctgggccttcatctaccacgccttcgtgttcctgcccgtgttcggctgcctgatcctgagcgtgttcagcaccatccccgagcacaccaagctggccagcagctgcctgctgatcctggagttcgtgatgatcgtggtgttcggcctggagttcatcatcagaatctggagcgccggctgctgctgcagatacagaggctggcagggcagactgagattcgccagaaagcccttctgcgtgatcgacaccatcgtgctgatcgccagcatcgccgtggtgagcgccaagacccagggcaacatcttcgccaccagcgccctgagaagcctgagattcctgcagatcctgagaatggtgagaatggacagaagaggcggcacctggaagctgctgggcagcgtggtgtacgcccacagcaaggagctgatcaccgcctggtacatcggcttcctggtgctgatcttcagcagcttcctggtgtacctggtggagaaggacgccaacaaggagttcagcacctacgccgacgccctgtggtggggcaccatcaccctgaccaccatcggctacggcgacaagacccccctgacctggctgggcagactgctgagcgccggcttcgccctgctgggcatcagcttcttcgccctgcccgccggcatcctgggcagcggcttcgccctgaaggtgcaggagcagcacagacagaagcacttcgagaagagaagaaaccccgccgccaacctgatccagtgcgtgtggagaagctacgccgccgacgagaagagcgtgagcatcgccacctggaagccccacctgaaggccctgcacacctgcagccccaccaagaaggagcagggcgaggccagcagcagccagaagctgagcttcaaggagagagtgagaatggccagccccagaggccagagcatcaagagcagacaggccagcgtgggcgacagaagaagccccagcaccgacatcaccgccgagggcagccccaccaaggtgcagaagagctggagcttcaacgacagaaccagattcagacccagcctgagactgaagagcagccagcccaagcccgtgatcgacgccgacaccgccctgggcaccgacgacgtgtacgacgagaagggctgccagtgcgacgtgagcgtggaggacctgaccccccccctgaagaccgtgatcagagccatcagaatcatgaagttccacgtggccaagagaaagttcaaggagaccctgagaccctacgacgtgaaggacgtgatcgagcagtacagcgccggccacctggacatgctgtgcagaatcaagagcctgcagaccagagtggaccagatcctgggcaagggccagatcaccagcgacaagaagagcagagagaagatcaccgccgagcacgagaccaccgacgacctgagcatgctgggcagagtggtgaaggtggagaagcaggtgcagagcatcgagagcaagctggactgcctgctggacatctaccagcaggtgctgagaaagggcagcgccagcgccctggccctggccagcttccagatcccccccttcgagtgcgagcagaccagcgactaccagagccccgtggacagcaaggacctgagcggcagcgcccagaacagcggctgcctgagcagaagcaccagcgccaacatcagcagaggcctgcagttcatcctgacccccaacgagttcagcgcccagaccttctacgccctgagccccaccatgcacagccaggccacccaggtgcccatcagccagagcgacggcagcgccgtggccgccaccaacaccatcgccaaccagatcaacaccgcccccaagcccgccgcccccaccaccctgcagatccccccccccctgcccgccatcaagcacctgcccagacccgagaccctgcaccccaaccccgccggcctgcaggagagcatcagcgacgtgaccacctgcctggtggccagcaaggagaacgtgcaggtggcccagagcaacctgaccaaggacagaagcatgagaaagagcttcgacatgggcggcgagaccctgctgagcgtgtgccccatggtgcccaaggacctgggcaagagcctgagcgtgcagaacctgatcagaagcaccgaggagctgaacatccagctgagcggcagcgagagcagcggcagcagaggcagccaggacttctaccccaagtggagagagagcaagctgttcatcaccgacgaggaggtgggccccgaggagaccgagaccgacaccttcgacgccgccccccagcccgccagagaggccgccttcgccagcgacagcctgagaaccggcagaagcagaagcagccagagcatctgcaaggccggcgagagcaccgacgccctgagcctgccccacgtgaagctgaagtag

SEQ ID NO: 94145 - DNA, 2802 bp, Artificial Sequence
  Description of Artificial Sequence: Synthetic coding sequence
atgcccagacaccacgccggcggcgaggagggcggcgccgccggcctgtgggtgaagagcggcgccgccgccgccgccgccggcggcggcagactgggcagcggcatgaaggacgtggagagcggcagaggcagagtgctgctgaacagcgccgccgccagaggcgacggcctgctgctgctgggcaccagagccgccaccctgggcggcggcggcggcggcctgagagagagcagaagaggcaagcagggcgccagaatgagcctgctgggcaagcccctgagctacaccagcagccagagctgcagaagaaacgtgaagtacagaagagtgcagaactacctgtacaacgtgctggagagacccagaggctgggccttcatctaccacgccttcgtgttcctgctggtgttcggctgcctgatcctgagcgtgttcagcaccatccccgagcacaccaagctggccagcagctgcctgctgatcctggagttcgtgatgatcgtggtgttcggcctggagttcatcatcagaatctggagcgccggctgctgctgcagatacagaggctggcagggcagactgagattcgccagaaagcccttctgcgtgatcgacaccatcgtgctgatcgccagcatcgccgtggtgagcgccaagacccagggcaacatcttcgccaccagcgccctgagaagcctgagattcctgcagatcctgagaatggtgagaatggacagaagaggcggcacctggaagctgctgggcagcgtggtgtacgcccacagcaaggagctgatcaccgcctggtacatcggcttcctggtgctgatcttcagcagcttcctggtgtacctggtggagaaggacgccaacaaggagttcagcacctacgccgacgccctgtggtggggcaccatcaccctgaccaccatcggctacggcgacaagacccccctgacctggctgggcagactgctgagcgccggcttcgccctgctgggcatcagcttcttcgccctgcccgccggcatcctgggcagcggcttcgccctgaaggtgcaggagcagcacagacagaagcacttcgagaagagaagaaaccccgccgccaacctgatccagtgcgtgtggagaagctacgccgccgacgagaagagcgtgagcatcgccacctggaagccccacctgaaggccctgcacacctgcagccccaccaagcagaaccagcagggcgagagccagagctgccagaagctgagcttcaaggagagagtgagaatggccagccccagaggccagagcatcaagagcagacaggccagcgtgggcgacagaagaagccccagcaccgacatcaccgccgagggcagccccaccaaggtgcagaagagctggagcttcaacgacagaaccagattcagacccagcctgagactgaagagcagccagcccaagcccgtgatcgacgccgacaccgccctgggcaccgacgacgtgtacgacgagaagggctgccagtgcgacgtgagcgtggaggacctgaccccccccctgaagaccgtgatcagagccatcagaatcatgaagttccacgtggccaagagaaagttcaaggagaccctgagaccctacgacgtgaaggacgtgatcgagcagtacagcgccggccacctggacatgctgtgcagaatcaagagcctgcagaccagagtggaccagatcctgggcaagggccagatcaccagcgacaagaagagcagagagaagatcaccgccgagcacgagaccaccgacgacctgagcatgctgggcagagtggtgaaggtggagaagcaggtgcagagcatcgagagcaagctggactgcctgctggacatctaccagcaggtgctgagaaagggcagcgccagcgccctggccctggccagcttccagatcccccccttcgagtgcgagcagaccagcgactaccagagccccgtggacagcaaggacctgagcggcagcgcccagaacagcggctgcctgagcagaagcaccagcgccaacatcagcagaggcctgcagttcatcctgacccccaacgagttcagcgcccagaccttctacgccctgagccccaccatgcacagccaggccacccaggtgcccatcagccagagcgacggcagcgccgtggccgccaccaacaccatcgccaaccagatcaacaccgcccccaagcccgccgcccccaccaccctgcagatccccccccccctgcccgccatcaagcacctgcccagacccgagaccctgcaccccaaccccgccggcctgcaggagagcatcagcgacgtgaccacctgcctggtggccagcaaggagaacgtgcaggtggcccagagcaacctgaccaaggacagaagcatgagaaagagcttcgacatgggcggcgagaccctgctgagcgtgtgccccatggtgcccaaggacctgggcaagagcctgagcgtgcagaacctgatcagaagcaccgaggagctgaacatccagctgagcggcagcgagagcagcggcagcagaggcagccaggacttctaccccaagtggagagagagcaagctgttcatcaccgacgaggaggtgggccccgaggagaccgagaccgacaccttcgacgccgccccccagcccgccagagaggccgccttcgccagcgacagcctgagaaccggcagaagcagaagcagccagagcatctgcaaggccggcgagagcaccgacgccctgagcctgccccacgtgaagctgaagtag

SEQ ID NO: 94146 - DNA, 1284 bp, Artificial Sequence
  Description of Artificial Sequence: Synthetic coding sequence
atgcccagacaccacgccggcggcgaggagggcggcgccgccggcctgtgggtgaagagcggcgccgccgccgccgccgccggcggcggcagactgggcagcggcatgaaggacgtggagagcggcagaggcagagtgctgctgaacagcgccgccgccagaggcgacggcctgctgctgctgggcaccagagccgccaccctgggcggcggcggcggcggcctgagagagagcagaagaggcaagcagggcgccagaatgagcctgctgggcaagcccctgagctacaccagcagccagagctgcagaagaaacgtgaagtacagaagagtgcagaactacctgtacaacgtgctggagagacccagaggctgggccttcatctaccacgccttcgtgttcctgctggtgttcggctgcctgatcctgagcgtgttcagcaccatccccgagcacaccaagctggccagcagctgcctgctgatcctggagttcgtgatgatcgtggtgttcggcctggagttcatcatcagaatctggagcgccggctgctgctgcagatacagaggctggcagggcagactgagattcgccagaaagcccttctgcgtgatcgacaccatcgtgctgatcgccagcatcgccgtggtgagcgccaagacccagggcaacatcttcgccaccagcgccctgagaagcctgagattcctgcagatcctgagaatggtgagaatggacagaagaggcggcacctggaagctgctgggcagcgtggtgtacgcccacagcaaggagctgatcaccgcctggtacatcggcttcctggtgctgatcttcagcagcttcctggtgtacctggtggagaaggacgccaacaaggagttcagcacctacgccgacgccctgtggtggggcaccatcaccctgaccaccatcggctacggcgacaagacccccctgacctggctgggcagactgctgagcgccggcttcgccctgctgggcatcagcttcttcgccctgcccgccggcatcctgggcagcggcttcgccctgaaggtgcaggagcagcacagacagaagcacttcgagaagagaagaaaccccgccgccaacctgatccagtgcgtgtggagaagctacgccgccgacgagaagagcgtgagcatcgccacctggaagccccacctgaaggccctgcacacctgcagccccaccaagaaggagcagggcgaggccagcagcagattcgtgatcagcctgctgctgcacgtgtgcctgtag

SEQ ID NO: 94147 - DNA, 2799 bp, Artificial Sequence
  Description of Artificial Sequence: Synthetic coding sequence
atgcccagacaccacgccggcggcgaggagggcggcgccgccggcctgtgggtgaagagcggcgccgccgccgccgccgccggcggcggcagactgggcagcggcatgaaggacgtggagagcggcagaggcagagtgctgctgaacagcgccgccgccagaggcgacggcctgctgctgctgggcaccagagccgccaccctgggcggcggcggcggcggcctgagagagagcagaagaggcaagcagggcgccagaatgagcctgctgggcaagcccctgagctacaccagcagccagagctgcagaagaaacgtgaagtacagaagagtgcagaactacctgtacaacgtgctggagagacccagaggctgggccttcatctaccacgccttcgtgttcctgctggtgttcggctgcctgatcctgagcgtgttcagcaccatccccgagcacaccaagctggccagcagctgcctgctgatcctggagttcgtgatgatcgtggtgttcggcctggagttcatcatcagaatctggagcgccggctgctgctgcagatacagaggctggcagggcagactgagattcgccagaaagcccttctgcgtgatcgacaccatcgtgctgatcgccagcatcgccgtggtgagcgccaagacccagggcaacatcttcgccaccagcgccctgagaagcctgagattcctgcagatcctgagaatggtgagaatggacagaagaggcggcacctggaagctgctgggcagcgtggtgtacgcccacagcaaggagctgatcaccgcctggtacatcggcttcctggtgctgatcttcagcagcttcctggtgtacctggtggagaaggacgccaacaaggagttcagcacctacgccgacgccctgtggtggggcaccatcaccctgaccaccatcggctacggcgacaagacccccctgacctggctgggcagactgctgagcgccggcttcgccctgctgggcatcagcttcttcgccctgcccgccggcatcctgggcagcggcttcgccctgaaggtgcaggagcagcacagacagaagcacttcgagaagagaagaaaccccgccgccaacctgatccagtgcgtgtggagaagctacgccgccgacgagaagagcgtgagcatcgccacctggaagccccacctgaaggccctgcacacctgcagccccaccaagaaggagcagggcgaggccagcagcagccagaagctgagcttcaaggagagagtgagaatggccagccccagaggccagagcatcaagagcagacaggccagcgtgggcgacagaagaagccccagcaccgacatcaccgccgagggcagccccaccaaggtgcagaagagctggagcttcaacgacagaaccagattcagacccagcctgagactgaagagcagccagcccaagcccgtgatcgacgccgacaccgccctgggcaccgacgacgtgtacgacgagaagggctgccagtgcgacgtgagcgtggaggacctgaccccccccctgaagaccgtgatcagagccatcagaatcatgaagttccacgtggccaagagaaagttcaaggagaccctgagaccctacgacgtgaaggacgtgatcgagcagtacagcgccggccacctggacatgctgtgcagaatcaagagcctgcagaccagagtggaccagatcctgggcaagggccagatcaccagcgacaagaagagcagagagaagatcaccgccgagcacgagaccaccgacgacctgagcatgctgggcagagtggtgaaggtggagaagcaggtgcagagcatcgagagcaagctggactgcctgctggacatctaccagcaggtgctgagaaagggcagcgccagcgccctggccctggccagcttccagatcccccccttcgagtgcgagcagaccagcgactaccagagccccgtggacagcaaggacctgagcggcagcgcccagaacagcggctgcctgagcagaagcaccagcgccaacatcagcagaggcctgcagttcatcctgacccccaacgagttcagcgcccagaccttctacgccctgagccccaccatgcacagccaggccacccaggtgcccatcagccagagcgacggcagcgccgtggccgccaccaacaccatcgccaaccagatcaacaccgcccccaagcccgccgcccccaccaccctgcagatccccccccccctgcccgccatcaagcacctgcccagacccgagaccctgcaccccaaccccgccggcctgcaggagagcatcagcgacgtgaccacctgcctggtggccagcaaggagaacgtgcaggtggcccagagcaacctgaccaaggacagaagcatgagaaagagcttcgacatgggcggcgagaccctgctgagcgtgtgccccatggtgcccaaggacctgggcaagagcctgagcgtgcagaacctgatcagaagcaccgaggagctgaacatccagctgagcggcagcgagagcagcggcagcagaggcagccaggacttctaccccaagtggagagagagcaagctgttcatcaccgacgaggaggtgggccccgaggagaccgagaccgacaccttcgacgccgccccccagcccgccagagaggccgccttcgccagcgacagcctgagaaccggcagaagcagaagcagccagagcatctgcaaggccggcgagagcaccgacgccctgagcctgccccacgtgaagctgaagtag

SEQ ID NO: 94148 - DNA, 2829 bp, Artificial Sequence
  Description of Artificial Sequence: Synthetic coding sequence
atgcccagacaccacgccggcggcgaggagggcggcgccgccggcctgtgggtgaagagcggcgccgccgccgccgccgccggcggcggcagactgggcagcggcatgaaggacgtggagagcggcagaggcagagtgctgctgaacagcgccgccgccagaggcgacggcctgctgctgctgggcaccagagccgccaccctgggcggcggcggcggcggcctgagagagagcagaagaggcaagcagggcgccagaatgagcctgctgggcaagcccctgagctacaccagcagccagagctgcagaagaaacgtgaagtacagaagagtgcagaactacctgtacaacgtgctggagagacccagaggctgggccttcatctaccacgccttcgtgttcctgctggtgttcggctgcctgatcctgagcgtgttcagcaccatccccgagcacaccaagctggccagcagctgcctgctgatcctggagttcgtgatgatcgtggtgttcggcctggagttcatcatcagaatctggagcgccggctgctgctgcagatacagaggctggcagggcagactgagattcgccagaaagcccttctgcgtgatcgacaccatcgtgctgatcgccagcatcgccgtggtgagcgccaagacccagggcaacatcttcgccaccagcgccctgagaagcctgagattcctgcagatcctgagaatggtgagaatggacagaagaggcggcacctggaagctgctgggcagcgtggtgtacgcccacagcaaggagctgatcaccgcctggtacatcggcttcctggtgctgatcttcagcagcttcctggtgtacctggtggagaaggacgccaacaaggagttcagcacctacgccgacgccctgtggtggggcaccatcaccctgaccaccatcggctacggcgacaagacccccctgacctggctgggcagactgctgagcgccggcttcgccctgctgggcatcagcttcttcgccctgcccgccggcatcctgggcagcggcttcgccctgaaggtgcaggagcagcacagacagaagcacttcgagaagagaagaaaccccgccgccaacctgatccagtgcgtgtggagaagctacgccgccgacgagaagagcgtgagcatcgccacctggaagccccacctgaaggccctgcacacctgcagccccaccaacaagttctgcagcaacaagcagaagctgttcagaatgtacaccagcagaaagcagagccagaagctgagcttcaaggagagagtgagaatggccagccccagaggccagagcatcaagagcagacaggccagcgtgggcgacagaagaagccccagcaccgacatcaccgccgagggcagccccaccaaggtgcagaagagctggagcttcaacgacagaaccagattcagacccagcctgagactgaagagcagccagcccaagcccgtgatcgacgccgacaccgccctgggcaccgacgacgtgtacgacgagaagggctgccagtgcgacgtgagcgtggaggacctgaccccccccctgaagaccgtgatcagagccatcagaatcatgaagttccacgtggccaagagaaagttcaaggagaccctgagaccctacgacgtgaaggacgtgatcgagcagtacagcgccggccacctggacatgctgtgcagaatcaagagcctgcagaccagagtggaccagatcctgggcaagggccagatcaccagcgacaagaagagcagagagaagatcaccgccgagcacgagaccaccgacgacctgagcatgctgggcagagtggtgaaggtggagaagcaggtgcagagcatcgagagcaagctggactgcctgctggacatctaccagcaggtgctgagaaagggcagcgccagcgccctggccctggccagcttccagatcccccccttcgagtgcgagcagaccagcgactaccagagccccgtggacagcaaggacctgagcggcagcgcccagaacagcggctgcctgagcagaagcaccagcgccaacatcagcagaggcctgcagttcatcctgacccccaacgagttcagcgcccagaccttctacgccctgagccccaccatgcacagccaggccacccaggtgcccatcagccagagcgacggcagcgccgtggccgccaccaacaccatcgccaaccagatcaacaccgcccccaagcccgccgcccccaccaccctgcagatccccccccccctgcccgccatcaagcacctgcccagacccgagaccctgcaccccaaccccgccggcctgcaggagagcatcagcgacgtgaccacctgcctggtggccagcaaggagaacgtgcaggtggcccagagcaacctgaccaaggacagaagcatgagaaagagcttcgacatgggcggcgagaccctgctgagcgtgtgccccatggtgcccaaggacctgggcaagagcctgagcgtgcagaacctgatcagaagcaccgaggagctgaacatccagctgagcggcagcgagagcagcggcagcagaggcagccaggacttctaccccaagtggagagagagcaagctgttcatcaccgacgaggaggtgggccccgaggagaccgagaccgacaccttcgacgccgccccccagcccgccagagaggccgccttcgccagcgacagcctgagaaccggcagaagcagaagcagccagagcatctgcaaggccggcgagagcaccgacgccctgagcctgccccacgtgaagctgaagtag

SEQ ID NO: 94149 - DNA, 2772 bp, Artificial Sequence
  Description of Artificial Sequence: Synthetic coding sequence
atgcccagacaccacgccggcggcgaggagggcggcgccgccggcctgtgggtgaagagcggcgccgccgccgccgccgccggcggcggcagactgggcagcggcatgaaggacgtggagagcggcagaggcagagtgctgctgaacagcgccgccgccagaggcgacggcctgctgctgctgggcaccagagccgccaccctgggcggcggcggcggcggcctgagagagagcagaagaggcaagcagggcgccagaatgagcctgctgggcaagcccctgagctacaccagcagccagagctgcagaagaaacgtgaagtacagaagagtgcagaactacctgtacaacgtgctggagagacccagaggctgggccttcatctaccacgccttcgtgttcctgctggtgttcggctgcctgatcctgagcgtgttcagcaccatccccgagcacaccaagctggccagcagctgcctgctgatcctggagttcgtgatgatcgtggtgttcggcctggagttcatcatcagaatctggagcgccggctgctgctgcagatacagaggctggcagggcagactgagattcgccagaaagcccttctgcgtgatcgacaccatcgtgctgatcgccagcatcgccgtggtgagcgccaagacccagggcaacatcttcgccaccagcgccctgagaagcctgagattcctgcagatcctgagaatggtgagaatggacagaagaggcggcacctggaagctgctgggcagcgtggtgtacgcccacagcaaggagctgatcaccgcctggtacatcggcttcctggtgctgatcttcagcagcttcctggtgtacctggtggagaaggacgccaacaaggagttcagcacctacgccgacgccctgtggtggggcaccatcaccctgaccaccatcggctacggcgacaagacccccctgacctggctgggcagactgctgagcgccggcttcgccctgctgggcatcagcttcttcgccctgcccgccggcatcctgggcagcggcttcgccctgaaggtgcaggagcagcacagacagaagcacttcgagaagagaagaaaccccgccgccaacctgatccagtgcgtgtggagaagctacgccgccgacgagaagagcgtgagcatcgccacctggaagccccacctgaaggccctgcacacctgcagccccaccaaccagaagctgagcttcaaggagagagtgagaatggccagccccagaggccagagcatcaagagcagacaggccagcgtgggcgacagaagaagccccagcaccgacatcaccgccgagggcagccccaccaaggtgcagaagagctggagcttcaacgacagaaccagattcagacccagcctgagactgaagagcagccagcccaagcccgtgatcgacgccgacaccgccctgggcaccgacgacgtgtacgacgagaagggctgccagtgcgacgtgagcgtggaggacctgaccccccccctgaagaccgtgatcagagccatcagaatcatgaagttccacgtggccaagagaaagttcaaggagaccctgagaccctacgacgtgaaggacgtgatcgagcagtacagcgccggccacctggacatgctgtgcagaatcaagagcctgcagaccagagtggaccagatcctgggcaagggccagatcaccagcgacaagaagagcagagagaagatcaccgccgagcacgagaccaccgacgacctgagcatgctgggcagagtggtgaaggtggagaagcaggtgcagagcatcgagagcaagctggactgcctgctggacatctaccagcaggtgctgagaaagggcagcgccagcgccctggccctggccagcttccagatcccccccttcgagtgcgagcagaccagcgactaccagagccccgtggacagcaaggacctgagcggcagcgcccagaacagcggctgcctgagcagaagcaccagcgccaacatcagcagaggcctgcagttcatcctgacccccaacgagttcagcgcccagaccttctacgccctgagccccaccatgcacagccaggccacccaggtgcccatcagccagagcgacggcagcgccgtggccgccaccaacaccatcgccaaccagatcaacaccgcccccaagcccgccgcccccaccaccctgcagatccccccccccctgcccgccatcaagcacctgcccagacccgagaccctgcaccccaaccccgccggcctgcaggagagcatcagcgacgtgaccacctgcctggtggccagcaaggagaacgtgcaggtggcccagagcaacctgaccaaggacagaagcatgagaaagagcttcgacatgggcggcgagaccctgctgagcgtgtgccccatggtgcccaaggacctgggcaagagcctgagcgtgcagaacctgatcagaagcaccgaggagctgaacatccagctgagcggcagcgagagcagcggcagcagaggcagccaggacttctaccccaagtggagagagagcaagctgttcatcaccgacgaggaggtgggccccgaggagaccgagaccgacaccttcgacgccgccccccagcccgccagagaggccgccttcgccagcgacagcctgagaaccggcagaagcagaagcagccagagcatctgcaaggccggcgagagcaccgacgccctgagcctgccccacgtgaagctgaagtag

SEQ ID NO: 94150 - DNA, 2469 bp, Artificial Sequence
  Description of Artificial Sequence: Synthetic coding sequence
atgcccagacaccacgccggcggcgaggagggcggcgccgccggcctgtgggtgaagagcggcgccgccgccgccgccgccggcggcggcagactgggcagcggcatgaaggacgtggagagcggcagaggcagagtgctgctgaacagcgccgccgccagaggcgacggcctgctgctgctgggcaccagagccgccaccctgggcggcggcggcggcggcctgagagagagcagaagaggcaagcagggcgccagaatgagcctgctgggcaagcccctgagctacaccagcagccagagctgcagaagaaacgtgaagtacagaagagtgcagaactacctgtacaacgtgctggagagacccagaggctgggccttcatctaccacgccttcgtgttcctgctggtgttcggctgcctgatcctgagcgtgttcagcaccatccccgagcacaccaagctggccagcagctgcctgctgatcctggagttcgtgatgatcgtggtgttcggcctggagttcatcatcagaatctggagcgccggctgctgctgcagatacagaggctggcagggcagactgagattcgccagaaagcccttctgcgtgatcgacaccatcgtgctgatcgccagcatcgccgtggtgagcgccaagacccagggcaacatcttcgccaccagcgccctgagaagcctgagattcctgcagatcctgagaatggtgagaatggacagaagaggcggcacctggaagctgctgggcagcgtggtgtacgcccacagcaaggagctgatcaccgcctggtacatcggcttcctggtgctgatcttcagcagcttcctggtgtacctggtggagaaggacgccaacaaggagttcagcacctacgccgacgccctgtggtggggcaccatcaccctgaccaccatcggctacggcgacaagacccccctgacctggctgggcagactgctgagcgccggcttcgccctgctgggcatcagcttcttcgccctgcccgccggcatcctgggcagcggcttcgccctgaaggtgcaggagcagcacagacagaagcacttcgagaagagaagaaaccccgccgccaacctgatccagtgcgtgtggagaagctacgccgccgacgagaagagcgtgagcatcgccacctggaagccccacctgaaggccctgcacacctgcagccccaccaagaaggagcagggcgaggccagcagcagaatcatgaagttccacgtggccaagagaaagttcaaggagaccctgagaccctacgacgtgaaggacgtgatcgagcagtacagcgccggccacctggacatgctgtgcagaatcaagagcctgcagaccagagtggaccagatcctgggcaagggccagatcaccagcgacaagaagagcagagagaagatcaccgccgagcacgagaccaccgacgacctgagcatgctgggcagagtggtgaaggtggagaagcaggtgcagagcatcgagagcaagctggactgcctgctggacatctaccagcaggtgctgagaaagggcagcgccagcgccctggccctggccagcttccagatcccccccttcgagtgcgagcagaccagcgactaccagagccccgtggacagcaaggacctgagcggcagcgcccagaacagcggctgcctgagcagaagcaccagcgccaacatcagcagaggcctgcagttcatcctgacccccaacgagttcagcgcccagaccttctacgccctgagccccaccatgcacagccaggccacccaggtgcccatcagccagagcgacggcagcgccgtggccgccaccaacaccatcgccaaccagatcaacaccgcccccaagcccgccgcccccaccaccctgcagatccccccccccctgcccgccatcaagcacctgcccagacccgagaccctgcaccccaaccccgccggcctgcaggagagcatcagcgacgtgaccacctgcctggtggccagcaaggagaacgtgcaggtggcccagagcaacctgaccaaggacagaagcatgagaaagagcttcgacatgggcggcgagaccctgctgagcgtgtgccccatggtgcccaaggacctgggcaagagcctgagcgtgcagaacctgatcagaagcaccgaggagctgaacatccagctgagcggcagcgagagcagcggcagcagaggcagccaggacttctaccccaagtggagagagagcaagctgttcatcaccgacgaggaggtgggccccgaggagaccgagaccgacaccttcgacgccgccccccagcccgccagagaggccgccttcgccagcgacagcctgagaaccggcagaagcagaagcagccagagcatctgcaaggccggcgagagcaccgacgccctgagcctgccccacgtgaagctgaagtag

SEQ ID NO: 94151 - DNA, 2856 bp, Artificial Sequence
  Description of Artificial Sequence: Synthetic coding sequence
atgcccagacaccacgccggcggcgaggagggcggcgccgccggcctgtgggtgaagagcggcgccgccgccgccgccgccggcggcggcagactgggcagcggcatgaaggacgtggagagcggcagaggcagagtgctgctgaacagcgccgccgccagaggcgacggcctgctgctgctgggcaccagagccgccaccctgggcggcggcggcggcggcctgagagagagcagaagaggcaagcagggcgccagaatgagcctgctgggcaagcccctgagctacaccagcagccagagctgcagaagaaacgtgaagtacagaagagtgcagaactacctgtacaacgtgctggagagacccagaggctgggccttcatctaccacgccttcgtgttcctgcccgtgttcggctgcctgatcctgagcgtgttcagcaccatccccgagcacaccaagctggccagcagctgcctgctgatcctggagttcgtgatgatcgtggtgttcggcctggagttcatcatcagaatctggagcgccggctgctgctgcagatacagaggctggcagggcagactgagattcgccagaaagcccttctgcgtgatcgacaccatcgtgctgatcgccagcatcgccgtggtgagcgccaagacccagggcaacatcttcgccaccagcgccctgagaagcctgagattcctgcagatcctgagaatggtgagaatggacagaagaggcggcacctggaagctgctgggcagcgtggtgtacgcccacagcaaggagctgatcaccgcctggtacatcggcttcctggtgctgatcttcagcagcttcctggtgtacctggtggagaaggacgccaacaaggagttcagcacctacgccgacgccctgtggtggggcaccatcaccctgaccaccatcggctacggcgacaagacccccctgacctggctgggcagactgctgagcgccggcttcgccctgctgggcatcagcttcttcgccctgcccgccggcatcctgggcagcggcttcgccctgaaggtgcaggagcagcacagacagaagcacttcgagaagagaagaaaccccgccgccaacctgatccagtgcgtgtggagaagctacgccgccgacgagaagagcgtgagcatcgccacctggaagccccacctgaaggccctgcacacctgcagccccaccaagaaggagcagggcgaggccagcagcagcaagttctgcagcaacaagcagaagctgttcagaatgtacaccagcagaaagcagagccagaagctgagcttcaaggagagagtgagaatggccagccccagaggccagagcatcaagagcagacaggccagcgtgggcgacagaagaagccccagcaccgacatcaccgccgagggcagccccaccaaggtgcagaagagctggagcttcaacgacagaaccagattcagacccagcctgagactgaagagcagccagcccaagcccgtgatcgacgccgacaccgccctgggcaccgacgacgtgtacgacgagaagggctgccagtgcgacgtgagcgtggaggacctgaccccccccctgaagaccgtgatcagagccatcagaatcatgaagttccacgtggccaagagaaagttcaaggagaccctgagaccctacgacgtgaaggacgtgatcgagcagtacagcgccggccacctggacatgctgtgcagaatcaagagcctgcagaccagagtggaccagatcctgggcaagggccagatcaccagcgacaagaagagcagagagaagatcaccgccgagcacgagaccaccgacgacctgagcatgctgggcagagtggtgaaggtggagaagcaggtgcagagcatcgagagcaagctggactgcctgctggacatctaccagcaggtgctgagaaagggcagcgccagcgccctggccctggccagcttccagatcccccccttcgagtgcgagcagaccagcgactaccagagccccgtggacagcaaggacctgagcggcagcgcccagaacagcggctgcctgagcagaagcaccagcgccaacatcagcagaggcctgcagttcatcctgacccccaacgagttcagcgcccagaccttctacgccctgagccccaccatgcacagccaggccacccaggtgcccatcagccagagcgacggcagcgccgtggccgccaccaacaccatcgccaaccagatcaacaccgcccccaagcccgccgcccccaccaccctgcagatccccccccccctgcccgccatcaagcacctgcccagacccgagaccctgcaccccaaccccgccggcctgcaggagagcatcagcgacgtgaccacctgcctggtggccagcaaggagaacgtgcaggtggcccagagcaacctgaccaaggacagaagcatgagaaagagcttcgacatgggcggcgagaccctgctgagcgtgtgccccatggtgcccaaggacctgggcaagagcctgagcgtgcagaacctgatcagaagcaccgaggagctgaacatccagctgagcggcagcgagagcagcggcagcagaggcagccaggacttctaccccaagtggagagagagcaagctgttcatcaccgacgaggaggtgggccccgaggagaccgagaccgacaccttcgacgccgccccccagcccgccagagaggccgccttcgccagcgacagcctgagaaccggcagaagcagaagcagccagagcatctgcaaggccggcgagagcaccgacgccctgagcctgccccacgtgaagctgaagtag

SEQ ID NO: 94152 - DNA, 2577 bp, Artificial Sequence
  Description of Artificial Sequence: Synthetic coding sequence
atgcccgccggcatgaccaagcacggcagcagaagcaccagcagcctgccccccgagcccatggagatcgtgagaagcaaggcctgcagcagaagagtgagactgaacgtgggcggcctggcccacgaggtgctgtggagaaccctggacagactgcccagaaccagactgggcaagctgagagactgcaacacccacgacagcctgctggaggtgtgcgacgactacagcctggacgacaacgagtacttcttcgacagacaccccggcgccttcaccagcatcctgaacttctacagaaccggcagactgcacatgatggaggagatgtgcgccctgagcttcagccaggagctggactactggggcatcgacgagatctacctggagagctgctgccaggccagataccaccagaagaaggagcagatgaacgaggagctgaagagagaggccgagaccctgagagagagagagggcgaggagttcgacaacacctgctgcgccgagaagagaaagaagctgtgggacctgctggagaagcccaacagcagcgtggccgccaagatcctggccatcatcagcatcatgttcatcgtgctgagcaccatcgccctgagcctgaacaccctgcccgagctgcagagcctggacgagttcggccagagcaccgacaacccccagctggcccacgtggaggccgtgtgcatcgcctggttcaccatggagtacctgctgagattcctgagcagccccaagaagtggaagttcttcaagggccccctgaacgccatcgacctgctggccatcctgccctactacgtgaccatcttcctgaccgagagcaacaagagcgtgctgcagttccagaacgtgagaagagtggtgcagatcttcagaatcatgagaatcctgagaatcctgaagctggccagacacagcaccggcctgcagagcctgggcttcaccctgagaagaagctacaacgagctgggcctgctgatcctgttcctggccatgggcatcatgatcttcagcagcctggtgttcttcgccgagaaggacgaggacgacaccaagttcaagagcatccccgccagcttctggtgggccaccatcaccatgaccaccgtgggctacggcgacatctaccccaagaccctgctgggcaagatcgtgggcggcctgtgctgcatcgccggcgtgctggtgatcgccctgcccatccccatcatcgtgaacaacttcagcgagttctacaaggagcagaagagacaggagaaggccatcaagagaagagaggccctggagagagccaagagaaacggcagcatcgtgagcatgaacatgaaggacgccttcgccagaagcatcgagatgatggacatcgtggtggagaagaacggcgagaacatgggcaagaaggacaaggtgcaggacaaccacctgagccccaacaagtggaagtggaccaagagaaccctgagcgagaccagcagcagcaagagcttcgagaccaaggagcagggcagccccgagaaggccagaagcagcagcagcccccagcacctgaacgtgcagcagctggaggacatgtacaacaagatggccaagacccagagccagcccatcctgaacaccaaggagagcgccgcccagagcaagcccaaggaggagctggagatggagagcatccccagccccgtggcccccctgcccaccagaaccgagggcgtgatcgacatgagaagcatgagcagcatcgacagcttcatcagctgcgccaccgacttccccgaggccaccagattcagccacagccccctgaccagcctgcccagcaagaccggcggcagcaccgcccccgaggtgggctggagaggcgccctgggcgccagcggcggcagattcgtggaggccaaccccagccccgacgccagccagcacagcagcttcttcatcgagagccccaagagcagcatgaagaccaacaaccccctgaagctgagagccctgaaggtgaacttcatggagggcgaccccagccccctgctgcccgtgctgggcatgtaccacgaccccctgagaaacagaggcagcgccgccgccgccgtggccggcctggagtgcgccaccctgctggacaaggccgtgctgagccccgagagcagcatctacaccaccgccagcgccaagaccccccccagaagccccgagaagcacaccgccatcgccttcaacttcgaggccggcgtgcaccagtacatcgacgccgacaccgacgacgagggccagctgctgtacagcgtggacagcagcccccccaagagcctgcccggcagcaccagccccaagttcagcaccggcaccagaagcgagaagaaccacttcgagagcagccccctgcccaccagccccaagttcctgagacagaactgcatctacagcaccgaggccctgaccggcaagggccccagcggccaggagaagtgcaagctggagaaccacatcagccccgacgtgagagtgctgcccggcggcggcgcccacggcagcaccagagaccagagcatctag

SEQ ID NO: 94153 - DNA, 2442 bp, Artificial Sequence
  Description of Artificial Sequence: Synthetic coding sequence
agagacggcggcgagaagaccgccgtgaccagactgggcaagctgagagactgcaacacccacgacagcctgctggaggtgtgcgacgactacagcctggacgacaacgagtacttcttcgacagacaccccggcgccttcaccagcatcctgaacttctacagaaccggcagactgcacatgatggaggagatgtgcgccctgagcttcagccaggagctggactactggggcatcgacgagatctacctggagagctgctgccaggccagataccaccagaagaaggagcagatgaacgaggagctgaagagagaggccgagaccctgagagagagagagggcgaggagttcgacaacacctgctgcgccgagaagagaaagaagctgtgggacctgctggagaagcccaacagcagcgtggccgccaagatcctggccatcatcagcatcatgttcatcgtgctgagcaccatcgccctgagcctgaacaccctgcccgagctgcagagcctggacgagttcggccagagcaccgacaacccccagctggcccacgtggaggccgtgtgcatcgcctggttcaccatggagtacctgctgagattcctgagcagccccaagaagtggaagttcttcaagggccccctgaacgccatcgacctgctggccatcctgccctactacgtgaccatcttcctgaccgagagcaacaagagcgtgctgcagttccagaacgtgagaagagtggtgcagatcttcagaatcatgagaatcctgagaatcctgaagctggccagacacagcaccggcctgcagagcctgggcttcaccctgagaagaagctacaacgagctgggcctgctgatcctgttcctggccatgggcatcatgatcttcagcagcctggtgttcttcgccgagaaggacgaggacgacaccaagttcaagagcatccccgccagcttctggtgggccaccatcaccatgaccaccgtgggctacggcgacatctaccccaagaccctgctgggcaagatcgtgggcggcctgtgctgcatcgccggcgtgctggtgatcgccctgcccatccccatcatcgtgaacaacttcagcgagttctacaaggagcagaagagacaggagaaggccatcaagagaagagaggccctggagagagccaagagaaacggcagcatcgtgagcatgaacatgaaggacgccttcgccagaagcatcgagatgatggacatcgtggtggagaagaacggcgagaacatgggcaagaaggacaaggtgcaggacaaccacctgagccccaacaagtggaagtggaccaagagaaccctgagcgagaccagcagcagcaagagcttcgagaccaaggagcagggcagccccgagaaggccagaagcagcagcagcccccagcacctgaacgtgcagcagctggaggacatgtacaacaagatggccaagacccagagccagcccatcctgaacaccaaggagagcgccgcccagagcaagcccaaggaggagctggagatggagagcatccccagccccgtggcccccctgcccaccagaaccgagggcgtgatcgacatgagaagcatgagcagcatcgacagcttcatcagctgcgccaccgacttccccgaggccaccagattcagccacagccccctgaccagcctgcccagcaagaccggcggcagcaccgcccccgaggtgggctggagaggcgccctgggcgccagcggcggcagattcgtggaggccaaccccagccccgacgccagccagcacagcagcttcttcatcgagagccccaagagcagcatgaagaccaacaaccccctgaagctgagagccctgaaggtgaacttcatggagggcgaccccagccccctgctgcccgtgctgggcatgtaccacgaccccctgagaaacagaggcagcgccgccgccgccgtggccggcctggagtgcgccaccctgctggacaaggccgtgctgagccccgagagcagcatctacaccaccgccagcgccaagaccccccccagaagccccgagaagcacaccgccatcgccttcaacttcgaggccggcgtgcaccagtacatcgacgccgacaccgacgacgagggccagctgctgtacagcgtggacagcagcccccccaagagcctgcccggcagcaccagccccaagttcagcaccggcaccagaagcgagaagaaccacttcgagagcagccccctgcccaccagccccaagttcctgagacagaactgcatctacagcaccgaggccctgaccggcaagggccccagcggccaggagaagtgcaagctggagaaccacatcagccccgacgtgagagtgctgcccggcggcggcgcccacggcagcaccagagaccagagcatctag

SEQ ID NO: 94154 - DNA, 2736 bp, Artificial Sequence
  Description of Artificial Sequence: Synthetic coding sequence
atggccgagaaggccccccccggcctgaacagaaagaccagcagaagcaccctgagcctgccccccgagcccgtggacatcatcagaagcaagacctgcagcagaagagtgaagatcaacgtgggcggcctgaaccacgaggtgctgtggagaaccctggacagactgcccagaaccagactgggcaagctgagagactgcaacacccacgagagcctgctggaggtgtgcgacgactacaacctgaacgagaacgagtacttcttcgacagacaccccggcgccttcaccagcatcctgaacttctacagaaccggcaagctgcacatgatggaggagatgtgcgccctgagcttcggccaggagctggactactggggcatcgacgagatctacctggagagctgctgccaggccagataccaccagaagaaggagcagatgaacgaggagctgagaagagaggccgagaccatgagagagagagagggcgaggagttcgacaacacctgctgccccgacaagagaaagaagctgtgggacctgctggagaagcccaacagcagcgtggccgccaagatcctggccatcgtgagcatcctgttcatcgtgctgagcaccatcgccctgagcctgaacaccctgcccgagctgcaggagaccgacgagttcggccagctgaacgacaacagacagctggcccacgtggaggccgtgtgcatcgcctggttcaccatggagtacctgctgagattcctgagcagccccaacaagtggaagttcttcaagggccccctgaacgtgatcgacctgctggccatcctgccctactacgtgaccatcttcctgaccgagagcaacaagagcgtgctgcagttccagaacgtgagaagagtggtgcagatcttcagaatcatgagaatcctgagaatcctgaagctggccagacacagcaccggcctgcagagcctgggcttcaccctgagaagaagctacaacgagctgggcctgctgatcctgttcctggccatgggcatcatgatcttcagcagcctggtgttcttcgccgagaaggacgaggacgccaccaagttcaccagcatccccgccagcttctggtgggccaccatcaccatgaccaccgtgggctacggcgacatctaccccaagaccctgctgggcaagatcgtgggcggcctgtgctgcatcgccggcgtgctggtgatcgccctgcccatccccatcatcgtgaacaacttcagcgagttctacaaggagcagaagagacaggagaaggccatcaagagaagagaggccctggagagagccaagagaaacggcagcatcgtgagcatgaacctgaaggacgccttcgccagaagcatggagctgatcgacgtggccgtggagaaggccggcgagagcgccaacaccaaggacagcgccgacgacaaccacctgagccccagcagatggaagtgggccagaaaggccctgagcgagaccagcagcaacaagagcttcgagaacaagtaccaggaggtgagccagaaggacagccacgagcagctgaacaacaccagcagcagcagcccccagcacctgagcgcccagaagctggagatgctgtacaacgagatcaccaagacccagccccacagccaccccaaccccgactgccaggagaagcccgagagacccagcgcctacgaggaggagatcgagatggaggaggtggtgtgcccccaggagcagctggccgtggcccagaccgaggtgatcgtggacatgaagagcaccagcagcatcgacagcttcaccagctgcgccaccgacttcaccgagaccgagagaagccccctgcccccccccagcgccagccacctgcagatgaagttccccaccgacctgcccggcaccgaggagcaccagagagccagaggcccccccttcctgaccctgagcagagagaagggccccgccgccagagacggcaccctggagtacgcccccgtggacatcaccgtgaacctggacgccagcggcagccagtgcggcctgcacagccccctgcagagcgacaacgccaccgacagccccaagagcagcctgaagggcagcaaccccctgaagagcagaagcctgaaggtgaacttcaaggagaacagaggcagcgccccccagaccccccccagcaccgccagacccctgcccgtgaccaccgccgacttcagcctgaccaccccccagcacatcagcaccatcctgctggaggagacccccagccagggcgacagacccctgctgggcaccgaggtgagcgccccctgccagggccccagcaagggcctgagccccagattccccaagcagaagctgttccccttcagcagcagagagagaagaagcttcaccgagatcgacaccggcgacgacgaggacttcctggagctgcccggcgccagagaggagaagcaggtggacagcagccccaactgcttcgccgacaagcccagcgacggcagagaccccctgagagaggagggcagcgtgggcagcagcagcccccaggacaccggccacaactgcagacaggacatctaccacgccgtgagcgaggtgaagaaggacagcagccaggagggctgcaagatggagaaccacctgttcgcccccgagatccacagcaaccccggcgacaccggctactgccccaccagagagaccagcatgtag

SEQ ID NO: 94155 - DNA, 1206 bp, Artificial Sequence
  Description of Artificial Sequence: Synthetic coding sequence
atgcaggtgagcatcgcctgcaccgagcacaacctgaagagcagaaacggcgaggacagactgctgagcaagcagagcagcaccgcccccaacgtggtgaacgccgccagagccaagttcagaaccgtggccatcatcgccagaagcctgggcaccttcaccccccagcaccacatcagcctgaaggagagcaccgccaagcagaccggcatgaagtacagaaacctgggcaagagcggcctgagagtgagctgcctgggcctgggcacctgggtgaccttcggcggccagatcagcgacgaggtggccgagagactgatgaccatcgcctacgagagcggcgtgaacctgttcgacaccgccgaggtgtacgccgccggcaaggccgaggtgatcctgggcagcatcatcaagaagaagggctggagaagaagcagcctggtgatcaccaccaagctgtactggggcggcaaggccgagaccgagagaggcctgagcagaaagcacatcatcgagggcctgaagggcagcctgcagagactgcagctggagtacgtggacgtggtgttcgccaacagacccgacagcaacacccccatggaggagatcgtgagagccatgacccacgtgatcaaccagggcatggccatgtactggggcaccagcagatggagcgccatggagatcatggaggcctacagcgtggccagacagttcaacatgatcccccccgtgtgcgagcaggccgagtaccacctgttccagagagagaaggtggaggtgcagctgcccgagctgtaccacaagatcggcgtgggcgccatgacctggagccccctggcctgcggcatcatcagcggcaagtacggcaacggcgtgcccgagagcagcagagccagcctgaagtgctaccagtggctgaaggagagaatcgtgagcgaggagggcagaaagcagcagaacaagctgaaggacctgagccccatcgccgagagactgggctgcaccctgccccagctggccgtggcctggtgcctgagaaacgagggcgtgagcagcgtgctgctgggcagcagcacccccgagcagctgatcgagaacctgggcgccatccaggtgctgcccaagatgaccagccacgtggtgaacgagatcgacaacatcctgagaaacaagccctacagcaagaaggactacagaagctag

SEQ ID NO: 94156 - DNA, 1173 bp, Artificial Sequence
  Description of Artificial Sequence: Synthetic coding sequence
atgctggccgccagaaccggcgccgccggcagccagatcagcgaggagaacaccaagctgagaagacagagcggcttcagcgtggccggcaaggacaagagccccaagaaggccagcgagaacgccaaggacagcagcctgagccccagcggcgagagccagctgagagccagacagctggccctgctgagagaggtggagatgaactggtacctgaagctgtgcgacctgagcagcgagcacaccaccgtgtgcaccaccggcatgccccacagaaacctgggcaagagcggcctgagagtgagctgcctgggcctgggcacctgggtgaccttcggcggccagatcagcgacgaggtggccgagagactgatgaccatcgcctacgagagcggcgtgaacctgttcgacaccgccgaggtgtacgccgccggcaaggccgaggtgatcctgggcagcatcatcaagaagaagggctggagaagaagcagcctggtgatcaccaccaagctgtactggggcggcaaggccgagaccgagagaggcctgagcagaaagcacatcatcgaggagatcgtgagagccatgacccacgtgatcaaccagggcatggccatgtactggggcaccagcagatggagcgccatggagatcatggaggcctacagcgtggccagacagttcaacatgatcccccccgtgtgcgagcaggccgagtaccacctgttccagagagagaaggtggaggtgcagctgcccgagctgtaccacaagatcggcgtgggcgccatgacctggagccccctggcctgcggcatcatcagcggcaagtacggcaacggcgtgcccgagagcagcagagccagcctgaagtgctaccagtggctgaaggagagaatcgtgagcgaggagggcagaaagcagcagaacaagctgaaggacctgagccccatcgccgagagactgggctgcaccctgccccagctggccgtggcctggtgcctgagaaacgagggcgtgagcagcgtgctgctgggcagcagcacccccgagcagctgatcgagaacctgggcgccatccaggtgctgcccaagatgaccagccacgtggtgaacgagatcgacaacatcctgagaaacaagccctacagcaagaaggactacagaagctag

SEQ ID NO: 94157 - DNA, 1227 bp, Artificial Sequence
  Description of Artificial Sequence: Synthetic coding sequence
atgcacctgtacaagcccgcctgcgccgacatccccagccccaagctgggcctgcccaagagcagcgagagcgccctgaagtgcagatggcacctggccgtgaccaagacccagccccaggccgcctgcaagcccgtgagacccagcggcgccgccgagcagaagtacgtggagaagttcctgagagtgcacggcatcagcctgcaggagaccaccagagccgagaccggcatggcctacagaaacctgggcaagagcggcctgagagtgagctgcctgggcctgggcacctgggtgaccttcggcggccagatcagcgacgaggtggccgagagactgatgaccatcgcctacgagagcggcgtgaacctgttcgacaccgccgaggtgtacgccgccggcaaggccgaggtgatcctgggcagcatcatcaagaagaagggctggagaagaagcagcctggtgatcaccaccaagctgtactggggcggcaaggccgagaccgagagaggcctgagcagaaagcacatcatcgagggcctgaagggcagcctgcagagactgcagctggagtacgtggacgtggtgttcgccaacagacccgacagcaacacccccatggaggagatcgtgagagccatgacccacgtgatcaaccagggcatggccatgtactggggcaccagcagatggagcgccatggagatcatggaggcctacagcgtggccagacagttcaacatgatcccccccgtgtgcgagcaggccgagtaccacctgttccagagagagaaggtggaggtgcagctgcccgagctgtaccacaagatcggcgtgggcgccatgacctggagccccctggcctgcggcatcatcagcggcaagtacggcaacggcgtgcccgagagcagcagagccagcctgaagtgctaccagtggctgaaggagagaatcgtgagcgaggagggcagaaagcagcagaacaagctgaaggacctgagccccatcgccgagagactgggctgcaccctgccccagctggccgtggcctggtgcctgagaaacgagggcgtgagcagcgtgctgctgggcagcagcacccccgagcagctgatcgagaacctgggcgccatccaggtgctgcccaagatgaccagccacgtggtgaacgagatcgacaacatcctgagaaacaagccctacagcaagaaggactacagaagctag

SEQ ID NO: 94158 - DNA, 1260 bp, Artificial Sequence
  Description of Artificial Sequence: Synthetic coding sequence
atgctggccgccagaaccggcgccgccggcagccagatcagcgaggagaacaccaagctgagaagacagagcggcttcagcgtggccggcaaggacaagagccccaagaaggccagcgagaacgccaaggacagcagcctgagccccagcggcgagagccagctgagagccagacagctggccctgctgagagaggtggagatgaactggtacctgaagctgtgcgacctgagcagcgagcacaccaccgtgtgcaccaccggcatgccccacagaaacctgggcaagagcggcctgagagtgagctgcctgggcctgggcacctgggtgaccttcggcggccagatcagcgacgaggtggccgagagactgatgaccatcgcctacgagagcggcgtgaacctgttcgacaccgccgaggtgtacgccgccggcaaggccgaggtgatcctgggcagcatcatcaagaagaagggctggagaagaagcagcctggtgatcaccaccaagctgtactggggcggcaaggccgagaccgagagaggcctgagcagaaagcacatcatcgagggcctgaagggcagcctgcagagactgcagctggagtacgtggacgtggtgttcgccaacagacccgacagcaacacccccatggaggagatcgtgagagccatgacccacgtgatcaaccagggcatggccatgtactggggcaccagcagatggagcgccatggagatcatggaggcctacagcgtggccagacagttcaacatgatcccccccgtgtgcgagcaggccgagtaccacctgttccagagagagaaggtggaggtgcagctgcccgagctgtaccacaagatcggcgtgggcgccatgacctggagccccctggcctgcggcatcatcagcggcaagtacggcaacggcgtgcccgagagcagcagagccagcctgaagtgctaccagtggctgaaggagagaatcgtgagcgaggagggcagaaagcagcagaacaagctgaaggacctgagccccatcgccgagagactgggctgcaccctgccccagctggccgtggcctggtgcctgagaaacgagggcgtgagcagcgtgctgctgggcagcagcacccccgagcagctgatcgagaacctgggcgccatccaggtgctgcccaagatgaccagccacgtggtgaacgagatcgacaacatcctgagaaacaagccctacagcaagaaggactacagaagctag

SEQ ID NO: 94159 - DNA, 1104 bp, Artificial Sequence
  Description of Artificial Sequence: Synthetic coding sequence
atgtaccccgagagcaccaccggcagccccgccagactgagcctgagacagaccggcagccccggcatgatctacagcaccagatacggcagccccaagagacagctgcagttctacagaaacctgggcaagagcggcctgagagtgagctgcctgggcctgggcacctgggtgaccttcggcggccagatcaccgacgagatggccgagcagctgatgaccctggcctacgacaacggcatcaacctgttcgacaccgccgaggtgtacgccgccggcaaggccgaggtggtgctgggcaacatcatcaagaagaagggctggagaagaagcagcctggtgatcaccaccaagatcttctggggcggcaaggccgagaccgagagaggcctgagcagaaagcacatcatcgagggcctgaaggccagcctggagagactgcagctggagtacgtggacgtggtgttcgccaacagacccgaccccaacacccccatggaggagaccgtgagagccatgacccacgtgatcaaccagggcatggccatgtactggggcaccagcagatggagcagcatggagatcatggaggcctacagcgtggccagacagttcaacctgaccccccccatctgcgagcaggccgagtaccacatgttccagagagagaaggtggaggtgcagctgcccgagctgttccacaagatcggcgtgggcgccatgacctggagccccctggcctgcggcatcgtgagcggcaagtacgacagcggcatccccccctacagcagagccagcctgaagggctaccagtggctgaaggacaagatcctgagcgaggagggcagaagacagcaggccaagctgaaggagctgcaggccatcgccgagagactgggctgcaccctgccccagctggccatcgcctggtgcctgagaaacgagggcgtgagcagcgtgctgctgggcgccagcaacgccgaccagctgatggagaacatcggcgccatccaggtgctgcccaagctgagcagcagcatcatccacgagatcgacagcatcctgggcaacaagccctacagcaagaaggactacagaagctag

SEQ ID NO: 94160 - DNA, 1104 bp, Artificial Sequence; identical to SEQ ID NO: 94159
  Description of Artificial Sequence: Synthetic coding sequence

SEQ ID NO: 94161 - DNA, 1062 bp, Artificial Sequence
  Description of Artificial Sequence: Synthetic coding sequence
atgtaccccgagagcaccaccggcagccccgccagactgagcctgagacagaccggcagccccggcatgatctacagaaacctgggcaagagcggcctgagagtgagctgcctgggcctgggcacctgggtgaccttcggcggccagatcaccgacgagatggccgagcagctgatgaccctggcctacgacaacggcatcaacctgttcgacaccgccgaggtgtacgccgccggcaaggccgaggtggtgctgggcaacatcatcaagaagaagggctggagaagaagcagcctggtgatcaccaccaagatcttctggggcggcaaggccgagaccgagagaggcctgagcagaaagcacatcatcgagggcctgaaggccagcctggagagactgcagctggagtacgtggacgtggtgttcgccaacagacccgaccccaacacccccatggaggagaccgtgagagccatgacccacgtgatcaaccagggcatggccatgtactggggcaccagcagatggagcagcatggagatcatggaggcctacagcgtggccagacagttcaacctgaccccccccatctgcgagcaggccgagtaccacatgttccagagagagaaggtggaggtgcagctgcccgagctgttccacaagatcggcgtgggcgccatgacctggagccccctggcctgcggcatcgtgagcggcaagtacgacagcggcatccccccctacagcagagccagcctgaagggctaccagtggctgaaggacaagatcctgagcgaggagggcagaagacagcaggccaagctgaaggagctgcaggccatcgccgagagactgggctgcaccctgccccagctggccatcgcctggtgcctgagaaacgagggcgtgagcagcgtgctgctgggcgccagcaacgccgaccagctgatggagaacatcggcgccatccaggtgctgcccaagctgagcagcagcatcatccacgagatcgacagcatcctgggcaacaagccctacagcaagaaggactacagaagctag

SEQ ID NO: 94162 - DNA, 1248 bp, Artificial Sequence
  Description of Artificial Sequence: Synthetic coding sequence
atgctgagcatgacctacagcgagagcctgagaagcgtgagcagcagatgccacagcgagtgggccctgcaccccgtgagacagaccgacaccctggagctgcagagactgagagaggtgagagccgccgcccaggccagaaacatggagagcttcctgagaatgcacggcctgagcctggacggctgcaccgcccagagaaccggcatgaagtacagaaacctgggcaagagcggcctgagagtgagctgcctgggcctgggcacctgggtgaccttcggcggccagatcaccgacgagatggccgagcagctgatgaccctggcctacgacaacggcatcaacctgttcgacaccgccgaggtgtacgccgccggcaaggccgaggtggtgctgggcaacatcatcaagaagaagggctggagaagaagcagcctggtgatcaccaccaagatcttctggggcggcaaggccgagaccgagagaggcctgagcagaaagcacatcatcgagggcctgaaggccagcctggagagactgcagctggagtacgtggacgtggtgttcgccaacagacccgaccccaacacccccatggagggcgaccccttcagcagcagcaagagcagaaccttcatcatcgaggagaccgtgagagccatgacccacgtgatcaaccagggcatggccatgtactggggcaccagcagatggagcagcatggagatcatggaggcctacagcgtggccagacagttcaacctgaccccccccatctgcgagcaggccgagtaccacatgttccagagagagaaggtggaggtgcagctgcccgagctgttccacaagatcggcgtgggcgccatgacctggagccccctggcctgcggcatcgtgagcggcaagtacgacagcggcatccccccctacagcagagccagcctgaagggctaccagtggctgaaggacaagatcctgagcgaggagggcagaagacagcaggccaagctgaaggagctgcaggccatcgccgagagactgggctgcaccctgccccagctggccatcgcctggtgcctgagaaacgagggcgtgagcagcgtgctgctgggcgccagcaacgccgaccagctgatggagaacatcggcgccatccaggtgctgcccaagctgagcagcagcatcatccacgagatcgacagcatcctgggcaacaagccctacagcaagaaggactacagaagctag

SEQ ID NO: 94163 - DNA, 522 bp, Artificial Sequence
  Description of Artificial Sequence: Synthetic coding sequence
atgtaccccgagagcaccaccggcagccccgccagactgagcctgagacagaccggcagccccggcatgatctacagcaccagatacggcagccccaagagacagctgcagttctacagaaacctgggcaagagcggcctgagagtgagctgcctgggcctgggcacctgggtgaccttcggcggccagatcaccgacgagatggccgagcagctgatgaccctggcctacgacaacggcatcaacctgttcgacaccgccgaggtgtacgccgccggcaaggccgaggtggtgctgggcaacatcatcaagaagaagggctggagccagcagggcgagagagccggccaggccagagtgacccccccctgcagcctgggcagaagagccagagacgccagcaagagcgccggcgccggctgccacctgcaggcccaggcctgcgtgcccagcagcacccaggccctgcagaccaccagaggcagagcccccctgaagccccccccccccctggccagctag

SEQ ID NO: 94164 - DNA, 1062 bp, Artificial Sequence; identical to SEQ ID NO: 94161
  Description of Artificial Sequence: Synthetic coding sequence

SEQ ID NO: 94165 - DNA, 1104 bp, Artificial Sequence; identical to SEQ ID NO: 94159
  Description of Artificial Sequence: Synthetic coding sequence

SEQ ID NO: 94166 - DNA, 522 bp, Artificial Sequence
  Description of Artificial Sequence: Synthetic coding sequence
atgtaccccgagagcaccaccggcagccccgccagactgagcctgagacagaccggcagccccggcatgatctacagcaccagatacggcagccccaagagacagctgcagttctacagaaacctgggcaagagcggcctgagagtgagctgcctgggcctgggcacctgggtgaccttcggcggccagatcaccgacgagatggccgagcagctgatgaccctggcctacgacaacggcatcaacctgttcgacaccgccgaggtgtacgccgccggcaaggccgaggtggtgctgggcaacatcatcaagaagaagggctggagacagagaggcgagagagccggccaggccagagtgacccccccctgcagcctgggcagaagagccagagacgccagcaagagcgccggcgccggctgccacctgcaggcccaggcctgcgtgcccagcagcacccaggccctgcagaccaccagaggcagagcccccctgaagccccccccccccctggccagctag

SEQ ID NO: 94167 - DNA, 762 bp, Artificial Sequence
  Description of Artificial Sequence: Synthetic coding sequence
atgtaccccgagagcaccaccggcagccccgccagactgagcctgagacagaccggcagccccggcatgatctacagcaccagatacggcagccccaagagacagctgcagttctacagaaacctgggcaagagcggcctgagagtgagctgcctgggcctgggcacctgggtgaccttcggcggccagatcaccgacgagatggccgagcagctgatgaccctggcctacgacaacggcatcaacctgttcgacaccgccgaggtgtacgccgccggcaaggccgaggtggtgctgggcaacatcatcaagaagaagggctggagaagaagcagcctggtgatcaccaccaagatcttctggggcggcaaggccgagaccgagagaggcctgagcagaaagcacatcatcgagggcctgaaggccagcctggagagactgcagctggagtacgtggacgtggtgttcgccaacagacccgaccccaacacccccatggaggagaccgtgagagccatgacccacgtgatcaaccagggcatggccatgtactggggcaccagcagatggagcagcatggagatcatggaggcctacagcgtggccagacagttcaacctgaccccccccatctgcgagcaggccgagtaccacatgttccagagagagaaggtggaggtgcagctgcccgagctgttccacaagatcggcgtgggcgccatgacctggagccccctggcctgcggcatcgtgagcggctag

SEQ ID NO: 94168 - DNA, 765 bp, Artificial Sequence
  Description of Artificial Sequence: Synthetic coding sequence
atgtaccccgagagcaccaccggcagccccgccagactgagcctgagacagaccggcagccccggcatgatctacagaaacctgggcaagagcggcctgagagtgagctgcctgggcctgggcacctgggtgaccttcggcggccagatcaccgacgagatggccgagcagctgatgaccctggcctacgacaacggcatcaacctgttcgacaccgccgaggtgtacgccgccggcaaggccgaggtggtgctgggcaacatcatcaagaagaagggctggagaagaagcagcctggtgatcaccaccaagatcttctggggcggcaaggccgagaccgagagaggcctgagcagaaagcacatcatcgagggcctgaaggccagcctggagagactgcagctggagtacgtggacgtggtgttcgccaacagacccgaccccaacacccccatggaggagaccgtgagagccatgacccacgtgatcaaccagggcatggccatgtactggggcaccagcagatggagcagcatggagatcatggaggcctacagcgtggccagacagttcaacctgaccccccccatctgcgagcaggccgagtaccacatgttccagagagagaaggtggaggtgcagctgcccgagctgttccacaagatcggcgtgggcgccatgacctggagccccctggcctgcggcatcgtgagcggcaagtacgacagcggcatccccccctacagcagagccagcctgaagtag

SEQ ID NO: 94169 - DNA, 288 bp, Artificial Sequence
  Description of Artificial Sequence: Synthetic coding sequence
atgtaccccgagagcaccaccggcagccccgccagactgagcctgagacagaccggcagccccggcatgatctacagaaacctgggcaagagcggcctgagagtgagctgcctgggcctgggcacctgggtgaccttcggcggccagatcaccgacgagatggccgagcagctgatgaccctggcctacgacaacggcatcaacctgttcgacaccgccgaggtgtacgccgccggcaaggccgaggtggtgctgggcaacatcatcaagaagaagggctggagatag

SEQ ID NO: 94170 - DNA, 159 bp, Artificial Sequence
  Description of Artificial Sequence: Synthetic coding sequence
atgtaccccgagagcaccaccggcagccccgccagactgagcctgagacagaccggcagccccggcatgatctacagcaccagatacggcagccccaagagacagctgcagttctacagaaacctgggcaagagcggcctgagagtgagctgcctgtag

SEQ ID NO: 94171 - DNA, 903 bp, Artificial Sequence
  Description of Artificial Sequence: Synthetic coding sequence
atggccgagcagctgatgaccctggcctacgacaacggcatcaacctgttcgacaccgccgaggtgtacgccgccggcaaggccgaggtggtgctgggcaacatcatcaagaagaagggctggagaagaagcagcctggtgatcaccaccaagatcttctggggcggcaaggccgagaccgagagaggcctgagcagaaagcacatcatcgagggcctgaaggccagcctggagagactgcagctggagtacgtggacgtggtgttcgccaacagacccgaccccaacacccccatggaggagaccgtgagagccatgacccacgtgatcaaccagggcatggccatgtactggggcaccagcagatggagcagcatggagatcatggaggcctacagcgtggccagacagttcaacctgaccccccccatctgcgagcaggccgagtaccacatgttccagagagagaaggtggaggtgcagctgcccgagctgttccacaagatcggcgtgggcgccatgacctggagccccctggcctgcggcatcgtgagcggcaagtacgacagcggcatccccccctacagcagagccagcctgaagggctaccagtggctgaaggacaagatcctgagcgaggagggcagaagacagcaggccaagctgaaggagctgcaggccatcgccgagagactgggctgcaccctgccccagctggccatcgcctggtgcctgagaaacgagggcgtgagcagcgtgctgctgggcgccagcaacgccgaccagctgatggagaacatcggcgccatccaggtgctgcccaagctgagcagcagcatcatccacgagatcgacagcatcctgggcaacaagccctacagcaagaaggactacagaagctag

SEQ ID NO: 94172 - DNA, 1215 bp, Artificial Sequence
  Description of Artificial Sequence: Synthetic coding sequence
atgcaggtgagcatcgcctgcaccgagcagaacctgagaagcagaagcagcgaggacagactgtgcggccccagacccggccccggcggcggcaacggcggccccgccggcggcggccacggcaacccccccggcggcggcggcagcggccccaaggccagagccgccctggtgcccagaccccccgcccccgccggcgccctgagagagagcaccggcagaggcaccggcatgaagtacagaaacctgggcaagagcggcctgagagtgagctgcctgggcctgggcacctgggtgaccttcggcagccagatcagcgacgagaccgccgaggacgtgctgaccgtggcctacgagcacggcgtgaacctgttcgacaccgccgaggtgtacgccgccggcaaggccgagagaaccctgggcaacatcctgaagagcaagggctggagaagaagcagctacgtgatcaccaccaagatcttctggggcggccaggccgagaccgagagaggcctgagcagaaagcacatcatcgagggcctgagaggcagcctggagagactgcagctgggctacgtggacatcgtgttcgccaacagaagcgaccccaactgccccatggaggagatcgtgagagccatgacctacgtgatcaaccagggcctggccctgtactggggcaccagcagatggggcgccgccgagatcatggaggcctacagcatggccagacagttcaacctgatcccccccgtgtgcgagcaggccgagcaccacctgttccagagagagaaggtggagatgcagctgcccgagctgtaccacaagatcggcgtgggcagcgtgacctggtaccccctggcctgcggcctgatcaccagcaagtacgacggcagagtgcccgacacctgcagagccagcatcaagggctaccagtggctgaaggacaaggtgcagagcgaggacggcaagaagcagcaggccaaggtgatggacctgctgcccgtggcccaccagctgggctgcaccgtggcccagctggccatcgcctggtgcctgagaagcgagggcgtgagcagcgtgctgctgggcgtgagcagcgccgagcagctgatcgagcacctgggcgccctgcaggtgctgagccagctgaccccccagaccgtgatggagatcgacggcctgctgggcaacaagccccacagcaagaagtag

SEQ ID NO: 94173 - DNA, 2562 bp, Artificial Sequence
  Description of Artificial Sequence: Synthetic coding sequence
atgagcgagaaggtggactggctgcagagccagaacggcgtgtgcaaggtggacgtgtacagccccggcgacaaccaggcccaggactggaagatggacaccagcaccgaccccgtgagagtgctgagctggctgagaagagacctggagaagagcaccgccgagttccaggacgtgagattcaagcccggcgagagcttcggcggcgagaccagcaacagcggcgacccccacaagggcttcagcgtggactactacaacaccaccaccaagggcacccccgagagactgcacttcgagatgacccacaaggagatcccctgccagggccccagagcccagctgggcaacggcagcagcgtggacgaggtgagcttctacgccaacagactgaccaacctggtgatcgccatggccagaaaggagatcaacgagaagatcgacggcagcgagaacaagtgcgtgtaccagagcctgtacatgggcaacgagcccacccccaccaagagcctgagcaagatcgccagcgagctggtgaacgagaccgtgagcgcctgcagcagaaacgccgcccccgacaaggcccccggcagcggcgacagagtgagcggcagcagccagagcccccccaacctgaagtacaagagcaccctgaagatcaaggagagcaccaaggagagacagggccccgacgacaagccccccagcaagaagagcttcttctacaaggaggtgttcgagagcagaaacggcgactacgccagagagggcggcagattcttccccagagagagaaagagattcagaggccaggagagacccgacgacttcaccgccagcgtgagcgagggcatcatgacctacgccaacagcgtggtgagcgacatgatggtgagcatcatgaagaccctgaagatccaggtgaaggacaccaccatcgccaccatcctgctgaagaaggtgctgctgaagcacgccaaggaggtggtgagcgacctgatcgacagcttcctgagaaacctgcacagcgtgaccggcaccctgatgaccgacacccagttcgtgagcgccgtgaagagaaccgtgttcagccacggcagccagaaggccaccgacatcatggacgccatgctgagaaagctgtacaacgtgatgttcgccaagaaggtgcccgagcacgtgagaaaggcccaggacaaggccgagagctacagcctgatcagcatgaagggcatgggcgaccccaagaacagaaacgtgaacttcgccatgaagagcgagaccaagctgagagagaagatgtacagcgagcccaagagcgaggaggagacctgcgccaagaccctgggcgagcacatcatcaaggagggcctgaccctgtggcacaagacccagcagaaggagtgcaagagcctgggcttccagcacgccgccttcgaggcccccaacacccagagaaagcccgccagcgacatcagcttcgagtaccccgaggacatcggcaacctgagcctgcccccctacccccccgagaagcccgagaacttcatgtacgacagcgacagctgggccgaggacctgatcgtgagcgccctgctgctgatccagtaccacctggcccagggcggcagaagagacgccagaagcttcgtggaggccgccggcaccaccaacttccccgccaacgagccccccgtggcccccgacgagagctgcctgaagagcgcccccatcgtgggcgaccaggagcaggccgagaagaaggacctgagaagcgtgttcttcaacttcatcagaaacctgctgagcgagaccatcttcaagagagaccagagccccgagcccaaggtgcccgagcagcccgtgaaggaggacagaaagctgtgcgagagacccctggccagcagcccccccagactgtacgaggacgacgagacccccggcgccctgagcggcctgaccaagatggccgtgagccagatcgacggccacatgagcggccagatggtggagcacctgatgaacagcgtgatgaagctgtgcgtgatcatcgccaagagctgcgacgccagcctggccgagctgggcgacgacaagagcggcgacgccagcagactgaccagcgccttccccgacagcctgtacgagtgcctgcccgccaagggcaccggcagcgccgaggccgtgctgcagaacgcctaccaggccatccacaacgagatgagaggcaccagcggccagccccccgagggctgcgccgcccccaccgtgatcgtgagcaaccacaacctgaccgacaccgtgcagaacaagcagctgcaggccgtgctgcagtgggtggccgccagcgagctgaacgtgcccatcctgtacttcgccggcgacgacgagggcatccaggagaagctgctgcagctgagcgccgccgccgtggacaagggctgcagcgtgggcgaggtgctgcagagcgtgctgagatacgagaaggagagacagctgaacgaggccgtgggcaacgtgacccccctgcagctgctggactggctgatggtgaacctgtag

SEQ ID NO: 94174 - DNA, 1488 bp, Artificial Sequence
  Description of Artificial Sequence: Synthetic coding sequence
atgaccgtgatgagcggcgagaacgtggacgaggccagcgccgcccccggccacccccaggacggcagctaccccagacaggccgaccacgacgaccacgagtgctgcgagagagtggtgatcaacatcagcggcctgagattcgagacccagctgaagaccctggcccagttccccaacaccctgctgggcaaccccaagaagagaatgagatacttcgaccccctgagaaacgagtacttcttcgacagaaacagacccagcttcgacgccatcctgtactactaccagagcggcggcagactgagaagacccgtgaacgtgcccctggacatgttcagcgaggagatcaagttctacgagctgggcgaggaggccatggagaagttcagagaggacgagggcttcatcaaggaggaggagagacccctgcccgagaaggagtaccagagacaggtgtggctgctgttcgagtaccccgagagcagcggccccgccagagtgatcgccatcgtgagcgtgatggtgatcctgatcagcatcgtgatcttctgcctggagaccctgcccgagctgaaggacgacaaggacttcaccggcaccgtgcacagaatcgacaacaccaccgtgatctacaacagcaacatcttcaccgaccccttcttcatcgtggagaccctgtgcatcatctggttcagcttcgagctggtggtgagattcttcgcctgccccagcaagaccgacttcttcaagaacatcatgaacttcatcgacatcgtggccatcatcccctacttcatcaccctgggcaccgagatcgccgagcaggagggcaaccagaagggcgagcaggccaccagcctggccatcctgagagtgatcagactggtgagagtgttcagaatcttcaagctgagcagacacagcaagggcctgcagatcctgggccagaccctgaaggccagcatgagagagctgggcctgctgatcttcttcctgttcatcggcgtgatcctgttcagcagcgccgtgtacttcgccgaggccgaggaggccgagagccacttcagcagcatccccgacgccttctggtgggccgtggtgagcatgaccaccgtgggctacggcgacatgtaccccgtgaccatcggcggcaagatcgtgggcagcctgtgcgccatcgccggcgtgctgaccatcgccctgcccgtgcccgtgatcgtgagcaacttcaactacttctaccacagagagaccgagggcgaggagcaggcccagctgctgcacgtgagcagccccaacctggccagcgacagcgacctgagcagaagaagcagcagcaccatgagcaagagcgagtacatggagatcgaggaggacatgaacaacagcatcgcccactacagacaggtgaacatcagaaccgccaactgcaccaccgccaaccagaactgcgtgaacaagagcaagctgctgaccgacgtgtag

SEQ ID NO: 94175 - DNA, 1536 bp, Artificial Sequence
  Description of Artificial Sequence: Synthetic coding sequence
atggacgtgtgcggctggaaggagatggaggtggccctggtgaacttcgacaacagcgacgagatccaggaggagcccggctacgccaccgacttcgacagcaccagccccaagggcagacccggcggcagcagcttcagcaacggcaagatcctgatcagcgagagcaccaaccacgagaccgccttcagcaagctgcccggcgactacgccgacccccccggccccgagcccgtggtgctgaacgagggcaaccagagagtgatcatcaacatcgccggcctgagattcgagacccagctgagaaccctgagccagttccccgagaccctgctgggcgacagagagaagagaatgcagttcttcgacagcatgagaaacgagtacttcttcgacagaaacagacccagcttcgacggcatcctgtactactaccagagcggcggcaagatcagaagacccgccaacgtgcccatcgacatcttcgccgacgagatcagcttctacgagctgggcagcgaggccatggaccagttcagagaggacgagggcttcatcaaggaccccgagaccctgctgcccaccaacgacatccacagacagttctggctgctgttcgagtaccccgagagcagcagcgccgccagagccgtggccgtggtgagcgtgctggtggtggtgatcagcatcaccatcttctgcctggagaccctgcccgagttcagagaggacagagagctgaaggtggtgagagaccccaacctgaacatgagcaagaccgtgctgagccagaccatgttcaccgaccccttcttcatggtggagagcacctgcatcgtgtggttcaccttcgagctggtgctgagattcgtggtgtgccccagcaagaccgacttcttcagaaacatcatgaacatcatcgacatcatcagcatcatcccctacttcgccaccctgatcaccgagctggtgcaggagaccgagcccagcgcccagcagaacatgagcctggccatcctgagaatcatcagactggtgagagtgttcagaatcttcaagctgagcagacacagcaagggcctgcagatcctgggccagaccctgaaggccagcatgagagagctgggcctgctgatcttcttcctgttcatcggcgtgatcctgttcagcagcgccgtgtacttcgccgaggtggacgagcccgagagccacttcagcagcatccccgacggcttctggtgggccgtggtgaccatgaccaccgtgggctacggcgacatgtgccccaccacccccggcggcaagatcgtgggcaccctgtgcgccatcgccggcgtgctgaccatcgccctgcccgtgcccgtgatcgtgagcaacttcaactacttctaccacagagagaccgagaacgaggagaagcagaacatccccggcgagatcgagagaatcctgaacagcgtgggcagcagaatgggcagcaccgacagcctgaacaagaccaacggcggctgcagcaccgagaagagcagaaagtag

SEQ ID NO: 94176 - DNA, 1728 bp, Artificial Sequence
  Description of Artificial Sequence: Synthetic coding sequence
atggacgagagactgagcctgctgagaagcccccccccccccagcgccagacacagagcccaccccccccagagacccgccagcagcggcggcgcccacaccctggtgaaccacggctacgccgagcccgccgccggcagagagctgccccccgacatgaccgtggtgcccggcgaccacctgctggagcccgaggtggccgacggcggcggcgcccccccccagggcggctgcggcggcggcggctgcgacagatacgagcccctgccccccagcctgcccgccgccggcgagcaggactgctgcggcgagagagtggtgatcaacatcagcggcctgagattcgagacccagctgaagaccctgtgccagttccccgagaccctgctgggcgaccccaagagaagaatgagatacttcgaccccctgagaaacgagtacttcttcgacagaaacagacccagcttcgacgccatcctgtactactaccagagcggcggcagaatcagaagacccgtgaacgtgcccatcgacatcttcagcgaggagatcagattctaccagctgggcgaggaggccatggagaagttcagagaggacgagggcttcctgagagaggaggagagacccctgcccagaagagacttccagagacaggtgtggctgctgttcgagtaccccgagagcagcggccccgccagaggcatcgccatcgtgagcgtgctggtgatcctgatcagcatcgtgatcttctgcctggagaccctgcccgagttcagagacgagaaggactaccccgccagcaccagccaggacagcttcgaggccgccggcaacagcaccagcggcagcagagccggcgccagcagcttcagcgaccccttcttcgtggtggagaccctgtgcatcatctggttcagcttcgagctgctggtgagattcttcgcctgccccagcaaggccaccttcagcagaaacatcatgaacctgatcgacatcgtggccatcatcccctacttcatcaccctgggcaccgagctggccgagagacagggcaacggccagcaggccatgagcctggccatcctgagagtgatcagactggtgagagtgttcagaatcttcaagctgagcagacacagcaagggcctgcagatcctgggccagaccctgaaggccagcatgagagagctgggcctgctgatcttcttcctgttcatcggcgtgatcctgttcagcagcgccgtgtacttcgccgaggccgacgaccccaccagcggcttcagcagcatccccgacgccttctggtgggccgtggtgaccatgaccaccgtgggctacggcgacatgcaccccgtgaccatcggcggcaagatcgtgggcagcctgtgcgccatcgccggcgtgctgaccatcgccctgcccgtgcccgtgatcgtgagcaacttcaactacttctaccacagagagaccgagggcgaggagcagagccagtacatgcacgtgggcagctgccagcacctgagcagcagcgccgaggagctgagaaaggccagaagcaacagcaccctgagcaagagcgagtacatggtgatcgaggagggcggcatgaaccacagcgccttcccccagacccccttcaagaccggcaacagcaccgccacctgcaccaccaacaacaaccccaacagctgcgtgaacatcaagaagatcttcaccgacgtgtag

SEQ ID NO: 94177 - DNA, 1962 bp, Artificial Sequence
  Description of Artificial Sequence: Synthetic coding sequence
atggaggtggccatggtgagcgccgagagcagcggctgcaacagccacatgccctacggctacgccgcccaggccagagccagagagagagagagactggcccacagcagagccgccgccgccgccgccgtggccgccgccaccgccgccgtggagggcagcggcggcagcggcggcggcagccaccaccaccaccagagcagaggcgcctgcaccagccacgacccccagagcagcagaggcagcagaagaagaagaagacagagaagcgagaagaagaaggcccactacagacagagcagcttcccccactgcagcgacctgatgcccagcggcagcgaggagaagatcctgagagagctgagcgaggaggaggaggacgaggaggaggaggaggaggaggaggaggagggcagattctactacagcgaggacgaccacggcgacgagtgcagctacaccgacctgctgccccaggacgagggcggcggcggctacagcagcgtgagatacagcgactgctgcgagagagtggtgatcaacgtgagcggcctgagattcgagacccagatgaagaccctggcccagttccccgagaccctgctgggcgaccccgagaagagaacccagtacttcgaccccctgagaaacgagtacttcttcgacagaaacagacccagcttcgacgccatcctgtactactaccagagcggcggcagactgaagagacccgtgaacgtgcccttcgacatcttcaccgaggaggtgaagttctaccagctgggcgaggaggccctgctgaagttcagagaggacgagggcttcgtgagagaggaggaggacagagccctgcccgagaacgagttcaagaagcagatctggctgctgttcgagtaccccgagagcagcagccccgccagaggcatcgccatcgtgagcgtgctggtgatcctgatcagcatcgtgatcttctgcctggagaccctgcccgagttcagagacgacagagacctggtgatggccctgagcgccggcggccacggcggcctgctgaacgacaccagcgccccccacctggagaacagcggccacaccatcttcaacgaccccttcttcatcgtggagaccgtgtgcatcgtgtggttcagcttcgagttcgtggtgagatgcttcgcctgccccagccaggccctgttcttcaagaacatcatgaacatcatcgacatcgtgagcatcctgccctacttcatcaccctgggcaccgacctggcccagcagcagggcggcggcaacggccagcagcagcaggccatgagcttcgccatcctgagaatcatcagactggtgagagtgttcagaatcttcaagctgagcagacacagcaagggcctgcagatcctgggccacaccctgagagccagcatgagagagctgggcctgctgatcttcttcctgttcatcggcgtgatcctgttcagcagcgccgtgtacttcgccgaggccgacgagcccaccacccacttccagagcatccccgacgccttctggtgggccgtggtgaccatgaccaccgtgggctacggcgacatgaagcccatcaccgtgggcggcaagatcgtgggcagcctgtgcgccatcgccggcgtgctgaccatcgccctgcccgtgcccgtgatcgtgagcaacttcaactacttctaccacagagagaccgagaacgaggagcagacccagctgacccagaacgccgtgagctgcccctacctgcccagcaacctgctgaagaagttcagaagcagcaccagcagcagcctgggcgacaagagcgagtacctggagatggaggagggcgtgaaggagagcctgtgcgccaaggaggagaagtgccagggcaagggcgacgacagcgagaccgacaagaacaactgcagcaacgccaaggccgtggagaccgacgtgtag

SEQ ID NO: 94178 - DNA, 1842 bp, Artificial Sequence
  Description of Artificial Sequence: Synthetic coding sequence
atggagatcgccctggtgcccctggagaacggcggcgccatgaccgtgagaggcggcgacgaggccagagccggctgcggccaggccaccggcggcgagctgcagtgcccccccaccgccggcctgagcgacggccccaaggagcccgcccccaagggcagaggcgcccagagagacgccgacagcggcgtgagacccctgccccccctgcccgaccccggcgtgagacccctgccccccctgcccgaggagctgcccagacccagaagacccccccccgaggacgaggaggaggagggcgaccccggcctgggcaccgtggaggaccaggccctgggcaccgccagcctgcaccaccagagagtgcacatcaacatcagcggcctgagattcgagacccagctgggcaccctggcccagttccccaacaccctgctgggcgaccccgccaagagactgagatacttcgaccccctgagaaacgagtacttcttcgacagaaacagacccagcttcgacggcatcctgtactactaccagagcggcggcagactgagaagacccgtgaacgtgagcctggacgtgttcgccgacgagatcagattctaccagctgggcgacgaggccatggagagattcagagaggacgagggcttcatcaaggaggaggagaagcccctgcccagaaacgagttccagagacaggtgtggctgatcttcgagtaccccgagagcagcggcagcgccagagccatcgccatcgtgagcgtgctggtgatcctgatcagcatcatcaccttctgcctggagaccctgcccgagttcagagacgagagagagctgctgagacacccccccgccccccaccagccccccgcccccgcccccggcgccaacggcagcggcgtgatggccccccccagcggccccaccgtggcccccctgctgcccagaaccctggccgaccccttcttcatcgtggagaccacctgcgtgatctggttcaccttcgagctgctggtgagattcttcgcctgccccagcaaggccggcttcagcagaaacatcatgaacatcatcgacgtggtggccatcttcccctacttcatcaccctgggcaccgagctggccgagcagcagcccggcggcggcggcggcggccagaacggccagcaggccatgagcctggccatcctgagagtgatcagactggtgagagtgttcagaatcttcaagctgagcagacacagcaagggcctgcagatcctgggcaagaccctgcaggccagcatgagagagctgggcctgctgatcttcttcctgttcatcggcgtgatcctgttcagcagcgccgtgtacttcgccgaggccgacaaccagggcacccacttcagcagcatccccgacgccttctggtgggccgtggtgaccatgaccaccgtgggctacggcgacatgagacccatcaccgtgggcggcaagatcgtgggcagcctgtgcgccatcgccggcgtgctgaccatcgccctgcccgtgcccgtgatcgtgagcaacttcaactacttctaccacagagagaccgaccacgaggagcccgccgtgctgaaggaggagcagggcacccagagccagggccccggcctggacagaggcgtgcagagaaaggtgagcggcagcagaggcagcttctgcaaggccggcggcaccctggagaacgccgacagcgccagaagaggcagctgccccctggagaagtgcaacgtgaaggccaagagcaacgtggacctgagaagaagcctgtacgccctgtgcctggacaccagcagagagaccgacctgtag

SEQ ID NO: 94179 - DNA, 1557 bp, Artificial Sequence
  Description of Artificial Sequence: Synthetic coding sequence
atggccgccagcatggccagaagactgtggcccctgctgaccagaagaggcttcagacccagaggcggctgcatcagcaacgacagccccagaagaagcttcaccaccgagaagagaaacagaaacctgctgtacgagtacgccagagagggctacagcgccctgccccagctggacatcgagagattctgcgcctgccccgaggaggccgcccacgccctggagctgagaaagggcgagctgagaagcgccgacctgcccgccatcatcagcacctggcaggagctgagacagctgcaggagcagatcagaagcctggaggaggagaaggccgccgtgaccgaggccgtgagagccctgctggccaaccaggacagcggcgaggtgcagcaggaccccaagtaccagggcctgagagccagaggcagagagatcagaaaggagctggtgcacctgtaccccagagaggcccagctggaggagcagttctacctgcaggccctgaagctgcccaaccagacccaccccgacgtgcccgtgggcgacgagagccaggccagagtgctgcacatggtgggcgacaagcccgtgttcagcttccagcccagaggccacctggagatcggcgagaagctggacatcatcagacagaagagactgagccacgtgagcggccacagaagctactacctgagaggcgccggcgccctgctgcagcacggcctggtgaacttcaccttcaacaagctgctgagaagaggcttcacccccatgaccgtgcccgacctgctgagaggcgccgtgttcgagggctgcggcatgacccccaacgccaaccccagccagatctacaacatcgaccccgccagattcaaggacctgaacctggccggcaccgccgaggtgggcctggccggctacttcatggaccacaccgtggccttcagagacctgcccgtgagaatggtgtgcagcagcacctgctacagagccgagaccaacaccggccaggagcccagaggcctgtacagagtgcaccacttcaccaaggtggagatgttcggcgtgaccggccccggcctggagcagagcagccagctgctggaggagttcctgagcctgcagatggagatcctgaccgagctgggcctgcacttcagagtgctggacatgcccacccaggagctgggcctgcccgcctacagaaagttcgacatcgaggcctggatgcccggcagaggcagattcggcgaggtgaccagcgccagcaactgcaccgacttccagagcagaagactgcacatcatgttccagaccgaggccggcgagctgcagttcgcccacaccgtgaacgccaccgcctgcgccgtgcccagactgctgatcgccctgctggagagcaaccagcagaaggacggcagcgtgctggtgccccccgccctgcagagctacctgggcaccgacagaatcaccgcccccacccacgtgcccctgcagtacatcggccccaaccagcccagaaagcccggcctgcccggccagcccgccgtgagctag

SEQ ID NO: 94180 - DNA, 1893 bp, Artificial Sequence
  Description of Artificial Sequence: Synthetic coding sequence
atggccgccggcgtggccgcctggctgcccttcgccagagccgccgccatcggctggatgcccgtggccagcggccccatgcccgccccccccagacaggagagaaagagaacccaggacgccctgatcgtgctgaacgtgagcggcaccagattccagacctggcaggacaccctggagagataccccgacaccctgctgggcagcagcgagagagacttcttctaccaccccgagacccagcagtacttcttcgacagagaccccgacatcttcagacacatcctgaacttctacagaaccggcaagctgcactaccccagacacgagtgcatcagcgcctacgacgaggagctggccttcttcggcctgatccccgagatcatcggcgactgctgctacgaggagtacaaggacagaagaagagagaacgccgagagactgcaggacgacgccgacaccgacaccgccggcgagagcgccctgcccaccatgaccgccagacagagagtgtggagagccttcgagaacccccacaccagcaccatggccctggtgttctactacgtgaccggcttcttcatcgccgtgagcgtgatcgccaacgtggtggagaccgtgccctgcggcagcagccccggccacatcaaggagctgccctgcggcgagagatacgccgtggccttcttctgcctggacaccgcctgcgtgatgatcttcaccgtggagtacctgctgagactggccgccgcccccagcagatacagattcgtgagaagcgtgatgagcatcatcgacgtggtggccatcctgccctactacatcggcctggtgatgaccgacaacgaggacgtgagcggcgccttcgtgaccctgagagtgttcagagtgttcagaatcttcaagttcagcagacacagccagggcctgagaatcctgggctacaccctgaagagctgcgccagcgagctgggcttcctgctgttcagcctgaccatggccatcatcatcttcgccaccgtgatgttctacgccgagaagggcagcagcgccagcaagttcaccagcatccccgccgccttctggtacaccatcgtgaccatgaccaccctgggctacggcgacatggtgcccaagaccatcgccggcaagatcttcggcagcatctgcagcctgagcggcgtgctggtgatcgccctgcccgtgcccgtgatcgtgagcaacttcagcagaatctaccaccagaaccagagagccgacaagagaagagcccagaagaaggccagactggccagaatcagagccgccaagagcggcagcgccaacgcctacatgcagagcaagagaaacggcctgctgagcaaccagctgcagagcagcgaggacgagcaggccttcgtgagcaagagcggcagcagcttcgagacccagcaccaccacctgctgcactgcctggagaagaccaccaaccacgagttcgtggacgagcaggtgttcgaggagagctgcatggaggtggccaccgtgaacagacccagcagccacagccccagcctgagcagccagcagggcgtgaccagcacctgctgcagcagaagacacaagaagaccttcagaatccccaacgccaacgtgagcggcagccaccagggcagcatccaggagctgagcaccatccagatcagatgcgtggagagaacccccctgagcaacagcagaagcagcctgaacgccaagatggaggagtgcgtgaagctgaactgcgagcagccctacgtgaccaccgccatcatcagcatccccaccccccccgtgaccacccccgagggcgacgacagacccgagagccccgagtacagcggcggcaacatcgtgagagtgagcgccctgtag

SEQ ID NO: 94181 - DNA, 1911 bp, Artificial Sequence
  Description of Artificial Sequence: Synthetic coding sequence
atggccgccggcgtggccgcctggctgcccttcgccagagccgccgccatcggctggatgcccgtggccaactgccccatgcccctggcccccgccgacaagaacaagagacaggacgagctgatcgtgctgaacgtgagcggcagaagattccagacctggagaaccaccctggagagataccccgacaccctgctgggcagcaccgagaaggagttcttcttcaacgaggacaccaaggagtacttcttcgacagagaccccgaggtgttcagatgcgtgctgaacttctacagaaccggcaagctgcactaccccagatacgagtgcatcagcgcctacgacgacgagctggccttctacggcatcctgcccgagatcatcggcgactgctgctacgaggagtacaaggacagaaagagagagaacgccgagagactgatggacgacaacgacagcgagaacaaccaggagagcatgcccagcctgagcttcagacagaccatgtggagagccttcgagaacccccacaccagcaccctggccctggtgttctactacgtgaccggcttcttcatcgccgtgagcgtgatcaccaacgtggtggagaccgtgccctgcggcaccgtgcccggcagcaaggagctgccctgcggcgagagatacagcgtggccttcttctgcctggacaccgcctgcgtgatgatcttcaccgtggagtacctgctgagactgttcgccgcccccagcagatacagattcatcagaagcgtgatgagcatcatcgacgtggtggccatcatgccctactacatcggcctggtgatgaccaacaacgaggacgtgagcggcgccttcgtgaccctgagagtgttcagagtgttcagaatcttcaagttcagcagacacagccagggcctgagaatcctgggctacaccctgaagagctgcgccagcgagctgggcttcctgctgttcagcctgaccatggccatcatcatcttcgccaccgtgatgttctacgccgagaagggcagcagcgccagcaagttcaccagcatccccgccagcttctggtacaccatcgtgaccatgaccaccctgggctacggcgacatggtgcccaagaccatcgccggcaagatcttcggcagcatctgcagcctgagcggcgtgctggtgatcgccctgcccgtgcccgtgatcgtgagcaacttcagcagaatctaccaccagaaccagagagccgacaagagaagagcccagaagaaggccagactggccagaatcagagtggccaagaccggcagcagcaacgcctacctgcacagcaagagaaacggcctgctgaacgaggccctggagctgaccggcacccccgaggaggagcacatgggcaagaccaccagcctgatcgagagccagcaccaccacctgctgcactgcctggagaagaccaccaaccacgagttcatcgacgagcagatgttcgagcagaactgcatggagagcagcatgcagaactaccccagcaccagaagccccagcctgagcagccaccccggcctgaccaccacctgctgcagcagaagaagcaagaagaccacccacctgcccaacagcaacctgcccgccaccagactgagaagcatgcaggagctgagcaccatccacatccagggcagcgagcagcccagcctgaccaccagcagaagcagcctgaacctgaaggccgacgacggcctgagacccaactgcaagaccagccagatcaccaccgccatcatcagcatccccaccccccccgccctgacccccgagggcgagagcagacccccccccgccagccccggccccaacaccaacatccccagcatcgccagcaacgtggtgaaggtgagcgccctgtag

SEQ ID NO: 94182 - DNA, 1968 bp, Artificial Sequence
  Description of Artificial Sequence: Synthetic coding sequence
atggccgccggcgtggccgcctggctgcccttcgccagagccgccgccatcggctggatgcccgtggccaactgccccatgcccctggcccccgccgacaagaacaagagacaggacgagctgatcgtgctgaacgtgagcggcagaagattccagacctggagaaccaccctggagagataccccgacaccctgctgggcagcaccgagaaggagttcttcttcaacgaggacaccaaggagtacttcttcgacagagaccccgaggtgttcagatgcgtgctgaacttctacagaaccggcaagctgcactaccccagatacgagtgcatcagcgcctacgacgacgagctggccttctacggcatcctgcccgagatcatcggcgactgctgctacgaggagtacaaggacagaaagagagagaacgccgagagactgatggacgacaacgacagcgagaacaaccaggagagcatgcccagcctgagcttcagacagaccatgtggagagccttcgagaacccccacaccagcaccctggccctggtgttctactacgtgaccggcttcttcatcgccgtgagcgtgatcaccaacgtggtggagaccgtgccctgcggcaccgtgcccggcagcaaggagctgccctgcggcgagagatacagcgtggccttcttctgcctggacaccgcctgcgtgatgatcttcaccgtggagtacctgctgagactgttcgccgcccccagcagatacagattcatcagaagcgtgatgagcatcatcgacgtggtggccatcatgccctactacatcggcctggtgatgaccaacaacgaggacgtgagcggcgccttcgtgaccctgagagtgttcagagtgttcagaatcttcaagttcagcagacacagccagggcctgagaatcctgggctacaccctgaagagctgcgccagcgagctgggcttcctgctgttcagcctgaccatggccatcatcatcttcgccaccgtgatgttctacgccgagaagggcagcagcgccagcaagttcaccagcatccccgccagcttctggtacaccatcgtgaccatgaccaccctgggctacggcgacatggtgcccaagaccatcgccggcaagatcttcggcagcatctgcagcctgagcggcgtgctggtgatcgccctgcccgtgcccgtgatcgtgagcaacttcagcagaatctaccaccagaaccagagagccgacaagagaagagcccagaagaaggccagactggccagaatcagagtggccaagaccggcagcagcaacgcctacctgcacagcaagagaaacggcctgctgaacgaggccctggagctgaccggcacccccgaggaggagcacatgggcaagaccaccagcctgatcgagagccagcaccaccacctgctgcactgcctggagaagaccaccggcctgagctacctggtggacgaccccctgctgagcgtgagaaccagcaccatcaagaaccacgagttcatcgacgagcagatgttcgagcagaactgcatggagagcagcatgcagaactaccccagcaccagaagccccagcctgagcagccaccccggcctgaccaccacctgctgcagcagaagaagcaagaagaccacccacctgcccaacagcaacctgcccgccaccagactgagaagcatgcaggagctgagcaccatccacatccagggcagcgagcagcccagcctgaccaccagcagaagcagcctgaacctgaaggccgacgacggcctgagacccaactgcaagaccagccagatcaccaccgccatcatcagcatccccaccccccccgccctgacccccgagggcgagagcagacccccccccgccagccccggccccaacaccaacatccccagcatcgccagcaacgtggtgaaggtgagcgccctgtag

SEQ ID NO: 94183 - DNA, 1911 bp, Artificial Sequence; identical to SEQ ID NO: 94181
  Description of Artificial Sequence: Synthetic coding sequence

SEQ ID NO: 94184 - DNA, 1758 bp, Artificial Sequence
  Description of Artificial Sequence: Synthetic coding sequence
atgggccagggcgacgagagcgagagaatcgtgatcaacgtgggcggcaccagacaccagacctacagaagcaccctgagaaccctgcccggcaccagactggcctggctggccgagcccgacgcccacagccacttcgactacgaccccagagccgacgagttcttcttcgacagacaccccggcgtgttcgcccacatcctgaactactacagaaccggcaagctgcactgccccgccgacgtgtgcggccccctgtacgaggaggagctggccttctggggcatcgacgagaccgacgtggagccctgctgctggatgacctacagacagcacagagacgccgaggaggccctggacagcttcggcggcgcccccctggacaacagcgccgacgacgccgacgccgacggccccggcgacagcggcgacggcgaggacgagctggagatgaccaagagactggccctgagcgacagccccgacggcagacccggcggcttctggagaagatggcagcccagaatctgggccctgttcgaggacccctacagcagcagatacgccagatacgtggccttcgccagcctgttcttcatcctggtgagcatcaccaccttctgcctggagacccacgagagattcaaccccatcgtgaacaagaccgagatcgagaacgtgagaaacggcacccaggtgagatactacagagaggccgagaccgaggccttcctgacctacatcgagggcgtgtgcgtggtgtggttcaccttcgagttcctgatgagagtgatcttctgccccaacaaggtggagttcatcaagaacagcctgaacatcatcgacttcgtggccatcctgcccttctacctggaggtgggcctgagcggcctgagcagcaaggccgccaaggacgtgctgggcttcctgagagtggtgagattcgtgagaatcctgagaatcttcaagctgaccagacacttcgtgggcctgagagtgctgggccacaccctgagagccagcaccaacgagttcctgctgctgatcatcttcctggccctgggcgtgctgatcttcgccaccatgatctactacgccgagagaatcggcgcccagcccaacgaccccagcgccagcgagcacacccacttcaagaacatccccatcggcttctggtgggccgtggtgaccatgaccaccctgggctacggcgacatgtacccccagacctggagcggcatgctggtgggcgccctgtgcgccctggccggcgtgctgaccatcgccatgcccgtgcccgtgatcgtgaacaacttcggcatgtactacagcctggccatggccaagcagaagctgcccaagaagaagaagaagcacatccccagacccccccagctgggcagccccaactactgcaagagcgtggtgaacagcccccaccacagcacccagagcgacacctgccccctggcccaggaggagatcctggagatcaacagagccgacagcaagctgaacggcgaggtggccaaggccgccctggccaacgaggactgcccccacatcgaccaggccctgacccccgacgagggcctgcccttcaccagaagcggcaccagagagagatacggcccctgcttcctgctgagcaccggcgagtacgcctgcccccccggcggcggcatgagaaaggacctgtgcaaggagagccccgtgatcgccaagtacatgcccaccgaggccgtgagagtgacctag

SEQ ID NO: 94185 - DNA, 1536 bp, Artificial Sequence
  Description of Artificial Sequence: Synthetic coding sequence
atgggccagggcgacgagagcgagagaatcgtgatcaacgtgggcggcaccagacaccagacctacagaagcaccctgagaaccctgcccggcaccagactggcctggctggccgagcccgacgcccacagccacttcgactacgaccccagagccgacgagttcttcttcgacagacaccccggcgtgttcgcccacatcctgaactactacagaaccggcaagctgcactgccccgccgacgtgtgcggccccctgtacgaggaggagctggccttctggggcatcgacgagaccgacgtggagccctgctgctggatgacctacagacagcacagagacgccgaggaggccctggacagcttcggcggcgcccccctggacaacagcgccgacgacgccgacgccgacggccccggcgacagcggcgacggcgaggacgagctggagatgaccaagagactggccctgagcgacagccccgacggcagacccggcggcttctggagaagatggcagcccagaatctgggccctgttcgaggacccctacagcagcagatacgccagatacgtggccttcgccagcctgttcttcatcctggtgagcatcaccaccttctgcctggagacccacgagagattcaaccccatcgtgaacaagaccgagatcgagaacgtgagaaacggcacccaggtgagatactacagagaggccgagaccgaggccttcctgacctacatcgagggcgtgtgcgtggtgtggttcaccttcgagttcctgatgagagtgatcttctgccccaacaaggtggagttcatcaagaacagcctgaacatcatcgacttcgtggccatcctgcccttctacctggaggtgggcctgagcggcctgagcagcaaggccgccaaggacgtgctgggcttcctgagagtggtgagattcgtgagaatcctgagaatcttcaagctgaccagacacttcgtgggcctgagagtgctgggccacaccctgagagccagcaccaacgagttcctgctgctgatcatcttcctggccctgggcgtgctgatcttcgccaccatgatctactacgccgagagaatcggcgcccagcccaacgaccccagcgccagcgagcacacccacttcaagaacatccccatcggcttctggtgggccgtggtgaccatgaccaccctgggctacggcgacatgtacccccagacctggagcggcatgctggtgggcgccctgtgcgccctggccggcgtgctgaccatcgccatgcccgtgcccgtgatcgtgaacaacttcggcatgtactacagcctggccatggccaagcagaagctgcccaagaagaagaagaagcacatccccagacccccccagctgggcagccccaactactgcaagagcgtggtgaacagcccccaccacagcacccagagcgacacctgccccctggcccaggaggagatcctggagatcaacagagccggcagaaagcccctgagaggcatgagcatctag

SEQ ID NO: 94186 - DNA, 1842 bp, Artificial Sequence
  Description of Artificial Sequence: Synthetic coding sequence
atgggcaagatcgagaacaacgagagagtgatcctgaacgtgggcggcaccagacacgagacctacagaagcaccctgaagaccctgcccggcaccagactggccctgctggccagcagcgagccccccggcgactgcctgaccaccgccggcgacaagctgcagcccagccccccccccctgagccccccccccagagccccccccctgagccccggccccggcggctgcttcgagggcggcgccggcaactgcagcagcagaggcggcagagccagcgaccaccccggcggcggcagagagttcttcttcgacagacaccccggcgtgttcgcctacgtgctgaactactacagaaccggcaagctgcactgccccgccgacgtgtgcggccccctgttcgaggaggagctggccttctggggcatcgacgagaccgacgtggagccctgctgctggatgacctacagacagcacagagacgccgaggaggccctggacatcttcgagacccccgacctgatcggcggcgaccccggcgacgacgaggacctggccgccaagagactgggcatcgaggacgccgccggcctgggcggccccgacggcaagagcggcagatggagaagactgcagcccagaatgtgggccctgttcgaggacccctacagcagcagagccgccagattcatcgccttcgccagcctgttcttcatcctggtgagcatcaccaccttctgcctggagacccacgaggccttcaacatcgtgaagaacaagaccgagcccgtgatcaacggcaccagcgtggtgctgcagtacgagatcgagaccgaccccgccctgacctacgtggagggcgtgtgcgtggtgtggttcaccttcgagttcctggtgagaatcgtgttcagccccaacaagctggagttcatcaagaacctgctgaacatcatcgacttcgtggccatcctgcccttctacctggaggtgggcctgagcggcctgagcagcaaggccgccaaggacgtgctgggcttcctgagagtggtgagattcgtgagaatcctgagaatcttcaagctgaccagacacttcgtgggcctgagagtgctgggccacaccctgagagccagcaccaacgagttcctgctgctgatcatcttcctggccctgggcgtgctgatcttcgccaccatgatctactacgccgagagagtgggcgcccagcccaacgaccccagcgccagcgagcacacccagttcaagaacatccccatcggcttctggtgggccgtggtgaccatgaccaccctgggctacggcgacatgtacccccagacctggagcggcatgctggtgggcgccctgtgcgccctggccggcgtgctgaccatcgccatgcccgtgcccgtgatcgtgaacaacttcggcatgtactacagcctggccatggccaagcagaagctgcccagaaagagaaagaagcacatcccccccgccccccaggccagcagccccaccttctgcaagaccgagctgaacatggcctgcaacagcacccagagcgacacctgcctgggcaaggacaacagactgctggagcacaacagaagcgtgctgagcggcgacgacagcaccggcagcgagccccccctgagcccccccgagagactgcccatcagaagaagcagcaccagagacaagaacagaagaggcgagacctgcttcctgctgaccaccggcgactacacctgcgccagcgacggcggcatcagaaaggacaactgcaaggaggtggtgatcaccggctacacccaggccgaggccagaagcctgacctag

SEQ ID NO: 94187 - DNA, 1890 bp, Artificial Sequence
  Description of Artificial Sequence: Synthetic coding sequence
atgggcaagatcgagaacaacgagagagtgatcctgaacgtgggcggcaccagacacgagacctacagaagcaccctgaagaccctgcccggcaccagactggccctgctggccagcagcgagccccccggcgactgcctgaccaccgccggcgacaagctgcagcccagccccccccccctgagccccccccccagagccccccccctgagccccggccccggcggctgcttcgagggcggcgccggcaactgcagcagcagaggcggcagagccagcgaccaccccggcggcggcagagagttcttcttcgacagacaccccggcgtgttcgcctacgtgctgaactactacagaaccggcaagctgcactgccccgccgacgtgtgcggccccctgttcgaggaggagctggccttctggggcatcgacgagaccgacgtggagccctgctgctggatgacctacagacagcacagagacgccgaggaggccctggacatcttcgagacccccgacctgatcggcggcgaccccggcgacgacgaggacctggccgccaagagactgggcatcgaggacgccgccggcctgggcggccccgacggcaagagcggcagatggagaagactgcagcccagaatgtgggccctgttcgaggacccctacagcagcagagccgccagattcatcgccttcgccagcctgttcttcatcctggtgagcatcaccaccttctgcctggagacccacgaggccttcaacatcgtgaagaacaagaccgagcccgtgatcaacggcaccagcgtggtgctgcagtacgagatcgagaccgaccccgccctgacctacgtggagggcgtgtgcgtggtgtggttcaccttcgagttcctggtgagaatcgtgttcagccccaacaagctggagttcatcaagaacctgctgaacatcatcgacttcgtggccatcctgcccttctacctggaggtgggcctgagcggcctgagcagcaaggccgccaaggacgtgctgggcttcctgagagtggtgagattcgtgagaatcctgagaatcttcaagctgaccagacacttcgtgggcctgagagtgctgggccacaccctgagagccagcaccaacgagttcctgctgctgatcatcttcctggccctgggcgtgctgatcttcgccaccatgatctactacgccgagagagtgggcgcccagcccaacgaccccagcgccagcgagcacacccagttcaagaacatccccatcggcttctggtgggccgtggtgaccatgaccaccctgggctacggcgacatgtacccccagacctggagcggcatgctggtgggcgccctgtgcgccctggccggcgtgctgaccatcgccatgcccgtgcccgtgatcgtgaacaacttcggcatgtactacagcctggccatggccaagcagaagctgcccagaaagagaaagaagcacatcccccccgccccccaggccagcagccccaccttctgcaagaccgagctgaacatggcctgcaacagcacccagagcgacacctgcctgggcaaggacaacagactgctggagcacaacagaagcgtgctgagcggcgacgacagcaccggcagcgagccccccctgagcccccccgagagactgcccatcagaagaagcagcaccagagacaagaacagaagaggcgagacctgcttcctgctgaccaccggcgactacacctgcgccagcgacggcggcatcagaaaggtgctgtacagaatctaccacggcctgctgaccgccgagaagggcaccgtggagttcagccacaccaaggactacaccggcaacagactgctgctgctgaacgtgccctag

SEQ ID NO: 94188 - DNA, 1677 bp, Artificial Sequence
  Description of Artificial Sequence: Synthetic coding sequence
atgggcaagatcgagaacaacgagagagtgatcctgaacgtgggcggcaccagacacgagacctacagaagcaccctgaagaccctgcccggcaccagactggccctgctggccagcagcgagccccccggcgactgcctgaccaccgccggcgacaagctgcagcccagccccccccccctgagccccccccccagagccccccccctgagccccggccccggcggctgcttcgagggcggcgccggcaactgcagcagcagaggcggcagagccagcgaccaccccggcggcggcagagagttcttcttcgacagacaccccggcgtgttcgcctacgtgctgaactactacagaaccggcaagctgcactgccccgccgacgtgtgcggccccctgttcgaggaggagctggccttctggggcatcgacgagaccgacgtggagccctgctgctggatgacctacagacagcacagagacgccgaggaggccctggacatcttcgagacccccgacctgatcggcggcgaccccggcgacgacgaggacctggccgccaagagactgggcatcgaggacgccgccggcctgggcggccccgacggcaagagcggcagatggagaagactgcagcccagaatgtgggccctgttcgaggacccctacagcagcagagccgccagattcatcgccttcgccagcctgttcttcatcctggtgagcatcaccaccttctgcctggagacccacgaggccttcaacatcgtgaagaacaagaccgagcccgtgatcaacggcaccagcgtggtgctgcagtacgagatcgagaccgaccccgccctgacctacgtggagggcgtgtgcgtggtgtggttcaccttcgagttcctggtgagaatcgtgttcagccccaacaagctggagttcatcaagaacctgctgaacatcatcgacttcgtggccatcctgcccttctacctggaggtgggcctgagcggcctgagcagcaaggccgccaaggacgtgctgggcttcctgagagtggtgagattcgtgagaatcctgagaatcttcaagctgaccagacacttcgtgggcctgagagtgctgggccacaccctgagagccagcaccaacgagttcctgctgctgatcatcttcctggccctgggcgtgctgatcttcgccaccatgatctactacgccgagagagtgggcgcccagcccaacgaccccagcgccagcgagcacacccagttcaagaacatccccatcggcttctggtgggccgtggtgaccatgaccaccctgggctacggcgacatgtacccccagacctggagcggcatgctggtgggcgccctgtgcgccctggccggcgtgctgaccatcgccatgcccgtgcccgtgatcgtgaacaacttcggcatgtactacagcctggccatggccaagcagaagctgcccagaaagagaaagaagcacatcccccccgccccccaggccagcagccccaccttctgcaagaccgagctgaacatggcctgcaacagcacccagagcgacacctgcctgggcaaggacaacagactgctggagcacaacagaagcgacaactgcaaggaggtggtgatcaccggctacacccaggccgaggccagaagcctgacctag

SEQ ID NO: 94189 - DNA, 1842 bp, Artificial Sequence; identical to SEQ ID NO: 94186
  Description of Artificial Sequence: Synthetic coding sequence

SEQ ID NO: 94190 - DNA, 1917 bp, Artificial Sequence
  Description of Artificial Sequence: Synthetic coding sequence
atgggcaagatcgagaacaacgagagagtgatcctgaacgtgggcggcaccagacacgagacctacagaagcaccctgaagaccctgcccggcaccagactggccctgctggccagcagcgagccccccggcgactgcctgaccaccgccggcgacaagctgcagcccagccccccccccctgagccccccccccagagccccccccctgagccccggccccggcggctgcttcgagggcggcgccggcaactgcagcagcagaggcggcagagccagcgaccaccccggcggcggcagagagttcttcttcgacagacaccccggcgtgttcgcctacgtgctgaactactacagaaccggcaagctgcactgccccgccgacgtgtgcggccccctgttcgaggaggagctggccttctggggcatcgacgagaccgacgtggagccctgctgctggatgacctacagacagcacagagacgccgaggaggccctggacatcttcgagacccccgacctgatcggcggcgaccccggcgacgacgaggacctggccgccaagagactgggcatcgaggacgccgccggcctgggcggccccgacggcaagagcggcagatggagaagactgcagcccagaatgtgggccctgttcgaggacccctacagcagcagagccgccagattcatcgccttcgccagcctgttcttcatcctggtgagcatcaccaccttctgcctggagacccacgaggccttcaacatcgtgaagaacaagaccgagcccgtgatcaacggcaccagcgtggtgctgcagtacgagatcgagaccgaccccgccctgacctacgtggagggcgtgtgcgtggtgtggttcaccttcgagttcctggtgagaatcgtgttcagccccaacaagctggagttcatcaagaacctgctgaacatcatcgacttcgtggccatcctgcccttctacctggaggtgggcctgagcggcctgagcagcaaggccgccaaggacgtgctgggcttcctgagagtggtgagattcgtgagaatcctgagaatcttcaagctgaccagacacttcgtgggcctgagagtgctgggccacaccctgagagccagcaccaacgagttcctgctgctgatcatcttcctggccctgggcgtgctgatcttcgccaccatgatctactacgccgagagagtgggcgcccagcccaacgaccccagcgccagcgagcacacccagttcaagaacatccccatcggcttctggtgggccgtggtgaccatgaccaccctgggctacggcgacatgtacccccagacctggagcggcatgctggtgggcgccctgtgcgccctggccggcgtgctgaccatcgccatgcccgtgcccgtgatcgtgaacaacttcggcatgtactacagcctggccatggccaagcagaagctgcccagaaagagaaagaagcacatcccccccgccccccaggccagcagccccaccttctgcaagaccgagctgaacatggcctgcaacagcacccagagcgacacctgcctgggcaaggacaacagactgctggagcacaacagaagcgtgctgagcggcgacgacagcaccggcagcgagccccccctgagcccccccgagagactgcccatcagaagaagcagcaccagagacaagaacagaagaggcgagacctgcttcctgctgaccaccggcgactacacctgcgccagcgacggcggcatcagaaagggctacgagaagagcagaagcctgaacaacatcgccggcctggccggcaacgccctgagactgagccccgtgaccagcccctacaacagcccctgccccctgagaagaagcagaagccccatccccagcatcctgtag

SEQ ID NO: 94191 - DNA, 1890 bp, Artificial Sequence; identical to SEQ ID NO: 94187
  Description of Artificial Sequence: Synthetic coding sequence

SEQ ID NO: 94192 - DNA, 2187 bp, Artificial Sequence
  Description of Artificial Sequence: Synthetic coding sequence
atgctgagcagcgtgtgcgtgagcagcttcagaggcagacagggcgccagcaagcagcagcccgccccccccccccagccccccgagagccccccccccccccccctgcccccccagcagcagcagcccgcccagcccggccccgccgccagccccgccggcccccccgcccccagaggccccggcgacagaagagccgagccctgccccggcctgcccgccgccgccatgggcagacacggcggcggcggcggcgacagcggcaagatcgtgatcaacgtgggcggcgtgagacacgagacctacagaagcaccctgagaaccctgcccggcaccagactggccggcctgaccgagcccgaggccgccgccagattcgactacgaccccggcgccgacgagttcttcttcgacagacaccccggcgtgttcgcctacgtgctgaactactacagaaccggcaagctgcactgccccgccgacgtgtgcggccccctgttcgaggaggagctgggcttctggggcatcgacgagaccgacgtggaggcctgctgctggatgacctacagacagcacagagacgccgaggaggccctggacagcttcgaggcccccgaccccgccggcgccgccaacgccgccaacgccgccggcgcccacgacggcggcctggacgacgaggccggcgccggcggcggcggcctggacggcgccggcggcgagctgaagagactgtgcttccaggacgccggcggcggcgccggcggcccccccggcggcgccggcggcgccggcggcacctggtggagaagatggcagcccagagtgtgggccctgttcgaggacccctacagcagcagagccgccagatacgtggccttcgccagcctgttcttcatcctgatcagcatcaccaccttctgcctggagacccacgagggcttcatccacatcagcaacaagaccgtgacccaggccagccccatccccggcgccccccccgagaacatcaccaacgtggaggtggagaccgagcccttcctgacctacgtggagggcgtgtgcgtggtgtggttcaccttcgagttcctgatgagaatcaccttctgccccgacaaggtggagttcctgaagagcagcctgaacatcatcgactgcgtggccatcctgcccttctacctggaggtgggcctgagcggcctgagcagcaaggccgccaaggacgtgctgggcttcctgagagtggtgagattcgtgagaatcctgagaatcttcaagctgaccagacacttcgtgggcctgagagtgctgggccacaccctgagagccagcaccaacgagttcctgctgctgatcatcttcctggccctgggcgtgctgatcttcgccaccatgatctactacgccgagagaatcggcgccgaccccgacgacatcctgggcagcaaccacacctacttcaagaacatccccatcggcttctggtgggccgtggtgaccatgaccaccctgggctacggcgacatgtaccccaagacctggagcggcatgctggtgggcgccctgtgcgccctggccggcgtgctgaccatcgccatgcccgtgcccgtgatcgtgaacaacttcggcatgtactacagcctggccatggccaagcagaagctgcccaagaagaagaacaagcacatccccagacccccccagcccggcagccccaactactgcaagcccgacccccccccccccccccccccccacccccaccacggcagcggcggcatcagcccccccccccccatcaccccccccagcatgggcgtgaccgtggccggcgcctaccccgccggcccccacacccaccccggcctgctgagaggcggcgccggcggcctgggcatcatgggcctgccccccctgcccgcccccggcgagccctgccccctggcccaggaggaggtgatcgagatcaacagagccgaccccagacccaacggcgaccccgccgccgccgccctggcccacgaggactgccccgccatcgaccagcccgccatgagccccgaggacaagagccccatcacccccggcagcagaggcagatacagcagagacagagcctgcttcctgctgaccgactacgcccccagccccgacggcagcatcagaaaggccctggtgaccgcctag

SEQ ID NO: 94193 - DNA, 468 bp, Artificial Sequence
  Description of Artificial Sequence: Synthetic coding sequence
atgggcatcagacagcagctgagactgcccaccagaaccgcccagcccctgaccagcctgccctgccccagaaagaccagagcccccagcagactggaggccgtggccgccatcgccggcaccgagcccgccagcagcagccccaccatgcccctgcccctgatggcccccagcgagaagctgctgagcccccccgagaccagcagagacttcagaagccccccccccctgccccccagactgagagagatcccccagccccagcagcacagaggccccgagagaggcgtgcccgcccccagagccccctgccaccccccctggctgagccccggcagaccccccagaagccccgaccccgccctgcaccccctggccctgcccagccccctgtggggcgacagcggcgtgaccggcaagaaggtgaagggcgccggcggcggcggctggggcaagggcttcttctag

SEQ ID NO: 94194 - DNA, 1629 bp, Artificial Sequence
  Description of Artificial Sequence: Synthetic coding sequence
atgacctacagacagcacagagacgccgaggaggccctggacagcttcgaggcccccgaccccgccggcgccgccaacgccgccaacgccgccggcgcccacgacggcggcctggacgacgaggccggcgccggcggcggcggcctggacggcgccggcggcgagctgaagagactgtgcttccaggacgccggcggcggcgccggcggcccccccggcggcgccggcggcgccggcggcacctggtggagaagatggcagcccagagtgtgggccctgttcgaggacccctacagcagcagagccgccagatacgtggccttcgccagcctgttcttcatcctgatcagcatcaccaccttctgcctggagacccacgagggcttcatccacatcagcaacaagaccgtgacccaggccagccccatccccggcgccccccccgagaacatcaccaacgtggaggtggagaccgagcccttcctgacctacgtggagggcgtgtgcgtggtgtggttcaccttcgagttcctgatgagaatcaccttctgccccgacaaggtggagttcctgaagagcagcctgaacatcatcgactgcgtggccatcctgcccttctacctggaggtgggcctgagcggcctgagcagcaaggccgccaaggacgtgctgggcttcctgagagtggtgagattcgtgagaatcctgagaatcttcaagctgaccagacacttcgtgggcctgagagtgctgggccacaccctgagagccagcaccaacgagttcctgctgctgatcatcttcctggccctgggcgtgctgatcttcgccaccatgatctactacgccgagagaatcggcgccgaccccgacgacatcctgggcagcaaccacacctacttcaagaacatccccatcggcttctggtgggccgtggtgaccatgaccaccctgggctacggcgacatgtaccccaagacctggagcggcatgctggtgggcgccctgtgcgccctggccggcgtgctgaccatcgccatgcccgtgcccgtgatcgtgaacaacttcggcatgtactacagcctggccatggccaagcagaagctgcccaagaagaagaacaagcacatccccagacccccccagcccggcagccccaactactgcaagcccgacccccccccccccccccccccccacccccaccacggcagcggcggcatcagcccccccccccccatcaccccccccagcatgggcgtgaccgtggccggcgcctaccccgccggcccccacacccaccccggcctgctgagaggcggcgccggcggcctgggcatcatgggcctgccccccctgcccgcccccggcgagccctgccccctggcccaggaggaggtgatcgagatcaacagagccgaccccagacccaacggcgaccccgccgccgccgccctggcccacgaggactgccccgccatcgaccagcccgccatgagccccgaggacaagagccccatcacccccggcagcagaggcagatacagcagagacagagcctgcttcctgctgaccgactacgcccccagccccgacggcagcatcagaaaggccctggtgaccgcctag

SEQ ID NO: 94195 - DNA, 2274 bp, Artificial Sequence
  Description of Artificial Sequence: Synthetic coding sequence
atgctgagcagcgtgtgcgtgagcagcttcagaggcagacagggcgccagcaagcagcagcccgccccccccccccagccccccgagagccccccccccccccccctgcccccccagcagcagcagcccgcccagcccggccccgccgccagccccgccggcccccccgcccccagaggccccggcgacagaagagccgagccctgccccggcctgcccgccgccgccatgggcagacacggcggcggcggcggcgacagcggcaagatcgtgatcaacgtgggcggcgtgagacacgagacctacagaagcaccctgagaaccctgcccggcaccagactggccggcctgaccgagcccgaggccgccgccagattcgactacgaccccggcgccgacgagttcttcttcgacagacaccccggcgtgttcgcctacgtgctgaactactacagaaccggcaagctgcactgccccgccgacgtgtgcggccccctgttcgaggaggagctgggcttctggggcatcgacgagaccgacgtggaggcctgctgctggatgacctacagacagcacagagacgccgaggaggccctggacagcttcgaggcccccgaccccgccggcgccgccaacgccgccaacgccgccggcgcccacgacggcggcctggacgacgaggccggcgccggcggcggcggcctggacggcgccggcggcgagctgaagagactgtgcttccaggacgccggcggcggcgccggcggcccccccggcggcgccggcggcgccggcggcacctggtggagaagatggcagcccagagtgtgggccctgttcgaggacccctacagcagcagagccgccagatacgtggccttcgccagcctgttcttcatcctgatcagcatcaccaccttctgcctggagacccacgagggcttcatccacatcagcaacaagaccgtgacccaggccagccccatccccggcgccccccccgagaacatcaccaacgtggaggtggagaccgagcccttcctgacctacgtggagggcgtgtgcgtggtgtggttcaccttcgagttcctgatgagaatcaccttctgccccgacaaggtggagttcctgaagagcagcctgaacatcatcgactgcgtggccatcctgcccttctacctggaggtgggcctgagcggcctgagcagcaaggccgccaaggacgtgctgggcttcctgagagtggtgagattcgtgagaatcctgagaatcttcaagctgaccagacacttcgtgggcctgagagtgctgggccacaccctgagagccagcaccaacgagttcctgctgctgatcatcttcctggccctgggcgtgctgatcttcgccaccatgatctactacgccgagagaatcggcgccgaccccgacgacatcctgggcagcaaccacacctacttcaagaacatccccatcggcttctggtgggccgtggtgaccatgaccaccctgggctacggcgacatgtaccccaagacctggagcggcatgctggtgggcgccctgtgcgccctggccggcgtgctgaccatcgccatgcccgtgcccgtgatcgtgaacaacttcggcatgtactacagcctggccatggccaagcagaagctgcccaagaagaagaacaagcacatccccagacccccccagcccggcagccccaactactgcaagcccgacccccccccccccccccccccccacccccaccacggcagcggcggcatcagcccccccccccccatcaccccccccagcatgggcgtgaccgtggccggcgcctaccccgccggcccccacacccaccccggcctgctgagaggcggcgccggcggcctgggcatcatgggcctgccccccctgcccgcccccggcgagccctgccccctggcccaggaggaggtgatcgagatcaacagagccgaccccagacccaacggcgaccccgccgccgccgccctggcccacgaggactgccccgccatcgaccagcccgccatgagccccgaggacaagagccccatcacccccggcagcagaggcagatacagcagagacagagcctgcttcctgctgaccgactacgcccccagccccgacggcagcatcagaaaggccaccggcgccccccccctgcccccccaggactggagaaagcccggcccccccagcttcctgcccgacctgaacgccaacgccgccgcctggatcagcccctag

SEQ ID NO: 94196 - DNA, 1908 bp, Artificial Sequence
  Description of Artificial Sequence: Synthetic coding sequence
atgatcagcagcgtgtgcgtgagcagctacagaggcagaaagagcggcaacaagccccccagcaagacctgcctgaaggaggagatggccaagggcgaggccagcgagaagatcatcatcaacgtgggcggcaccagacacgagacctacagaagcaccctgagaaccctgcccggcaccagactggcctggctggccgaccccgacggcggcggcagacccgagaccgacggcggcggcgtgggcagcagcggcagcagcggcggcggcggctgcgagttcttcttcgacagacaccccggcgtgttcgcctacgtgctgaactactacagaaccggcaagctgcactgccccgccgacgtgtgcggccccctgttcgaggaggagctgaccttctggggcatcgacgagaccgacgtggagccctgctgctggatgacctacagacagcacagagacgccgaggaggccctggacatcttcgagagccccgacggcggcggcagcggcgccggccccagcgacgaggccggcgacgacgagagagagctggccctgcagagactgggcccccacgagggcggcgccggccacggcgccggcagcggcggctgcagaggctggcagcccagaatgtgggccctgttcgaggacccctacagcagcagagccgccagagtggtggccttcgccagcctgttcttcatcctggtgagcatcaccaccttctgcctggagacccacgaggccttcaacatcgacagaaacgtgaccgagatcctgagagtgggcaacatcaccagcgtgcacttcagaagagaggtggagaccgagcccatcctgacctacatcgagggcgtgtgcgtgctgtggttcaccctggagttcctggtgagaatcgtgtgctgccccgacaccctggacttcgtgaagaacctgctgaacatcatcgacttcgtggccatcctgcccttctacctggaggtgggcctgagcggcctgagcagcaaggccgccagagacgtgctgggcttcctgagagtggtgagattcgtgagaatcctgagaatcttcaagctgaccagacacttcgtgggcctgagagtgctgggccacaccctgagagccagcaccaacgagttcctgctgctgatcatcttcctggccctgggcgtgctgatcttcgccaccatgatctactacgccgagagaatcggcgccagacccagcgaccccagaggcaacgaccacaccgacttcaagaacatccccatcggcttctggtgggccgtggtgaccatgaccaccctgggctacggcgacatgtaccccaagacctggagcggcatgctggtgggcgccctgtgcgccctggccggcgtgctgaccatcgccatgcccgtgcccgtgatcgtgaacaacttcggcatgtactacagcctggccatggccaagcagaagctgcccaagaagagaaagaagcacgtgcccagacccgcccagctggagagccccatgtactgcaagagcgaggagaccagccccagagacagcacctgcagcgacaccagcccccccgccagagaggagggcatgatcgagagaaagagagccgacagcaagcagaacggcgacgccaacgccgtgctgagcgacgaggagggcgccggcctgacccagcccctggccagcagccccacccccgaggagagaagagccctgagaagaagcaccaccagagacagaaacaagaaggccgccgcctgcttcctgctgagcaccggcgactacgcctgcgccgacggcagcgtgagaaagggcaccttcgtgctgagagacctgcccctgcagcacagccccgaggccgcctgcccccccaccgccggcaccctgttcctgccccactag

SEQ ID NO: 94197 - DNA, 1881 bp, Artificial Sequence
  Description of Artificial Sequence: Synthetic coding sequence
atgatcagcagcgtgtgcgtgagcagctacagaggcagaaagagcggcaacaagccccccagcaagacctgcctgaaggaggagatggccaagggcgaggccagcgagaagatcatcatcaacgtgggcggcaccagacacgagacctacagaagcaccctgagaaccctgcccggcaccagactggcctggctggccgaccccgacggcggcggcagacccgagaccgacggcggcggcgtgggcagcagcggcagcagcggcggcggcggctgcgagttcttcttcgacagacaccccggcgtgttcgcctacgtgctgaactactacagaaccggcaagctgcactgccccgccgacgtgtgcggccccctgttcgaggaggagctgaccttctggggcatcgacgagaccgacgtggagccctgctgctggatgacctacagacagcacagagacgccgaggaggccctggacatcttcgagagccccgacggcggcggcagcggcgccggccccagcgacgaggccggcgacgacgagagagagctggccctgcagagactgggcccccacgagggcggcgccggccacggcgccggcagcggcggctgcagaggctggcagcccagaatgtgggccctgttcgaggacccctacagcagcagagccgccagagtggtggccttcgccagcctgttcttcatcctggtgagcatcaccaccttctgcctggagacccacgaggccttcaacatcgacagaaacgtgaccgagatcctgagagtgggcaacatcaccagcgtgcacttcagaagagaggtggagaccgagcccatcctgacctacatcgagggcgtgtgcgtgctgtggttcaccctggagttcctggtgagaatcgtgtgctgccccgacaccctggacttcgtgaagaacctgctgaacatcatcgacttcgtggccatcctgcccttctacctggaggtgggcctgagcggcctgagcagcaaggccgccagagacgtgctgggcttcctgagagtggtgagattcgtgagaatcctgagaatcttcaagctgaccagacacttcgtgggcctgagagtgctgggccacaccctgagagccagcaccaacgagttcctgctgctgatcatcttcctggccctgggcgtgctgatcttcgccaccatgatctactacgccgagagaatcggcgccagacccagcgaccccagaggcaacgaccacaccgacttcaagaacatccccatcggcttctggtgggccgtggtgaccatgaccaccctgggctacggcgacatgtaccccaagacctggagcggcatgctggtgggcgccctgtgcgccctggccggcgtgctgaccatcgccatgcccgtgcccgtgatcgtgaacaacttcggcatgtactacagcctggccatggccaagcagaagctgcccaagaagagaaagaagcacgtgcccagacccgcccagctggagagccccatgtactgcaagagcgaggagaccagccccagagacagcacctgcagcgacaccagcccccccgccagagaggagggcatgatcgagagaaagagagccgacagcaagcagaacggcgacgccaacgccgtgctgagcgacgaggagggcgccggcctgacccagcccctggccagcagccccacccccgaggagagaagagccctgagaagaagcaccaccagagacagaaacaagaaggccgccgcctgcttcctgctgagcaccggcgactacgcctgcgccgacggcagcgtgagaaaggagacctgccaggacgccctgagcagcaactacgcccaggccgaggtgctgaccctgagctag

SEQ ID NO: 94198 - DNA, 1908 bp, Artificial Sequence; identical to SEQ ID NO: 94196
  Description of Artificial Sequence: Synthetic coding sequence

SEQ ID NO: 94199 - DNA, 1485 bp, Artificial Sequence
  Description of Artificial Sequence: Synthetic coding sequence
atggacggcagcggcgagagaagcctgcccgagcccggcagccagagcagcgccgccagcgacgacatcgagatcgtggtgaacgtgggcggcgtgagacaggtgctgtacggcgacctgctgagccagtaccccgagaccagactggccgagctgatcaactgcctggccggcggctacgacaccatcttcagcctgtgcgacgactacgaccccggcaagagagagttctacttcgacagagaccccgacgccttcaagtgcgtgatcgaggtgtactacttcggcgaggtgcacatgaagaagggcatctgccccatctgcttcaagaacgagatggacttctggaaggtggacctgaagttcctggacgactgctgcaagagccacctgagcgagaagagagaggagctggaggagatcgccagaagagtgcagctgatcctggacgacctgggcgtggacgccgccgagggcagatggagaagatgccagaagtgcgtgtggaagttcctggagaagcccgagagcagctgccccgccagagtggtggccgtgctgagcttcctgctgatcctggtgagcagcgtggtgatgtgcatgggcaccatccccgagctgcaggtgctggacgccgagggcaacagagtggagcaccccaccctggagaacgtggagaccgcctgcatcggctggttcaccctggagtacctgctgagactgttcagcagccccaacaagctgcacttcgccctgagcttcatgaacatcgtggacgtgctggccatcctgcccttctacgtgagcctgaccctgacccacctgggcgccagaatgatggagctgaccaacgtgcagcaggccgtgcaggccctgagaatcatgagaatcgccagaatcttcaagctggccagacacagcagcggcctgcagaccctgacctacgccctgaagagaagcttcaaggagctgggcctgctgctgatgtacctggccgtgggcatcttcgtgttcagcgccctgggctacaccatggagcagagccaccccgagaccctgttcaagagcatcccccagagcttctggtgggccatcatcaccatgaccaccgtgggctacggcgacatctaccccaagaccaccctgggcaagctgaacgccgccatcagcttcctgtgcggcgtgatcgccatcgccctgcccatccaccccatcatcaacaacttcgtgagatactacaacaagcagagagtgctggagaccgccgccaagcacgagctggagctgatggagctgaacagcagcagcggcggcgagggcaagaccggcggcagcagaagcgacctggacaacctgccccccgagcccgccggcaaggaggcccccagctgcagcagcagactgaagctgagccacagcgacaccttcatccccctgctgaccgaggagaagcaccacagaaccagactgcagagctgcaagtag

SEQ ID NO: 94200 - DNA, 1542 bp, Artificial Sequence
  Description of Artificial Sequence: Synthetic coding sequence
atgaccctgctgcccggcgacaacagcgactacgactacagcgccctgagctgcaccagcgacgccagcttccaccccgccttcctgccccagagacaggccatcaagggcgccttctacagaagagcccagagactgagaccccaggacgagcccagacagggctgccagcccgaggacagaagaagaagaatcatcatcaacgtgggcggcatcaagtacagcctgccctggaccaccctggacgagttccccctgaccagactgggccagctgaaggcctgcaccaacttcgacgacatcctgaacgtgtgcgacgactacgacgtgacctgcaacgagttcttcttcgacagaaaccccggcgccttcggcaccatcctgaccttcctgagagccggcaagctgagactgctgagagagatgtgcgccctgagcttccaggaggagctgctgtactggggcatcgccgaggaccacctggacggctgctgcaagagaagatacctgcagaagatcgaggagttcgccgagatggtggagagagaggaggaggacgacgccctggacagcgagggcagagacagcgagggccccgccgagggcgagggcagactgggcagatgcatgagaagactgagagacatggtggagagaccccacagcggcctgcccggcaaggtgttcgcctgcctgagcgtgctgttcgtgaccgtgaccgccgtgaacctgagcgtgagcaccctgcccagcctgagagaggaggaggagcagggccactgcagccagatgtgccacaacgtgttcatcgtggagagcgtgtgcgtgggctggttcagcctggagttcctgctgagactgatccaggcccccagcaagttcgccttcctgagaagccccctgaccctgatcgacctggtggccatcctgccctactacatcaccctgctggtggacggcgccgccgccggcagaagaaagcccggcgccggcaacagctacctggacaaggtgggcctggtgctgagagtgctgagagccctgagaatcctgtacgtgatgagactggccagacacagcctgggcctgcagaccctgggcctgaccgccagaagatgcaccagagagttcggcctgctgctgctgttcctgtgcgtggccatcgccctgttcgcccccctgctgtacgtgatcgagaacgagatggccgacagccccgagttcaccagcatccccgcctgctactggtgggccgtgatcaccatgaccaccgtgggctacggcgacatggtgcccagaagcacccccggccaggtggtggccctgagcagcatcctgagcggcatcctgctgatggccttccccgtgaccagcatcttccacaccttcagcagaagctacctggagctgaagcaggagcaggagagagtgatgttcagaagagcccagttcctgatcaagaccaagagccagctgagcgtgagccaggacagcgacatcctgttcggcagcgccagcagcgacaccagagacaacaactag

SEQ ID NO: 94201 - DNA, 828 bp, Artificial Sequence
  Description of Artificial Sequence: Synthetic coding sequence
atgaccctgctgcccggcgacaacagcgactacgactacagcgccctgagctgcaccagcgacgccagcttccaccccgccttcctgccccagagacaggccatcaagggcgccttctacagaagagcccagagactgagaccccaggacgagcccagacagggctgccagcccgaggacagaagaagaagaatcatcatcaacgtgggcggcatcaagtacagcctgccctggaccaccctggacgagttccccctgaccagactgggccagctgaaggcctgcaccaacttcgacgacatcctgaacgtgtgcgacgactacgacgtgacctgcaacgagttcttcttcgacagaaaccccggcgccttcggcaccatcctgaccttcctgagagccggcaagctgagactgctgagagagatgtgcgccctgagcttccaggaggagctgctgtactggggcatcgccgaggaccacctggacggctgctgcaagagaagatacctgcagaagatcgaggagttcgccgagatggtggagagagaggaggaggacgacgccctggacagcgagggcagagacagcgagggccccgccgagggcgagggcagactgggcagatgcatgagaagactgagagacatggtggagagaccccacagcggcctgcccggcaaggtgttcgcctgcctgagcgtgctgttcgtgaccgtgaccgccgtgaacctgagcgtgagcaccctgcccagcctgagagaggaggaggagcaggtgagagcccacgcccccagaggcaacgccccccccagaggcaagggcctgtag

SEQ ID NO: 94202 - DNA, 543 bp, Artificial Sequence
  Description of Artificial Sequence: Synthetic coding sequence
atgaccctgctgcccggcgacaacagcgactacgactacagcgccctgagctgcaccagcgacgccagcttccaccccgccttcctgccccagagacaggccatcaagggcgccttctacagaagagcccagagactgagaccccaggacgagcccagacagggctgccagcccgaggacagaagaagaagaatcatcatcaacgtgggcggcatcaagtacagcctgccctggaccaccctggacgagttccccctgaccagactgggccagctgaaggcctgcaccaacttcgacgacatcctgaacgtgtgcgacgactacgacgtgacctgcaacgagttcttcttcgacagaaaccccggcgccttcggcaccatcctgaccttcctgagagccggcaagctgagactgctgagagagatgtgcgccctgagcttccaggaggagctgctgtactggggcatcgccgaggaccacctggacggctgctgcaagagaagatacctgcagaagatcgaggagttcgccgagatggtgtag

SEQ ID NO: 94203 - DNA, 291 bp, Artificial Sequence
  Description of Artificial Sequence: Synthetic coding sequence
atgaccctgctgcccggcgacaacagcgactacgactacagcgccctgagctgcaccagcgacgccagcttccaccccgccttcctgccccagagacaggccatcaagggcgccttctacagaagagcccagagactgagaccccaggacgagcccagacagggctgccagcccgaggacagaagaagaagaatcatcatcaacgtgggcggcatcaagtacagcctgccctggaccaccctggacgagttccccctgaccagactgggccagctgaaggcctgcacctag

SEQ ID NO: 94204 - DNA, 777 bp, Artificial Sequence
  Description of Artificial Sequence: Synthetic coding sequence
atgaccctgctgcccggcgacaacagcgactacgactacagcgccctgagctgcaccagcgacgccagcttccaccccgccttcctgccccagagacaggccatcaagggcgccttctacagaagagcccagagactgagaccccaggacgagcccagacagggctgccagcccgaggacagaagaagaagaatcatcatcaacgtgggcggcatcaagtacagcctgccctggaccaccctggacgagttccccctgaccagactgggccagctgaaggcctgcaccaacttcgacgacatcctgaacgtgtgcgacgactacgacgtgacctgcaacgagttcttcttcgacagaaaccccggcgccttcggcaccatcctgaccttcctgagagccggcaagctgagactgctgagagagatgtgcgccctgagcttccaggaggagctgctgtactggggcatcgccgaggaccacctggacggctgctgcaagagaagatacctgcagaagatcgaggagttcgccgagatggtggagagagaggaggaggacgacgccctggacagcgagggcagagacagcgagggccccgccgagggcgagggcagactgggcagatgcatgagaagactgagagacatggtggagagaccccacagcggcctgcccggcaaggtgttcgcctgcctgagcgtgctgttcgtgaccgtgaccgccgtgaacctgagcgtgagcaccctgcccagcctgagagaggaggaggagcagtag

SEQ ID NO: 94205 - DNA, 147 bp, Artificial Sequence
  Description of Artificial Sequence: Synthetic coding sequence
atgaccctgctgcccggcgacaacagcgactacgactacagcgccctgagctgcaccagcgacgccagcttccaccccgccttcctgccccagagacaggccatcaagggcgccttctacagaagagcccagagactgagaccctag

SEQ ID NO: 94206 - DNA, 1311 bp, Artificial Sequence
  Description of Artificial Sequence: Synthetic coding sequence
atgaccttcggcagaagcggcgccgccagcgtggtgctgaacgtgggcggcgccagatacagcctgagcagagagctgctgaaggacttccccctgagaagagtgagcagactgcacggctgcagaagcgagagagacgtgctggaggtgtgcgacgactacgacagagagagaaacgagtacttcttcgacagacacagcgaggccttcggcttcatcctgctgtacgtgagaggccacggcaagctgagattcgcccccagaatgtgcgagctgagcttctacaacgagatgatctactggggcctggagggcgcccacctggagtactgctgccagagaagactggacgacagaatgagcgacacctacaccttctacagcgccgacgagcccggcgtgctgggcagagacgaggccagacccggcggcgccgaggccgcccccagcagaagatggctggagagaatgagaagaaccttcgaggagcccaccagcagcctggccgcccagatcctggccagcgtgagcgtggtgttcgtgatcgtgagcatggtggtgctgtgcgccagcaccctgcccgactggagaaacgccgccgccgacaacagaagcctggacgacagaagcagatacagcgccggccccggcagagagcccagcggcatcatcgaggccatctgcatcggctggttcaccgccgagtgcatcgtgagattcatcgtgagcaagaacaagtgcgagttcgtgaagagacccctgaacatcatcgacctgctggccatcaccccctactacatcagcgtgctgatgaccgtgttcaccggcgagaacagccagctgcagagagccggcgtgaccctgagagtgctgagaatgatgagaatcttctgggtgatcaagctggccagacacttcatcggcctgcagaccctgggcctgaccctgaagagatgctacagagagatggtgatgctgctggtgttcatctgcgtggccatggccatcttcagcgccctgagccagctgctggagcacggcctggacctggagaccagcaacaaggacttcaccagcatccccgccgcctgctggtgggtgatcatcagcatgaccaccgtgggctacggcgacatgtaccccatcaccgtgcccggcagaatcctgggcggcgtgtgcgtggtgagcggcatcgtgctgctggccctgcccatcaccttcatctaccacagcttcgtgcagtgctaccacgagctgaagttcagaagcgccagatacagcagaagcctgagcaccgagttcctgaactag

SEQ ID NO: 94207 - DNA, 1278 bp, Artificial Sequence
  Description of Artificial Sequence: Synthetic coding sequence
atgaccttcggcagaagcggcgccgccagcgtggtgctgaacgtgggcggcgccagatacagcctgagcagagagctgctgaaggacttccccctgagaagagtgagcagactgcacggctgcagaagcgagagagacgtgctggaggtgtgcgacgactacgacagagagagaaacgagtacttcttcgacagacacagcgaggccttcggcttcatcctgctgtacgtgagaggccacggcaagctgagattcgcccccagaatgtgcgagctgagcttctacaacgagatgatctactggggcctggagggcgcccacctggagtactgctgccagagaagactggacgacagaatgagcgacacctacaccttctacagcgccgacgagcccggcgtgctgggcagagacgaggccagacccggcggcgccgaggccgcccccagcagaagatggctggagagaatgagaagaaccttcgaggagcccaccagcagcctggccgcccagatcctggccagcgtgagcgtggtgttcgtgatcgtgagcatggtggtgctgtgcgccagcaccctgcccgactggagaaacgccgccgccgacaacagaagcctggacgacagaagcagaatcatcgaggccatctgcatcggctggttcaccgccgagtgcatcgtgagattcatcgtgagcaagaacaagtgcgagttcgtgaagagacccctgaacatcatcgacctgctggccatcaccccctactacatcagcgtgctgatgaccgtgttcaccggcgagaacagccagctgcagagagccggcgtgaccctgagagtgctgagaatgatgagaatcttctgggtgatcaagctggccagacacttcatcggcctgcagaccctgggcctgaccctgaagagatgctacagagagatggtgatgctgctggtgttcatctgcgtggccatggccatcttcagcgccctgagccagctgctggagcacggcctggacctggagaccagcaacaaggacttcaccagcatccccgccgcctgctggtgggtgatcatcagcatgaccaccgtgggctacggcgacatgtaccccatcaccgtgcccggcagaatcctgggcggcgtgtgcgtggtgagcggcatcgtgctgctggccctgcccatcaccttcatctaccacagcttcgtgcagtgctaccacgagctgaagttcagaagcgccagatacagcagaagcctgagcaccgagttcctgaactag

SEQ ID NO: 94208 - DNA, 1560 bp, Artificial Sequence
  Description of Artificial Sequence: Synthetic coding sequence
atgcccatgcccagcagagacggcggcctgcaccccagacaccaccactacggcagccacagcccctggagccagctgctgagcagccccatggagacccccagcatcaagggcctgtactacagaagagtgagaaaggtgggcgccctggacgccagccccgtggacctgaagaaggagatcctgatcaacgtgggcggcagaagatacctgctgccctggagcaccctggacagattccccctgagcagactgagcaagctgagactgtgcagaagctacgaggagatcgtgcagctgtgcgacgactacgacgaggacagccaggagttcttcttcgacagaagccccagcgccttcggcgtgatcgtgagcttcctggccgccggcaagctggtgctgctgcaggagatgtgcgccctgagcttccaggaggagctggcctactggggcatcgaggaggcccacctggagagatgctgcctgagaaagctgctgagaaagctggaggagctggaggagctggccaagctgcacagagaggacgtgctgagacagcagagagagaccagaagacccgccagccacagcagcagatggggcctgtgcatgaacagactgagagagatggtggagaacccccagagcggcctgcccggcaaggtgttcgcctgcctgagcatcctgttcgtggccaccaccgccgtgagcctgtgcgtgagcaccatgcccgacctgagagccgaggaggaccagggcgagtgcagcagaaagtgctactacatcttcatcgtggagaccatctgcgtggcctggttcagcctggagttctgcctgagattcgtgcaggcccaggacaagtgccagttcttccagggccccctgaacatcatcgacatcctggccatcagcccctactacgtgagcctggccgtgagcgaggagccccccgaggacggcgagagacccagcggcagcagctacctggagaaggtgggcctggtgctgagagtgctgagagccctgagaatcctgtacgtgatgagactggccagacacagcctgggcctgcagaccctgggcctgaccgtgagaagatgcaccagagagttcggcctgctgctgctgttcctggccgtggccatcaccctgttcagccccctggtgtacgtggccgagaaggagagcggcagagtgctggagttcaccagcatccccgccagctactggtgggccatcatcagcatgaccaccgtgggctacggcgacatggtgcccagaagcgtgcccggccagatggtggccctgagcagcatcctgagcggcatcctgatcatggccttccccgccaccagcatcttccacaccttcagccacagctacctggagctgaagaaggagcaggagcagctgcaggccagactgagacacctgcagaacaccggccccgccagcgagtgcgagctgctggacccccacgtggccagcgagcacgagctgatgaacgacgtgaacgacctgatcctggagggccccgccctgcccatcatgcacatgtag

SEQ ID NO: 94209 - DNA, 2970 bp, Artificial Sequence
  Description of Artificial Sequence: Synthetic coding sequence
atgaccatggccggcggcagaagaggcctggtggccccccagaacaccttcctggagaacatcgtgagaagaagcaacgacaccaacttcgtgctgggcaacgcccagatcgtggactggcccatcgtgtacagcaacgacggcttctgcaagctgagcggctaccacagagccgaggtgatgcagaagagcagcacctgcagcttcatgtacggcgagctgaccgacaaggacaccatcgagaaggtgagacagaccttcgagaactacgagatgaacagcttcgagatcctgatgtacaagaagaacagaacccccgtgtggttcttcgtgaagatcgcccccatcagaaacgagcaggacaaggtggtgctgttcctgtgcaccttcagcgacatcaccgccttcaagcagcccatcgaggacgacagctgcaagggctggggcaagttcgccagactgaccagagccctgaccagcagcagaggcgtgctgcagcagctggcccccagcgtgcagaagggcgagaacgtgcacaagcacagcagactggccgaggtgctgcagctgggcagcgacatcctgccccagtacaagcaggaggcccccaagacccccccccacatcatcctgcactactgcgtgttcaagaccacctgggactggatcatcctgatcctgaccttctacaccgccatcctggtgccctacaacgtgagcttcaagaccagacagaacaacgtggcctggctggtggtggacagcatcgtggacgtgatcttcctggtggacatcgtgctgaacttccacaccaccttcgtgggccccgccggcgaggtgatcagcgaccccaagctgatcagaatgaactacctgaagacctggttcgtgatcgacctgctgagctgcctgccctacgacgtgatcaacgccttcgagaacgtggacgaggtgagcgccttcatgggcgaccccggcaagatcggcttcgccgaccagatccccccccccctggagggcagagagagccagggcatcagcagcctgttcagcagcctgaaggtggtgagactgctgagactgggcagagtggccagaaagctggaccactacatcgagtacggcgccgccgtgctggtgctgctggtgtgcgtgttcggcctggccgcccactggatggcctgcatctggtacagcatcggcgactacgagatcttcgacgaggacaccaagaccatcagaaacaacagctggctgtaccagctggccatggacatcggcaccccctaccagttcaacggcagcggcagcggcaagtgggagggcggccccagcaagaacagcgtgtacatcagcagcctgtacttcaccatgaccagcctgaccagcgtgggcttcggcaacatcgcccccagcaccgacatcgagaagatcttcgccgtggccatcatgatgatcggcagcctgctgtacgccaccatcttcggcaacgtgaccaccatcttccagcagatgtacgccaacaccaacagataccacgagatgctgaacagcgtgagagacttcctgaagctgtaccaggtgcccaagggcctgagcgagagagtgatggactacatcgtgagcacctggagcatgagcagaggcatcgacaccgagaaggtgctgcagatctgccccaaggacatgagagccgacatctgcgtgcacctgaacagaaaggtgttcaaggagcaccccgccttcagactggccagcgacggctgcctgagagccctggccatggagttccagaccgtgcactgcgcccccggcgacctgatctaccacgccggcgagagcgtggacagcctgtgcttcgtggtgagcggcagcctggaggtgatccaggacgacgaggtggtggccatcctgggcaagggcgacgtgttcggcgacgtgttctggaaggaggccaccctggcccagagctgcgccaacgtgagagccctgacctactgcgacctgcacgtgatcaagagagacgccctgcagaaggtgctggagttctacaccgccttcagccacagcttcagcagaaacctgatcctgacctacaacctgagaaagagaatcgtgttcagaaagatcagcgacgtgaagagagaggaggaggagagaatgaagagaaagaacgaggcccccctgatcctgccccccgaccaccccgtgagaagactgttccagagattcagacagcagaaggaggccagactggccgccgagagaggcggcagagacctggacgacctggacgtggagaagggcaacgtgctgaccgagcacgccagcgccaaccacagcctggtgaaggccagcgtggtgaccgtgagagagagccccgccacccccgtgagcttccaggccgccagcaccagcggcgtgcccgaccacgccaagctgcaggcccccggcagcgagtgcctgggccccaagggcggcggcggcgactgcgccaagagaaagagctgggccagattcaaggacgcctgcggcaagagcgaggactggaacaaggtgagcaaggccgagagcatggagaccctgcccgagagaaccaaggccagcggcgaggccaccctgaagaagaccgacagctgcgacagcggcatcaccaagagcgacctgagactggacaacgtgggcgaggccagaagcccccaggacagaagccccatcctggccgaggtgaagcacagcttctaccccatccccgagcagaccctgcaggccaccgtgctggaggtgagacacgagctgaaggaggacatcaaggccctgaacgccaagatgaccaacatcgagaagcagctgagcgagatcctgagaatcctgaccagcagaagaagcagccagagcccccaggagctgttcgagatcagcagaccccagagccccgagagcgagagagacatcttcggcgccagctag

SEQ ID NO: 94210 - DNA, 2889 bp, Artificial Sequence
  Description of Artificial Sequence: Synthetic coding sequence
atgaccatggccggcggcagaagaggcctggtggccccccagaacaccttcctggagaacatcgtgagaagaagcaacgacaccaacttcgtgctgggcaacgcccagatcgtggactggcccatcgtgtacagcaacgacggcttctgcaagctgagcggctaccacagagccgaggtgatgcagaagagcagcacctgcagcttcatgtacggcgagctgaccgacaaggacaccatcgagaaggtgagacagaccttcgagaactacgagatgaacagcttcgagatcctgatgtacaagaagaacagaacccccgtgtggttcttcgtgaagatcgcccccatcagaaacgagcaggacaaggtggtgctgttcctgtgcaccttcagcgacatcaccgccttcaagcagcccatcgaggacgacagctgcaagggctggggcaagttcgccagactgaccagagccctgaccagcagcagaggcgtgctgcagcagctggcccccagcgtgcagaagggcgagaacgtgcacaagcacagcagactggccgaggtgctgcagctgggcagcgacatcctgccccagtacaagcaggaggcccccaagacccccccccacatcatcctgcactactgcgtgttcaagaccacctgggactggatcatcctgatcctgaccttctacaccgccatcctggtgccctacaacgtgagcttcaagaccagacagaacaacgtggcctggctggtggtggacagcatcgtggacgtgatcttcctggtggacatcgtgctgaacttccacaccaccttcgtgggccccgccggcgaggtgatcagcgaccccaagctgatcagaatgaactacctgaagacctggttcgtgatcgacctgctgagctgcctgccctacgacgtgatcaacgccttcgagaacgtggacgagggcatcagcagcctgttcagcagcctgaaggtggtgagactgctgagactgggcagagtggccagaaagctggaccactacatcgagtacggcgccgccgtgctggtgctgctggtgtgcgtgttcggcctggccgcccactggatggcctgcatctggtacagcatcggcgactacgagatcttcgacgaggacaccaagaccatcagaaacaacagctggctgtaccagctggccatggacatcggcaccccctaccagttcaacggcagcggcagcggcaagtgggagggcggccccagcaagaacagcgtgtacatcagcagcctgtacttcaccatgaccagcctgaccagcgtgggcttcggcaacatcgcccccagcaccgacatcgagaagatcttcgccgtggccatcatgatgatcggcagcctgctgtacgccaccatcttcggcaacgtgaccaccatcttccagcagatgtacgccaacaccaacagataccacgagatgctgaacagcgtgagagacttcctgaagctgtaccaggtgcccaagggcctgagcgagagagtgatggactacatcgtgagcacctggagcatgagcagaggcatcgacaccgagaaggtgctgcagatctgccccaaggacatgagagccgacatctgcgtgcacctgaacagaaaggtgttcaaggagcaccccgccttcagactggccagcgacggctgcctgagagccctggccatggagttccagaccgtgcactgcgcccccggcgacctgatctaccacgccggcgagagcgtggacagcctgtgcttcgtggtgagcggcagcctggaggtgatccaggacgacgaggtggtggccatcctgggcaagggcgacgtgttcggcgacgtgttctggaaggaggccaccctggcccagagctgcgccaacgtgagagccctgacctactgcgacctgcacgtgatcaagagagacgccctgcagaaggtgctggagttctacaccgccttcagccacagcttcagcagaaacctgatcctgacctacaacctgagaaagagaatcgtgttcagaaagatcagcgacgtgaagagagaggaggaggagagaatgaagagaaagaacgaggcccccctgatcctgccccccgaccaccccgtgagaagactgttccagagattcagacagcagaaggaggccagactggccgccgagagaggcggcagagacctggacgacctggacgtggagaagggcaacgtgctgaccgagcacgccagcgccaaccacagcctggtgaaggccagcgtggtgaccgtgagagagagccccgccacccccgtgagcttccaggccgccagcaccagcggcgtgcccgaccacgccaagctgcaggcccccggcagcgagtgcctgggccccaagggcggcggcggcgactgcgccaagagaaagagctgggccagattcaaggacgcctgcggcaagagcgaggactggaacaaggtgagcaaggccgagagcatggagaccctgcccgagagaaccaaggccagcggcgaggccaccctgaagaagaccgacagctgcgacagcggcatcaccaagagcgacctgagactggacaacgtgggcgaggccagaagcccccaggacagaagccccatcctggccgaggtgaagcacagcttctaccccatccccgagcagaccctgcaggccaccgtgctggaggtgagacacgagctgaaggaggacatcaaggccctgaacgccaagatgaccaacatcgagaagcagctgagcgagatcctgagaatcctgaccagcagaagaagcagccagagcccccaggagctgttcgagatcagcagaccccagagccccgagagcgagagagacatcttcggcgccagctag

SEQ ID NO: 94211 - DNA, 3480 bp, Artificial Sequence
  Description of Artificial Sequence: Synthetic coding sequence
atgcccgtgagaagaggccacgtggccccccagaacaccttcctggacaccatcatcagaaagttcgagggccagagcagaaagttcatcatcgccaacgccagagtggagaactgcgccgtgatctactgcaacgacggcttctgcgagctgtgcggctacagcagagccgaggtgatgcagagaccctgcacctgcgacttcctgcacggccccagaacccagagaagagccgccgcccagatcgcccaggccctgctgggcgccgaggagagaaaggtggagatcgccttctacagaaaggacggcagctgcttcctgtgcctggtggacgtggtgcccgtgaagaacgaggacggcgccgtgatcatgttcatcctgaacttcgaggtggtgatggagaaggacatggtgggcagccccgcccacgacaccaaccacagaggcccccccaccagctggctggcccccggcagagccaagaccttcagactgaagctgcccgccctgctggccctgaccgccagagagagcagcgtgagaagcggcggcgccggcggcgccggcgcccccggcgccgtggtggtggacgtggacctgacccccgccgcccccagcagcgagagcctggccctggacgaggtgaccgccatggacaaccacgtggccggcctgggccccgccgaggagagaagagccctggtgggccccggcagcccccccagaagcgcccccggccagctgcccagccccagagcccacagcctgaaccccgacgccagcggcagcagctgcagcctggccagaaccagaagcagagagagctgcgccagcgtgagaagagccagcagcgccgacgacatcgaggccatgagagccggcgtgctgccccccccccccagacacgccagcaccggcgccatgcaccccctgagaagcggcctgctgaacagcaccagcgacagcgacctggtgagatacagaaccatcagcaagatcccccagatcaccctgaacttcgtggacctgaagggcgaccccttcctggccagccccaccagcgacagagagatcatcgcccccaagatcaaggagagaacccacaacgtgaccgagaaggtgacccaggtgctgagcctgggcgccgacgtgctgcccgagtacaagctgcaggcccccagaatccacagatggaccatcctgcactacagccccttcaaggccgtgtgggactggctgatcctgctgctggtgatctacaccgccgtgttcaccccctacagcgccgccttcctgctgaaggagaccgaggagggcccccccgccaccgagtgcggctacgcctgccagcccctggccgtggtggacctgatcgtggacatcatgttcatcgtggacatcctgatcaacttcagaaccacctacgtgaacgccaacgaggaggtggtgagccaccccggcagaatcgccgtgcactacttcaagggctggttcctgatcgacatggtggccgccatccccttcgacctgctgatcttcggcagcggcagcgaggagctgatcggcctgctgaagaccgccagactgctgagactggtgagagtggccagaaagctggacagatacagcgagtacggcgccgccgtgctgttcctgctgatgtgcaccttcgccctgatcgcccactggctggcctgcatctggtacgccatcggcaacatggagcagccccacatggacagcagaatcggctggctgcacaacctgggcgaccagatcggcaagccctacaacagcagcggcctgggcggccccagcatcaaggacaagtacgtgaccgccctgtacttcaccttcagcagcctgaccagcgtgggcttcggcaacgtgagccccaacaccaacagcgagaagatcttcagcatctgcgtgatgctgatcggcagcctgatgtacgccagcatcttcggcaacgtgagcgccatcatccagagactgtacagcggcaccgccagataccacacccagatgctgagagtgagagagttcatcagattccaccagatccccaaccccctgagacagagactggaggagtacttccagcacgcctggagctacaccaacggcatcgacatgaacgccgtgctgaagggcttccccgagtgcctgcaggccgacatctgcctgcacctgaacagaagcctgctgcagcactgcaagcccttcagaggcgccaccaagggctgcctgagagccctggccatgaagttcaagaccacccacgccccccccggcgacaccctggtgcacgccggcgacctgctgaccgccctgtacttcatcagcagaggcagcatcgagatcctgagaggcgacgtggtggtggccatcctgggcaagaacgacatcttcggcgagcccctgaacctgtacgccagacccggcaagagcaacggcgacgtgagagccctgacctactgcgacctgcacaagatccacagagacgacctgctggaggtgctggacatgtaccccgagttcagcgaccacttctggagcagcctggagatcaccttcaacctgagagacaccaacatgatccccggcagccccggcagcaccgagctggagggcggcttcagcagacagagaaagagaaagctgagcttcagaagaagaaccgacaaggacaccgagcagcccggcgaggtgagcgccctgggccccggcagagccggcgccggccccagcagcagaggcagacccggcggcccctggggcgagagccccagcagcggccccagcagccccgagagcagcgaggacgagggccccggcagaagcagcagccccctgagactggtgcccttcagcagccccagaccccccggcgagccccccggcggcgagcccctgatggaggactgcgagaagagcagcgacacctgcaaccccctgagcggcgccttcagcggcgtgagcaacatcttcagcttctggggcgacagcagaggcagacagtaccaggagctgcccagatgccccgcccccacccccagcctgctgaacatccccctgagcagccccggcagaagacccagaggcgacgtggagagcagactggacgccctgcagagacagctgaacagactggagaccagactgagcgccgacatggccaccgtgctgcagctgctgcagagacagatgaccctggtgccccccgcctacagcgccgtgaccacccccggccccggccccaccagcaccagccccctgctgcccgtgagccccctgcccaccctgaccctggacagcctgagccaggtgagccagttcatggcctgcgaggagctgccccccggcgcccccgagctgccccaggagggccccaccagaagactgagcctgcccggccagctgggcgccctgaccagccagcccctgcacagacacggcagcgaccccggcagctag

SEQ ID NO: 94212 - DNA, 2460 bp, Artificial Sequence
  Description of Artificial Sequence: Synthetic coding sequence
atggccgcccccgccggcaaggccagcagaaccggcgccctgagacccagagcccagaagggcagagtgagaagagccgtgagaatcagcagcctggtggcccaggaggtgctgagcctgggcgccgacgtgctgcccgagtacaagctgcaggcccccagaatccacagatggaccatcctgcactacagccccttcaaggccgtgtgggactggctgatcctgctgctggtgatctacaccgccgtgttcaccccctacagcgccgccttcctgctgaaggagaccgaggagggcccccccgccaccgagtgcggctacgcctgccagcccctggccgtggtggacctgatcgtggacatcatgttcatcgtggacatcctgatcaacttcagaaccacctacgtgaacgccaacgaggaggtggtgagccaccccggcagaatcgccgtgcactacttcaagggctggttcctgatcgacatggtggccgccatccccttcgacctgctgatcttcggcagcggcagcgaggagctgatcggcctgctgaagaccgccagactgctgagactggtgagagtggccagaaagctggacagatacagcgagtacggcgccgccgtgctgttcctgctgatgtgcaccttcgccctgatcgcccactggctggcctgcatctggtacgccatcggcaacatggagcagccccacatggacagcagaatcggctggctgcacaacctgggcgaccagatcggcaagccctacaacagcagcggcctgggcggccccagcatcaaggacaagtacgtgaccgccctgtacttcaccttcagcagcctgaccagcgtgggcttcggcaacgtgagccccaacaccaacagcgagaagatcttcagcatctgcgtgatgctgatcggcagcctgatgtacgccagcatcttcggcaacgtgagcgccatcatccagagactgtacagcggcaccgccagataccacacccagatgctgagagtgagagagttcatcagattccaccagatccccaaccccctgagacagagactggaggagtacttccagcacgcctggagctacaccaacggcatcgacatgaacgccgtgctgaagggcttccccgagtgcctgcaggccgacatctgcctgcacctgaacagaagcctgctgcagcactgcaagcccttcagaggcgccaccaagggctgcctgagagccctggccatgaagttcaagaccacccacgccccccccggcgacaccctggtgcacgccggcgacctgctgaccgccctgtacttcatcagcagaggcagcatcgagatcctgagaggcgacgtggtggtggccatcctgggcaagaacgacatcttcggcgagcccctgaacctgtacgccagacccggcaagagcaacggcgacgtgagagccctgacctactgcgacctgcacaagatccacagagacgacctgctggaggtgctggacatgtaccccgagttcagcgaccacttctggagcagcctggagatcaccttcaacctgagagacaccaacatgatccccggcagccccggcagcaccgagctggagggcggcttcagcagacagagaaagagaaagctgagcttcagaagaagaaccgacaaggacaccgagcagcccggcgaggtgagcgccctgggccccggcagagccggcgccggccccagcagcagaggcagacccggcggcccctggggcgagagccccagcagcggccccagcagccccgagagcagcgaggacgagggccccggcagaagcagcagccccctgagactggtgcccttcagcagccccagaccccccggcgagccccccggcggcgagcccctgatggaggactgcgagaagagcagcgacacctgcaaccccctgagcggcgccttcagcggcgtgagcaacatcttcagcttctggggcgacagcagaggcagacagtaccaggagctgcccagatgccccgcccccacccccagcctgctgaacatccccctgagcagccccggcagaagacccagaggcgacgtggagagcagactggacgccctgcagagacagctgaacagactggagaccagactgagcgccgacatggccaccgtgctgcagctgctgcagagacagatgaccctggtgccccccgcctacagcgccgtgaccacccccggccccggccccaccagcaccagccccctgctgcccgtgagccccctgcccaccctgaccctggacagcctgagccaggtgagccagttcatggcctgcgaggagctgccccccggcgcccccgagctgccccaggagggccccaccagaagactgagcctgcccggccagctgggcgccctgaccagccagcccctgcacagacacggcagcgaccccggcagctag

SEQ ID NO: 94213 - DNA, 1182 bp, Artificial Sequence
  Description of Artificial Sequence: Synthetic coding sequence
atggccgcccccgccggcaaggccagcagaaccggcgccctgagacccagagcccagaagggcagagtgagaagagccgtgagaatcagcagcctggtggcccaggaggtgctgagcctgggcgccgacgtgctgcccgagtacaagctgcaggcccccagaatccacagatggaccatcctgcactacagccccttcaaggccgtgtgggactggctgatcctgctgctggtgatctacaccgccgtgttcaccccctacagcgccgccttcctgctgaaggagaccgaggagggcccccccgccaccgagtgcggctacgcctgccagcccctggccgtggtggacctgatcgtggacatcatgttcatcgtggacatcctgatcaacttcagaaccacctacgtgaacgccaacgaggaggtggtgagccaccccggcagaatcgccgtgcactacttcaagggctggttcctgatcgacatggtggccgccatccccttcgacctgctgatcttcggcagcggcagcgaggagctgatcggcctgctgaagaccgccagactgctgagactggtgagagtggccagaaagctggacagatacagcgagtacggcgccgccgtgctgttcctgctgatgtgcaccttcgccctgatcgcccactggctggcctgcatctggtacgccatcggcaacatggagcagccccacatggacagcagaatcggctggctgcacaacctgggcgaccagatcggcaagccctacaacagcagcggcctgggcggccccagcatcaaggacaagtacgtgaccgccctgtacttcaccttcagcagcctgaccagcgtgggcttcggcaacgtgagccccaacaccaacagcgagaagatcttcagcatctgcgtgatgctgatcggcagcctgatgtacgccagcatcttcggcaacgtgagcgccatcatccagagactgtacagcggcaccgccagataccacacccagatgctgagagtgagagagttcatcagattccaccagatccccaaccccctgagacagtgctgcgaccaccccggcgcctggccccacttccacatccccgccgtggccagacagccccccccccacccccacctgggcctggccttcagcggcttccccgtgcacggcgtgtag

SEQ ID NO: 94214 - DNA, 3192 bp, Artificial Sequence
  Description of Artificial Sequence: Synthetic coding sequence
atgagcagccacagcgccggcagctgcttcctgtgcctggtggacgtggtgcccgtgaagaacgaggacggcgccgtgatcatgttcatcctgaacttcgaggtggtgatggagaaggacatggtgggcagccccgcccacgacaccaaccacagaggcccccccaccagctggctggcccccggcagagccaagaccttcagactgaagctgcccgccctgctggccctgaccgccagagagagcagcgtgagaagcggcggcgccggcggcgccggcgcccccggcgccgtggtggtggacgtggacctgacccccgccgcccccagcagcgagagcctggccctggacgaggtgaccgccatggacaaccacgtggccggcctgggccccgccgaggagagaagagccctggtgggccccggcagcccccccagaagcgcccccggccagctgcccagccccagagcccacagcctgaaccccgacgccagcggcagcagctgcagcctggccagaaccagaagcagagagagctgcgccagcgtgagaagagccagcagcgccgacgacatcgaggccatgagagccggcgtgctgccccccccccccagacacgccagcaccggcgccatgcaccccctgagaagcggcctgctgaacagcaccagcgacagcgacctggtgagatacagaaccatcagcaagatcccccagatcaccctgaacttcgtggacctgaagggcgaccccttcctggccagccccaccagcgacagagagatcatcgcccccaagatcaaggagagaacccacaacgtgaccgagaaggtgacccaggtgctgagcctgggcgccgacgtgctgcccgagtacaagctgcaggcccccagaatccacagatggaccatcctgcactacagccccttcaaggccgtgtgggactggctgatcctgctgctggtgatctacaccgccgtgttcaccccctacagcgccgccttcctgctgaaggagaccgaggagggcccccccgccaccgagtgcggctacgcctgccagcccctggccgtggtggacctgatcgtggacatcatgttcatcgtggacatcctgatcaacttcagaaccacctacgtgaacgccaacgaggaggtggtgagccaccccggcagaatcgccgtgcactacttcaagggctggttcctgatcgacatggtggccgccatccccttcgacctgctgatcttcggcagcggcagcgaggagctgatcggcctgctgaagaccgccagactgctgagactggtgagagtggccagaaagctggacagatacagcgagtacggcgccgccgtgctgttcctgctgatgtgcaccttcgccctgatcgcccactggctggcctgcatctggtacgccatcggcaacatggagcagccccacatggacagcagaatcggctggctgcacaacctgggcgaccagatcggcaagccctacaacagcagcggcctgggcggccccagcatcaaggacaagtacgtgaccgccctgtacttcaccttcagcagcctgaccagcgtgggcttcggcaacgtgagccccaacaccaacagcgagaagatcttcagcatctgcgtgatgctgatcggcagcctgatgtacgccagcatcttcggcaacgtgagcgccatcatccagagactgtacagcggcaccgccagataccacacccagatgctgagagtgagagagttcatcagattccaccagatccccaaccccctgagacagagactggaggagtacttccagcacgcctggagctacaccaacggcatcgacatgaacgccgtgctgaagggcttccccgagtgcctgcaggccgacatctgcctgcacctgaacagaagcctgctgcagcactgcaagcccttcagaggcgccaccaagggctgcctgagagccctggccatgaagttcaagaccacccacgccccccccggcgacaccctggtgcacgccggcgacctgctgaccgccctgtacttcatcagcagaggcagcatcgagatcctgagaggcgacgtggtggtggccatcctgggcaagaacgacatcttcggcgagcccctgaacctgtacgccagacccggcaagagcaacggcgacgtgagagccctgacctactgcgacctgcacaagatccacagagacgacctgctggaggtgctggacatgtaccccgagttcagcgaccacttctggagcagcctggagatcaccttcaacctgagagacaccaacatgatccccggcagccccggcagcaccgagctggagggcggcttcagcagacagagaaagagaaagctgagcttcagaagaagaaccgacaaggacaccgagcagcccggcgaggtgagcgccctgggccccggcagagccggcgccggccccagcagcagaggcagacccggcggcccctggggcgagagccccagcagcggccccagcagccccgagagcagcgaggacgagggccccggcagaagcagcagccccctgagactggtgcccttcagcagccccagaccccccggcgagccccccggcggcgagcccctgatggaggactgcgagaagagcagcgacacctgcaaccccctgagcggcgccttcagcggcgtgagcaacatcttcagcttctggggcgacagcagaggcagacagtaccaggagctgcccagatgccccgcccccacccccagcctgctgaacatccccctgagcagccccggcagaagacccagaggcgacgtggagagcagactggacgccctgcagagacagctgaacagactggagaccagactgagcgccgacatggccaccgtgctgcagctgctgcagagacagatgaccctggtgccccccgcctacagcgccgtgaccacccccggccccggccccaccagcaccagccccctgctgcccgtgagccccctgcccaccctgaccctggacagcctgagccaggtgagccagttcatggcctgcgaggagctgccccccggcgcccccgagctgccccaggagggccccaccagaagactgagcctgcccggccagctgggcgccctgaccagccagcccctgcacagacacggcagcgaccccggcagctag

SEQ ID NO: 94215 - DNA, 2667 bp, Artificial Sequence
  Description of Artificial Sequence: Synthetic coding sequence
atgcccgtgagaagaggccacgtggccccccagaacaccttcctggacaccatcatcagaaagttcgagggccagagcagaaagttcatcatcgccaacgccagagtggagaactgcgccgtgatctactgcaacgacggcttctgcgagctgtgcggctacagcagagccgaggtgatgcagagaccctgcacctgcgacttcctgcacggccccagaacccagagaagagccgccgcccagatcgcccaggccctgctgggcgccgaggagagaaaggtggagatcgccttctacagaaaggacggcagctgcttcctgtgcctggtggacgtggtgcccgtgaagaacgaggacggcgccgtgatcatgttcatcctgaacttcgaggtggtgatggagaaggacatggtgggcagccccgcccacgacaccaaccacagaggcccccccaccagctggctggcccccggcagagccaagaccttcagactgaagctgcccgccctgctggccctgaccgccagagagagcagcgtgagaagcggcggcgccggcggcgccggcgcccccggcgccgtggtggtggacgtggacctgacccccgccgcccccagcagcgagagcctggccctggacgaggtgaccgccatggacaaccacgtggccggcctgggccccgccgaggagagaagagccctggtgggccccggcagcccccccagaagcgcccccggccagctgcccagccccagagcccacagcctgaaccccgacgccagcggcagcagctgcagcctggccagaaccagaagcagagagagctgcgccagcgtgagaagagccagcagcgccgacgacatcgaggccatgagagccggcgtgctgccccccccccccagacacgccagcaccggcgccatgcaccccctgagaagcggcctgctgaacagcaccagcgacagcgacctggtgagatacagaaccatcagcaagatcccccagatcaccctgaacttcgtggacctgaagggcgaccccttcctggccagccccaccagcgacagagagatcatcgcccccaagatcaaggagagaacccacaacgtgaccgagaaggtgacccaggtgctgagcctgggcgccgacgtgctgcccgagtacaagctgcaggcccccagaatccacagatggaccatcctgcactacagccccttcaaggccgtgtgggactggctgatcctgctgctggtgatctacaccgccgtgttcaccccctacagcgccgccttcctgctgaaggagaccgaggagggcccccccgccaccgagtgcggctacgcctgccagcccctggccgtggtggacctgatcgtggacatcatgttcatcgtggacatcctgatcaacttcagaaccacctacgtgaacgccaacgaggaggtggtgagccaccccggcagaatcgccgtgcactacttcaagggctggttcctgatcgacatggtggccgccatccccttcgacctgctgatcttcggcagcggcagcgaggagctgatcggcctgctgaagaccgccagactgctgagactggtgagagtggccagaaagctggacagatacagcgagtacggcgccgccgtgctgttcctgctgatgtgcaccttcgccctgatcgcccactggctggcctgcatctggtacgccatcggcaacatggagcagccccacatggacagcagaatcggctggctgcacaacctgggcgaccagatcggcaagccctacaacagcagcggcctgggcggccccagcatcaaggacaagtacgtgaccgccctgtacttcaccttcagcagcctgaccagcgtgggcttcggcaacgtgagccccaacaccaacagcgagaagatcttcagcatctgcgtgatgctgatcggcagcctgatgtacgccagcatcttcggcaacgtgagcgccatcatccagagactgtacagcggcaccgccagataccacacccagatgctgagagtgagagagttcatcagattccaccagatccccaaccccctgagacagagactggaggagtacttccagcacgcctggagctacaccaacggcatcgacatgaacgccgtgctgaagggcttccccgagtgcctgcaggccgacatctgcctgcacctgaacagaagcctgctgcagcactgcaagcccttcagaggcgccaccaagggctgcctgagagccctggccatgaagttcaagaccacccacgccccccccggcgacaccctggtgcacgccggcgacctgctgaccgccctgtacttcatcagcagaggcagcatcgagatcctgagaggcgacgtggtggtggccatcctgggcatgggctggggcgccggcaccggcctggagatgcccagcgccgccagcagaggcgccagcctgctgaacatgcagagcctgggcctgtggacctgggactgcctgcagggccactgggcccccctgatccacctgaacagcggcccccccagcggcgccatggagagaagccccacctggggcgaggccgccgagctgtggggcagccacatcctgctgcccttcagaatcagacacaagcagaccctgttcgccagcctgaagtag

SEQ ID NO: 94216 - DNA, 3252 bp, Artificial Sequence
  Description of Artificial Sequence: Synthetic coding sequence
atgcccgccatgagaggcctgctggccccccagaacaccttcctggacaccatcgccaccagattcgacggcacccacagcaacttcgtgctgggcaacgcccaggtggccggcctgttccccgtggtgtactgcagcgacggcttctgcgacctgaccggcttcagcagagccgaggtgatgcagagaggctgcgcctgcagcttcctgtacggccccgacaccagcgagctggtgagacagcagatcagaaaggccctggacgagcacaaggagttcaaggccgagctgatcctgtacagaaagagcggcctgcccttctggtgcctgctggacgtgatccccatcaagaacgagaagggcgaggtggccctgttcctggtgagccacaaggacatcagcgagaccaagaacagaggcggccccgacagatggaaggagaccggcggcggcagaagaagatacggcagagccagaagcaagggcttcaacgccaacagaagaagaagcagagccgtgctgtaccacctgagcggccacctgcagaagcagcccaagggcaagcacaagctgaacaagggcgtgttcggcgagaagcccaacctgcccgagtacaaggtggccgccatcagaaagagccccttcatcctgctgcactgcggcgccctgagagccacctgggacggcttcatcctgctggccaccctgtacgtggccgtgaccgtgccctacagcgtgtgcgtgagcaccgccagagagcccagcgccgccagaggcccccccagcgtgtgcgacctggccgtggaggtgctgttcatcctggacatcgtgctgaacttcagaaccaccttcgtgagcaagagcggccaggtggtgttcgcccccaagagcatctgcctgcactacgtgaccacctggttcctgctggacgtgatcgccgccctgcccttcgacctgctgcacgccttcaaggtgaacgtgtacttcggcgcccacctgctgaagaccgtgagactgctgagactgctgagactgctgcccagactggacagatacagccagtacagcgccgtggtgctgaccctgctgatggccgtgttcgccctgctggcccactgggtggcctgcgtgtggttctacatcggccagagagagatcgagagcagcgagagcgagctgcccgagatcggctggctgcaggagctggccagaagactggagaccccctactacctggtgggcagaagacccgccggcggcaacagcagcggccagagcgacaactgcagcagcagcagcgaggccaacggcaccggcctggagctgctgggcggccccagcctgagaagcgcctacatcaccagcctgtacttcgccctgagcagcctgaccagcgtgggcttcggcaacgtgagcgccaacaccgacaccgagaagatcttcagcatctgcaccatgctgatcggcgccctgatgcacgccgtggtgttcggcaacgtgaccgccatcatccagagaatgtacgccagaagattcctgtaccacagcagaaccagagacctgagagactacatcagaatccacagaatccccaagcccctgaagcagagaatgctggagtacttccaggccacctgggccgtgaacaacggcatcgacaccaccgagctgctgcagagcctgcccgacgagctgagagccgacatcgccatgcacctgcacaaggaggtgctgcagctgcccctgttcgaggccgccagcagaggctgcctgagagccctgagcctggccctgagacccgccttctgcacccccggcgagtacctgatccaccagggcgacgccctgcaggccctgtacttcgtgtgcagcggcagcatggaggtgctgaagggcggcaccgtgctggccatcctgggcaagggcgacctgatcggctgcgagctgcccagaagagagcaggtggtgaaggccaacgccgacgtgaagggcctgacctactgcgtgctgcagtgcctgcagctggccggcctgcacgacagcctggccctgtaccccgagttcgcccccagattcagcagaggcctgagaggcgagctgagctacaacctgggcgccggcggcggcagcgccgaggtggacaccagcagcctgagcggcgacaacaccctgatgagcaccctggaggagaaggagaccgacggcgagcagggccccaccgtgagccccgcccccgccgacgagcccagcagccccctgctgagccccggctgcaccagcagcagcagcgccgccaagctgctgagccccagaagaaccgcccccagacccagactgggcggcagaggcagacccggcagagccggcgccctgaaggccgaggccggccccagcgccccccccagagccctggagggcctgagactgccccccatgccctggaacgtgccccccgacctgagccccagagtggtggacggcatcgaggacggctgcggcagcgaccagcccaagttcagcttcagagtgggccagagcggccccgagtgcagcagcagccccagccccggccccgagagcggcctgctgaccgtgccccacggccccagcgaggccagaaacaccgacaccctggacaagctgagacaggccgtgaccgagctgagcgagcaggtgctgcagatgagagagggcctgcagagcctgagacaggccgtgcagctggtgctggccccccacagagagggcccctgccccagagccagcggcgagggcccctgccccgccagcaccagcggcctgctgcagcccctgtgcgtggacaccggcgccagcagctactgcctgcagccccccgccggcagcgtgctgagcggcacctggccccaccccagacccggccccccccccctgatggccccctggccctggggcccccccgccagccagagcagcccctggcccagagccaccgccttctggaccagcaccagcgacagcgagccccccgccagcggcgacctgtgcagcgagcccagcacccccgccagccccccccccagcgaggagggcgccagaaccggccccgccgagcccgtgagccaggccgaggccaccagcaccggcgagcccccccccggcagcggcggcctggccctgccctgggacccccacagcctggagatggtgctgatcggctgccacggcagcggcaccgtgcagtggacccaggaggagggcaccggcgtgtag

SEQ ID NO: 94217 - DNA, 2967 bp, Artificial Sequence
  Description of Artificial Sequence: Synthetic coding sequence
atgcccggcggcaagagaggcctggtggccccccagaacaccttcctggagaacatcgtgagaagaagcagcgagagcagcttcctgctgggcaacgcccagatcgtggactggcccgtggtgtacagcaacgacggcttctgcaagctgagcggctaccacagagccgacgtgatgcagaagagcagcacctgcagcttcatgtacggcgagctgaccgacaagaagaccatcgagaaggtgagacagaccttcgacaactacgagagcaactgcttcgaggtgctgctgtacaagaagaacagaacccccgtgtggttctacatgcagatcgcccccatcagaaacgagcacgagaaggtggtgctgttcctgtgcaccttcaaggacatcaccctgttcaagcagcccatcgaggacgacagcaccaagggctggaccaagttcgccagactgaccagagccctgaccaacagcagaagcgtgctgcagcagctgacccccatgaacaagaccgaggtggtgcacaagcacagcagactggccgaggtgctgcagctgggcagcgacatcctgccccagtacaagcaggaggcccccaagacccccccccacatcatcctgcactactgcgccttcaagaccacctgggactgggtgatcctgatcctgaccttctacaccgccatcatggtgccctacaacgtgagcttcaagaccaagcagaacaacatcgcctggctggtgctggacagcgtggtggacgtgatcttcctggtggacatcgtgctgaacttccacaccaccttcgtgggccccggcggcgaggtgatcagcgaccccaagctgatcagaatgaactacctgaagacctggttcgtgatcgacctgctgagctgcctgccctacgacatcatcaacgccttcgagaacgtggacgagggcatcagcagcctgttcagcagcctgaaggtggtgagactgctgagactgggcagagtggccagaaagctggaccactacctggagtacggcgccgccgtgctggtgctgctggtgtgcgtgttcggcctggtggcccactggctggcctgcatctggtacagcatcggcgactacgaggtgatcgacgaggtgaccaacaccatccagatcgacagctggctgtaccagctggccctgagcatcggcaccccctacagatacaacaccagcgccggcatctgggagggcggccccagcaaggacagcctgtacgtgagcagcctgtacttcaccatgaccagcctgaccaccatcggcttcggcaacatcgcccccaccaccgacgtggagaagatgttcagcgtggccatgatgatggtgggcagcctgctgtacgccaccatcttcggcaacgtgaccaccatcttccagcagatgtacgccaacaccaacagataccacgagatgctgaacaacgtgagagacttcctgaagctgtaccaggtgcccaagggcctgagcgagagagtgatggactacatcgtgagcacctggagcatgagcaagggcatcgacaccgagaaggtgctgagcatctgccccaaggacatgagagccgacatctgcgtgcacctgaacagaaaggtgttcaacgagcaccccgccttcagactggccagcgacggctgcctgagagccctggccgtggagttccagaccatccactgcgcccccggcgacctgatctaccacgccggcgagagcgtggacgccctgtgcttcgtggtgagcggcagcctggaggtgatccaggacgacgaggtggtggccatcctgggcaagggcgacgtgttcggcgacatcttctggaaggagaccaccctggcccacgcctgcgccaacgtgagagccctgacctactgcgacctgcacatcatcaagagagaggccctgctgaaggtgctggacttctacaccgccttcgccaacagcttcagcagaaacctgaccctgacctgcaacctgagaaagagaatcatcttcagaaagatcagcgacgtgaagaaggaggaggaggagagactgagacagaagaacgaggtgaccctgagcatccccgtggaccaccccgtgagaaagctgttccagaagttcaagcagcagaaggagctgagaaaccagggcagcacccagggcgaccccgagagaaaccagctgcaggtggagagcagaagcctgcagaacggcgccagcatcaccggcaccagcgtggtgaccgtgagccagatcacccccatccagaccagcctggcctacgtgaagaccagcgagagcctgaagcagaacaacagagacgccatggagctgaagcccaacggcggcgccgaccagaagtgcctgaaggtgaacagccccatcagaatgaagaacggcaacggcaagggctggctgagactgaagaacaacatgggcgcccacgaggagaagaaggaggactggaacaacgtgaccaaggccgagagcatgggcctgctgagcgaggaccccaagagcagcgacagcgagaacagcgtgaccaagaaccccctgagaaagaccgacagctgcgacagcggcatcaccaagagcgacctgagactggacaaggccggcgaggccagaagccccctggagcacagccccatccaggccgacgccaagcaccccttctaccccatccccgagcaggccctgcagaccaccctgcaggaggtgaagcacgagctgaaggaggacatccagctgctgagctgcagaatgaccgccctggagaagcaggtggccgagatcctgaagatcctgagcgagaagagcgtgccccaggccagcagccccaagagccagatgcccctgcaggtgcccccccagatcccctgccaggacatcttcagcgtgagcagacccgagagccccgagagcgacaaggacgagatccacttctag

SEQ ID NO: 94218 - DNA, 1269 bp, Artificial Sequence
  Description of Artificial Sequence: Synthetic coding sequence
atgcagaagagcagcacctgcagcttcatgtacggcgagctgaccgacaagaagaccatcgagaaggtgagacagaccttcgacaactacgagagcaactgcttcgaggtgctgctgtacaagaagaacagaacccccgtgtggttctacatgcagatcgcccccatcagaaacgagcacgagaaggtggtgctgttcctgtgcaccttcaaggacatcaccctgttcaagcagcccatcgaggacgacagcaccaagggctggaccaagttcgccagactgaccagagccctgaccaacagcagaagcgtgctgcagcagctgacccccatgaacaagaccgaggtggtgcacaagcacagcagactggccgaggtgctgcagctgggcagcgacatcctgccccagtacaagcaggaggcccccaagacccccccccacatcatcctgcactactgcgccttcaagaccacctgggactgggtgatcctgatcctgaccttctacaccgccatcatggtgccctacaacgtgagcttcaagaccaagcagaacaacatcgcctggctggtgctggacagcgtggtggacgtgatcttcctggtggacatcgtgctgaacttccacaccaccttcgtgggccccggcggcgaggtgatcagcgaccccaagctgatcagaatgaactacctgaagacctggttcgtgatcgacctgctgagctgcctgccctacgacatcatcaacgccttcgagaacgtggacgagggcatcagcagcctgttcagcagcctgaaggtggtgagactgctgagactgggcagagtggccagaaagctggaccactacctggagtacggcgccgccgtgctggtgctgctggtgtgcgtgttcggcctggtggcccactggctggcctgcatctggtacagcatcggcgactacgaggtgatcgacgaggtgaccaacaccatccagatcgacagctggctgtaccagctggccctgagcatcggcaccccctacagatacaacaccagcgccggcatctgggagggcggccccagcaaggacagcctgtacgtgagcagcctgtacttcaccatgaccagcctgaccaccatcggcttcggcaacatcgcccccaccaccgacgtggagaagatgttcagcgtggccatgatgatggtgggctgcaagtacttcaacttcttcatcgagaactactgctactggcagttcagctggctgcagagccagatcggctag

SEQ ID NO: 94219 - DNA, 2199 bp, Artificial Sequence
  Description of Artificial Sequence: Synthetic coding sequence
atgcccgtgagaagaggccacgtggccccccagaacaccttcctgggcaccatcatcagaaagttcgagggccagaacaagaagttcatcatcgccaacgccagagtgcagaactgcgccatcatctactgcaacgacggcttctgcgagatgaccggcttcagcagacccgacgtgatgcagaagccctgcacctgcgacttcctgcacggccccgagaccaagagacacgacatcgcccagatcgcccaggccctgctgggcagcgaggagagaaaggtggaggtgacctactaccacaagaacggcagcaccttcatctgcaacacccacatcatccccgtgaagaaccaggagggcgtggccatgatgttcatcatcaacttcgagtacgtgaccgacaacgagaacgccgccacccccgagagagtgaaccccatcctgcccatcaagaccgtgaacagaaagttcttcggcttcaagttccccggcctgagagtgctgacctacagaaagcagagcctgccccaggaggaccccgacgtggtggtgatcgacagcagcaagcacagcgacgacagcgtggccatgaagcacttcaagagccccaccaaggagagctgcagccccagcgaggccgacgacaccaaggccctgatccagcccagcaagtgcagccccctggtgaacatcagcggccccctggaccacagcagccccaagagacagtgggacagactgtaccccgacatgctgcagagcagcagccagctgagccacagcagaagcagagagagcctgtgcagcatcagaagagccagcagcgtgcacgacatcgagggcttcggcgtgcaccccaagaacatcttcagagacagacacgccagcgagggccccttcaaccacatcaagagcagcctgctgggcagcaccagcgacagcaacctgaacaagtacagcaccatcaacaagatcccccagctgaccctgaacttcagcgaggtgaagaccgagaagaagaacagcagcccccccagcagcgacaagaccatcatcgcccccaaggtgaaggacagaacccacaacgtgaccgagaaggtgacccaggtgctgagcctgggcgccgacgtgctgcccgagtacaagctgcagacccccagaatcaacaagttcaccatcctgcactacagccccttcaaggccgtgtgggactggctgatcctgctgctggtgatctacaccgccatcttcaccccctacagcgccgccttcctgctgaacgacagagaggagcagaagagaagagagtgcggctacagctgcagccccctgaacgtggtggacctgatcgtggacatcatgttcatcatcgacatcctgatcaacttcagaaccacctacgtgaaccagaacgaggaggtggtgagcgaccccgccaagatcgccatccactacttcaagggctggttcctgatcgacatggtggccgccatccccttcgacctgctgatcttcggcagcggcagcgacgagaccaccaccctgatcggcctgctgaagaccgccagactgctgagactggtgagagtggccagaaagctggacagatacagcgagtacggcgccgccgtgctgatgctgctgatgtgcatcttcgccctgatcgcccactggctggcctgcatctggtacgccatcggcaacgtggagagaccctacctgaccgacaagatcggctggctggacagcctgggccagcagatcggcaagagatacaacgacagcgacagcagcagcggccccagcatcaaggacaagtacgtgaccgccctgtacttcaccttcagcagcctgaccagcgtgggcttcggcaacgtgagccccaacaccaacagcgagaagatcttcagcatctgcgtgatgctgatcggcagcctgatgtacgccagcatcttcggcaacgtgagcgccatcatccagagactgtacagcggcaccgccagataccacatgcagatgctgagagtgaaggagttcatcagattccaccagatccccaaccccctgagacagagactggaggagtacttccagcacgcctggacctacaccaacggcatcgacatgaacatggtgtgcatgagcgtgttccagaacgagagcgccgccggcatcatcgtgatcgccaagatggagtag

SEQ ID NO: 94220 - DNA, 3591 bp, Artificial Sequence
  Description of Artificial Sequence: Synthetic coding sequence
atgcccgtgagaagaggccacgtggccccccagaacaccttcctgggcaccatcatcagaaagttcgagggccagaacaagaagttcatcatcgccaacgccagagtgcagaactgcgccatcatctactgcaacgacggcttctgcgagatgaccggcttcagcagacccgacgtgatgcagaagccctgcacctgcgacttcctgcacggccccgagaccaagagacacgacatcgcccagatcgcccaggccctgctgggcagcgaggagagaaaggtggaggtgacctactaccacaagaacggcagcaccttcatctgcaacacccacatcatccccgtgaagaaccaggagggcgtggccatgatgttcatcatcaacttcgagtacgtgaccgacaacgagaacgccgccacccccgagagagtgaaccccatcctgcccatcaagaccgtgaacagaaagttcttcggcttcaagttccccggcctgagagtgctgacctacagaaagcagagcctgccccaggaggaccccgacgtggtggtgatcgacagcagcaagcacagcgacgacagcgtggccatgaagcacttcaagagccccaccaaggagagctgcagccccagcgaggccgacgacaccaaggccctgatccagcccagcaagtgcagccccctggtgaacatcagcggccccctggaccacagcagccccaagagacagtgggacagactgtaccccgacatgctgcagagcagcagccagctgagccacagcagaagcagagagagcctgtgcagcatcagaagagccagcagcgtgcacgacatcgagggcttcggcgtgcaccccaagaacatcttcagagacagacacgccagcgaggacaacggcagaaacgtgaagggccccttcaaccacatcaagagcagcctgctgggcagcaccagcgacagcaacctgaacaagtacagcaccatcaacaagatcccccagctgaccctgaacttcagcgaggtgaagaccgagaagaagaacagcagcccccccagcagcgacaagaccatcatcgcccccaaggtgaaggacagaacccacaacgtgaccgagaaggtgacccaggtgctgagcctgggcgccgacgtgctgcccgagtacaagctgcagacccccagaatcaacaagttcaccatcctgcactacagccccttcaaggccgtgtgggactggctgatcctgctgctggtgatctacaccgccatcttcaccccctacagcgccgccttcctgctgaacgacagagaggagcagaagagaagagagtgcggctacagctgcagccccctgaacgtggtggacctgatcgtggacatcatgttcatcatcgacatcctgatcaacttcagaaccacctacgtgaaccagaacgaggaggtggtgagcgaccccgccaagatcgccatccactacttcaagggctggttcctgatcgacatggtggccgccatccccttcgacctgctgatcttcggcagcggcagcgacgagaccaccaccctgatcggcctgctgaagaccgccagactgctgagactggtgagagtggccagaaagctggacagatacagcgagtacggcgccgccgtgctgatgctgctgatgtgcatcttcgccctgatcgcccactggctggcctgcatctggtacgccatcggcaacgtggagagaccctacctgaccgacaagatcggctggctggacagcctgggccagcagatcggcaagagatacaacgacagcgacagcagcagcggccccagcatcaaggacaagtacgtgaccgccctgtacttcaccttcagcagcctgaccagcgtgggcttcggcaacgtgagccccaacaccaacagcgagaagatcttcagcatctgcgtgatgctgatcggcagcctgatgtacgccagcatcttcggcaacgtgagcgccatcatccagagactgtacagcggcaccgccagataccacatgcagatgctgagagtgaaggagttcatcagattccaccagatccccaaccccctgagacagagactggaggagtacttccagcacgcctggacctacaccaacggcatcgacatgaacatggtgctgaagggcttccccgagtgcctgcaggccgacatctgcctgcacctgaaccagaccctgctgcagaactgcaaggccttcagaggcgccagcaagggctgcctgagagccctggccatgaagttcaagaccacccacgccccccccggcgacaccctggtgcactgcggcgacgtgctgaccgccctgtacttcctgagcagaggcagcatcgagatcctgaaggacgacatcgtggtggccatcctgggcaagaacgacatcttcggcgagatggtgcacctgtacgccaagcccggcaagagcaacgccgacgtgagagccctgacctactgcgacctgcacaagatccagagagaggacctgctggaggtgctggacatgtaccccgagttcagcgaccacttcctgaccaacctggagctgaccttcaacctgagacacgagagcgccaaggccgacctgctgagaagccagagcatgaacgacagcgagggcgacaactgcaagctgagaagaagaaagctgagcttcgagagcgagggcgagaaggagaacagcaccaacgaccccgaggacagcgccgacaccatcagacactaccagagcagcaagagacacttcgaggagaagaagagcagaagcagcagcttcatcagcagcatcgacgacgagcagaagcccctgttcagcggcatcgtggacagcagccccggcatcggcaaggccagcggcctggacttcgaggagaccgtgcccaccagcggcagaatgcacatcgacaagagaagccacagctgcaaggacatcaccgacatgagaagctgggagagagagaacgcccacccccagcccgaggacagcagccccagcgccctgcagagagccgcctggggcatcagcgagaccgagagcgacctgacctacggcgaggtggagcagagactggacctgctgcaggagcagctgaacagactggagagccagatgaccaccgacatccagaccatcctgcagctgctgcagaagcagaccaccgtggtgccccccgcctacagcatggtgaccgccggcagcgagtaccagagacccatcatccagctgatgagaaccagccagcccgaggccagcatcaagaccgacagaagcttcagccccagcagccagtgccccgagttcctggacctggagaagagcaagctgaagagcaaggagagcctgagcagcggcgtgcacctgaacaccgccagcgaggacaacctgaccagcctgctgaagcaggacagcgacctgagcctggagctgcacctgagacagagaaagacctacgtgcaccccatcagacaccccagcctgcccgacagcagcctgagcaccgtgggcatcgtgggcctgcacagacacgtgagcgaccccggcctgcccggcaagtag

SEQ ID NO: 94221 - DNA, 1755 bp, Artificial Sequence
  Description of Artificial Sequence: Synthetic coding sequence
atggtggccgaggtgtgcagcatgcccaccgccagcaccgtgaagaagcccttcgacctgagaagcaagatgggcaagtggtgccaccacagattcccctgctgcagaggcagcggcaagagcaacatgggcaccagcggcgaccacgacgacagcttcatgaagatgctgagaagcaagatgggcaagtgctgcagacactgcttcccctgctgcagaggcagcggcaccagcaacgtgggcaccagcggcgaccacgagaacagcttcatgaagatgctgagaagcaagatgggcaagtggtgctgccactgcttcccctgctgcagaggcagcggcaagagcaacgtgggcgcctggggcgactacgaccacagcgccttcatggagcccagataccacatcagaagagaggacctggacaagctgcacagagccgcctggtggggcaaggtgcccagaaaggacctgatcgtgatgctgagagacaccgacatgaacaagagagacaaggagaagagaaccgccctgcacctggccagcgccaacggcaacagcgaggtggtgcagctgctgctggacagaagatgccagctgaacgtgctggacaacaagaagagaaccgccctgatcaaggccatccagtgccaggaggacgagtgcgtgctgatgctgctggagcacggcgccgacagaaacatccccgacgagtacggcaacaccgccctgcactacgccatctacaacgaggacaagctgatggccaaggccctgctgctgtacggcgccgacatcgagagcaagaacaagtgcggcctgacccccctgctgctgggcgtgcacgagcagaagcagcaggtggtgaagttcctgatcaagaagaaggccaacctgaacgtgctggacagatacggcagaaccgccctgatcctggccgtgtgctgcggcagcgccagcatcgtgaacctgctgctggagcagaacgtggacgtgagcagccaggacctgagcggccagaccgccagagagtacgccgtgagcagccaccaccacgtgatctgcgagctgctgagcgactacaaggagaagcagatgctgaagatcagcagcgagaacagcaaccccgagcaggacctgaagctgaccagcgaggaggagagccagagactgaaggtgagcgagaacagccagcccgagaagatgagccaggagcccgagatcaacaaggactgcgacagagaggtggaggaggagatcaagaagcacggcagcaaccccgtgggcctgcccgagaacctgaccaacggcgccagcgccggcaacggcgacgacggcctgatcccccagagaagaagcagaaagcccgagaaccagcagttccccgacaccgagaacgaggagtaccacagcgacgagcagaacgacaccagaaagcagctgagcgaggagcagaacaccggcatcagccaggacgagatcctgaccaacaagcagaagcagatcgaggtggccgagcagaagatgaacagcgagctgagcctgagccacaagaaggaggaggacctgctgagagagaacagcgtgctgcaggaggagatcgccatgctgagactggagctggacgagaccaagcaccagaaccagctgagagagaacaagatcctggaggagatcgagagcgtgaaggagaagaccgacaagctgctgagagccatgcagctgaacgaggaggccctgaccaagaccaacatctag

SEQ ID NO: 94222 - DNA, 1638 bp, Artificial Sequence
  Description of Artificial Sequence: Synthetic coding sequence
atggtggccgaggccggcagcatgcccgccgccagcagcgtgaagaagcccttcggcctgagaagcaagatgggcaagtggtgcagacactgcttcgcctggtgcagaggcagcggcaagagcaacgtgggcaccagcggcgaccacgacgacagcgccatgaagaccctgagaagcaagatgggcaagtggtgctgccactgcttcccctggtgcagaggcagcggcaagagcaacgtgggcaccagcggcgaccacgacgacagcgccatgaagaccctgagaagcaagatgggcaagtggtgctgccactgcttcccctgctgcagaggcagcggcaagagcaacgtgggcaccagcggcgaccacgacgacagcgccatgaagaccctgagaagcaagatgggcaagtggtgctgccactgcttcccctgctgcagaggcagcggcaagaacaaggtgggcccctggggcgactacgacgacagcgccttcatggagcccagataccacgtgagaagagaggacctggacaagctgcacagagccgcctggtggggcaaggtgcccagaaaggacctgatcgtgatgctgaaggacaccgacatgaacaagaaggacaagcagaagagaaccgccctgcacctggccagcgccaacggcaacagcgaggtggtgaagctgctgctggacagaagatgccagctgaacatcctggacaacaagaagagaaccgccctgaccaaggccgtgcagtgccaggaggacgagtgcgccctgatgctgctggagcacggcaccgaccccaacatccccgacgagtacggcaacaccgccctgcactacgccatctacaacgaggacaagctgatggccaaggccctgctgctgtacggcgccgacatcgagagcaagaacaagcacggcctgacccccctgctgctgggcgtgcacgagcagaagcagcaggtggtgaagttcctgatcaagaagaaggccaacctgaacgccctggacagatacggcagaaccgccctgatcctggccgtgtgctgcggcagcgccagcatcgtgagcctgctgctggagcagaacatcgacgtgagcagccaggacctgagcggccagaccgccagagagtacgccgtgagcagcagacacaacgtgatctgccagctgctgagcgactacaaggagaagcagatcctgaaggtgagcagcgagaacagcaaccccgagcaggacctgaagctgaccagcgaggaggagagccagagactgaagggcagcgagaacagccagcccgaggagatgagccaggagcccgagatcaacaagggcggcgacagaaaggtggaggaggagatgaagaagcacggcagcacccacatgggcttccccgagaacctgaccaacggcgccaccgccgacaacggcgacgacggcctgatcccccccagaaagagcagaacccccgagagccagcagttccccgacaccgagaacgagcagtaccacagcgacgagcagaacgacacccagaagcagctgagcgaggagcagaacaccggcatcctgcaggacgagatcctgatccacgaggagaagcagatcgaggtggccgagaacgagttctag

SEQ ID NO: 94223 - DNA, 867 bp, Artificial Sequence
  Description of Artificial Sequence: Synthetic coding sequence
atggtggccgaggccggcagcatgcccgccgccagcagcgtgaagaagcccttcggcctgagaagcaagatgggcaagtggtgcagacactgcttcgcctggtgcagaggcagcggcaagagcaacgtgggcaccagcggcgaccacgacgacagcgccatgaagaccctgagaagcaagatgggcaagtggtgctgccactgcttcccctggtgcagaggcagcggcaagagcaacgtgggcaccagcggcgaccacgacgacagcgccatgaagaccctgagaagcaagatgggcaagtggtgctgccactgcttcccctgctgcagaggcagcggcaagagcaacgtgggcaccagcggcgaccacgacgacagcgccatgaagaccctgagaagcaagatgggcaagtggtgctgccactgcttcccctgctgcagaggcagcggcaagaacaaggtgggcccctggggcgactacgacgacagcgccttcatggagcccagataccacgtgagaagagaggacctggacaagctgcacagagccgcctggtggggcaaggtgcccagaaaggacctgatcgtgatgctgaaggacaccgacatgaacaagaaggacaagcagaagagaaccgccctgcacctggccagcgccaacggcaacagcgaggtggtgaagctgctgctggacagaagatgccagctgaacatcctggacaacaagaagagaaccgccctgaccaaggccgtgcagtgccaggaggacgagtgcgccctgatgctgctggagcacggcaccgaccccaacatccccgacgagtacggcaacaccgccctgcactacgccatctacaacgaggactag

SEQ ID NO: 94224 - DNA, 1527 bp, Artificial Sequence
  Description of Artificial Sequence: Synthetic coding sequence
atggtggccgaggccggcagcatgcccgccgccagcagcgtgaagaagcccttcggcctgagaagcaagatgggcaagtggtgcagacactgcttcgcctggtgcagaggcagcggcaagagcaacgtgggcaccagcggcgaccacgacgacagcgccatgaagaccctgagaagcaagatgggcaagtggtgctgccactgcttcccctggtgcagaggcagcggcaagagcaacgtgggcaccagcggcgaccacgacgacagcgccatgaagaccctgagaagcaagatgggcaagtggtgctgccactgcttcccctgctgcagaggcagcggcaagaacaaggtgggcccctggggcgactacgacgacagcgccttcatggagcccagataccacgtgagaagagaggacctggacaagctgcacagagccgcctggtggggcaaggtgcccagaaaggacctgatcgtgatgctgaaggacaccgacatgaacaagaaggacaagcagaagagaaccgccctgcacctggccagcgccaacggcaacagcgaggtggtgaagctgctgctggacagaagatgccagctgaacatcctggacaacaagaagagaaccgccctgaccaaggccgtgcagtgccaggaggacgagtgcgccctgatgctgctggagcacggcaccgaccccaacatccccgacgagtacggcaacaccgccctgcactacgccatctacaacgaggacaagctgatggccaaggccctgctgctgtacggcgccgacatcgagagcaagaacaagcacggcctgacccccctgctgctgggcgtgcacgagcagaagcagcaggtggtgaagttcctgatcaagaagaaggccaacctgaacgccctggacagatacggcagaaccgccctgatcctggccgtgtgctgcggcagcgccagcatcgtgagcctgctgctggagcagaacatcgacgtgagcagccaggacctgagcggccagaccgccagagagtacgccgtgagcagcagacacaacgtgatctgccagctgctgagcgactacaaggagaagcagatcctgaaggtgagcagcgagaacagcaaccccgagcaggacctgaagctgaccagcgaggaggagagccagagactgaagggcagcgagaacagccagcccgaggagatgagccaggagcccgagatcaacaagggcggcgacagaaaggtggaggaggagatgaagaagcacggcagcacccacatgggcttccccgagaacctgaccaacggcgccaccgccgacaacggcgacgacggcctgatcccccccagaaagagcagaacccccgagagccagcagttccccgacaccgagaacgagcagtaccacagcgacgagcagaacgacacccagaagcagctgagcgaggagcagaacaccggcatcctgcaggacgagatcctgatccacgaggagaagcagatcgaggtggccgagaacgagttctag

SEQ ID NO: 94225 - DNA, 954 bp, Artificial Sequence
  Description of Artificial Sequence: Synthetic coding sequence
atgagctgccaggccttcaccagcgccgacaccttcatccccctgaacagcgacgccagcgccaccctgcccctgatcatgcaccacagcgccgccgagtgcctgcccgtgagcaaccacgccaccaacgtgatgagcaccgtgcccagcatcctgagcctgatccagacccccaagtgcctgtgcacccacttcagcgtgaccaccctgggcaacaccgccaccggcctgcactacagcgtgcccagctgccactacggcaaccagcccagcacctacggcgtgatggccggcagcctgaccccctgcctgtacaagttccccgaccacaccctgagccacggcttcccccccatccaccagcccctgctggccgaggaccccaccgccgccgacttcaagcaggagctgagaagaaagagcaagctggtggaggagcccatcgacatggacagccccgagatcagagagctggagaagttcgccaacgagttcaaggtgagaagaatcaagctgggctacacccagaccaacgtgggcgaggccctggccgccgtgcacggcagcgagttcagccagaccaccatctgcagattcgagaacctgcagctgagcttcaagaacgcctgcaagctgaaggccatcctgagcaagtggctggaggaggccgagcaggtgggcgccctgtacaacgagaaggtgggcgccaacgagagaaagagaaagagaagaaccaccatcagcatcgccgccaaggacgccctggagagacacttcggcgagcagaacaagcccagcagccaggagatcatgagaatggccgaggagctgaacctggagaaggaggtggtgagagtgtggttctgcaacagaagacagagagagaagagagtgaagaccagcctgaaccagagcctgttcagcatcagcaaggagcacctggagtgcagatag

SEQ ID NO: 94226 - DNA, 876 bp, Artificial Sequence
  Description of Artificial Sequence: Synthetic coding sequence
atgagctgccaggccttcaccagcgccgacaccttcatccccctgaacagcgacgccagcgccaccctgcccctgatcatgcaccacagcgccgccgagtgcctgcccgtgagcaaccacgccaccaacgtgatgagcaccgccaccggcctgcactacagcgtgcccagctgccactacggcaaccagcccagcacctacggcgtgatggccggcagcctgaccccctgcctgtacaagttccccgaccacaccctgagccacggcttcccccccatccaccagcccctgctggccgaggaccccaccgccgccgacttcaagcaggagctgagaagaaagagcaagctggtggaggagcccatcgacatggacagccccgagatcagagagctggagaagttcgccaacgagttcaaggtgagaagaatcaagctgggctacacccagaccaacgtgggcgaggccctggccgccgtgcacggcagcgagttcagccagaccaccatctgcagattcgagaacctgcagctgagcttcaagaacgcctgcaagctgaaggccatcctgagcaagtggctggaggaggccgagcaggtgggcgccctgtacaacgagaaggtgggcgccaacgagagaaagagaaagagaagaaccaccatcagcatcgccgccaaggacgccctggagagacacttcggcgagcagaacaagcccagcagccaggagatcatgagaatggccgaggagctgaacctggagaaggaggtggtgagagtgtggttctgcaacagaagacagagagagaagagagtgaagaccagcctgaaccagagcctgttcagcatcagcaaggagcacctggagtgcagatag

SEQ ID NO: 94227 - DNA, 771 bp, Artificial Sequence
  Description of Artificial Sequence: Synthetic coding sequence
atgctgtggcagaagcccaccgcccccgagcaggcccccgcccccgccagaccctaccagggcgtgagagtgaaggagcccgtgaaggagctgctgagaagaaagagaggccacgccagcagcggcgccgcccccgcccccaccgccgtggtgctgccccaccagcccctggccacctacaccaccgtgggccccagctgcctggacatggagggcagcgtgagcgccgtgaccgaggaggccgccctgtgcgccggctggctgagccagcccacccccgccaccctgcagcccctggccccctggaccccctacaccgagtacgtgccccacgaggccgtgagctgcccctacagcgccgacatgtacgtgcagcccgtgtgccccagctacaccgtggtgggccccagcagcgtgctgacctacgccagcccccccctgatcaccaacgtgaccaccagaagcagcgccacccccgccgtgggcccccccctggagggccccgagcaccaggcccccctgacctacttcccctggccccagcccctgagcaccctgcccaccagcaccctgcagtaccagccccccgcccccgccctgcccggcccccagttcgtgcagctgcccatcagcatccccgagcccgtgctgcaggacatggaggaccccagaagagccgccagcagcctgaccatcgacaagctgctgctggaggaggaggacagcgacgcctacgccctgaaccacaccctgagcgtggagggcttctag

SEQ ID NO: 94228 - DNA, 1440 bp, Artificial Sequence
  Description of Artificial Sequence: Synthetic coding sequence
atggtgcacagcagcatgggcgcccccgagatcagaatgagcaagcccctggaggccgagaagcagggcctggacagccccagcgagcacaccgacaccgagagaaacggccccgacaccaaccaccagaacccccagaacaagaccagccccttcagcgtgagccccaccggccccagcaccaagatcaaggccgaggaccccagcggcgacagcgcccccgccgcccccctgcccccccagcccgcccagccccacctgccccaggcccagctgatgctgaccggcagccagctggccggcgacatccagcagctgctgcagctgcagcagctggtgctggtgcccggccaccacctgcagccccccgcccagttcctgctgccccaggcccagcagagccagcccggcctgctgcccacccccaacctgttccagctgccccagcagacccagggcgccctgctgaccagccagcccagagccggcctgcccacccaggccgtgaccagacccaccctgcccgacccccacctgagccacccccagccccccaagtgcctggagccccccagccaccccgaggagcccagcgacctggaggagctggagcagttcgccagaaccttcaagcagagaagaatcaagctgggcttcacccagggcgacgtgggcctggccatgggcaagctgtacggcaacgacttcagccagaccaccatcagcagattcgaggccctgaacctgagcttcaagaacatgtgcaagctgaagcccctgctggagaagtggctgaacgacgccgagaccatgagcgtggacagcagcctgcccagccccaaccagctgagcagccccagcctgggcttcgacggcctgcccggcagaagaagaaagaagagaaccagcatcgagaccaacgtgagattcgccctggagaagagcttcctggccaaccagaagcccaccagcgaggagatcctgctgatcgccgagcagctgcacatggagaaggaggtgatcagagtgtggttctgcaacagaagacagaaggagaagagaatcaacccctgcagcgccgcccccatgctgcccagccccggcaagcccgccagctacagcccccacatggtgaccccccagggcggcgccggcaccctgcccctgagccaggccagcagcagcctgagcaccaccgtgaccaccctgagcagcgccgtgggcaccctgcaccccagcagaaccgccggcggcggcggcggcggcggcggcgccgccccccccctgaacagcatccccagcgtgaccccccccccccccgccaccaccaacagcaccaaccccagcccccagggcagccacagcgccatcggcctgagcggcctgaaccccagcaccggccccggcctgtggtggaaccccgccccctaccagccctag

SEQ ID NO: 94229 - DNA, 1809 bp, Artificial Sequence
  Description of Artificial Sequence: Synthetic coding sequence
atggtgcacagcagcatgggcgcccccgagatcagaatgagcaagcccctggaggccgagaagcagggcctggacagccccagcgagcacaccgacaccgagagaaacggccccgacaccaaccaccagaacccccagaacaagaccagccccttcagcgtgagccccaccggccccagcaccaagatcaaggccgaggaccccagcggcgacagcgcccccgccgcccccctgcccccccagcccgcccagccccacctgccccaggcccagctgatgctgaccggcagccagctggccggcgacatccagcagctgctgcagctgcagcagctggtgctggtgcccggccaccacctgcagccccccgcccagttcctgctgccccaggcccagcagagccagcccggcctgctgcccacccccaacctgttccagctgccccagcagacccagggcgccctgctgaccagccagcccagagccggcctgcccacccaggccgtgaccagacccaccctgcccgacccccacctgagccacccccagccccccaagtgcctggagccccccagccaccccgaggagcccagcgacctggaggagctggagcagttcgccagaaccttcaagcagagaagaatcaagctgggcttcacccagggcgacgtgggcctggccatgggcaagctgtacggcaacgacttcagccagaccaccatcagcagattcgaggccctgaacctgagcttcaagaacatgtgcaagctgaagcccctgctggagaagtggctgaacgacgccgagaccatgagcgtggacagcagcctgcccagccccaaccagctgagcagccccagcctgggcttcgacggcctgcccggcagaagaagaaagaagagaaccagcatcgagaccaacgtgagattcgccctggagaagagcttcctggccaaccagaagcccaccagcgaggagatcctgctgatcgccgagcagctgcacatggagaaggaggtgatcagagtgtggttctgcaacagaagacagaaggagaagagaatcaacccctgcagcgccgcccccatgctgcccagccccggcaagcccgccagctacagcccccacatggtgaccccccagggcggcgccggcaccctgcccctgagccaggccagcagcagcctgagcaccaccgtgaccaccctgagcagcgccgtgggcaccctgcaccccagcagaaccgccggcggcggcggcggcggcggcggcgccgccccccccctgaacagcatccccagcgtgaccccccccccccccgccaccaccaacagcaccaaccccagcccccagggcagccacagcgccatcggcctgagcggcctgaaccccagcaccggcagcaccatggtgggcctgagcagcggcctgagccccgccctgatgagcaacaaccccctggccaccatccaggccctggccagcggcggcaccctgcccctgaccagcctggacggcagcggcaacctggtgctgggcgccgccggcgccgcccccggcagccccggcctggtgaccagccccctgttcctgaaccacgccggcctgcccctgctgagcaccccccccggcgtgggcctggtgagcgccgccgccgccgccgtggccgccagcatcagcagcaagagccccggcctgagcagcagcagcagcagcagcagcagcagcagcagcagcacctgcagcgagaccgccgcccagacccccggcggccccggcggccccgaggccggcagcaagcccgagtag

SEQ ID NO: 94230 - DNA, 1392 bp, Artificial Sequence
  Description of Artificial Sequence: Synthetic coding sequence
atggtgcacagcagcatgggcgcccccgagatcagaatgagcaagcccctggaggccgagaagcagggcctggacagccccagcgagcacaccgacaccgagagaaacggccccgacaccaaccaccagaacccccagaacaagaccagccccttcagcgtgagccccaccggccccagcaccaagatcaaggccgaggaccccagcggcgacagcgcccccgccgcccccctgcccccccagcccgcccagccccacctgccccaggcccagctgatgctgaccggcagccagctggccggcgacatccagcagctgctgcagctgcagcagctggtgctggtgcccggccaccacctgcagccccccgcccagttcctgctgccccaggcccagcagagccagcccggcctgctgcccacccccaacctgttccagctgccccagcagacccagggcgccctgctgaccagccagcccagagccggcctgcccacccagccccccaagtgcctggagccccccagccaccccgaggagcccagcgacctggaggagctggagcagttcgccagaaccttcaagcagagaagaatcaagctgggcttcacccagggcgacgtgggcctggccatgggcaagctgtacggcaacgacttcagccagaccaccatcagcagattcgaggccctgaacctgagcttcaagaacatgtgcaagctgaagcccctgctggagaagtggctgaacgacgccgagaccatgagcgtggacagcagcctgcccagccccaaccagctgagcagccccagcctgggcttcgacggcctgcccggcagaagaagaaagaagagaaccagcatcgagaccaacgtgagattcgccctggagaagagcttcctggccaaccagaagcccaccagcgaggagatcctgctgatcgccgagcagctgcacatggagaaggaggtgatcagagtgtggttctgcaacagaagacagaaggagaagagaatcaacccctgcagcgccgcccccatgctgcccagccccggcaagcccgccagctacagcccccacatggtgaccccccagggcggcgccggcaccctgcccctgagccaggccagcagcagcctgagcaccaccgtgaccaccctgagcagcgccgtgggcaccctgcaccccagcagaaccgccggcggcggcggcggcggcggcggcgccgccccccccctgaacagcatccccagcgtgaccccccccccccccgccaccaccaacagcaccaaccccagcccccagggcagccacagcgccatcggcctgagcggcctgaaccccagcaccggccccggcctgtggtggaaccccgccccctaccagccctag

SEQ ID NO: 94231 - DNA, 1425 bp, Artificial Sequence
  Description of Artificial Sequence: Synthetic coding sequence
atgggcgcccccgagatcagaatgagcaagcccctggaggccgagaagcagggcctggacagccccagcgagcacaccgacaccgagagaaacggccccgacaccaaccaccagaacccccagaacaagaccagccccttcagcgtgagccccaccggccccagcaccaagatcaaggccgaggaccccagcggcgacagcgcccccgccgcccccctgcccccccagcccgcccagccccacctgccccaggcccagctgatgctgaccggcagccagctggccggcgacatccagcagctgctgcagctgcagcagctggtgctggtgcccggccaccacctgcagccccccgcccagttcctgctgccccaggcccagcagagccagcccggcctgctgcccacccccaacctgttccagctgccccagcagacccagggcgccctgctgaccagccagcccagagccggcctgcccacccaggccgtgaccagacccaccctgcccgacccccacctgagccacccccagccccccaagtgcctggagccccccagccaccccgaggagcccagcgacctggaggagctggagcagttcgccagaaccttcaagcagagaagaatcaagctgggcttcacccagggcgacgtgggcctggccatgggcaagctgtacggcaacgacttcagccagaccaccatcagcagattcgaggccctgaacctgagcttcaagaacatgtgcaagctgaagcccctgctggagaagtggctgaacgacgccgagaccatgagcgtggacagcagcctgcccagccccaaccagctgagcagccccagcctgggcttcgacggcctgcccggcagaagaagaaagaagagaaccagcatcgagaccaacgtgagattcgccctggagaagagcttcctggccaaccagaagcccaccagcgaggagatcctgctgatcgccgagcagctgcacatggagaaggaggtgatcagagtgtggttctgcaacagaagacagaaggagaagagaatcaacccctgcagcgccgcccccatgctgcccagccccggcaagcccgccagctacagcccccacatggtgaccccccagggcggcgccggcaccctgcccctgagccaggccagcagcagcctgagcaccaccgtgaccaccctgagcagcgccgtgggcaccctgcaccccagcagaaccgccggcggcggcggcggcggcggcggcgccgccccccccctgaacagcatccccagcgtgaccccccccccccccgccaccaccaacagcaccaaccccagcccccagggcagccacagcgccatcggcctgagcggcctgaaccccagcaccggccccggcctgtggtggaaccccgccccctaccagccctag

SEQ ID NO: 94232 - DNA, 1203 bp, Artificial Sequence
  Description of Artificial Sequence: Synthetic coding sequence
atggtgcacagcagcatgggcgcccccgagatcagaatgagcaagcccctggaggccgagaagcagggcctggacagccccagcgagcacaccgacaccgagagaaacggccccgacaccaaccaccagaacccccagaacaagaccagccccttcagcgtgagccccaccggccccagcaccaagatcaaggccgaggaccccagcggcgacagcgcccccgccgcccccctgcccccccagcccgcccagccccacctgccccaggcccagctgatgctgaccggcagccagctggccggcgacatccagcagctgctgcagctgcagcagctggtgctggtgcccggccaccacctgcagccccccgcccagttcctgctgccccaggcccagcagagccagcccggcctgctgcccacccccaacctgttccagctgccccagcagacccagggcgccctgctgaccagccagcccagagccggcctgcccacccagccccccaagtgcctggagccccccagccaccccgaggagcccagcgacctggaggagctggagcagttcgccagaaccttcaagcagagaagaatcaagctgggcttcacccagggcgacgtgggcctggccatgggcaagctgtacggcaacgacttcagccagaccaccatcagcagattcgaggccctgaacctgagcttcaagaacatgtgcaagctgaagcccctgctggagaagtggctgaacgacgccgagaccatgagcgtggacagcagcctgcccagccccaaccagctgagcagccccagcctgggcttcgacggcctgcccggcagaagaagaaagaagagaaccagcatcgagaccaacgtgagattcgccctggagaagagcttcctggccaaccagaagcccaccagcgaggagatcctgctgatcgccgagcagctgcacatggagaaggaggtgatcagagtgtggttctgcaacagaagacagaaggagaagagaatcaacccctgcagcgccgcccccatgctgcccagccccggcaagcccgccagctacagcccccacatggtgaccccccagggcggcgccggcaccctgcccctgagccaggccagcagcagcctgagcaccaccgcccagacccccgccctgaaggccgccaccagactgagcgcctgccaggcctag

SEQ ID NO: 94233 - DNA, 1404 bp, Artificial Sequence
  Description of Artificial Sequence: Synthetic coding sequence
atggtgcacagcagcatgggcgcccccgagatcagaatgagcaagcccctggaggccgagaagcagggcctggacagccccagcgagcacaccgacaccgagagaaacggccccgacaccaaccaccagaacccccagaacaagaccagccccttcagcgtgagccccaccggccccagcaccaagatcaaggccgaggaccccagcggcgacagcgcccccgccgcccccctgcccccccagcccgcccagccccacctgccccaggcccagctgatgctgaccggcagccagctggccggcgacatccagcagctgctgcagctgcagcagctggtgctggtgcccggccaccacctgcagccccccgcccagttcctgctgccccaggcccagcagagccagcccggcctgctgcccacccccaacctgttccagctgccccagcagacccagggcgccctgctgaccagccagcccagagccggcctgcccacccaggccgtgaccagacccaccctgcccgacccccacctgagccacccccagccccccaagtgcctggagccccccagccaccccgaggagcccagcgacctggaggagctggagcagttcgccagaaccttcaagcagagaagaatcaagctgggcttcacccagggcgacgtgggcctggccatgggcaagctgtacggcaacgacttcagccagaccaccatcagcagattcgaggccctgaacctgagcttcaagaacatgtgcaagctgaagcccctgctggagaagtggctgaacgacgccgagaccatgagcgtggacagcagcctgcccagccccaaccagctgagcagccccagcctgggcttcgacggcctgcccggcagaagaagaaagaagagaaccagcatcgagaccaacgtgagattcgccctggagaagagcttcctggccaaccagaagcccaccagcgaggagatcctgctgatcgccgagcagctgcacatggagaaggaggtgatcagagtgtggttctgcaacagaagacagaaggagaagagaatcaacccctgcagcgccgcccccatgctgcccagccccggcaagcccgccagctacagcccccacatggtgaccccccagggcggcgccggcaccctgcccctgagccaggccagcagcagcctgagcaccaccgtgaccaccctgagcagcgccgtgggcaccctgcaccccagcagaaccgccggcggcggcggcggcggcggcggcgccgccccccccctgaacagcatccccagcgtgaccccccccccccccgccaccaccaacagcaccaaccccagcccccagggcagccacagcgccatcggcctgagcggcctgaaccccagcaccggctag

SEQ ID NO: 94234 - DNA, 1761 bp, Artificial Sequence
  Description of Artificial Sequence: Synthetic coding sequence
atggtgcacagcagcatgggcgcccccgagatcagaatgagcaagcccctggaggccgagaagcagggcctggacagccccagcgagcacaccgacaccgagagaaacggccccgacaccaaccaccagaacccccagaacaagaccagccccttcagcgtgagccccaccggccccagcaccaagatcaaggccgaggaccccagcggcgacagcgcccccgccgcccccctgcccccccagcccgcccagccccacctgccccaggcccagctgatgctgaccggcagccagctggccggcgacatccagcagctgctgcagctgcagcagctggtgctggtgcccggccaccacctgcagccccccgcccagttcctgctgccccaggcccagcagagccagcccggcctgctgcccacccccaacctgttccagctgccccagcagacccagggcgccctgctgaccagccagcccagagccggcctgcccacccagccccccaagtgcctggagccccccagccaccccgaggagcccagcgacctggaggagctggagcagttcgccagaaccttcaagcagagaagaatcaagctgggcttcacccagggcgacgtgggcctggccatgggcaagctgtacggcaacgacttcagccagaccaccatcagcagattcgaggccctgaacctgagcttcaagaacatgtgcaagctgaagcccctgctggagaagtggctgaacgacgccgagaccatgagcgtggacagcagcctgcccagccccaaccagctgagcagccccagcctgggcttcgacggcctgcccggcagaagaagaaagaagagaaccagcatcgagaccaacgtgagattcgccctggagaagagcttcctggccaaccagaagcccaccagcgaggagatcctgctgatcgccgagcagctgcacatggagaaggaggtgatcagagtgtggttctgcaacagaagacagaaggagaagagaatcaacccctgcagcgccgcccccatgctgcccagccccggcaagcccgccagctacagcccccacatggtgaccccccagggcggcgccggcaccctgcccctgagccaggccagcagcagcctgagcaccaccgtgaccaccctgagcagcgccgtgggcaccctgcaccccagcagaaccgccggcggcggcggcggcggcggcggcgccgccccccccctgaacagcatccccagcgtgaccccccccccccccgccaccaccaacagcaccaaccccagcccccagggcagccacagcgccatcggcctgagcggcctgaaccccagcaccggcagcaccatggtgggcctgagcagcggcctgagccccgccctgatgagcaacaaccccctggccaccatccaggccctggccagcggcggcaccctgcccctgaccagcctggacggcagcggcaacctggtgctgggcgccgccggcgccgcccccggcagccccggcctggtgaccagccccctgttcctgaaccacgccggcctgcccctgctgagcaccccccccggcgtgggcctggtgagcgccgccgccgccgccgtggccgccagcatcagcagcaagagccccggcctgagcagcagcagcagcagcagcagcagcagcagcagcagcacctgcagcgagaccgccgcccagacccccggcggccccggcggccccgaggccggcagcaagcccgagtag

SEQ ID NO: 94235 - DNA, 1311 bp, Artificial Sequence
  Description of Artificial Sequence: Synthetic coding sequence
atggtgaacctggagagcatgcacaccgacatcaagatgagcggcgacgtggccgacagcaccgacgccagaagcaccctgagccaggtggagcccggcaacgacagaaacggcctggacttcaacagacagatcaagaccgaggacctgagcgacagcctgcagcagaccctgagccacagaccctgccacctgagccagggccccgccatgatgagcggcaaccagatgagcggcctgaacgccagcccctgccaggacatggccagcctgcaccccctgcagcagctggtgctggtgcccggccacctgcagagcgtgagccagttcctgctgagccagacccagcccggccagcagggcctgcagcccaacctgctgcccttcccccagcagcagagcggcctgctgctgccccagaccggccccggcctggccagccaggccttcggccaccccggcctgcccggcagcagcctggagccccacctggaggccagccagcacctgcccgtgcccaagcacctgcccagcagcggcggcgccgacgagcccagcgacctggaggagctggagaagttcgccaagaccttcaagcagagaagaatcaagctgggcttcacccagggcgacgtgggcctggccatgggcaagctgtacggcaacgacttcagccagaccaccatcagcagattcgaggccctgaacctgagcttcaagaacatgtgcaagctgaagcccctgctggagaagtggctgaacgacgccgagagcagccccagcgaccccagcgtgagcacccccagcagctaccccagcctgagcgaggtgttcggcagaaagagaaagaagagaaccagcatcgagaccaacatcagactgaccctggagaagagattccaggacaaccccaagcccagcagcgaggagatcagcatgatcgccgagcagctgagcatggagaaggaggtggtgagagtgtggttctgcaacagaagacagaaggagaagagaatcaactgccccgtggccacccccatcaagccccccgtgtacaacagcagactggtgagccccagcggcagcctgggccccctgagcgtgccccccgtgcacagcaccatgcccggcaccgtgaccagcagctgcagccccggcaacaacagcagacccagcagccccggcagcggcctgcacgccagcagccccaccgccagccagaacaacagcaaggccgccgtgaacagcgccagcagcttcaacagcagcggcagctggtacagatggaaccacagcacctacctgcactag

SEQ ID NO: 94236 - DNA, 1317 bp, Artificial Sequence
  Description of Artificial Sequence: Synthetic coding sequence
atggagagccccagaaccgccaagggcggcagagacatcaagatgagcggcgacgtggccgacagcaccgacgccagaagcaccctgagccaggtggagcccggcaacgacagaaacggcctggacttcaacagacagatcaagaccgaggacctgagcgacagcctgcagcagaccctgagccacagaccctgccacctgagccagggccccgccatgatgagcggcaaccagatgagcggcctgaacgccagcccctgccaggacatggccagcctgcaccccctgcagcagctggtgctggtgcccggccacctgcagagcgtgagccagttcctgctgagccagacccagcccggccagcagggcctgcagcccaacctgctgcccttcccccagcagcagagcggcctgctgctgccccagaccggccccggcctggccagccaggccttcggccaccccggcctgcccggcagcagcctggagccccacctggaggccagccagcacctgcccgtgcccaagcacctgcccagcagcggcggcgccgacgagcccagcgacctggaggagctggagaagttcgccaagaccttcaagcagagaagaatcaagctgggcttcacccagggcgacgtgggcctggccatgggcaagctgtacggcaacgacttcagccagaccaccatcagcagattcgaggccctgaacctgagcttcaagaacatgtgcaagctgaagcccctgctggagaagtggctgaacgacgccgagagcagccccagcgaccccagcgtgagcacccccagcagctaccccagcctgagcgaggtgttcggcagaaagagaaagaagagaaccagcatcgagaccaacatcagactgaccctggagaagagattccaggacaaccccaagcccagcagcgaggagatcagcatgatcgccgagcagctgagcatggagaaggaggtggtgagagtgtggttctgcaacagaagacagaaggagaagagaatcaactgccccgtggccacccccatcaagccccccgtgtacaacagcagactggtgagccccagcggcagcctgggccccctgagcgtgccccccgtgcacagcaccatgcccggcaccgtgaccagcagctgcagccccggcaacaacagcagacccagcagccccggcagcggcctgcacgccagcagccccaccgccagccagaacaacagcaaggccgccgtgaacagcgccagcagcttcaacagcagcggcagctggtacagatggaaccacagcacctacctgcactag

SEQ ID NO: 94237 - DNA, 1356 bp, Artificial Sequence
  Description of Artificial Sequence: Synthetic coding sequence
atggccaccaccgcccagtacctgcccagaggccccggcggcggcgccggcggcaccggccccctgatgcaccccgacgccgccgccgccgccgccgccgccgccgccgccgagagactgcacgccggcgccgcctacagagaggtgcagaagctgatgcaccacgagtggctgggcgccggcgccggccaccccgtgggcctggcccacccccagtggctgcccaccggcggcggcggcggcggcgactgggccggcggcccccacctggagcacggcaaggccggcggcggcggcaccggcagagccgacgacggcggcggcggcggcggcttccacgccagactggtgcaccagggcgccgcccacgccggcgccgcctgggcccagggcagcaccgcccaccacctgggccccgccatgagccccagccccggcgccagcggcggccaccagccccagcccctgggcctgtacgcccaggccgcctaccccggcggcggcggcggcggcctggccggcatgctggccgccggcggcggcggcgccggccccggcctgcaccacgccctgcacgaggacggccacgaggcccagctggagcccagcccccccccccacctgggcgcccacggccacgcccacggccacgcccacgccggcggcctgcacgccgccgccgcccacctgcaccccggcgccggcggcggcggcagcagcgtgggcgagcacagcgacgaggacgcccccagcagcgacgacctggagcagttcgccaagcagttcaagcagagaagaatcaagctgggcttcacccaggccgacgtgggcctggccctgggcaccctgtacggcaacgtgttcagccagaccaccatctgcagattcgaggccctgcagctgagcttcaagaacatgtgcaagctgaagcccctgctgaacaagtggctggaggagaccgacagcagcagcggcagccccaccaacctggacaagatcgccgcccagggcagaaagagaaagaagagaaccagcatcgaggtgggcgtgaagggcgccctggagagccacttcctgaagtgccccaagcccagcgcccacgagatcaccggcctggccgacagcctgcagctggagaaggaggtggtgagagtgtggttctgcaacagaagacagaaggagaagagaatgacccccgccgccggcgccggccacccccccatggacgacgtgtacgcccccggcgagctgggccccggcggcggcggcgccagcccccccagcgccccccccccccccccccccgccgccctgcaccaccaccaccaccacaccctgcccggcagcgtgcagtag

SEQ ID NO: 94238 - DNA, 1332 bp, Artificial Sequence
  Description of Artificial Sequence: Synthetic coding sequence
atggccaccgccgccagcaaccactacagcctgctgaccagcagcgccagcatcgtgcacgccgagccccccggcggcatgcagcagggcgccggcggctacagagaggcccagagcctggtgcagggcgactacggcgccctgcagagcaacggccaccccctgagccacgcccaccagtggatcaccgccctgagccacggcggcggcggcggcggcggcggcggcggcggcggcggcggcggcggcggcggcggcggcggcgacggcagcccctggagcaccagccccctgggccagcccgacatcaagcccagcgtggtggtgcagcagggcggcagaggcgacgagctgcacggccccggcgccctgcagcagcagcaccagcagcagcagcagcagcagcagcagcagcagcagcagcagcagcagcagcagcagcagcagagacccccccacctggtgcaccacgccgccaaccaccaccccggccccggcgcctggagaagcgccgccgccgccgcccacctgccccccagcatgggcgccagcaacggcggcctgctgtacagccagcccagcttcaccgtgaacggcatgctgggcgccggcggccagcccgccggcctgcaccaccacggcctgagagacgcccacgacgagccccaccacgccgaccaccacccccacccccacagccacccccaccagcagccccccccccccccccccccccagggcccccccggccaccccggcgcccaccacgacccccacagcgacgaggacacccccaccagcgacgacctggagcagttcgccaagcagttcaagcagagaagaatcaagctgggcttcacccaggccgacgtgggcctggccctgggcaccctgtacggcaacgtgttcagccagaccaccatctgcagattcgaggccctgcagctgagcttcaagaacatgtgcaagctgaagcccctgctgaacaagtggctggaggaggccgacagcagcagcggcagccccaccagcatcgacaagatcgccgcccagggcagaaagagaaagaagagaaccagcatcgaggtgagcgtgaagggcgccctggagagccacttcctgaagtgccccaagcccagcgcccaggagatcaccagcctggccgacagcctgcagctggagaaggaggtggtgagagtgtggttctgcaacagaagacagaaggagaagagaatgaccccccccggcggcaccctgcccggcgccgaggacgtgtacggcggcagcagagacacccccccccaccacggcgtgcagacccccgtgcagtag

SEQ ID NO: 94239 - DNA, 1131 bp, Artificial Sequence
  Description of Artificial Sequence: Synthetic coding sequence
atggccaccgccgccagcaaccactacagcctgctgaccagcagcgccagcatcgtgcacgccgagccccccggcggcatgcagcagggcgccggcggctacagagaggcccagagcctggtgcagggcgactacggcgccctgcagagcaacggccaccccctgagccacgcccaccagtggatcaccgccctgagccacggcggcgacggcagcccctggagcaccagccccctgggccagcccgacatcaagcccagcgtggtggtgcagcagggcggcagaggcgacgagctgcacggccccggcgccctgcagcagcagcaccagcagcagcagcagcagcagcagcagcagcagcagcagcagcagcagcagcagcagcagcagagacccccccacctggtgcaccacgccgccaaccaccaccccggccccggcgcctggagaagcgccgccgccgccgcccacctgccccccagcatgggcgccagcaacggcggcctgctgtacagccagccccccccccccccccagggcccccccggccaccccggcgcccaccacgacccccacagcgacgaggacacccccaccagcgacgacctggagcagttcgccaagcagttcaagcagagaagaatcaagctgggcttcacccaggccgacgtgggcctggccctgggcaccctgtacggcaacgtgttcagccagaccaccatctgcagattcgaggccctgcagctgagcttcaagaacatgtgcaagctgaagcccctgctgaacaagtggctggaggaggccgacagcagcagcggcagccccaccagcatcgacaagatcgccgcccagggcagaaagagaaagaagagaaccagcatcgaggtgagcgtgaagggcgccctggagagccacttcctgaagtgccccaagcccagcgcccaggagatcaccagcctggccgacagcctgcagctggagaaggaggtggtgagagtgtggttctgcaacagaagacagaaggagaagagaatgaccccccccggcggcaccctgcccggcgccgaggacgtgtacggcggcagcagagacacccccccccaccacggcgtgcagacccccgtgcagtag

SEQ ID NO: 94240 - DNA, 1503 bp, Artificial Sequence
  Description of Artificial Sequence: Synthetic coding sequence
atggccaccgccgccagcaacccctacctgcccggcaacagcctgctggccgccggcagcatcgtgcacagcgacgccgccggcgccggcggcggcggcggcggcggcggcggcggcggcggcggcggcgccggcggcggcggcggcggcatgcagcccggcagcgccgccgtgaccagcggcgcctacagaggcgaccccagcagcgtgaagatggtgcagagcgacttcatgcagggcgccatggccgccagcaacggcggccacatgctgagccacgcccaccagtgggtgaccgccctgccccacgccgccgccgccgccgccgccgccgccgccgccgccgtggaggccagcagcccctggagcggcagcgccgtgggcatggccggcagcccccagcagcccccccagcccccccccccccccccccagggccccgacgtgaagggcggcgccggcagagacgacctgcacgccggcaccgccctgcaccacagaggccccccccacctgggccccccccccccccccccccaccagggccaccccggcggctggggcgccgccgccgccgccgccgccgccgccgccgccgccgccgccgccgcccacctgcccagcatggccggcggccagcagccccccccccagagcctgctgtacagccagcccggcggcttcaccgtgaacggcatgctgagcgccccccccggccccggcggcggcggcggcggcgccggcggcggcgcccagagcctggtgcaccccggcctggtgagaggcgacacccccgagctggccgagcaccaccaccaccaccaccaccacgcccacccccaccccccccacccccaccacgcccagggccccccccaccacggcggcggcggcggcggcgccggccccggcctgaacagccacgacccccacagcgacgaggacacccccaccagcgacgacctggagcagttcgccaagcagttcaagcagagaagaatcaagctgggcttcacccaggccgacgtgggcctggccctgggcaccctgtacggcaacgtgttcagccagaccaccatctgcagattcgaggccctgcagctgagcttcaagaacatgtgcaagctgaagcccctgctgaacaagtggctggaggaggccgacagcagcaccggcagccccaccagcatcgacaagatcgccgcccagggcagaaagagaaagaagagaaccagcatcgaggtgagcgtgaagggcgccctggagagccacttcctgaagtgccccaagcccagcgcccaggagatcaccaacctggccgacagcctgcagctggagaaggaggtggtgagagtgtggttctgcaacagaagacagaaggagaagagaatgaccccccccggcatccagcagcagacccccgacgacgtgtacagccaggtgggcaccgtgagcgccgacaccccccccccccaccacggcctgcagaccagcgtgcagtag

SEQ ID NO: 94241 - DNA, 1086 bp, Artificial Sequence
  Description of Artificial Sequence: Synthetic coding sequence
atggccaccgccgccagcaacccctacagcatcctgagcagcaccagcctggtgcacgccgacagcgccggcatgcagcagggcagccccttcagaaacccccagaagctgctgcagagcgactacctgcagggcgtgcccagcaacggccaccccctgggccaccactgggtgaccagcctgagcgacggcggcccctggagcagcaccctggccaccagccccctggaccagcaggacgtgaagcccggcagagaggacctgcagctgggcgccatcatccaccacagaagcccccacgtggcccaccacagcccccacaccaaccaccccaacgcctggggcgccagccccgcccccaaccccagcatcaccagcagcggccagcccctgaacgtgtacagccagcccggcttcaccgtgagcggcatgctggagcacggcggcctgacccccccccccgccgccgccagcgcccagagcctgcaccccgtgctgagagagccccccgaccacggcgagctgggcagccaccactgccaggaccacagcgacgaggagacccccaccagcgacgagctggagcagttcgccaagcagttcaagcagagaagaatcaagctgggcttcacccaggccgacgtgggcctggccctgggcaccctgtacggcaacgtgttcagccagaccaccatctgcagattcgagggcctgcagctgagcttcaagaacatgtgcaagctgaagcccctgctgaacaagtggctggaggaggccgacagcagcaccggcagccccaccagcatcgacaagatcgccgcccagggcagaaagagaaagaagagaaccagcatcgaggtgagcgtgaagggcgtgctggagacccacttcctgaagtgccccaagcccgccgcccaggagatcagcagcctggccgacagcctgcagctggagaaggaggtggtgagagtgtggttctgcaacagaagacagaaggagaagagaatgaccccccccggcgaccagcagccccacgaggtgtacagccacaccgtgaagaccgacaccagctgccacgacctgtag

SEQ ID NO: 94242 - DNA, 1260 bp, Artificial Sequence
  Description of Artificial Sequence: Synthetic coding sequence
atgatgagcatgaacagcaagcagccccacttcgccatgcaccccaccctgcccgagcacaagtaccccagcctgcacagcagcagcgaggccatcagaagagcctgcctgcccaccccccccctgcagagcaacctgttcgccagcctggacgagaccctgctggccagagccgaggccctggccgccgtggacatcgccgtgagccagggcaagagccaccccttcaagcccgacgccacctaccacaccatgaacagcgtgccctgcaccagcaccagcaccgtgcccctggcccaccaccaccaccaccaccaccaccaccaggccctggagcccggcgacctgctggaccacatcagcagccccagcctggccctgatggccggcgccggcggcgccggcgccgccgccggcggcggcggcgcccacgacggccccggcggcggcggcggccccggcggcggcggcggccccggcggcggccccggcggcggcggcggcggcggccccggcggcggcggcggcggccccggcggcggcctgctgggcggcagcgcccacccccacccccacatgcacagcctgggccacctgagccaccccgccgccgccgccgccatgaacatgcccagcggcctgccccaccccggcctggtggccgccgccgcccaccacggcgccgccgccgccgccgccgccgccgccgccggccaggtggccgccgccagcgccgccgccgccgtggtgggcgccgccggcctggccagcatctgcgacagcgacaccgaccccagagagctggaggccttcgccgagagattcaagcagagaagaatcaagctgggcgtgacccaggccgacgtgggcagcgccctggccaacctgaagatccccggcgtgggcagcctgagccagagcaccatctgcagattcgagagcctgaccctgagccacaacaacatgatcgccctgaagcccatcctgcaggcctggctggaggaggccgagggcgcccagagagagaagatgaacaagcccgagctgttcaacggcggcgagaagaagagaaagagaaccagcatcgccgcccccgagaagagaagcctggaggcctacttcgccgtgcagcccagacccagcagcgagaagatcgccgccatcgccgagaagctggacctgaagaagaacgtggtgagagtgtggttctgcaaccagagacagaagcagaagagaatgaagttcagcgccacctactag

SEQ ID NO: 94243 - DNA, 1911 bp, Artificial Sequence
  Description of Artificial Sequence: Synthetic coding sequence
atgaagaagctgcagggcgcccacctgagaaagcccgtgacccccgacctgctgatgacccccagcgaccagggcgacgtggacctggacgtggacttcgccgcccacagaggcaactggaccggcaagctggacttcctgctgagctgcatcggctactgcgtgggcctgggcaacgtgtggagattcccctacagagcctacaccaacggcggcggcgccttcctggtgccctacttcctgatgctggccatctgcggcatccccctgttcttcctggagctgagcctgggccagttcagcagcctgggccccctggccgtgtggaagatcagccccctgttcaagggcgccggcgccgccatgctgctgatcgtgggcctggtggccatctactacaacatgatcatcgcctacgtgctgttctacctgttcgccagcctgaccagcgacctgccctgggagcactgcggcaactggtggaacaccgagctgtgcctggagcacagagtgagcaaggacggcaacggcgccctgcccctgaacctgacctgcaccgtgagccccagcgaggagtactggagcagatacgtgctgcacatccagggcagccagggcatcggcagccccggcgagatcagatggaacctgtgcctgtgcctgctgctggcctgggtgatcgtgttcctgtgcatcctgaagggcgtgaagagcagcggcaaggtggtgtacttcaccgccaccttcccctacctgatcctgctgatgctgctggtgagaggcgtgaccctgcccggcgcctggaagggcatccagttctacctgaccccccagttccaccacctgctgagcagcaaggtgtggatcgaggccgccctgcagatcttctacagcctgggcgtgggcttcggcggcctgctgaccttcgccagctacaacaccttccaccagaacatctacagagacaccttcatcgtgaccctgggcaacgccatcaccagcatcctggccggcttcgccatcttcagcgtgctgggctacatgagccaggagctgggcgtgcccgtggaccaggtggccaaggccggccccggcctggccttcgtggtgtacccccaggccatgaccatgctgcccctgagccccttctggagcttcctgttcttcttcatgctgctgaccctgggcctggacagccagttcgccttcctggagaccatcgtgaccgccgtgaccgacgagttcccctactacctgagacccaagaaggccgtgttcagcggcctgatctgcgtggccatgtacctgatgggcctgatcctgaccaccgacggcggcatgtactggctggtgctgctggacgactacagcgccagcttcggcctgatggtggtggtgatcaccacctgcctggccgtgaccagagtgtacggcatccagagattctgcagagacatccacatgatgctgggcttcaagcccggcctgtacttcagagcctgctggctgttcctgagccccgccaccctgctggccctgatggtgtacagcatcgtgaagtaccagcccagcgagtacggcagctacagattccccccctgggccgagctgctgggcatcctgatgggcctgctgagctgcctgatgatccccgccggcatgctggtggccgtgctgagagaggagggcagcctgtgggagagactgcagcaggccagcagacccgccatggactggggccccagcctggaggagaacagaaccggcatgtacgtggccaccctggccggcagccagagccccaagcccctgatggtgcacatgagaaagtacggcggcatcaccagcttcgagaacaccgccatcgaggtggacagagagatcgccgaggaggaggagagcatgatgtag

SEQ ID NO: 94244 - DNA, 798 bp, Artificial Sequence
  Description of Artificial Sequence: Synthetic coding sequence
atgcacttctacagactgttcctgggcgccaccagaagattcctgaaccccgagtggaagggcgagatcgacaactggtgcgtgtacgtgctgaccagcctgctgcccttcaagatccagagccaggacatcaaggccctgcagaaggagctggagcagttcgccaagctgctgaagcagaagagaatcaccctgggctacacccaggccgacgtgggcctgaccctgggcgtgctgttcggcaaggtgttcagccagaccaccatctgcagattcgaggccctgcagctgagcttcaagaacatgtgcaagctgagacccctgctgcagaagtgggtggaggaggccgacaacaacgagaacctgcaggagatctgcaaggccgagaccctggtgcaggccagaaagagaaagagaaccagcatcgagaacagagtgagaggcaacctggagaacctgttcctgcagtgccccaagcccaccctgcagcagatcagccacatcgcccagcagctgggcctggagaaggacgtggtgagagtgtggttctgcaacagaagacagaagggcaagagaagcagcagcgactacgcccagagagaggacttcgaggccgccggcagccccttcagcggcggccccgtgagcttccccctggcccccggcccccacttcggcacccccggctacggcagcccccacttcaccgccctgtacagcagcgtgcccttccccgagggcgaggccttcccccccgtgagcgtgaccaccctgggcagccccatgcacagcaactag

SEQ ID NO: 94245 - DNA, 1083 bp, Artificial Sequence
  Description of Artificial Sequence: Synthetic coding sequence
atggccggccacctggccagcgacttcgccttcagccccccccccggcggcggcggcgacggccccggcggccccgagcccggctgggtggaccccagaacctggctgagcttccagggcccccccggcggccccggcatcggccccggcgtgggccccggcagcgaggtgtggggcatccccccctgcccccccccctacgagttctgcggcggcatggcctactgcggcccccaggtgggcgtgggcctggtgccccagggcggcctggagaccagccagcccgagggcgaggccggcgtgggcgtggagagcaacagcgacggcgccagccccgagccctgcaccgtgacccccggcgccgtgaagctggagaaggagaagctggagcagaaccccgaggagagccaggacatcaaggccctgcagaaggagctggagcagttcgccaagctgctgaagcagaagagaatcaccctgggctacacccaggccgacgtgggcctgaccctgggcgtgctgttcggcaaggtgttcagccagaccaccatctgcagattcgaggccctgcagctgagcttcaagaacatgtgcaagctgagacccctgctgcagaagtgggtggaggaggccgacaacaacgagaacctgcaggagatctgcaaggccgagaccctggtgcaggccagaaagagaaagagaaccagcatcgagaacagagtgagaggcaacctggagaacctgttcctgcagtgccccaagcccaccctgcagcagatcagccacatcgcccagcagctgggcctggagaaggacgtggtgagagtgtggttctgcaacagaagacagaagggcaagagaagcagcagcgactacgcccagagagaggacttcgaggccgccggcagccccttcagcggcggccccgtgagcttccccctggcccccggcccccacttcggcacccccggctacggcagcccccacttcaccgccctgtacagcagcgtgcccttccccgagggcgaggccttcccccccgtgagcgtgaccaccctgggcagccccatgcacagcaactag

SEQ ID NO: 94246 - DNA, 372 bp, Artificial Sequence
  Description of Artificial Sequence: Synthetic coding sequence
atggccggccacctggccagcgacttcgccttcagccccccccccggcggcggcggcgacggccccggcggccccgagcccggctgggtggaccccagaacctggctgagcttccagggcccccccggcggccccggcatcggccccggcgtgggccccggcagcgaggtgtggggcatccccccctgcccccccccctacgagttctgcggcggcatggcctactgcggcccccaggtgggcgtgggcctggtgccccagggcggcctggagaccagccagcccgagggcgaggccggcgtgggcgtggagacccccatgggcccccccagaagccccgccccccaccccttccccttccccctgctgtag

SEQ ID NO: 94247 - DNA, 558 bp, Artificial Sequence
  Description of Artificial Sequence: Synthetic coding sequence
atggccggccacctggccagcgacttcgccttcagccccccccccggcggcggcggcgacggccccggcggccccgagcccggctgggtggaccccagaacctggctgagcttccagggcccccccggcggccccggcatcggccccggcgtgggccccggcagcgaggtgtggggcatccccccctgcccccccccctacgagttctgcggcggcatggcctactgcggcccccaggtgggcgtgggcctggtgccccagggcggcctggagaccagccagcccgagggcgaggccggcgtgggcgtggagagcaacagcgacggcgccagccccgagccctgcaccgtgacccccggcgccgtgaagctggagaaggagaagctggagcagaaccccgaggagagccaggacatcaaggccctgcagaaggagctggagcagttcgccaagctgctgaagcagaagagaatcaccctgggctacacccaggccgacgtgcaccccggcggcagcatctgggagggcatccagcccaacgaccacctgcccctgtag

SEQ ID NO: 94248 - DNA, 558 bp, Artificial Sequence; identical to SEQ ID NO: 94247
  Description of Artificial Sequence: Synthetic coding sequence

SEQ ID NO: 94249 - DNA, 495 bp, Artificial Sequence
  Description of Artificial Sequence: Synthetic coding sequence
atgtgcaagctgagacccctgctgcagaagtgggtggaggaggccgacaacaacgagaacctgcaggagatctgcaaggccgagaccctggtgcaggccagaaagagaaagagaaccagcatcgagaacagagtgagaggcaacctggagaacctgttcctgcagtgccccaagcccaccctgcagcagatcagccacatcgcccagcagctgggcctggagaaggacgtggtgagagtgtggttctgcaacagaagacagaagggcaagagaagcagcagcgactacgcccagagagaggacttcgaggccgccggcagccccttcagcggcggccccgtgagcttccccctggcccccggcccccacttcggcacccccggctacggcagcccccacttcaccgccctgtacagcagcgtgcccttccccgagggcgaggccttcccccccgtgagcgtgaccaccctgggcagccccatgcacagcaactag

SEQ ID NO: 94250 - DNA, 495 bp, Artificial Sequence; identical to SEQ ID NO: 94249
  Description of Artificial Sequence: Synthetic coding sequence

SEQ ID NO: 94251 - DNA, 2076 bp, Artificial Sequence
  Description of Artificial Sequence: Synthetic coding sequence
atgagcgccctgctgcaggaccccatgatcgccggccaggtgagcaagcccctgctgagcgtgagaagcgagatgaacgccgagctgagaggcgaggacaaggccgccaccagcgacagcgagctgaacgagcccctgctggcccccgtggagagcaacgacagcgaggacacccccagcaagctgttcggcgccagaggcaaccccgccctgagcgaccccggcacccccgaccagcaccaggccagccagacccacccccccttccccgtgggcccccagcccctgctgaccgcccagcagctggccagcgccgtggccggcgtgatgcccggcggcccccccgccctgaaccagcccatcctgatccccttcaacatggccggccagctgggcggccagcagggcctggtgctgaccctgcccaccgccaacctgaccaacatccagggcctggtggccgccgccgccgccggcggcatcatgaccctgcccctgcagaacctgcaggccaccagcagcctgaacagccagctgcagcagctgcagctgcagctgcagcagcagcagcagcagcagcagcagcagcccccccccagcaccaaccagcacccccagcccgccccccaggcccccagccagagccagcagcagcccctgcagcccacccccccccagcagcccccccccgccagccagcagccccccgcccccaccagccagctgcagcaggccccccagccccagcagcaccagccccacagccacagccagaaccagaaccagcccagccccacccagcagagcagcagccccccccagaagcccagccagagccccggccacggcctgcccagccccctgaccccccccaaccccctgcagctggtgaacaaccccctggccagccaggccgccgccgccgccgccgccatgagcagcatcgccagcagccaggccttcggcaacgccctgagcagcctgcagggcgtgaccggccagctggtgaccaacgcccagggccagatcatcggcaccatccccctgatgcccaaccccggccccagcagccaggccgccagcggcacccagggcctgcaggtgcagcccatcaccccccagctgctgaccaacgcccagggccagatcatcgccaccgtgatcggcaaccagatcctgcccgtgatcaacacccagggcatcaccctgagccccatcaagcccggccagcagctgcaccagcccagccagaccagcgtgggccaggccgccagccagggcaacctgctgcacctggcccacagccaggccagcatgagccagagccccgtgagacaggccagcagcagcagcagcagcagcagcagcagcagcgccctgagcgtgggccagctggtgagcaacccccagaccgccgccggcgaggtggacggcgtgaacctggaggagatcagagagttcgccaaggccttcaagatcagaagactgagcctgggcctgacccagacccaggtgggccaggccctgagcgccaccgagggccccgcctacagccagagcgccatctgcagacacaccatcctgagaagccacttcttcctgccccaggaggcccaggagaacaccatcgccagcagcctgaccgccaagctgaaccccggcctgctgtaccccgccagattcgagaagctggacatcacccccaagagcgcccagaagatcaagcccgtgctggagagatggatggccgaggccgaggccagacacagagccggcatgcagaacctgaccgagttcatcggcagcgagcccagcaagaagagaaagagaagaaccagcttcaccccccaggccctggagatcctgaacgcccacttcgagaagaacacccaccccagcggccaggagatgaccgagatcgccgagaagctgaactacgacagagaggtggtgagagtgtggttctgcaacaagagacaggccctgaagaacaccatcaagagactgaagcagcacgagcccgccaccgccgtgcccctggagcccctgaccgacagcctggaggagaacagctag

SEQ ID NO: 94252 - DNA, 1968 bp, Artificial Sequence
  Description of Artificial Sequence: Synthetic coding sequence
atgagcgccctgctgcaggaccccatgatcgccggccaggtgagcaagcccctgctgagcgtgagaagcgagatgaacgccgagctgagaggcgaggacaaggccgccaccagcgacagcgagctgaacgagcccctgctggcccccgtggagagcaacgacagcgaggacacccccagcaagctgttcggcgccagaggcaaccccgccctgagcgaccccggcacccccgaccagcaccaggccagccagacccacccccccttccccgtgggcccccagcccctgctgaccgcccagcagctggccagcgccgtggccggcgtgatgcccggcggcccccccgccctgaaccagcccatcctgatccccttcaacatggccggccagctgggcggccagcagggcctggtgctgaccctgcccaccgccaacctgaccaacatccagggcctggtggccgccgccgccgccggcggcatcatgaccctgcccctgcagaacctgcaggccaccagcagcctgaacagccagctgcagcagctgcagctgcagctgcagcagcagcagcagcagcagcagcagcagcccccccccagcaccaaccagcacccccagcccgccccccaggcccccagccagagccagcagcagcccctgcagcccacccccccccagcagcccccccccgccagccagcagccccccgcccccaccagccagctgcagcaggccccccagccccagcagcaccagccccacagccacagccagaaccagaaccagcccagccccacccagcagagcagcagccccccccagaagcccagccagagccccggccacggcctgcccagccccctgaccccccccaaccccctgcagctggtgaacaaccccctggccagccaggccgccgccgccgccgccgccatgagcagcatcgccagcagccaggccttcggcaacgccctgagcagcctgcagggcgtgaccggccagctggtgaccaacgcccagggccagatcatcggcaccatccccctgatgcccaaccccggccccagcagccaggccgccagcggcacccagggcctgcaggtgcagcccatcaccccccagctgctgaccaacgcccagggccagatcatcgccaccgtgatcggcaaccagatcctgcccgtgatcaacacccagggcatcaccctgagccccatcaagcccggccagcagctgcaccagcccagccagaccagcgtgggccaggccgccagccagggcaacctgctgcacctggcccacagccaggccagcatgagccagagccccgtgagacaggccagcagcagcagcagcagcagcagcagcagcagcgccctgagcgtgggccagctggtgagcaacccccagaccgccgccggcgaggtggacggcgtgaacctggaggagatcagagagttcgccaaggccttcaagatcagaagactgagcctgggcctgacccagacccaggtgggccaggccctgagcgccaccgagggccccgcctacagccagagcgccatctgcagattcgagaagctggacatcacccccaagagcgcccagaagatcaagcccgtgctggagagatggatggccgaggccgaggccagacacagagccggcatgcagaacctgaccgagttcatcggcagcgagcccagcaagaagagaaagagaagaaccagcttcaccccccaggccctggagatcctgaacgcccacttcgagaagaacacccaccccagcggccaggagatgaccgagatcgccgagaagctgaactacgacagagaggtggtgagagtgtggttctgcaacaagagacaggccctgaagaacaccatcaagagactgaagcagcacgagcccgccaccgccgtgcccctggagcccctgaccgacagcctggaggagaacagctag

SEQ ID NO: 94253 - DNA, 2076 bp, Artificial Sequence
  Description of Artificial Sequence: Synthetic coding sequence
atggagaagatctacagcagaggcgagctgcaccacttcatcgacggcttcaacgaggagaagagcaactggatgagatacgtgaaccccgcccacagccccagagagcagaacctggccgcctgccagaacggcatgaacatctacttctacaccatcaagcccatccccgccaaccaggagctgctggtgtggtactgcagagacttcgccgagagactgcactacccctaccccggcgagctgaccatgatgaacctgacccagacccagagcagcctgaagcagcccagcaccgagaagaacgagctgtgccccaagaacgtgcccaagagagagtacagcgtgaaggagatcctgaagctggacagcaaccccagcaagggcaaggacctgtacagaagcaacatcagccccctgaccagcgagaaggacctggacgacttcagaagaagaggcagccccgagatgcccttctaccccagagtggtgtaccccatcagagcccccctgcccgaggacttcctgaaggccagcctggcctacggcatcgagagacccacctacatcaccagaagccccatccccagcagcaccacccccagccccagcgccagaagcagccccgaccagagcctgaagagcagcagcccccacagcagccccggcaacaccgtgagccccgtgggccccggcagccaggagcacagagacagctacgcctacctgaacgccagctacggcaccgagggcctgggcagctaccccggctacgcccccctgccccacctgccccccgccttcatccccagctacaacgcccactaccccaagttcctgctgcccccctacggcatgaactgcaacggcctgagcgccgtgagcagcatgaacggcatcaacaacttcggcctgttccccagactgtgccccgtgtacagcaacctgctgggcggcggcagcctgccccaccccatgctgaaccccaccagcctgcccagcagcctgcccagcgacggcgccagaagactgctgcagcccgagcaccccagagaggtgctggtgcccgccccccacagcgccttcagcttcaccggcgccgccgccagcatgaaggacaaggcctgcagccccaccagcggcagccccaccgccggcaccgccgccaccgccgagcacgtggtgcagcccaaggccaccagcgccgccatggccgcccccagcagcgacgaggccatgaacctgatcaagaacaagagaaacatgaccggctacaagaccctgccctaccccctgaagaagcagaacggcaagatcaagtacgagtgcaacgtgtgcgccaagaccttcggccagctgagcaacctgaaggtgcacctgagagtgcacagcggcgagagacccttcaagtgccagacctgcaacaagggcttcacccagctggcccacctgcagaagcactacctggtgcacaccggcgagaagccccacgagtgccaggtgtgccacaagagattcagcagcaccagcaacctgaagacccacctgagactgcacagcggcgagaagccctaccagtgcaaggtgtgccccgccaagttcacccagttcgtgcacctgaagctgcacaagagactgcacaccagagagagaccccacaagtgcagccagtgccacaagaactacatccacctgtgcagcctgaaggtgcacctgaagggcaactgcgccgccgcccccgcccccggcctgcccctggaggacctgaccagaatcaacgaggagatcgagaagttcgacatcagcgacaacgccgacagactggaggacgtggaggacgacatcagcgtgatcagcgtggtggagaaggagatcctggccgtggtgagaaaggagaaggaggagaccggcctgaaggtgagcctgcagagaaacatgggcaacggcctgctgagcagcggctgcagcctgtacgagagcagcgacctgcccctgatgaagctgccccccagcaaccccctgcccctggtgcccgtgaaggtgaagcaggagaccgtggagcccatggacccctag

SEQ ID NO: 94254 - DNA, 2370 bp, Artificial Sequence
  Description of Artificial Sequence: Synthetic coding sequence
atgaagatggacatggaggacgccgacatgaccctgtggaccgaggccgagttcgaggagaagtgcacctacatcgtgaacgaccacccctgggacagcggcgccgacggcggcaccagcgtgcaggccgaggccagcctgcccagaaacctgctgttcaagtacgccaccaacagcgaggaggtgatcggcgtgatgagcaaggagtacatccccaagggcaccagattcggccccctgatcggcgagatctacaccaacgacaccgtgcccaagaacgccaacagaaagtacttctggagaatctacagcagaggcgagctgcaccacttcatcgacggcttcaacgaggagaagagcaactggatgagatacgtgaaccccgcccacagccccagagagcagaacctggccgcctgccagaacggcatgaacatctacttctacaccatcaagcccatccccgccaaccaggagctgctggtgtggtactgcagagacttcgccgagagactgcactacccctaccccggcgagctgaccatgatgaacctgacccagacccagagcagcctgaagcagcccagcaccgagaagaacgagctgtgccccaagaacgtgcccaagagagagtacagcgtgaaggagatcctgaagctggacagcaaccccagcaagggcaaggacctgtacagaagcaacatcagccccctgaccagcgagaaggacctggacgacttcagaagaagaggcagccccgagatgcccttctaccccagagtggtgtaccccatcagagcccccctgcccgaggacttcctgaaggccagcctggcctacggcatcgagagacccacctacatcaccagaagccccatccccagcagcaccacccccagccccagcgccagaagcagccccgaccagagcctgaagagcagcagcccccacagcagccccggcaacaccgtgagccccgtgggccccggcagccaggagcacagagacagctacgcctacctgaacgccagctacggcaccgagggcctgggcagctaccccggctacgcccccctgccccacctgccccccgccttcatccccagctacaacgcccactaccccaagttcctgctgcccccctacggcatgaactgcaacggcctgagcgccgtgagcagcatgaacggcatcaacaacttcggcctgttccccagactgtgccccgtgtacagcaacctgctgggcggcggcagcctgccccaccccatgctgaaccccaccagcctgcccagcagcctgcccagcgacggcgccagaagactgctgcagcccgagcaccccagagaggtgctggtgcccgccccccacagcgccttcagcttcaccggcgccgccgccagcatgaaggacaaggcctgcagccccaccagcggcagccccaccgccggcaccgccgccaccgccgagcacgtggtgcagcccaaggccaccagcgccgccatggccgcccccagcagcgacgaggccatgaacctgatcaagaacaagagaaacatgaccggctacaagaccctgccctaccccctgaagaagcagaacggcaagatcaagtacgagtgcaacgtgtgcgccaagaccttcggccagctgagcaacctgaaggtgcacctgagagtgcacagcggcgagagacccttcaagtgccagacctgcaacaagggcttcacccagctggcccacctgcagaagcactacctggtgcacaccggcgagaagccccacgagtgccaggtgtgccacaagagattcagcagcaccagcaacctgaagacccacctgagactgcacagcggcgagaagccctaccagtgcaaggtgtgccccgccaagttcacccagttcgtgcacctgaagctgcacaagagactgcacaccagagagagaccccacaagtgcagccagtgccacaagaactacatccacctgtgcagcctgaaggtgcacctgaagggcaactgcgccgccgcccccgcccccggcctgcccctggaggacctgaccagaatcaacgaggagatcgagaagttcgacatcagcgacaacgccgacagactggaggacgtggaggacgacatcagcgtgatcagcgtggtggagaaggagatcctggccgtggtgagaaaggagaaggaggagaccggcctgaaggtgagcctgcagagaaacatgggcaacggcctgctgagcagcggctgcagcctgtacgagagcagcgacctgcccctgatgaagctgccccccagcaaccccctgcccctggtgcccgtgaaggtgaagcaggagaccgtggagcccatggacccctag

SEQ ID NO: 94255 - DNA, 2478 bp, Artificial Sequence
  Description of Artificial Sequence: Synthetic coding sequence
atgctggacatctgcctggagaagagagtgggcaccaccctggccgcccccaagtgcaacagcagcaccgtgagattccagggcctggccgagggcaccaagggcaccatgaagatggacatggaggacgccgacatgaccctgtggaccgaggccgagttcgaggagaagtgcacctacatcgtgaacgaccacccctgggacagcggcgccgacggcggcaccagcgtgcaggccgaggccagcctgcccagaaacctgctgttcaagtacgccaccaacagcgaggaggtgatcggcgtgatgagcaaggagtacatccccaagggcaccagattcggccccctgatcggcgagatctacaccaacgacaccgtgcccaagaacgccaacagaaagtacttctggagaatctacagcagaggcgagctgcaccacttcatcgacggcttcaacgaggagaagagcaactggatgagatacgtgaaccccgcccacagccccagagagcagaacctggccgcctgccagaacggcatgaacatctacttctacaccatcaagcccatccccgccaaccaggagctgctggtgtggtactgcagagacttcgccgagagactgcactacccctaccccggcgagctgaccatgatgaacctgacccagacccagagcagcctgaagcagcccagcaccgagaagaacgagctgtgccccaagaacgtgcccaagagagagtacagcgtgaaggagatcctgaagctggacagcaaccccagcaagggcaaggacctgtacagaagcaacatcagccccctgaccagcgagaaggacctggacgacttcagaagaagaggcagccccgagatgcccttctaccccagagtggtgtaccccatcagagcccccctgcccgaggacttcctgaaggccagcctggcctacggcatcgagagacccacctacatcaccagaagccccatccccagcagcaccacccccagccccagcgccagaagcagccccgaccagagcctgaagagcagcagcccccacagcagccccggcaacaccgtgagccccgtgggccccggcagccaggagcacagagacagctacgcctacctgaacgccagctacggcaccgagggcctgggcagctaccccggctacgcccccctgccccacctgccccccgccttcatccccagctacaacgcccactaccccaagttcctgctgcccccctacggcatgaactgcaacggcctgagcgccgtgagcagcatgaacggcatcaacaacttcggcctgttccccagactgtgccccgtgtacagcaacctgctgggcggcggcagcctgccccaccccatgctgaaccccaccagcctgcccagcagcctgcccagcgacggcgccagaagactgctgcagcccgagcaccccagagaggtgctggtgcccgccccccacagcgccttcagcttcaccggcgccgccgccagcatgaaggacaaggcctgcagccccaccagcggcagccccaccgccggcaccgccgccaccgccgagcacgtggtgcagcccaaggccaccagcgccgccatggccgcccccagcagcgacgaggccatgaacctgatcaagaacaagagaaacatgaccggctacaagaccctgccctaccccctgaagaagcagaacggcaagatcaagtacgagtgcaacgtgtgcgccaagaccttcggccagctgagcaacctgaaggtgcacctgagagtgcacagcggcgagagacccttcaagtgccagacctgcaacaagggcttcacccagctggcccacctgcagaagcactacctggtgcacaccggcgagaagccccacgagtgccaggtgtgccacaagagattcagcagcaccagcaacctgaagacccacctgagactgcacagcggcgagaagccctaccagtgcaaggtgtgccccgccaagttcacccagttcgtgcacctgaagctgcacaagagactgcacaccagagagagaccccacaagtgcagccagtgccacaagaactacatccacctgtgcagcctgaaggtgcacctgaagggcaactgcgccgccgcccccgcccccggcctgcccctggaggacctgaccagaatcaacgaggagatcgagaagttcgacatcagcgacaacgccgacagactggaggacgtggaggacgacatcagcgtgatcagcgtggtggagaaggagatcctggccgtggtgagaaaggagaaggaggagaccggcctgaaggtgagcctgcagagaaacatgggcaacggcctgctgagcagcggctgcagcctgtacgagagcagcgacctgcccctgatgaagctgccccccagcaaccccctgcccctggtgcccgtgaaggtgaagcaggagaccgtggagcccatggacccctag

SEQ ID NO: 94256 - DNA, 192 bp, Artificial Sequence
  Description of Artificial Sequence: Synthetic coding sequence
atgaagatggacatggaggacgccgacatgaccctgtggaccgaggccgagttcgaggagaagtgcacctacatcgtgaacgaccacccctgggacagcggcgccgacggcggcaccagcgtgcaggccgaggccagcctgcccagaaacctgctgttcaagtacgccaccaacagcgaggaggtgatctag

SEQ ID NO: 94257 - DNA, 2367 bp, Artificial Sequence
  Description of Artificial Sequence: Synthetic coding sequence
atgaagatggacatggaggacgccgacatgaccctgtggaccgaggccgagttcgaggagaagtgcacctacatcgtgaacgaccacccctgggacagcggcgccgacggcggcaccagcgtgcaggccgaggccagcctgcccagaaacctgctgttcaagtacgccaccaacagcgaggaggtgatcggcgtgatgagcaaggagtacatccccaagggcaccagattcggccccctgatcggcgagatctacaccaacgacaccgtgcccaagaacgccaacagaaagtacttctggagaatctacagcagaggcgagctgcaccacttcatcgacggcttcaacgaggagaagagcaactggatgagatacgtgaaccccgcccacagccccagagagcagaacctggccgcctgccagaacggcatgaacatctacttctacaccatcaagcccatccccgccaaccaggagctgctggtgtggtactgcagagacttcgccgagagactgcactacccctaccccggcgagctgaccatgatgaacctgacccagacccagagcagcctgaagcagcccagcaccgagaagaacgagctgtgccccaagaacgtgcccaagagagagtacagcgtgaaggagatcctgaagctggacagcaaccccagcaagggcaaggacctgtacagaagcaacatcagccccctgaccagcgagaaggacctggacgacttcagaagaagaggcagccccgagatgcccttctaccccagagtggtgtaccccatcagagcccccctgcccgaggacttcctgaaggccagcctggcctacggcatcgagagacccacctacatcaccagaagccccatccccagcagcaccacccccagccccagcgccagaagcagccccgaccagagcctgaagagcagcagcccccacagcagccccggcaacaccgtgagccccgtgggccccggcagccaggagcacagagacagctacgcctacctgaacgccagctacggcaccgagggcctgggcagctaccccggctacgcccccctgccccacctgccccccgccttcatccccagctacaacgcccactaccccaagttcctgctgcccccctacggcatgaactgcaacggcctgagcgccgtgagcagcatgaacggcatcaacaacttcggcctgttccccagactgtgccccgtgtacagcaacctgctgggcggcggcagcctgcccaccccctgcagcacccccctgctgcccagcagcctgcccagcgacggcgccagaagactgctgcagcccgagcaccccagagaggtgctggtgcccgccccccacagcgccttcagcttcaccggcgccgccgccagcatgaaggacaaggcctgcagccccaccagcggcagccccaccgccggcaccgccgccaccgccgagcacgtggtgcagcccaaggccaccagcgccgccatggccgcccccagcagcgacgaggccatgaacctgatcaagaacaagagaaacatgaccggctacaagaccctgccctaccccctgaagaagcagaacggcaagatcaagtacgagtgcaacgtgtgcgccaagaccttcggccagctgagcaacctgaaggtgcacctgagagtgcacagcggcgagagacccttcaagtgccagacctgcaacaagggcttcacccagctggcccacctgcagaagcactacctggtgcacaccggcgagaagccccacgagtgccaggtgtgccacaagagattcagcagcaccagcaacctgaagacccacctgagactgcacagcggcgagaagccctaccagtgcaaggtgtgccccgccaagttcacccagttcgtgcacctgaagctgcacaagagactgcacaccagagagagaccccacaagtgcagccagtgccacaagaactacatccacctgtgcagcctgaaggtgcacctgaagggcaactgcgccgccgcccccgcccccggcctgcccctggaggacctgaccagaatcaacgaggagatcgagaagttcgacatcagcgacaacgccgacagactggaggacgtggaggacgacatcagcgtgatcagcgtggtggagaaggagatcctggccgtggtgagaaaggagaaggaggagaccggcctgaaggtgagcctgcagagaaacatgggcaacggcctgctgagcagcggctgcagcctgtacgagagcagcgacctgcccctgatgaagctgccccccagcaaccccctgcccctggtgcccgtgaaggtgaagcaggagaccgtggagcccatggacccctag

SEQ ID NO: 94258 - DNA, 1716 bp, Artificial Sequence
  Description of Artificial Sequence: Synthetic coding sequence
atggccctgcccagacccagcgaggccgtgccccaggacaaggtgtgctacccccccgagagcagcccccagaacctggccgcctactacacccccttccccagctacggccactacagaaacagcctggccaccgtggaggaggacttccagcccttcagacagctggaggccgccgccagcgccgcccccgccatgccccccttccccttcagaatggccccccccctgctgagccccggcctgggcctgcagagagagcccctgtacgacctgccctggtacagcaagctgcccccctggtaccccatcccccacgtgcccagagaggtgccccccttcctgagcagcagccacgagtacgccggcgccagcagcgaggacctgggccaccagatcatcggcggcgacaacgagagcggcccctgctgcggccccgacaccctgatcccccccccccccgccgacgccagcctgctgcccgagggcctgagaaccagccagctgctgccctgcagccccagcaagcagagcgaggacggccccaagcccagcaaccaggagggcaagagccccgccagattccagttcaccgaggaggacctgcacttcgtgctgtacggcgtgacccccagcctggagcaccccgccagcctgcaccacgccatcagcggcctgctggtgccccccgacagcagcggcagcgacagcctgccccagaccctggacaaggacagcctgcagctgcccgagggcctgtgcctgatgcagaccgtgttcggcgaggtgccccacttcggcgtgttctgcagcagcttcatcgccaagggcgtgagattcggccccttccagggcaaggtggtgaacgccagcgaggtgaagacctacggcgacaacagcgtgatgtgggagatcttcgaggacggccacctgagccacttcatcgacggcaagggcggcaccggcaactggatgagctacgtgaactgcgccagattccccaaggagcagaacctggtggccgtgcagtgccagggccacatcttctacgagagctgcaaggagatccaccagaaccaggagctgctggtgtggtacggcgactgctacgagaagttcctggacatccccgtgagcctgcaggtgaccgagcccggcaagcagcccagcggccccagcgaggagagcgccgagggctacagatgcgagagatgcggcaaggtgttcacctacaagtactacagagacaagcacctgaagtacaccccctgcgtggacaagggcgacagaaagttcccctgcagcctgtgcaagagaagcttcgagaagagagacagactgagaatccacatcctgcacgtgcacgagaagcacagaccccacaagtgcagcacctgcggcaagtgcttcagccagagcagcagcctgaacaagcacatgagagtgcacagcggcgacagaccctaccagtgcgtgtactgcaccaagagattcaccgccagcagcatcctgagaacccacatcagacagcacagcggcgagaagcccttcaagtgcaagtactgcggcaagagcttcgccagccacgccgcccacgacagccacgtgagaagaagccacaaggaggacgacggctgcagctgcagcatctgcggcaagatcttcagcgaccaggagaccttctacagccacatgaagttccacgaggactactag

SEQ ID NO: 94259 - DNA, 303 bp, Artificial Sequence
  Description of Artificial Sequence: Synthetic coding sequence
atggccctgcccagacccagcgaggccgtgccccaggacaaggtgtgctacccccccgagagcagcccccagaacctggccgcctactacacccccttccccagctacggccactacagaaacagcctggccaccgtggaggaggacttccagcccttcagacagctggaggccgccgccagcgccgcccccgccatgccccccttccccttcagaatggccccccccctgctgagccccggcctgggcctgcagagagagcccctgtacgacctgccctggtacagcaagctgcccccctag

SEQ ID NO: 94260 - DNA, 3831 bp, Artificial Sequence
  Description of Artificial Sequence: Synthetic coding sequence
atgagaagcaaggccagagccagaaagctggccaagagcgacggcgacgtggtgaacaacatgtacgagcccaacagagacctgctggccagccacagcgccgaggacgaggccgaggacagcgccatgagccccatccccgtgggcccccccagccccttccccaccagcgaggacttcacccccaaggagggcagcccctacgaggcccccgtgtacatccccgaggacatccccatccccgccgacttcgagctgagagagagcagcatccccggcgccggcctgggcgtgtgggccaagagaaagatggaggccggcgagagactgggcccctgcgtggtggtgcccagagccgccgccaaggagaccgacttcggctgggagcagatcctgaccgacgtggaggtgagcccccaggagggctgcatcaccaagatcagcgaggacctgggcagcgagaagttctgcgtggacgccaaccaggccggcgccggcagctggctgaagtacatcagagtggcctgcagctgcgacgaccagaacctgaccatgtgccagatcagcgagcagatctactacaaggtgatcaaggacatcgagcccggcgaggagctgctggtgcacgtgaaggagggcgtgtaccccctgggcaccgtgccccccggcctggacgaggagcccaccttcagatgcgacgagtgcgacgagctgttccagagcaagctggacctgagaagacacaagaagtacacctgcggcagcgtgggcgccgccctgtacgagggcctggccgaggagctgaagcccgagggcctgggcggcggcagcggccaggcccacgagtgcaaggactgcgagagaatgttccccaacaagtacagcctggagcagcacatggtgatccacaccgaggagagagagtacaagtgcgaccagtgccccaaggccttcaactggaagagcaacctgatcagacaccagatgagccacgacagcggcaagagattcgagtgcgagaactgcgtgaaggtgttcaccgaccccagcaacctgcagagacacatcagaagccagcacgtgggcgccagagcccacgcctgccccgactgcggcaagaccttcgccaccagcagcggcctgaagcagcacaagcacatccacagcaccgtgaagcccttcatctgcgaggtgtgccacaagagctacacccagttcagcaacctgtgcagacacaagagaatgcacgccgactgcagaacccagatcaagtgcaaggactgcggccagatgttcagcaccaccagcagcctgaacaagcacagaagattctgcgagggcaagaaccactacacccccggcggcatcttcgcccccggcctgcccctgacccccagccccatgatggacaaggccaagcccagccccagcctgaaccacgccagcctgggcttcaacgagtacttccccagcagaccccaccccggcagcctgcccttcagcaccgccccccccaccttccccgccctgacccccggcttccccggcatcttcccccccagcctgtaccccagaccccccctgctgccccccaccagcctgctgaagagccccctgaaccacacccaggacgccaagctgcccagccccctgggcaaccccgccctgcccctggtgagcgccgtgagcaacagcagccagggcaccaccgccgccgccggccccgaggagaagttcgagagcagactggaggacagctgcgtggagaagctgaagaccagaagcagcgacatgagcgacggcagcgacttcgaggacgtgaacaccaccaccggcaccgacctggacaccaccaccggcaccggcagcgacctggacagcgacgtggacagcgaccccgacaaggacaagggcaagggcaagagcgccgagggccagcccaagttcggcggcggcctggccccccccggcgcccccaacagcgtggccgaggtgcccgtgttctacagccagcacagcttcttccccccccccgacgagcagctgctgaccgccaccggcgccgccggcgacagcatcaaggccatcgccagcatcgccgagaagtacttcggccccggcttcatgggcatgcaggagaagaagctgggcagcctgccctaccacagcgccttccccttccagttcctgcccaacttcccccacagcctgtaccccttcaccgacagagccctggcccacaacctgctggtgaaggccgagcccaagagccccagagacgccctgaaggtgggcggccccagcgccgagtgccccttcgacctgaccaccaagcccaaggacgtgaagcccatcctgcccatgcccaagggccccagcgcccccgccagcggcgaggagcagcccctggacctgagcatcggcagcagagccagagccagccagaacggcggcggcagagagcccagaaagaaccacgtgtacggcgagagaaagctgggcgccggcgagggcctgccccaggtgtgccccgccagaatgccccagcagccccccctgcactacgccaagcccagccccttcttcatggaccccatctacagcagagtggagaagagaaaggtgaccgaccccgtgggcgccctgaaggagaagtacctgagacccagccccctgctgttccacccccagatgagcgccatcgagaccatgaccgagaagctggagagcttcgccgccatgaaggccgacagcggcagcagcctgcagcccctgccccaccaccccttcaacttcagaagccccccccccaccctgagcgaccccatcctgagaaagggcaaggagagatacacctgcagatactgcggcaagatcttccccagaagcgccaacctgaccagacacctgagaacccacaccggcgagcagccctacagatgcaagtactgcgacagaagcttcagcatcagcagcaacctgcagagacacgtgagaaacatccacaacaaggagaagcccttcaagtgccacctgtgcaacagatgcttcggccagcagaccaacctggacagacacctgaagaagcacgagcacgagaacgcccccgtgagccagcaccccggcgtgctgaccaaccacctgggcaccagcgccagcagccccaccagcgagagcgacaaccacgccctgctggacgagaaggaggacagctacttcagcgagatcagaaacttcatcgccaacagcgagatgaaccaggccagcaccagaaccgagaagagagccgacatgcagatcgtggacggcagcgcccagtgccccggcctggccagcgagaagcaggaggacgtggaggaggaggacgacgacgacctggaggaggacgacgaggacagcctggccggcaagagccaggacgacaccgtgagccccgcccccgagccccaggccgcctacgaggacgaggaggacgaggagcccgccgccagcctggccgtgggcttcgaccacaccagaagatgcgccgaggaccacgagggcggcctgctggccctggagcccatgcccaccttcggcaagggcctggacctgagaagagccgccgaggaggccttcgaggtgaaggacgtgctgaacagcaccctggacagcgaggccctgaagcacaccctgtgcagacaggccaagaaccaggcctacgccatgatgctgagcctgagcgaggacacccccctgcacacccccagccagggcagcctggacgcctggctgaaggtgaccggcgccaccagcgagagcggcgccttccaccccatcaaccacctgtag

SEQ ID NO: 94261 - DNA, 3831 bp, Artificial Sequence
  Description of Artificial Sequence: Synthetic coding sequence
atgagaagcaaggccagagccagaaagctggccaagagcgacggcgacgtggtgaacaacatgtacgagcccaacagagacctgctggccagccacagcgccgaggacgaggccgaggacagcgccatgagccccatccccgtgggcccccccagccccttccccaccagcgaggacttcacccccaaggagggcagcccctacgaggcccccgtgtacatccccgaggacatccccatccccgccgacttcgagctgagagagagcagcatccccggcgccggcctgggcgtgtgggccaagagaaagatggaggccggcgagagactgggcccctgcgtggtggtgcccagagccgccgccaaggagaccgacttcggctgggagcagatcctgaccgacgtggaggtgagcccccaggagggctgcatcaccaagatcagcgaggacctgggcagcgagaagttctgcgtggacgccaaccaggccggcgccggcagctggctgaagtacatcagagtggcctgcagctgcgacgaccagaacctgaccatgtgccagatcagcgagcaggtgatctactacaaggtgatcaaggacatcgagcccggcgaggagctgctggtgcacgtgaaggagggcgtgtaccccctgggcaccgtgccccccggcctggacgaggagcccaccttcagatgcgacgagtgcgacgagctgttccagagcaagctggacctgagaagacacaagaagtacacctgcggcagcgtgggcgccgccctgtacgagggcctggccgaggagctgaagcccgagggcctgggcggcggcagcggccaggcccacgagtgcaaggactgcgagagaatgttccccaacaagtacagcctggagcagcacatggtgatccacaccgaggagagagagtacaagtgcgaccagtgccccaaggccttcaactggaagagcaacctgatcagacaccagatgagccacgacagcggcaagagattcgagtgcgagaactgcgtgaaggtgttcaccgaccccagcaacctgcagagacacatcagaagccagcacgtgggcgccagagcccacgcctgccccgactgcggcaagaccttcgccaccagcagcggcctgaagcagcacaagcacatccacagcaccgtgaagcccttcatctgcgaggtgtgccacaagagctacacccagttcagcaacctgtgcagacacaagagaatgcacgccgactgcagaacccagatcaagtgcaaggactgcggccagatgttcagcaccaccagcagcctgaacaagcacagaagattctgcgagggcaagaaccactacacccccggcggcatcttcgcccccggcctgcccctgacccccagccccatgatggacaaggccaagcccagccccagcctgaaccacgccagcctgggcttcaacgagtacttccccagcagaccccaccccggcagcctgcccttcagcaccgccccccccaccttccccgccctgacccccggcttccccggcatcttcccccccagcctgtaccccagaccccccctgctgccccccaccagcctgctgaagagccccctgaaccacacccaggacgccaagctgcccagccccctgggcaaccccgccctgcccctggtgagcgccgtgagcaacagcagccagggcaccaccgccgccgccggccccgaggagaagttcgagagcagactggaggacagctgcgtggagaagctgaagaccagaagcagcgacatgagcgacggcagcgacttcgaggacgtgaacaccaccaccggcaccgacctggacaccaccaccggcaccggcagcgacctggacagcgacgtggacagcgaccccgacaaggacaagggcaagggcaagagcgccgagggccagcccaagttcggcggcggcctggccccccccggcgcccccaacagcgtggccgaggtgcccgtgttctacagccagcacagcttcttccccccccccgacgagcagctgctgaccgccaccggcgccgccggcgacagcatcaaggccatcgccagcatcgccgagaagtacttcggccccggcttcatgggcatgcaggagaagaagctgggcagcctgccctaccacagcgccttccccttccagttcctgcccaacttcccccacagcctgtaccccttcaccgacagagccctggcccacaacctgctggtgaaggccgagcccaagagccccagagacgccctgaaggtgggcggccccagcgccgagtgccccttcgacctgaccaccaagcccaaggacgtgaagcccatcctgcccatgcccaagggccccagcgcccccgccagcggcgaggagcagcccctggacctgagcatcggcagcagagccagagccagccagaacggcggcggcagagagcccagaaagaaccacgtgtacggcgagagaaagctgggcgccggcgagggcctgccccaggtgtgccccgccagaatgccccagcagccccccctgcactacgccaagcccagccccttcttcatggaccccatctacagagtggagaagagaaaggtgaccgaccccgtgggcgccctgaaggagaagtacctgagacccagccccctgctgttccacccccagatgagcgccatcgagaccatgaccgagaagctggagagcttcgccgccatgaaggccgacagcggcagcagcctgcagcccctgccccaccaccccttcaacttcagaagccccccccccaccctgagcgaccccatcctgagaaagggcaaggagagatacacctgcagatactgcggcaagatcttccccagaagcgccaacctgaccagacacctgagaacccacaccggcgagcagccctacagatgcaagtactgcgacagaagcttcagcatcagcagcaacctgcagagacacgtgagaaacatccacaacaaggagaagcccttcaagtgccacctgtgcaacagatgcttcggccagcagaccaacctggacagacacctgaagaagcacgagcacgagaacgcccccgtgagccagcaccccggcgtgctgaccaaccacctgggcaccagcgccagcagccccaccagcgagagcgacaaccacgccctgctggacgagaaggaggacagctacttcagcgagatcagaaacttcatcgccaacagcgagatgaaccaggccagcaccagaaccgagaagagagccgacatgcagatcgtggacggcagcgcccagtgccccggcctggccagcgagaagcaggaggacgtggaggaggaggacgacgacgacctggaggaggacgacgaggacagcctggccggcaagagccaggacgacaccgtgagccccgcccccgagccccaggccgcctacgaggacgaggaggacgaggagcccgccgccagcctggccgtgggcttcgaccacaccagaagatgcgccgaggaccacgagggcggcctgctggccctggagcccatgcccaccttcggcaagggcctggacctgagaagagccgccgaggaggccttcgaggtgaaggacgtgctgaacagcaccctggacagcgaggccctgaagcacaccctgtgcagacaggccaagaaccaggcctacgccatgatgctgagcctgagcgaggacacccccctgcacacccccagccagggcagcctggacgcctggctgaaggtgaccggcgccaccagcgagagcggcgccttccaccccatcaaccacctgtag

SEQ ID NO: 94262 - DNA, 3279 bp, Artificial Sequence
  Description of Artificial Sequence: Synthetic coding sequence
ttctgcgcctacagcgccaagatctactacaaggtgatcaaggacatcgagcccggcgaggagctgctggtgcacgtgaaggagggcgtgtaccccctgggcaccgtgccccccggcctggacgaggagcccaccttcagatgcgacgagtgcgacgagctgttccagagcaagctggacctgagaagacacaagaagtacacctgcggcagcgtgggcgccgccctgtacgagggcctggccgaggagctgaagcccgagggcctgggcggcggcagcggccaggcccacgagtgcaaggactgcgagagaatgttccccaacaagtacagcctggagcagcacatggtgatccacaccgaggagagagagtacaagtgcgaccagtgccccaaggccttcaactggaagagcaacctgatcagacaccagatgagccacgacagcggcaagagattcgagtgcgagaactgcgtgaaggtgttcaccgaccccagcaacctgcagagacacatcagaagccagcacgtgggcgccagagcccacgcctgccccgactgcggcaagaccttcgccaccagcagcggcctgaagcagcacaagcacatccacagcaccgtgaagcccttcatctgcgaggtgtgccacaagagctacacccagttcagcaacctgtgcagacacaagagaatgcacgccgactgcagaacccagatcaagtgcaaggactgcggccagatgttcagcaccaccagcagcctgaacaagcacagaagattctgcgagggcaagaaccactacacccccggcggcatcttcgcccccggcctgcccctgacccccagccccatgatggacaaggccaagcccagccccagcctgaaccacgccagcctgggcttcaacgagtacttccccagcagaccccaccccggcagcctgcccttcagcaccgccccccccaccttccccgccctgacccccggcttccccggcatcttcccccccagcctgtaccccagaccccccctgctgccccccaccagcctgctgaagagccccctgaaccacacccaggacgccaagctgcccagccccctgggcaaccccgccctgcccctggtgagcgccgtgagcaacagcagccagggcaccaccgccgccgccggccccgaggagaagttcgagagcagactggaggacagctgcgtggagaagctgaagaccagaagcagcgacatgagcgacggcagcgacttcgaggacgtgaacaccaccaccggcaccgacctggacaccaccaccggcaccggcagcgacctggacagcgacgtggacagcgaccccgacaaggacaagggcaagggcaagagcgccgagggccagcccaagttcggcggcggcctggccccccccggcgcccccaacagcgtggccgaggtgcccgtgttctacagccagcacagcttcttccccccccccgacgagcagctgctgaccgccaccggcgccgccggcgacagcatcaaggccatcgccagcatcgccgagaagtacttcggccccggcttcatgggcatgcaggagaagaagctgggcagcctgccctaccacagcgccttccccttccagttcctgcccaacttcccccacagcctgtaccccttcaccgacagagccctggcccacaacctgctggtgaaggccgagcccaagagccccagagacgccctgaaggtgggcggccccagcgccgagtgccccttcgacctgaccaccaagcccaaggacgtgaagcccatcctgcccatgcccaagggccccagcgcccccgccagcggcgaggagcagcccctggacctgagcatcggcagcagagccagagccagccagaacggcggcggcagagagcccagaaagaaccacgtgtacggcgagagaaagctgggcgccggcgagggcctgccccaggtgtgccccgccagaatgccccagcagccccccctgcactacgccaagcccagccccttcttcatggaccccatctacagcagagtggagaagagaaaggtgaccgaccccgtgggcgccctgaaggagaagtacctgagacccagccccctgctgttccacccccagatgagcgccatcgagaccatgaccgagaagctggagagcttcgccgccatgaaggccgacagcggcagcagcctgcagcccctgccccaccaccccttcaacttcagaagccccccccccaccctgagcgaccccatcctgagaaagggcaaggagagatacacctgcagatactgcggcaagatcttccccagaagcgccaacctgaccagacacctgagaacccacaccggcgagcagccctacagatgcaagtactgcgacagaagcttcagcatcagcagcaacctgcagagacacgtgagaaacatccacaacaaggagaagcccttcaagtgccacctgtgcaacagatgcttcggccagcagaccaacctggacagacacctgaagaagcacgagcacgagaacgcccccgtgagccagcaccccggcgtgctgaccaaccacctgggcaccagcgccagcagccccaccagcgagagcgacaaccacgccctgctggacgagaaggaggacagctacttcagcgagatcagaaacttcatcgccaacagcgagatgaaccaggccagcaccagaaccgagaagagagccgacatgcagatcgtggacggcagcgcccagtgccccggcctggccagcgagaagcaggaggacgtggaggaggaggacgacgacgacctggaggaggacgacgaggacagcctggccggcaagagccaggacgacaccgtgagccccgcccccgagccccaggccgcctacgaggacgaggaggacgaggagcccgccgccagcctggccgtgggcttcgaccacaccagaagatgcgccgaggaccacgagggcggcctgctggccctggagcccatgcccaccttcggcaagggcctggacctgagaagagccgccgaggaggccttcgaggtgaaggacgtgctgaacagcaccctggacagcgaggccctgaagcacaccctgtgcagacaggccaagaaccaggcctacgccatgatgctgagcctgagcgaggacacccccctgcacacccccagccagggcagcctggacgcctggctgaaggtgaccggcgccaccagcgagagcggcgccttccaccccatcaaccacctgtag

SEQ ID NO: 94263 - DNA, 3828 bp, Artificial Sequence
  Description of Artificial Sequence: Synthetic coding sequence
atgagaagcaaggccagagccagaaagctggccaagagcgacggcgacgtggtgaacaacatgtacgagcccaacagagacctgctggccagccacagcgccgaggacgaggccgaggacagcgccatgagccccatccccgtgggcccccccagccccttccccaccagcgaggacttcacccccaaggagggcagcccctacgaggcccccgtgtacatccccgaggacatccccatccccgccgacttcgagctgagagagagcagcatccccggcgccggcctgggcgtgtgggccaagagaaagatggaggccggcgagagactgggcccctgcgtggtggtgcccagagccgccgccaaggagaccgacttcggctgggagcagatcctgaccgacgtggaggtgagcccccaggagggctgcatcaccaagatcagcgaggacctgggcagcgagaagttctgcgtggacgccaaccaggccggcgccggcagctggctgaagtacatcagagtggcctgcagctgcgacgaccagaacctgaccatgtgccagatcagcgagcagatctactacaaggtgatcaaggacatcgagcccggcgaggagctgctggtgcacgtgaaggagggcgtgtaccccctgggcaccgtgccccccggcctggacgaggagcccaccttcagatgcgacgagtgcgacgagctgttccagagcaagctggacctgagaagacacaagaagtacacctgcggcagcgtgggcgccgccctgtacgagggcctggccgaggagctgaagcccgagggcctgggcggcggcagcggccaggcccacgagtgcaaggactgcgagagaatgttccccaacaagtacagcctggagcagcacatggtgatccacaccgaggagagagagtacaagtgcgaccagtgccccaaggccttcaactggaagagcaacctgatcagacaccagatgagccacgacagcggcaagagattcgagtgcgagaactgcgtgaaggtgttcaccgaccccagcaacctgcagagacacatcagaagccagcacgtgggcgccagagcccacgcctgccccgactgcggcaagaccttcgccaccagcagcggcctgaagcagcacaagcacatccacagcaccgtgaagcccttcatctgcgaggtgtgccacaagagctacacccagttcagcaacctgtgcagacacaagagaatgcacgccgactgcagaacccagatcaagtgcaaggactgcggccagatgttcagcaccaccagcagcctgaacaagcacagaagattctgcgagggcaagaaccactacacccccggcggcatcttcgcccccggcctgcccctgacccccagccccatgatggacaaggccaagcccagccccagcctgaaccacgccagcctgggcttcaacgagtacttccccagcagaccccaccccggcagcctgcccttcagcaccgccccccccaccttccccgccctgacccccggcttccccggcatcttcccccccagcctgtaccccagaccccccctgctgccccccaccagcctgctgaagagccccctgaaccacacccaggacgccaagctgcccagccccctgggcaaccccgccctgcccctggtgagcgccgtgagcaacagcagccagggcaccaccgccgccgccggccccgaggagaagttcgagagcagactggaggacagctgcgtggagaagctgaagaccagaagcagcgacatgagcgacggcagcgacttcgaggacgtgaacaccaccaccggcaccgacctggacaccaccaccggcaccggcagcgacctggacagcgacgtggacagcgaccccgacaaggacaagggcaagggcaagagcgccgagggccagcccaagttcggcggcggcctggccccccccggcgcccccaacagcgtggccgaggtgcccgtgttctacagccagcacagcttcttccccccccccgacgagcagctgctgaccgccaccggcgccgccggcgacagcatcaaggccatcgccagcatcgccgagaagtacttcggccccggcttcatgggcatgcaggagaagaagctgggcagcctgccctaccacagcgccttccccttccagttcctgcccaacttcccccacagcctgtaccccttcaccgacagagccctggcccacaacctgctggtgaaggccgagcccaagagccccagagacgccctgaaggtgggcggccccagcgccgagtgccccttcgacctgaccaccaagcccaaggacgtgaagcccatcctgcccatgcccaagggccccagcgcccccgccagcggcgaggagcagcccctggacctgagcatcggcagcagagccagagccagccagaacggcggcggcagagagcccagaaagaaccacgtgtacggcgagagaaagctgggcgccggcgagggcctgccccaggtgtgccccgccagaatgccccagcagccccccctgcactacgccaagcccagccccttcttcatggaccccatctacagagtggagaagagaaaggtgaccgaccccgtgggcgccctgaaggagaagtacctgagacccagccccctgctgttccacccccagatgagcgccatcgagaccatgaccgagaagctggagagcttcgccgccatgaaggccgacagcggcagcagcctgcagcccctgccccaccaccccttcaacttcagaagccccccccccaccctgagcgaccccatcctgagaaagggcaaggagagatacacctgcagatactgcggcaagatcttccccagaagcgccaacctgaccagacacctgagaacccacaccggcgagcagccctacagatgcaagtactgcgacagaagcttcagcatcagcagcaacctgcagagacacgtgagaaacatccacaacaaggagaagcccttcaagtgccacctgtgcaacagatgcttcggccagcagaccaacctggacagacacctgaagaagcacgagcacgagaacgcccccgtgagccagcaccccggcgtgctgaccaaccacctgggcaccagcgccagcagccccaccagcgagagcgacaaccacgccctgctggacgagaaggaggacagctacttcagcgagatcagaaacttcatcgccaacagcgagatgaaccaggccagcaccagaaccgagaagagagccgacatgcagatcgtggacggcagcgcccagtgccccggcctggccagcgagaagcaggaggacgtggaggaggaggacgacgacgacctggaggaggacgacgaggacagcctggccggcaagagccaggacgacaccgtgagccccgcccccgagccccaggccgcctacgaggacgaggaggacgaggagcccgccgccagcctggccgtgggcttcgaccacaccagaagatgcgccgaggaccacgagggcggcctgctggccctggagcccatgcccaccttcggcaagggcctggacctgagaagagccgccgaggaggccttcgaggtgaaggacgtgctgaacagcaccctggacagcgaggccctgaagcacaccctgtgcagacaggccaagaaccaggcctacgccatgatgctgagcctgagcgaggacacccccctgcacacccccagccagggcagcctggacgcctggctgaaggtgaccggcgccaccagcgagagcggcgccttccaccccatcaaccacctgtag

SEQ ID NO: 94264 - DNA, 3771 bp, Artificial Sequence
  Description of Artificial Sequence: Synthetic coding sequence
atgagaagcaaggccagagccagaaagctggccaagagcgacggcgacgtggtgaacaacatgtacgagcccaacagagacctgctggccagccacagcgccgaggacgaggccgaggacagcgccatgagccccatccccgtgggcccccccagccccttccccaccagcgaggacttcacccccaaggagggcagcccctacgaggcccccgtgtacatccccgaggacatccccatccccgccgacttcgagctgagagagagcagcatccccggcgccggcctgggcgtgtgggccaagagaaagatggaggccggcgagagactgggcccctgcgtggtggtgcccagagccgccgccaaggagaccgacttcggctgggagcagatcctgaccgacgtggaggtgagcccccaggagggctgcatcaccaagatcagcgaggacctgggcagcgagaagttctgcgtggacgccaaccaggccggcgccggcagctggctgaagtacatcagagtggcctgcagctgcgacgaccagaacctgaccatgtgccagatcagcgagcagatctactacaaggtgatcaaggacatcgagcccggcgaggagctgctggtgcacgtgaaggagggcgtgtaccccctgggcaccgtgccccccggcctggacgaggagcccaccttcagatgcgacgagtgcgacgagctgttccagagcaagctggacctgagaagacacaagaagtacacctgcggcagcgtgggcgccgccctgtacgagggcctggccgaggagctgaagcccgagggcctgggcggcggcagcggccaggcccacgagtgcaaggactgcgagagaatgttccccaacaagtacagcctggagcagcacatggtgatccacaccgaggagagagagtacaagtgcgaccagtgccccaaggccttcaactggaagagcaacctgatcagacaccagatgagccacgacagcggcaagagattcgagtgcgagaactgcgtgaaggtgttcaccgaccccagcaacctgcagagacacatcagaagccagcacgtgggcgccagagcccacgcctgccccgactgcggcaagaccttcgccaccagcagcggcctgaagcagcacaagcacatccacagcaccgtgaagcccttcatctgcgaggtgtgccacaagagctacacccagttcagcaacctgtgcagacacaagagaatgcacgccgactgcagaacccagatcaagtgcaaggactgcggccagatgttcagcaccaccagcagcctgaacaagcacagaagattctgcgagggcaagaaccactacacccccggcggcatcttcgcccccggcctgcccctgacccccagccccatgatggacaaggccaagcccagccccagcctgaaccacgccagcctgggcttcaacgagtacttccccagcagaccccaccccggcagcctgcccttcagcaccgccccccccaccttccccgccctgacccccggcttccccggcatcttcccccccagcctgtaccccagaccccccctgctgccccccaccagcctgctgaagagccccctgaaccacacccaggacgccaagctgcccagccccctgggcaaccccgccctgcccctggtgagcgccgtgagcaacagcagccagggcaccaccgccgccgccggccccgaggagaagttcgagagcagactggaggacagctgcgtggagaagctgaagaccagaagcagcgacatgagcgacggcagcgacttcgaggacgtgaacaccaccaccggcaccgacctggacaccaccaccggcaccggcagcgacctggacagcgacgtggacagcgaccccgacaaggacaagggcaagggcaagagcgccgagggccagcccaagttcggcggcggcctggccccccccggcgcccccaacagcgtggccgaggtgcccgtgttctacagccagcacagcttcttccccccccccgacgagcagctgctgaccgccaccggcgccgccggcgacagcatcaaggccatcgccagcatcgccgagaagtacttcggccccggcttcatgggcatgcaggagaagaagctgggcagcctgccctaccacagcgccttccccttccagttcctgcccaacttcccccacagcctgtaccccttcaccgacagagccctggcccacaacctgctggtgaaggccgagcccaagagccccagagacgccctgaaggtgggcggccccagcgccgagtgccccttcgacctgaccaccaagcccaaggacgtgaagcccatcctgcccatgcccaagggccccagcgcccccgccagcggcgaggagcagcccctggacctgagcatcggcagcagagccagagccagccagaacggcggcggcagagagcccagaaagaaccacgtgtacggcgagagaaagctgggcgccggcgagggcctgccccaggtgtgccccgccagaatgccccagcagccccccctgcactacgccaagcccagccccttcttcatggaccccatctacagagtggagaagagaaaggtgaccgaccccgtgggcgccctgaaggagaagtacctgagacccagccccctgctgttccacccccagatgagcgccatcgagaccatgaccgagaagctggagagcttcgccgccatgaaggccgacagcggcagcagcctgcagcccctgccccaccaccccttcaacttcagaagccccccccccaccctgagcgaccccatcctgagaaagggcaaggagagatacacctgcagatactgcggcaagatcttccccagaagcgccaacctgaccagacacctgagaacccacaccggcgagcagccctacagatgcaagtactgcgacagaagcttcagcatcagcagcaacctgcagagacacgtgagaaacatccacaacaaggagaagcccttcaagtgccacctgtgcaacagatgcttcggccagcagaccaacctggacagacacctgaagaagcacgagcacgagaacgcccccgtgagccagcaccccggcgtgctgaccaaccacctgggcaccagcgccagcagccccaccagcgagagcgacaaccacgccctgctggacgagaaggaggacagctacttcagcgagatcagaaacttcatcgccaacagcgagatgaaccaggccagcaccagaaccgagaagagagccgacatgcagatcgtggacggcagcgcccagtgccccggcctggccagcgagaagcaggaggacgtggaggaggaggacgacgacgacctggaggaggacgacgaggacagcctggccggcaagagccaggacgacaccgtgagccccgcccccgagccccaggccgcctacgaggacgaggaggacgaggagcccgccgccagcctggccgtgggcttcgaccacaccagaagatgcgccgaggaccacgagggcggcctgctggccctggagcccatgcccaccttcggcaagggcctggacctgagaagagccgccgaggaggccttcgaggtgaaggacgtgctgaacagcaccctggacagcgaggccctgaagcacaccctgtgcagacaggccaagaaccagggcagcctggacgcctggctgaaggtgaccggcgccaccagcgagagcggcgccttccaccccatcaaccacctgtag

SEQ ID NO: 94265 - DNA, 3255 bp, Artificial Sequence
  Description of Artificial Sequence: Synthetic coding sequence
atctactacaaggtgatcaaggacatcgagcccggcgaggagctgctggtgcacgtgaaggagggcgtgtaccccctgggcaccgtgccccccggcctggacgaggagcccaccttcagatgcgacgagtgcgacgagctgttccagagcaagctggacctgagaagacacaagaagtacacctgcggcagcgtgggcgccgccctgtacgagggcctggccgaggagctgaagcccgagggcctgggcggcggcagcggccaggcccacgagtgcaaggactgcgagagaatgttccccaacaagtacagcctggagcagcacatggtgatccacaccgaggagagagagtacaagtgcgaccagtgccccaaggccttcaactggaagagcaacctgatcagacaccagatgagccacgacagcggcaagagattcgagtgcgagaactgcgtgaaggtgttcaccgaccccagcaacctgcagagacacatcagaagccagcacgtgggcgccagagcccacgcctgccccgactgcggcaagaccttcgccaccagcagcggcctgaagcagcacaagcacatccacagcaccgtgaagcccttcatctgcgaggtgtgccacaagagctacacccagttcagcaacctgtgcagacacaagagaatgcacgccgactgcagaacccagatcaagtgcaaggactgcggccagatgttcagcaccaccagcagcctgaacaagcacagaagattctgcgagggcaagaaccactacacccccggcggcatcttcgcccccggcctgcccctgacccccagccccatgatggacaaggccaagcccagccccagcctgaaccacgccagcctgggcttcaacgagtacttccccagcagaccccaccccggcagcctgcccttcagcaccgccccccccaccttccccgccctgacccccggcttccccggcatcttcccccccagcctgtaccccagaccccccctgctgccccccaccagcctgctgaagagccccctgaaccacacccaggacgccaagctgcccagccccctgggcaaccccgccctgcccctggtgagcgccgtgagcaacagcagccagggcaccaccgccgccgccggccccgaggagaagttcgagagcagactggaggacagctgcgtggagaagctgaagaccagaagcagcgacatgagcgacggcagcgacttcgaggacgtgaacaccaccaccggcaccgacctggacaccaccaccggcaccggcagcgacctggacagcgacgtggacagcgaccccgacaaggacaagggcaagggcaagagcgccgagggccagcccaagttcggcggcggcctggccccccccggcgcccccaacagcgtggccgaggtgcccgtgttctacagccagcacagcttcttccccccccccgacgagcagctgctgaccgccaccggcgccgccggcgacagcatcaaggccatcgccagcatcgccgagaagtacttcggccccggcttcatgggcatgcaggagaagaagctgggcagcctgccctaccacagcgccttccccttccagttcctgcccaacttcccccacagcctgtaccccttcaccgacagagccctggcccacaacctgctggtgaaggccgagcccaagagccccagagacgccctgaaggtgggcggccccagcgccgagtgccccttcgacctgaccaccaagcccaaggacgtgaagcccatcctgcccatgcccaagggccccagcgcccccgccagcggcgaggagcagcccctggacctgagcatcggcagcagagccagagccagccagaacggcggcggcagagagcccagaaagaaccacgtgtacggcgagagaaagctgggcgccggcgagggcctgccccaggtgtgccccgccagaatgccccagcagccccccctgcactacgccaagcccagccccttcttcatggaccccatctacagagtggagaagagaaaggtgaccgaccccgtgggcgccctgaaggagaagtacctgagacccagccccctgctgttccacccccagatgagcgccatcgagaccatgaccgagaagctggagagcttcgccgccatgaaggccgacagcggcagcagcctgcagcccctgccccaccaccccttcaacttcagaagccccccccccaccctgagcgaccccatcctgagaaagggcaaggagagatacacctgcagatactgcggcaagatcttccccagaagcgccaacctgaccagacacctgagaacccacaccggcgagcagccctacagatgcaagtactgcgacagaagcttcagcatcagcagcaacctgcagagacacgtgagaaacatccacaacaaggagaagcccttcaagtgccacctgtgcaacagatgcttcggccagcagaccaacctggacagacacctgaagaagcacgagcacgagaacgcccccgtgagccagcaccccggcgtgctgaccaaccacctgggcaccagcgccagcagccccaccagcgagagcgacaaccacgccctgctggacgagaaggaggacagctacttcagcgagatcagaaacttcatcgccaacagcgagatgaaccaggccagcaccagaaccgagaagagagccgacatgcagatcgtggacggcagcgcccagtgccccggcctggccagcgagaagcaggaggacgtggaggaggaggacgacgacgacctggaggaggacgacgaggacagcctggccggcaagagccaggacgacaccgtgagccccgcccccgagccccaggccgcctacgaggacgaggaggacgaggagcccgccgccagcctggccgtgggcttcgaccacaccagaagatgcgccgaggaccacgagggcggcctgctggccctggagcccatgcccaccttcggcaagggcctggacctgagaagagccgccgaggaggccttcgaggtgaaggacgtgctgaacagcaccctggacagcgaggccctgaagcacaccctgtgcagacaggccaagaaccaggcctacgccatgatgctgagcctgagcgaggacacccccctgcacacccccagccagggcagcctggacgcctggctgaaggtgaccggcgccaccagcgagagcggcgccttccaccccatcaaccacctgtag

SEQ ID NO: 94266 - DNA, 3774 bp, Artificial Sequence
  Description of Artificial Sequence: Synthetic coding sequence
atgagaagcaaggccagagccagaaagctggccaagagcgacggcgacgtggtgaacaacatgtacgagcccaacagagacctgctggccagccacagcgccgaggacgaggccgaggacagcgccatgagccccatccccgtgggcccccccagccccttccccaccagcgaggacttcacccccaaggagggcagcccctacgaggcccccgtgtacatccccgaggacatccccatccccgccgacttcgagctgagagagagcagcatccccggcgccggcctgggcgtgtgggccaagagaaagatggaggccggcgagagactgggcccctgcgtggtggtgcccagagccgccgccaaggagaccgacttcggctgggagcagatcctgaccgacgtggaggtgagcccccaggagggctgcatcaccaagatcagcgaggacctgggcagcgagaagttctgcgtggacgccaaccaggccggcgccggcagctggctgaagtacatcagagtggcctgcagctgcgacgaccagaacctgaccatgtgccagatcagcgagcagatctactacaaggtgatcaaggacatcgagcccggcgaggagctgctggtgcacgtgaaggagggcgtgtaccccctgggcaccgtgccccccggcctggacgaggagcccaccttcagatgcgacgagtgcgacgagctgttccagagcaagctggacctgagaagacacaagaagtacacctgcggcagcgtgggcgccgccctgtacgagggcctggccgaggagctgaagcccgagggcctgggcggcggcagcggccaggcccacgagtgcaaggactgcgagagaatgttccccaacaagtacagcctggagcagcacatggtgatccacaccgaggagagagagtacaagtgcgaccagtgccccaaggccttcaactggaagagcaacctgatcagacaccagatgagccacgacagcggcaagagattcgagtgcgagaactgcgtgaaggtgttcaccgaccccagcaacctgcagagacacatcagaagccagcacgtgggcgccagagcccacgcctgccccgactgcggcaagaccttcgccaccagcagcggcctgaagcagcacaagcacatccacagcaccgtgaagcccttcatctgcgaggtgtgccacaagagctacacccagttcagcaacctgtgcagacacaagagaatgcacgccgactgcagaacccagatcaagtgcaaggactgcggccagatgttcagcaccaccagcagcctgaacaagcacagaagattctgcgagggcaagaaccactacacccccggcggcatcttcgcccccggcctgcccctgacccccagccccatgatggacaaggccaagcccagccccagcctgaaccacgccagcctgggcttcaacgagtacttccccagcagaccccaccccggcagcctgcccttcagcaccgccccccccaccttccccgccctgacccccggcttccccggcatcttcccccccagcctgtaccccagaccccccctgctgccccccaccagcctgctgaagagccccctgaaccacacccaggacgccaagctgcccagccccctgggcaaccccgccctgcccctggtgagcgccgtgagcaacagcagccagggcaccaccgccgccgccggccccgaggagaagttcgagagcagactggaggacagctgcgtggagaagctgaagaccagaagcagcgacatgagcgacggcagcgacttcgaggacgtgaacaccaccaccggcaccgacctggacaccaccaccggcaccggcagcgacctggacagcgacgtggacagcgaccccgacaaggacaagggcaagggcaagagcgccgagggccagcccaagttcggcggcggcctggccccccccggcgcccccaacagcgtggccgaggtgcccgtgttctacagccagcacagcttcttccccccccccgacgagcagctgctgaccgccaccggcgccgccggcgacagcatcaaggccatcgccagcatcgccgagaagtacttcggccccggcttcatgggcatgcaggagaagaagctgggcagcctgccctaccacagcgccttccccttccagttcctgcccaacttcccccacagcctgtaccccttcaccgacagagccctggcccacaacctgctggtgaaggccgagcccaagagccccagagacgccctgaaggtgggcggccccagcgccgagtgccccttcgacctgaccaccaagcccaaggacgtgaagcccatcctgcccatgcccaagggccccagcgcccccgccagcggcgaggagcagcccctggacctgagcatcggcagcagagccagagccagccagaacggcggcggcagagagcccagaaagaaccacgtgtacggcgagagaaagctgggcgccggcgagggcctgccccaggtgtgccccgccagaatgccccagcagccccccctgcactacgccaagcccagccccttcttcatggaccccatctacagcagagtggagaagagaaaggtgaccgaccccgtgggcgccctgaaggagaagtacctgagacccagccccctgctgttccacccccagatgagcgccatcgagaccatgaccgagaagctggagagcttcgccgccatgaaggccgacagcggcagcagcctgcagcccctgccccaccaccccttcaacttcagaagccccccccccaccctgagcgaccccatcctgagaaagggcaaggagagatacacctgcagatactgcggcaagatcttccccagaagcgccaacctgaccagacacctgagaacccacaccggcgagcagccctacagatgcaagtactgcgacagaagcttcagcatcagcagcaacctgcagagacacgtgagaaacatccacaacaaggagaagcccttcaagtgccacctgtgcaacagatgcttcggccagcagaccaacctggacagacacctgaagaagcacgagcacgagaacgcccccgtgagccagcaccccggcgtgctgaccaaccacctgggcaccagcgccagcagccccaccagcgagagcgacaaccacgccctgctggacgagaaggaggacagctacttcagcgagatcagaaacttcatcgccaacagcgagatgaaccaggccagcaccagaaccgagaagagagccgacatgcagatcgtggacggcagcgcccagtgccccggcctggccagcgagaagcaggaggacgtggaggaggaggacgacgacgacctggaggaggacgacgaggacagcctggccggcaagagccaggacgacaccgtgagccccgcccccgagccccaggccgcctacgaggacgaggaggacgaggagcccgccgccagcctggccgtgggcttcgaccacaccagaagatgcgccgaggaccacgagggcggcctgctggccctggagcccatgcccaccttcggcaagggcctggacctgagaagagccgccgaggaggccttcgaggtgaaggacgtgctgaacagcaccctggacagcgaggccctgaagcacaccctgtgcagacaggccaagaaccagggcagcctggacgcctggctgaaggtgaccggcgccaccagcgagagcggcgccttccaccccatcaaccacctgtag

SEQ ID NO: 94267 - DNA, 600 bp, Artificial Sequence
  Description of Artificial Sequence: Synthetic coding sequence
atgagcagcgagaactgcttcgtggccgagaacagcagcctgcaccccgagagcggccaggagaacgacgccaccagcccccacttcagcaccagacacgagggcagcttccaggtgcccgtgctgtgcgccgtgatgaacgtggtgttcatcaccatcctgatcatcgccctgatcgccctgagcgtgggccagtacaactgccccggccagtacaccttcagcatgcccagcgacagccacgtgagcagctgcagcgaggactgggtgggctaccagagaaagtgctacttcatcagcaccgtgaagagaagctggaccagcgcccagaacgcctgcagcgagcacggcgccaccctggccgtgatcgacagcgagaaggacatgaacttcctgaagagatacgccggcagagaggagcactgggtgggcctgaagaaggagcccggccacccctggaagtggagcaacggcaaggagttcaacaactggttcaacgtgaccggcagcgacaagtgcgtgttcctgaagaacaccgaggtgagcagcatggagtgcgagaagaacctgtactggatctgcaacaagccctacaagtag

SEQ ID NO: 94268 - DNA, 228 bp, Artificial Sequence
  Description of Artificial Sequence: Synthetic coding sequence
atgcaccacagaatgaacgagatgaacctgagccccgtgggcatggagcagctgaccagcagcagcgtgagcaacgccctgcccgtgagcggcagccacctgggcctggccgccagccccacccacagcgccatccccgcccccggcctgcccgtggccatccccaacctgggccccagcctgagcagcctgcccagcgccctgagcctgatgctgcccatgggctag

SEQ ID NO: 94269 - DNA, 1893 bp, Artificial Sequence
  Description of Artificial Sequence: Synthetic coding sequence
atgctgggcatgtacgtgcccgacagattcagcctgaagagcagcagagtgcaggacggcatgggcctgtacaccgccagaagagtgagaaagggcgagaagttcggccccttcgccggcgagaagagaatgcccgaggacctggacgagaacatggactacagactgatgtgggaggtgagaggcagcaagggcgaggtgctgtacatcctggacgccaccaaccccagacacagcaactggctgagattcgtgcacgaggcccccagccaggagcagaagaacctggccgccatccaggagggcgagaacatcttctacctggccgtggaggacatcgagaccgacaccgagctgctgatcggctacctggacagcgacatggaggccgaggaggaggagcagcagatcatgaccgtgatcaaggagggcgaggtggagaacagcagaagacagagcaccgccggcagaaaggacagactgggctgcaaggaggactacgcctgcccccagtgcgagagcagcttcaccagcgaggacatcctggccgagcacctgcagaccctgcaccagaagcccaccgaggagaaggagttcaagtgcaagaactgcggcaagaagttccccgtgaagcaggccctgcagagacacgtgctgcagtgcaccgccaagagcagcctgaaggagagcagcagaagcttccagtgcagcgtgtgcaacagcagcttcagcagcgccagcagcttcgagcagcaccaggagacctgcagaggcgacgccagattcgtgtgcaaggccgacagctgcggcaagagactgaagagcaaggacgccctgaagagacaccaggagaacgtgcacaccggcgaccccaagaagaagctgatctgcagcgtgtgcaacaagaagtgcagcagcgccagcagcctgcaggagcacagaaagatccacgagatcttcgactgccaggagtgcatgaagaagttcatcagcgccaaccagctgaagagacacatgatcacccacagcgagaagagaccctacaactgcgagatctgcaacaagagcttcaagagactggaccaggtgggcgcccacaaggtgatccacagcgaggacaagccctacaagtgcaagctgtgcggcaagggcttcgcccacagaaacgtgtacaagaaccacaagaagacccacagcgaggagagacccttccagtgcgaggagtgcaaggccctgttcagaacccccttcagcctgcagagacacctgctgatccacaacagcgagagaaccttcaagtgccaccactgcgacgccaccttcaagagaaaggacaccctgaacgtgcacgtgcaggtggtgcacgagagacacaagaagtacagatgcgagctgtgcaacaaggccttcgtgacccccagcgtgctgagaagccacaagaagacccacaccggcgagaaggagaagatctgcccctactgcggccagaagttcgccagcagcggcaccctgagagtgcacatcagaagccacaccggcgagagaccctaccagtgcccctactgcgagaagggcttcagcaagaacgacggcctgaagatgcacatcagaacccacaccagagagaagccctacaagtgcagcgagtgcagcaaggccttcagccagaagagaggcctggacgagcacaagagaacccacaccggcgagaagcccttccagtgcgacgtgtgcgacctggccttcagcctgaagaagatgctgatcagacacaagatgacccacaaccccaacagacccctggccgagtgccagttctgccacaagaagttcaccagaaacgactacctgaaggtgcacatggacaacatccacggcgtggccgacagctag

SEQ ID NO: 94270 - DNA, 336 bp, Artificial Sequence
  Description of Artificial Sequence: Synthetic coding sequence
atgctgggcatgtacgtgcccgacagattcagcctgaagagcagcagagtgcaggacggcatgggcctgtacaccgccagaagagtgagaaagggcgagaagttcggccccttcgccggcgagaagagaatgcccgaggacctggacgagaacatggactacagactgatgtgggaggtgagaggcagcaagggcgaggtgctgtacatcctggacgccaccaaccccagacacagcaactggctgagattcgtgcacgaggcccccagccaggagcagaagaacctggccgccatccaggacaagaacctgggccccgccgagtggagaggctag

SEQ ID NO: 94271 - DNA, 1800 bp, Artificial Sequence
  Description of Artificial Sequence: Synthetic coding sequence
atgctgggcatgtacgtgcccgacagattcagcctgaagagcagcagagtgcaggacggcatgggcctgtacaccgccagaagagtgagaaagggcgagaagttcggccccttcgccggcgagaagagaatgcccgaggacctggacgagaacatggactacagactgatgtgggaggtgagaggcagcaagggcgaggtgctgtacatcctggacgccaccaaccccagacacagcaactggctgagattcgtgcacgaggcccccagccaggagcagaagaacctggccgccatccaggagggcgagaacatcttctacctggccgtggaggacatcgagaccgacaccgagctgctgatcggctacctggacagcgacatggaggccgaggaggaggagcagcagatcatgaccgtgatcaaggagggcgaggtggagaacagcagaagacagagcaccgccggcagaaaggacagactgggctgcaaggaggactacgcctgcccccagtgcgagagcagcttcaccagcgaggacatcctggccgagcacctgcagaccctgcaccagaagcccaccgaggagaaggagttcaagtgcaagaactgcggcaagaagttccccgtgaagcaggccctgcagagacacttcgagcagcaccaggagacctgcagaggcgacgccagattcgtgtgcaaggccgacagctgcggcaagagactgaagagcaaggacgccctgaagagacaccaggagaacgtgcacaccggcgaccccaagaagaagctgatctgcagcgtgtgcaacaagaagtgcagcagcgccagcagcctgcaggagcacagaaagatccacgagatcttcgactgccaggagtgcatgaagaagttcatcagcgccaaccagctgaagagacacatgatcacccacagcgagaagagaccctacaactgcgagatctgcaacaagagcttcaagagactggaccaggtgggcgcccacaaggtgatccacagcgaggacaagccctacaagtgcaagctgtgcggcaagggcttcgcccacagaaacgtgtacaagaaccacaagaagacccacagcgaggagagacccttccagtgcgaggagtgcaaggccctgttcagaacccccttcagcctgcagagacacctgctgatccacaacagcgagagaaccttcaagtgccaccactgcgacgccaccttcaagagaaaggacaccctgaacgtgcacgtgcaggtggtgcacgagagacacaagaagtacagatgcgagctgtgcaacaaggccttcgtgacccccagcgtgctgagaagccacaagaagacccacaccggcgagaaggagaagatctgcccctactgcggccagaagttcgccagcagcggcaccctgagagtgcacatcagaagccacaccggcgagagaccctaccagtgcccctactgcgagaagggcttcagcaagaacgacggcctgaagatgcacatcagaacccacaccagagagaagccctacaagtgcagcgagtgcagcaaggccttcagccagaagagaggcctggacgagcacaagagaacccacaccggcgagaagcccttccagtgcgacgtgtgcgacctggccttcagcctgaagaagatgctgatcagacacaagatgacccacaaccccaacagacccctggccgagtgccagttctgccacaagaagttcaccagaaacgactacctgaaggtgcacatggacaacatccacggcgtggccgacagctag

SEQ ID NO: 94272 - DNA, 1506 bp, Artificial Sequence
  Description of Artificial Sequence: Synthetic coding sequence
atgctgggcatgtacgtgcccgacagattcagcctgaagagcagcagagtgcaggacggcatgggcctgtacaccgccagaagagtgagaaagggcgagaagttcggccccttcgccggcgagaagagaatgcccgaggacctggacgagaacatggactacagactgatgtgggaggtgagaggcagcaagggcgaggtgctgtacatcctggacgccaccaaccccagacacagcaactggctgagattcgtgcacgaggcccccagccaggagcagaagaacctggccgccatccaggagggcgagaacatcttctacctggccgtggaggacatcgagaccgacaccgagctgctgatcggctacctggacagcgacatggaggccgaggaggaggagcagcagatcatgaccgtgatcaaggagggcgaggtggagaacagcagaagacagagcaccgccggcagaaaggacagactgggctgcaaggaggactacgcctgcccccagtgcgagagcagcttcaccagcgaggacatcctggccgagcacctgcagaccctgcaccagaagcccaccgaggagaaggagttcaagtgcaagaactgcggcaagaagttccccgtgaagcaggccctgcagagacacttcgagcagcaccaggagacctgcagaggcgacgccagattcgtgtgcaaggccgacagctgcggcaagagactgaagagcaaggacgccctgaagagacaccaggagaacgtgcacaccggcgaccccaagaagaagctgatctgcagcgtgtgcaacaagaagtgcagcagcgccagcagcctgcaggagcacagaaagatccacgagatcttcgactgccaggagtgcatgaagaagttcatcagcgccaaccagctgaagagacacatgatcacccacagcgagaagagaccctacaactgcgagatctgcaacaagagcttcaagagactggaccaggtgggcgcccacaaggtgatccacagcgaggacaagccctacaagtgcaagctgtgcggcaagggcttcgcccacagaaacgtgtacaagaaccacaagaagacccacagcgaggagagacccttccagtgcgaggagtgcaaggccctgttcagaacccccttcagcctgcagagacacctgctgatccacaacagcgagagaaccttcaagtgccaccactgcgacgccaccttcaagagaaaggacaccctgaacgtgcacgtgcaggtggtgcacgagagacacaagaagtacagatgcgagctgtgcaacaaggccttcgtgacccccagcgtgctgagaagccacaagaagacccacaccggcgagaaggagaagatctgcccctactgcggccagaagttcgccagcagcggcaccctgagagtgcacatcagaagccacaccggcgaggccgtgcaggtgctgagagtgcagcagggcctgcagcccgaggccagacccggctag

SEQ ID NO: 94273 - DNA, 1227 bp, Artificial Sequence
  Description of Artificial Sequence: Synthetic coding sequence
atgtgccagaacttcttcatcgacagctgcgccgcccacggcccccccaccttcgtgaaggacagcgccgtggacaagggccaccccaacagaagcgccctgagcctgccccccggcctgagaatcggccccagcggcatcccccaggccggcctgggcgtgtggaacgaggccagcgacctgcccctgggcctgcacttcggcccctacgagggcagaatcaccgaggacgaggaggccgccaacaacggctacagctggctgatcaccaagggcagaaactgctacgagtacgtggacggcaaggacaagagctgggccaactggatgagatacgtgaactgcgccagagacgacgaggagcagaacctggtggccttccagtaccacagacagatcttctacagaacctgcagagtgatcagacccggctgcgagctgctggtgtggtacggcgacgagtacggccaggagctgggcatcaagtggggcagcaagtggaagaaggagctgatggccggcagagagcccaagcccgagatccacccctgccccagctgctgcctggccttcagcagccagaagttcctgagccagcacgtggagagaaaccacagcagccagaacttccccggccccagcgccagaaagctgctgcagcccgagaacccctgccccggcgaccagaaccaggagcagcagtaccccgacccccacagcagaaacgacaagaccaagggccaggagatcaaggagagaagcaagctgctgaacaagagaacctggcagagagagatcagcagagccttcagcagcccccccaagggccagatgggcagctgcagagtgggcaagagaatcatggaggaggagagcagaaccggccagaaggtgaaccccggcaacaccggcaagctgttcgtgggcgtgggcatcagcagaatcgccaaggtgaagtacggcgagtgcggccagggcttcagcgtgaagagcgacgtgatcacccaccagagaacccacaccggcgagaagccctacgtgtgcagagagtgcggcagaggcttcagctggcagagcgtgctgctgacccaccagagaacccacaccggcgagaagccctacgtgtgcagagagtgcggcagaggcttcagcagacagagcgtgctgctgacccaccagagaacccacaccggcgagaagccctacgtgtgcagagaggacgagtag

SEQ ID NO: 94274 - DNA, 2685 bp, Artificial Sequence
  Description of Artificial Sequence: Synthetic coding sequence
atgagccccgagaagagccaggaggagagccccgaggaggacaccgagagaaccgagagaaagcccatggtgaaggacgccttcaaggacatcagcatctacttcaccaaggaggagtgggccgagatgggcgactgggagaagaccagatacagaaacgtgaagagaaactacaacgccctgatcaccatcggcctgagagccaccagacccgccttcatgtgccacagaagacaggccatcaagctgcaggtggacgacaccgaggacagcgacgaggagtggacccccagacagcaggtgaagcccccctggatggccctgagagtggagcagagaaagcaccagaagggcatgcccaaggccagcttcagcaacgagagcagcctgaaggagctgagcagaaccgccaacctgctgaacgccagcggcagcgagcaggcccagaagcccgtgagccccagcggcgaggccagcaccagcggccagcacagcagactgaagctggagctgagaaagaaggagaccgagagaaagatgtacagcctgagagagagaaagggccacgcctacaaggaggtgagcgagccccaggacgacgactacctgtactgcgagatgtgccagaacttcttcatcgacagctgcgccgcccacggcccccccaccttcgtgaaggacagcgccgtggacaagggccaccccaacagaagcgccctgagcctgccccccggcctgagaatcggccccagcggcatcccccaggccggcctgggcgtgtggaacgaggccagcgacctgcccctgggcctgcacttcggcccctacgagggcagaatcaccgaggacgaggaggccgccaacaacggctacagctggctgatcaccaagggcagaaactgctacgagtacgtggacggcaaggacaagagctgggccaactggatgagatacgtgaactgcgccagagacgacgaggagcagaacctggtggccttccagtaccacagacagatcttctacagaacctgcagagtgatcagacccggctgcgagctgctggtgtggtacggcgacgagtacggccaggagctgggcatcaagtggggcagcaagtggaagaaggagctgatggccggcagagagcccaagcccgagatccacccctgccccagctgctgcctggccttcagcagccagaagttcctgagccagcacgtggagagaaaccacagcagccagaacttccccggccccagcgccagaaagctgctgcagcccgagaacccctgccccggcgaccagaaccaggagcagcagtaccccgacccccacagcagaaacgacaagaccaagggccaggagatcaaggagagaagcaagctgctgaacaagagaacctggcagagagagatcagcagagccttcagcagcccccccaagggccagatgggcagctgcagagtgggcaagagaatcatggaggaggagagcagaaccggccagaaggtgaaccccggcaacaccggcaagctgttcgtgggcgtgggcatcagcagaatcgccaaggtgaagtacggcgagtgcggccagggcttcagcgtgaagagcgacgtgatcacccaccagagaacccacaccggcgagaagctgtacgtgtgcagagagtgcggcagaggcttcagctggaagagccacctgctgatccaccagagaatccacaccggcgagaagccctacgtgtgcagagagtgcggcagaggcttcagctggcagagcgtgctgctgacccaccagagaacccacaccggcgagaagccctacgtgtgcagagagtgcggcagaggcttcagcagacagagcgtgctgctgacccaccagagaagacacaccggcgagaagccctacgtgtgcagagagtgcggcagaggcttcagcagacagagcgtgctgctgacccaccagagaagacacaccggcgagaagccctacgtgtgcagagagtgcggcagaggcttcagctggcagagcgtgctgctgacccaccagagaacccacaccggcgagaagccctacgtgtgcagagagtgcggcagaggcttcagctggcagagcgtgctgctgacccaccagagaacccacaccggcgagaagccctacgtgtgcagagagtgcggcagaggcttcagcaacaagagccacctgctgagacaccagagaacccacaccggcgagaagccctacgtgtgcagagagtgcggcagaggcttcagagacaagagccacctgctgagacaccagagaacccacaccggcgagaagccctacgtgtgcagagagtgcggcagaggcttcagagacaagagcaacctgctgagccaccagagaacccacaccggcgagaagccctacgtgtgcagagagtgcggcagaggcttcagcaacaagagccacctgctgagacaccagagaacccacaccggcgagaagccctacgtgtgcagagagtgcggcagaggcttcagaaacaagagccacctgctgagacaccagagaacccacaccggcgagaagccctacgtgtgcagagagtgcggcagaggcttcagcgacagaagcagcctgtgctaccaccagagaacccacaccggcgagaagccctacgtgtgcagagaggacgagtag

SEQ ID NO: 94275 - DNA, 303 bp, Artificial Sequence
  Description of Artificial Sequence: Synthetic coding sequence
atgagccccgagaagagccaggaggagagccccgaggaggacaccgagagaaccgagagaaagcccatggtgaaggacgccttcaaggacatcagcatctacttcaccaaggaggagtgggccgagatgggcgactgggagaagaccagatacagaaacgtgaagagaaactacaacgccctgatcaccatcggcctgagagccaccagacccgccttcatgtgccacagaagacaggccatcaagctgcaggtggacgacaccgaggacagcgacgaggagtggacccccagacagcagtag

SEQ ID NO: 94276 - DNA, 537 bp, Artificial Sequence
  Description of Artificial Sequence: Synthetic coding sequence
atgagcgaggtgagactgccccccctgagagccctggacgacttcgtgctgggcagcgccagactggccgcccccgacccctgcgacccccagagatggtgccacagagtgatcaacaacctgctgtactaccagaccaactacctgctgtgcttcggcatcggcctggccctggccggctacgtgagacccctgcacaccctgctgagcgccctggtggtggccgtggccctgggcgtgctggtgtgggccgccgagaccagagccgccgtgagaagatgcagaagaagccaccccgccgcctgcctggccgccgtgctggccgtgggcctgctggtgctgtgggtggccggcggcgcctgcaccttcctgttcagcatcgccggccccgtgctgctgatcctggtgcacgccagcctgagactgagaaacctgaagaacaagatcgagaacaagatcgagagcatcggcctgaagagaacccccatgggcctgctgctggaggccctgggccaggagcaggaggccggcagctag

SEQ ID NO: 94277 - DNA, 846 bp, Artificial Sequence
  Description of Artificial Sequence: Synthetic coding sequence
atggccggcacctggctgctgctgctgctggccctgggctgccccgccctgcccaccggcgtgggcggcacccccttccccagcctggccccccccatcatgctgctggtggacggcaagcagcagatggtggtggtgtgcctggtgctggacgtggccccccccggcctggacagccccatctggttcagcgccggcaacggcagcgccctggacgccttcacctacggccccagccccgccaccgacggcacctggaccaacctggcccacctgagcctgcccagcgaggagctggccagctgggagcccctggtgtgccacaccggccccggcgccgagggccacagcagaagcacccagcccatgcacctgagcggcgaggccagcaccgccagaacctgcccccaggagcccctgagaggcacccccggcggcgccctgtggctgggcgtgctgagactgctgctgttcaagctgctgctgttcgacctgctgctgacctgcagctgcctgtgcgaccccgccggccccctgcccagccccgccaccaccaccagactgagagccctgggcagccacagactgcaccccgccaccgagaccggcggcagagaggccaccagcagccccagaccccagcccagagacagaagatggggcgacaccccccccggcagaaagcccggcagccccgtgtggggcgagggcagctacctgagcagctaccccacctgccccgcccaggcctggtgcagcagaagcgccctgagagcccccagcagcagcctgggcgccttcttcgccggcgacctgcccccccccctgcaggccggcgccgcctag

SEQ ID NO: 94278 - DNA, 384 bp, Artificial Sequence
  Description of Artificial Sequence: Synthetic coding sequence
atggccgccaccagccccggcccctgggtgagcagccccacccacagaagctgcttcctgcccttcctgaccagaggctgccacaacagagtgtgggccgcccaccccttcctgctgtggccccaccagagctgctgctggtggatggagagcagcagatggtggtggagcgcctggagcctgatgctgcaccccctggccctgaccgcccccggcagaaagcccggcagccccgtgtggggcgagggcagctacctgagcagctaccccacctgccccgcccaggcctggtgcagcagaagcgccctgagagcccccagcagcagcctgggcgccttcttcgccggcgacctgcccccccccctgcaggccggcgccgcctag

SEQ ID NO: 94279 - DNA, 771 bp, Artificial Sequence
  Description of Artificial Sequence: Synthetic coding sequence
atggccggcacctggctgctgctgctgctggccctgggctgccccgccctgcccaccggccccgtgagcttccccagcagccccgaggccgccaccaccggccccatctggttcagcgccggcaacggcagcgccctggacgccttcacctacggccccagccccgccaccgacggcacctggaccaacctggcccacctgagcctgcccagcgaggagctggccagctgggagcccctggtgtgccacaccggccccggcgccgagggccacagcagaagcacccagcccatgcacctgagcggcgaggccagcaccgccagaacctgcccccaggagcccctgagaggcacccccggcggcgccctgtggctgggcgtgctgagactgctgctgttcaagctgctgctgttcgacctgctgctgacctgcagctgcctgtgcgaccccgccggccccctgcccagccccgccaccaccaccagactgagagccctgggcagccacagactgcaccccgccaccgagaccggcggcagagaggccaccagcagccccagaccccagcccagagacagaagatggggcgacaccccccccggcagaaagcccggcagccccgtgtggggcgagggcagctacctgagcagctaccccacctgccccgcccaggcctggtgcagcagaagcgccctgagagcccccagcagcagcctgggcgccttcttcgccggcgacctgcccccccccctgcaggccggcgccgcctag

SEQ ID NO: 94280 - DNA, 525 bp, Artificial Sequence
  Description of Artificial Sequence: Synthetic coding sequence
atggccggcacctggctgctgctgctgctggccctgggctgccccgccctgcccaccggcgaggccagcaccgccagaacctgcccccaggagcccctgagaggcacccccggcggcgccctgtggctgggcgtgctgagactgctgctgttcaagctgctgctgttcgacctgctgctgacctgcagctgcctgtgcgaccccgccggccccctgcccagccccgccaccaccaccagactgagagccctgggcagccacagactgcaccccgccaccgagaccggcggcagagaggccaccagcagccccagaccccagcccagagacagaagatggggcgacaccccccccggcagaaagcccggcagccccgtgtggggcgagggcagctacctgagcagctaccccacctgccccgcccaggcctggtgcagcagaagcgccctgagagcccccagcagcagcctgggcgccttcttcgccggcgacctgcccccccccctgcaggccggcgccgcctag

SEQ ID NO: 94281 - DNA, 438 bp, Artificial Sequence
  Description of Artificial Sequence: Synthetic coding sequence
atgagctgggcccccgtgctgctgatgctgttcgtgtactgcaccggctgcggcccccagcccgtgctgcaccagccccccgccatgagcagcgccctgggcaccaccatcagactgacctgcaccctgagaaacgaccacgacatcggcgtgtacagcgtgtactggtaccagcagagacccggccacccccccagattcctgctgagatacttcagccagagcgacaagagccagggcccccaggtgccccccagattcagcggcagcaaggacgtggccagaaacagaggctacctgagcatcagcgagctgcagcccgaggacgaggccatgtactactgcgccatgggcgccagaagcagcgagaaggaggagagagagagagagtgggaggaggagatggagcccaccgccgccagaaccagagtgccctag

SEQ ID NO: 94282 - DNA, 372 bp, Artificial Sequence
  Description of Artificial Sequence: Synthetic coding sequence
atggcctgcagatgcctgagcttcctgctgatgggcaccttcctgagcgtgagccagaccgtgctggcccagctggacgccctgctggtgttccccggccaggtggcccagctgagctgcaccctgagcccccagcacgtgaccatcagagactacggcgtgagctggtaccagcagagagccggcagcgcccccagatacctgctgtactacagaagcgaggaggaccaccacagacccgccgacatccccgacagattcagcgccgccaaggacgaggcccacaacgcctgcgtgctgaccatcagccccgtgcagcccgaggacgacgccgactactactgcagcgtgggctacggcttcagcccctag

SEQ ID NO: 94283 - DNA, 513 bp, Artificial Sequence
  Description of Artificial Sequence: Synthetic coding sequence
atggacgagcagcccagactgatgcacagccacgccggcgtgggcatggccggccaccccggcctgagccagcacctgcaggacggcgccggcggcaccgagggcgagggcggcagaaagcaggacatcggcgacatcctgcagcagatcatgaccatcaccgaccagagcctggacgaggcccaggccagaaagcacgccctgaactgccacagaatgaagcccgccctgttcaacgtgctgtgcgagatcaaggagaagaccgtgctgagcatcagaggcgcccaggaggaggagcccaccgacccccagctgatgagactggacaacatgctgctggccgagggcgtggccggccccgagaagggcggcggcagcgccgccgccgccgccgccgccgccgccagcggcggcgccggcagcgacaacagcgtggagcacagcgactacagagccaagctgagccagatcagacagatctaccacaccgagctggagaagtacgagcagtag

SEQ ID NO: 94284 - DNA, 1044 bp, Artificial Sequence
  Description of Artificial Sequence: Synthetic coding sequence
atggacgagcagcccagactgatgcacagccacgccggcgtgggcatggccggccaccccggcctgagccagcacctgcaggacggcgccggcggcaccgagggcgagggcggcagaaagcaggacatcggcgacatcctgcagcagatcatgaccatcaccgaccagagcctggacgaggcccaggccagaaagcacgccctgaactgccacagaatgaagcccgccctgttcaacgtgctgtgcgagatcaaggagaagaccgtgctgagcatcagaggcgcccaggaggaggagcccaccgacccccagctgatgagactggacaacatgctgctggccgagggcgtggccggccccgagaagggcggcggcagcgccgccgccgccgccgccgccgccgccagcggcggcgccggcagcgacaacagcgtggagcacagcgactacagagccaagctgagccagatcagacagatctaccacaccgagctggagaagtacgagcaggcctgcaacgagttcaccacccacgtgatgaacctgctgagagagcagagcagaaccagacccatcagccccaaggagatcgagagaatggtgagcatcatccacagaaagttcagcagcatccagatgcagctgaagcagagcacctgcgaggccgtgatgatcctgagaagcagattcctggacgccagaagaaagagaagaaacttcaacaagcaggccaccgagatcctgaacgagtacttctacagccacctgagcaacccctaccccagcgaggaggccaaggaggagctggccaagaagtgcggcatcaccgtgagccaggtgagcaactggttcggcaacaagagaatcagatacaagaagaacatcggcaagttccaggaggaggccaacatctacgccgccaagaccgccgtgaccgccaccaacgtgagcgcccacggcagccaggccaacagccccagcacccccaacagcgccggcggctaccccagcccctgctaccagcccgacagaagaatccagtag

SEQ ID NO: 94285 - DNA, 1044 bp, Artificial Sequence; identical to SEQ ID NO: 94284
  Description of Artificial Sequence: Synthetic coding sequence

SEQ ID NO: 94286 - DNA, 1293 bp, Artificial Sequence
  Description of Artificial Sequence: Synthetic coding sequence
atggacgagcagcccagactgatgcacagccacgccggcgtgggcatggccggccaccccggcctgagccagcacctgcaggacggcgccggcggcaccgagggcgagggcggcagaaagcaggacatcggcgacatcctgcagcagatcatgaccatcaccgaccagagcctggacgaggcccaggccagaaagcacgccctgaactgccacagaatgaagcccgccctgttcaacgtgctgtgcgagatcaaggagaagaccgtgctgagcatcagaggcgcccaggaggaggagcccaccgacccccagctgatgagactggacaacatgctgctggccgagggcgtggccggccccgagaagggcggcggcagcgccgccgccgccgccgccgccgccgccagcggcggcgccggcagcgacaacagcgtggagcacagcgactacagagccaagctgagccagatcagacagatctaccacaccgagctggagaagtacgagcaggcctgcaacgagttcaccacccacgtgatgaacctgctgagagagcagagcagaaccagacccatcagccccaaggagatcgagagaatggtgagcatcatccacagaaagttcagcagcatccagatgcagctgaagcagagcacctgcgaggccgtgatgatcctgagaagcagattcctggacgccagaagaaagagaagaaacttcaacaagcaggccaccgagatcctgaacgagtacttctacagccacctgagcaacccctaccccagcgaggaggccaaggaggagctggccaagaagtgcggcatcaccgtgagccaggtgagcaactggttcggcaacaagagaatcagatacaagaagaacatcggcaagttccaggaggaggccaacatctacgccgccaagaccgccgtgaccgccaccaacgtgagcgcccacggcagccaggccaacagccccagcacccccaacagcgccggcagcagcagcagcttcaacatgagcaacagcggcgacctgttcatgagcgtgcagagcctgaacggcgacagctaccagggcgcccaggtgggcgccaacgtgcagagccaggtggacaccctgagacacgtgatcagccagaccggcggctacagcgacggcctggccgccagccagatgtacagcccccagggcatcagcgccaacggcggctggcaggacgccaccacccccagcagcgtgaccagccccaccgagggccccggcagcgtgcacagcgacaccagcaactag

SEQ ID NO: 94287 - DNA, 978 bp, Artificial Sequence
  Description of Artificial Sequence: Synthetic coding sequence
atgagactggacaacatgctgctggccgagggcgtggccggccccgagaagggcggcggcagcgccgccgccgccgccgccgccgccgccagcggcggcgccggcagcgacaacagcgtggagcacagcgactacagagccaagctgagccagatcagacagatctaccacaccgagctggagaagtacgagcaggcctgcaacgagttcaccacccacgtgatgaacctgctgagagagcagagcagaaccagacccatcagccccaaggagatcgagagaatggtgagcatcatccacagaaagttcagcagcatccagatgcagctgaagcagagcacctgcgaggccgtgatgatcctgagaagcagattcctggacgccagaagaaagagaagaaacttcaacaagcaggccaccgagatcctgaacgagtacttctacagccacctgagcaacccctaccccagcgaggaggccaaggaggagctggccaagaagtgcggcatcaccgtgagccaggtgagcaactggttcggcaacaagagaatcagatacaagaagaacatcggcaagttccaggaggaggccaacatctacgccgccaagaccgccgtgaccgccaccaacgtgagcgcccacggcagccaggccaacagccccagcacccccaacagcgccggcagcagcagcagcttcaacatgagcaacagcggcgacctgttcatgagcgtgcagagcctgaacggcgacagctaccagggcgcccaggtgggcgccaacgtgcagagccaggtggacaccctgagacacgtgatcagccagaccggcggctacagcgacggcctggccgccagccagatgtacagcccccagggcatcagcgccaacggcggctggcaggacgccaccacccccagcagcgtgaccagccccaccgagggccccggcagcgtgcacagcgacaccagcaactag

SEQ ID NO: 94288 - DNA, 1113 bp, Artificial Sequence
  Description of Artificial Sequence: Synthetic coding sequence
atgctgctggtgttcttcgtgctgtggacctgcagcctggccctgctggccagcagccagagccccccccccccctgcgccagcgtgctgagcatcagaggcgcccaggaggaggagcccaccgacccccagctgatgagactggacaacatgctgctggccgagggcgtggccggccccgagaagggcggcggcagcgccgccgccgccgccgccgccgccgccagcggcggcgccggcagcgacaacagcgtggagcacagcgactacagagccaagctgagccagatcagacagatctaccacaccgagctggagaagtacgagcaggcctgcaacgagttcaccacccacgtgatgaacctgctgagagagcagagcagaaccagacccatcagccccaaggagatcgagagaatggtgagcatcatccacagaaagttcagcagcatccagatgcagctgaagcagagcacctgcgaggccgtgatgatcctgagaagcagattcctggacgccagaagaaagagaagaaacttcaacaagcaggccaccgagatcctgaacgagtacttctacagccacctgagcaacccctaccccagcgaggaggccaaggaggagctggccaagaagtgcggcatcaccgtgagccaggtgagcaactggttcggcaacaagagaatcagatacaagaagaacatcggcaagttccaggaggaggccaacatctacgccgccaagaccgccgtgaccgccaccaacgtgagcgcccacggcagccaggccaacagccccagcacccccaacagcgccggcagcagcagcagcttcaacatgagcaacagcggcgacctgttcatgagcgtgcagagcctgaacggcgacagctaccagggcgcccaggtgggcgccaacgtgcagagccaggtggacaccctgagacacgtgatcagccagaccggcggctacagcgacggcctggccgccagccagatgtacagcccccagggcatcagcgccaacggcggctggcaggacgccaccacccccagcagcgtgaccagccccaccgagggccccggcagcgtgcacagcgacaccagcaactag

SEQ ID NO: 94289 - DNA, 1263 bp, Artificial Sequence
  Description of Artificial Sequence: Synthetic coding sequence
atggacgagcagcccagactgatgcacagccacgccggcgtgggcatggccggccaccccggcctgagccagcacctgcaggacggcgccggcggcaccgagggcgagggcggcagaaagcaggacatcggcgacatcctgcagcagatcatgaccatcaccgaccagagcctggacgaggcccaggccagaaagcacgccctgaactgccacagaatgaagcccgccctgttcaacgtgctgtgcgagatcaaggagaagaccgtgctgagcatcagaggcgcccaggaggaggagcccaccgacccccagctgatgagactggacaacatgctgctggccgagggcgtggccggccccgagaagggcggcggcagcgccgccgccgccgccgccgccgccgccagcggcggcgccggcagcgacaacagcgtggagcacagcgactacagagccaagctgagccagatcagacagatctaccacaccgagctggagaagtacgagcaggcctgcaacgagttcaccacccacgtgatgaacctgctgagagagcagagcagaaccagacccatcagccccaaggagatcgagagaatggtgagcatcatccacagaaagttcagcagcatccagatgcagctgaagcagagcacctgcgaggccgtgatgatcctgagaagcagattcctggacgccagaagaaagagaagaaacttcaacaagcaggccaccgagatcctgaacgagtacttctacagccacctgagcaacccctaccccagcgaggaggccaaggaggagctggccaagaagtgcggcatcaccgtgagccaggtgagcaactggttcggcaacaagagaatcagatacaagaagaacatcggcaagttccaggaggaggccaacatctacgccgccaagaccgccgtgaccgccaccaacgtgagcgcccacggcagccaggccaacagccccagcacccccaacagcgccggcagcagcagcagcttcaacatgagcaacagcggcgacctgttcatgagcgtgcagagcctgaacggcgacagctaccagggcgcccaggtgggcgccaacgtgcagagccaggtggacaccctgagacacgtgatcagccagaccggcggctacagcgacggcctggccgccagccagatgtacagcccccagggcatcagccacctgcccagacaccccagacaggcccactaccacttcagactgcccacctggcacccctag

SEQ ID NO: 94290 - DNA, 906 bp, Artificial Sequence
  Description of Artificial Sequence: Synthetic coding sequence
atgagactggacaacatgctgctggccgagggcgtggccggccccgagaagggcggcggcagcgccgccgccgccgccgccgccgccgccagcggcggcgccggcagcgacaacagcgtggagcacagcgactacagagccaagctgagccagatcagacagatctaccacaccgagctggagaagtacgagcaggcctgcaacgagttcaccacccacgtgatgaacctgctgagagagcagagcagaaccagacccatcagccccaaggagatcgagagaatggtgagcatcatccacagaaagttcagcagcatccagatgcagctgaagcagagcacctgcgaggccgtgatgatcctgagaagcagattcctggacgccagaagaaagagaagaaacttcaacaagcaggccaccgagatcctgaacgagtacttctacagccacctgagcaacccctaccccagcgaggaggccaaggaggagctggccaagaagtgcggcatcaccgtgagccaggtgagcaactggttcggcaacaagagaatcagatacaagaagaacatcggcaagttccaggaggaggccaacatctacgccgccaagaccgccgtgaccgccaccaacgtgagcgcccacggcagccaggccaacagccccagcacccccaacagcgccggcagcagcagcagcttcaacatgagcaacagcggcgacctgttcatgagcgtgcagagcctgaacggcgacagctaccagggcgcccaggtgggcgccaacgtgcagagccaggtggacaccctgagacacgtgatcagccagaccggcggctacagcgacggcctggccgccagccagatgtacagcccccagggcatcagcgagatcgccagaacctactag

SEQ ID NO: 94291 - DNA, 1020 bp, Artificial Sequence
  Description of Artificial Sequence: Synthetic coding sequence
atggacgagcagcccagactgatgcacagccacgccggcgtgggcatggccggccaccccggcctgagccagcacctgcaggacggcgccggcggcaccgagggcgagggcggcagaaagcaggacatcggcgacatcctgcagcagatcatgaccatcaccgaccagagcctggacgaggcccaggccagaaagcacgccctgaactgccacagaatgaagcccgccctgttcaacgtgctgtgcgagatcaaggagaagaccgtgctgagcatcagaggcgcccaggaggaggagcccaccgacccccagctgatgagactggacaacatgctgctggccgagggcgtggccggccccgagaagggcggcggcagcgccgccgccgccgccgccgccgccgccagcggcggcgccggcagcgacaacagcgtggagcacagcgactacagagccaagctgagccagatcagacagatctaccacaccgagctggagaagtacgagcaggcctgcaacgagttcaccacccacgtgatgaacctgctgagagagcagagcagaaccagacccatcagccccaaggagatcgagagaatggtgagcatcatccacagaaagttcagcagcatccagatgcagctgaagcagagcacctgcgaggccgtgatgatcctgagaagcagattcctggacgccagaagaaagagaagaaacttcaacaagcaggccaccgagatcctgaacgagtacttctacagccacctgagcaacccctaccccagcgaggaggccaaggaggagctggccaagaagtgcggcatcaccgtgagccaggtggacaccctgagacacgtgatcagccagaccggcggctacagcgacggcctggccgccagccagatgtacagcccccagggcatcagcgccaacggcggctggcaggacgccaccacccccagcagcgtgaccagccccaccgagggccccggcagcgtgcacagcgacaccagcaactag

SEQ ID NO: 94292 - DNA, 978 bp, Artificial Sequence; identical to SEQ ID NO: 94287
  Description of Artificial Sequence: Synthetic coding sequence

SEQ ID NO: 94293 - DNA, 978 bp, Artificial Sequence; identical to SEQ ID NO: 94287
  Description of Artificial Sequence: Synthetic coding sequence

SEQ ID NO: 94294 - DNA, 1293 bp, Artificial Sequence
  Description of Artificial Sequence: Synthetic coding sequence
atggacgagagactgctgggcccccccccccccggcggcggcagaggcggcctgggcctggtgagcggcgagcccggcggccccggcgagccccccggcggcggcgaccccggcggcggcagcggcggcgtgcccggcggcagaggcaagcaggacatcggcgacatcctgcagcagatcatgaccatcaccgaccagagcctggacgaggcccaggccaagaagcacgccctgaactgccacagaatgaagcccgccctgttcagcgtgctgtgcgagatcaaggagaagaccggcctgagcatcagaagcagccaggaggaggagcccgtggacccccagctgatgagactggacaacatgctgctggccgagggcgtggccggccccgagaagggcggcggcagcgccgccgccgccgccgccgccgccgccagcggcggcggcgtgagccccgacaacagcatcgagcacagcgactacagaagcaagctggcccagatcagacacatctaccacagcgagctggagaagtacgagcaggcctgcaacgagttcaccacccacgtgatgaacctgctgagagagcagagcagaaccagacccgtggcccccaaggagatggagagaatggtgagcatcatccacagaaagttcagcgccatccagatgcagctgaagcagagcacctgcgaggccgtgatgatcctgagaagcagattcctggacgccagaagaaagagaagaaacttcagcaagcaggccaccgaggtgctgaacgagtacttctacagccacctgagcaacccctaccccagcgaggaggccaaggaggagctggccaagaagtgcggcatcaccgtgagccaggtgagcaactggttcggcaacaagagaatcagatacaagaagaacatcggcaagttccaggaggaggccaacatctacgccgtgaagaccgccgtgagcgtgacccagggcggccacagcagaaccagcagccccaccccccccagcagcgccggcagcggcggcagcttcaacctgagcggcagcggcgacatgttcctgggcatgcccggcctgaacggcgacagctacagcgccagccaggtggagagcctgagacacagcatgggccccggcggctacggcgacaacctgggcggcggccagatgtacagccccagagagatgagagccaacggcagctggcaggaggccgtgacccccagcagcgtgaccagccccaccgagggccccggcagcgtgcacagcgacaccagcaactag

SEQ ID NO: 94295 - DNA, 1293 bp, Artificial Sequence; identical to SEQ ID NO: 94294
  Description of Artificial Sequence: Synthetic coding sequence

SEQ ID NO: 94296 - DNA, 1293 bp, Artificial Sequence; identical to SEQ ID NO: 94294
  Description of Artificial Sequence: Synthetic coding sequence

SEQ ID NO: 94297 - DNA, 1293 bp, Artificial Sequence; identical to SEQ ID NO: 94294
  Description of Artificial Sequence: Synthetic coding sequence

SEQ ID NO: 94298 - DNA, 1293 bp, Artificial Sequence; identical to SEQ ID NO: 94294
  Description of Artificial Sequence: Synthetic coding sequence

SEQ ID NO: 94299 - DNA, 1293 bp, Artificial Sequence; identical to SEQ ID NO: 94294
  Description of Artificial Sequence: Synthetic coding sequence

SEQ ID NO: 94300 - DNA, 1293 bp, Artificial Sequence; identical to SEQ ID NO: 94294
  Description of Artificial Sequence: Synthetic coding sequence

SEQ ID NO: 94301 - DNA, 1392 bp, Artificial Sequence
  Description of Artificial Sequence: Synthetic coding sequence
atggacgagagactgctgggcccccccccccccggcggcggcagaggcggcctgggcctggtgagcggcgagcccggcggccccggcgagccccccggcggcggcgaccccggcggcggcagcggcggcgtgcccggcggcagaggcaagcaggacatcggcgacatcctgcagcagatcatgaccatcaccgaccagagcctggacgaggcccaggccaagaagcacgccctgaactgccacagaatgaagcccgccctgttcagcgtgctgtgcgagatcaaggagaagaccggcctgagcatcagaagcagccaggaggaggagcccgtggacccccagctgatgagactggacaacatgctgctggccgagggcgtggccggccccgagaagggcggcggcagcgccgccgccgccgccgccgccgccgccagcggcggcggcgtgagccccgacaacagcatcgagcacagcgactacagaagcaagctggcccagatcagacacatctaccacagcgagctggagaagtacgagcaggcctgcaacgagttcaccacccacgtgatgaacctgctgagagagcagagcagaaccagacccgtggcccccaaggagatggagagaatggtgagcatcatccacagaaagttcagcgccatccagatgcagctgaagcagagcacctgcgaggccgtgatgatcctgagaagcagattcctggacgccagaagaaagagaagaaacttcagcaagcaggccaccgaggtgctgaacgagtacttctacagccacctgagcaacccctaccccagcgaggaggccaaggaggagctggccaagaagtgcggcatcaccgtgagccaggtgctgtggagactgagagaggagctgagcggcaaggtgcacgccagccagctgggcgccgtggtgagcaactggttcggcaacaagagaatcagatacaagaagaacatcggcaagttccaggaggaggccaacatctacgccgtgaagaccgccgtgatcatcgccgagagaggccccttcggcgtgagaggcaccgagctgagcctgcccagcctgcccccccagggcagcggcggcagcttcaacctgagcggcagcggcgacatgttcctgggcatgcccggcctgaacggcgacagctacagcgccagccaggtgagatgccccagccccctgcaggtggagagcctgagacacagcatgggccccggcggctacggcgacaacctgggcggcggccagatgtacagccccagagagatgagagccaacggcagctggcaggaggccgtgacccccagcagcgtgaccagccccaccgagggccccggcagcgtgcacagcgacaccagcaactag

SEQ ID NO: 94302 - DNA, 1392 bp, Artificial Sequence; identical to SEQ ID NO: 94301
  Description of Artificial Sequence: Synthetic coding sequence

SEQ ID NO: 94303 - DNA, 1317 bp, Artificial Sequence
  Description of Artificial Sequence: Synthetic coding sequence
atggacgagagactgctgggcccccccccccccggcggcggcagaggcggcctgggcctggtgagcggcgagcccggcggccccggcgagccccccggcggcggcgaccccggcggcggcagcggcggcgtgcccggcggcagaggcaagcaggacatcggcgacatcctgcagcagatcatgaccatcaccgaccagagcctggacgaggcccaggccaagaagcacgccctgaactgccacagaatgaagcccgccctgttcagcgtgctgtgcgagatcaaggagaagaccggcctgagcatcagaagcagccaggaggaggagcccgtggacccccagctgatgagactggacaacatgctgctggccgagggcgtggccggccccgagaagggcggcggcagcgccgccgccgccgccgccgccgccgccagcggcggcggcgtgagccccgacaacagcatcgagcacagcgactacagaagcaagctggcccagatcagacacatctaccacagcgagctggagaagtacgagcaggcctgcaacgagttcaccacccacgtgatgaacctgctgagagagcagagcagaaccagacccgtggcccccaaggagatggagagaatggtgagcatcatccacagaaagttcagcgccatccagatgcagctgaagcagagcacctgcgaggccgtgatgatcctgagaagcagattcctggacgccagaagaaagagaagaaacttcagcaagcaggccaccgaggtgctgaacgagtacttctacagccacctgagcaacccctaccccagcgaggaggccaaggaggagctggccaagaagtgcggcatcaccgtgagccaggtgagcaactggttcggcaacaagagaatcagatacaagaagaacatcggcaagttccaggaggaggccaacatctacgccgtgaagaccgccgtgagcgtgacccagggcggccacagcagaaccagcagccccaccccccccagcagcgccggcagcggcggcagcttcaacctgagcggcagcggcgacatgttcctgggcatgcccggcctgaacggcgacagctacagcgccagccaggtgagatgccccagccccctgcaggtggagagcctgagacacagcatgggccccggcggctacggcgacaacctgggcggcggccagatgtacagccccagagagatgagagccaacggcagctggcaggaggccgtgacccccagcagcgtgaccagccccaccgagggccccggcagcgtgcacagcgacaccagcaactag

SEQ ID NO: 94304 - DNA, 1317 bp, Artificial Sequence; identical to SEQ ID NO: 94303
  Description of Artificial Sequence: Synthetic coding sequence

SEQ ID NO: 94305 - DNA, 1392 bp, Artificial Sequence; identical to SEQ ID NO: 94301
  Description of Artificial Sequence: Synthetic coding sequence

SEQ ID NO: 94306 - DNA, 1392 bp, Artificial Sequence; identical to SEQ ID NO: 94301
  Description of Artificial Sequence: Synthetic coding sequence

SEQ ID NO: 94307 - DNA, 1332 bp, Artificial Sequence
  Description of Artificial Sequence: Synthetic coding sequence
ggcgccgagcagggcggcggcctgagagcccccccccagctgtggaccaacggctactggggcagacccctgcaggccggcgccggcggcctgggcctggtgagcggcgagcccggcggccccggcgagccccccggcggcggcgaccccggcggcggcagcggcggcgtgcccggcggcagaggcaagcaggacatcggcgacatcctgcagcagatcatgaccatcaccgaccagagcctggacgaggcccaggccaagaagcacgccctgaactgccacagaatgaagcccgccctgttcagcgtgctgtgcgagatcaaggagaagaccggcctgagcatcagaagcagccaggaggaggagcccgtggacccccagctgatgagactggacaacatgctgctggccgagggcgtggccggccccgagaagggcggcggcagcgccgccgccgccgccgccgccgccgccagcggcggcggcgtgagccccgacaacagcatcgagcacagcgactacagaagcaagctggcccagatcagacacatctaccacagcgagctggagaagtacgagcaggcctgcaacgagttcaccacccacgtgatgaacctgctgagagagcagagcagaaccagacccgtggcccccaaggagatggagagaatggtgagcatcatccacagaaagttcagcgccatccagatgcagctgaagcagagcacctgcgaggccgtgatgatcctgagaagcagattcctggacgccagaagaaagagaagaaacttcagcaagcaggccaccgaggtgctgaacgagtacttctacagccacctgagcaacccctaccccagcgaggaggccaaggaggagctggccaagaagtgcggcatcaccgtgagccaggtgagcaactggttcggcaacaagagaatcagatacaagaagaacatcggcaagttccaggaggaggccaacatctacgccgtgaagaccgccgtgagcgtgacccagggcggccacagcagaaccagcagccccaccccccccagcagcgccggcagcggcggcagcttcaacctgagcggcagcggcgacatgttcctgggcatgcccggcctgaacggcgacagctacagcgccagccaggtggagagcctgagacacagcatgggccccggcggctacggcgacaacctgggcggcggccagatgtacagccccagagagatgagagccaacggcagctggcaggaggccgtgacccccagcagcgtgaccagccccaccgagggccccggcagcgtgcacagcgacaccagcaactag

SEQ ID NO: 94308 - DNA, 1332 bp, Artificial Sequence; identical to SEQ ID NO: 94307
  Description of Artificial Sequence: Synthetic coding sequence

SEQ ID NO: 94309 - DNA, 1317 bp, Artificial Sequence; identical to SEQ ID NO: 94303
  Description of Artificial Sequence: Synthetic coding sequence

SEQ ID NO: 94310 - DNA, 1380 bp, Artificial Sequence
  Description of Artificial Sequence: Synthetic coding sequence
atggacgagagactgctgggcccccccccccccggcggcggcagaggcggcctgggcctggtgagcggcgagcccggcggccccggcgagccccccggcggcggcgaccccggcggcggcagcggcggcgtgcccggcggcagaggcaagcaggacatcggcgacatcctgcagcagatcatgaccatcaccgaccagagcctggacgaggcccaggccaagaagcacgccctgaactgccacagaatgaagcccgccctgttcagcgtgctgtgcgagatcaaggagaagaccggcctgagcatcagaagcagccaggaggaggagcccgtggacccccagctgatgagactggacaacatgctgctggccgagggcgtggccggccccgagaagggcggcggcagcgccgccgccgccgccgccgccgccgccagcggcggcggcgtgagccccgacaacagcatcgagcacagcgactacagaagcaagctggcccagatcagacacatctaccacagcgagctggagaagtacgagcaggcctgcaacgagttcaccacccacgtgatgaacctgctgagagagcagagcagaaccagacccgtggcccccaaggagatggagagaatggtgagcatcatccacagaaagttcagcgccatccagatgcagctgaagcagagcacctgcgaggccgtgatgatcctgagaagcagattcctggacgccagaagaaagagaagaaacttcagcaagcaggccaccgaggtgctgaacgagtacttctacagccacctgagcaacccctaccccagcgaggaggccaaggaggagctggccaagaagtgcggcatcaccgtgagccaggtgctgtggagactgagagaggagctgagcggcaaggtgcacgccagccagctgggcgccgtggtgagcaactggttcggcaacaagagaatcagatacaagaagaacatcggcaagttccaggaggaggccaacatctacgccgtgaagaccgccgtgagcgtgacccagggcggccacagcagaaccagcagccccaccccccccagcagcgccggcagcggcggcagcttcaacctgagcggcagcggcgacatgttcctgggcatgcccggcctgaacggcgacagctacagcgccagccaggtgagatgccccagccccctgcaggtggagagcctgagacacagcatgggccccggcggctacggcgacaacctgggcggcggccagatgtacagccccagagagatgagagccaacggcagctggcaggaggccgtgacccccagcagcgtgaccagccccaccgagggccccggcagcgtgcacagcgacaccagcaactag

SEQ ID NO: 94311 - DNA, 1332 bp, Artificial Sequence; identical to SEQ ID NO: 94307
  Description of Artificial Sequence: Synthetic coding sequence

SEQ ID NO: 94312 - DNA, 1317 bp, Artificial Sequence; identical to SEQ ID NO: 94303
  Description of Artificial Sequence: Synthetic coding sequence

SEQ ID NO: 94313 - DNA, 1317 bp, Artificial Sequence; identical to SEQ ID NO: 94303
  Description of Artificial Sequence: Synthetic coding sequence

SEQ ID NO: 94314 - DNA, 1332 bp, Artificial Sequence; identical to SEQ ID NO: 94307
  Description of Artificial Sequence: Synthetic coding sequence

SEQ ID NO: 94315 - DNA, 1392 bp, Artificial Sequence; identical to SEQ ID NO: 94301
  Description of Artificial Sequence: Synthetic coding sequence

SEQ ID NO: 94316 - DNA, 1332 bp, Artificial Sequence; identical to SEQ ID NO: 94307
  Description of Artificial Sequence: Synthetic coding sequence

SEQ ID NO: 94317 - DNA, 1332 bp, Artificial Sequence; identical to SEQ ID NO: 94307
  Description of Artificial Sequence: Synthetic coding sequence

SEQ ID NO: 94318 - DNA, 1056 bp, Artificial Sequence
  Description of Artificial Sequence: Synthetic coding sequence
atggacgaccagagcagaatgctgcagaccctggccggcgtgaacctggccggccacagcgtgcagggcggcatggccctgcccccccccccccacggccacgagggcgccgacggcgacggcagaaagcaggacatcggcgacatcctgcaccagatcatgaccatcaccgaccagagcctggacgaggcccaggccaagaagcacgccctgaactgccacagaatgaagcccgccctgttcagcgtgctgtgcgagatcaaggagaagaccggcctgagcatcagaggcgcccaggaggaggacccccccgacccccagctgatgagactggacaacatgctgctggccgagggcgtgagcggccccgagaagggcggcggcagcgccgccgccgccgccgccgccgccgccagcggcggcagcagcgacaacagcatcgagcacagcgactacagagccaagctgacccagatcagacagatctaccacaccgagctggagaagtacgagcaggcctgcaacgagttcaccacccacgtgatgaacctgctgagagagcagagcagaaccagacccatcagccccaaggagatcgagagaatggtgggcatcatccacagaaagttcagcagcatccagatgcagctgaagcagagcacctgcgaggccgtgatgatcctgagaagcagattcctggacgccagaagaaagagaagaaacttcagcaagcaggccaccgagatcctgaacgagtacttctacagccacctgagcaacccctaccccagcgaggaggccaaggaggagctggccaagaagtgcagcatcaccgtgagccaggtgagcaactggttcggcaacaagagaatcagatacaagaagaacatcggcaagttccaggaggaggccaacctgtacgccgccaagaccgccgtgaccgccgcccacgccgtggccgccgccgtgcagaacaaccagaccaacagccccaccacccccaacagcggcggctacccccccagctgctaccagagcgacggcagactgcagtag

SEQ ID NO: 94319 - DNA, 762 bp, Artificial Sequence
  Description of Artificial Sequence: Synthetic coding sequence
atgaacctgctgagagagcagagcagaaccagacccatcagccccaaggagatcgagagaatggtgggcatcatccacagaaagttcagcagcatccagatgcagctgaagcagagcacctgcgaggccgtgatgatcctgagaagcagattcctggacgccagaagaaagagaagaaacttcagcaagcaggccaccgagatcctgaacgagtacttctacagccacctgagcaacccctaccccagcgaggaggccaaggaggagctggccaagaagtgcagcatcaccgtgagccaggtgagcaactggttcggcaacaagagaatcagatacaagaagaacatcggcaagttccaggaggaggccaacctgtacgccgccaagaccgccgtgaccgccgcccacgccgtggccgccgccgtgcagaacaaccagaccaacagccccaccacccccaacagcggcagcagcggcagcttcaacctgcccaacagcggcgacatgttcatgaacatgcagagcctgaacggcgacagctaccagggcagccaggtgggcgccaacgtgcagagccaggtggacaccctgagacacgtgatcaaccagaccggcggctacagcgacggcctgggcggcaacagcctgtacagcccccacaacctgaacgccaacggcggctggcaggacgccaccacccccagcagcgtgaccagccccaccgagggccccggcagcgtgcacagcgacaccagcaactag

SEQ ID NO: 94320 - DNA, 1368 bp, Artificial Sequence
  Description of Artificial Sequence: Synthetic coding sequence
atggacgaccagagcagaatgctgcagaccctggccggcgtgaacctggccggccacagcgtgcagggcggcatggccctgcccccccccccccacggccacgagggcgccgacggcgacggcagaaagcaggacatcggcgacatcctgcaccagatcatgaccatcaccgaccagagcctggacgaggcccaggccaagaagcacgccctgaactgccacagaatgaagcccgccctgttcagcgtgctgtgcgagatcaaggagaagaccggcctgagcatcagaggcgcccaggaggaggacccccccgacccccagctgatgagactggacaacatgctgctggccgagggcgtgagcggccccgagaagggcggcggcagcgccgccgccgccgccgccgccgccgccagcggcggcagcagcgacaacagcatcgagcacagcgactacagagccaagctgacccagatcagacagatctaccacaccgagctggagaagtacgagcaggcctgcaacgagttcaccacccacgtgatgaacctgctgagagagcagagcagaaccagacccatcagccccaaggagatcgagagaatggtgggcatcatccacagaaagttcagcagcatccagatgcagctgaagcagagcacctgcgaggccgtgatgatcctgagaagcagattcctggacgccagaagaaagagaagaaacttcagcaagcaggccaccgagatcctgaacgagtacttctacagccacctgagcaacccctaccccagcgaggaggccaaggaggagctggccaagaagtgcagcatcaccgtgagccagagcctggtgaaggaccccaaggagagaggcagcaagggcagcgacatccagcccaccagcgtggtgagcaactggttcggcaacaagagaatcagatacaagaagaacatcggcaagttccaggaggaggccaacctgtacgccgccaagaccgccgtgaccgccgcccacgccgtggccgccgccgtgcagaacaaccagaccaacagccccaccacccccaacagcggcagcagcggcagcttcaacctgcccaacagcggcgacatgttcatgaacatgcagagcctgaacggcgacagctaccagggcagccaggtgggcgccaacgtgcagagccaggtggacaccctgagacacgtgatcaaccagaccggcggctacagcgacggcctgggcggcaacagcctgtacagcccccacaacctgaacgccaacggcggctggcaggacgccaccacccccagcagcgtgaccagccccaccgagggccccggcagcgtgcacagcgacaccagcaactag

SEQ ID NO: 94321 - DNA, 1305 bp, Artificial Sequence
  Description of Artificial Sequence: Synthetic coding sequence
atggacgaccagagcagaatgctgcagaccctggccggcgtgaacctggccggccacagcgtgcagggcggcatggccctgcccccccccccccacggccacgagggcgccgacggcgacggcagaaagcaggacatcggcgacatcctgcaccagatcatgaccatcaccgaccagagcctggacgaggcccaggccaagaagcacgccctgaactgccacagaatgaagcccgccctgttcagcgtgctgtgcgagatcaaggagaagaccggcctgagcatcagaggcgcccaggaggaggacccccccgacccccagctgatgagactggacaacatgctgctggccgagggcgtgagcggccccgagaagggcggcggcagcgccgccgccgccgccgccgccgccgccagcggcggcagcagcgacaacagcatcgagcacagcgactacagagccaagctgacccagatcagacagatctaccacaccgagctggagaagtacgagcaggcctgcaacgagttcaccacccacgtgatgaacctgctgagagagcagagcagaaccagacccatcagccccaaggagatcgagagaatggtgggcatcatccacagaaagttcagcagcatccagatgcagctgaagcagagcacctgcgaggccgtgatgatcctgagaagcagattcctggacgccagaagaaagagaagaaacttcagcaagcaggccaccgagatcctgaacgagtacttctacagccacctgagcaacccctaccccagcgaggaggccaaggaggagctggccaagaagtgcagcatcaccgtgagccaggtgagcaactggttcggcaacaagagaatcagatacaagaagaacatcggcaagttccaggaggaggccaacctgtacgccgccaagaccgccgtgaccgccgcccacgccgtggccgccgccgtgcagaacaaccagaccaacagccccaccacccccaacagcggcagcagcggcagcttcaacctgcccaacagcggcgacatgttcatgaacatgcagagcctgaacggcgacagctaccagggcagccaggtgggcgccaacgtgcagagccaggtggacaccctgagacacgtgatcaaccagaccggcggctacagcgacggcctgggcggcaacagcctgtacagcccccacaacctgaacgccaacggcggctggcaggacgccaccacccccagcagcgtgaccagccccaccgagggccccggcagcgtgcacagcgacaccagcaactag

SEQ ID NO: 94322 - DNA, 789 bp, Artificial Sequence
  Description of Artificial Sequence: Synthetic coding sequence
atgagaggcctgagcatcagaggcgcccaggaggaggacccccccgacccccagctgatgagactggacaacatgctgctggccgagggcgtgagcggccccgagaagggcggcggcagcgccgccgccgccgccgccgccgccgccagcggcggcagcagcgacaacagcatcgagcacagcgactacagagccaagctgacccagatcagacagatctaccacaccgagctggagaagtacgagcaggcctgcaacgagttcaccacccacgtgatgaacctgctgagagagcagagcagaaccagacccatcagccccaaggagatcgagagaatggtgggcatcatccacagaaagttcagcagcatccagatgcagctgaagcagagcacctgcgaggccgtgatgatcctgagaagcagattcctggacgccagaagaaagagaagaaacttcagcaagcaggccaccgagatcctgaacgagtacttctacagccacctgagcaacccctaccccagcgaggaggccaaggaggagctggccaagaagtgcagcatcaccgtgagccaggtgagcaactggttcggcaacaagagaatcagatacaagaagaacatcggcaagttccaggaggaggccaacctgtacgccgccaagaccgccgtgaccgccgcccacgccgtggccgccgccgtgcagaacaaccagaccaacagccccaccacccccaacagcggcggctacccccccagctgctaccagagcgacggcagactgcagtag

SEQ ID NO: 94323 - DNA, 1080 bp, Artificial Sequence
  Description of Artificial Sequence: Synthetic coding sequence
atgaagcccgccctgttcagcgtgctgtgcgagatcaaggagaagaccggcctgagcatcagaggcgcccaggaggaggacccccccgacccccagctgatgagactggacaacatgctgctggccgagggcgtgagcggccccgagaagggcggcggcagcgccgccgccgccgccgccgccgccgccagcggcggcagcagcgacaacagcatcgagcacagcgactacagagccaagctgacccagatcagacagatctaccacaccgagctggagaagtacgagcaggcctgcaacgagttcaccacccacgtgatgaacctgctgagagagcagagcagaaccagacccatcagccccaaggagatcgagagaatggtgggcatcatccacagaaagttcagcagcatccagatgcagctgaagcagagcacctgcgaggccgtgatgatcctgagaagcagattcctggacgccagaagaaagagaagaaacttcagcaagcaggccaccgagatcctgaacgagtacttctacagccacctgagcaacccctaccccagcgaggaggccaaggaggagctggccaagaagtgcagcatcaccgtgagccaggtgagcaactggttcggcaacaagagaatcagatacaagaagaacatcggcaagttccaggaggaggccaacctgtacgccgccaagaccgccgtgaccgccgcccacgccgtggccgccgccgtgcagaacaaccagaccaacagccccaccacccccaacagcggcagcagcggcagcttcaacctgcccaacagcggcgacatgttcatgaacatgcagagcctgaacggcgacagctaccagggcagccaggtgggcgccaacgtgcagagccaggtggacaccctgagacacgtgatcaaccagaccggcggctacagcgacggcctgggcggcaacagcctgtacagcccccacaacctgaacgccaacggcggctggcaggacgccaccacccccagcagcgtgaccagccccaccgagggccccggcagcgtgcacagcgacaccagcaactag

SEQ ID NO: 94324 - DNA, 1530 bp, Artificial Sequence
  Description of Artificial Sequence: Synthetic coding sequence
atggagagaagaagactgtggggcagcatccagagcagatacatcagcatgagcgtgtggaccagccccagaagactggtggagctggccggccagagcctgctgaaggacgaggccctggccatcgccgccctggagctgctgcccagagagctgttcccccccctgttcatggccgccttcgacggcagacacagccagaccctgaaggccatggtgcaggcctggcccttcacctgcctgcccctgggcgtgctgatgaagggccagcacctgcacctggagaccttcaaggccgtgctggacggcctggacgtgctgctggcccaggaggtgagacccagaagatggaagctgcaggtgctggacctgagaaagaacagccaccaggacttctggaccgtgtggagcggcaacagagccagcctgtacagcttccccgagcccgaggccgcccagcccatgaccaagaagagaaaggtggacggcctgagcaccgaggccgagcagcccttcatccccgtggaggtgctggtggacctgttcctgaaggagggcgcctgcgacgagctgttcagctacctgatcgagaaggtgaagagaaagaagaacgtgctgagactgtgctgcaagaagctgaagatcttcgccatgcccatgcaggacatcaagatgatcctgaagatggtgcagctggacagcatcgaggacctggaggtgacctgcacctggaagctgcccaccctggccaagttcagcccctacctgggccagatgatcaacctgagaagactgctgctgagccacatccacgccagcagctacatcagccccgagaaggaggagcagtacatcgcccagttcaccagccagttcctgagcctgcagtgcctgcaggccctgtacgtggacagcctgttcttcctgagaggcagactggaccagctgctgagacacgtgatgaaccccctggagaccctgagcatcaccaactgcagactgagcgagggcgacgtgatgcacctgagccagagccccagcgtgagccagctgagcgtgctgagcctgagcggcgtgatgctgaccgacgtgagccccgagcccctgcaggccctgctggagagagccagcgccaccctgcaggacctggtgttcgacgagtgcggcatcaccgacgaccagctgctggccctgctgcccagcctgagccactgcagccagctgaccaccctgagcttctacggcaacagcatcagcatcagcgccctgcagagcctgctgcagcacctgatcggcctgagcaacctgacccacgtgctgtaccccgtgcccctggagagctacgaggacatccacggcaccctgcacctggagagactggcctacctgcacgccagactgagagagctgctgtgcgagctgggcagacccagcatggtgtggctgagcgccaacccctgcccccactgcggcgacagaaccttctacgaccccgagcccatcctgtgcccctgcttcatgcccaactag

SEQ ID NO: 94325 - DNA, 1530 bp, Artificial Sequence; identical to SEQ ID NO: 94324
  Description of Artificial Sequence: Synthetic coding sequence

SEQ ID NO: 94326 - DNA, 1530 bp, Artificial Sequence; identical to SEQ ID NO: 94324
  Description of Artificial Sequence: Synthetic coding sequence

SEQ ID NO: 94327 - DNA, 261 bp, Artificial Sequence
  Description of Artificial Sequence: Synthetic coding sequence
atggagagaagaagactgtggggcagcatccagagcagatacatcagcatgagcgtgtggaccagccccagaagactggtggagctggccggccagagcctgctgaaggacgaggccctggccatcgccgccctggagctgctgcccagagagctgttcccccccctgttcatggccgccttcgacggcagacacagccagaccctgaaggccatggtgcaggcctggcccttcacctgcctgcccctgggcgtgctgtag

SEQ ID NO: 94328 - DNA, 1530 bp, Artificial Sequence; identical to SEQ ID NO: 94324
  Description of Artificial Sequence: Synthetic coding sequence

SEQ ID NO: 94329 - DNA, 348 bp, Artificial Sequence
  Description of Artificial Sequence: Synthetic coding sequence
atggagagaagaagactgtggggcagcatccagagcagatacatcagcatgagcgtgtggaccagccccagaagactggtggagctggccggccagagcctgctgaaggacgaggccctggccatcgccgccctggagctgctgcccagagagctgttcccccccctgttcatggccgccttcgacggcagacacagccagaccctgaaggccatggtgcaggcctggcccttcacctgcctgcccctgggcgtgctgatgaagggccagcacctgcacctggagaccttcaaggccgtgctggacggcctggacgtgctgctggcccaggaggtgagacccagatag

SEQ ID NO: 94330 - DNA, 459 bp, Artificial Sequence
  Description of Artificial Sequence: Synthetic coding sequence
atggagagaagaagactgtggggcagcatccagagcagatacatcagcatgagcgtgtggaccagccccagaagactggtggagctggccggccagagcctgctgaaggacgaggccctggccatcgccgccctggagctgctgcccagagagctgttcccccccctgttcatggccgccttcgacggcagacacagccagaccctgaaggccatggtgcaggcctggcccttcacctgcctgcccctgggcgtgctgatgaagggccagcacctgcacctggagaccttcaaggccgtgctggacggcctggacgtgctgctggcccaggaggtgagacccagaagatggaagctgcaggtgctggacctgagaaagaacagccaccaggacttctggaccgtgtggagcggcaacagagccagcctgtacagcttccccgagcccgaggccgcctag

SEQ ID NO: 94331 - DNA, 1482 bp, Artificial Sequence
  Description of Artificial Sequence: Synthetic coding sequence
atgagcgtgtggaccagccccagaagactggtggagctggccggccagagcctgctgaaggacgaggccctggccatcgccgccctggagctgctgcccagagagctgttcccccccctgttcatggccgccttcgacggcagacacagccagaccctgaaggccatggtgcaggcctggcccttcacctgcctgcccctgggcgtgctgatgaagggccagcacctgcacctggagaccttcaaggccgtgctggacggcctggacgtgctgctggcccaggaggtgagacccagaagatggaagctgcaggtgctggacctgagaaagaacagccaccaggacttctggaccgtgtggagcggcaacagagccagcctgtacagcttccccgagcccgaggccgcccagcccatgaccaagaagagaaaggtggacggcctgagcaccgaggccgagcagcccttcatccccgtggaggtgctggtggacctgttcctgaaggagggcgcctgcgacgagctgttcagctacctgatcgagaaggtgaagagaaagaagaacgtgctgagactgtgctgcaagaagctgaagatcttcgccatgcccatgcaggacatcaagatgatcctgaagatggtgcagctggacagcatcgaggacctggaggtgacctgcacctggaagctgcccaccctggccaagttcagcccctacctgggccagatgatcaacctgagaagactgctgctgagccacatccacgccagcagctacatcagccccgagaaggaggagcagtacatcgcccagttcaccagccagttcctgagcctgcagtgcctgcaggccctgtacgtggacagcctgttcttcctgagaggcagactggaccagctgctgagacacgtgatgaaccccctggagaccctgagcatcaccaactgcagactgagcgagggcgacgtgatgcacctgagccagagccccagcgtgagccagctgagcgtgctgagcctgagcggcgtgatgctgaccgacgtgagccccgagcccctgcaggccctgctggagagagccagcgccaccctgcaggacctggtgttcgacgagtgcggcatcaccgacgaccagctgctggccctgctgcccagcctgagccactgcagccagctgaccaccctgagcttctacggcaacagcatcagcatcagcgccctgcagagcctgctgcagcacctgatcggcctgagcaacctgacccacgtgctgtaccccgtgcccctggagagctacgaggacatccacggcaccctgcacctggagagactggcctacctgcacgccagactgagagagctgctgtgcgagctgggcagacccagcatggtgtggctgagcgccaacccctgcccccactgcggcgacagaaccttctacgaccccgagcccatcctgtgcccctgcttcatgcccaactag

SEQ ID NO: 94332 - DNA, 606 bp, Artificial Sequence
  Description of Artificial Sequence: Synthetic coding sequence
atggagagaagaagactgtggggcagcatccagagcagatacatcagcatgagcgtgtggaccagccccagaagactggtggagctggccggccagagcctgctgaaggacgaggccctggccatcgccgccctggagctgctgcccagagagctgttcccccccctgttcatggccgccttcgacggcagacacagccagaccctgaaggccatggtgcaggcctggcccttcacctgcctgcccctgggcgtgctgatgaagggccagcacctgcacctggagaccttcaaggccgtgctggacggcctggacgtgctgctggcccaggaggtgagacccagaagatggaagctgcaggtgctggacctgagaaagaacagccaccaggacttctggaccgtgtggagcggcaacagagccagcctgtacagcttccccgagcccgaggccgcccagcccatgaccaagaagagaaaggtggacggcctgagcaccgaggccgagcagcccttcatccccgtggaggtgctggtggacctgttcctgaaggagggcgcctgcgacgagctgttcagctacctgatcgagaaggtgaagagatag

SEQ ID NO: 94333 - DNA, 1482 bp, Artificial Sequence; identical to SEQ ID NO: 94331
  Description of Artificial Sequence: Synthetic coding sequence

SEQ ID NO: 94334 - DNA, 1530 bp, Artificial Sequence; identical to SEQ ID NO: 94324
  Description of Artificial Sequence: Synthetic coding sequence

SEQ ID NO: 94335 - DNA, 369 bp, Artificial Sequence
  Description of Artificial Sequence: Synthetic coding sequence
atggccgcccccgtggacctggagctgaagaaggccttcaccgagctgcaggccaaggtgatcgacacccagcagaaggtgaagctggccgacatccagatcgagcagctgaacagaaccaagaagcacgcccacctgaccgacaccgagatcatgaccctggtggacgagaccaacatgtacgagggcgtgggcagaatgttcatcctgcagagcaaggaggccatccacagccagctgctggagaagcagaagatcgccgaggagaagatcaaggagctggagcagaagaagagctacctggagagaagcgtgaaggaggccgaggacaacatcagagagatgctgatggccagaagagcccagtag

SEQ ID NO: 94336 - DNA, 465 bp, Artificial Sequence
  Description of Artificial Sequence: Synthetic coding sequence
atggccgagaacagcggcagagccggcaagagcagcggcagcggcgccggcaagggcgccgtgagcgccgagcaggtgatcgccggcttcaacagactgagacaggagcagagaggcctggccagcaaggccgccgagctggagatggagctgaacgagcacagcctggtgatcgacaccctgaaggaggtggacgagaccagaaagtgctacagaatggtgggcggcgtgctggtggagagaaccgtgaaggaggtgctgcccgccctggagaacaacaaggagcagatccagaagatcatcgagaccctgacccagcagctgcaggccaagggcaaggagctgaacgagttcagagagaagcacaacatcagactgatgggcgaggacgagaagcccgccgccaaggagaacagcgagggcgccggcgccaaggccagcagcgccggcgtgctggtgagctag

SEQ ID NO: 94337 - DNA, 405 bp, Artificial Sequence
  Description of Artificial Sequence: Synthetic coding sequence
atggccgccaccatgaagaaggccgccgccgaggacgtgaacgtgaccttcgaggaccagcagaagatcaacaagttcgccagaaacaccagcagaatcaccgagctgaaggaggagatcgaggtgaagaagaagcagctgcagaacctggaggacgcctgcgacgacatcatgctggccgacgacgactgcctgatgatcccctaccagatcggcgacgtgttcatcagccacagccaggaggagacccaggagatgctggaggaggccaagaagaacctgcaggaggagatcgacgccctggagagcagagtggagagcatccagagagtgctggccgacctgaaggtgcagctgtacgccaagttcggcagcaacatcaacctggaggccgacgagagctag

SEQ ID NO: 94338 - DNA, 465 bp, Artificial Sequence
  Description of Artificial Sequence: Synthetic coding sequence
atggcccagagcatcaacatcaccgagctgaacctgccccagctggagatgctgaagaaccagctggaccaggaggtggagttcctgagcaccagcatcgcccagctgaaggtggtgcagaccaagtacgtggaggccaaggactgcctgaacgtgctgaacaagagcaacgagggcaaggagctgctggtgcccctgaccagcagcatgtacgtgcccggcaagctgcacgacgtggagcacgtgctgatcgacgtgggcaccggctactacgtggagaagaccgccgaggacgccaaggacttcttcaagagaaagatcgacttcctgaccaagcagatggagaagatccagcccgccctgcaggagaagcacgccatgaagcaggccgtgatggagatgatgagccagaagatccagcagctgaccgccctgggcgccgcccaggccaccgccaaggcctag

SEQ ID NO: 94339 - DNA, 330 bp, Artificial Sequence
  Description of Artificial Sequence: Synthetic coding sequence
atggcccagagcatcaacatcaccgagctgaacctgccccagctggagatgctgaagaaccagctggaccagatgtacgtgcccggcaagctgcacgacgtggagcacgtgctgatcgacgtgggcaccggctactacgtggagaagaccgccgaggacgccaaggacttcttcaagagaaagatcgacttcctgaccaagcagatggagaagatccagcccgccctgcaggagaagcacgccatgaagcaggccgtgatggagatgatgagccagaagatccagcagctgaccgccctgggcgccgcccaggccaccgccaaggcctag

SEQ ID NO: 94340 - DNA, 465 bp, Artificial Sequence; identical to SEQ ID NO: 94338
  Description of Artificial Sequence: Synthetic coding sequence

SEQ ID NO: 94341 - DNA, 1281 bp, Artificial Sequence
  Description of Artificial Sequence: Synthetic coding sequence
atgggcaccctgagcgcccccccctgcacccagagaatcaagtggaagggcctgctgctgaccgccagcctgctgaacttctggaacctgcccaccaccgcccaggtgaccatcgaggccgagcccaccaaggtgagcgagggcaaggacgtgctgctgctggtgcacaacctgccccagaacctgaccggctacatctggtacaagggccagatgagagacctgtaccactacatcaccagctacgtggtggacggcgagatcatcatctacggccccgcctacagcggcagagagaccgcctacagcaacgccagcctgctgatccagaacgtgaccagagaggacgccggcagctacaccctgcacatcatcaagggcgacgacggcaccagaggcgtgaccggcagattcaccttcaccctgcacctggagacccccaagcccagcatcagcagcagcaacctgaaccccagagagaccatggaggccgtgagcctgacctgcgaccccgagacccccgacgccagctacctgtggtggatgaacggccagagcctgcccatgacccacagcctgaagctgagcgagaccaacagaaccctgttcctgctgggcgtgaccaagtacaccgccggcccctacgagtgcgagatcagaaaccccgtgagcgccagcagaagcgaccccgtgaccctgaacctgctgcccaagctgcccaagccctacatcaccatcaacaacctgaaccccagagagaacaaggacgtgctgaacttcacctgcgagcccaagagcgagaactacacctacatctggtggctgaacggccagagcctgcccgtgagccccagagtgaagagacccatcgagaacagaatcctgatcctgcccagcgtgaccagaaacgagaccggcccctaccagtgcgagatcagagacagatacggcggcatcagaagcgaccccgtgaccctgaacgtgctgtacggccccgacctgcccagaatctaccccagcttcacctactacagaagcggcgaggtgctgtacctgagctgcagcgccgacagcaacccccccgcccagtacagctggaccatcaacgagaagttccagctgcccggccagaagctgttcatcagacacatcaccaccaagcacagcggcctgtacgtgtgcagcgtgagaaacagcgccaccggcaaggagagcagcaagagcatgaccgtggaggtgagcggcaagtggatccccgccagcctggccatcggcttctag

SEQ ID NO: 94342 - DNA, 432 bp, Artificial Sequence
  Description of Artificial Sequence: Synthetic coding sequence
atgggcaccctgagcgcccccccctgcacccagagaatcaagtggaagggcctgctgctgaccgccagcctgctgaacttctggaacctgcccaccaccgcccaggtgaccatcgaggccgagcccaccaaggtgagcgagggcaaggacgtgctgctgctggtgcacaacctgccccagaacctgaccggctacatctggtacaagggccagatgagagacctgtaccactacatcaccagctacgtggtggacggcgagatcatcatctacggccccgcctacagcggcagagagaccgcctacagcaacgccagcctgctgatccagaacgtgaccagagaggacgccggcagctacaccctgcacatcatcaagggcgacgacggcaccagaggcgtgaccggcagattcaccttcaccctgcactag

SEQ ID NO: 94343 - DNA, 1287 bp, Artificial Sequence
  Description of Artificial Sequence: Synthetic coding sequence
atgggcaccctgagcgcccccccctgcacccagagaatcaagtggaagggcctgctgctgaccgccagcctgctgaacttctggaacctgcccaccaccgcccaggtgaccatcgaggccgagcccaccaaggtgagcgagggcaaggacgtgctgctgctggtgcacaacctgccccagaacctgaccggctacatctggtacaagggccagatgagagacctgtaccactacatcaccagctacgtggtggacggcgagatcatcatctacggccccgcctacagcggcagagagaccgcctacagcaacgccagcctgctgatccagaacgtgaccagagaggacgccggcagctacaccctgcacatcatcaagggcgacgacggcaccagaggcgtgaccggcagattcaccttcaccctgcacctggagacccccaagcccagcatcagcagcagcaacctgaaccccagagagaccatggaggccgtgagcctgacctgcgaccccgagacccccgacgccagctacctgtggtggatgaacggccagagcctgcccatgacccacagcctgaagctgagcgagaccaacagaaccctgttcctgctgggcgtgaccaagtacaccgccggcccctacgagtgcgagatcagaaaccccgtgagcgccagcagaagcgaccccgtgaccctgaacctgctgcccaagctgcccaagccctacatcaccatcaacaacctgaaccccagagagaacaaggacgtgctgaacttcacctgcgagcccaagagcgagaactacacctacatctggtggctgaacggccagagcctgcccgtgagccccagagtgaagagacccatcgagaacagaatcctgatcctgcccagcgtgaccagaaacgagaccggcccctaccagtgcgagatcagagacagatacggcggcatcagaagcgaccccgtgaccctgaacgtgctgtacggccccgacctgcccagaatctaccccagcttcacctactacagaagcggcgaggtgctgtacctgagctgcagcgccgacagcaacccccccgcccagtacagctggaccatcaacgagaagttccagctgcccggccagaagctgttcatcagacacatcaccaccaagcacagcggcctgtacgtgtgcagcgtgagaaacagcgccaccggcaaggagagcagcaagagcatgaccgtggaggtgagcgcctacagcagcagcatcaactacaccagcggcaacagaaactag

SEQ ID NO: 94344 - DNA, 1260 bp, Artificial Sequence
  Description of Artificial Sequence: Synthetic coding sequence
atgggcaccctgagcgcccccccctgcacccagagaatcaagtggaagggcctgctgctgaccgccagcctgctgaacttctggaacctgcccaccaccgcccaggtgaccatcgaggccgagcccaccaaggtgagcgagggcaaggacgtgctgctgctggtgcacaacctgccccagaacctgaccggctacatctggtacaagggccagatgagagacctgtaccactacatcaccagctacgtggtggacggcgagatcatcatctacggccccgcctacagcggcagagagaccgcctacagcaacgccagcctgctgatccagaacgtgaccagagaggacgccggcagctacaccctgcacatcatcaagggcgacgacggcaccagaggcgtgaccggcagattcaccttcaccctgcacctggagacccccaagcccagcatcagcagcagcaacctgaaccccagagagaccatggaggccgtgagcctgacctgcgaccccgagacccccgacgccagctacctgtggtggatgaacggccagagcctgcccatgacccacagcctgaagctgagcgagaccaacagaaccctgttcctgctgggcgtgaccaagtacaccgccggcccctacgagtgcgagatcagaaaccccgtgagcgccagcagaagcgaccccgtgaccctgaacctgctgcccaagctgcccaagccctacatcaccatcaacaacctgaaccccagagagaacaaggacgtgctgaacttcacctgcgagcccaagagcgagaactacacctacatctggtggctgaacggccagagcctgcccgtgagccccagagtgaagagacccatcgagaacagaatcctgatcctgcccagcgtgaccagaaacgagaccggcccctaccagtgcgagatcagagacagatacggcggcatcagaagcgaccccgtgaccctgaacgtgctgtacggccccgacctgcccagaatctaccccagcttcacctactacagaagcggcgaggtgctgtacctgagctgcagcgccgacagcaacccccccgcccagtacagctggaccatcaacgagaagttccagctgcccggccagaagctgttcatcagacacatcaccaccaagcacagcggcctgtacgtgtgcagcgtgagaaacagcgccaccggcaaggagagcagcaagagcatgaccgtggaggtgagcgactggaccgtgccctag

SEQ ID NO: 94345 - DNA, 1254 bp, Artificial Sequence
  Description of Artificial Sequence: Synthetic coding sequence
atgggcaccctgagcgcccccccctgcacccagagaatcaagtggaagggcctgctgctgaccgccagcctgctgaacttctggaacctgcccaccaccgcccaggtgaccatcgaggccgagcccaccaaggtgagcgagggcaaggacgtgctgctgctggtgcacaacctgccccagaacctgaccggctacatctggtacaagggccagatgagagacctgtaccactacatcaccagctacgtggtggacggcgagatcatcatctacggccccgcctacagcggcagagagaccgcctacagcaacgccagcctgctgatccagaacgtgaccagagaggacgccggcagctacaccctgcacatcatcaagggcgacgacggcaccagaggcgtgaccggcagattcaccttcaccctgcacctggagacccccaagcccagcatcagcagcagcaacctgaaccccagagagaccatggaggccgtgagcctgacctgcgaccccgagacccccgacgccagctacctgtggtggatgaacggccagagcctgcccatgacccacagcctgaagctgagcgagaccaacagaaccctgttcctgctgggcgtgaccaagtacaccgccggcccctacgagtgcgagatcagaaaccccgtgagcgccagcagaagcgaccccgtgaccctgaacctgctgcccaagctgcccaagccctacatcaccatcaacaacctgaaccccagagagaacaaggacgtgctgaacttcacctgcgagcccaagagcgagaactacacctacatctggtggctgaacggccagagcctgcccgtgagccccagagtgaagagacccatcgagaacagaatcctgatcctgcccagcgtgaccagaaacgagaccggcccctaccagtgcgagatcagagacagatacggcggcatcagaagcgaccccgtgaccctgaacgtgctgtacggccccgacctgcccagaatctaccccagcttcacctactacagaagcggcgaggtgctgtacctgagctgcagcgccgacagcaacccccccgcccagtacagctggaccatcaacgagaagttccagctgcccggccagaagctgttcatcagacacatcaccaccaagcacagcggcctgtacgtgtgcagcgtgagaaacagcgccaccggcaaggagagcagcaagagcatgaccgtggaggtgagcgaggccctgtag

SEQ ID NO: 94346 - DNA, 642 bp, Artificial Sequence
  Description of Artificial Sequence: Synthetic coding sequence
atgggccccctgagcgcccccccctgcaccgagcacatcaagtggaagggcctgctgctgaccgtggagacccccaagcccagcatcagcagcagcaacctgaaccccagagaggccatggagaccgtgatcctgacctgcaaccccgagacccccgacgccagctacctgtggtggatgaacggccagagcctgcccatgacccacagaatgcagctgagcgagaccaacagaaccctgttcctgttcggcgtgaccaagtacaccgccggcccctacgagtgcgagatctggaacagcggcagcgccagcagaagcgaccccgtgaccctgaacctgctgcacggccccgacctgcccagaatcttccccagcgtgaccagctactacagcggcgagaacctggacctgagctgcttcgccaacagcaacccccccgcccagtacagctggaccatcaacggcaagttccagctgagcggccagaagctgttcatcccccagatcacccccaagcacaacggcctgtacgcctgcagcgccagaaacagcgccaccggcgaggagagcagcaccagcctgaccatcagagtgatcgccccccccggcctgggcaccttcgccttcaacaaccccacctag

SEQ ID NO: 94347 - DNA, 1008 bp, Artificial Sequence
  Description of Artificial Sequence: Synthetic coding sequence
atgggccccctgagcgcccccccctgcaccgagcacatcaagtggaagggcctgctgctgaccgccctgctgctgaacttctggaacctgcccaccaccgcccaggtgatgatcgaggcccagccccccaaggtgagcgagggcaaggacgtgctgctgctggtgcacaacctgccccagaacctgaccggctacatctggtacaagggccagatcagagacctgtaccactacatcaccagctacgtggtggacggccagatcatcatctacggccccgcctacagcggcagagagaccgtgtacagcaacgccagcctgctgatccagaacgtgaccagagaggacgccggcagctacaccctgcacatcatcaagagaggcgacggcaccagaggcgtgaccggctacttcaccttcaccctgtacctggagacccccaagcccagcatcagcagcagcaacctgaaccccagagaggccatggagaccgtgatcctgacctgcaaccccgagacccccgacgccagctacctgtggtggatgaacggccagagcctgcccatgacccacagaatgcagctgagcgagaccaacagaaccctgttcctgttcggcgtgaccaagtacaccgccggcccctacgagtgcgagatctggaacagcggcagcgccagcagaagcgaccccgtgaccctgaacctgctgcacggccccgacctgcccagaatcttccccagcgtgaccagctactacagcggcgagaacctggacctgagctgcttcgccaacagcaacccccccgcccagtacagctggaccatcaacggcaagttccagctgagcggccagaagctgttcatcccccagatcacccccaagcacaacggcctgtacgcctgcagcgccagaaacagcgccaccggcgaggagagcagcaccagcctgaccatcagagtgatcgccccccccggcctgggcaccttcgccttcaacaaccccacctag

SEQ ID NO: 94348 - DNA, 1008 bp, Artificial Sequence; identical to SEQ ID NO: 94347
  Description of Artificial Sequence: Synthetic coding sequence

SEQ ID NO: 94349 - DNA, 642 bp, Artificial Sequence; identical to SEQ ID NO: 94346
  Description of Artificial Sequence: Synthetic coding sequence

SEQ ID NO: 94350 - DNA, 1008 bp, Artificial Sequence
  Description of Artificial Sequence: Synthetic coding sequence
atgggccccctgagcgcccccccctgcaccgagcacatcaagtggaagggcctgctggtgaccgccagcctgctgaacttctggaacctgcccaccaccgcccaggtgaccatcgaggcccagccccccaaggtgagcgagggcaaggacgtgctgctgctggtgcacaacctgccccagaacctgaccggctacatctggtacaagggccagatcagagacctgtaccactacatcaccagctacgtggtggacggccagatcatcatctacggccccgcctacagcggcagagagaccgcctacagcaacgccagcctgctgatccagaacgtgaccagagaggacgccggcagctacaccctgcacatcatcaagagaggcgacggcaccagaggcgtgaccggctacttcaccttcaccctgtacctggagacccccaagcccagcatcagcagcagcaacctgaaccccagagaggccatggagaccgtgatcctgacctgcgaccccgagacccccgacaccagctaccagtggtggatgaacggccagagcctgcccatgacccacagattccagctgagcgagaccaacagaaccctgttcctgttcggcgtgaccaagtacaccgccggcccctacgagtgcgagatcagaaacagcggcagcgccagcagaagcgaccccgtgaccctgaacctgctgcacggccccgacctgcccagaatccaccccagctacaccaactacagaagcggcgacaacctgtacctgagctgcttcgccaacagcaacccccccgcccagtacagctggaccatcaacggcaagttccagcagagcggccagaacctgttcatcccccagatcaccaccaagcacagcggcctgtacgtgtgcagcgtgagaaacagcgccaccggcgaggagagcagcaccagcctgaccgtgaaggtgagcgccagcaccagaatcggcctgctgcccctgctgaaccccacctag

SEQ ID NO: 94351 - DNA, 1008 bp, Artificial Sequence; identical to SEQ ID NO: 94350
  Description of Artificial Sequence: Synthetic coding sequence

SEQ ID NO: 94352 - DNA, 1008 bp, Artificial Sequence; identical to SEQ ID NO: 94350
  Description of Artificial Sequence: Synthetic coding sequence

SEQ ID NO: 94353 - DNA, 1287 bp, Artificial Sequence
  Description of Artificial Sequence: Synthetic coding sequence
atgggccccctgagcgcccccccctgcacccagagaatcacctggaagggcctgctgctgaccgccctgctgctgaacttctggaacctgcccaccaccgcccaggtgaccatcgaggccgagcccaccaaggtgagcaagggcaaggacgtgctgctgctggtgcacaacctgccccagaacctggccggctacatctggtacaagggccagatgaaggacctgtaccactacatcaccagctacgtggtggacggccagatcatcatctacggccccgcctacagcggcagagagaccgtgtacagcaacgccagcctgctgatccagaacgtgaccagagaggacgccggcagctacaccctgcacatcgtgaagagaggcgacggcaccagaggcgagaccggccacttcaccttcaccctgtacctggagacccccaagcccagcatcagcagcagcaacctgtaccccagagaggacatggaggccgtgagcctgacctgcgaccccgagacccccgacgccagctacctgtggtggatgaacggccagagcctgcccatgacccacagcctgcagctgagcaagaacaagagaaccctgttcctgttcggcgtgaccaagtacaccgccggcccctacgagtgcgagatcagaaaccccgtgagcgccagcagaagcgaccccgtgaccctgaacctgctgcccaagctgcccaagccctacatcaccatcaacaacctgaaccccagagagaacaaggacgtgctggccttcacctgcgagcccaagagcgagaactacacctacatctggtggctgaacggccagagcctgcccgtgagccccagagtgaagagacccatcgagaacagaatcctgatcctgcccagcgtgaccagaaacgagaccggcccctaccagtgcgagatccaggacagatacggcggcatcagaagctaccccgtgaccctgaacgtgctgtacggccccgacctgcccagaatctaccccagcttcacctactaccacagcggcgagaacctgtacctgagctgcttcgccgacagcaacccccccgccgagtacagctggaccatcaacggcaagttccagctgagcggccagaagctgttcatcccccagatcaccaccaagcacagcggcctgtacgcctgcagcgtgagaaacagcgccaccggcatggagagcagcaagagcatgaccgtgaaggtgagcgcccccagcggcaccggccacctgcccggcctgaaccccctgtag

SEQ ID NO: 94354 - DNA, 981 bp, Artificial Sequence
  Description of Artificial Sequence: Synthetic coding sequence
atgggccccctgagcgcccccccctgcacccagagaatcacctggaagggcgtgctgctgaccgccagcctgctgaacttctggaacccccccaccaccgcccaggtgaccatcgaggcccagccccccaaggtgagcgagggcaaggacgtgctgctgctggtgcacaacctgccccagaacctggccggctacatctggtacaagggccagatgacctacctgtaccactacatcaccagctacgtggtggacggccagagaatcatctacggccccgcctacagcggcagagagagagtgtacagcaacgccagcctgctgatccagaacgtgacccaggaggacgccggcagctacaccctgcacatcatcaagagaagagacggcaccggcggcgtgaccggccacttcaccttcaccctgcacctggagacccccaagcccagcatcagcagcagcaacctgaaccccagagaggccatggaggccgtgatcctgacctgcgaccccgccacccccgccgccagctaccagtggtggatgaacggccagagcctgcccatgacccacagactgcagctgagcaagaccaacagaaccctgttcatcttcggcgtgaccaagtacatcgccggcccctacgagtgcgagatcagaaaccccgtgagcgccagcagaagcgaccccgtgaccctgaacctgctgcacggccccgacctgcccagcatctaccccagcttcacctactacagaagcggcgagaacctgtacctgagctgcttcgccgagagcaaccccagagcccagtacagctggaccatcaacggcaagttccagctgagcggccagaagctgagcatcccccagatcaccaccaagcacagcggcctgtacgcctgcagcgtgagaaacagcgccaccggcaaggagagcagcaagagcatcaccgtgaaggtgagcgactggatcctgccctag

SEQ ID NO: 94355 - DNA, 1260 bp, Artificial Sequence
  Description of Artificial Sequence: Synthetic coding sequence
atgggccccctgagcgcccccccctgcacccagagaatcacctggaagggcgtgctgctgaccgccagcctgctgaacttctggaacccccccaccaccgcccaggtgaccatcgaggcccagccccccaaggtgagcgagggcaaggacgtgctgctgctggtgcacaacctgccccagaacctggccggctacatctggtacaagggccagatgacctacctgtaccactacatcaccagctacgtggtggacggccagagaatcatctacggccccgcctacagcggcagagagagagtgtacagcaacgccagcctgctgatccagaacgtgacccaggaggacgccggcagctacaccctgcacatcatcaagagaagagacggcaccggcggcgtgaccggccacttcaccttcaccctgcacctggagacccccaagcccagcatcagcagcagcaacctgaaccccagagaggccatggaggccgtgatcctgacctgcgaccccgccacccccgccgccagctaccagtggtggatgaacggccagagcctgcccatgacccacagactgcagctgagcaagaccaacagaaccctgttcatcttcggcgtgaccaagtacatcgccggcccctacgagtgcgagatcagaaaccccgtgagcgccagcagaagcgaccccgtgaccctgaacctgctgcccaagctgagcaagccctacatcaccatcaacaacctgaaccccagagagaacaaggacgtgctgaccttcacctgcgagcccaagagcaagaactacacctacatctggtggctgaacggccagagcctgcccgtgagccccagagtgaagagacccatcgagaacagaatcctgatcctgcccaacgtgaccagaaacgagaccggcccctaccagtgcgagatcagagacagatacggcggcatcagaagcgaccccgtgaccctgaacgtgctgtacggccccgacctgcccagcatctaccccagcttcacctactacagaagcggcgagaacctgtacctgagctgcttcgccgagagcaaccccagagcccagtacagctggaccatcaacggcaagttccagctgagcggccagaagctgagcatcccccagatcaccaccaagcacagcggcctgtacgcctgcagcgtgagaaacagcgccaccggcaaggagagcagcaagagcatcaccgtgaaggtgagcgactggatcctgccctag

SEQ ID NO: 94356 - DNA, 981 bp, Artificial Sequence
  Description of Artificial Sequence: Synthetic coding sequence
atgggccccctgagcgcccccccctgcacccagagaatcacctggaagggcgtgctgctgaccgccagcctgctgaacttctggaacccccccaccaccgcccaggtgaccatcgaggcccagccccccaaggtgagcgagggcaaggacgtgctgctgctggtgcacaacctgccccagaacctggccggctacatctggtacaagggccagatgacctacctgtaccactacatcaccagctacgtggtggacggccagagaatcatctacggccccgcctacagcggcagagagagagtgtacagcaacgccagcctgctgatccagaacgtgacccaggaggacgccggcagctacaccctgcacatcatcaagagaagagacggcaccggcggcgtgaccggccacttcaccttcaccctgcaccccaagctgagcaagccctacatcaccatcaacaacctgaaccccagagagaacaaggacgtgctgaccttcacctgcgagcccaagagcaagaactacacctacatctggtggctgaacggccagagcctgcccgtgagccccagagtgaagagacccatcgagaacagaatcctgatcctgcccaacgtgaccagaaacgagaccggcccctaccagtgcgagatcagagacagatacggcggcatcagaagcgaccccgtgaccctgaacgtgctgtacggccccgacctgcccagcatctaccccagcttcacctactacagaagcggcgagaacctgtacctgagctgcttcgccgagagcaaccccagagcccagtacagctggaccatcaacggcaagttccagctgagcggccagaagctgagcatcccccagatcaccaccaagcacagcggcctgtacgcctgcagcgtgagaaacagcgccaccggcaaggagagcagcaagagcatcaccgtgaaggtgagcgactggatcctgccctag

SEQ ID NO: 94357 - DNA, 1008 bp, Artificial Sequence
  Description of Artificial Sequence: Synthetic coding sequence
atgggccccctgagcgcccccccctgcacccagcacatcacctggaagggcctgctgctgaccgccagcctgctgaacttctggaacctgcccatcaccgcccaggtgaccatcgaggccctgccccccaaggtgagcgagggcaaggacgtgctgctgctggtgcacaacctgccccagaacctggccggctacatctggtacaagggccagctgatggacctgtaccactacatcaccagctacgtggtggacggccagatcaacatctacggccccgcctacaccggcagagagaccgtgtacagcaacgccagcctgctgatccagaacgtgaccagagaggacgccggcagctacaccctgcacatcatcaagagaggcgacagaaccagaggcgtgaccggctacttcaccttcaacctgtacctgaagctgcccaagccctacatcaccatcaacaacagcaagcccagagagaacaaggacgtgctggccttcacctgcgagcccaagagcgagaactacacctacatctggtggctgaacggccagagcctgcccgtgagccccagagtgaagagacccatcgagaacagaatcctgatcctgcccagcgtgaccagaaacgagaccggcccctacgagtgcgagatcagagacagagacggcggcatgagaagcgaccccgtgaccctgaacgtgctgtacggccccgacctgcccagcatctaccccagcttcacctactacagaagcggcgagaacctgtacctgagctgcttcgccgagagcaacccccccgccgagtacttctggaccatcaacggcaagttccagcagagcggccagaagctgagcatcccccagatcaccaccaagcacagaggcctgtacacctgcagcgtgagaaacagcgccaccggcaaggagagcagcaagagcatgaccgtggaggtgagcgcccccagcggcatcggcagactgcccctgctgaaccccatctag

SEQ ID NO: 94358 - DNA, 1008 bp, Artificial Sequence; identical to SEQ ID NO: 94357
  Description of Artificial Sequence: Synthetic coding sequence

SEQ ID NO: 94359 - DNA, 1008 bp, Artificial Sequence; identical to SEQ ID NO: 94357
  Description of Artificial Sequence: Synthetic coding sequence

SEQ ID NO: 94360 - DNA, 1275 bp, Artificial Sequence
  Description of Artificial Sequence: Synthetic coding sequence
atgggccccctgagcgcccccccctgcacccagcacatcacctggaagggcctgctgctgaccgccagcctgctgaacttctggaacctgcccaccaccgcccaggtgatcatcgaggccaagccccccaaggtgagcgagggcaaggacgtgctgctgctggtgcacaacctgccccagaacctgaccggctacatctggtacaagggccagatgaccgacctgtaccactacatcaccagctacgtggtgcacggccagatcatctacggccccgcctacagcggcagagagaccgtgtacagcaacgccagcctgctgatccagaacgtgacccaggaggacgccggcagctacaccctgcacatcatcaagagaggcgacggcaccggcggcgtgaccggctacttcaccgtgaccctgtacagcgagacccccaagcccagcatcagcagcagcaacctgaaccccagagaggtgatggaggccgtgagactgatctgcgaccccgagacccccgacgccagctacctgtggctgctgaacggccagaacctgcccatgacccacagactgcagctgagcaagaccaacagaaccctgtacctgttcggcgtgaccaagtacatcgccggcccctacgagtgcgagatcagaaaccccgtgagcgccagcagaagcgaccccgtgaccctgaacctgctgcccaagctgcccatgccctacatcaccatcaacaacctgaaccccagagagaagaaggacgtgctggccttcacctgcgagcccaagagcagaaactacacctacatctggtggctgaacggccagagcctgcccgtgagccccagagtgaagagacccatcgagaacagaatcctgatcctgcccagcgtgaccagaaacgagaccggcccctaccagtgcgagatcagagacagatacggcggcatcagaagcaaccccgtgaccctgaacgtgctgtacggccccgacctgcccagaatctaccccagcttcacctactacagaagcggcgagaacctggacctgagctgcttcgccgacagcaacccccccgccgagtacagctggaccatcaacggcaagttccagctgagcggccagaagctgttcatcccccagatcaccaccaaccacagcggcctgtacgcctgcagcgtgagaaacagcgccaccggcaaggagatcagcaagagcatgatcgtgaaggtgagcggcccctgccacggcaaccagaccgagagccactag

SEQ ID NO: 94361 - DNA, 1308 bp, Artificial Sequence
  Description of Artificial Sequence: Synthetic coding sequence
atgggccccctgagcgcccccccctgcacccagcacatcacctggaagggcctgctgctgaccgccagcctgctgaacttctggaacctgcccaccaccgcccaggtgatcatcgaggccaagccccccaaggtgagcgagggcaaggacgtgctgctgctggtgcacaacctgccccagaacctgaccggctacatctggtacaagggccagatgaccgacctgtaccactacatcaccagctacgtggtgcacggccagatcatctacggccccgcctacagcggcagagagaccgtgtacagcaacgccagcctgctgatccagaacgtgacccaggaggacgccggcagctacaccctgcacatcatcaagagaggcgacggcaccggcggcgtgaccggctacttcaccgtgaccctgtacagcgagacccccaagcccagcatcagcagcagcaacctgaaccccagagaggtgatggaggccgtgagactgatctgcgaccccgagacccccgacgccagctacctgtggctgctgaacggccagaacctgcccatgacccacagactgcagctgagcaagaccaacagaaccctgtacctgttcggcgtgaccaagtacatcgccggcccctacgagtgcgagatcagaaaccccgtgagcgccagcagaagcgaccccgtgaccctgaacctgctgcccaagctgcccatgccctacatcaccatcaacaacctgaaccccagagagaagaaggacgtgctggccttcacctgcgagcccaagagcagaaactacacctacatctggtggctgaacggccagagcctgcccgtgagccccagagtgaagagacccatcgagaacagaatcctgatcctgcccagcgtgaccagaaacgagaccggcccctaccagtgcgagatcagagacagatacggcggcatcagaagcaaccccgtgaccctgaacgtgctgtacggccccgacctgcccagaatctaccccagcttcacctactacagaagcggcgagaacctggacctgagctgcttcgccgacagcaacccccccgccgagtacagctggaccatcaacggcaagttccagctgagcggccagaagctgttcatcccccagatcaccaccaaccacagcggcctgtacgcctgcagcgtgagaaacagcgccaccggcaaggagatcagcaagagcatgatcgtgaaggtgagcgagaccgccagcccccaggtgacctacgccggccccaacacctggttccaggagatcctgctgctgtag

SEQ ID NO: 94362 - DNA, 606 bp, Artificial Sequence
  Description of Artificial Sequence: Synthetic coding sequence
atgggcggcgacgagaacagaggcgtgaccggccacttcaccttcaccctgtacctggagacccccaagcccagcatcagcagcagcaagctgaaccccagagaggccatggaggccgtgagcctgacctgcgaccccgagacccccgacgccagctacctgtggtggatgaacggccagagcctgcccatgagccacagactgcagctgagcgagaccaacagaaccctgttcctgctgggcgtgaccaagtacaccgccggcccctacgagtgcgagatcagaaaccccgtgagcgccagcagaagcgaccccttcaccctgaacctgctgcacggccccgacctgcccagaatctaccccagcttcacctactacagaagcggcgaggtgctgtacctgagctgcagcgccgacagcaacccccccgcccagtacagctggaccatcaacggcaagttccagctgagcggccagaagctgttcatcccccagatcaccaccaagcacagcggcctgtacgcctgcagcgtgagaaacagcgccaccggcaaggagagcagcaagagcatgaccgtgaaggtgagcgactggaccctgccctag

SEQ ID NO: 94363 - DNA, 1281 bp, Artificial Sequence
  Description of Artificial Sequence: Synthetic coding sequence
atgggcctgctgagcgcccccccctgcacccagagaatcacctggaagggcctgctgctgaccgccagcctgctgaacttctggaacccccccaccaccgcccaggtgaccatcgaggcccagcccaccaaggtgagcgagggcaaggacgtgctgctgctggtgcacaacctgccccagaacctgaccggctacatctggtacaagggccagatcagagacctgtaccactacatcaccagctacgtggtggacggccagatcatcatctacggccccgcctacagcggcagagagaccatctacagcaacgccagcctgctgatccagaacgtgacccaggaggacgccggcagctacaccctgcacatcatcatgggcggcgacgagaacagaggcgtgaccggccacttcaccttcaccctgtacctggagacccccaagcccagcatcagcagcagcaagctgaaccccagagaggccatggaggccgtgagcctgacctgcgaccccgagacccccgacgccagctacctgtggtggatgaacggccagagcctgcccatgagccacagactgcagctgagcgagaccaacagaaccctgttcctgctgggcgtgaccaagtacaccgccggcccctacgagtgcgagatcagaaaccccgtgagcgccagcagaagcgaccccttcaccctgaacctgctgcccaagctgcccaagccctacatcaccatcaacaacctgaagcccagagagaacaaggacgtgctgaacttcacctgcgagcccaagagcgagaactacacctacatctggtggctgaacggccagagcctgcccgtgagccccagagtgaagagacccatcgagaacagaatcctgatcctgcccagcgtgaccagaaacgagaccggcccctaccagtgcgagatcagagaccagtacggcggcatcagaagctaccccgtgaccctgaacgtgctgtacggccccgacctgcccagaatctaccccagcttcacctactacagaagcggcgaggtgctgtacctgagctgcagcgccgacagcaacccccccgcccagtacagctggaccatcaacggcaagttccagctgagcggccagaagctgttcatcccccagatcaccaccaagcacagcggcctgtacgcctgcagcgtgagaaacagcgccaccggcaaggagagcagcaagagcatgaccgtgaaggtgagcggcaagagaatccccgtgagcctggccatcggcatctag

SEQ ID NO: 94364 - DNA, 717 bp, Artificial Sequence
  Description of Artificial Sequence: Synthetic coding sequence
atgagccacagactgcagctgagcgagaccaacagaaccctgttcctgctgggcgtgaccaagtacaccgccggcccctacgagtgcgagatcagaaaccccgtgagcgccagcagaagcgaccccttcaccctgaacctgctgcccaagctgcccaagccctacatcaccatcaacaacctgaagcccagagagaacaaggacgtgctgaacttcacctgcgagcccaagagcgagaactacacctacatctggtggctgaacggccagagcctgcccgtgagccccagagtgaagagacccatcgagaacagaatcctgatcctgcccagcgtgaccagaaacgagaccggcccctaccagtgcgagatcagagaccagtacggcggcatcagaagctaccccgtgaccctgaacgtgctgtacggccccgacctgcccagaatctaccccagcttcacctactacagaagcggcgaggtgctgtacctgagctgcagcgccgacagcaacccccccgcccagtacagctggaccatcaacggcaagttccagctgagcggccagaagctgttcatcccccagatcaccaccaagcacagcggcctgtacgcctgcagcgtgagaaacagcgccaccggcaaggagagcagcaagagcatgaccgtgaaggtgagcgcctacagcagcagcatcaactacaccgccgtgtactag

SEQ ID NO: 94365 - DNA, 1260 bp, Artificial Sequence
  Description of Artificial Sequence: Synthetic coding sequence
atgggcctgctgagcgcccccccctgcacccagagaatcacctggaagggcctgctgctgaccgccagcctgctgaacttctggaacccccccaccaccgcccaggtgaccatcgaggcccagcccaccaaggtgagcgagggcaaggacgtgctgctgctggtgcacaacctgccccagaacctgaccggctacatctggtacaagggccagatcagagacctgtaccactacatcaccagctacgtggtggacggccagatcatcatctacggccccgcctacagcggcagagagaccatctacagcaacgccagcctgctgatccagaacgtgacccaggaggacgccggcagctacaccctgcacatcatcatgggcggcgacgagaacagaggcgtgaccggccacttcaccttcaccctgtacctggagacccccaagcccagcatcagcagcagcaagctgaaccccagagaggccatggaggccgtgagcctgacctgcgaccccgagacccccgacgccagctacctgtggtggatgaacggccagagcctgcccatgagccacagactgcagctgagcgagaccaacagaaccctgttcctgctgggcgtgaccaagtacaccgccggcccctacgagtgcgagatcagaaaccccgtgagcgccagcagaagcgaccccttcaccctgaacctgctgcccaagctgcccaagccctacatcaccatcaacaacctgaagcccagagagaacaaggacgtgctgaacttcacctgcgagcccaagagcgagaactacacctacatctggtggctgaacggccagagcctgcccgtgagccccagagtgaagagacccatcgagaacagaatcctgatcctgcccagcgtgaccagaaacgagaccggcccctaccagtgcgagatcagagaccagtacggcggcatcagaagctaccccgtgaccctgaacgtgctgtacggccccgacctgcccagaatctaccccagcttcacctactacagaagcggcgaggtgctgtacctgagctgcagcgccgacagcaacccccccgcccagtacagctggaccatcaacggcaagttccagctgagcggccagaagctgttcatcccccagatcaccaccaagcacagcggcctgtacgcctgcagcgtgagaaacagcgccaccggcaaggagagcagcaagagcatgaccgtgaaggtgagcgactggaccctgccctag

SEQ ID NO: 94366 - DNA, 894 bp, Artificial Sequence
  Description of Artificial Sequence: Synthetic coding sequence
atgggcctgctgagcgcccccccctgcacccagagaatcacctggaagggcctgctgctgaccgtggagacccccaagcccagcatcagcagcagcaagctgaaccccagagaggccatggaggccgtgagcctgacctgcgaccccgagacccccgacgccagctacctgtggtggatgaacggccagagcctgcccatgagccacagactgcagctgagcgagaccaacagaaccctgttcctgctgggcgtgaccaagtacaccgccggcccctacgagtgcgagatcagaaaccccgtgagcgccagcagaagcgaccccttcaccctgaacctgctgcccaagctgcccaagccctacatcaccatcaacaacctgaagcccagagagaacaaggacgtgctgaacttcacctgcgagcccaagagcgagaactacacctacatctggtggctgaacggccagagcctgcccgtgagccccagagtgaagagacccatcgagaacagaatcctgatcctgcccagcgtgaccagaaacgagaccggcccctaccagtgcgagatcagagaccagtacggcggcatcagaagctaccccgtgaccctgaacgtgctgtacggccccgacctgcccagaatctaccccagcttcacctactacagaagcggcgaggtgctgtacctgagctgcagcgccgacagcaacccccccgcccagtacagctggaccatcaacggcaagttccagctgagcggccagaagctgttcatcccccagatcaccaccaagcacagcggcctgtacgcctgcagcgtgagaaacagcgccaccggcaaggagagcagcaagagcatgaccgtgaaggtgagcgactggaccctgccctag

SEQ ID NO: 94367 - DNA, 1209 bp, Artificial Sequence
  Description of Artificial Sequence: Synthetic coding sequence
atgggccccctgcccgcccccagctgcacccagagaatcacctggaagggcctgctgctgaccgccagcctgctgaacttctggaacccccccaccaccgccgaggtgaccatcgaggcccagccccccaaggtgagcgagggcaaggacgtgctgctgctggtgcacaacctgccccagaacctgcccggctacttctggtacaagggcgagatgaccgacctgtaccactacatcatcagctacatcgtggacggcaagatcatcatctacggccccgcctacagcggcagagagaccgtgtacagcaacgccagcctgctgatccagaacgtgaccagaaaggacgccggcacctacaccctgcacatcatcaagagaggcgacgagaccagagaggagatcagacacttcaccttcaccctgtacctggagacccccaagccctacatcagcagcagcaacctgaaccccagagaggccatggaggccgtgagactgatctgcgaccccgagaccctggacgccagctacctgtggtggatgaacggccagagcctgcccgtgacccacagactgcagctgagcaagaccaacagaaccctgtacctgttcggcgtgaccaagtacatcgccggcccctacgagtgcgagatcagaaaccccgtgagcgccagcagaagcgaccccgtgaccctgaacctgctgcacggccccgacctgcccagaatctaccccagcttcacctactacagaagcggcgagaacctggacctgagctgcttcaccgagagcaacccccccgccgagtacttctggaccatcaacggcaagttccagcagagcggccagaagctgttcatcccccagatcaccagaaaccacagcggcctgtacgcctgcagcgtgcacaacagcgccaccggcaaggagatcagcaagagcatgaccgtgaaggtgagcggcaagtggatccccgccagcctggccgtgggcttctacgtggagagcatctggctgagcgagaagagccaggagaacatcttcatccccagcctgtgccccatgggcaccagcaagagccagatcctgctgctgaacccccccaacctgagcctgcagaccctgttcagcctgttcttctgcttcctgatggccgacctggtgagcggcctgaagaaggtgggcagaggcctgtaccagccctag

SEQ ID NO: 94368 - DNA, 1281 bp, Artificial Sequence
  Description of Artificial Sequence: Synthetic coding sequence
atgggccccctgcccgcccccagctgcacccagagaatcacctggaagggcctgctgctgaccgccagcctgctgaacttctggaacccccccaccaccgccgaggtgaccatcgaggcccagccccccaaggtgagcgagggcaaggacgtgctgctgctggtgcacaacctgccccagaacctgcccggctacttctggtacaagggcgagatgaccgacctgtaccactacatcatcagctacatcgtggacggcaagatcatcatctacggccccgcctacagcggcagagagaccgtgtacagcaacgccagcctgctgatccagaacgtgaccagaaaggacgccggcacctacaccctgcacatcatcaagagaggcgacgagaccagagaggagatcagacacttcaccttcaccctgtacctggagacccccaagccctacatcagcagcagcaacctgaaccccagagaggccatggaggccgtgagactgatctgcgaccccgagaccctggacgccagctacctgtggtggatgaacggccagagcctgcccgtgacccacagactgcagctgagcaagaccaacagaaccctgtacctgttcggcgtgaccaagtacatcgccggcccctacgagtgcgagatcagaaaccccgtgagcgccagcagaagcgaccccgtgaccctgaacctgctgcccaagctgcccatcccctacatcaccatcaacaacctgaaccccagagagaacaaggacgtgctggccttcacctgcgagcccaagagcgagaactacacctacatctggtggctgaacggccagagcctgcccgtgagccccggcgtgaagagacccatcgagaacagaatcctgatcctgcccagcgtgaccagaaacgagaccggcccctaccagtgcgagatcagagacagatacggcggcctgagaagcaaccccgtgatcctgaacgtgctgtacggccccgacctgcccagaatctaccccagcttcacctactacagaagcggcgagaacctggacctgagctgcttcaccgagagcaacccccccgccgagtacttctggaccatcaacggcaagttccagcagagcggccagaagctgttcatcccccagatcaccagaaaccacagcggcctgtacgcctgcagcgtgcacaacagcgccaccggcaaggagatcagcaagagcatgaccgtgaaggtgagcggcccctgccacggcgacctgaccgagagccagagctag

SEQ ID NO: 94369 - DNA, 723 bp, Artificial Sequence
  Description of Artificial Sequence: Synthetic coding sequence
atgggccccctgcccgcccccagctgcacccagagaatcacctggaagggcctgctgctgaccgccagcctgctgaacttctggaacccccccaccaccgccgaggtgaccatcgaggcccagccccccaaggtgagcgagggcaaggacgtgctgctgctggtgcacaacctgccccagaacctgcccggctacttctggtacaagggcgagatgaccgacctgtaccactacatcatcagctacatcgtggacggcaagatcatcatctacggccccgcctacagcggcagagagaccgtgtacagcaacgccagcctgctgatccagaacgtgaccagaaaggacgccggcacctacaccctgcacatcatcaagagaggcgacgagaccagagaggagatcagacacttcaccttcaccctgtactacggccccgacctgcccagaatctaccccagcttcacctactacagaagcggcgagaacctggacctgagctgcttcaccgagagcaacccccccgccgagtacttctggaccatcaacggcaagttccagcagagcggccagaagctgttcatcccccagatcaccagaaaccacagcggcctgtacgcctgcagcgtgcacaacagcgccaccggcaaggagatcagcaagagcatgaccgtgaaggtgagcggcccctgccacggcgacctgaccgagagccagagctag

SEQ ID NO: 94370 - DNA, 1164 bp, Artificial Sequence
  Description of Artificial Sequence: Synthetic coding sequence
atgggccccctgcccgcccccagctgcacccagagaatcacctggaagggcctgctgctgaccgccagcctgctgaacttctggtacaagggcgagatgaccgacctgtaccactacatcatcagctacatcgtggacggcaagatcatcatctacggccccgcctacagcggcagagagaccgtgtacagcaacgccagcctgctgatccagaacgtgaccagaaaggacgccggcacctacaccctgcacatcatcaagagaggcgacgagaccagagaggagatcagacacttcaccttcaccctgtacctggagacccccaagccctacatcagcagcagcaacctgaaccccagagaggccatggaggccgtgagactgatctgcgaccccgagaccctggacgccagctacctgtggtggatgaacggccagagcctgcccgtgacccacagactgcagctgagcaagaccaacagaaccctgtacctgttcggcgtgaccaagtacatcgccggcccctacgagtgcgagatcagaaaccccgtgagcgccagcagaagcgaccccgtgaccctgaacctgctgcccaagctgcccatcccctacatcaccatcaacaacctgaaccccagagagaacaaggacgtgctggccttcacctgcgagcccaagagcgagaactacacctacatctggtggctgaacggccagagcctgcccgtgagccccggcgtgaagagacccatcgagaacagaatcctgatcctgcccagcgtgaccagaaacgagaccggcccctaccagtgcgagatcagagacagatacggcggcctgagaagcaaccccgtgatcctgaacgtgctgtacggccccgacctgcccagaatctaccccagcttcacctactacagaagcggcgagaacctggacctgagctgcttcaccgagagcaacccccccgccgagtacttctggaccatcaacggcaagttccagcagagcggccagaagctgttcatcccccagatcaccagaaaccacagcggcctgtacgcctgcagcgtgcacaacagcgccaccggcaaggagatcagcaagagcatgaccgtgaaggtgagcggcccctgccacggcgacctgaccgagagccagagctag

SEQ ID NO: 94371 - DNA, 1002 bp, Artificial Sequence
  Description of Artificial Sequence: Synthetic coding sequence
atgggccccctgcccgcccccagctgcacccagagaatcacctggaagggcctgctgctgaccgccagcctgctgaacttctggaacccccccaccaccgccgaggtgaccatcgaggcccagccccccaaggtgagcgagggcaaggacgtgctgctgctggtgcacaacctgccccagaacctgcccggctacttctggtacaagggcgagatgaccgacctgtaccactacatcatcagctacatcgtggacggcaagatcatcatctacggccccgcctacagcggcagagagaccgtgtacagcaacgccagcctgctgatccagaacgtgaccagaaaggacgccggcacctacaccctgcacatcatcaagagaggcgacgagaccagagaggagatcagacacttcaccttcaccctgtacagcaagctgcccatcccctacatcaccatcaacaacctgaaccccagagagaacaaggacgtgctggccttcacctgcgagcccaagagcgagaactacacctacatctggtggctgaacggccagagcctgcccgtgagccccggcgtgaagagacccatcgagaacagaatcctgatcctgcccagcgtgaccagaaacgagaccggcccctaccagtgcgagatcagagacagatacggcggcctgagaagcaaccccgtgatcctgaacgtgctgtacggccccgacctgcccagaatctaccccagcttcacctactacagaagcggcgagaacctggacctgagctgcttcaccgagagcaacccccccgccgagtacttctggaccatcaacggcaagttccagcagagcggccagaagctgttcatcccccagatcaccagaaaccacagcggcctgtacgcctgcagcgtgcacaacagcgccaccggcaaggagatcagcaagagcatgaccgtgaaggtgagcggcccctgccacggcgacctgaccgagagccagagctag

SEQ ID NO: 94372 - DNA, 1032 bp, Artificial Sequence
  Description of Artificial Sequence: Synthetic coding sequence
atgctgctgctgaagaagcacaccgaggacatcagcagcgtgtacgagatcagagagagactgggcagcggcgccttcagcgaggtggtgctggcccaggagagaggcagcgcccacctggtggccctgaagtgcatccccaagaaggccctgagaggcaaggaggccctggtggagaacgagatcgccgtgctgagaagaatcagccaccccaacatcgtggccctggaggacgtgcacgagagccccagccacctgtacctggccatggagctggtgaccggcggcgagctgttcgacagaatcatggagagaggcagctacaccgagaaggacgccagccacctggtgggccaggtgctgggcgccgtgagctacctgcacagcctgggcatcgtgcacagagacctgaagcccgagaacctgctgtacgccacccccttcgaggacagcaagatcatggtgagcgacttcggcctgagcaagatccaggccggcaacatgctgggcaccgcctgcggcacccccggctacgtggcccccgagctgctggagcagaagccctacggcaaggccgtggacgtgtgggccctgggcgtgatcagctacatcctgctgtgcggctacccccccttctacgacgagagcgaccccgagctgttcagccagatcctgagagccagctacgagttcgacagccccttctgggacgacatcagcgagagcgccaaggacttcatcagacacctgctggagagagacccccagaagagattcacctgccagcaggccctgagacacctgtggatcagcggcgacaccgccttcgacagagacatcctgggcagcgtgagcgagcagatcagaaagaacttcgccagaacccactggaagagagccttcaacgccaccagcttcctgagacacatcagaaagctgggccagatccccgagggcgagggcgccagcgagcagggcatggccagacacagccacagcggcctgagagccggccagccccccaagtggtag

SEQ ID NO: 94373 - DNA, 1101 bp, Artificial Sequence
  Description of Artificial Sequence: Synthetic coding sequence
atgctgctgctgaagaagcacaccgaggacatcagcagcgtgtacgagatcagagagagactgggcagcggcgccttcagcgaggtggtgctggcccaggagagaggcagcgcccacctggtggccctgaagtgcatccccaagaaggccctgagaggcaaggaggccctggtggagaacgagatcgccgtgctgagaagaatcagccaccccaacatcgtggccctggaggacgtgcacgagagccccagccacctgtacctggccatggagctggtgaccggcggcgagctgttcgacagaatcatggagagaggcagctacaccgagaaggacgccagccacctggtgggccaggtgctgggcgccgtgagctacctgcacagcctgggcatcgtgcacagagacctgaagcccgagaacctgctgtacgccacccccttcgaggacagcaagatcatggtgagcgacttcggcctgagcaagatccaggccggcaacatgctgggcaccgcctgcggcacccccggctacgccgagcccgtgaccctgagcggcatggccgcctgcgtgcccgtgagagccagcgtgtgcctgtggccccccgcccccgagctgctggagcagaagccctacggcaaggccgtggacgtgtgggccctgggcgtgatcagctacatcctgctgtgcggctacccccccttctacgacgagagcgaccccgagctgttcagccagatcctgagagccagctacgagttcgacagccccttctgggacgacatcagcgagagcgccaaggacttcatcagacacctgctggagagagacccccagaagagattcacctgccagcaggccctgagacacctgtggatcagcggcgacaccgccttcgacagagacatcctgggcagcgtgagcgagcagatcagaaagaacttcgccagaacccactggaagagagccttcaacgccaccagcttcctgagacacatcagaaagctgggccagatccccgagggcgagggcgccagcgagcagggcatggccagacacagccacagcggcctgagagccggccagccccccaagtggtag

SEQ ID NO: 94374 - DNA, 1083 bp, Artificial Sequence
  Description of Artificial Sequence: Synthetic coding sequence
atgtggagaagagtgtgcggcggcctggccggcagaagacccagcggcgacatgctgctgctgaagaagcacaccgaggacatcagcagcgtgtacgagatcagagagagactgggcagcggcgccttcagcgaggtggtgctggcccaggagagaggcagcgcccacctggtggccctgaagtgcatccccaagaaggccctgagaggcaaggaggccctggtggagaacgagatcgccgtgctgagaagaatcagccaccccaacatcgtggccctggaggacgtgcacgagagccccagccacctgtacctggccatggagctggtgaccggcggcgagctgttcgacagaatcatggagagaggcagctacaccgagaaggacgccagccacctggtgggccaggtgctgggcgccgtgagctacctgcacagcctgggcatcgtgcacagagacctgaagcccgagaacctgctgtacgccacccccttcgaggacagcaagatcatggtgagcgacttcggcctgagcaagatccaggccggcaacatgctgggcaccgcctgcggcacccccggctacgtggcccccgagctgctggagcagaagccctacggcaaggccgtggacgtgtgggccctgggcgtgatcagctacatcctgctgtgcggctacccccccttctacgacgagagcgaccccgagctgttcagccagatcctgagagccagctacgagttcgacagccccttctgggacgacatcagcgagagcgccaaggacttcatcagacacctgctggagagagacccccagaagagattcacctgccagcaggccctgagacacctgtggatcagcggcgacaccgccttcgacagagacatcctgggcagcgtgagcgagcagatcagaaagaacttcgccagaacccactggaagagagccttcaacgccaccagcttcctgagacacatcagaaagctgggccagatccccgagggcgagggcgccagcgagcagggcatggccagacacagccacagcggcctgagagccggccagccccccaagtggtag

SEQ ID NO: 94375 - DNA, 1032 bp, Artificial Sequence; identical to SEQ ID NO: 94372
  Description of Artificial Sequence: Synthetic coding sequence

SEQ ID NO: 94376 - DNA, 1101 bp, Artificial Sequence; identical to SEQ ID NO: 94373
  Description of Artificial Sequence: Synthetic coding sequence

SEQ ID NO: 94377 - DNA, 132 bp, Artificial Sequence
  Description of Artificial Sequence: Synthetic coding sequence
atgctgctgctgaagaagcacaccgaggacatcagcagcgtgtacgagatcagagagagactgggcagcggcgccttcagcgaggtggtgctggcccaggagagaggcagcgcccacctggtggccctgtag

SEQ ID NO: 94378 - DNA, 675 bp, Artificial Sequence
  Description of Artificial Sequence: Synthetic coding sequence
atgctgctgctgaagaagcacaccgaggacatcagcagcgtgtacgagatcagagagagactgggcagcggcgccttcagcgaggtggtgctggcccaggagagaggcagcgcccacctggtggccctgaagtgcatccccaagaaggccctgagaggcaaggaggccctggtggagaacgagatcgccgtgctgagaagaatcagccaccccaacatcgtggccctggaggacgtgcacgagagccccagccacctgtacctggccatggagctggtgaccggcggcgagctgttcgacagaatcatggagagaggcagctacaccgagaaggacgccagccacctggtgggccaggtgctgggcgccgtgagctacctgcacagcctgggcatcgtgcacagagacctgaagcccgagaacctgctgtacgccacccccttcgaggacagcaagatcatggtgagcgacttcggcctgagcaagatccaggccggcaacatgctgggcaccgcctgcggcacccccggctacgtggcccccgagctgctggagcagaagccctacggcaaggccgtggacgtgtgggccctgggcgtgatcagctacatcctgctgtgcggctacccccccttctacgacgagagcgaccccgagctgttcagccagatctag

SEQ ID NO: 94379 - DNA, 132 bp, Artificial Sequence; identical to SEQ ID NO: 94377
  Description of Artificial Sequence: Synthetic coding sequence

SEQ ID NO: 94380 - DNA, 132 bp, Artificial Sequence; identical to SEQ ID NO: 94377
  Description of Artificial Sequence: Synthetic coding sequence

SEQ ID NO: 94381 - DNA, 261 bp, Artificial Sequence
  Description of Artificial Sequence: Synthetic coding sequence
atgctgctgctgaagaagcacaccgaggacatcagcagcgtgtacgagatcagagagagactgggcagcggcgccttcagcgaggtggtgctggcccaggagagaggcagcgcccacctggtggccctgaagtgcatccccaagaaggccctgagaggcaaggaggccctggtggagaacgagatcgccgtgctgagaagaatcagccaccccaacatcgtggccctggaggacgtgcacgagagccccagccacctgtag

SEQ ID NO: 94382 - DNA, 246 bp, Artificial Sequence
  Description of Artificial Sequence: Synthetic coding sequence
tgaatcagcggcgacaccgccttcgacagagacatcctgggcagcgtgagcgagcagatcagaaagaacttcgccagaacccactggaagagagccttcaacgccaccagcttcctgagacacatcagaaagctgggccagatccccgagggcgagggcgccagcgagcagggcatggccagacacagccacagcggcggcccccagggcctgagcttcctgcacggctgctgcgtgctgagatag

SEQ ID NO: 94383 - DNA, 681 bp, Artificial Sequence
  Description of Artificial Sequence: Synthetic coding sequence
atgctgctgctgaagaagcacaccgaggacatcagcagcgtgtacgagatcagagagagactgggcagcggcgccttcagcgaggtggtgctggcccaggagagaggcagcgcccacctggtggccctgaagtgcatccccaagaaggccctgagaggcaaggaggccctggtggagaacgagatcgccgtgctgagaagaatcagccaccccaacatcgtggccctggaggacgtgcacgagagccccagccacctgtacctggccatggagctggtgaccggcggcgagctgttcgacagaatcatggagagaggcagctacaccgagaaggacgccagccacctggtgggccaggtgctgggcgccgtgagctacctgcacagcctgggcatcgtgcacagagacctgaagcccgagaacctgctgtacgccacccccttcgaggacagcaagatcatggtgagcgacttcggcctgagcaagatccaggccggcaacatgctgggcaccgcctgcggcacccccggctacgtggcccccgagctgctggagcagaagccctacggcaaggccgtggacgtgtgggccctgggcgtgatcagctacatcctgctgtgcggctacccccccttctacgacgagagcgaccccgagctgttcagccagatcctgagatag

SEQ ID NO: 94384 - DNA, 1281 bp, Artificial Sequence
  Description of Artificial Sequence: Synthetic coding sequence
atggaggccgccttcggccaggtggccggcagcgcctgccccagaagaggcggcgagggcagagactggaaggccgagagcctggccgacctgtggcccaagagcagccccggcgacagccacagatggtgcaagggccccggcgccggccccgccggcccccagctgagagaggccgccagagccagcagcggcctgggcggcggcggcagacaccccagcagaatccccgccatcgccctgcaggacatgctgctgctgaagaagcacaccgaggacatcagcagcgtgtacgagatcagagagagactgggcagcggcgccttcagcgaggtggtgctggcccaggagagaggcagcgcccacctggtggccctgaagtgcatccccaagaaggccctgagaggcaaggaggccctggtggagaacgagatcgccgtgctgagaagaatcagccaccccaacatcgtggccctggaggacgtgcacgagagccccagccacctgtacctggccatggagctggtgaccggcggcgagctgttcgacagaatcatggagagaggcagctacaccgagaaggacgccagccacctggtgggccaggtgctgggcgccgtgagctacctgcacagcctgggcatcgtgcacagagacctgaagcccgagaacctgctgtacgccacccccttcgaggacagcaagatcatggtgagcgacttcggcctgagcaagatccaggccggcaacatgctgggcaccgcctgcggcacccccggctacgtggcccccgagctgctggagcagaagccctacggcaaggccgtggacgtgtgggccctgggcgtgatcagctacatcctgctgtgcggctacccccccttctacgacgagagcgaccccgagctgttcagccagatcctgagagccagctacgagttcgacagccccttctgggacgacatcagcgagagcgccaaggacttcatcagacacctgctggagagagacccccagaagagattcacctgccagcaggccctgagacacctgtggatcagcggcgacaccgccttcgacagagacatcctgggcagcgtgagcgagcagatcagaaagaacttcgccagaacccactggaagagagccttcaacgccaccagcttcctgagacacatcagaaagctgggccagatccccgagggcgagggcgccagcgagcagggcatggccagacacagccacagcggcctgagagccggccagccccccaagtggtag

SEQ ID NO: 94385 - DNA, 132 bp, Artificial Sequence; identical to SEQ ID NO: 94377
  Description of Artificial Sequence: Synthetic coding sequence

SEQ ID NO: 94386 - DNA, 4884 bp, Artificial Sequence
  Description of Artificial Sequence: Synthetic coding sequence
atgagactgtggagctgggtgctgcacctgggcctgctgagcgccgccctgggctgcggcctggccgagagacccagaagagccagaagagaccccagagccggcagaccccccagacccgccgccggccccgccacctgcgccaccagagccgccagaggcagaagagccagccccccccccccccccccccccggcggcgcctgggaggccgtgagagtgcccagaagaagacagcagagagaggccagaggcgccaccgaggagcccagcccccccagcagagccctgtacttcagcggcagaggcgagcagctgagactgagagccgacctggagctgcccagagacgccttcaccctgcaggtgtggctgagagccgagggcggccagagaagccccgccgtgatcaccggcctgtacgacaagtgcagctacatcagcagagacagaggctgggtggtgggcatccacaccatcagcgaccaggacaacaaggaccccagatacttcttcagcctgaagaccgacagagccagacaggtgaccaccatcaacgcccacagaagctacctgcccggccagtgggtgtacctggccgccacctacgacggccagttcatgaagctgtacgtgaacggcgcccaggtggccaccagcggcgagcaggtgggcggcatcttcagccccctgacccagaagtgcaaggtgctgatgctgggcggcagcgccctgaaccacaactacagaggctacatcgagcacttcagcctgtggaaggtggccagaacccagagagagatcctgagcgacatggagacccacggcgcccacaccgccctgccccagctgctgctgcaggagaactgggacaacgtgaagcacgcctggagccccatgaaggacggcagcagccccaaggtggagttcagcaacgcccacggcttcctgctggacaccagcctggagccccccctgtgcggccagaccctgtgcgacaacaccgaggtgatcgccagctacaaccagctgagcagcttcagacagcccaaggtggtgagatacagagtggtgaacctgtacgaggacgaccacaagaaccccaccgtgaccagagagcaggtggacttccagcaccaccagctggccgaggccttcaagcagtacaacatcagctgggagctggacgtgctggaggtgagcaacagcagcctgagaagaagactgatcctggccaactgcgacatcagcaagatcggcgacgagaactgcgaccccgagtgcaaccacaccctgaccggccacgacggcggcgactgcagacacctgagacaccccgccttcgtgaagaagcagcacaacggcgtgtgcgacatggactgcaactacgagagattcaacttcgacggcggcgagtgctgcgaccccgagatcaccaacgtgacccagacctgcttcgaccccgacagcccccacagagcctacctggacgtgaacgagctgaagaacatcctgaagctggacggcagcacccacctgaacatcttcttcgccaagagcagcgaggaggagctggccggcgtggccacctggccctgggacaaggaggccctgatgcacctgggcggcatcgtgctgaaccccagcttctacggcatgcccggccacacccacaccatgatccacgagatcggccacagcctgggcctgtaccacgtgttcagaggcatcagcgagatccagagctgcagcgacccctgcatggagaccgagcccagcttcgagaccggcgacctgtgcaacgacaccaaccccgcccccaagcacaagagctgcggcgaccccggccccggcaacgacacctgcggcttccacagcttcttcaacaccccctacaacaacttcatgagctacgccgacgacgactgcaccgacagcttcacccccaaccaggtggccagaatgcactgctacctggacctggtgtaccagggctggcagcccagcagaaagcccgcccccgtggccctggccccccaggtgctgggccacaccaccgacagcgtgaccctggagtggttcccccccatcgacggccacttcttcgagagagagctgggcagcgcctgccacctgtgcctggagggcagaatcctggtgcagtacgccagcaacgccagcagccccatgccctgcagccccagcggccactggagccccagagaggccgagggccaccccgacgtggagcagccctgcaagagcagcgtgagaacctggagccccaacagcgccgtgaacccccacaccgtgccccccgcctgccccgagccccagggctgctacctggagctggagttcctgtaccccctggtgcccgagagcctgaccatctgggtgaccttcgtgagcaccgactgggacagcagcggcgccgtgaacgacatcaagctgctggccgtgagcggcaagaacatcagcctgggcccccagaacgtgttctgcgacgtgcccctgaccatcagactgtgggacgtgggcgaggaggtgtacggcatccagatctacaccctggacgagcacctggagatcgacgccgccatgctgaccagcaccgccgacacccccctgtgcctgcagtgcaagcccctgaagtacaaggtggtgagagacccccccctgcagatggacgtggccagcatcctgcacctgaacagaaagttcgtggacatggacctgaacctgggcagcgtgtaccagtactgggtgatcaccatcagcggcaccgaggagagcgagcccagccccgccgtgacctacatccacggcagcggctactgcggcgacggcatcatccagaaggaccagggcgagcagtgcgacgacatgaacaagatcaacggcgacggctgcagcctgttctgcagacaggaggtgagcttcaactgcatcgacgagcccagcagatgctacttccacgacggcgacggcgtgtgcgaggagttcgagcagaagaccagcatcaaggactgcggcgtgtacaccccccagggcttcctggaccagtgggccagcaacgccagcgtgagccaccaggaccagcagtgccccggctgggtgatcatcggccagcccgccgccagccaggtgtgcagaaccaaggtgatcgacctgagcgagggcatcagccagcacgcctggtacccctgcaccatcagctacccctacagccagctggcccagaccaccttctggctgagagcctacttcagccagcccatggtggccgccgccgtgatcgtgcacctggtgaccgacggcacctactacggcgaccagaagcaggagaccatcagcgtgcagctgctggacaccaaggaccagagccacgacctgggcctgcacgtgctgagctgcagaaacaaccccctgatcatccccgtggtgcacgacctgagccagcccttctaccacagccaggccgtgagagtgagcttcagcagccccctggtggccatcagcggcgtggccctgagaagcttcgacaacttcgaccccgtgaccctgagcagctgccagagaggcgagacctacagccccgccgagcagagctgcgtgcacttcgcctgcgagaagaccgactgccccgagctggccgtggagaacgccagcctgaactgcagcagcagcgacagataccacggcgcccagtgcaccgtgagctgcagaaccggctacgtgctgcagatcagaagagacgacgagctgatcaagagccagaccggccccagcgtgaccgtgacctgcaccgagggcaagtggaacaagcaggtggcctgcgagcccgtggactgcagcatccccgaccaccaccaggtgtacgccgccagcttcagctgccccgagggcaccaccttcggcagccagtgcagcttccagtgcagacaccccgcccagctgaagggcaacaacagcctgctgacctgcatggaggacggcctgtggagcttccccgaggccctgtgcgagctgatgtgcctggcccccccccccgtgcccaacgccgacctgcagaccgccagatgcagagagaacaagcacaaggtgggcagcttctgcaagtacaagtgcaagcccggctaccacgtgcccggcagcagcagaaagagcaagaagagagccttcaagacccagtgcacccaggacggcagctggcaggagggcgcctgcgtgcccgtgacctgcgacccccccccccccaagttccacggcctgtaccagtgcaccaacggcttccagttcaacagcgagtgcagaatcaagtgcgaggacagcgacgccagccagggcctgggcagcaacgtgatccactgcagaaaggacggcacctggaacggcagcttccacgtgtgccaggagatgcagggccagtgcagcgtgcccaacgagctgaacagcaacctgaagctgcagtgccccgacggctacgccatcggcagcgagtgcgccaccagctgcctggaccacaacagcgagagcatcatcctgcccatgaacgtgaccgtgagagacatcccccactggctgaaccccaccagagtggagagagtggtgtgcaccgccggcctgaagtggtacccccaccccgccctgatccactgcgtgaagggctgcgagcccttcatgggcgacaactactgcgacgccatcaacaacagagccttctgcaactacgacggcggcgactgctgcaccagcaccgtgaagaccaagaaggtgacccccttccccatgagctgcgacctgcagggcgactgcgcctgcagagacccccaggcccaggagcacagcagaaaggacctgagaggctacagccacggctag

SEQ ID NO: 94387 - DNA, 1701 bp, Artificial Sequence
  Description of Artificial Sequence: Synthetic coding sequence
atggactgcaactacgagagattcaacttcgacggcggcgagtgctgcgaccccgagatcaccaacgtgacccagacctgcttcgaccccgacagcccccacagagcctacctggacgtgaacgagctgaagaacatcctgaagctggacggcagcacccacctgaacatcttcttcgccaagagcagcgaggaggagctggccggcgtggccacctggccctgggacaaggaggccctgatgcacctggacgacgactgcaccgacagcttcacccccaaccaggtggccagaatgcactgctacctggacctggtgtaccagggctggcagcccagcagaaagcccgcccccgtggccctggccccccaggtgctgggccacaccaccgacagcgtgaccctggagtggttcccccccatcgacggccacttcttcgagagagagctgggcagcgcctgccacctgtgcctggagggcagaatcctggtgcagtacgccagcaacgccagcagccccatgccctgcagccccagcggccactggagccccagagaggccgagggccaccccgacgtggagcagccctgcaagagcagcgtgagaacctggagccccaacagcgccgtgaacccccacaccgtgccccccgcctgccccgagccccagggctgctacctggagctggagttcctgtaccccctggtgcccgagagcctgaccatctgggtgaccttcgtgagcaccgactgggacagcagcggcgccgtgaacgacatcaagctgctggccgtgagcggcaagaacatcagcctgggcccccagaacgtgttctgcgacgtgcccctgaccatcagactgtgggacgtgggcgaggaggtgtacggcatccagatctacaccctggacgagcacctggagatcgacgccgccatgctgaccagcaccgccgacacccccctgtgcctgcagtgcaagcccctgaagtacaaggtggtgagagacccccccctgcagatggacgtggccagcatcctgcacctgaacagaaagttcgtggacatggacctgaacctgggcagcgtgtaccagtactgggtgatcaccatcagcggcaccgaggagagcgagcccagccccgccgtgacctacatccacggcagcggctactgcggcgacggcatcatccagaaggaccagggcgagcagtgcgacgacatgaacaagatcaacggcgacggctgcagcctgttctgcagacaggaggtgagcttcaactgcatcgacgagcccagcagatgctacttccacgacggcgacggcgtgtgcgaggagttcgagcagaagaccagcatcaaggactgcggcgtgtacaccccccagggcttcctggaccagtgggccagcaacgccagcgtgagccaccaggaccagcagtgccccggctgggtgatcatcggccagcccgccgccagccaggtgtgcagaaccaaggtgatcgacctgagcgagggcatcagcgcctgcctggtgcccctgcaccaccagctgcccatcttccccgccggcagcgaccacttcctggcccccggcgtgttcttcagcaccaacggctgcagaagctgccactgcccccccggcgacggctgggacatcctgtggggccccaaggccggcgaccaccagagagccgccgcctag

SEQ ID NO: 94388 - DNA, 1998 bp, Artificial Sequence
  Description of Artificial Sequence: Synthetic coding sequence
atgaacaagatcaacggcgacggctgcagcctgttctgcagacaggaggtgagcttcaactgcatcgacgagcccagcagatgctacttccacgacggcgacggcgtgtgcgaggagttcgagcagaagaccagcatcaaggactgcggcgtgtacaccccccagggcttcctggaccagtgggccagcaacgccagcgtgagccaccaggaccagcagtgccccggctgggtgatcatcggccagcccgccgccagccaggtgtgcagaaccaaggtgatcgacctgagcgagggcatcagccagcacgcctggtacccctgcaccatcagctacccctacagccagctggcccagaccaccttctggctgagagcctacttcagccagcccatggtggccgccgccgtgatcgtgcacctggtgaccgacggcacctactacggcgaccagaagcaggagaccatcagcgtgcagctgctggacaccaaggaccagagccacgacctgggcctgcacgtgctgagctgcagaaacaaccccctgatcatccccgtggtgcacgacctgagccagcccttctaccacagccaggccgtgagagtgagcttcagcagccccctggtggccatcagcggcgtggccctgagaagcttcgacaacttcgaccccgtgaccctgagcagctgccagagaggcgagacctacagccccgccgagcagagctgcgtgcacttcgcctgcgagaagaccgactgccccgagctggccgtggagaacgccagcctgaactgcagcagcagcgacagataccacggcgcccagtgcaccgtgagctgcagaaccggctacgtgctgcagatcagaagagacgacgagctgatcaagagccagaccggccccagcgtgaccgtgacctgcaccgagggcaagtggaacaagcaggtggcctgcgagcccgtggactgcagcatccccgaccaccaccaggtgtacgccgccagcttcagctgccccgagggcaccaccttcggcagccagtgcagcttccagtgcagacaccccgcccagctgaagggcaacaacagcctgctgacctgcatggaggacggcctgtggagcttccccgaggccctgtgcgagctgatgtgcctggcccccccccccgtgcccaacgccgacctgcagaccgccagatgcagagagaacaagcacaaggtgggcagcttctgcaagtacaagtgcaagcccggctaccacgtgcccggcagcagcagaaagagcaagaagagagccttcaagacccagtgcacccaggacggcagctggcaggagggcgcctgcgtgcccgtgacctgcgacccccccccccccaagttccacggcctgtaccagtgcaccaacggcttccagttcaacagcgagtgcagaatcaagtgcgaggacagcgacgccagccagggcctgggcagcaacgtgatccactgcagaaaggacggcacctggaacggcagcttccacgtgtgccaggagatgcagggccagtgcagcgtgcccaacgagctgaacagcaacctgaagctgcagtgccccgacggctacgccatcggcagcgagtgcgccaccagctgcctggaccacaacagcgagagcatcatcctgcccatgaacgtgaccgtgagagacatcccccactggctgaaccccaccagagtggagagagtggtgtgcaccgccggcctgaagtggtacccccaccccgccctgatccactgcgtgaagggctgcgagcccttcatgggcgacaactactgcgacgccatcaacaacagagccttctgcaactacgacggcggcgactgctgcaccagcaccgtgaagaccaagaaggtgacccccttccccatgagctgcgacctgcagggcgactgcgcctgcagagacccccaggcccaggagcacagcagaaaggacctgagaggctacagccacggctag

SEQ ID NO: 94389 - DNA, 4449 bp, Artificial Sequence
  Description of Artificial Sequence: Synthetic coding sequence
atgagaaaggacagactgctgcacctgtgcctggtgctgctgctgatcctgctgagcgccagcgacagcaacagcaccgagccccagtacatggtgctggtgcccagcctgctgcacaccgaggcccccaagaagggctgcgtgctgctgagccacctgaacgagaccgtgaccgtgagcgccagcctggagagcggcagagagaacagaagcctgttcaccgacctggtggccgagaaggacctgttccactgcgtgagcttcaccctgcccagaatcagcgccagcagcgaggtggccttcctgagcatccagatcaagggccccacccaggacttcagaaagagaaacaccgtgctggtgctgaacacccagagcctggtgttcgtgcagaccgacaagcccatgtacaagcccggccagaccgtgagattcagagtggtgagcgtggacgagaacttcagacccagaaacgagctgatccccctgatctacctggagaaccccagaagaaacagaatcgcccagtggcagagcctgaagctggaggccggcatcaaccagctgagcttccccctgagcagcgagcccatccagggcagctacagagtggtggtgcagaccgagagcggcggcagaatccagcaccccttcaccgtggaggagttcgtgctgcccaagttcgaggtgaaggtgcaggtgcccaagatcatcagcatcatggacgagaaggtgaacatcaccgtgtgcggcgagtacacctacggcaagcccgtgcccggcctggccaccgtgagcctgtgcagaaagctgagcagagtgctgaactgcgacaagcaggaggtgtgcgaggagttcagccagcagctgaacagcaacggctgcatcacccagcaggtgcacaccaagatgctgcagatcaccaacaccggcttcgagatgaagctgagagtggaggccagaatcagagaggagggcaccgacctggaggtgaccgccaacagaatcagcgagatcaccaacatcgtgagcaagctgaagttcgtgaaggtggacagccacttcagacagggcatccccttcttcgcccaggtgctgctggtggacggcaagggcgtgcccatccccaacaagctgttcttcatcagcgtgaacgacgccaactactacagcaacgccaccaccaacgagcagggcctggcccagttcagcatcaacaccaccagcatcagcgtgaacaagctgttcgtgagagtgttcaccgtgcaccccaacctgtgcttccactacagctgggtggccgaggaccaccagggcgcccagcacaccgccaacagagtgttcagcctgagcggcagctacatccacctggagcccgtggccggcaccctgccctgcggccacaccgagaccatcaccgcccactacaccctgaacagacaggccatgggcgagctgagcgagctgagcttccactacctgatcatggccaagggcgtgatcgtgagaagcggcacccacaccctgcccgtggagagcggcgacatgaagggcagcttcgccctgagcttccccgtggagagcgacgtggcccccatcgccagaatgttcatcttcgccatcctgcccgacggcgaggtggtgggcgacagcgagaagttcgagatcgagaactgcctggccaacaaggtggacctgagcttcagccccgcccagagcccccccgccagccacgcccacctgcaggtggccgccgccccccagagcctgtgcgccctgagagccgtggaccagagcgtgctgctgatgaagcccgaggccgagctgagcgtgagcagcgtgtacaacctgctgaccgtgaaggacctgaccaacttccccgacaacgtggaccagcaggaggaggagcagggccactgccccagacccttcttcatccacaacggcgccatctacgtgcccctgagcagcaacgaggccgacatctacagcttcctgaagggcatgggcctgaaggtgttcaccaacagcaagatcagaaagcccaagagctgcagcgtgatccccagcgtgagcgccggcgccgtgggccagggctactacggcgccggcctgggcgtggtggagagaccctacgtgccccagctgggcacctacaacgtgatccccctgaacaacgagcagagcagcggccccgtgcccgagaccgtgagaagctacttccccgagacctggatctgggagctggtggccgtgaacagcagcggcgtggccgaggtgggcgtgaccgtgcccgacaccatcaccgagtggaaggccggcgccttctgcctgagcgaggacgccggcctgggcatcagcagcaccgccagcctgagagccttccagcccttcttcgtggagctgaccatgccctacagcgtgatcagaggcgaggtgttcaccctgaaggccaccgtgctgaactacctgcccaagtgcatcagagtgagcgtgcagctgaaggccagccccgccttcctggccagccagaacaccaagggcgaggagagctactgcatctgcggcaacgagagacagaccctgagctggaccgtgacccccaagaccctgggcaacgtgaacttcagcgtgagcgccgaggccatgcagagcctggagctgtgcggcaacgaggtggtggaggtgcccgagatcaagagaaaggacaccgtgatcaagaccctgctggtggaggccgagggcatcgagcaggagaagaccttcagcagcatgacctgcgccagcggcgccaacgtgagcgagcagctgagcctgaagctgcccagcaacgtggtgaaggagagcgccagagccagcttcagcgtgctgggcgacatcctgggcagcgccatgcagaacatccagaacctgctgcagatgccctacggctgcggcgagcagaacatggtgctgttcgcccccaacatctacgtgctgaactacctgaacgagacccagcagctgacccaggagatcaaggccaaggccgtgggctacctgatcaccggctaccagagacagctgaactacaagcaccaggacggcagctacagcaccttcggcgagagatacggcagaaaccagggcaacacctggctgaccgccttcgtgctgaagaccttcgcccaggccagaagctacatcttcatcgacgaggcccacatcacccagagcctgacctggctgagccagatgcagaaggacaacggctgcttcagaagcagcggcagcctgctgaacaacgccatcaagggcggcgtggaggacgaggccaccctgagcgcctacgtgaccatcgccctgctggagatccccctgcccgtgaccaaccccatcgtgagaaacgccctgttctgcctggagagcgcctggaacgtggccaaggagggcacccacggcagccacgtgtacaccaaggccctgctggcctacgccttcagcctgctgggcaagcagaaccagaacagagagatcctgaacagcctggacaaggaggccgtgaaggaggacaacctggtgcactgggagagaccccagagacccaaggcccccgtgggccacctgtaccagacccaggcccccagcgccgaggtggagatgaccagctacgtgctgctggcctacctgaccgcccagcccgcccccaccagcggcgacctgaccagcgccaccaacatcgtgaagtggatcatgaagcagcagaacgcccagggcggcttcagcagcacccaggacaccgtggtggccctgcacgccctgagcagatacggcgccgccaccttcaccagaaccgagaagaccgcccaggtgaccgtgcaggacagccagaccttcagcaccaacttccaggtggacaacaacaacctgctgctgctgcagcagatcagcctgcccgagctgcccggcgagtacgtgatcaccgtgaccggcgagagatgcgtgtacctgcagaccagcatgaagtacaacatcctgcccgagaaggaggacagccccttcgccctgaaggtgcagaccgtgccccagacctgcgacggccacaaggcccacaccagcttccagatcagcctgaccatcagctacaccggcaacagacccgccagcaacatggtgatcgtggacgtgaagatggtgagcggcttcatccccctgaagcccaccgtgaagatgctggagagaagcagcagcgtgagcagaaccgaggtgagcaacaaccacgtgctgatctacgtggagcaggtgaccaaccagaccctgagcttcagcttcatggtgctgcaggacatccccgtgggcgacctgaagcccgccatcgtgaaggtgtacgactactacgagaccgacgagagcgtggtggccgagtacatcgccccctgcagcaccgacaccgagcacggcaacgtgtag

SEQ ID NO: 94390 - DNA, 3807 bp, Artificial Sequence
  Description of Artificial Sequence: Synthetic coding sequence
atgagcgagagctacagaagaaccaccttccccgtgagattcagagtggtgagcgtggacgagaacttcagacccagaaacgagctgatccccctgatctacctggagaaccccagaagaaacagaatcgcccagtggcagagcctgaagctggaggccggcatcaaccagctgagcttccccctgagcagcgagcccatccagggcagctacagagtggtggtgcagaccgagagcggcggcagaatccagcaccccttcaccgtggaggagttcgtgctgcccaagttcgaggtgaaggtgcaggtgcccaagatcatcagcatcatggacgagaaggtgaacatcaccgtgtgcggcgagtacacctacggcaagcccgtgcccggcctggccaccgtgagcctgtgcagaaagctgagcagagtgctgaactgcgacaagcaggaggtgtgcgaggagttcagccagcagctgaacagcaacggctgcatcacccagcaggtgcacaccaagatgctgcagatcaccaacaccggcttcgagatgaagctgagagtggaggccagaatcagagaggagggcaccgacctggaggtgaccgccaacagaatcagcgagatcaccaacatcgtgagcaagctgaagttcgtgaaggtggacagccacttcagacagggcatccccttcttcgcccaggtgctgctggtggacggcaagggcgtgcccatccccaacaagctgttcttcatcagcgtgaacgacgccaactactacagcaacgccaccaccaacgagcagggcctggcccagttcagcatcaacaccaccagcatcagcgtgaacaagctgttcgtgagagtgttcaccgtgcaccccaacctgtgcttccactacagctgggtggccgaggaccaccagggcgcccagcacaccgccaacagagtgttcagcctgagcggcagctacatccacctggagcccgtggccggcaccctgccctgcggccacaccgagaccatcaccgcccactacaccctgaacagacaggccatgggcgagctgagcgagctgagcttccactacctgatcatggccaagggcgtgatcgtgagaagcggcacccacaccctgcccgtggagagcggcgacatgaagggcagcttcgccctgagcttccccgtggagagcgacgtggcccccatcgccagaatgttcatcttcgccatcctgcccgacggcgaggtggtgggcgacagcgagaagttcgagatcgagaactgcctggccaacaaggtggacctgagcttcagccccgcccagagcccccccgccagccacgcccacctgcaggtggccgccgccccccagagcctgtgcgccctgagagccgtggaccagagcgtgctgctgatgaagcccgaggccgagctgagcgtgagcagcgtgtacaacctgctgaccgtgaaggacctgaccaacttccccgacaacgtggaccagcaggaggaggagcagggccactgccccagacccttcttcatccacaacggcgccatctacgtgcccctgagcagcaacgaggccgacatctacagcttcctgaagggcatgggcctgaaggtgttcaccaacagcaagatcagaaagcccaagagctgcagcgtgatccccagcgtgagcgccggcgccgtgggccagggctactacggcgccggcctgggcgtggtggagagaccctacgtgccccagctgggcacctacaacgtgatccccctgaacaacgagcagagcagcggccccgtgcccgagaccgtgagaagctacttccccgagacctggatctgggagctggtggccgtgaacagcagcggcgtggccgaggtgggcgtgaccgtgcccgacaccatcaccgagtggaaggccggcgccttctgcctgagcgaggacgccggcctgggcatcagcagcaccgccagcctgagagccttccagcccttcttcgtggagctgaccatgccctacagcgtgatcagaggcgaggtgttcaccctgaaggccaccgtgctgaactacctgcccaagtgcatcagagccgagggcatcgagcaggagaagaccttcagcagcatgacctgcgccagcggcgccaacgtgagcgagcagctgagcctgaagctgcccagcaacgtggtgaaggagagcgccagagccagcttcagcgtgctgggcgacatcctgggcagcgccatgcagaacatccagaacctgctgcagatgccctacggctgcggcgagcagaacatggtgctgttcgcccccaacatctacgtgctgaactacctgaacgagacccagcagctgacccaggagatcaaggccaaggccgtgggctacctgatcaccggctaccagagacagctgaactacaagcaccaggacggcagctacagcaccttcggcgagagatacggcagaaaccagggcaacacctggctgaccgccttcgtgctgaagaccttcgcccaggccagaagctacatcttcatcgacgaggcccacatcacccagagcctgacctggctgagccagatgcagaaggacaacggctgcttcagaagcagcggcagcctgctgaacaacgccatcaagggcggcgtggaggacgaggccaccctgagcgcctacgtgaccatcgccctgctggagatccccctgcccgtgaccaaccccatcgtgagaaacgccctgttctgcctggagagcgcctggaacgtggccaaggagggcacccacggcagccacgtgtacaccaaggccctgctggcctacgccttcagcctgctgggcaagcagaaccagaacagagagatcctgaacagcctggacaaggaggccgtgaaggaggacaacctggtgcactgggagagaccccagagacccaaggcccccgtgggccacctgtaccagacccaggcccccagcgccgaggtggagatgaccagctacgtgctgctggcctacctgaccgcccagcccgcccccaccagcggcgacctgaccagcgccaccaacatcgtgaagtggatcatgaagcagcagaacgcccagggcggcttcagcagcacccaggacaccgtggtggccctgcacgccctgagcagatacggcgccgccaccttcaccagaaccgagaagaccgcccaggtgaccgtgcaggacagccagaccttcagcaccaacttccaggtggacaacaacaacctgctgctgctgcagcagatcagcctgcccgagctgcccggcgagtacgtgatcaccgtgaccggcgagagatgcgtgtacctgcagaccagcatgaagtacaacatcctgcccgagaaggaggacagccccttcgccctgaaggtgcagaccgtgccccagacctgcgacggccacaaggcccacaccagcttccagatcagcctgaccatcagctacaccggcaacagacccgccagcaacatggtgatcgtggacgtgaagatggtgagcggcttcatccccctgaagcccaccgtgaagatgctggagagaagcagcagcgtgagcagaaccgaggtgagcaacaaccacgtgctgatctacgtggagcaggtgaccaaccagaccctgagcttcagcttcatggtgctgcaggacatccccgtgggcgacctgaagcccgccatcgtgaaggtgtacgactactacgagaccgacgagagcgtggtggccgagtacatcgccccctgcagcaccgacaccgagcacggcaacgtgtag

SEQ ID NO: 94391 - DNA, 660 bp, Artificial Sequence
  Description of Artificial Sequence: Synthetic coding sequence
atggtgaagtacttcctgggccagagcgtgctgagaagcagctgggaccaggtgttcgccgccttctggcagagataccccaacccctacagcaagcacgtgctgaccgaggacatcgtgcacagagaggtgacccccgaccagaagctgctgagcagaagactgctgaccaagaccaacagaatgcccagatgggccgagagactgttccccgccaacgtggcccacagcgtgtacgtgctggaggacagcatcgtggacccccagaaccagaccatgaccaccttcacctggaacatcaaccacgccagactgatggtggtggaggagagatgcgtgtactgcgtgaacagcgacaacagcggctggaccgagatcagaagagaggcctgggtgagcagcagcctgttcggcgtgagcagagccgtgcaggagttcggcctggccagattcaagagcaacgtgaccaagaccatgaagggcttcgagtacatcctggccaagctgcagggcgaggcccccagcaagaccctggtggagaccgccaaggaggccaaggagaaggccaaggagaccgccctggccgccaccgagaaggccaaggacctggccagcaaggccgccaccaagaagcagcagcagcagcagcagttcgtgtag

SEQ ID NO: 94392 - DNA, 1770 bp, Artificial Sequence
  Description of Artificial Sequence: Synthetic coding sequence
atgagcagcagctactggagcgagaccagcagcagcagctgcggcacccagcagctgcccgaggtgctgcagtgccagccccagcactaccactgctaccaccagagcagccaggcccagcagccccccgagaagaacgtggtgtacgagagagtgagaacctacagcggccccatgaacaaggtggtgcaggccctggaccccttcaacagcagagaggtgctgagccccctgaagaccaccagcagctaccagaacctggtgtggagcgaccacagccaggagctgcacagccccaccctgaagatcagcacctgcgcccccagcaccctgcacatcacccagaacaccgagcaggagctgcacagccccaccgtgaagctgaccacctacccccagaccaccatcagaaagtacgtggtgcagaaccccgagcaggagcccctgagccagttcctgagaggcagccacttcttccccggcaacaacgtgatctacgagaagaccatcagaaaggtggagaagctgaacaccgaccagggctgccacccccaggcccagtgccaccaccacatcatccagcagccccaggtgatccacagcgcccactggcagcagcccgacagcagccagcagatccaggccatcaccggcaacaaccccatcagcacccacatcggcaacgagctgtgccacagcggcagcagccagatctgcgagcaggtgatcatccaggacgacggccccgagaagctggaccccagatacttcggcgagctgctggccgacctgagcagaaagaacaccgacctgtaccactgcctgctggagcacctgcagagaatcggcggcagcaagcaggacttcgagagcaccgacgagagcgaggacatcgagagcctgatccccaagggcctgagcgagttcaccaagcagcagatcagatacatcctgcagatgagaggcatgagcgacaagagcctgagactggtgctgagcaccttcagcaacatcagagaggagctgggccacctgcagaacgacatgaccagcctggagaacgacaagatgagactggagaaggacctgagcttcaaggacacccagctgaaggagtacgaggagctgctggccagcgtgagagccaacaaccaccagcagcagcagggcctgcaggacagcagcagcaagtgccaggccctggaggagaacaacctgagcctgagacacaccctgagcgacatggagtacagactgaaggagctggagtactgcaagagaaacctggagcaggagaaccagaacctgagaatgcaggtgagcgagacctgcaccggccccatgctgcaggccaagatggacgagatcggcaaccactacaccgagatggtgaagaacctgagaatggagaaggacagagagatctgcagactgagaagccagctgaaccagtaccacaaggacgtgagcaagagagagggcagctgcagcgacttccagttcaagctgcacgagctgaccagcctgctggaggagaaggacagcctgatcaagagacagagcgaggagctgagcaagctgagacaggagatctacagcagccacaaccagcccagcaccggcggcagaaccaccatcaccaccaagaagtacagaacccagtaccccatcctgggcctgctgtacgacgactacgagtacatcccccccggcagcgagacccagaccatcgtgatcgagaagaccgaggacaagtacacctgcccctag

SEQ ID NO: 94393 - DNA, 921 bp, Artificial Sequence
  Description of Artificial Sequence: Synthetic coding sequence
atgagcagcagctactggagcgagaccagcagcagcagctgcggcacccagcagctgcccgaggtgctgcagtgccagccccagcactaccactgctaccaccagagcagccaggcccagcagccccccgagaagaacgtggtgtacgagagagtgagaacctacagcggccccatgaacaaggtggtgcaggccctggaccccttcaacagcagagaggtgctgagccccctgaagaccaccagcagctaccagaacctggtgtggagcgaccacagccaggagctgcacagccccaccctgaagatcagcacctgcgcccccagcaccctgcacatcacccagaacaccgagcaggagctgcacagccccaccgtgaagctgaccacctacccccagaccaccatcagaaagtacgtggtgcagaaccccgagcaggagcccctgagccagttcctgagaggcagccacttcttccccggcaacaacgtgatctacgagaagaccatcagaaaggtggagaagctgaacaccgaccagggctgccacccccaggcccagtgccaccaccacatcatccagcagccccaggtgatccacagcgcccactggcagcagcccgacagcagccagcagatccaggccatcaccggcaacaaccccatcagcacccacatcggcaacgagctgtgccacagcggcagcagccagatctgcgagcaggtgatcatccaggacgacggccccgagaagctggaccccagatacttcggcgagctgctggccgacctgagcagaaagaacaccgacctgtaccactgcctgctggagcacctgcagagaatcggcagaaagcagagcctgagcagcacctacaccatcagacacggcatccagaccaagagaaccggcatcctgtag

SEQ ID NO: 94394 - DNA, 1788 bp, Artificial Sequence
  Description of Artificial Sequence: Synthetic coding sequence
atgagcagcagctactggagcgagaccagcagcagcagctgcggcacccagcagctgcccgaggtgctgcagtgccagccccagcactaccactgctaccaccagagcagccaggcccagcagccccccgagaagaacgtggtgtacgagagagtgagaacctacagcggccccatgaacaaggtggtgcaggccctggaccccttcaacagcagagaggtgctgagccccctgaagaccaccagcagctaccagaacctggtgtggagcgaccacagccaggagctgcacagccccaccctgaagatcagcacctgcgcccccagcaccctgcacatcacccagaacaccgagcaggagctgcacagccccaccgtgaagctgaccacctacccccagaccaccatcagaaagtacgtggtgcagaaccccgagcaggagcccctgagccagttcctgagaggcagccacttcttccccggcaacaacgtgatctacgagaagaccatcagaaaggtggagaagctgaacaccgaccagggctgccacccccaggcccagtgccaccaccacatcatccagcagccccaggtgatccacagcgcccactggcagcagcccgacagcagccagcagatccaggccatcaccggcaacaaccccatcagcacccacatcggcaacgagctgtgccacagcggcagcagccagatctgcgagcaggtgatcatccaggacgacggccccgagaagctggaccccagatacttcggcgagctgctggccgacctgagcagaaagaacaccgacctgtaccactgcctgctggagcacctgcagagaatcggcggcagcaagcaggacttcgagagcaccgacgagagcgaggacatcgagagcctgatccccaagggcctgagcgagttcaccaagcagcagatcagatacatcctgcagatgagaggcatgagcgacaagagcctgagactggtgctgagcaccttcagcaacatcagagaggagctgggccacctgcagaacgacatgaccagcctggagaacgacaagatgagactggagaaggacctgagcttcaaggacacccagctgaaggagtacgaggagctgctggccagcgtgagagccaacaaccaccagcagcagcagggcctgcaggacagcagcagcaagtgccaggccctggaggagaacaacctgagcctgagacacaccctgagcgacatggagtacagactgaaggagctggagtactgcaagagaaacctggagcaggagaaccagaacctgagaatgcaggtgagcgagacctgcaccggccccatgctgcaggccaagatggacgagatcggcaaccactacaccgagatggtgaagaacctgagaatggagaaggacagagagatctgcagactgagaagccagctgaaccagtaccacaaggacgtgagcaagagagagggcagctgcagcgacttccagttcaagctgcacgagctgaccagcctgctggaggagaaggacagcctgatcaagagacagagcgaggagctgagcaagctgagacaggagatctacagcagccacaaccagcccagcaccggcggcagaaccaccatcaccaccaagaagtacagaacccagtaccccatcctgggcctgctgtacgacgactacgagtacatcccccccggcagcgagacccagaccatcgtgatcgagaagaccgaggacaagtacacctgcgtgagcagcctgggccacttctag

SEQ ID NO: 94395 - DNA, 921 bp, Artificial Sequence
  Description of Artificial Sequence: Synthetic coding sequence
atggccagcagatggtggagatggagaagaggctgcagctggaagcccgccgccagaagccccggccccggcagccccggcagagccggccccctgggccccagcgccgccgccgaggtgagagcccaggtgcacagaagaaagggcctggacctgagccagatcccctacatcaacctggtgaagcacctgaccagcgcctgccccaacgtgtgcagaatcagcagattccaccacaccacccccgacagcaagacccacagcggcgagaagtacaccgaccccttcaagctgggctggagagacctgaagggcctgtacgaggacatcagaaaggagctgctgatcagcaccagcgagctgaaggagatgagcgagtactacttcgacggcaagggcaaggccttcagacccatcatcgtggccctgatggccagagcctgcaacatccaccacaacaacagcagacacgtgcaggccagccagagagccatcgccctgatcgccgagatgatccacaccgccagcctggtgcacgacgacgtgatcgacgacgccagcagcagaagaggcaagcacaccgtgaacaagatctggggcgagaagaaggccgtgctggccggcgacctgatcctgagcgccgccagcatcgccctggccagaatcggcaacaccaccgtgatcagcatcctgacccaggtgatcgaggacctggtgagaggcgagttcctgcagctgggcagcaaggagaacgagaacgagagattcgcccactacctggagaagaccttcaagaagaccgccagcctgatcgccaacagctgcaaggccgtgttccccagaaacgagtgctacgaccacgccaccgtgcagttcgcctggagatgcagacagagcagcaccgtgtgcaccaccgagtag

SEQ ID NO: 94396 - DNA, 1248 bp, Artificial Sequence
  Description of Artificial Sequence: Synthetic coding sequence
atggccagcagatggtggagatggagaagaggctgcagctggaagcccgccgccagaagccccggccccggcagccccggcagagccggccccctgggccccagcgccgccgccgaggtgagagcccaggtgcacagaagaaagggcctggacctgagccagatcccctacatcaacctggtgaagcacctgaccagcgcctgccccaacgtgtgcagaatcagcagattccaccacaccacccccgacagcaagacccacagcggcgagaagtacaccgaccccttcaagctgggctggagagacctgaagggcctgtacgaggacatcagaaaggagctgctgatcagcaccagcgagctgaaggagatgagcgagtactacttcgacggcaagggcaaggccttcagacccatcatcgtggccctgatggccagagcctgcaacatccaccacaacaacagcagacacgtgcaggccagccagagagccatcgccctgatcgccgagatgatccacaccgccagcctggtgcacgacgacgtgatcgacgacgccagcagcagaagaggcaagcacaccgtgaacaagatctggggcgagaagaaggccgtgctggccggcgacctgatcctgagcgccgccagcatcgccctggccagaatcggcaacaccaccgtgatcagcatcctgacccaggtgatcgaggacctggtgagaggcgagttcctgcagctgggcagcaaggagaacgagaacgagagattcgcccactacctggagaagaccttcaagaagaccgccagcctgatcgccaacagctgcaaggccgtgagcgtgctgggctgccccgaccccgtggtgcacgagatcgcctaccagtacggcaagaacgtgggcatcgccttccagctgatcgacgacgtgctggacttcaccagctgcagcgaccagatgggcaagcccaccagcgccgacctgaagctgggcctggccaccggccccgtgctgttcgcctgccagcagttccccgagatgaacgccatgatcatgagaagattcagcctgcccggcgacgtggacagagccagacagtacgtgctgcagagcgacggcgtgcagcagaccacctacctggcccagcagtactgccacgaggccatcagagagatcagcaagctgagacccagccccgagagagacgccctgatccagctgagcgagatcgtgctgaccagagacaagtag

SEQ ID NO: 94397 - DNA, 1131 bp, Artificial Sequence
  Description of Artificial Sequence: Synthetic coding sequence
atgcccgcccacgtgcacagaagaaagggcctggacctgagccagatcccctacatcaacctggtgaagcacctgaccagcgcctgccccaacgtgtgcagaatcagcagattccaccacaccacccccgacagcaagacccacagcggcgagaagtacaccgaccccttcaagctgggctggagagacctgaagggcctgtacgaggacatcagaaaggagctgctgatcagcaccagcgagctgaaggagatgagcgagtactacttcgacggcaagggcaaggccttcagacccatcatcgtggccctgatggccagagcctgcaacatccaccacaacaacagcagacacgtgcaggccagccagagagccatcgccctgatcgccgagatgatccacaccgccagcctggtgcacgacgacgtgatcgacgacgccagcagcagaagaggcaagcacaccgtgaacaagatctggggcgagaagaaggccgtgctggccggcgacctgatcctgagcgccgccagcatcgccctggccagaatcggcaacaccaccgtgatcagcatcctgacccaggtgatcgaggacctggtgagaggcgagttcctgcagctgggcagcaaggagaacgagaacgagagattcgcccactacctggagaagaccttcaagaagaccgccagcctgatcgccaacagctgcaaggccgtgagcgtgctgggctgccccgaccccgtggtgcacgagatcgcctaccagtacggcaagaacgtgggcatcgccttccagctgatcgacgacgtgctggacttcaccagctgcagcgaccagatgggcaagcccaccagcgccgacctgaagctgggcctggccaccggccccgtgctgttcgcctgccagcagttccccgagatgaacgccatgatcatgagaagattcagcctgcccggcgacgtggacagagccagacagtacgtgctgcagagcgacggcgtgcagcagaccacctacctggcccagcagtactgccacgaggccatcagagagatcagcaagctgagacccagccccgagagagacgccctgatccagctgagcgagatcgtgctgaccagagacaagtag

SEQ ID NO: 94398 - DNA, 723 bp, Artificial Sequence
  Description of Artificial Sequence: Synthetic coding sequence
atgaacttcagacagctgctgctgcacctgcccagatacctgggcgccagcggcagccccagaagactgtggtggagccccagcctggacaccatcagcagcgtgggcagctggagaggcagaagcagcaagagccccgcccactggaaccaggtggtgagcgaggccgagaagatcgtgggctaccccaccagcttcatgagcctgagatgcctgctgagcgacgagctgagcaacatcgccatgcaggtgagaaagctggtgggcacccagcaccccctgctgaccaccgccagaggcctggtgcacgacagctggaacagcctgcagctgagaggcctggtggtgctgctgatcagcaaggccgccggccccagcagcgtgaacaccagctgccagaactacgacatggtgagcggcatctacagctgccagagaagcctggccgagatcaccgagctgatccacatcgccctgctggtgcacagaggcatcgtgaacctgaacgagctgcagagcagcgacggccccctgaaggacatgcagttcggcaacaagatcgccatcctgagcggcgacttcctgctggccaacgcctgcaacggcctggccctgctgcagaacaccaagagcttcagcttcaacggccccatcgccatctaccagatgggcgactgcgagagcgcctggatcctgagcaagcaccccagagccctgagctag

SEQ ID NO: 94399 - DNA, 270 bp, Artificial Sequence
  Description of Artificial Sequence: Synthetic coding sequence
atggagctggccaagcacgacgccgaggtgcagaacatggccttccagtacggcaagcacatggccatgagccacaagatcaacagcgacgtgcagcccttcatcaaggagaagaccagcgacagcatgaccttcaacctgaacagcgcccccgtggtgctgcaccaggagttcctgggcagagacctgtggatcaagcagatcggcgagagcagcagcaccgaggtgcagctgagcaacttccagcagatgctgctgagcaccctgtag

SEQ ID NO: 94400 - DNA, 1200 bp, Artificial Sequence
  Description of Artificial Sequence: Synthetic coding sequence
atgaacttcagacagctgctgctgcacctgcccagatacctgggcgccagcggcagccccagaagactgtggtggagccccagcctggacaccatcagcagcgtgggcagctggagaggcagaagcagcaagagccccgcccactggaaccaggtggtgagcgaggccgagaagatcgtgggctaccccaccagcttcatgagcctgagatgcctgctgagcgacgagctgagcaacatcgccatgcaggtgagaaagctggtgggcacccagcaccccctgctgaccaccgccagaggcctggtgcacgacagctggaacagcctgcagctgagaggcctggtggtgctgctgatcagcaaggccgccggccccagcagcgtgaacaccagctgccagaactacgacatggtgagcggcatctacagctgccagagaagcctggccgagatcaccgagctgatccacatcgccctgctggtgcacagaggcatcgtgaacctgaacgagctgcagagcagcgacggccccctgaaggacatgcagttcggcaacaagatcgccatcctgagcggcgacttcctgctggccaacgcctgcaacggcctggccctgctgcagaacaccaaggtggtggagctgctggccagcgccctgatggacctggtgcagggcgtgtaccacgagaacagcaccagcaaggagagctacatcaccgacgacatcggcatcagcacctggaaggagcagaccttcctgagccacggcgccctgctggccaagagctgccaggccgccatggagctggccaagcacgacgccgaggtgcagaacatggccttccagtacggcaagcacatggccatgagccacaagatcaacagcgacgtgcagcccttcatcaaggagaagaccagcgacagcatgaccttcaacctgaacagcgcccccgtggtgctgcaccaggagttcctgggcagagacctgtggatcaagcagatcggcgaggcccaggagaagggcagactggactacgccaagctgagagagagaatcaaggccggcaagggcgtgaccagcgccatcgacctgtgcagataccacggcaacaaggccctggaggccctggagagcttcccccccagcgaggccagaagcgccctggagaacatcgtgttcgccgtgaccagattcagctag

SEQ ID NO: 94401 - DNA, 243 bp, Artificial Sequence
  Description of Artificial Sequence: Synthetic coding sequence
gtgcagaacatggccttccagtacggcaagcacatggccatgagccacaagatcaacagcgacgtgcagcccttcatcaaggagaagaccagcgacagcatgaccttcaacctgaacagcgcccccgtggtgctgcaccaggagttcctgggcagagacctgtggatcaagcagatcggcgagagcagcagcaccgaggtgcagctgagcaacttccagcagatgctgctgagcaccctgtag

SEQ ID NO: 94402 - DNA, 894 bp, Artificial Sequence
  Description of Artificial Sequence: Synthetic coding sequence
atgaacttcagacagctgctgctgcacctgcccagatacctgggcgccagcggcagccccagaagactgtggtggagccccagcctggacaccatcagcagcgtgggcagctggagaggcagaagcagcaagagccccgcccactggaaccaggtggtgagcgaggccgagaagatcgtgggctaccccaccagcttcatgagcctgagatgcctgctgagcgacgagctgagcaacatcgccatgcaggtgagaaagctggtgggcacccagcaccccctgctgaccaccgccagaggcctggtgcacgacagctggaacagcctgcagctgagaggcctggtggtgctgctgatcagcaaggccgccggccccagcagcgtgaacaccagctgccagaactacgacatggtgagcggcatctacagctgccagagaagcctggccgagatcaccgagctgatccacatcgccctgctggtgcacagaggcatcgtgaacctgaacgagctgcagagcagcgacggccccctgaaggacatgcagttcggcaacaagatcgccatcctgagcggcgacttcctgctggccaacgcctgcaacggcctggccctgctgcagaacaccaaggtggtggagctgctggccagcgccctgatggacctggtgcagggcgtgtaccacgagaacagcaccagcaaggcccaggagaagggcagactggactacgccaagctgagagagagaatcaaggccggcaagggcgtgaccagcgccatcgacctgtgcagataccacggcaacaaggccctggaggccctggagagcttcccccccagcgaggccagaagcgccctggagaacatcgtgttcgccgtgaccagattcagctag

SEQ ID NO: 94403 - DNA, 882 bp, Artificial Sequence
  Description of Artificial Sequence: Synthetic coding sequence
atgggcagagtggtggccgagctggtgagcagcctgctgggcctgtggctgctgctgtgcagctgcggctgccccgagggcgccgagctgagagccccccccgacaagatcgccatcatcggcgccggcatcggcggcaccagcgccgcctactacctgagacagaagttcggcaaggacgtgaagatcgacctgttcgagagagaggaggtgggcggcagactggccaccatgatggtgcagggccaggagtacgaggccggcggcagcgtgatccaccccctgaacctgcacatgaagagattcgtgaaggacctgggcctgagcgccgtgcaggccagcggcggcctgctgggcatctacaacggcgagaccctggtgttcgaggagagcaactggttcatcatcaacgtgatcaagctggtgtggagatacggcttccagagcctgagaatgcacatgtgggtggaggacgtgctggacaagttcatgagaatctacagataccagagccacgactacgccttcagcagcgtggagaagctgctgcacgccctgggcggcgacgacttcctgggcatgctgaacagaaccctgctggagaccctgcagaaggccggcttcagcgagaagttcctgaacgagatgatcgcccccgtgatgagagtgaactacggccagagcaccgacatcaacgccttcgtgggcgccgtgagcctgagctgcagcgacagcggcctgtgggccgtggagggcggcaacaagctggtgtgcagcggcctgctgcaggccagcaagagcaacctgatcagcggcagcgtgatgtacatcgaggagaagaccaagaccaagtacaccgtgctgggcctgtgccccctgtag

SEQ ID NO: 94404 - DNA, 1518 bp, Artificial Sequence
  Description of Artificial Sequence: Synthetic coding sequence
atgggcagagtggtggccgagctggtgagcagcctgctgggcctgtggctgctgctgtgcagctgcggctgccccgagggcgccgagctgagagccccccccgacaagatcgccatcatcggcgccggcatcggcggcaccagcgccgcctactacctgagacagaagttcggcaaggacgtgaagatcgacctgttcgagagagaggaggtgggcggcagactggccaccatgatggtgcagggccaggagtacgaggccggcggcagcgtgatccaccccctgaacctgcacatgaagagattcgtgaaggacctgggcctgagcgccgtgcaggccagcggcggcctgctgggcatctacaacggcgagaccctggtgttcgaggagagcaactggttcatcatcaacgtgatcaagctggtgtggagatacggcttccagagcctgagaatgcacatgtgggtggaggacgtgctggacaagttcatgagaatctacagataccagagccacgactacgccttcagcagcgtggagaagctgctgcacgccctgggcggcgacgacttcctgggcatgctgaacagaaccctgctggagaccctgcagaaggccggcttcagcgagaagttcctgaacgagatgatcgcccccgtgatgagagtgaactacggccagagcaccgacatcaacgccttcgtgggcgccgtgagcctgagctgcagcgacagcggcctgtgggccgtggagggcggcaacaagctggtgtgcagcggcctgctgcaggccagcaagagcaacctgatcagcggcagcgtgatgtacatcgaggagaagaccaagaccaagtacaccggcaaccccaccaagatgtacgaggtggtgtaccagatcggcaccgagaccagaagcgacttctacgacatcgtgctggtggccacccccctgaacagaaagatgagcaacatcaccttcctgaacttcgacccccccatcgaggagttccaccagtactaccagcacatcgtgaccaccctggtgaagggcgagctgaacaccagcatcttcagcagcagacccatcgacaagttcggcctgaacaccgtgctgaccaccgacaacagcgacctgttcatcaacagcatcggcatcgtgcccagcgtgagagagaaggaggaccccgagcccagcaccgacggcacctacgtgtggaagatcttcagccaggagaccctgaccaaggcccagatcctgaagctgttcctgagctacgactacgccgtgaagaagccctggctggcctacccccactacaagccccccgagaagtgccccagcatcatcctgcacgacagactgtactacctgaacggcatcgagtgcgccgccagcgccatggagatgagcgccatcgccgcccacaacgccgccctgctggcctaccacagatggaacggccacaccgacatgatcgaccaggacggcctgtacgagaagctgaagaccgagctgtag

SEQ ID NO: 94405 - DNA, 1287 bp, Artificial Sequence
  Description of Artificial Sequence: Synthetic coding sequence
atgatggtgcagggccaggagtacgaggccggcggcagcgtgatccaccccctgaacctgcacatgaagagattcgtgaaggacctgggcctgagcgccgtgcaggccagcggcggcctgctgggcatctacaacggcgagaccctggtgttcgaggagagcaactggttcatcatcaacgtgatcaagctggtgtggagatacggcttccagagcctgagaatgcacatgtgggtggaggacgtgctggacaagttcatgagaatctacagataccagagccacgactacgccttcagcagcgtggagaagctgctgcacgccctgggcggcgacgacttcctgggcatgctgaacagaaccctgctggagaccctgcagaaggccggcttcagcgagaagttcctgaacgagatgatcgcccccgtgatgagagtgaactacggccagagcaccgacatcaacgccttcgtgggcgccgtgagcctgagctgcagcgacagcggcctgtgggccgtggagggcggcaacaagctggtgtgcagcggcctgctgcaggccagcaagagcaacctgatcagcggcagcgtgatgtacatcgaggagaagaccaagaccaagtacaccggcaaccccaccaagatgtacgaggtggtgtaccagatcggcaccgagaccagaagcgacttctacgacatcgtgctggtggccacccccctgaacagaaagatgagcaacatcaccttcctgaacttcgacccccccatcgaggagttccaccagtactaccagcacatcgtgaccaccctggtgaagggcgagctgaacaccagcatcttcagcagcagacccatcgacaagttcggcctgaacaccgtgctgaccaccgacaacagcgacctgttcatcaacagcatcggcatcgtgcccagcgtgagagagaaggaggaccccgagcccagcaccgacggcacctacgtgtggaagatcttcagccaggagaccctgaccaaggcccagatcctgaagctgttcctgagctacgactacgccgtgaagaagccctggctggcctacccccactacaagccccccgagaagtgccccagcatcatcctgcacgacagactgtactacctgaacggcatcgagtgcgccgccagcgccatggagatgagcgccatcgccgcccacaacgccgccctgctggcctaccacagatggaacggccacaccgacatgatcgaccaggacggcctgtacgagaagctgaagaccgagctgtag

SEQ ID NO: 94406 - DNA, 1284 bp, Artificial Sequence
  Description of Artificial Sequence: Synthetic coding sequence
atggtgcagggccaggagtacgaggccggcggcagcgtgatccaccccctgaacctgcacatgaagagattcgtgaaggacctgggcctgagcgccgtgcaggccagcggcggcctgctgggcatctacaacggcgagaccctggtgttcgaggagagcaactggttcatcatcaacgtgatcaagctggtgtggagatacggcttccagagcctgagaatgcacatgtgggtggaggacgtgctggacaagttcatgagaatctacagataccagagccacgactacgccttcagcagcgtggagaagctgctgcacgccctgggcggcgacgacttcctgggcatgctgaacagaaccctgctggagaccctgcagaaggccggcttcagcgagaagttcctgaacgagatgatcgcccccgtgatgagagtgaactacggccagagcaccgacatcaacgccttcgtgggcgccgtgagcctgagctgcagcgacagcggcctgtgggccgtggagggcggcaacaagctggtgtgcagcggcctgctgcaggccagcaagagcaacctgatcagcggcagcgtgatgtacatcgaggagaagaccaagaccaagtacaccggcaaccccaccaagatgtacgaggtggtgtaccagatcggcaccgagaccagaagcgacttctacgacatcgtgctggtggccacccccctgaacagaaagatgagcaacatcaccttcctgaacttcgacccccccatcgaggagttccaccagtactaccagcacatcgtgaccaccctggtgaagggcgagctgaacaccagcatcttcagcagcagacccatcgacaagttcggcctgaacaccgtgctgaccaccgacaacagcgacctgttcatcaacagcatcggcatcgtgcccagcgtgagagagaaggaggaccccgagcccagcaccgacggcacctacgtgtggaagatcttcagccaggagaccctgaccaaggcccagatcctgaagctgttcctgagctacgactacgccgtgaagaagccctggctggcctacccccactacaagccccccgagaagtgccccagcatcatcctgcacgacagactgtactacctgaacggcatcgagtgcgccgccagcgccatggagatgagcgccatcgccgcccacaacgccgccctgctggcctaccacagatggaacggccacaccgacatgatcgaccaggacggcctgtacgagaagctgaagaccgagctgtag

SEQ ID NO: 94407 - DNA, 1485 bp, Artificial Sequence
  Description of Artificial Sequence: Synthetic coding sequence
atggccagagccgcccccctgctggccgccctgaccgccctgctggccgccgccgccgccggcggcgacgccccccccggcaagatcgccgtggtgggcgccggcatcggcggcagcgccgtggcccacttcctgcagcagcacttcggccccagagtgcagatcgacgtgtacgagaagggcaccgtgggcggcagactggccaccatcagcgtgaacaagcagcactacgagagcggcgccgccagcttccacagcctgagcctgcacatgcaggacttcgtgaagctgctgggcctgagacacagaagagaggtggtgggcagaagcgccatcttcggcggcgagcacttcatgctggaggagaccgactggtacctgctgaacctgttcagactgtggtggcactacggcatcagcttcctgagactgcagatgtgggtggaggaggtgatggagaagttcatgagaatctacaagtaccaggcccacggctacgccttcagcggcgtggaggagctgctgtacagcctgggcgagagcaccttcgtgaacatgacccagcacagcgtggccgagagcctgctgcaggtgggcgtgacccagagattcatcgacgacgtggtgagcgccgtgctgagagccagctacggccagagcgccgccatgcccgccttcgccggcgccatgagcctggccggcgcccagggcagcctgtggagcgtggagggcggcaacaagctggtgtgcagcggcctgctgaagctgaccaaggccaacgtgatccacgccaccgtgaccagcgtgaccctgcacagcaccgagggcaaggccctgtaccaggtggcctacgagaacgaggtgggcaacagcagcgacttctacgacatcgtggtgatcgccacccccctgcacctggacaacagcagcagcaacctgaccttcgccggcttccacccccccatcgacgacgtgcagggcagcttccagcccaccgtggtgagcctggtgcacggctacctgaacagcagctacttcggcttccccgaccccaagctgttccccttcgccaacatcctgaccaccgacttccccagcttcttctgcaccctggacaacatctgccccgtgaacatcagcgccagcttcagaagaaagcagccccaggaggccgccgtgtggagagtgcagagccccaagcccctgttcagaacccagctgaagaccctgttcagaagctactacagcgtgcagaccgccgagtggcaggcccaccccctgtacggcagcagacccaccctgcccagattcgccctgcacgaccagctgttctacctgaacgccctggagtgggccgccagcagcgtggaggtgatggccgtggccgccaagaacgtggccctgctggcctacaacagatggtaccaggacctggacaagatcgaccagaaggacctgatgcacaaggtgaagaccgagctgtag

SEQ ID NO: 94408 - DNA, 531 bp, Artificial Sequence
  Description of Artificial Sequence: Synthetic coding sequence
atgaaggtgctgctgtgcgacctgctgctgctgagcctgttcagcagcgtgttcagcagctgccagagagactgcctgacctgccaggagaagctgcaccccgccctggacagcttcgacctggaggtgtgcatcctggagtgcgaggagaaggtgttccccagccccctgtggaccccctgcaccaaggtgatggccagaagcagctggcagctgagccccgccgcccccgagcacgtggccgccgccctgtaccagcccagagccagcgagatgcagcacctgagaagaatgcccagagtgagaagcctgttccaggagcaggaggagcccgagcccggcatggaggaggccggcgagatggagcagaagcagctgcagaagagattcggcggcttcaccggcgccagaaagagcgccagaaagctggccaaccagaagagattcagcgagttcatgagacagtacctggtgctgagcatgcagagcagccagagaagaagaaccctgcaccagaacggcaacgtgtag

SEQ ID NO: 94409 - DNA, 465 bp, Artificial Sequence
  Description of Artificial Sequence: Synthetic coding sequence
atgaaggtgctgctgtgcgacctgctgctgctgagcctgttcagcagcgtgttcagcagctgccagagagactgcctgacctgccaggagaagctgcaccccgccctggacagcttcgacctggaggtgtgcatcctggagtgcgaggagaaggtgttccccagccccctgtggaccccctgcaccaaggtgatggccagaagcagctggcagctgagccccgccgcccccgagcacgtggccgccgccctgtaccagcccagagccagcgagatgcagcacctgagaagaatgcccagagtgagaagcctgttccaggagcaggaggagcccgagcccggcatggaggaggccggcgagatggagcagaagcagctgcagaagagattcggcggcttcaccggcgccagaaagagcgccagaaagctggccaaccagaagagattcagcgagttcatgagatag

SEQ ID NO: 94410 - DNA, 1230 bp, Artificial Sequence
  Description of Artificial Sequence: Synthetic coding sequence
atgaccgagctgcccgcccccctgagctacttccagaacgcccagatgagcgaggacaaccacctgagcaacaccgtgagaagccagaacgacaacagagagagacaggagcacaacgacagaagaagcctgggccaccccgagcccctgagcaacggcagaccccagggcaacagcagacaggtggtggagcaggacgaggaggaggacgaggagctgaccctgaagtacggcgccaagcacgtgatcatgctgttcgtgcccgtgaccctgtgcatggtggtggtggtggccaccatcaagagcgtgagcttctacaccagaaaggacggccagctgatctacacccccttcaccgaggacaccgagaccgtgggccagagagccctgcacagcatcctgaacgccgccatcatgatcagcgtgatcgtggtgatgaccatcctgctggtggtgctgtacaagtacagatgctacaaggtgatccacgcctggctgatcatcagcagcctgctgctgctgttcttcttcagcttcatctacctgggcgaggtgttcaagacctacaacgtggccgtggactacatcaccgtggccctgctgatctggaacttcggcgtggtgggcatgatcagcatccactggaagggccccctgagactgcagcaggcctacctgatcatgatcagcgccctgatggccctggtgttcatcaagtacctgcccgagtggaccgcctggctgatcctggccgtgatcagcgtgtacgacctggtggccgtgctgtgccccaagggccccctgagaatgctggtggagaccgcccaggagagaaacgagaccctgttccccgccctgatctacagcagcaccatggtgtggctggtgaacatggccgagggcgaccccgaggcccagagaagagtgagcaagaacagcaagtacaacgccgagagaggcgtgaagctgggcctgggcgacttcatcttctacagcgtgctggtgggcaaggccagcgccaccgccagcggcgactggaacaccaccatcgcctgcttcgtggccatcctgatcggcctgtgcctgaccctgctgctgctggccatcttcaagaaggccctgcccgccctgcccatcagcatcaccttcggcctggtgttctacttcgccaccgactacctggtgcagcccttcatggaccagctggccttccaccagttctacatctag

SEQ ID NO: 94411 - DNA, 1404 bp, Artificial Sequence
  Description of Artificial Sequence: Synthetic coding sequence
atgaccgagctgcccgcccccctgagctacttccagaacgcccagatgagcgaggacaaccacctgagcaacaccgtgagaagccagaacgacaacagagagagacaggagcacaacgacagaagaagcctgggccaccccgagcccctgagcaacggcagaccccagggcaacagcagacaggtggtggagcaggacgaggaggaggacgaggagctgaccctgaagtacggcgccaagcacgtgatcatgctgttcgtgcccgtgaccctgtgcatggtggtggtggtggccaccatcaagagcgtgagcttctacaccagaaaggacggccagctgatctacacccccttcaccgaggacaccgagaccgtgggccagagagccctgcacagcatcctgaacgccgccatcatgatcagcgtgatcgtggtgatgaccatcctgctggtggtgctgtacaagtacagatgctacaaggtgatccacgcctggctgatcatcagcagcctgctgctgctgttcttcttcagcttcatctacctgggcgaggtgttcaagacctacaacgtggccgtggactacatcaccgtggccctgctgatctggaacttcggcgtggtgggcatgatcagcatccactggaagggccccctgagactgcagcaggcctacctgatcatgatcagcgccctgatggccctggtgttcatcaagtacctgcccgagtggaccgcctggctgatcctggccgtgatcagcgtgtacgacctggtggccgtgctgtgccccaagggccccctgagaatgctggtggagaccgcccaggagagaaacgagaccctgttccccgccctgatctacagcagcaccatggtgtggctggtgaacatggccgagggcgaccccgaggcccagagaagagtgagcaagaacagcaagtacaacgccgagagcaccgagagagagagccaggacaccgtggccgagaacgacgacggcggcttcagcgaggagtgggaggcccagagagacagccacctgggcccccacagaagcacccccgagagcagagccgccgtgcaggagctgagcagcagcatcctggccggcgaggaccccgaggagagaggcgtgaagctgggcctgggcgacttcatcttctacagcgtgctggtgggcaaggccagcgccaccgccagcggcgactggaacaccaccatcgcctgcttcgtggccatcctgatcggcctgtgcctgaccctgctgctgctggccatcttcaagaaggccctgcccgccctgcccatcagcatcaccttcggcctggtgttctacttcgccaccgactacctggtgcagcccttcatggaccagctggccttccaccagttctacatctag

SEQ ID NO: 94412 - DNA, 1137 bp, Artificial Sequence
  Description of Artificial Sequence: Synthetic coding sequence
atgaccgagctgcccgcccccctgagctacttccagaacgcccagatgagcgaggacaaccacctgagcaacaccgtgagaagccagaacgacaacagagagagacaggagcacaacgacagaagaagcctgggccaccccgagcccctgagcaacggcagaccccagggcaacagcagacaggtggtggagcaggacgaggaggaggacgaggagctgaccctgaagtacggcgccaagcacgtgatcatgctgttcgtgcccgtgaccctgtgcatggtggtggtggtggccaccatcaagagcgtgagcttctacaccagaaaggacggccagctgatctacacccccttcaccgaggacaccgagaccgtgggccagagagccctgcacagcatcctgaacgccgccatcatgatcagcgtgatcgtggtgatgaccatcctgctggtggtgctgtacaagtacagatgctacaaggtgatccacgcctggctgatcatcagcagcctgctgctgctgttcttcttcagcttcatctacctgggcgaggtgttcaagacctacaacgtggccgtggactacatcaccgtggccctgctgatctggaacttcggcgtggtgggcatgatcagcatccactggaagggccccctgagactgcagcaggcctacctgatcatgatcagcgccctgatggccctggtgttcatcaagtacctgcccgagtggaccgcctggctgatcctggccgtgatcagcgtgtacgacctggtggccgtgctgtgccccaagggccccctgagaatgctggtggagaccgcccaggagagaaacgagaccctgttccccgccctgatctacagcagcaccatggtgtggctggtgaacatggccgagggcgaccccgaggcccagagaagagtgagcaagaacagcaagtacaacgccgagagagcctgcctgccccccgccgccatcaacctgctgagcatcgcccccatggcccccagactgttcatgcccaagggcgcctgcagacccaccgcccagaagggcagccacaagaccctgctgcagagaatgatgatggccggcagcgtgagaaacggcaagcccagaggcaccgtgatctag

SEQ ID NO: 94413 - DNA, 1392 bp, Artificial Sequence
  Description of Artificial Sequence: Synthetic coding sequence
atgaccgagctgcccgcccccctgagctacttccagaacgcccagatgagcgaggacaaccacctgagcaacaccaacgacaacagagagagacaggagcacaacgacagaagaagcctgggccaccccgagcccctgagcaacggcagaccccagggcaacagcagacaggtggtggagcaggacgaggaggaggacgaggagctgaccctgaagtacggcgccaagcacgtgatcatgctgttcgtgcccgtgaccctgtgcatggtggtggtggtggccaccatcaagagcgtgagcttctacaccagaaaggacggccagctgatctacacccccttcaccgaggacaccgagaccgtgggccagagagccctgcacagcatcctgaacgccgccatcatgatcagcgtgatcgtggtgatgaccatcctgctggtggtgctgtacaagtacagatgctacaaggtgatccacgcctggctgatcatcagcagcctgctgctgctgttcttcttcagcttcatctacctgggcgaggtgttcaagacctacaacgtggccgtggactacatcaccgtggccctgctgatctggaacttcggcgtggtgggcatgatcagcatccactggaagggccccctgagactgcagcaggcctacctgatcatgatcagcgccctgatggccctggtgttcatcaagtacctgcccgagtggaccgcctggctgatcctggccgtgatcagcgtgtacgacctggtggccgtgctgtgccccaagggccccctgagaatgctggtggagaccgcccaggagagaaacgagaccctgttccccgccctgatctacagcagcaccatggtgtggctggtgaacatggccgagggcgaccccgaggcccagagaagagtgagcaagaacagcaagtacaacgccgagagcaccgagagagagagccaggacaccgtggccgagaacgacgacggcggcttcagcgaggagtgggaggcccagagagacagccacctgggcccccacagaagcacccccgagagcagagccgccgtgcaggagctgagcagcagcatcctggccggcgaggaccccgaggagagaggcgtgaagctgggcctgggcgacttcatcttctacagcgtgctggtgggcaaggccagcgccaccgccagcggcgactggaacaccaccatcgcctgcttcgtggccatcctgatcggcctgtgcctgaccctgctgctgctggccatcttcaagaaggccctgcccgccctgcccatcagcatcaccttcggcctggtgttctacttcgccaccgactacctggtgcagcccttcatggaccagctggccttccaccagttctacatctag

SEQ ID NO: 94414 - DNA, 555 bp, Artificial Sequence
  Description of Artificial Sequence: Synthetic coding sequence
atgaccgagctgcccgcccccctgagctacttccagaacgcccagatgagcgaggacaaccacctgagcaacaccgtgagaagccagaacgacaacagagagagacaggagcacaacgacagaagaagcctgggccaccccgagcccctgagcaacggcagaccccagggcaacagcagacaggtggtggagcaggacgaggaggaggacgaggagctgaccctgaagtacggcgccaagcacgtgatcatgctgttcgtgcccgtgaccctgtgcatggtggtggtggtggccaccatcaagagcgtgagcttctacaccagaaaggacggccagctgatctacacccccttcaccgaggacaccgagaccgtgggccagagagccctgcacagcatcctgaacgccgccatcatgatcagcgtgatcgtggtgatgaccatcctgctggtggtgctgtacaagtacagatgctacaaggtgagcatgagacacagaagcctgctgagcaccctgttcttcctgtggctgggcatcctggtgaccgtgacctag

SEQ ID NO: 94415 - DNA, 1392 bp, Artificial Sequence; identical to SEQ ID NO: 94413
  Description of Artificial Sequence: Synthetic coding sequence

SEQ ID NO: 94416 - DNA, 279 bp, Artificial Sequence
  Description of Artificial Sequence: Synthetic coding sequence
atgaccgagctgcccgcccccctgagctacttccagaacgcccagatgagcgaggacaaccacctgagcaacaccaacgacaacagagagagacaggagcacaacgacagaagaagcctgggccaccccgagcccctgagcaacggcagaccccagggcaacagcagacaggtggtggagcaggacgaggaggaggacgaggagctgaccctgaagtacggcgccaagcacgtgatcatgctgttcgtgcccgtgaccctgtgcatggtggtggtgtag

SEQ ID NO: 94417 - DNA, 444 bp, Artificial Sequence
  Description of Artificial Sequence: Synthetic coding sequence
atgaccgagctgcccgcccccctgagctacttccagaacgcccagatgagcgaggacaaccacctgagcaacaccaacgacaacagagagagacaggagcacaacgacagaagaagcctgggccaccccgagcccctgagcaacggcagaccccagggcaacagcagacaggtggtggagcaggacgaggaggaggacgaggagctgaccctgaagtacggcgccaagcacgtgatcatgctgttcgtgcccgtgaccctgtgcatggtggtggtggtggccaccatcaagagcgtgagcttctacaccagaaaggacggccagctgatctacacccccttcaccgaggacaccgagaccgtgggccagagagccctgcacagcatcctgaacgccgccatcatgatcagcgtgatcgtggtgatgaccatcctgctggtgtag

SEQ ID NO: 94418 - DNA, 330 bp, Artificial Sequence
  Description of Artificial Sequence: Synthetic coding sequence
atgaccgagctgcccgcccccctgagctacttccagaacgcccagatgagcgaggacaaccacctgagcaacaccgtgagaagccagaacgacaacagagagagacaggagcacaacgacagaagaagcctgggccaccccgagcccctgagcaacggcagaccccagggcaacagcagacaggtggtggagcaggacgaggaggaggacgaggagctgaccctgaagtacggcgccaagcacgtgatcatgctgttcgtgcccgtgaccctgtgcatggtggtggtggtggccaccatcaagagcgtgagcttctacaccagaaagtag

SEQ ID NO: 94419 - DNA, 468 bp, Artificial Sequence
  Description of Artificial Sequence: Synthetic coding sequence
atgaccgagctgcccgcccccctgagctacttccagaacgcccagatgagcgaggacaaccacctgagcaacaccgtgagaagccagaacgacaacagagagagacaggagcacaacgacagaagaagcctgggccaccccgagcccctgagcaacggcagaccccagggcaacagcagacaggtggtggagcaggacgaggaggaggacgaggagctgaccctgaagtacggcgccaagcacgtgatcatgctgttcgtgcccgtgaccctgtgcatggtggtggtggtggccaccatcaagagcgtgagcttctacaccagaaaggacggccagctgatctacacccccttcaccgaggacaccgagaccgtgggccagagagccctgcacagcatcctgaacgccgccatcatgatcagcgtgatcgtggtgatgaccatcctgctggtggtgctgtacaagtag

SEQ ID NO: 94420 - DNA, 177 bp, Artificial Sequence
  Description of Artificial Sequence: Synthetic coding sequence
atgaccgagctgcccgcccccctgagctacttccagaacgcccagatgagcgaggacaaccacctgagcaacaccaacgacaacagagagagacaggagcacaacgacagaagaagcctgggccaccccgagcccctgagcaacggcagaccccagggcaacagcagacaggtgtag

SEQ ID NO: 94421 - DNA, 279 bp, Artificial Sequence; identical to SEQ ID NO: 94416
  Description of Artificial Sequence: Synthetic coding sequence

SEQ ID NO: 94422 - DNA, 192 bp, Artificial Sequence
  Description of Artificial Sequence: Synthetic coding sequence
atgaccgagctgcccgcccccctgagctacttccagaacgcccagatgagcgaggacaaccacctgagcaacaccaacgacaacagagagagacaggagcacaacgacagaagaagcctgggccaccccgagcccctgagcaacggcagaccccagggcaacagcagacaggtggtggagcaggacgagtag

SEQ ID NO: 94423 - DNA, 276 bp, Artificial Sequence
  Description of Artificial Sequence: Synthetic coding sequence
atgaccgagctgcccgcccccctgagctacttccagaacgcccagatgagcgaggacaaccacctgagcaacaccaacgacaacagagagagacaggagcacaacgacagaagaagcctgggccaccccgagcccctgagcaacggcagaccccagggcaacagcagacaggtggtggagcaggacgaggaggaggacgaggagctgaccctgaagtacggcgccaagcacgtgatcatgctgttcgtgcccgtgaccctgtgcatggtggtgtag

SEQ ID NO: 94424 - DNA, 189 bp, Artificial Sequence
  Description of Artificial Sequence: Synthetic coding sequence
atgaccgagctgcccgcccccctgagctacttccagaacgcccagatgagcgaggacaaccacctgagcaacaccaacgacaacagagagagacaggagcacaacgacagaagaagcctgggccaccccgagcccctgagcaacggcagaccccagggcaacagcagacaggtggtggagcaggactag

SEQ ID NO: 94425 - DNA, 300 bp, Artificial Sequence
  Description of Artificial Sequence: Synthetic coding sequence
atgaccgagctgcccgcccccctgagctacttccagaacgcccagatgagcgaggacaaccacctgagcaacaccgtgagaagccagaacgacaacagagagagacaggagcacaacgacagaagaagcctgggccaccccgagcccctgagcaacggcagaccccagggcaacagcagacaggtggtggagcaggacgaggaggaggacgaggagctgaccctgaagtacggcgccaagcacgtgatcatgctgttcgtgcccgtgaccctgtgcatggtggtggtggtggccacctag

SEQ ID NO: 94426 - DNA, 408 bp, Artificial Sequence
  Description of Artificial Sequence: Synthetic coding sequence
atgaccgagctgcccgcccccctgagctacttccagaacgcccagatgagcgaggacaaccacctgagcaacaccaacgacaacagagagagacaggagcacaacgacagaagaagcctgggccaccccgagcccctgagcaacggcagaccccagggcaacagcagacaggtggtggagcaggacgaggaggaggacgaggagctgaccctgaagtacggcgccaagcacgtgatcatgctgttcgtgcccgtgaccctgtgcatggtggtggtggtggccaccatcaagagcgtgagcttctacaccagaaaggacggccagctgatctacacccccttcaccgaggacaccgagaccgtgggccagagagccctgcacagcatcctgaacgccgccatcatgtag

SEQ ID NO: 94427 - DNA, 330 bp, Artificial Sequence
  Description of Artificial Sequence: Synthetic coding sequence
atgaccgagctgcccgcccccctgagctacttccagaacgcccagatgagcgaggacaaccacctgagcaacaccaacgacaacagagagagacaggagcacaacgacagaagaagcctgggccaccccgagcccctgagcaacggcagaccccagggcaacagcagacaggtggtggagcaggacgaggaggaggacgaggagctgaccctgaagtacggcgccaagcacgtgatcatgctgttcgtgcccgtgaccctgtgcatggtggtggtggtggccaccatcaagagcgtgagcttctacaccagaaaggacggccagctgtag

SEQ ID NO: 94428 - DNA, 1248 bp, Artificial Sequence
  Description of Artificial Sequence: Synthetic coding sequence
atgctgaccttcatggccagcgacagcgaggaggaggtgtgcgacgagagaaccagcctgatgagcgccgagagccccacccccagaagctgccaggagggcagacagggccccgaggacggcgagaacaccgcccagtggagaagccaggagaacgaggaggacggcgaggaggaccccgacagatacgtgtgcagcggcgtgcccggcagaccccccggcctggaggaggagctgaccctgaagtacggcgccaagcacgtgatcatgctgttcgtgcccgtgaccctgtgcatgatcgtggtggtggccaccatcaagagcgtgagattctacaccgagaagaacggccagctgatctacacccccttcaccgaggacacccccagcgtgggccagagactgctgaacagcgtgctgaacaccctgatcatgatcagcgtgatcgtggtgatgaccatcttcctggtggtgctgtacaagtacagatgctacaagttcatccacggctggctgatcatgagcagcctgatgctgctgttcctgttcacctacatctacctgggcgaggtgctgaagacctacaacgtggccatggactaccccaccctgctgctgaccgtgtggaacttcggcgccgtgggcatggtgtgcatccactggaagggccccctggtgctgcagcaggcctacctgatcatgatcagcgccctgatggccctggtgttcatcaagtacctgcccgagtggagcgcctgggtgatcctgggcgccatcagcgtgtacgccgccatggtgtggaccgtgggcatggccaagctggaccccagcagccagggcgccctgcagctgccctacgaccccgagatggaggaggacagctacgacagcttcggcgagcccagctaccccgaggtgttcgagccccccctgaccggctaccccggcgaggagctggaggaggaggaggagagaggcgtgaagctgggcctgggcgacttcatcttctacagcgtgctggtgggcaaggccgccgccaccggcagcggcgactggaacaccaccctggcctgcttcgtggccatcctgatcggcctgtgcctgaccctgctgctgctggccgtgttcaagaaggccctgcccgccctgcccatcagcatcaccttcggcctgatcttctacttcagcaccgacaacctggtgagacccttcatggacaccctggccagccaccagctgtacatctag

SEQ ID NO: 94429 - DNA, 1446 bp, Artificial Sequence
  Description of Artificial Sequence: Synthetic coding sequence
atgctggccggcaccgtgagattcgccagacactgcctgaagttcttccccgcccagaagcccgcctgcgtggacttcggcgccagcagaggcagagccatgctgaccttcatggccagcgacagcgaggaggaggtgtgcgacgagagaaccagcctgatgagcgccgagagccccacccccagaagctgccaggagggcagacagggccccgaggacggcgagaacaccgcccagtggagaagccaggagaacgaggaggacggcgaggaggaccccgacagatacgtgtgcagcggcgtgcccggcagaccccccggcctggaggaggagctgaccctgaagtacggcgccaagcacgtgatcatgctgttcgtgcccgtgaccctgtgcatgatcgtggtggtggccaccatcaagagcgtgagattctacaccgagaagaacggccagctgatctacacccccttcaccgaggacacccccagcgtgggccagagactgctgaacagcgtgctgaacaccctgatcatgatcagcgtgatcgtggtgatgaccatcttcctggtggtgctgtacaagtacagatgctacaagttcatccacggctggctgatcatgagcagcctgatgctgctgttcctgttcacctacatctacctgggcgaggtgctgaagacctacaacgtggccatggactaccccaccctgctgctgaccgtgtggaacttcggcgccgtgggcatggtgtgcatccactggaagggccccctggtgctgcagcaggcctacctgatcatgatcagcgccctgatggccctggtgttcatcaagtacctgcccgagtggagcgcctgggtgatcctgggcgccatcagcgtgtacgacctggtggccgtgctgtgccccaagggccccctgagaatgctggtggagaccgcccaggagagaaacgagcccatcttccccgccctgatctacagcagcgccatggtgtggaccgtgggcatggccaagctggaccccagcagccagggcgccctgcagctgccctacgaccccgagatggaggaggacagctacgacagcttcggcgagcccagctaccccgaggtgttcgagccccccctgaccggctaccccggcgaggagctggaggaggaggaggagagaggcgtgaagctgggcctgggcgacttcatcttctacagcgtgctggtgggcaaggccgccgccaccggcagcggcgactggaacaccaccctggcctgcttcgtggccatcctgatcggcctgtgcctgaccctgctgctgctggccgtgttcaagaaggccctgcccgccctgcccatcagcatcaccttcggcctgatcttctacttcagcaccgacaacctggtgagacccttcatggacaccctggccagccaccagctgtacatctag

SEQ ID NO: 94430 - DNA, 1347 bp, Artificial Sequence
  Description of Artificial Sequence: Synthetic coding sequence
atgctgaccttcatggccagcgacagcgaggaggaggtgtgcgacgagagaaccagcctgatgagcgccgagagccccacccccagaagctgccaggagggcagacagggccccgaggacggcgagaacaccgcccagtggagaagccaggagaacgaggaggacggcgaggaggaccccgacagatacgtgtgcagcggcgtgcccggcagaccccccggcctggaggaggagctgaccctgaagtacggcgccaagcacgtgatcatgctgttcgtgcccgtgaccctgtgcatgatcgtggtggtggccaccatcaagagcgtgagattctacaccgagaagaacggccagctgatctacacccccttcaccgaggacacccccagcgtgggccagagactgctgaacagcgtgctgaacaccctgatcatgatcagcgtgatcgtggtgatgaccatcttcctggtggtgctgtacaagtacagatgctacaagttcatccacggctggctgatcatgagcagcctgatgctgctgttcctgttcacctacatctacctgggcgaggtgctgaagacctacaacgtggccatggactaccccaccctgctgctgaccgtgtggaacttcggcgccgtgggcatggtgtgcatccactggaagggccccctggtgctgcagcaggcctacctgatcatgatcagcgccctgatggccctggtgttcatcaagtacctgcccgagtggagcgcctgggtgatcctgggcgccatcagcgtgtacgacctggtggccgtgctgtgccccaagggccccctgagaatgctggtggagaccgcccaggagagaaacgagcccatcttccccgccctgatctacagcagcgccatggtgtggaccgtgggcatggccaagctggaccccagcagccagggcgccctgcagctgccctacgaccccgagatggaggaggacagctacgacagcttcggcgagcccagctaccccgaggtgttcgagccccccctgaccggctaccccggcgaggagctggaggaggaggaggagagaggcgtgaagctgggcctgggcgacttcatcttctacagcgtgctggtgggcaaggccgccgccaccggcagcggcgactggaacaccaccctggcctgcttcgtggccatcctgatcggcctgtgcctgaccctgctgctgctggccgtgttcaagaaggccctgcccgccctgcccatcagcatcaccttcggcctgatcttctacttcagcaccgacaacctggtgagacccttcatggacaccctggccagccaccagctgtacatctag

SEQ ID NO: 94431 - DNA, 1446 bp, Artificial Sequence; identical to SEQ ID NO: 94429
  Description of Artificial Sequence: Synthetic coding sequence

SEQ ID NO: 94432 - DNA, 1344 bp, Artificial Sequence
  Description of Artificial Sequence: Synthetic coding sequence
atgctgaccttcatggccagcgacagcgaggaggaggtgtgcgacgagagaaccagcctgatgagcgccgagagccccacccccagaagctgccaggagggcagacagggccccgaggacggcgagaacaccgcccagtggagaagccaggagaacgaggaggacggcgaggaggaccccgacagatacgtgtgcagcggcgtgcccggcagaccccccggcctggaggaggagctgaccctgaagtacggcgccaagcacgtgatcatgctgttcgtgcccgtgaccctgtgcatgatcgtggtggtggccaccatcaagagcgtgagattctacaccgagaagaacggccagctgatctacacccccttcaccgaggacacccccagcgtgggccagagactgctgaacagcgtgctgaacaccctgatcatgatcagcgtgatcgtggtgatgaccatcttcctggtggtgctgtacaagtacagatgctacaagttcatccacggctggctgatcatgagcagcctgatgctgctgttcctgttcacctacatctacctgggcgaggtgctgaagacctacaacgtggccatggactaccccaccctgctgctgaccgtgtggaacttcggcgccgtgggcatggtgtgcatccactggaagggccccctggtgctgcagcaggcctacctgatcatgatcagcgccctgatggccctggtgttcatcaagtacctgcccgagtggagcgcctgggtgatcctgggcgccatcagcgtgtacgacctggtggccgtgctgtgccccaagggccccctgagaatgctggtggagaccgcccaggagagaaacgagcccatcttccccgccctgatctacagcagcgccatggtgtggaccgtgggcatggccaagctggaccccagcagccagggcgccctgcagctgccctacgaccccgagatggaggacagctacgacagcttcggcgagcccagctaccccgaggtgttcgagccccccctgaccggctaccccggcgaggagctggaggaggaggaggagagaggcgtgaagctgggcctgggcgacttcatcttctacagcgtgctggtgggcaaggccgccgccaccggcagcggcgactggaacaccaccctggcctgcttcgtggccatcctgatcggcctgtgcctgaccctgctgctgctggccgtgttcaagaaggccctgcccgccctgcccatcagcatcaccttcggcctgatcttctacttcagcaccgacaacctggtgagacccttcatggacaccctggccagccaccagctgtacatctag

SEQ ID NO: 94433 - DNA, 390 bp, Artificial Sequence
  Description of Artificial Sequence: Synthetic coding sequence
atgctgaccttcatggccagcgacagcgaggaggaggtgtgcgacgagagaaccagcctgatgagcgccgagagccccacccccagaagctgccaggagggcagacagggccccgaggacggcgagaacaccgcccagtggagaagccaggagaacgaggaggacggcgaggaggaccccgacagatacgtgtgcagcggcgtgcccggcagaccccccggcctggaggaggagctgaccctgaagtacggcgccaagcacgtgatcatgctgttcgtgcccgtgaccctgtgcatgatcgtggtggtggccaccatcaagagcgtgagattctacaccgagaagaacggccagctgatctacacccccttcaccgaggacaccccctag

SEQ ID NO: 94434 - DNA, 66 bp, Artificial Sequence
  Description of Artificial Sequence: Synthetic coding sequence
atgctgaccttcatggccagcgacagcgaggaggaggtgtgcgacgagagaaccagcctgatgtag

SEQ ID NO: 94435 - DNA, 990 bp, Artificial Sequence
  Description of Artificial Sequence: Synthetic coding sequence
atggcctggagaggctgggcccagagaggctggggctgcggccaggcctggggcgccagcgtgggcggcagaagctgcgaggagctgaccgccgtgctgacccccccccagctgctgggcagaagattcaacttcttcatccagcagaagtgcggcttcagaaaggcccccagaaaggtggagcccagaagaagcgaccccggcaccagcggcgaggcctacaagagaagcgccctgatcccccccgtggaggagaccgtgttctaccccagcccctaccccatcagaagcctgatcaagcccctgttcttcaccgtgggcttcaccggctgcgccttcggcagcgccgccatctggcagtacgagagcctgaagagcagagtgcagagctacttcgacggcatcaaggccgactggctggacagcatcagaccccagaaggagggcgacttcagaaaggagatcaacaagtggtggaacaacctgagcgacggccagagaaccgtgaccggcatcatcgccgccaacgtgctggtgttctgcctgtggagagtgcccagcctgcagagaaccatgatcagatacttcaccagcaaccccgccagcagcgtgatcagcaacttcgtgagctacgtgggcaaggtggccaccggcagatacggccccagcctgggcgccagcggcgccatcatgaccgtgctggccgccgtgtgcaccaagatccccgagggcagactggccatcatcttcctgcccatgttcaccttcaccgccggcaacgccctgaaggccatcatcgccatggacaccgccggcatgatcctgggctggaagttcttcgaccacgccgcccacctgggcggcgccctgttcggcatctggtacgtgacctacggccacgagctgatctggaagaacagagagcccctggtgaagatctggcacgagatcagaaccaacggccccaagaagggcggcggcagcaagtag

SEQ ID NO: 94436 - DNA, 1140 bp, Artificial Sequence
  Description of Artificial Sequence: Synthetic coding sequence
atggcctggagaggctgggcccagagaggctggggctgcggccaggcctggggcgccagcgtgggcggcagaagctgcgaggagctgaccgccgtgctgacccccccccagctgctgggcagaagattcaacttcttcatccagcagaagtgcggcttcagaaaggcccccagaaaggtggagcccagaagaagcgaccccggcaccagcggcgaggcctacaagagaagcgccctgatcccccccgtggaggagaccgtgttctaccccagcccctaccccatcagaagcctgatcaagcccctgttcttcaccgtgggcttcaccggctgcgccttcggcagcgccgccatctggcagtacgagagcctgaagagcagagtgcagagctacttcgacggcatcaaggccgactggctggacagcatcagaccccagaaggagggcgacttcagaaaggagatcaacaagtggtggaacaacctgagcgacggccagagaaccgtgaccggcatcatcgccgccaacgtgctggtgttctgcctgtggagagtgcccagcctgcagagaaccatgatcagatacttcaccagcaaccccgccagcaaggtgctgtgcagccccatgctgctgagcaccttcagccacttcagcctgttccacatggccgccaacatgtacgtgctgtggagcttcagcagcagcatcgtgaacatcctgggccaggagcagttcatggccgtgtacctgagcgccggcgtgatcagcaacttcgtgagctacgtgggcaaggtggccaccggcagatacggccccagcctgggcgccagcggcgccatcatgaccgtgctggccgccgtgtgcaccaagatccccgagggcagactggccatcatcttcctgcccatgttcaccttcaccgccggcaacgccctgaaggccatcatcgccatggacaccgccggcatgatcctgggctggaagttcttcgaccacgccgcccacctgggcggcgccctgttcggcatctggtacgtgacctacggccacgagctgatctggaagaacagagagcccctggtgaagatctggcacgagatcagaaccaacggccccaagaagggcggcggcagcaagtag

SEQ ID NO: 94437 - DNA, 663 bp, Artificial Sequence
  Description of Artificial Sequence: Synthetic coding sequence
atggccagcgccaccgacagcagatacggccagaaggagagcagcgaccagaacttcgactacatgttcaagatcctgatcatcggcaacagcagcgtgggcaagaccagcttcctgttcagatacgccgacgacagcttcacccccgccttcgtgagcaccgtgggcatcgacttcaaggtgaagaccatctacagaaacgacaagagaatcaagctgcagatctgggacaccgccggccaggagagatacagaaccatcaccaccgcctactacagaggcgccatgggcttcatcctgatgtacgacatcaccaacgaggagagcttcaacgccgtgcaggactggagcacccagatcaagacctacagctgggacaacgcccaggtgctgctggtgggcaacaagtgcgacatggaggacgagagagtggtgagcagcgagagaggcagacagctggccgaccacctgggcttcgagttcttcgaggccagcgccaaggacaacatcaacgtgaagcagaccttcgagagactggtggacgtgatctgcgagaagatgagcgagagcctggacaccgccgaccccgccgtgaccggcgccaagcagggcccccagctgagcgaccagcaggtgcccccccaccaggactgcgcctgctag

SEQ ID NO: 94438 - DNA, 306 bp, Artificial Sequence
  Description of Artificial Sequence: Synthetic coding sequence
atgaacctggagagagtgagcaacgaggagaagctgaacctgtgcagaaagtactacctgggcggcttcgccttcctgcccttcctgtggctggtgaacatcttctggttcttcagagaggccttcctggtgcccgcctacaccgagcagagccagatcaagggctacgtgtggagaagcgccgtgggcttcctgttctgggtgatcgtgctgaccagctggatcaccatcttccagatctacagacccagatggggcgccctgggcgactacctgagcttcaccatccccctgggcaccccctag

SEQ ID NO: 94439 - DNA, 378 bp, Artificial Sequence
  Description of Artificial Sequence: Synthetic coding sequence
atggccaagtacctggcccagatcatcgtgatgggcgtgcaggtggtgggcagagccttcgccagagccctgagacaggagttcgccgccagcagagccgccgccgacgccagaggcagagccggccacagaagcgccgccgccagcaacctgagcggcctgagcctgcaggaggcccagcagatcctgaacgtgagcaagctgagccccgaggaggtgcagaagaactacgagcacctgttcaaggtgaacgacaagagcgtgggcggcagcttctacctgcagagcaaggtggtgagagccaaggagagactggacgaggagctgaagatccaggcccaggaggacagagagaagggccagatgccccacacctag

SEQ ID NO: 94440 - DNA, 2496 bp, Artificial Sequence
  Description of Artificial Sequence: Synthetic coding sequence
atgcccctggagatggagcccaagatgagcaagctggccttcggctgccagagaagcagcaccagcgacgacgacagcggctgcgccctggaggagtacgcctgggtgccccccggcctgagacccgagcagatccagctgtacttcgcctgcctgcccgaggagaaggtgccctacgtgaacagccccggcgagaagcacagaatcaagcagctgctgtaccagctgcccccccacgacaacgaggtgagatactgccagagcctgagcgaggaggagaagaaggagctgcaggtgttcagcgcccagagaaagaaggaggccctgggcagaggcaccatcaagctgctgagcagagccgtgatgcacgccgtgtgcgagcagtgcggcctgaagatcaacggcggcgaggtggccgtgttcgccagcagagccggccccggcgtgtgctggcaccccagctgcttcgtgtgcttcacctgcaacgagctgctggtggacctgatctacttctaccaggacggcaagatccactgcggcagacaccacgccgagctgctgaagcccagatgcagcgcctgcgacgagatcatcttcgccgacgagtgcaccgaggccgagggcagacactggcacatgaagcacttctgctgcctggagtgcgagaccgtgctgggcggccagagatacatcatgaaggacggcagacccttctgctgcggctgcttcgagagcctgtacgccgagtactgcgagacctgcggcgagcacatcggcgtggaccacgcccagatgacctacgacggccagcactggcacgccaccgaggcctgcttcagctgcgcccagtgcaaggccagcctgctgggctgccccttcctgcccaagcagggccagatctactgcagcaagacctgcagcctgggcgaggacgtgcacgccagcgacagcagcgacagcgccttccagagcgccagaagcagagacagcagaagaagcgtgagaatgggcaagagcagcagaagcgccgaccagtgcagacagagcctgctgctgagccccgccctgaactacaagttccccggcctgagcggcaacgccgacgacaccctgagcagaaagctggacgacctgagcctgagcagacagggcaccagcttcgccagcgaggagttctggaagggcagagtggagcaggagacccccgaggaccccgaggagtgggccgaccacgaggactacatgacccagctgctgctgaagttcggcgacaagagcctgttccagccccagcccaacgagatggacatcagagccagcgagcactggatcagcgacaacatggtgaagagcaagaccgagctgaagcagaacaaccagagcctggccagcaagaagtaccagagcgacatgtactgggcccagagccaggacggcctgggcgacagcgcctacggcagccaccccggccccgccagcagcagaagactgcaggagctggagctggaccacggcgccagcggctacaaccacgacgagacccagtggtacgaggacagcctggagtgcctgagcgacctgaagcccgagcagagcgtgagagacagcatggacagcctggccctgagcaacatcaccggcgccagcgtggacggcgagaacaagcccagacccagcctgtacagcctgcagaacttcgaggagatggagaccgaggactgcgagaagatgagcaacatgggcaccctgaacagcagcatgctgcacagaagcgccgagagcctgaagagcctgagcagcgagctgtgccccgagaagatcctgcccgaggagaagcccgtgcacctgcccgtgctgagaagaagcaagagccagagcagaccccagcaggtgaagttcagcgacgacgtgatcgacaacggcaactacgacatcgagatcagacagccccccatgagcgagagaaccagaagaagagtgtacaacttcgaggagagaggcagcagaagccaccaccacagaagaagaagaagcagaaagagcagaagcgacaacgccctgaacctggtgaccgagagaaagtacagccccaaggacagactgagactgtacacccccgacaactacgagaagttcatccagaacaagagcgccagagagatccaggcctacatccagaacgccgacctgtacggccagtacgcccacgccaccagcgactacggcctgcagaaccccggcatgaacagattcctgggcctgtacggcgaggacgacgacagctggtgcagcagcagcagcagcagcagcgacagcgaggaggagggctacttcctgggccagcccatcccccagcccagaccccagagattcgcctactacaccgacgacctgagcagcccccccagcgccctgcccaccccccagttcggccagagaaccaccaagagcaagaagaagaagggccacaagggcaagaactgcatcatcagctag

SEQ ID NO: 94441 - DNA, 2496 bp, Artificial Sequence; identical to SEQ ID NO: 94440
  Description of Artificial Sequence: Synthetic coding sequence

SEQ ID NO: 94442 - DNA, 2496 bp, Artificial Sequence; identical to SEQ ID NO: 94440
  Description of Artificial Sequence: Synthetic coding sequence

SEQ ID NO: 94443 - DNA, 333 bp, Artificial Sequence
  Description of Artificial Sequence: Synthetic coding sequence
atgcccctggagatggagcccaagatgagcaagctggccttcggctgccagagaagcagcaccagcgacgacgacagcggctgcgccctggaggagtacgcctgggtgccccccggcctgagacccgagcagatccagctgtacttcgcctgcctgcccgaggagaaggtgccctacgtgaacagccccggcgagaagcacagaatcaagcagctgctgtaccagctgcccccccacgacaacgaggtgagatactgccagagcctgagcgaggaggagaagaaggagctgcaggtgttcagcgcccagagaaagaaggaggccctgggctag

SEQ ID NO: 94444 - DNA, 2496 bp, Artificial Sequence; identical to SEQ ID NO: 94440
  Description of Artificial Sequence: Synthetic coding sequence

SEQ ID NO: 94445 - DNA, 360 bp, Artificial Sequence
  Description of Artificial Sequence: Synthetic coding sequence
atgcccctggagatggagcccaagatgagcaagctggccttcggctgccagagaagcagcaccagcgacgacgacagcggctgcgccctggaggagtacgcctgggtgccccccggcctgagacccgagcagatccagctgtacttcgcctgcctgcccgaggagaaggtgccctacgtgaacagccccggcgagaagcacagaatcaagcagctgctgtaccagctgcccccccacgacaacgaggtgagatactgccagagcctgagcgaggaggagaagaaggagctgcaggtgttcagcgcccagagaaagaaggaggccctgggcagaggcaccatcaagctgctgagcagatag

SEQ ID NO: 94446 - DNA, 480 bp, Artificial Sequence
  Description of Artificial Sequence: Synthetic coding sequence
atgcccctggagatggagcccaagatgagcaagctggccttcggctgccagagaagcagcaccagcgacgacgacagcggctgcgccctggaggagtacgcctgggtgccccccggcctgagacccgagcagatccagctgtacttcgcctgcctgcccgaggagaaggtgccctacgtgaacagccccggcgagaagcacagaatcaagcagctgctgtaccagctgcccccccacgacaacgaggtgagatactgccagagcctgagcgaggaggagaagaaggagctgcaggtgttcagcgcccagagaaagaaggaggccctgggcagaggcaccatcaagctgctgagcagagccgtgatgcacgccgtgtgcgagcagtgcggcctgaagatcaacggcggcgaggtggccgtgttcgccagcagagccggccccggcgtgtgctggcaccccagctgcttcgtgtgcttctag

SEQ ID NO: 94447 - DNA, 2496 bp, Artificial Sequence; identical to SEQ ID NO: 94440
  Description of Artificial Sequence: Synthetic coding sequence

SEQ ID NO: 94448 - DNA, 2535 bp, Artificial Sequence
  Description of Artificial Sequence: Synthetic coding sequence
atggtgaccgtgatgcccctggagatggagaagaccatcagcaagctgatgttcgacttccagagaaacagcaccagcgacgacgacagcggctgcgccctggaggagtacgcctgggtgccccccggcctgaagcccgagcaggtgcaccagtactacagctgcctgcccgaggagaaggtgccctacgtgaacagccccggcgagaagctgagaatcaagcagctgctgcaccagctgcccccccacgacaacgaggtgagatactgcaacagcctggacgaggaggagaagagagagctgaagctgttcagcagccagagaaagagagagaacctgggcagaggcaacgtgagacccttccccgtgaccatgaccggcgccatctgcgagcagtgcggcggccagatcaacggcggcgacatcgccgtgttcgccagcagagccggccacggcgtgtgctggcaccccccctgcttcgtgtgcaccgtgtgcaacgagctgctggtggacctgatctacttctaccaggacggcaagatctactgcggcagacaccacgccgagtgcctgaagcccagatgcgccgcctgcgacgagatcatcttcgccgacgagtgcaccgaggccgagggcagacactggcacatgaagcacttctgctgcttcgagtgcgagaccgtgctgggcggccagagatacatcatgaaggagggcagaccctactgctgccactgcttcgagagcctgtacgccgagtactgcgacacctgcgcccagcacatcggcatcgaccagggccagatgacctacgacggccagcactggcacgccaccgagacctgcttctgctgcgcccactgcaagaagagcctgctgggcagacccttcctgcccaagcagggccagatcttctgcagcagagcctgcagcgccggcgaggaccccaacggcagcgacagcagcgacagcgccttccagaacgccagagccaaggagagcagaagaagcgccaagatcggcaagaacaagggcaagaccgaggagcccatgctgaaccagcacagccagctgcaggtgagcagcaacagactgagcgccgacgtggaccccctgagcctgcagatggacatgctgagcctgagcagccagacccccagcctgaacagagaccccatctggagaagcagagaggagccctaccactacggcaacaagatggagcagaaccagacccagagccccctgcagctgctgagccagtgcaacatcagaaccagctacagccccggcggccagggcgccggcgcccagcccgagatgtggggcaagcacttcagcaaccccaagagaagcagcagcctggccatgaccggccacgccggcagcttcatcaaggagtgcagagaggactactaccccggcagactgagaagccaggagagctacagcgacatgagcagccagagcttcagcgagaccagaggcagcatccaggtgcccaagtacgaggaggaggaggaggaggagggcggcctgagcacccagcagtgcagaaccagacaccccatcagcagcctgaagtacaccgaggacatgacccccaccgagcagacccccagaggcagcatggagagcctggccctgagcaacgccaccggcctgagcgccgacggcggcgccaagagacaggagcacctgagcagattcagcatgcccgacctgagcaaggacagcggcatgaacgtgagcgagaagctgagcaacatgggcaccctgaacagcagcatgcagttcagaagcgccgagagcgtgagaagcctgctgagcgcccagcagtaccaggagatggagggcaacctgcaccagctgagcaaccccatcggctacagagacctgcagagccacggcagaatgcaccagagcttcgacttcgacggcggcatggccggcagcaagctgcccggccaggagggcgtgagaatccagcccatgagcgagagaaccagaagaagagccaccagcagagacgacaacagaagattcagaccccacagaagcagaagaagcagaagaagcagaagcgacaacgccctgcacctggccagcgagagagaggccatcagcagactgaaggacagaccccccctgagagccagagaggactacgaccagttcatgagacagagaagcttccaggagagcatgggccacggcagcagaagagacctgtacggccagtgccccagaaccgtgagcgacctggccctgcagaacgccttcggcgacagatggggcccctacttcgccgagtacgactggtgcagcacctgcagcagcagcagcgagagcgacaacgagggctacttcctgggcgagcccatcccccagcccgccagactgagatacgtgaccagcgacgagctgctgcacaagtacagcagctacggcctgcccaagagcagcaccctgggcggcagaggccagctgcacagcagaaagagacagaagagcaagaactgcatcatcagctag

SEQ ID NO: 94449 - DNA, 453 bp, Artificial Sequence
  Description of Artificial Sequence: Synthetic coding sequence
atggtgaccgtgatgcccctggagatggagaagaccatcagcaagctgatgttcgacttccagagaaacagcaccagcgacgacgacagcggctgcgccctggaggagtacgcctgggtgccccccggcctgaagcccgagcaggtgcaccagtactacagctgcctgcccgaggagaaggtgccctacgtgaacagccccggcgagaagctgagaatcaagcagctgctgcaccagctgcccccccacgacaacgaggtgagatactgcaacagcctggacgaggaggagaagagagagctgaagctgttcagcagccagagaaagagagagaacctgggcagaggcaacgtgagacccttccccgtgaccatgaccggcgccatctgcgagcagtgcggcggccagatcaacggcggcgacatcgccgtgttcgccagcagagccggctag

SEQ ID NO: 94450 - DNA, 1263 bp, Artificial Sequence
  Description of Artificial Sequence: Synthetic coding sequence
atggagaccttcgaccccaccgagctgcccgagctgctgaagctgtactacagaagactgttcccctacagccagtactacagatggctgaactacggcggcgtgatcaagaactacttccagcacagagagttcagcttcaccctgaaggacgacatctacatcagataccagagcttcaacaaccagagcgacctggagaaggagatgcagaagatgaacccctacaagatcgacatcggcgccgtgtacagccacagacccaaccagcacaacaccgtgaagctgggcgccttccaggcccaggagaaggagctggtgttcgacatcgacatgaccgactacgacgacgtgagaagatgctgcagcagcgccgacatctgccccaagtgctggaccctgatgaccatggccatcagaatcatcgacagagccctgaaggaggacttcggcttcaagcacagactgtgggtgtacagcggcagaagaggcgtgcactgctgggtgtgcgacgagagcgtgagaaagctgagcagcgccgtgagaagcggcatcgtggagtacctgagcctggtgaagggcggccaggacgtgaagaagaaggtgcacctgagcgagaagatccaccccttcatcagaaagagcatcaacatcatcaagaagtacttcgaggagtacgccctggtgaaccaggacatcctggagaacaaggagagctgggacaagatcctggccctggtgcccgagaccatccacgacgagctgcagcagagcttccagaagagccacaacagcctgcagagatgggagcacctgaagaaggtggccagcagataccagaacaacatcaagaacgacaagtacggcccctggctggagtgggagatcatgctgcagtactgcttccccagactggacatcaacgtgagcaagggcatcaaccacctgctgaagagccccttcagcgtgcaccccaagaccggcagaatcagcgtgcccatcgacctgcagaaggtggaccagttcgaccccttcaccgtgcccaccatcagcttcatctgcagagagctggacgccatcagcaccaacgaggaggagaaggaggagaacgaggccgagagcgacgtgaagcacagaaccagagactacaagaagaccagcctggccccctacgtgaaggtgttcgagcacttcctggagaacctggacaagagcagaaagggcgagctgctgaagaagagcgacctgcagaaggacttctag

SEQ ID NO: 94451 - DNA, 1284 bp, Artificial Sequence
  Description of Artificial Sequence: Synthetic coding sequence
atggagaccttcgaccccaccgagctgcccgagctgctgaagctgtactacagaagactgttcccctacagccagtactacagatggctgaactacggcggcgtgatcaagaactacttccagcacagagagttcagcttcaccctgaaggacgacatctacatcagataccagagcttcaacaaccagagcgacctggagaaggagatgcagaagatgaacccctacaagatcgacatcggcgccgtgtacagccacagacccaaccagcacaacaccgtgaagctgggcgccttccaggcccaggagaaggagctggtgttcgacatcgacatgaccgactacgacgacgtgagaagatgctgcagcagcgccgacatctgccccaagtgctggaccctgatgaccatggccatcagaatcatcgacagagccctgaagggcaaggacttcggcttcaagcacagactgtgggtgtacagcggcagaagaggcgtgcactgctgggtgtgcgacgagagcgtgagaaagctgagcagcgccgtgagaagcggcatcgtggagtacctgagcctggtgaagggcggccaggacgtgaagaagaaggtgcacctgagcgagaagatccaccccttcatcagaaagagcatcaacatcatcaagaagtacttcgaggagtacgccctggtgaaccaggacatcctggagaacaaggagagctgggacaagatcctggccctgatgggcctgttcctgaacgaccccagccccatccacgacgagctgcagcagagcttccagaagagccacaacagcctgcagagatgggagcacctgaagaaggtggccagcagataccagaacaacatcaagaacgacaagtacggcccctggctggagtgggagatcatgctgcagtactgcttccccagactggacatcaacgtgagcaagggcatcaaccacctgctgaagagccccttcagcgtgcaccccaagaccggcagaatcagcgtgcccatcgacctgcagaaggtggaccagttcgaccccttcaccgtgcccaccatcagcttcatctgcagagagctggacgccatcagcaccaacgaggaggagaaggaggagaacgaggccgagagcgacgtgaagcacagaaccagagactacaagaagaccagcctggccccctacgtgaaggtgttcgagcacttcctggagaacctggacaagagcagaaagggcgagctgctgaagaagagcgacctgcagaaggacttctag

SEQ ID NO: 94452 - DNA, 762 bp, Artificial Sequence
  Description of Artificial Sequence: Synthetic coding sequence
atggccaacctgggctgctggatgctggtgctgttcgtggccacctggagcgacctgggcctgtgcaagaagagacccaagcccggcggctggaacaccggcggcagcagataccccggccagggcagccccggcggcaacagataccccccccagggcggcggcggctggggccagccccacggcggcggctggggccagccccacggcggcggctggggccagccccacggcggcggctggggccagccccacggcggcggctggggccagggcggcggcacccacagccagtggaacaagcccagcaagcccaagaccaacatgaagcacatggccggcgccgccgccgccggcgccgtggtgggcggcctgggcggctacatgctgggcagcgccatgagcagacccatcatccacttcggcagcgactacgaggacagatactacagagagaacatgcacagataccccaaccaggtgtactacagacccatggacgagtacagcaaccagaacaacttcgtgcacgactgcgtgaacatcaccatcaagcagcacaccgtgaccaccaccaccaagggcgagaacttcaccgagaccgacgtgaagatgatggagagagtggtggagcagatgtgcatcacccagtacgagagagagagccaggcctactaccagagaggcagcagcatggtgctgttcagcagcccccccgtgatcctgctgatcagcttcctgatcttcctgatcgtgggctag

SEQ ID NO: 94453 - DNA, 750 bp, Artificial Sequence
  Description of Artificial Sequence: Synthetic coding sequence
atggccaacctgggctgctggatgctggtgctgttcgtggccacctggagcgacctgggcctgtgcaagaagagacccaagcccggcggctggaacaccggcggcagcagataccccggccagggcagccccggcggcaacagataccccccccagggcggcggcggctggggccagccccacggcggcggctggggccagccccacggcggcggctggggccagccccacggcggcggctggggccagccccacggcggcggctggggccagggcggcggcacccacagccagtggaacaagcccagcaagcccaagaccaacatgaagcacatggccggcgccgccgccgccggcgccgtggtgggcggcctgggcggctacatgctgggcagcgccatgagcagacccatcatccacttcggcagcgactacgaggacagatactacagagagaacatgcacagataccccaaccaggtgtactacagacccatggacgagtacagcaaccagaacaacttcgtgcacgactgcgtgaacatcaccatcaagcagcacaccgtgaccaccaccaccaagggcgagaacttcaccgagaccgacgtgaagatgatggagagagtggtggagcagatgtgcatcacccagtacgagagagagagccaggcctactaccagagaggcagcagcatggtgctgttcagcagcccccccgtgatcctgctgatcagcttcctgatcttctag

SEQ ID NO: 94454 - DNA, 762 bp, Artificial Sequence; identical to SEQ ID NO: 94452
  Description of Artificial Sequence: Synthetic coding sequence

SEQ ID NO: 94455 - DNA, 579 bp, Artificial Sequence
  Description of Artificial Sequence: Synthetic coding sequence
atggagcactggggccagccccacggcggcggctggggccagccccacggcggcggctggggccagccccacggcggcggctggggccagggcggcggcacccacagccagtggaacaagcccagcaagcccaagaccaacatgaagcacatggccggcgccgccgccgccggcgccgtggtgggcggcctgggcggctacatgctgggcagcgccatgagcagacccatcatccacttcggcagcgactacgaggacagatactacagagagaacatgcacagataccccaaccaggtgtactacagacccatggacgagtacagcaaccagaacaacttcgtgcacgactgcgtgaacatcaccatcaagcagcacaccgtgaccaccaccaccaagggcgagaacttcaccgagaccgacgtgaagatgatggagagagtggtggagcagatgtgcatcacccagtacgagagagagagccaggcctactaccagagaggcagcagcatggtgctgttcagcagcccccccgtgatcctgctgatcagcttcctgatcttcctgatcgtgggctag

SEQ ID NO: 94456 - DNA, 654 bp, Artificial Sequence
  Description of Artificial Sequence: Synthetic coding sequence
atggccaacctgggctgctggatgctggtgctgttcgtggccacctggagcgacctgggcctgtgcaagaagagacccaagcccggcggctggaacaccggcggcagcagataccccggccagggcagccccggcggcaacagataccccccccagggcggcggcggctggggccagccccacggcggcggctggggccagccccacggcggcggctggggccagccccacggcggcggctggggccagccccacggcggcggctggggccagggcggcggcacccacagccagtggaacaagcccagcaagcccaagaccaacatgaagcacatggccggcgccgccgccgccggcgccgtggtgggcggcctgggcggctacatgctgggcagcgccatgagcagacccatcatccacttcggcagcgactacgaggacagatactacagagagaacatgcacagataccccaaccaggtgtactacagacccatggacgagtacagcaaccagaacaacttcgtgcacgactgcgtgaacatcaccatcaagcagcacaccgtgaccaccaccaccaagggcgagaacttcaccgagaccgacgtgaagatgatggagagagtggtggagcagatgtgcatcacccagtag

SEQ ID NO: 94457 - DNA, 531 bp, Artificial Sequence
  Description of Artificial Sequence: Synthetic coding sequence
atgagaaagcacctgagctggtggtggctggccaccgtgtgcatgctgctgttcagccacctgagcgccgtgcagaccagaggcatcaagcacagaatcaagtggaacagaaaggccctgcccagcaccgcccagatcaccgaggcccaggtggccgagaacagacccggcgccttcatcaagcagggcagaaagctggacatcgacttcggcgccgagggcaacagatactacgaggccaactactggcagttccccgacggcatccactacaacggctgcagcgaggccaacgtgaccaaggaggccttcgtgaccggctgcatcaacgccacccaggccgccaaccagggcgagttccagaagcccgacaacaagctgcaccagcaggtgctgtggagactggtgcaggagctgtgcagcctgaagcactgcgagttctggctggagagaggcgccggcctgagagtgaccatgcaccagcccgtgctgctgtgcctgctggccctgatctggctgaccgtgaagtag

SEQ ID NO: 94458 - DNA, 1023 bp, Artificial Sequence
  Description of Artificial Sequence: Synthetic coding sequence
atggccaccggcggctacagaaccagcagcggcctgggcggcagcaccaccgacttcctggaggagtggaaggccaagagagagaagatgagagccaagcagaacccccccggccccgccccccccggcggcggcagcagcgacgccgccggcaagccccccgccggcgccctgggcacccccgccgccgccgccgccaacgagctgaacaacaacctgcccggcggcgcccccgccgcccccgccgtgcccggccccggcggcgtgaactgcgccgtgggcagcgccatgctgaccagagccgcccccggccccagaagaagcgaggacgagccccccgccgccagcgccagcgccgccccccccccccagagagacgaggaggagcccgacggcgtgcccgagaagggcaagagcagcggccccagcgccagaaagggcaagggccagatcgagaagagaaagctgagagagaagagaagaagcaccggcgtggtgaacatccccgccgccgagtgcctggacgagtacgaggacgacgaggccggccagaaggagagaaagagagaggacgccatcacccagcagaacaccatccagaacgaggccgtgaacctgctggaccccggcagcagctacctgctgcaggagccccccagaaccgtgagcggcagatacaagagcaccaccagcgtgagcgaggaggacgtgagcagcagatacagcagaaccgacagaagcggcttccccagatacaacagagacgccaacgtgagcggcaccctggtgagcagcagcaccctggagaagaagatcgaggacctggagaaggaggtggtgagagagagacaggagaacctgagactggtgagactgatgcaggacaaggaggagatgatcggcaagctgaaggaggagatcgacctgctgaacagagacctggacgacatcgaggacgagaacgagcagctgaagcaggagaacaagaccctgctgaaggtggtgggccagctgaccagatag

SEQ ID NO: 94459 - DNA, 231 bp, Artificial Sequence
  Description of Artificial Sequence: Synthetic coding sequence
atggccaccggcggctacagaaccagcagcggcctgggcggcagcaccaccgacttcctggaggagtggaaggccaagagagagaagatgagagccaagcagaacccccccggccccgccccccccggcggcggcagcagcgacgccgccggcaagccccccgccggcgccctgggcacccccgccgccgccgccgccaacgagctgaacaacaacctgcccggcggctag

SEQ ID NO: 94460 - DNA, 195 bp, Artificial Sequence
  Description of Artificial Sequence: Synthetic coding sequence
atggccaccggcggctacagaaccagcagcggcctgggcggcagcaccaccgacttcctggaggagtggaaggccaagagagagaagatgagagccaagcagaacccccccggccccgccccccccggcggcggcagcagcgacgccgccggcaagccccccgccggcgccctgggcacccccgccgccgcctag

SEQ ID NO: 94461 - DNA, 663 bp, Artificial Sequence
  Description of Artificial Sequence: Synthetic coding sequence
atgaagagcgtgatctaccacgccctgagccagaaggaggccaacgacagcgacgtgcagcccagcggcgcccagagagccgaggccttcgtgagagccttcctgaagagaagcacccccagaatgagcccccaggccagagaggaccagctgcagagaaaggccgtggtgctggagtacttcaccagacacaagagaaaggagaagaagaagaaggccaagggcctgagcgccagacagagaagagagctgagactgttcgacatcaagcccgagcagcagagatacagcctgttcctgcccctgcacgagctgtggaagcagtacatcagagacctgtgcagcggcctgaagcccgacacccagccccagatgatccaggccaagctgctgaaggccgacctgcacggcgccatcatcagcgtgaccaagagcaagtgccccagctacgtgggcatcaccggcatcctgctgcaggagaccaagcacatcttcaagatcatcaccaaggaggacagactgaaggtgatccccaagctgaactgcgtgttcaccgtggagaccgacggcttcatcagctacatctacggcagcaagttccagctgagaagcagcgagagaagcgccaagaagttcaaggccaagggcaccatcgacctgtag

SEQ ID NO: 94462 - DNA, 1695 bp, Artificial Sequence
  Description of Artificial Sequence: Synthetic coding sequence
atgagcagccacggcaacagcctgttcctgagagagagcggccagagactgggcagagtgggctggctgcagagactgcaggagagcctgcagcagagagccctgagaaccagactgagactgcagaccatgaccctggagcacgtgctgagattcctgagaagaaacgccttcatcctgctgaccgtgagcgccgtggtgatcggcgtgagcctggccttcgccctgagaccctaccagctgacctacagacagatcaagtacttcagcttccccggcgagctgctgatgagaatgctgcagatgctggtgctgcccctgatcgtgagcagcctggtgaccggcatggccagcctggacaacaaggccaccggcagaatgggcatgagagccgccgtgtactacatggtgaccaccatcatcgccgtgttcatcggcatcctgatggtgaccatcatccaccccggcaagggcagcaaggagggcctgcacagagagggcagaatcgagaccatccccaccgccgacgccttcatggacctgatcagaaacatgttcccccccaacctggtggaggcctgcttcaagcagttcaagacccagtacagcaccagagtggtgaccagaaccatggtgagaaccgagaacggcagcgagcccggcgccagcatgcccccccccttcagcgtggagaacggcaccagcttcctggagaacgtgaccagagccctgggcaccctgcaggagatgctgagcttcgaggagaccgtgcccgtgcccggcagcgccaacggcatcaacgccctgggcctggtggtgttcagcgtggccttcggcctggtgatcggcggcatgaagcacaagggcagagtgctgagagacttcttcgacagcctgaacgaggccatcatgagactggtgggcatcatcatctggtacgcccccgtgggcatcctgttcctgatcgccggcaagatcctggagatggaggacatggccgtgctgggcggccagctgggcatgtacaccctgaccgtgatcgtgggcctgttcctgcacgccggcatcgtgctgcccctgatctacttcctggtgacccacagaaaccccttccccttcatcggcggcatgctgcaggccctgatcaccgccatgggcaccagcagcagcagcgccaccctgcccatcaccttcagatgcctggaggagggcctgggcgtggacagaagaatcaccagattcgtgctgcccgtgggcgccaccgtgaacatggacggcaccgccctgtacgaggccctggccgccatcttcatcgcccaggtgaacaactacgagctgaacctgggccagatcaccaccatcagcatcaccgccaccgccgccagcgtgggcgccgccggcatcccccaggccggcctggtgaccatggtgatcgtgctgaccagcgtgggcctgcccaccgaggacatcaccctgatcatcgccgtggactggttcctggacagactgagaaccatgaccaacgtgctgggcgacagcatcggcgccgccgtgatcgagcacctgagccagagagagctggagctgcaggaggccgagctgaccctgcccagcctgggcaagccctacaagagcctgatggcccaggagaagggcgccagcagaggcagaggcggcaacgagagcgccatgtag

SEQ ID NO: 94463 - DNA, 420 bp, Artificial Sequence
  Description of Artificial Sequence: Synthetic coding sequence
atgcactgcctgagaaagagaagaatgacccccatgagcagatacagcctgttcctgcccctgcacgagctgtggaagcagtacatcagagacctgtgcagcggcctgaagcccgacacccagccccagatgatccaggccaagctgctgaaggccgacctgcacggcgccatcatcagcgtgaccaagagcaagtgccccagctacgtgggcatcaccggcatcctgctgcaggagaccaagcacatcttcaagatcatcaccaaggaggacagactgaaggtgatccccaagctgaactgcgtgttcaccgtggagaccgacggcttcatcagctacatctacggcagcaagttccagctgagaagcagcgagagaagcgccaagaagttcaaggccaagggcaccatcgacctgtag

SEQ ID NO: 94464 - DNA, 342 bp, Artificial Sequence
  Description of Artificial Sequence: Synthetic coding sequence
atggtgagattcaagcacagatacctgctgtgcgagctggtgagcgacgaccccagatgcagactgagcctggacgacagagtgctgagcagcctggtgagagacaccatcgccagagtgcacggcaccttcggcgccgccgcctgcagcatcggcttcgccggcaccatcagaacctgccagaagttcctgatccagtacaacagaagacagctgctgatcctgctgcagaactgcaccgacgagggcgagagagaggccatccagaagagcgtgaccagaagctgcctgctggaggaggaggaggagagcggcgaggaggccgccgaggccatggagtag

SEQ ID NO: 94465 - DNA, 492 bp, Artificial Sequence
  Description of Artificial Sequence: Synthetic coding sequence
atggtgagattcaagcacagatacctgctgtgcgagctggtgagcgacgaccccagatgcagactgagcctggacgacagagtgctgagcagcctggtgagagacaccatcgccagagtgcacggcaccttcggcgccgccgcctgcagcatcggcttcgccgtgagatacctgaacgcctacaccggcatcgtgctgctgagatgcagaaaggagttctaccagctggtgtggagcgccctgcccttcatcacctacctggagaacaagggccacagatacccctgcttcttcaacaccctgcacgtgggcggcaccatcagaacctgccagaagttcctgatccagtacaacagaagacagctgctgatcctgctgcagaactgcaccgacgagggcgagagagaggccatccagaagagcgtgaccagaagctgcctgctggaggaggaggaggagagcggcgaggaggccgccgaggccatggagtag

SEQ ID NO: 94466 - DNA, 423 bp, Artificial Sequence
  Description of Artificial Sequence: Synthetic coding sequence
atggccgagaacagagagcccagaggcgccgtggaggccgagctggaccccgtggagtacaccctgagaaagagactgcccagcagactgcccagaagacccaacgacatctacgtgaacatgaagaccgacttcaaggcccagctggccagatgccagaagctgctggacggcggcgccagaggccagaacgcctgcagcgagatctacatccacggcctgggcctggccatcaacagagccatcaacatcgccctgcagctgcaggccggcagcttcggcagcctgcaggtggccgccaacaccagcaccgtggagctggtggacgagctggagcccgagaccgacaccagagagcccctgaccagaatcagaaacaacagcgccatccacatcagagtgttcagagtgacccccaagtag

SEQ ID NO: 94467 - DNA, 414 bp, Artificial Sequence
  Description of Artificial Sequence: Synthetic coding sequence
atggccgagaacagagagcccagaggcgccgtggaggccgagctggaccccgtggagtacaccctgagaaagagactgcccagcagactgcccagaagacccaacgacatctacgtgaacatgaagaccgacttcaaggcccagctggccagatgccagaagctgctggacggcggcgccagaggccagaacgcctgcagcgagatctacatccacggcctgggcctggccatcaacagagccatcaacatcgccctgcagctgcaggccggcagcttcggcagcctgcaggtggccgccaacaccagcaccgtggagctggtggacgagctggagcccgagaccgacaccagagagcccctgaccagaatcagaaacaacagcgccatccacatcagagtgttcagagtgtag

SEQ ID NO: 94468 - DNA, 708 bp, Artificial Sequence
  Description of Artificial Sequence: Synthetic coding sequence
atgagaagaggcgccccccaggaccaggagctggtgggccccggcccccccggcagaggcagcagaggcgcccccccccccctgggccccgtggtgcccgtgctggtgttcccccccgacctggtgttcagagccgaccagagaagcggccccagacagctgctgaccctgtacaaccccaccggcaccgccctgagattcagagtgctgtgcaccgcccccgccaagtacaccgtgttcgacgccgagggctacgtgaagccccagagctgcatcgacatcgtgatcagacacgtggcccccatccccagccactacgacgtgcaggacagattcagaatcgagctgagcgaggagggcgccgagggcagagtggtgggcagaaaggacatcaccagcatcctgagagcccccgcctaccccctggagctgcagggccagcccgaccccgcccccagacccggcccccccgccggcacccccccccccaccgccagacacttccaggagcaccccagacagcagctggccaccagcagcttcctgctgttcctgctgaccggcatcgtgagcgtggccttcctgctgctgcccctgcccgacgagctgggcagccagctgccccaggtgctgcacgtgagcctgggccagaagctggtggccgcctacgtgctgggcctgctgaccatggtgttcctgagaacctag

SEQ ID NO: 94469 - DNA, 1248 bp, Artificial Sequence
  Description of Artificial Sequence: Synthetic coding sequence
atgagaggcgccaacgcctgggcccccctgtgcctgctgctggccgccgccacccagctgagcagacagcagagccccgagagacccgtgttcacctgcggcggcatcctgaccggcgagagcggcttcatcggcagcgagggcttccccggcgtgtacccccccaacagcaagtgcacctggaagatcaccgtgcccgagggcaaggtggtggtgctgaacttcagattcatcgacctggagagcgacaacctgtgcagatacgacttcgtggacgtgtacaacggccacgccaacggccagagaatcggcagattctgcggcaccttcagacccggcgccctggtgagcagcggcaacaagatgatggtgcagatgatcagcgacgccaacaccgccggcaacggcttcatggccatgttcagcgccgccgagcccaacgagagaggcgaccagtactgcggcggcctgctggacagacccagcggcagcttcaagacccccaactggcccgacagagactaccccgccggcgtgacctgcgtgtggcacatcgtggcccccaagaaccagctgatcgagctgaagttcgagaagttcgacgtggagagagacaactactgcagatacgactacgtggccgtgttcaacggcggcgaggtgaacgacgccagaagaatcggcaagtactgcggcgacagcccccccgcccccatcgtgagcgagagaaacgagctgctgatccagttcctgagcgacctgagcctgaccgccgacggcttcatcggccactacatcttcagacccaagaagctgcccaccaccaccgagcagcccgtgaccaccaccttccccgtgaccaccggcctgaagcccaccgtggccctgtgccagcagaagtgcagaagaaccggcaccctggagggcaactactgcagcagcgacttcgtgctggccggcaccgtgatcaccaccatcaccagagacggcagcctgcacgccaccgtgagcatcatcaacatctacaaggagggcaacctggccatccagcaggccggcaagaacatgagcgccagactgaccgtggtgtgcaagcagtgccccctgctgagaagaggcctgaactacatcatcatgggccaggtgggcgaggacggcagaggcaagatcatgcccaacagcttcatcatgatgttcaagaccaagaaccagaagctgctggacgccctgaagaacaagcagtgctag

SEQ ID NO: 94470 - DNA, 2184 bp, Artificial Sequence
  Description of Artificial Sequence: Synthetic coding sequence
atgagacccctgctgctgctggccctgctgggctggctgctgctggccgaggccaagggcgacgccaagcccgaggacaacctgctggtgctgaccgtggccaccaaggagaccgagggcttcagaagattcaagagaagcgcccagttcttcaactacaagatccaggccctgggcctgggcgaggactggaacgtggagaagggcaccagcgccggcggcggccagaaggtgagactgctgaagaaggccctggagaagcacgccgacaaggaggacctggtgatcctgttcgccgacagctacgacgtgctgttcgccagcggccccagagagctgctgaagaagttcagacaggccagaagccaggtggtgttcagcgccgaggagctgatctaccccgacagaagactggagaccaagtaccccgtggtgagcgacggcaagagattcctgggcagcggcggcttcatcggctacgcccccaacctgagcaagctggtggccgagtgggagggccaggacagcgacagcgaccagctgttctacaccaagatcttcctggaccccgagaagagagagcagatcaacatcaccctggaccacagatgcagaatcttccagaacctggacggcgccctggacgaggtggtgctgaagttcgagatgggccacgtgagagccagaaacctggcctacgacaccctgcccgtgctgatccacggcaacggccccaccaagctgcagctgaactacctgggcaactacatccccagattctggaccttcgagaccggctgcaccgtgtgcgacgagggcctgagaagcctgaagggcatcggcgacgaggccctgcccaccgtgctggtgggcgtgttcatcgagcagcccacccccttcgtgagcctgttcttccagagactgctgagactgcactacccccagaagcacatgagactgttcatccacaaccacgagcagcaccacaaggcccaggtggaggagttcctggcccagcacggcagcgagtaccagagcgtgaagctggtgggccccgaggtgagaatggccaacgccgacgccagaaacatgggcgccgacctgtgcagacaggacagaagctgcacctactacttcagcgtggacgccgacgtggccctgaccgagcccaacagcctgagactgctgatccagcagaacaagaacgtgatcgcccccctgatgaccagacacggcagactgtggagcaacttctggggcgccctgagcgccgacggctactacgccagaagcgaggactacgtggacatcgtgcagggcagaagagtgggcgtgtggaacgtgccctacatcagcaacatctacctgatcaagggcagcgccctgagaggcgagctgcagagcagcgacctgttccaccacagcaagctggaccccgacatggccttctgcgccaacatcagacagcaggacgtgttcatgttcctgaccaacagacacaccctgggccacctgctgagcctggacagctacagaaccacccacctgcacaacgacctgtgggaggtgttcagcaaccccgaggactggaaggagaagtacatccaccagaactacaccaaggccctggccggcaagctggtggagaccccctgccccgacgtgtactggttccccatcttcaccgaggtggcctgcgacgagctggtggaggagatggagcacttcggccagtggagcctgggcaacaacaaggacaacagaatccagggcggctacgagaacgtgcccaccatcgacatccacatgaaccagatcggcttcgagagagagtggcacaagttcctgctggagtacatcgcccccatgaccgagaagctgtaccccggctactacaccagagcccagttcgacctggccttcgtggtgagatacaagcccgacgagcagcccagcctgatgccccaccacgacgccagcaccttcaccatcaacatcgccctgaacagagtgggcgtggactacgagggcggcggctgcagattcctgagatacaactgcagcatcagagcccccagaaagggctggaccctgatgcaccccggcagactgacccactaccacgagggcctgcccaccaccagaggcaccagatacatcgccgtgagcttcgtggacccctag

SEQ ID NO: 94471 - DNA, 600 bp, Artificial Sequence
  Description of Artificial Sequence: Synthetic coding sequence
atgagacccctgctgctgctggccctgctgggctggctgctgctggccgaggccaagggcgacgccaagcccgaggacaacctgctggtgctgaccgtggccaccaaggagaccgagggcttcagaagattcaagagaagcgcccagttcttcaactacaagatccaggccctgggcctgggcgaggactggaacgtggagaagggcaccagcgccggcggcggccagaaggtgagactgctgaagaaggccctggagaagcacgccgacaaggaggacctggtgatcctgttcgccgacagctacgacgtgctgttcgccagcggccccagagagctgctgaagaagttcagacaggccagaagccaggtggtgttcagcgccgaggagctgatctaccccgacagaagactggagaccaagtaccccgtggtgagcgacggcaagagattcctgggcagcggcggcttcatcggctacgcccccaacctgagcaagctggtggccgagtgggagggccaggacagcgacagcgaccagctgttctacaccaagatcttcctggaccccgagaagagagtgagcagactgcacagctag

SEQ ID NO: 94472 - DNA, 2325 bp, Artificial Sequence
  Description of Artificial Sequence: Synthetic coding sequence
atgagacccctgctgctgctggccctgctgggctggctgctgctggccgaggccaagggcgacgccaagcccgaggccccctgctgccaggagggcctgagagccggcggcagcggcagcctgcacctgggcagagacttcaccgtgctggccggcgccagaggcagccccagccccagcgtgagcagcatccccagattctggatccccggcagcgacaacctgctggtgctgaccgtggccaccaaggagaccgagggcttcagaagattcaagagaagcgcccagttcttcaactacaagatccaggccctgggcctgggcgaggactggaacgtggagaagggcaccagcgccggcggcggccagaaggtgagactgctgaagaaggccctggagaagcacgccgacaaggaggacctggtgatcctgttcgccgacagctacgacgtgctgttcgccagcggccccagagagctgctgaagaagttcagacaggccagaagccaggtggtgttcagcgccgaggagctgatctaccccgacagaagactggagaccaagtaccccgtggtgagcgacggcaagagattcctgggcagcggcggcttcatcggctacgcccccaacctgagcaagctggtggccgagtgggagggccaggacagcgacagcgaccagctgttctacaccaagatcttcctggaccccgagaagagagagcagatcaacatcaccctggaccacagatgcagaatcttccagaacctggacggcgccctggacgaggtggtgctgaagttcgagatgggccacgtgagagccagaaacctggcctacgacaccctgcccgtgctgatccacggcaacggccccaccaagctgcagctgaactacctgggcaactacatccccagattctggaccttcgagaccggctgcaccgtgtgcgacgagggcctgagaagcctgaagggcatcggcgacgaggccctgcccaccgtgctggtgggcgtgttcatcgagcagcccacccccttcgtgagcctgttcttccagagactgctgagactgcactacccccagaagcacatgagactgttcatccacaaccacgagcagcaccacaaggcccaggtggaggagttcctggcccagcacggcagcgagtaccagagcgtgaagctggtgggccccgaggtgagaatggccaacgccgacgccagaaacatgggcgccgacctgtgcagacaggacagaagctgcacctactacttcagcgtggacgccgacgtggccctgaccgagcccaacagcctgagactgctgatccagcagaacaagaacgtgatcgcccccctgatgaccagacacggcagactgtggagcaacttctggggcgccctgagcgccgacggctactacgccagaagcgaggactacgtggacatcgtgcagggcagaagagtgggcgtgtggaacgtgccctacatcagcaacatctacctgatcaagggcagcgccctgagaggcgagctgcagagcagcgacctgttccaccacagcaagctggaccccgacatggccttctgcgccaacatcagacagcaggacgtgttcatgttcctgaccaacagacacaccctgggccacctgctgagcctggacagctacagaaccacccacctgcacaacgacctgtgggaggtgttcagcaaccccgaggactggaaggagaagtacatccaccagaactacaccaaggccctggccggcaagctggtggagaccccctgccccgacgtgtactggttccccatcttcaccgaggtggcctgcgacgagctggtggaggagatggagcacttcggccagtggagcctgggcaacaacaaggacaacagaatccagggcggctacgagaacgtgcccaccatcgacatccacatgaaccagatcggcttcgagagagagtggcacaagttcctgctggagtacatcgcccccatgaccgagaagctgtaccccggctactacaccagagcccagttcgacctggccttcgtggtgagatacaagcccgacgagcagcccagcctgatgccccaccacgacgccagcaccttcaccatcaacatcgccctgaacagagtgggcgtggactacgagggcggcggctgcagattcctgagatacaactgcagcatcagagcccccagaaagggctggaccctgatgcaccccggcagactgacccactaccacgagggcctgcccaccaccagaggcaccagatacatcgccgtgagcttcgtggacccctag

SEQ ID NO: 94473 - DNA, 1176 bp, Artificial Sequence
  Description of Artificial Sequence: Synthetic coding sequence
atgagacccctgctgctgctggccctgctgggctggctgctgctggccgaggccaagggcgacgccaagcccgaggacaacctgctggtgctgaccgtggccaccaaggagaccgagggcttcagaagattcaagagaagcgcccagttcttcaactacaagatccaggccctgggcctgggcgaggactggaacgtggagaagggcaccagcgccggcggcggccagaaggtgagactgctgaagaaggccctggagaagcacgccgacaaggaggacctggtgatcctgttcgccgacagctacgacgtgctgttcgccagcggccccagagagctgctgaagaagttcagacaggccagaagccaggtggtgttcagcgccgaggagctgatctaccccgacagaagactggagaccaagtaccccgtggtgagcgacggcaagagattcctgctggaggacgtgttcatgttcctgaccaacagacacaccctgggccacctgctgagcctggacagctacagaaccacccacctgcacaacgacctgtgggaggtgttcagcaaccccgaggactggaaggagaagtacatccaccagaactacaccaaggccctggccggcaagctggtggagaccccctgccccgacgtgtactggttccccatcttcaccgaggtggcctgcgacgagctggtggaggagatggagcacttcggccagtggagcctgggcaacaacaaggacaacagaatccagggcggctacgagaacgtgcccaccatcgacatccacatgaaccagatcggcttcgagagagagtggcacaagttcctgctggagtacatcgcccccatgaccgagaagctgtaccccggctactacaccagagcccagttcgacctggccttcgtggtgagatacaagcccgacgagcagcccagcctgatgccccaccacgacgccagcaccttcaccatcaacatcgccctgaacagagtgggcgtggactacgagggcggcggctgcagattcctgagatacaactgcagcatcagagcccccagaaagggctggaccctgatgcaccccggcagactgacccactaccacgagggcctgcccaccaccagaggcaccagatacatcgccgtgagcttcgtggacccctag

SEQ ID NO: 94474 - DNA, 852 bp, Artificial Sequence
  Description of Artificial Sequence: Synthetic coding sequence
atgagacccctgctgctgctggccctgctgggctggctgctgctggccgaggccaagggcgacgccaagcccgaggacaacctgctggtgctgaccgtggccaccaaggagaccgagggcttcagaagattcaagagaagcgcccagttcttcaactacaagatccaggccctgggcctgggcgaggactggaacgtggagaagggcaccagcgccggcggcggccagaaggtgagactgctgaagaaggccctggagaagcacgccgacaaggaggacctggtgatcctgttcgccgacagctacgacgtgctgttcgccagcggccccagagagctgctgaagaagttcagacaggccagaagccaggtggtgttcagcgccgaggagctgatctaccccgacagaagactggagaccaagtaccccgtggtgagcgacggcaagagattcctgggcagcggcggcttcatcggctacgcccccaacctgagcaagctggtggccgagtgggagggccaggacagcgacagcgaccagctgttctacaccaagatcttcctggaccccgagaagagagagcagatcaacatcaccctggaccacagatgcagaatcttccagaacctggacggcgccctggtgagcccctggggccagggccacctgcccggcgcctgctacgagctgaccgccagcgtgctgaccagcgagctgagcgtgatgcccagcttccccgccgtggtgctgcagctgaactacctgggcaactacatccccagattctggaccttcgagaccggctgcaccgtgtgcgacgagggcctgagaagcctgaagggcatcggctag

SEQ ID NO: 94475 - DNA, 678 bp, Artificial Sequence
  Description of Artificial Sequence: Synthetic coding sequence
atgagacccctgctgctgctggccctgctgggctggctgctgctggccgaggccaagggcgacgccaagcccgaggccccctgctgccaggagggcctgagagccggcggcagcggcagcctgcacctgggcagagacttcaccgtgctggccggcgccagaggcagccccagccccagcgtgagcagcatccccagattctggatccccggcagcgacaacctgctggtgctgaccgtggccaccaaggagaccgagggcttcagaagattcaagagaagcgcccagttcttcaactacaagatccaggccctgggcctgggcgaggactggaacgtggagaagggcaccagcgccggcggcggccagaaggtgagactgctgaagaaggccctggagaagcacgccgacaaggaggacctggtgatcctgttcgccgacagctacgacgtgctgttcgccagcggccccagagagctgctgaagaagttcagacaggccagaagccaggtggtgttcagcgccgaggagctgatctaccccgacagaagactggagaccaagtaccccgtggtgagcgacggcaagagattcctgggcagcggcggcttcatcggctacgcccccaacctgagcaagctggtggccgagtgggagggccaggacagcgacagctag

SEQ ID NO: 94476 - DNA, 2277 bp, Artificial Sequence
  Description of Artificial Sequence: Synthetic coding sequence
atgggcggctgcaccgtgaagccccagctgctgctgctggccctggtgctgcacccctggaacccctgcctgggcgccgacagcgagaagcccagcagcatccccaccgacaagctgctggtgatcaccgtggccaccaaggagagcgacggcttccacagattcatgcagagcgccaagtacttcaactacaccgtgaaggtgctgggccagggcgaggagtggagaggcggcgacggcatcaacagcatcggcggcggccagaaggtgagactgatgaaggaggtgatggagcactacgccgaccaggacgacctggtggtgatgttcaccgagtgcttcgacgtgatcttcgccggcggccccgaggaggtgctgaagaagttccagaaggccaaccacaaggtggtgttcgccgccgacggcatcctgtggcccgacaagagactggccgacaagtaccccgtggtgcacatcggcaagagatacctgaacagcggcggcttcatcggctacgccccctacgtgaacagaatcgtgcagcagtggaacctgcaggacaacgacgacgaccagctgttctacaccaaggtgtacatcgaccccctgaagagagaggccatcaacatcaccctggaccacaagtgcaagatcttccagaccctgaacggcgccgtggacgaggtggtgctgaagttcgagaacggcaaggccagagccaagaacaccttctacgagaccctgcccgtggccatcaacggcaacggccccaccaagatcctgctgaactacttcggcaactacgtgcccaacagctggacccaggacaacggctgcaccctgtgcgagttcgacaccgtggacctgagcgccgtggacgtgcaccccaacgtgagcatcggcgtgttcatcgagcagcccacccccttcctgcccagattcctggacatcctgctgaccctggactaccccaaggaggccctgaagctgttcatccacaacaaggaggtgtaccacgagaaggacatcaaggtgttcttcgacaaggccaagcacgagatcaagaccatcaagatcgtgggccccgaggagaacctgagccaggccgaggccagaaacatgggcatggacttctgcagacaggacgagaagtgcgactactacttcagcgtggacgccgacgtggtgctgaccaaccccagaaccctgaagatcctgatcgagcagaacagaaagatcatcgcccccctggtgaccagacacggcaagctgtggagcaacttctggggcgccctgagccccgacggctactacgccagaagcgaggactacgtggacatcgtgcagggcaacagagtgggcgtgtggaacgtgccctacatggccaacgtgtacctgatcaagggcaagaccctgagaagcgagatgaacgagagaaactacttcgtgagagacaagctggaccccgacatggccctgtgcagaaacgccagagagatgaccctgcagagagagaaggacagccccacccccgagaccttccagatgctgagcccccccaagggcgtgttcatgtacatcagcaacagacacgagttcggcagactgctgagcaccgccaactacaacaccagccactacaacaacgacctgtggcagatcttcgagaaccccgtggactggaaggagaagtacatcaacagagactacagcaagatcttcaccgagaacatcgtggagcagccctgccccgacgtgttctggttccccatcttcagcgagaaggcctgcgacgagctggtggaggagatggagcactacggcaagtggagcggcggcaagcaccacgacagcagaatcagcggcggctacgagaacgtgcccaccgacgacatccacatgaagcaggtggacctggagaacgtgtggctgcacttcatcagagagttcatcgcccccgtgaccctgaaggtgttcgccggctactacaccaagggcttcgccctgctgaacttcgtggtgaagtacagccccgagagacagagaagcctgagaccccaccacgacgccagcaccttcaccatcaacatcgccctgaacaacgtgggcgaggacttccagggcggcggctgcaagttcctgagatacaactgcagcatcgagagccccagaaagggctggagcttcatgcaccccggcagactgacccacctgcacgagggcctgcccgtgaagaacggcaccagatacatcgccgtgagcttcatcgacccctag

SEQ ID NO: 94477 - DNA, 2214 bp, Artificial Sequence
  Description of Artificial Sequence: Synthetic coding sequence
atgggcggctgcaccgtgaagccccagctgctgctgctggccctggtgctgcacccctggaacccctgcctgggcgccgacagcgagaagcccagcagcatccccaccgacaagctgctggtgatcaccgtggccaccaaggagagcgacggcttccacagattcatgcagagcgccaagtacttcaactacaccgtgaaggtgctgggccagggcgaggagtggagaggcggcgacggcatcaacagcatcggcggcggccagaaggtgagactgatgaaggaggtgatggagcactacgccgaccaggacgacctggtggtgatgttcaccgagtgcttcgacgtgatcttcgccggcggccccgaggaggtgctgaagaagttccagaaggccaaccacaaggtggtgttcgccgccgacggcatcctgtggcccgacaagagactggccgacaagtaccccgtggtgcacatcggcaagagatacctgaacagcggcggcttcatcggctacgccccctacgtgaacagaatcgtgcagcagtggaacctgcaggacaacgacgacgaccagctgttctacaccaaggtgtacatcgaccccctgaagagagaggccatcaacatcaccctggaccacaagtgcaagatcttccagaccctgaacggcgccgtggacgaggtggtgctgaagttcgagaacggcaaggccagagccaagaacaccttctacgagaccctgcccgtggccatcaacggcaacggccccaccaagatcctgctgaactacttcggcaactacgtgcccaacagctggacccaggacaacggctgcaccctgtgcgagttcgacaccgtggacctgagcgccgtggacgtgcaccccaacgtgagcatcggcgtgttcatcgagcagcccacccccttcctgcccagattcctggacatcctgctgaccctggactaccccaaggaggccctgaagctgttcatccacaacaaggaggtgtaccacgagaaggacatcaaggtgttcttcgacaaggccaagcacgagatcaagaccatcaagatcgtgggccccgaggagaacctgagccaggccgaggccagaaacatgggcatggacttctgcagacaggacgagaagtgcgactactacttcagcgtggacgccgacgtggtgctgaccaaccccagaaccctgaagatcctgatcgagcagaacagaaagatcatcgcccccctggtgaccagacacggcaagctgtggagcaacttctggggcgccctgagccccgacggctactacgccagaagcgaggactacgtggacatcgtgcagggcaacagagtgggcgtgtggaacgtgccctacatggccaacgtgtacctgatcaagggcaagaccctgagaagcgagatgaacgagagaaactacttcgtgagagacaagctggaccccgacatggccctgtgcagaaacgccagagagatgggcgtgttcatgtacatcagcaacagacacgagttcggcagactgctgagcaccgccaactacaacaccagccactacaacaacgacctgtggcagatcttcgagaaccccgtggactggaaggagaagtacatcaacagagactacagcaagatcttcaccgagaacatcgtggagcagccctgccccgacgtgttctggttccccatcttcagcgagaaggcctgcgacgagctggtggaggagatggagcactacggcaagtggagcggcggcaagcaccacgacagcagaatcagcggcggctacgagaacgtgcccaccgacgacatccacatgaagcaggtggacctggagaacgtgtggctgcacttcatcagagagttcatcgcccccgtgaccctgaaggtgttcgccggctactacaccaagggcttcgccctgctgaacttcgtggtgaagtacagccccgagagacagagaagcctgagaccccaccacgacgccagcaccttcaccatcaacatcgccctgaacaacgtgggcgaggacttccagggcggcggctgcaagttcctgagatacaactgcagcatcgagagccccagaaagggctggagcttcatgcaccccggcagactgacccacctgcacgagggcctgcccgtgaagaacggcaccagatacatcgccgtgagcttcatcgacccctag

SEQ ID NO: 94478 - DNA, 1257 bp, Artificial Sequence
  Description of Artificial Sequence: Synthetic coding sequence
atgctggagaaccacatcctgcacaagagaatctacatcctgaccttcttcagccagcagatcttcatcctgtgccacgcccacttcatcttcttcttcaccgtgagagacttctgcagacaggacgagaagtgcgactactacttcagcgtggacgccgacgtggtgctgaccaaccccagaaccctgaagatcctgatcgagcagaacagaaagatcatcgcccccctggtgaccagacacggcaagctgtggagcaacttctggggcgccctgagccccgacggctactacgccagaagcgaggactacgtggacatcgtgcagggcaacagagtgggcgtgtggaacgtgccctacatggccaacgtgtacctgatcaagggcaagaccctgagaagcgagatgaacgagagaaactacttcgtgagagacaagctggaccccgacatggccctgtgcagaaacgccagagagatgaccctgcagagagagaaggacagccccacccccgagaccttccagatgctgagcccccccaagggcgtgttcatgtacatcagcaacagacacgagttcggcagactgctgagcaccgccaactacaacaccagccactacaacaacgacctgtggcagatcttcgagaaccccgtggactggaaggagaagtacatcaacagagactacagcaagatcttcaccgagaacatcgtggagcagccctgccccgacgtgttctggttccccatcttcagcgagaaggcctgcgacgagctggtggaggagatggagcactacggcaagtggagcggcggcaagcaccacgacagcagaatcagcggcggctacgagaacgtgcccaccgacgacatccacatgaagcaggtggacctggagaacgtgtggctgcacttcatcagagagttcatcgcccccgtgaccctgaaggtgttcgccggctactacaccaagggcttcgccctgctgaacttcgtggtgaagtacagccccgagagacagagaagcctgagaccccaccacgacgccagcaccttcaccatcaacatcgccctgaacaacgtgggcgaggacttccagggcggcggctgcaagttcctgagatacaactgcagcatcgagagccccagaaagggctggagcttcatgcaccccggcagactgacccacctgcacgagggcctgcccgtgaagaacggcaccagatacatcgccgtgagcttcatcgacccctag

SEQ ID NO: 94479 - DNA, 2112 bp, Artificial Sequence
  Description of Artificial Sequence: Synthetic coding sequence
atgcagagcgccaagtacttcaactacaccgtgaaggtgctgggccagggcgaggagtggagaggcggcgacggcatcaacagcatcggcggcggccagaaggtgagactgatgaaggaggtgatggagcactacgccgaccaggacgacctggtggtgatgttcaccgagtgcttcgacgtgatcttcgccggcggccccgaggaggtgctgaagaagttccagaaggccaaccacaaggtggtgttcgccgccgacggcatcctgtggcccgacaagagactggccgacaagtaccccgtggtgcacatcggcaagagatacctgaacagcggcggcttcatcggctacgccccctacgtgaacagaatcgtgcagcagtggaacctgcaggacaacgacgacgaccagctgttctacaccaaggtgtacatcgaccccctgaagagagaggccatcaacatcaccctggaccacaagtgcaagatcttccagaccctgaacggcgccgtggacgaggtggtgctgaagttcgagaacggcaaggccagagccaagaacaccttctacgagaccctgcccgtggccatcaacggcaacggccccaccaagatcctgctgaactacttcggcaactacgtgcccaacagctggacccaggacaacggctgcaccctgtgcgagttcgacaccgtggacctgagcgccgtggacgtgcaccccaacgtgagcatcggcgtgttcatcgagcagcccacccccttcctgcccagattcctggacatcctgctgaccctggactaccccaaggaggccctgaagctgttcatccacaacaaggaggtgtaccacgagaaggacatcaaggtgttcttcgacaaggccaagcacgagatcaagaccatcaagatcgtgggccccgaggagaacctgagccaggccgaggccagaaacatgggcatggacttctgcagacaggacgagaagtgcgactactacttcagcgtggacgccgacgtggtgctgaccaaccccagaaccctgaagatcctgatcgagcagaacagaaagatcatcgcccccctggtgaccagacacggcaagctgtggagcaacttctggggcgccctgagccccgacggctactacgccagaagcgaggactacgtggacatcgtgcagggcaacagagtgggcgtgtggaacgtgccctacatggccaacgtgtacctgatcaagggcaagaccctgagaagcgagatgaacgagagaaactacttcgtgagagacaagctggaccccgacatggccctgtgcagaaacgccagagagatgaccctgcagagagagaaggacagccccacccccgagaccttccagatgctgagcccccccaagggcgtgttcatgtacatcagcaacagacacgagttcggcagactgctgagcaccgccaactacaacaccagccactacaacaacgacctgtggcagatcttcgagaaccccgtggactggaaggagaagtacatcaacagagactacagcaagatcttcaccgagaacatcgtggagcagccctgccccgacgtgttctggttccccatcttcagcgagaaggcctgcgacgagctggtggaggagatggagcactacggcaagtggagcggcggcaagcaccacgacagcagaatcagcggcggctacgagaacgtgcccaccgacgacatccacatgaagcaggtggacctggagaacgtgtggctgcacttcatcagagagttcatcgcccccgtgaccctgaaggtgttcgccggctactacaccaagggcttcgccctgctgaacttcgtggtgaagtacagccccgagagacagagaagcctgagaccccaccacgacgccagcaccttcaccatcaacatcgccctgaacaacgtgggcgaggacttccagggcggcggctgcaagttcctgagatacaactgcagcatcgagagccccagaaagggctggagcttcatgcaccccggcagactgacccacctgcacgagggcctgcccgtgaagaacggcaccagatacatcgccgtgagcttcatcgacccctag

SEQ ID NO: 94480 - DNA, 1092 bp, Artificial Sequence; identical to SEQ ID NO: 77645
  Description of Artificial Sequence: Synthetic coding sequence

SEQ ID NO: 94481 - DNA, 231 bp, Artificial Sequence
  Description of Artificial Sequence: Synthetic coding sequence
atgaccagcagcggccccggccccagattcctgctgctgctgcccctgctgctgccccccgccgccagcgccagcgacagacccagaggcagagaccccgtgaaccccgagaagctgctggtgatcaccgtggccaccgccgagaccgagggctacctgagattcctgagaagcgccgagttcttcaactacaccgtgagaaccctgggcctgggcgaggagtggagatag

SEQ ID NO: 94482 - DNA, 732 bp, Artificial Sequence
  Description of Artificial Sequence: Synthetic coding sequence
atggagaagtacgccgacagagaggacatgatcatcatgttcgtggacagctacgacgtgatcctggccggcagccccaccgagctgctgaagaagttcgtgcagagcggcagcagactgctgttcagcgccgagagcttctgctggcccgagtggggcctggccgagcagtaccccgaggtgggcaccggcaagagattcctgaacagcggcggcttcatcggcttcgccaccaccatccaccagatcgtgagacagtggaagtacaaggacgacgacgacgaccagctgttctacaccagactgtacctggaccccggcctgagagagaagctgagcctgaacctggaccacaagagcagaatcttccagaacctgaacggcgccctggacgaggtggtgctgaagttcgacagaaacagagtgagaatcagaaacgtggcctacgacaccctgcccatcgtggtgcacggcaacggccccaccaagctgcagctgaactacctgggcaactacgtgcccaacggctggacccccgagggcggctgcggcttctgcaaccaggacagaagaaccctgcccggcggccccgccagcccccccggcgtgagcggcagagtgtgcggcaccgcctacagcgtgagcgcccccctgcccgccgccgccgccacccccggcctgagccccagacagggccaccccttccccgcccagcagagaggcctgccctag

SEQ ID NO: 94483 - DNA, 1740 bp, Artificial Sequence
  Description of Artificial Sequence: Synthetic coding sequence
atggccgccaagagcgacggcgccgccgccagcgccagccccgaccccgagggcgccgccggcggcgccagaggcagcgccggcggcagaggcgaggccgccgccgccgccggcccccccggcgtggtgggcgccggcggccccggccccagatacgagctgagagactgctgctgggtgctgtgcgccctgctggtgttcttcagcgacggcgccaccgacctgtggctggccgccagctactacctgcagaaccagcacacctacttcagcctgaccctgctgttcgtgctgctgcccagcctggtggtgcagctgctgagcttcagatggttcgtgtacgactacagcgagcccgccggcagccccggccccgccgtgagcaccaaggacagcgtggccggcggcgccgccatcagcaccaaggacagcgccggcgccttcagaaccaaggagggcagccccgagcccggcccccagcccgcccccagcagcgccagcgcctacagaagaagatgctgcagactgtgcatctggctgctgcagaccctggtgcacctgctgcagctgggccaggtgtggagatacctgagagccctgtacctgggcctgcagagcagatggagaggcgagagactgagaagacacttctactggcagatgctgttcgagagcgccgacgtgagcatgctgagactgctggagaccttcctgagaagcgccccccagctggtgctgcagctgagcctgctggtgcacagaggcggcgcccccgacctgctgcccgccctgagcaccagcgccagcctggtgagcctggcctggaccctggccagctaccagaaggtgctgagagacagcagagacgacaagagacccctgagctacaagggcgccgtggcccaggtgctgtggcacctgttcagcatcgccgccagaggcctggccttcgccctgttcgccagcgtgtacaagctgtacttcggcatcttcatcgtggcccactggtgcgtgatgaccttctgggtgatccagggcgagaccgacttctgcatgagcaagtgggaggagatcatctacaacatggtggtgggcatcatctacatcttctgctggttcaacgtgaaggagggcagaagcagaagaagaatgaccctgtaccactgcatcgtgctgctggagaacgccgccctgaccggcttctggtacagcagcagaaacttcagcaccgacttctacagcctgatcatggtgtgcgtggtggccagcagcttcgccctgggcatcttcttcatgtgcgtgtactactgcctgctgcaccccaacggccccatgctgggcccccaggcccccggctgcatcttcagaaaggccagcgagccctgcggcccccccgccgacgccatcaccagcccccccagaagcctgcccagaaccaccggcgccgagagagacggcgccagcgccggcgagagagccggcacccccaccccccccgtgttccaggtgagacccggcctgccccccacccccgtggccagaaccctgagaaccgagggccccgtgatcagaatcgacctgcccagaaagaagtaccccgcctgggacgcccacttcatcgacagaagactgagaaagaccatcctggccctggagtacagcagccccgccacccccagactgcagtacagaagcgtgggcaccagccaggagctgctggagtacgagaccaccgtgtag

SEQ ID NO: 94484 - DNA, 765 bp, Artificial Sequence
  Description of Artificial Sequence: Synthetic coding sequence
atggcctggcagggcctggtgctggccgcctgcctgctgatgttccccagcaccaccgccgactgcctgagcagatgcagcctgtgcgccgtgaagacccaggacggccccaagcccatcaaccccctgatctgcagcctgcagtgccaggccgccctgctgcccagcgaggagtgggagagatgccagagcttcctgagcttcttcacccccagcaccctgggcctgaacgacaaggaggacctgggcagcaagagcgtgggcgagggcccctacagcgagctggccaagctgagcggcagcttcctgaaggagctggagaagagcaagttcctgcccagcatcagcaccaaggagaacaccctgagcaagagcctggaggagaagctgagaggcctgagcgacggcttcagagagggcgccgagagcgagctgatgagagacgcccagctgaacgacggcgccatggagaccggcaccctgtacctggccgaggaggaccccaaggagcaggtgaagagatacggcggcttcctgagaaagtaccccaagagaagcagcgaggtggccggcgagggcgacggcgacagcatgggccacgaggacctgtacaagagatacggcggcttcctgagaagaatcagacccaagctgaagtgggacaaccagaagagatacggcggcttcctgagaagacagttcaaggtggtgaccagaagccaggaggaccccaacgcctacagcggcgagctgttcgacgcctag

SEQ ID NO: 94485 - DNA, 765 bp, Artificial Sequence; identical to SEQ ID NO: 94484
  Description of Artificial Sequence: Synthetic coding sequence

SEQ ID NO: 94486 - DNA, 804 bp, Artificial Sequence
  Description of Artificial Sequence: Synthetic coding sequence
atggccagattcctgaccctgtgcacctggctgctgctgctgggccccggcctgctggccaccgtgagagccgagtgcagccaggactgcgccacctgcagctacagactggtgagacccgccgacatcaacttcctggcctgcgtgatggagtgcgagggcaagctgcccagcctgaagatctgggagacctgcaaggagctgctgcagctgagcaagcccgagctgccccaggacggcaccagcaccctgagagagaacagcaagcccgaggagagccacctgctggccaagagatacggcggcttcatgaagagatacggcggcttcatgaagaagatggacgagctgtaccccatggagcccgaggaggaggccaacggcagcgagatcctggccaagagatacggcggcttcatgaagaaggacgccgaggaggacgacagcctggccaacagcagcgacctgctgaaggagctgctggagaccggcgacaacagagagagaagccaccaccaggacggcagcgacaacgaggaggaggtgagcaagagatacggcggcttcatgagaggcctgaagagaagcccccagctggaggacgaggccaaggagctgcagaagagatacggcggcttcatgagaagagtgggcagacccgagtggtggatggactaccagaagagatacggcggcttcctgaagagattcgccgaggccctgcccagcgacgaggagggcgagagctacagcaaggaggtgcccgagatggagaagagatacggcggcttcatgagattctag

SEQ ID NO: 94487 - DNA, 804 bp, Artificial Sequence; identical to SEQ ID NO: 94486
  Description of Artificial Sequence: Synthetic coding sequence

SEQ ID NO: 94488 - DNA, 318 bp, Artificial Sequence
  Description of Artificial Sequence: Synthetic coding sequence
atggccagattcctgaccctgtgcacctggctgctgctgctgggccccggcctgctggccaccgtgagagccgagtgcagccaggactgcgccacctgcagctacagactggtgagacccgccgacatcaacttcctggcctgcgtgatggagtgcgagggcaagctgcccagcctgaagatctgggagacctgcaaggagctgctgcagctgagcaagcccgagctgccccaggacggcaccagcaccctgagagagaacagcaagcccgaggagagccacctgctggccaagagatacggcggcttcatgaagtag

SEQ ID NO: 94489 - DNA, 570 bp, Artificial Sequence
  Description of Artificial Sequence: Synthetic coding sequence
atggccagattcctgaccctgtgcacctggctgctgctgctgggccccggcctgctggccaccgtgagagccgagtgcagccaggactgcgccacctgcagctacagactggtgagacccgccgacatcaacttcctggcctgcgtgatggagtgcgagggcaagctgcccagcctgaagatctgggagacctgcaaggagctgctgcagctgagcaagcccgagctgccccaggacggcaccagcaccctgagagagaacagcaagcccgaggagagccacctgctggccaagagatacggcggcttcatgaagagatacggcggcttcatgaagaagatggacgagctgtaccccatggagcccgaggaggaggccaacggcagcgagatcctggccaagagatacggcggcttcatgaagaaggacgccgaggaggacgacagcctggccaacagcagcgacctgctgaaggagctgctggagaccggcgacaacagagagagaagccaccaccaggacggcagcgacaacgaggaggagaagaagaagaagaagagaaaggagtag

SEQ ID NO: 94490 - DNA, 423 bp, Artificial Sequence
  Description of Artificial Sequence: Synthetic coding sequence
atggccggctggcagagctacgtggacaacctgatgtgcgacggctgctgccaggaggccgccatcgtgggctactgcgacgccaagtacgtgtgggccgccaccgccggcggcgtgttccagagcatcacccccatcgagatcgacatgatcgtgggcaaggacagagagggcttcttcaccaacggcctgaccctgggcgccaagaagtgcagcgtgatcagagacagcctgtacgtggacggcgactgcaccatggacatcagaaccaagagccagggcggcgagcccacctacaacgtggccgtgggcagagccggcagagtgctggtgttcgtgatgggcaaggagggcgtgcacggcggcggcctgaacaagaaggcctacagcatggccaagtacctgagagacagcggcttctag

SEQ ID NO: 94491 - DNA, 423 bp, Artificial Sequence
  Description of Artificial Sequence: Synthetic coding sequence
atggccggctggcagagctacgtggacaacctgatgtgcgacggctgctgccaggaggccgccatcgtgggctactgcgacgccaagtacgtgtgggccgccaccgccggcggcgtgttccagagcatcacccccatcgagatcgacatgatcgtgggcaaggacagagagggcttcttcaccaacggcctgaccctgggcgccaagaagtgcagcgtgatcagagacagcctgtacgtggacggcgactgcaccatggacatcagaaccaagagccagggcggcgagcccacctacaacgtggccgtgggcagagccggcagagccctggtgatcgtgatgggcaaggagggcgtgcacggcggcaccctgaacaagaaggcctacgagctggccctgtacctgagaagaagcgacgtgtag

SEQ ID NO: 94492 - DNA, 414 bp, Artificial Sequence
  Description of Artificial Sequence: Synthetic coding sequence
atgggcgactggaaggtgtacatcagcgccgtgctgagagaccagagaatcgacgacgtggccatcgtgggccacgccgacaacagctgcgtgtgggccagcagacccggcggcctgctggccgccatcagcccccaggaggtgggcgtgctgaccggccccgacagacacaccttcctgcaggccggcctgagcgtgggcggcagaagatgctgcgtgatcagagaccacctgctggccgagggcgacggcgtgctggacgccagaaccaagggcctggacgccagagccgtgtgcgtgggcagagcccccagagccctgctggtgctgatgggcagaagaggcgtgcacggcggcatcctgaacaagaccgtgcacgagctgatcagaggcctgagaatgcagggcgcctag

SEQ ID NO: 94493 - DNA, 1167 bp, Artificial Sequence
  Description of Artificial Sequence: Synthetic coding sequence
atgaagtggatggtggtggtgctggtgtgcctgcagctgctggaggccgccgtggtgaaggtgcccctgaagaagttcaagagcatcagagagaccatgaaggagaagggcctgctgggcgagttcctgagaacccacaagtacgaccccgcctggaagtacagattcggcgacctgagcgtgacctacgagcccatggcctacatggacgccgcctacttcggcgagatcagcatcggcacccccccccagaacttcctggtgctgttcgacaccggcagcagcaacctgtgggtgcccagcgtgtactgccagagccaggcctgcaccagccacagcagattcaaccccagcgagagcagcacctacagcaccaacggccagaccttcagcctgcagtacggcagcggcagcctgaccggcttcttcggctacgacaccctgaccgtgcagagcatccaggtgcccaaccaggagttcggcctgagcgagaacgagcccggcaccaacttcgtgtacgcccagttcgacggcatcatgggcctggcctaccccgccctgagcgtggacgaggccaccaccgccatgcagggcatggtgcaggagggcgccctgaccagccccgtgttcagcgtgtacctgagcaaccagcagggcagcagcggcggcgccgtggtgttcggcggcgtggacagcagcctgtacaccggccagatctactgggcccccgtgacccaggagctgtactggcagatcggcatcgaggagttcctgatcggcggccaggccagcggctggtgcagcgagggctgccaggccatcgtggacaccggcaccagcctgctgaccgtgccccagcagtacatgagcgccctgctgcaggccaccggcgcccaggaggacgagtacggccagttcctggtgaactgcaacagcatccagaacctgcccagcctgaccttcatcatcaacggcgtggagttccccctgccccccagcagctacatcctgagcaacaacggctactgcaccgtgggcgtggagcccacctacctgagcagccagaacggccagcccctgtggatcctgggcgacgtgttcctgagaagctactacagcgtgtacgacctgggcaacaacagagtgggcttcgccaccgccgcctag

SEQ ID NO: 94494 - DNA, 315 bp, Artificial Sequence
  Description of Artificial Sequence: Synthetic coding sequence
atgaagtggatggtggtggtgctggtgtgcctgcagctgctggaggccgccgtggtgaaggtgcccctgaagaagttcaagagcatcagagagaccatgaaggagaagggcctgctgggcgagttcctgagaacccacaagtacgaccccgcctggaagtacagattcggcgacctgagcgtgacctacgagcccatggcctacatggacgccgcctacttcggcgagatcagcatcggcacccccccccagaacttcctggtgctgttcgacaccggcagcagccccctgcccctggaccccgcccccagctag

SEQ ID NO: 94495 - DNA, 411 bp, Artificial Sequence
  Description of Artificial Sequence: Synthetic coding sequence
atgaagtggatggtggtggtgctggtgtgcctgcagctgctggaggccgccgtggtgaaggtgcccctgaagaagttcaagagcatcagagagaccatgaaggagaagggcctgctgggcgagttcctgagaacccacaagtacgaccccgcctggaagtacagattcggcgacctgagcgtgacctacgagcccatggcctacatggacgtgcagagcatccaggtgcccaaccaggagttcggcctgagcgagaacgagcccggcaccaacttcgtgtacgcccagttcgacggcatcatgggcctggcctaccccgccctgagcgtggacgaggccaccaccgccatgcagggcatggtgcaggagggcgccctgaccagccccgtgttcagcgtgtacctgagctag

SEQ ID NO: 94496 - DNA, 948 bp, Artificial Sequence
  Description of Artificial Sequence: Synthetic coding sequence
atgaagtggatggtggtggtgctggtgtgcctgcagctgctggaggccgccgtggtgaaggtgcccctgaagaagttcaagagcatcagagagaccatgaaggagaagggcctgctgggcgagttcctgagaacccacaagtacgaccccgcctggaagtacagattcggcgacctgagcgtgacctacgagcccatggcctacatggacgccgcctacttcggcgagatcagcatcggcacccccccccagaacttcctggtgctgttcgacaccggcagcagcaacctgtgggtgcccagcgtgtactgccagagccaggcctgcaccagccacagcagattcaaccccagcgagagcagcacctacagcaccaacggccagaccttcagcctgcagtacggcagcggcagcctgaccggcttcttcggctacgacaccctgaccgtgcagagcatccaggtgcccaaccaggagttcggcctgagcgagaacgagcccggcaccaacttcgtgtacgcccagttcgacggcatcatgggcctggcctaccccgccctgagcgtggacgaggccaccaccgccatgcagggcatggtgcaggagggcgccctgaccagccccgtgttcagcgtgtacctgagcaacctggtgctggagagcagcggcctgggccccctgctgacccccagcagagccgccccccccagcagcaccctgcagctgcccgagaagcccctggagcagacctggaacatcctgacccccttcaccaagaccctgcccgtgagcaacctgagcagaaaggtgaccagctgggccggcgtgggcatccccgtgacctgcctgcccgaggccggcagcggcggcgagagaagagccgagtgcggcctgggcgtgcccaccaccagaggcccccccagaagccagcaccacagcggcgcctag

SEQ ID NO: 94497 - DNA, 543 bp, Artificial Sequence
  Description of Artificial Sequence: Synthetic coding sequence
atgctgtgcctgctgctgaccctgggcgtggccctggtgtgcggcgtgcccgccatggacatcccccagaccaagcaggacctggagctgcccaagctggccggcacctggcacagcatggccatggccaccaacaacatcagcctgatggccaccctgaaggcccccctgagagtgcacatcaccagcctgctgcccacccccgaggacaacctggagatcgtgctgcacagatgggagaacaacagctgcgtggagaagaaggtgctgggcgagaagaccgagaaccccaagaagttcaagatcaactacaccgtggccaacgaggccaccctgctggacaccgactacgacaacttcctgttcctgtgcctgcaggacaccaccacccccatccagagcatgatgtgccagtacctggccagagtgctggtggaggacgacgagatcatgcagggcttcatcagagccttcagacccctgcccagacacctgtggtacctgctggacctgaagcagatggaggagccctgcagattctag

SEQ ID NO: 94498 - DNA, 261 bp, Artificial Sequence
  Description of Artificial Sequence: Synthetic coding sequence
atgctgtgcctgctgctgaccctgggcgtggccctggtgtgcggcgtgcccgccatggacatcccccagaccaagcaggacctggagctgcccaaggacaccaccacccccatccagagcatgatgtgccagtacctggccagagtgctggtggaggacgacgagatcatgcagggcttcatcagagccttcagacccctgcccagacacctgtggtacctgctggacctgaagcagatggaggccccctgctggctgtag

SEQ ID NO: 94499 - DNA, 543 bp, Artificial Sequence; identical to SEQ ID NO: 94497
  Description of Artificial Sequence: Synthetic coding sequence

SEQ ID NO: 94500 - DNA, 438 bp, Artificial Sequence
  Description of Artificial Sequence: Synthetic coding sequence
atgctgtgcctgctgctgaccctgggcgtggccctggtgtgcggcgtgcccgccatggacatcccccagaccaagcaggacctggagctgcccaaggcccccctgagagtgcacatcaccagcctgctgcccacccccgaggacaacctggagatcgtgctgcacagatgggagaacaacagctgcgtggagaagaaggtgctgggcgagaagaccgagaaccccaagaagttcaagatcaactgcaaggccagcggcgccccccagctgagctggaagccccagggccccagaaccgaccccgccagcagcaccgccagagtgctggtggaggacgacgagatcatgcagggcttcatcagagccttcagacccctgcccagacacctgtggtacctgctggacctgaagcagatggaggagccctgcagattctag

SEQ ID NO: 94501 - DNA, 399 bp, Artificial Sequence
  Description of Artificial Sequence: Synthetic coding sequence
ctgatggccaccctgaaggcccccctgagagtgcacatcaccagcctgctgcccacccccgaggacaacctggagatcgtgctgcacagatgggagaacaacagctgcgtggagaagaaggtgctgggcgagaagaccgagaaccccaagaagttcaagatcaactacaccgtggccaacgaggccaccctgctggacaccgactacgacaacttcctgttcctgtgcctgcaggacaccaccacccccatccagagcatgatgtgccagtacctggccagagtgctggtggaggacgacgagatcatgcagggcttcatcagagccttcagacccctgcccagacacctgtggtacctgctggacctgaagcagatggaggagccctgcagattctag

SEQ ID NO: 94502 - DNA, 396 bp, Artificial Sequence
  Description of Artificial Sequence: Synthetic coding sequence
tgagtgcccgccatggacatcccccagaccaagcaggacctggagctgcccaaggcccccctgagagtgcacatcaccagcctgctgcccacccccgaggacaacctggagatcgtgctgcacagatgggagaacaacagctgcgtggagaagaaggtgctgggcgagaagaccgagaaccccaagaagttcaagatcaactgcaaggccagcggcgccccccagctgagctggaagccccagggccccagaaccgaccccgccagcagcaccgccagagtgctggtggaggacgacgagatcatgcagggcttcatcagagccttcagacccctgcccagacacctgtggtacctgctggacctgaagcagatggaggagccctgcagattctag

SEQ ID NO: 94503 - DNA, 381 bp, Artificial Sequence
  Description of Artificial Sequence: Synthetic coding sequence
tgacccctgagagtgcacatcaccagcctgctgcccacccccgaggacaacctggagatcgtgctgcacagatgggagaacaacagctgcgtggagaagaaggtgctgggcgagaagaccgagaaccccaagaagttcaagatcaactacaccgtggccaacgaggccaccctgctggacaccgactacgacaacttcctgttcctgtgcctgcaggacaccaccacccccatccagagcatgatgtgccagtacctggccagagtgctggtggaggacgacgagatcatgcagggcttcatcagagccttcagacccctgcccagacacctgtggtacctgctggacctgaagcagatggaggagccctgcagattctag

SEQ ID NO: 94504 - DNA, 102 bp, Artificial Sequence
  Description of Artificial Sequence: Synthetic coding sequence
tgagagatcatgcagggcttcatcagagccttcagacccctgcccagacacctgtggtacctgctggacctgaagcagatggaggagccctgcagattctag

SEQ ID NO: 94505 - DNA, 543 bp, Artificial Sequence; identical to SEQ ID NO: 94497
  Description of Artificial Sequence: Synthetic coding sequence

SEQ ID NO: 94506 - DNA, 510 bp, Artificial Sequence
  Description of Artificial Sequence: Synthetic coding sequence
atgctgtgcctgctgctgaccctgggcgtggccctggtgtgcggcgtgcccgccatggacatcccccagaccaagcaggacctggagctgcccaagctggccggcacctggcacagcatggccatggccaccaacaacatcagcctgatggccaccctgaaggcccccctgagagtgcacatcaccagcctgctgcccacccccgaggacaacctggagatcgtgctgcacagatgggagaacaacagctgcgtggagaagaaggtgctgggcgagaagaccgagaaccccaagaagttcaagatcaactacaccgtggccaacgaggccaccctgctggacaccgactacgacaacttcctgttcctgtgcctgcaggacaccaccacccccatccagagcatgatgtgccagtacctggagagctggtggagaaccatgagaagctgcagagacagcagcggcctgagcggcccctgccccggcacctacggcacctgctggacctag

SEQ ID NO: 94507 - DNA, 2274 bp, Artificial Sequence
  Description of Artificial Sequence: Synthetic coding sequence
atgagcagaaagatcagcaaggagagcaagaaggtgaacatcagcagcagcctggagagcgaggacatcagcctggagaccaccgtgcccaccgacgacatcagcagcagcgaggagagagagggcaaggtgagaatcaccagacagctgatcgagagaaaggagctgctgcacaacatccagctgctgaagatcgagctgagccagaagaccatgatgatcgacaacctgaaggtggactacctgaccaagatcgaggagctggaggagaagctgaacgacgccctgcaccagaagcagctgctgaccctgagactggacaaccagctggccttccagcagaaggacgccagcaagtaccaggagctgatgaagcaggagatggagaccatcctgctgagacagaagcagctggaggagaccaacctgcagctgagagagaaggccggcgacgtgagaagaaacctgagagacttcgagctgaccgaggagcagtacatcaagctgaaggccttccccgaggaccagctgagcatccccgagtacgtgagcgtgagattctacgagctggtgaaccccctgagaaaggagatctgcgagctgcaggtgaagaagaacatcctggccgaggagctgagcaccaacaagaaccagctgaagcagctgaccgagacctacgaggaggacagaaagaactacagcgaggtgcagatcagatgccagagactggccctggagctggccgacaccaagcagctgatccagcagggcgactacagacaggagaactacgacaaggtgaagagcgagagagacgccctggagcaggaggtgatcgagctgagaagaaagcacgagatcctggaggccagccacatgatccagaccaaggagagaagcgagctgagcaaggaggtggtgaccctggagcagaccgtgaccctgctgcagaaggacaaggagtacctgaacagacagaacatggagctgagcgtgagatgcgcccacgaggaggacagactggagagactgcaggcccagctggaggagagcaagaaggccagagaggagatgtacgagaagtacgtggccagcagagaccactacaagaccgagtacgagaacaagctgcacgacgagctggagcagatcagactgaagaccaaccaggagatcgaccagctgagaaacgccagcagagagatgtacgagagagagaacagaaacctgagagaggccagagacaacgccgtggccgagaaggagagagccgtgatggccgagaaggacgccctggagaagcacgaccagctgctggacagatacagagagctgcagctgagcaccgagagcaaggtgaccgagttcctgcaccagagcaagctgaagagcttcgagagcgagagagtgcagctgctgcaggaggagaccgccagaaacctgacccagtgccagctggagtgcgagaagtaccagaagaagctggaggtgctgaccaaggagttctacagcctgcaggccagcagcgagaagagaatcaccgagctgcaggcccagaacagcgagcaccaggccagactggacatctacgagaagctggagaaggagctggacgagatcatcatgcagaccgccgagatcgagaacgaggacgaggccgagagagtgctgttcagctacggctacggcgccaacgtgcccaccaccgccaagagaagactgaagcagagcgtgcacctggccagaagagtgctgcagctggagaagcagaacagcctgatcctgaaggacctggagcacagaaaggaccaggtgacccagctgagccaggagctggacagagccaacagcctgctgaaccagacccagcagccctacagatacctgatcgagagcgtgagacagagagacagcaagatcgacagcctgaccgagagcatcgcccagctggagaaggacgtgagcaacctgaacaaggagaagagcgccctgctgcagaccaagaaccagatggccctggacctggagcagctgctgaaccacagagaggagctggccgccatgaagcagatcctggtgaagatgcacagcaagcacagcgagaacagcctgctgctgaccaagaccgagcccaagcacgtgaccgagaaccagaagagcaagaccctgaacgtgcccaaggagcacgaggacaacatcttcacccccaagcccaccctgttcaccaagaaggaggcccccgagtggagcaagaagcagaagatgaagacctag

SEQ ID NO: 94508 - DNA, 651 bp, Artificial Sequence
  Description of Artificial Sequence: Synthetic coding sequence
ttcagaaccgccaaggtggagaacgaggacgaggccgagagagtgctgttcagctacggctacggcgccaacgtgcccaccaccgccaagagaagactgaagcagagcgtgcacctggccagaagagtgctgcagctggagaagcagaacagcctgatcctgaaggacctggagcacagaaaggaccaggtgacccagctgagccaggagctggacagagccaacagcctgctgaaccagacccagcagccctacagatacctgatcgagagcgtgagacagagagacagcaagatcgacagcctgaccgagagcatcgcccagctggagaaggacgtgagcaacctgaacaaggagaagagcgccctgctgcagaccaagaaccagatggccctggacctggagcagctgctgaaccacagagaggagctggccgccatgaagcagatcctggtgaagatgcacagcaagcacagcgagaacagcctgctgctgaccaagaccgagcccaagcacgtgaccgagaaccagaagagcaagaccctgaacgtgcccaaggagcacgaggacaacatcttcacccccaagcccaccctgttcaccaagaaggaggcccccgagtggagcaagaagcagaagatgaagacctag

SEQ ID NO: 94509 - DNA, 1245 bp, Artificial Sequence
  Description of Artificial Sequence: Synthetic coding sequence
atgagcagaaagatcagcaaggagagcaagaaggtgaacatcagcagcagcctggagagcgaggacatcagcctggagaccaccgtgcccaccgacgacatcagcagcagcgaggagagagagggcaaggtgagaatcaccagacagctgatcgagagaaaggagctgctgcacaacatccagctgctgaagatcgagctgagccagaagaccatgatgatcgacaacctgaaggtggactacctgaccaagatcgaggagctggaggagaagctgaacgacgccctgcaccagaagcagctgctgaccctgagactggacaaccagctggccttccagcagaaggacgccagcaagtaccaggagctgatgaagcaggagatggagaccatcctgctgagacagaagcagctggaggagaccaacctgcagctgagagagaaggccggcgacgtgagaagaaacctgagagacttcgagctgaccgaggagcagtacatcaagctgaaggccttccccgaggaccagctgagcatccccgagtacgtgagcgtgagattctacgagctggtgaaccccctgagaaaggagatctgcgagctgcaggtgaagaagaacatcctggccgaggagctgagcaccaacaagaaccagctgaagcagctgaccgagacctacgaggaggacagaaagaactacagcgaggtgcagatcagatgccagagactggccctggagctggccgacaccaagcagctgatccagcagggcgactacagacaggagaactacgacaaggtgaagagcgagagagacgccctggagcaggaggtgatcgagctgagaagaaagcacgagatcctggaggccagccacatgatccagaccaaggagagaagcgagctgagcaaggaggtggtgaccctggagcagaccgtgaccctgctgcagaaggacaaggagtacctgaacagacagaacatggagctgagcgtgagatgcgcccacgaggaggacagactggagagactgcaggcccagctggaggagagcaagaaggccagagaggagatgtacgagaagtacgtggccagcagagaccactacaagaccgagtacgagaacaagctgcacgacgagctggagcagatcagactgaagaccaaccaggagatcgaccagctgagaaacgccagcagagagatgtacgagagagagaacagaaagaagagaaagaagaagtag

SEQ ID NO: 94510 - DNA, 1734 bp, Artificial Sequence
  Description of Artificial Sequence: Synthetic coding sequence
atgaccgagctggccggcgccagcagcagctgctgccacagacccgccggcagaggcgccatgcagagcgtgctgcaccacttccagagactgagaggcagagagggcggcagccacttcatcaacaccagcagccccagaggcgaggccaagatgagcatcaccagcgacgaggtgaacttcctggtgtacagatacctgcaggagagcggcttcagccacagcgccttcaccttcggcatcgagagccacatcagccagagcaacatcaacggcaccctggtgccccccgccgccctgatcagcatcctgcagaagggcctgcagtacgtggaggccgagatcagcatcaacgaggacggcaccgtgttcgacggcagacccatcgagagcctgagcctgatcgacgccgtgatgcccgacgtggtgcagaccagacagcaggccttcagagagaagctggcccagcagcaggccagcgccgccgccgccgccgccgccgccaccgccgccgccaccgccgccaccaccaccagcgccggcgtgagccaccagaaccccagcaagaacagagaggccaccgtgaacggcgaggagaacagagcccacagcgtgaacaaccacgccaagcccatggagatcgacggcgaggtggagatccccagcagcaaggccaccgtgctgagaggccacgagagcgaggtgttcatctgcgcctggaaccccgtgagcgacctgctggccagcggcagcggcgacagcaccgccagaatctggaacctgaacgagaacagcaacggcggcagcacccagctggtgctgagacactgcatcagagagggcggccacgacgtgcccagcaacaaggacgtgaccagcctggactggaacaccaacggcaccctgctggccaccggcagctacgacggcttcgccagaatctggaccgaggacggcaacctggccagcaccctgggccagcacaagggccccatcttcgccctgaagtggaacagaaagggcaactacatcctgagcgccggcgtggacaagaccaccatcatctgggacgcccacaccggcgaggccaagcagcagttccccttccacagcgcccccgccctggacgtggactggcagaacaacaccaccttcgccagctgcagcaccgacatgtgcatccacgtgtgcagactgggctgcgacagacccgtgaagaccttccagggccacaccaacgaggtgaacgccatcaagtgggaccccagcggcatgctgctggccagctgcagcgacgacatgaccctgaagatctggagcatgaagcaggaggtgtgcatccacgacctgcaggcccacaacaaggagatctacaccatcaagtggagccccaccggccccgccaccagcaaccccaacagcaacatcatgctggccagcgccagcttcgacagcaccgtgagactgtgggacatcgagagaggcgtgtgcacccacaccctgaccaagcaccaggagcccgtgtacagcgtggccttcagccccgacggcaagtacctggccagcggcagcttcgacaagtgcgtgcacatctggaacacccagagcggcaacctggtgcacagctacagaggcaccggcggcatcttcgaggtgtgctggaacgccagaggcgacaaggtgggcgccagcgccagcgacggcagcgtgtgcgtgctggacctgagaaagtag

SEQ ID NO: 94511 - DNA, 432 bp, Artificial Sequence
  Description of Artificial Sequence: Synthetic coding sequence
atggccgccgaggacgtggtggccaccggcgccgaccccagcgacctggagagcggcggcctgctgcacgagatcttcaccagccccctgaacctgctgctgctgggcctgtgcatcttcctgctgtacaagatcgtgagaggcgaccagcccgccgccagcggcgacagcgacgacgacgagcccccccccctgcccagactgaagagaagagacttcacccccgccgagctgagaagattcgacggcgtgcaggaccccagaatcctgatggccatcaacggcaaggtgttcgacgtgaccaagggcagaaagttctacggccccgtgaagtaccaccacgtgggcaagctgctgaaggagggcgaggagcccaccgtgtacagcgacgaggaggagcccaaggacgagagcgccagaaagaacgactag

SEQ ID NO: 94512 - DNA, 672 bp, Artificial Sequence
  Description of Artificial Sequence: Synthetic coding sequence
atggccgccggcgacggcgacgtgaagctgggcaccctgggcagcggcagcgagagcagcaacgacggcggcagcgagagccccggcgacgccggcgccgccgccgagggcggcggctgggccgccgccgccctggccctgctgaccggcggcggcgagatgctgctgaacgtggccctggtggccctggtgctgctgggcgcctacagactgtgggtgagatggggcagaagaggcctgggcgccggcgccggcgccggcgaggagagccccgccaccagcctgcccagaatgaagaagagagacttcagcctggagcagctgagacagtacgacggcagcagaaaccccagaatcctgctggccgtgaacggcaaggtgttcgacgtgaccaagggcagcaagttctacggccccgccggcccctacggcatcttcgccggcagagacgccagcagaggcctggccaccttctgcctggacaaggacgccctgagagacgagtacgacgacctgagcgacctgaacgccgtgcagatggagagcgtgagagagtgggagatgcagttcaaggagaagtacgactacgtgggcagactgctgaagcccggcgaggagcccagcgagtacaccgacgaggaggacaccaaggaccacaacaagcaggactag

SEQ ID NO: 94513 - DNA, 402 bp, Artificial Sequence
  Description of Artificial Sequence: Synthetic coding sequence
atggccgccggcgacggcgacgtgaagctgggcaccctgggcagcggcagcgagagcagcaacgacggcggcagcgagagccccggcgacgccggcgccgccgccgagggcggcggctgggccgccgccgccctggccctgctgaccggcggcggcgagatgctgctgaacgtggccctggtggccctggtgctgctgggcgcctacagactgtgggtgagatggggcagaagaggcctgggcgccggcgccggcgccggcctgcagctgggcgccgccgcccccgtgagaagactgccccagcccgcccaccccgccagaggccagtgggagagcctgagaagagaccagagacagcaggtgctgagacccggcggcagcatctggaacatctgctggtag

SEQ ID NO: 94514 - DNA, 744 bp, Artificial Sequence
  Description of Artificial Sequence: Synthetic coding sequence
atgggcggcgccggcagaggcgtgggcgagggcagaggcagaggcggcggcggcagaagatggagagccgtgatggccgccggcgacggcgacgtgaagctgggcaccctgggcagcggcagcgagagcagcaacgacggcggcagcgagagccccggcgacgccggcgccgccgccgagggcggcggctgggccgccgccgccctggccctgctgaccggcggcggcgagatgctgctgaacgtggccctggtggccctggtgctgctgggcgcctacagactgtgggtgagatggggcagaagaggcctgggcgccggcgccggcgccggcgaggagagccccgccaccagcctgcccagaatgaagaagagagacttcagcctggagcagctgagacagtacgacggcagcagaaaccccagaatcctgctggccgtgaacggcaaggtgttcgacgtgaccaagggcagcaagttctacggccccgccggcccctacggcatcttcgccggcagagacgccagcagaggcctggccaccttctgcctggacaaggacgccctgagagacgagtacgacgacctgagcgacctgaacgccgtgcagatggagagcgtgagagagtgggagatgcagttcaaggagaagtacgactacgtgggcagactgctgaagcccggcgaggagcccagcgagtacaccgacgaggaggacaccaaggaccacaacaagcaggactag

SEQ ID NO: 94515 - DNA, 1041 bp, Artificial Sequence
  Description of Artificial Sequence: Synthetic coding sequence
atggccatggcccagaagctgagccacctgctgcccagcctgagacaggtgatccaggagccccagctgagcctgcagcccgagcccgtgttcaccgtggacagagccgaggtgccccccctgttctggaagccctacatctacgccggctacagacccctgcaccagacctggagattctacttcagaaccctgttccagcagcacaacgaggccgtgaacgtgtggacccacctgctggccgccctggtgctgctgctgagactggccctgttcgtggagaccgtggacttctggggcgacccccacgccctgcccctgttcatcatcgtgctggccagcttcacctacctgagcttcagcgccctggcccacctgctgcaggccaagagcgagttctggcactacagcttcttcttcctggactacgtgggcgtggccgtgtaccagttcggcagcgccctggcccacttctactacgccatcgagcccgcctggcacgcccaggtgcaggccgtgttcctgcccatggccgccttcctggcctggctgagctgcatcggcagctgctacaacaagtacatccagaagcccggcctgctgggcagaacctgccaggaggtgcccagcgtgctggcctacgccctggacatcagccccgtggtgcacagaatcttcgtgagcagcgaccccaccaccgacgaccccgccctgctgtaccacaagtgccaggtggtgttcttcctgctggccgccgccttcttcagcaccttcatgcccgagagatggttccccggcagctgccacgtgttcggccagggccaccagctgttccacatcttcctggtgctgtgcaccctggcccagctggaggccgtggccctggactacgaggccagaagacccatctacgagcccctgcacacccactggccccacaacttcagcggcctgttcctgctgaccgtgggcagcagcatcctgaccgccttcctgctgagccagctggtgcagagaaagctggaccagaagaccaagtag

SEQ ID NO: 94516 - DNA, 867 bp, Artificial Sequence
  Description of Artificial Sequence: Synthetic coding sequence
atgcagatcccccaggccccctggcccgtggtgtgggccgtgctgcagctgggctggagacccggctggttcctggacagccccgacagaccctggaacccccccaccttcagccccgccctgctggtggtgaccgagggcgacaacgccaccttcacctgcagcttcagcaacaccagcgagagcttcgtgctgaactggtacagaatgagccccagcaaccagaccgacaagctggccgccttccccgaggacagaagccagcccggccaggactgcagattcagagtgacccagctgcccaacggcagagacttccacatgagcgtggtgagagccagaagaaacgacagcggcacctacctgtgcggcgccatcagcctggcccccaaggcccagatcaaggagagcctgagagccgagctgagagtgaccgagagaagagccgaggtgcccaccgcccaccccagccccagccccagacccgccggccagttccagaccctggtggtgggcgtggtgggcggcctgctgggcagcctggtgctgctggtgtgggtgctggccgtgatctgcagcagagccgccagaggcaccatcggcgccagaagaaccggccagcccctgaaggaggaccccagcgccgtgcccgtgttcagcgtggactacggcgagctggacttccagtggagagagaagacccccgagccccccgtgccctgcgtgcccgagcagaccgagtacgccaccatcgtgttccccagcggcatgggcaccagcagccccgccagaagaggcagcgccgacggccccagaagcgcccagcccctgagacccgaggacggccactgcagctggcccctgtag

SEQ ID NO: 94517 - DNA, 540 bp, Artificial Sequence
  Description of Artificial Sequence: Synthetic coding sequence
atgcagatcccccaggccccctggcccgtggtgtgggccgtgctgcagctgggctggagacccggctggttcctggacagccccgacagaccctggaacccccccaccttcagccccgccctgctggtggtgaccgagggcgacaacgccaccttcacctgcagcttcagcaacaccagcgagagcttcgtgctgaactggtacagaatgagccccagcaaccagaccgacaagctggccgccttccccgaggacagaagccagcccggccaggactgcagattcagagtgacccagctgcccaacggcagagacttccacatgagcgtggtgagagccagaagaaacgacagcggcacctacctgtgcggcgccatcagcctggcccccaaggcccagatcaaggagagcctgagagccgagctgagagtgaccggcaccatcggcgccagaagaaccggccagcccctgaaggaggaccccagcgccgtgcccgtgttcagcgtggactacggcgagctggacttccagtggagatag

SEQ ID NO: 94518 - DNA, 639 bp, Artificial Sequence
  Description of Artificial Sequence: Synthetic coding sequence
atgagaatgaccatggaggagatgaagaacgaggccgagaccaccagcatggtgagcatgcccctgtacgccgtgatgtaccccgtgttcaacgagctggagagagtgaacctgagcgccgcccagaccctgagagccgccttcatcaaggccgagaaggagaaccccggcctgacccaggacatcatcatgaagatcctggagaagaagagcgtggaggtgaacttcaccgagagcctgctgagaatggccgccgacgacgtggaggagtacatgatcgagagacccgagcccgagttccaggacctgaacgagaaggccagagccctgaagcagatcctgagcaagatccccgacgagatcaacgacagagtgagattcctgcagaccatcaaggacatcgccagcgccatcaaggagctgctggacaccgtgaacaacgtgttcaagaagtaccagtaccagaacagaagagccctggagcaccagaagaaggagttcgtgaagtacagcaagagcttcagcgacaccctgaagacctacttcaaggacggcaaggccatcaacgtgttcgtgagcgccaacagactgatccaccagaccaacctgatcctgcagaccttcaagaccgtggcctag

SEQ ID NO: 94519 - DNA, 639 bp, Artificial Sequence; identical to SEQ ID NO: 94518
  Description of Artificial Sequence: Synthetic coding sequence

SEQ ID NO: 94520 - DNA, 441 bp, Artificial Sequence
  Description of Artificial Sequence: Synthetic coding sequence
atgagaatgaccatggaggagatgaagaacgaggccgagaccaccagcatggtgagcatgcccctgtacgccgtgatgtaccccgtgttcaacgagctggagagagtgaacctgagcgccgcccagaccctgagagccgccttcatcaaggccgagaaggagaaccccggcctgacccaggacatcatcatgaagatcctggagaagaagagcgtggaggtgaacttcaccgagagcctgctgagaatggccgccgacgacgtggaggagtacatgatcgagagacccgagcccgagttccaggacctgaacgagaaggccagagccctgaagcagatcctgagcaagatccccgacgagatcaacgacagagtgagattcctgcagaccatcaaggacatcgccagcgccatcaaggagctgctggacaccgtgaactag

SEQ ID NO: 94521 - DNA, 240 bp, Artificial Sequence
  Description of Artificial Sequence: Synthetic coding sequence
atgagaatgaccatggaggagatgaagaacgaggccgagaccaccagcatggtgagcatgcccctgtacgccgtgatgtaccccgtgttcaacgagctggagagagtgaacctgagcgccgcccagaccctgagagccgccttcatcaaggccgagaaggagaaccccggcctgacccaggacatcatcatgaagatcctggagaagaagagcgtggaggtgaacttcaccgagagctag

SEQ ID NO: 94522 - DNA, 639 bp, Artificial Sequence; identical to SEQ ID NO: 94518
  Description of Artificial Sequence: Synthetic coding sequence

SEQ ID NO: 94523 - DNA, 639 bp, Artificial Sequence; identical to SEQ ID NO: 94518
  Description of Artificial Sequence: Synthetic coding sequence

SEQ ID NO: 94524 - DNA, 609 bp, Artificial Sequence
  Description of Artificial Sequence: Synthetic coding sequence
atgagaatgaccatggaggagatgaagaacgaggccgagaccaccagcatggtgagcatgcccctgtacgccgtgatgtaccccgtgttcaacgagctggagagagtgaacctgagcgccgcccagaccctgagagccgccttcatcaaggccgagaaggagaaccccggcctgacccaggacatcatcatgaagatcctggagaagaagagcgtggaggtgaacttcaccgagagcctgctgagaatggccgccgacgacgtggaggagtacatgatcgagagacccgagcccgagttccaggacctgaacgagaaggccagagccctgaagcagatcctgagcaagatccccgacgagatcaacgacagagtgagattcctgcagaccatcaaggacatcgccagcgccatcaaggagctgctggacaccgtgaacaacgtgttcaagaagtaccagtaccagaacagaagagccctggagcaccagaagaaggagttcgtgaagtacagcaagagcttcagcgacaccctgaagacctacttcaaggacggcaaggccatcaacgtgttcgtgagcgccaacagactgatccaccagaccaactag

SEQ ID NO: 94525 - DNA, 561 bp, Artificial Sequence
  Description of Artificial Sequence: Synthetic coding sequence
atgagaatgaccatggaggagatgaagaacgaggccgagaccaccagcatggtgagcatgcccctgtacgccgtgatgtaccccgtgttcaacgagctggagagagtgaacctgagcgccgcccagaccctgagagccgccttcatcaaggccgagaaggagaaccccggcctgacccaggacatcatcatgaagatcctggagaagaagagcgtggaggtgaacttcaccgagagcctgctgagaatggccgccgacgacgtggaggagtacatgatcgagagacccgagcccgagttccaggacctgaacgagaaggccagagccctgaagcagatcctgagcaagatccccgacgagatcaacgacagagtgagattcctgcagaccatcaaggacatcgccagcgccatcaaggagctgctggacaccgtgaacaacgtgttcaagaagtaccagtaccagaacagaagagccctggagcaccagaagaaggagttcgtgaagtacagcaagagcttcagcgacaccctgaagacctacttcaaggacggcaagtag

SEQ ID NO: 94526 - DNA, 405 bp, Artificial Sequence
  Description of Artificial Sequence: Synthetic coding sequence
atgagaatgaccatggaggagatgaagaacgaggccgagaccaccagcatggtgagcatgcccctgtacgccgtgatgtaccccgtgttcaacgagctggagagagtgaacctgagcgccgcccagaccctgagagccgccttcatcaaggccgagaaggagaaccccggcctgacccaggacatcatcatgaagatcctggagaagaagagcgtggaggtgaacttcaccgagagcctgctgagaatggccgccgacgacgtggaggagtacatgatcgagagacccgagcccgagttccaggacctgaacgagaaggccagagccctgaagcagatcctgagcaagatccccgacgagatcaacgacagagtgagattcctgcagaccatcaaggacatctag

SEQ ID NO: 94527 - DNA, 639 bp, Artificial Sequence; identical to SEQ ID NO: 94518
  Description of Artificial Sequence: Synthetic coding sequence

SEQ ID NO: 94528 - DNA, 5616 bp, Artificial Sequence
  Description of Artificial Sequence: Synthetic coding sequence
atggccaacctggaggagagcttccccagaggcggcaccagaaagatccacaagcccgagaaggccttccagcagagcgtggagcaggacaacctgttcgacatcagcaccgaggagggcagcaccaagagaaagaagagccagaagggccccgccaagaccaagaagctgaagatcgagaagagagagagcagcaagagcgccagagagaagttcgagatcctgagcgtggagagcctgtgcgagggcatgagaatcctgggctgcgtgaaggaggtgaacgagctggagctggtgatcagcctgcccaacggcctgcagggcttcgtgcaggtgaccgagatctgcgacgcctacaccaagaagctgaacgagcaggtgacccaggagcagcccctgaaggacctgctgcacctgcccgagctgttcagccccggcatgctggtgagatgcgtggtgagcagcctgggcatcaccgacagaggcaagaagagcgtgaagctgagcctgaaccccaagaacgtgaacagagtgctgagcgccgaggccctgaagcccggcatgctgctgaccggcaccgtgagcagcctggaggaccacggctacctggtggacatcggcgtggacggcaccagagccttcctgcccctgctgaaggcccaggagtacatcagacagaagaacaagggcgccaagctgaaggtgggccagtacctgaactgcatcgtggagaaggtgaagggcaacggcggcgtggtgagcctgagcgtgggccacagcgaggtgagcaccgccatcgccaccgagcagcagagctggaacctgaacaacctgctgcccggcctggtggtgaaggcccaggtgcagaaggtgacccccttcggcctgaccctgaacttcctgaccttcttcaccggcgtggtggacttcatgcacctggaccccaagaaggccggcacctacttcagcaaccaggccgtgagagcctgcatcctgtgcgtgcaccccagaaccagagtggtgcacctgagcctgagacccatcttcctgcagcccggcagacccctgaccagactgagctgccagaacctgggcgccgtgctggacgacgtgcccgtgcagggcttcttcaagaaggccggcgccaccttcagactgaaggacggcgtgctggcctacgccagactgagccacctgagcgacagcaagaacgtgttcaaccccgaggccttcaagcccggcaacacccacaagtgcagaatcatcgactacagccagatggacgagctggccctgctgagcctgagaaccagcatcatcgaggcccagtacctgagataccacgacatcgagcccggcgccgtggtgaagggcaccgtgctgaccatcaagagctacggcatgctggtgaaggtgggcgagcagatgagaggcctggtgccccccatgcacctggccgacatcctgatgaagaaccccgagaagaagtaccacatcggcgacgaggtgaagtgcagagtgctgctgtgcgaccccgaggccaagaagctgatgatgaccctgaagaagaccctgatcgagagcaagctgcccgtgatcacctgctacgccgacgccaagcccggcctgcagacccacggcttcatcatcagagtgaaggactacggctgcatcgtgaagttctacaacaacgtgcagggcctggtgcccaagcacgagctgagcaccgagtacatccccgaccccgagagagtgttctacaccggccaggtggtgaaggtggtggtgctgaactgcgagcccagcaaggagagaatgctgctgagcttcaagctgagcagcgaccccgagcccaagaaggagcccgccggccacagccagaagaagggcaaggccatcaacatcggccagctggtggacgtgaaggtgctggagaagaccaaggacggcctggaggtggccgtgctgccccacaacatcagagccttcctgcccaccagccacctgagcgaccacgtggccaacggccccctgctgcaccactggctgcaggccggcgacatcctgcacagagtgctgtgcctgagccagagcgagggcagagtgctgctgtgcagaaagcccgccctggtgagcaccgtggagggcggccaggaccccaagaacttcagcgagatccaccccggcatgctgctgatcggcttcgtgaagagcatcaaggactacggcgtgttcatccagttccccagcggcctgagcggcctggcccccaaggccatcatgagcgacaagttcgtgaccagcaccagcgaccacttcgtggagggccagaccgtggccgccaaggtgaccaacgtggacgaggagaagcagagaatgctgctgagcctgagactgagcgactgcggcctgggcgacctggccatcaccagcctgctgctgctgaaccagtgcctggaggagctgcagggcgtgagaagcctgatgagcaacagagacagcgtgctgatccagaccctggccgagatgacccccggcatgttcctggacctggtggtgcaggaggtgctggaggacggcagcgtggtgttcagcggcggccccgtgcccgacctggtgctgaaggccagcagataccacagagccggccaggaggtggagagcggccagaagaagaaggtggtgatcctgaacgtggacctgctgaagctggaggtgcacgtgagcctgcaccaggacctggtgaacagaaaggccagaaagctgagaaagggcagcgagcaccaggccatcgtgcagcacctggagaagagcttcgccatcgccagcctggtggagaccggccacctggccgccttcagcctgaccagccacctgaacgacaccttcagattcgacagcgagaagctgcaggtgggccagggcgtgagcctgaccctgaagaccaccgagcccggcgtgaccggcctgctgctggccgtggagggccccgccgccaagagaaccatgagacccacccagaaggacagcgagaccgtggacgaggacgaggaggtggaccccgccctgaccgtgggcaccatcaagaagcacaccctgagcatcggcgacatggtgaccggcaccgtgaagagcatcaagcccacccacgtggtggtgaccctggaggacggcatcatcggctgcatccacgccagccacatcctggacgacgtgcccgagggcaccagccccaccaccaagctgaaggtgggcaagaccgtgaccgccagagtgatcggcggcagagacatgaagaccttcaagtacctgcccatcagccaccccagattcgtgagaaccatccccgagctgagcgtgagacccagcgagctggaggacggccacaccgccctgaacacccacagcgtgagccccatggagaagatcaagcagtaccaggccggccagaccgtgacctgcttcctgaagaagtacaacgtggtgaagaagtggctggaggtggagatcgcccccgacatcagaggcagaatccccctgctgctgaccagcctgagcttcaaggtgctgaagcaccccgacaagaagttcagagtgggccaggccctgagagccaccgtggtgggccccgacagcagcaagaccctgctgtgcctgagcctgaccggcccccacaagctggaggagggcgaggtggccatgggcagagtggtgaaggtgacccccaacgagggcctgaccgtgagcttccccttcggcaagatcggcaccgtgagcatcttccacatgagcgacagctacagcgagacccccctggaggacttcgtgccccagaaggtggtgagatgctacatcctgagcaccgccgacaacgtgctgaccctgagcctgagaagcagcagaaccaaccccgagaccaagagcaaggtggaggaccccgagatcaacagcatccaggacatcaaggagggccagctgctgagaggctacgtgggcagcatccagccccacggcgtgttcttcagactgggccccagcgtggtgggcctggccagatacagccacgtgagccagcacagccccagcaagaaggccctgtacaacaagcacctgcccgagggcaagctgctgaccgccagagtgctgagactgaaccaccagaagaacctggtggagctgagcttcctgcccggcgacaccggcaagcccgacgtgctgagcgccagcctggagggccagctgaccaagcaggaggagagaaagaccgaggccgaggagagagaccagaagggcgagaagaagaaccagaagagaaacgagaagaagaaccagaagggccaggaggaggtggagatgcccagcaaggagaagcagcagccccagaagccccaggcccagaagagaggcggcagagagtgcagagagagcggcagcgagcaggagagagtgagcaagaagcccaagaaggccggcctgagcgaggaggacgacagcctggtggacgtgtactacagagagggcaaggaggaggccgaggagaccaacgtgctgcccaaggagaagcagaccaagcccgccgaggcccccagactgcagctgagcagcggcttcgcctggaacgtgggcctggacagcctgacccccgccctgccccccctggccgagagcagcgacagcgaggaggacgagaagccccaccaggccaccatcaagaagagcaagaaggagagagagctggagaagcagaaggccgagaaggagctgagcagaatcgaggaggccctgatggaccccggcagacagcccgagagcgccgacgacttcgacagactggtgctgagcagccccaacagcagcatcctgtggctgcagtacatggccttccacctgcaggccaccgagatcgagaaggccagagccgtggccgagagagccctgaagaccatcagcttcagagaggagcaggagaagctgaacgtgtgggtggccctgctgaacctggagaacatgtacggcagccaggagagcctgaccaaggtgttcgagagagccgtgcagtacaacgagcccctgaaggtgttcctgcacctggccgacatctacgccaagagcgagaagttccaggaggccggcgagctgtacaacagaatgctgaagagattcagacaggagaaggccgtgtggatcaagtacggcgccttcctgctgagaagaagccaggccgccgccagccacagagtgctgcagagagccctggagtgcctgcccagcaaggagcacgtggacgtgatcgccaagttcgcccagctggagttccagctgggcgacgccgagagagccaaggccatcttcgagaacaccctgagcacctaccccaagagaaccgacgtgtggagcgtgtacatcgacatgaccatcaagcacggcagccagaaggacgtgagagacatcttcgagagagtgatccacctgagcctggcccccaagagaatgaagttcttcttcaagagatacctggactacgagaagcagcacggcaccgagaaggacgtgcaggccgtgaaggccaaggccctggagtacgtggaggccaagagcagcgtgctggaggactag

SEQ ID NO: 94529 - DNA, 3705 bp, Artificial Sequence
  Description of Artificial Sequence: Synthetic coding sequence
atggccaacctggaggagagcttccccagaggcggcaccagaaagatccacaagcccgagaaggccttccagcagagcgtggagcaggacaacctgttcgacatcagcaccgaggagggcagcaccaagagaaagaagagccagaagggccccgccaagaccaagaagctgaagatcgagaagagagagagcagcaagagcgccagagagaagttcgagatcctgagcgtggagagcctgtgcgagggcatgagaatcctgggctgcgtgaaggaggtgaacgagctggagctggtgatcagcctgcccaacggcctgcagggcttcgtgcaggtgaccgagatctgcgacgcctacaccaagaagctgaacgagcaggtgacccaggagcagcccctgaaggacctgctgcacctgcccgagctgttcagccccggcatgctggtgagatgcgtggtgagcagcctgggcatcaccgacagaggcaagaagagcgtgaagctgagcctgaaccccaagaacgtgaacagagtgctgagcgccgaggccctgaagcccggcatgctgctgaccggcaccgtgagcagcctggaggaccacggctacctggtggacatcggcgtggacggcaccagagccttcctgcccctgctgaaggcccaggagtacatcagacagaagaacaagggcgccaagctgaaggtgggccagtacctgaactgcatcgtggagaaggtgaagggcaacggcggcgtggtgagcctgagcgtgggccacagcgaggtgagcaccgccatcgccaccgagcagcagagctggaacctgaacaacctgctgcccggcctggtggtgaaggcccaggtgcagaaggtgacccccttcggcctgaccctgaacttcctgaccttcttcaccggcgtggtggacttcatgcacctggaccccaagaaggccggcacctacttcagcaaccaggccgtgagagcctgcatcctgtgcgtgcaccccagaaccagagtggtgcacctgagcctgagacccatcttcctgcagcccggcagacccctgaccagactgagctgccagaacctgggcgccgtgctggacgacgtgcccgtgcagggcttcttcaagaaggccggcgccaccttcagactgaaggacggcgtgctggcctacgccagactgagccacctgagcgacagcaagaacgtgttcaaccccgaggccttcaagcccggcaacacccacaagtgcagaatcatcgactacagccagatggacgagctggccctgctgagcctgagaaccagcatcatcgaggcccagtacctgagataccacgacatcgagcccggcgccgtggtgaagggcaccgtgctgaccatcaagagctacggcatgctggtgaaggtgggcgagcagatgagaggcctggtgccccccatgcacctggccgacatcctgatgaagaaccccgagaagaagtaccacatcggcgacgaggtgaagtgcagagtgctgctgtgcgaccccgaggccaagaagctgatgatgaccctgaagaagaccctgatcgagagcaagctgcccgtgatcacctgctacgccgacgccaagcccggcctgcagacccacggcttcatcatcagagtgaaggactacggctgcatcgtgaagttctacaacaacgtgcagggcctggtgcccaagcacgagctgagcaccgagtacatccccgaccccgagagagtgttctacaccggccaggtggtgaaggtggtggtgctgaactgcgagcccagcaaggagagaatgctgctgagcttcaagctgagcagcgaccccgagcccaagaaggagcccgccggccacagccagaagaagggcaaggccatcaacatcggccagctggtggacgtgaaggtgctggagaagaccaaggacggcctggaggtggccgtgctgccccacaacatcagagccttcctgcccaccagccacctgagcgaccacgtggccaacggccccctgctgcaccactggctgcaggccggcgacatcctgcacagagtgctgtgcctgagccagagcgagggcagagtgctgctgtgcagaaagcccgccctggtgagcaccgtggagggcggccaggaccccaagaacttcagcgagatccaccccggcatgctgctgatcggcttcgtgaagagcatcaaggactacggcgtgttcatccagttccccagcggcctgagcggcctggcccccaaggccatcatgagcgacaagttcgtgaccagcaccagcgaccacttcgtggagggccagaccgtggccgccaaggtgaccaacgtggacgaggagaagcagagaatgctgctgagcctgagactgagcgactgcggcctgggcgacctggccatcaccagcctgctgctgctgaaccagtgcctggaggagctgcagggcgtgagaagcctgatgagcaacagagacagcgtgctgatccagaccctggccgagatgacccccggcatgttcctggacctggtggtgcaggaggtgctggaggacggcagcgtggtgttcagcggcggccccgtgcccgacctggtgctgaaggccagcagataccacagagccggccaggaggtggagagcggccagaagaagaaggtggtgatcctgaacgtggacctgctgaagctggaggtgcacgtgagcctgcaccaggacctggtgaacagaaaggccagaaagctgagaaagggcagcgagcaccaggccatcgtgcagcacctggagaagagcttcgccatcgccagcctggtggagaccggccacctggccgccttcagcctgaccagccacctgaacgacaccttcagattcgacagcgagaagctgcaggtgggccagggcgtgagcctgaccctgaagaccaccgagcccggcgtgaccggcctgctgctggccgtggagggccccgccgccaagagaaccatgagacccacccagaaggacagcgagaccgtggacgaggacgaggaggtggaccccgccctgaccgtgggcaccatcaagaagcacaccctgagcatcggcgacatggtgaccggcaccgtgaagagcatcaagcccacccacgtggtggtgaccctggaggacggcatcatcggctgcatccacgccagccacatcctggacgacgtgcccgagggcaccagccccaccaccaagctgaaggtgggcaagaccgtgaccgccagagtgatcggcggcagagacatgaagaccttcaagtacctgcccatcagccaccccagattcgtgagaaccatccccgagctgagcgtgagacccagcgagctggaggacggccacaccgccctgaacacccacagcgtgagccccatggagaagatcaagcagtaccaggccggcctgagcgaggaggacgacagcctggtggacgtgtactacagagagggcaaggaggaggccgaggagaccaacgtgctgcccaaggagaagcagaccaagcccgccgaggcccccagactgcagctgagcagcggcttcgcctggaacgtgggcctggacagcctgacccccgccctgccccccctggccgagagcagcgacagcgaggaggacgagaagccccaccaggccacccagatcaagaagagcaagaagtag

SEQ ID NO: 94530 - DNA, 936 bp, Artificial Sequence
  Description of Artificial Sequence: Synthetic coding sequence
atggccgccgccggcgccagacccgtggagctgggcttcgccgagagcgcccccgcctggagactgagaagcgagcagttccccagcaaggtgtacgcccccctgcccggcagacccgacgccttccacagatgcatcttcctgttctgctgcagagagcagccctgctgcgccggcctgagagtgttcagaaaccagctgcccagaaagaacgacttctacagctacgagccccccagcgagaaccccccccccgagaccggcgagagcgtgtgcctgcagctgaagagcggcgcccacctgtgcagagtgtgcggctgcctgggccccaagacctgcagcagatgccacaaggcctactactgcagcaaggagcaccagaccctggactggagactgggccacaagcaggcctgcgcccagcccgaccacctggaccacatcatccccgaccacaacttcctgttccccgagttcgagatcgtgatcgagaccgaggacgagatcatgcccgaggtggtggagaaggaggactacagcgagatcatcggcagcatgggcgaggccctggaggaggagctggacagcatggccaagcacgagagcagagaggacaagatcttccagaagttcaagacccagatcgccctggagcccgagcagatcctgagatacggcagaggcatcgcccccatctggatcagcggcgagaacatcccccaggagaaggacatccccgactgcccctgcggcgccaagagaatcctggagttccaggtgatgccccagctgctgaactacctgaaggccgacagactgggcaagagcatcgactggggcatcctggccgtgttcacctgcgccgagagctgcagcctgggcaccggctacaccgaggagttcgtgtggaagcaggacgtgaccgacaccccctag

SEQ ID NO: 94531 - DNA, 687 bp, Artificial Sequence
  Description of Artificial Sequence: Synthetic coding sequence
atggccgccgccggcgccagacccgtggagctgggcttcgccgagagcgcccccgcctggagactgagaagcgagcagttccccagcaaggtgggcggcagacccgcctggctgggcgccgccggcctgcccggcccccaggccctggcctgcgagctgtgcggcagacccctgagcttcctgctgcaggtgtacgcccccctgcccggcagacccgacgccttccacagatgcatcttcctgttctgctgcagagagcagccctgctgcgccggcctgagagtgttcagaaaccagctgcccagaaagaacgacttctacagctacgagccccccagcgagaaccccccccccgagaccggcgagagcgtgtgcctgcagctgaagagcggcgcccacctgtgcagagtgtgcggctgcctgggccccaagacctgcagcagatgccacaaggcctactactgcagcaaggagcaccagaccctggactggagactgggccacaagcaggcctgcgcccagcccgaccacctggaccacatcatccccgaccacaacttcctgttccccgagttcgagatcgtgatcgagaccgaggacgagatcatgcccgaggtggtggagaaggaggactacagcgagatcatcggcagcatgggcaagcagttccaggacttcatccactag

SEQ ID NO: 94532 - DNA, 1035 bp, Artificial Sequence
  Description of Artificial Sequence: Synthetic coding sequence
atggccgccgccggcgccagacccgtggagctgggcttcgccgagagcgcccccgcctggagactgagaagcgagcagttccccagcaaggtgggcggcagacccgcctggctgggcgccgccggcctgcccggcccccaggccctggcctgcgagctgtgcggcagacccctgagcttcctgctgcaggtgtacgcccccctgcccggcagacccgacgccttccacagatgcatcttcctgttctgctgcagagagcagccctgctgcgccggcctgagagtgttcagaaaccagctgcccagaaagaacgacttctacagctacgagccccccagcgagaaccccccccccgagaccggcgagagcgtgtgcctgcagctgaagagcggcgcccacctgtgcagagtgtgcggctgcctgggccccaagacctgcagcagatgccacaaggcctactactgcagcaaggagcaccagaccctggactggagactgggccacaagcaggcctgcgcccagcccgaccacctggaccacatcatccccgaccacaacttcctgttccccgagttcgagatcgtgatcgagaccgaggacgagatcatgcccgaggtggtggagaaggaggactacagcgagatcatcggcagcatgggcgaggccctggaggaggagctggacagcatggccaagcacgagagcagagaggacaagatcttccagaagttcaagacccagatcgccctggagcccgagcagatcctgagatacggcagaggcatcgcccccatctggatcagcggcgagaacatcccccaggagaaggacatccccgactgcccctgcggcgccaagagaatcctggagttccaggtgatgccccagctgctgaactacctgaaggccgacagactgggcaagagcatcgactggggcatcctggccgtgttcacctgcgccgagagctgcagcctgggcaccggctacaccgaggagttcgtgtggaagcaggacgtgaccgacaccccctag

SEQ ID NO: 94533 - DNA, 588 bp, Artificial Sequence
  Description of Artificial Sequence: Synthetic coding sequence
atggccgccgccggcgccagacccgtggagctgggcttcgccgagagcgcccccgcctggagactgagaagcgagcagttccccagcaaggtgtacgcccccctgcccggcagacccgacgccttccacagatgcatcttcctgttctgctgcagagagcagccctgctgcgccggcctgagagtgttcagaaaccagctgcccagaaagaacgacttctacagctacgagccccccagcgagaaccccccccccgagaccggcgagagcgtgtgcctgcagctgaagagcggcgcccacctgtgcagagtgtgcggctgcctgggccccaagacctgcagcagatgccacaaggcctactactgcagcaaggagcaccagaccctggactggagactgggccacaagcaggcctgcgcccagcccgaccacctggaccacatcatccccgaccacaacttcctgttccccgagttcgagatcgtgatcgagaccgaggacgagatcatgcccgaggtggtggagaaggaggactacagcgagatcatcggcagcatgggcaagcagttccaggacttcatccactag
